United States Patent 10,858,665 (ISOLATED POLYNUCLEOTIDES, POLYPEPTIDES AND METHODS OF USING SAME FOR INCREASING ABIOTIC STRESS TOLERANCE, BIOMASS AND YIELD OF PLANTS) - sequence listing, part 3

SEQ ID NO: 3591 - DNA, 1439 bp, Quercus alba
tgtaaaaagacgcaccaataaatttgcttcaatattttatgttttaaaaattattttattataataatttcagtaataaatttttaattttcaaccaaataactgtattcgaacagttggccacatgggttggggcacttttatgggaaacgccgccggcttgtgatttgtgaacccacagtttgagattgcaccaagaaacgcacacctttttctgggtaccataaaaacacagctctctctctcttcatctacttgaaaagaaaattcctgatataataacacagtatacagaagatgggtaatctgctttgttttgtacaagttgaccaatccactgtggctatcaaggagaaatttggtaagtttgaggaagttcttgagccaggatgccatttcttgccttggtgccttggaagtcagctttctggtcatctcactcttcggttacagcaattggatgtgcgatgtgagactaagacaaaggacaatgtatttgtcaatgtcgttgcctctattcaataccgtgccctggcagacaaggcaagcgatgccttttacaaactcagcaacacaagaagccaaatccaggcctatgtgtatgatgtaatcagagcaagtgtcccaaagctcaccttggatgaagcctttgtacagaaaaatgacattgccaaagctgtagaagatgaacttgaaaaggctatgtctgcttatgggtatgaaattgttcaaacactcattgttgatatagaacctgatgagcaggtcaagcgagcaatgaatgaaatcaatgcagctgcaagaatgagggtggcagccaatgagaaggcagaggctgagaaaatcttgcaaattaagcgagctgagggtgaggctgagtcgaagtatttgtctgggctgggtattgcccgccaacgtcaagcaattgttgatggattgagagatagtgtgttgggcttctctgttaatgtgccggggaccacgccaaaggatgtcatggacatggttcttgttacccagtattttgacacaatgaaggaaattggtgctgcctcaaaatcctctgctgtgttcatccctcatggacctggtgctgttcgtgatgtagcatctcaaattcgtgatggacttcttcagggttctgttcaacattagggttacttttccattttttcccccgttgtgtattgaaacgaggtctatgtatgttgatgtttctctgcaagtttttcagcgtgttatgtaatctatcttgatgcaactgtcatgtctgtttgtgaattgataattattgtaaataggagactgaaagatgtctcaagtatgtacggatcttcaaacttgaatatgacacagctaaaattgcttctgttaatatttcttcctcaaccagaaattctcatcaaaaaaaaaaaaagttaattaatcggctgatacta

SEQ ID NO: 3592 - DNA, 1250 bp, Capsicum annuum
tgttcaaattagcgaatttaatgtggctatcggacacagcacaaaagaactccatcacattttctactctctatgcatacccccttactatataaactcacccaccctacctagaaaaaccaatttccattcttcactcctttgctagctcttcccctctgctttagtatgggcaatttgttgtgctgtgtacaagttgatcaatccaccgtcgcaattacggagcagtttggcaagtatcaagatgtgctccagccagggtgccactgtttgccttggttcctcgggtaccagttagctggcaatctttccctcagggtgcagcaacttgatgttcgctgtgaaacaaagacaaaggataatgtgtttgtcaatgttgtggcatcaattcagtatcgtgccctggcagagaaagcaaatgatgctttttacaaactaagcaacactaagggtcaaattcaggcttatgtttttgatgtcataagagcaagtgttccaaaactcaatcttgatgatgtttttgagcagaaaaatgaaattgccagggctgtcgaggaggagcttgagaaggctatgtcggcttatggatttgaaattgttcagacacttatagttgatatagaaccagatgagcatgtgaagagagctatgaatgaaattaatgctgctgctcggatgagggtggctgctaacgagaaggcagaggcggaaaagatcttacaaattaaaagggctgaaggagaggcggagtcaaagtatctctcagggttaggtattgcacgacagcgtcaagcaattgtggatggtctaagagacagtgtgctcggattctcagtgaatgtccctggaacctcagcaaaggatgttatggacatggtcctcttgacccagtattttgacaccatgaaagaaattggcgcttccagcaaatcatctgccgtcttccttcctcatgggcctggtgctgtaagagatgtggcaagccagattcgcgatggactccttcaagcttctgtggaccattaaatgttctctccctcagaaatgtcaaatgagtttcactctaatcagccttttcctttttgtgtttactttctgaagtgtggatatgtttggtgagtttggctttatatttgtgaatgccactagtacctatgtatattgtaaaaatgttaagatctcccagacctttgaagaattgtcaagtactattaatagattgatatgatattgtgtacatgttaaaaaaa

SEQ ID NO: 3593 - DNA, 1291 bp, Populus trichocarpa
gaaatagaataacaagaacagacgtcgctcgtcaacagctctgtttcggcttcctttccctttgcttaaagccagagaagatgggtaatctgtgttgttgcgtacaagttgatcagtcttcagtagctataaaggagacatttggaaagtttgaagcagttcttgatcctggatgtcattgccttccttggttccttggaagccagctcgcaggccatctgtctctgaggttgcagcagttggatgtccgatgtgagaccaagacgaaggacaacgtttttgtcaatgttgttgcatctattcaataccgtgccctggcagacaaggcaagtgatgctttctacaaactaaccaacacaaggactcaaatccaggcctatgtttttgatgtaataagggccagtgtcccaaaacttaatctcgatgatgtgtttgagcagaagaatgagatagccaaagctgtggaagatgaacttggaaaggccatgtctgcttatggatatgagattgtgcaaacactcattgttgatatagaaccagatgagcatgtgaagcgggcaatgaatgagatcaatgcagctgcaagactgagattggcggctaatgagaaggcagaggctgagaagattctacaaatcaagagagctgagggtgaggctgaatcaaagtatctctctgggctgggtattgctcgccagcgacaagcaattgtggatggcttgagagatagcgtgttgggcttctctgagaatgtgccagggacctctgcaaaggatgtcatggacatggtcctggtcacccagtacttcgacacaatgaaggaaatcggtgctgcctcaaaatcctctgctgtgtttattcctcatggacctggtgctattcgtgatgttgctactcagattcgagatggacttcttcaggcttcggcccacaagtaattgtgcagattttcaaagcttttacagggtttgtgtttgagaggagctaatgcatgctatatatttctgtaaaggtttcgtatgttgaatcctgggttttggtgatttttgttttgctttcatgtgagagttgcatgaatctgatattctctcaattttggaagtttgtgaatgataattgaatgatgctttatactgtgcaagtggatacagtagaaggcaaacattaaacagtacatataaaaaagtgctgctgtggttaaattagtaatatttttttccccaacgatgattgctagtattcctcattttctacttgcagagtttagctcgctacatgtctctgtcacttc

SEQ ID NO: 3594 - DNA, 1126 bp, Solanum tuberosum
cttgattttgcttcataactcaatatgggcaatttgttctgttgtgttcaagttgatcaatccactgttgcgattaaggagcagtttggcaagtatcaggatgtgcttgagccagggtgccactgtgtaccttggttcctcggaagccagttggctggtcatctctccctcagggtgcagcaactagatgtgcgctgtgaaaccaagacgaaggataatgtatttgtcaatgttgtcgcatcaattcagtatcgtgccattgctgacaaagcaaatgaagctttctacaagctaagtaacactaagggtcagattcaggcatatgtttttgatgtcataagagctagtgttccgaaactcattcttgataatgtctttgagcaaaaaaatgaaattgctaaggctgtggaggaggaacttgagaaagctatgtcagcttatggatatgaaattgttcagacacttatcgttgatatagtaccagatgagcatgtgaagagagctatgaatgaaatcaatgctgctgctcggctgagggtggctgctaatgaaaaggcagaggccgagaagattttgcaaattaagagggctgaaggagaggccgaggctaagtatctctcaggattaggtattgcacgacaacgtcaagcaattgtggatggtctgagagacagtgtgctaggattttcagtcaatgtgcctggaactacggcaaaggatgttatggacatggtcctcgtcacccagtacttcgacaccatgaaagaaattggcgcttccagcaaatcatctgctgtcttcatcccccatgggcctggtgctgtaaaagatgtggcacagcaaattcgtgatggacttcttcaggcttctgttgggcattaaatctttattgctcatgaatgttaaggatttcatatcaaagcaagttttagtctttcttccttcagaatctgaaatatgtggtgaattaactttgttagagatttgtgaattccgatactacgtatgtttataattggtttgctatggttttgaatatttacagaagaattgtgtaaagaattttcaagttcaataagattgttctacagcattgcgtatttttgctaaaaaaaaaaaaaaaaaa

SEQ ID NO: 3595 - DNA, 1169 bp, Solanum phureja
tatatatatatagaggctaaaaccccaaagctgagttgtgaattcttattattctgccgttcttgattttgcttcataactcaatatgggcaatttgttctgttgtgttcaagttgatcaatccactgttgcgattaaggagcagtttggcaagtatcaggatgtgcttgagccagggtgccactgtgtaccttggttcctcggaagccagttggctggtcatctctccctcagggtgcagcaactagatgtgcgctgtgaaaccaagacgaaggataatgtatttgtcaatgttgtcgcatcaattcagtatcgtgccattgctgacaaagcaaatgaagctttctacaagctaagtaacactaagggtcagattcaggcatatgtttttgatgtcataagagctagtgttccgaaactcattcttgataatgtctttgagcaaaaaaatgaaattgctaaggctgtggaggaggaacttgagaaagctatgtcagcttatggatatgaaattgttcagacacttatcgttgatatagtaccagatgagcatgtgaagagagctatgaatgaaatcaatgctgctgctcggctgagggtggctgctaatgaaaaggcagaggccgagaagattttgcaaattaagagggctgaaggagaggccgaggctaagtatctctcaggattaggtattgcacgacaacgtcaagcaattgtggatggtctgagagacagtgtgctaggattttcagtcaatgtgcctggaactacggcaaaggatgttatggacatggtcctcgtcacccagtacttcgacaccatgaaagaaattggcgcttccagcaaatcatctgctgtcttcatcccccatgggcctggtgctgtaaaagatgtggcacagcaaattcgtgatggacttcttcaggcttctgttgggcattaaatctttattgctcatgaatgttaaggatttcatatcaaagcaagttttagtctttcttccttcagaatctgaaatatgtggtgaattaactttgttagagatttgtgaattccgatactacctatgtttataattggtttgctatggttttgaatatttacagaagaattgtgtacagaattttcaagttccataagattgttctacagcattgcgtatttttgct

SEQ ID NO: 3596 - DNA, 1819 bp, Glycine max
gaaagattatcataccaaaaaattgctcaaaaaaattattataccaagaaaatgtatagaaaaattattatcccatccatgtcaattattattagacttttgaagtcgtctttggttgacctgcacttcgtaaatccacttatctgaaattctgaacagtacagttcttgcgttgtttcggaggatcaattgtttgattaagcaaaaaacttaatagtaggttgtatctgcatgacaactacgactttggattgtaaatgatatctccttcaagagattgtgattggcttgtcatgccggttagcttgcaattctgggtttctgacagacaatatataaattgtatttatgtatgactacgactatggaatatatcaagaataccgagtatttgtctaccctcagtattcgagagctacttgcttataatttatgcaagagctctcccaagtcagctttgctttcgaagcatttattgtcattctgatcctcactgtattttgcttctaggttgtaactttttaaaagcaaatggggaatcttttttgttgtgtgcaagttgatcaatcaacagtggctataagagaaggatttggacgatttgagaaggtacttcagccaggatgccattgcatgccatggttccttggaaaacaacttgctggtcatctctctcttcggctacagcaactggatcttcgatgtgagaccaaaacaaaggataatgtctttgtcaacgttgttgcttctattcaatatcgtgccctggcagagaaggccaatgatgctttttacaaattgagcaatacaaagacccaaattcaagcctatgtttttgatgtaattagggcaagtgttccaaaactaaacttagatgatgcttttgagcagaaaaatgaaattgccaaagctgtggaagaagaacttgagaaggctatgtcagcttatgggtatgaaattgttcaaacactgattgttgatatagatccagatgagcatgtgaagcgggccatgaatgaaatcaatgctgctgcaagattgaggatggcagctaatgagaaggcagaggcagaaaagatcttgctaattaaacgagccgagggtgaggctgagtctaagtatctctctggactgggtattgctcgccaacgccaagcaattgtggatggcttgagagatagtgtgcttggattctcagttaatgtacctgggacaactgcaaaagatgtcatggacatggtccttgtcactcagtattttgacactatgaaagaaattggtgctgcctctaagtcttctgctgtgttcattccacatggacctggtgctgttcgtgatgtagctggtcaaattcgggagggacttcttcaggcttctcatcagtagcctctactccacctagatcttgtgtttggtttgaattggagtatggtgaagttatagcacctgtgtctacctgtatttctgttctgtgcagtgtgttttgtgattttgttttagaataaactgcaaaattgatcctccaaagattatggcatcatctcattaatcttcaaaagattttttctatcaaatcagtcccacaaatatctaaaatgttaccaatttttttcttagaggactaaagaagtggtaacacaagaatttagtatttgatttgtatctttgtgggattgatttgttgaccaaaatctttgaaggaccagttcaaggacttactctttcgatttatactttcaagcagtcaagtaatactgtatattctgttgtctatattgtgaatcatgcataactaaactattaagtatccctgtatata

SEQ ID NO: 3597 - DNA, 2132 bp, Glycine max
tagaaagattatcataccaaaaaattgctcaaaaaaattattataccaagaaaatgtatagaaaaattattatcccatccatgtcaattattattagacttttgaagtcgtctttggttgacctgcacttcgtaaatccacttatctgaaattctgaacagtacagttcttgcgttgtttcggaggatcaattgtttgattaagcaaaaaacttaatagtaggtaattaattcattcatagttttcttacaactgtaattcaatttcagccctttaactttcgtagttgatatctggagggattgcttccaaactcggcatagtccgtgtctaatggctgttagagtttacccaattggttaattatttatatatttttatgtttggacttgtctttgtgttctcttgttccacacataaattaaacaaaggtactattatatacttttctaggttgtatctgcatgacaactacgactttggattgtaaatgatatctccttcaagagattgtgattggcttgtcatgccggttagcttgcaattctgggtttctgacagacaatatataaattgtatttatgtatgactacgactatggaatatatcaagaataccgagtatttgtctaccctcagtattcgagagctacttgcttataatttatgcaagagctctcccaagtcagctttgctttcgaagcatttattgtcattctgatcctcactgtattttgcttctaggttgtaactttttaaaagcaaatggggaatcttttttgttgtgtgcaagttgatcaatcaacagtggctataagagaaggatttggacgatttgagaaggtacttcagccaggatgccattgcatgccatggttccttggaaaacaacttgctggtcatctctctcttcggctacagcaactggatcttcgatgtgagaccaaaacaaaggataatgtctttgtcaacgttgttgcttctattcaatatcgtgccctggcagagaaggccaatgatgctttttacaaattgagcaatacaaagacccaaattcaagcctatgtttttgatgtaattagggcaagtgttccaaaactaaacttagatgatgcttttgagcagaaaaatgaaattgccaaagctgtggaagaagaacttgagaaggctatgtcagcttatgggtatgaaattgttcaaacactgattgttgatatagatccagatgagcatgtgaagcgggccatgaatgaaatcaatgctgctgcaagattgaggatggcagctaatgagaaggcagaggcagaaaagatcttgctaattaaacgagccgagggtgaggctgagtctaagtatctctctggactgggtattgctcgccaacgccaagcaattgtggatggcttgagagatagtgtgcttggattctcagttaatgtacctgggacaactgcaaaagatgtcatggacatggtccttgtcactcagtattttgacactatgaaagaaattggtgctgcctctaagtcttctgctgtgttcattccacatggacctggtgctgttcgtgatgtagctggtcaaattcgggagggacttcttcaggcttctcatcagtagcctctactccacctagatcttgtgtttggtttgaattggagtatggtgaagttatagcacctgtgtctacctgtatttctgttctgtgcagtgtgttttgtgattttgttttagaataaactgcaaaattgatcctccaaagattatggcatcatctcattaatcttcaaaagattttttctatcaaatcagtcccacaaatatctaaaatgttaccaatttttttcttagaggactaaagaagtggtaacacaagaatttagtatttgatttgtatctttgtgggattgatttgttgaccaaaatctttgaaggaccagttcaaggacttactctttcgatttatactttcaagcagtcaagtaatactgtatattctgttgtctatattgtgaatcatgcataactaaactattaagtatccctgtatatatatgttgactaaattgtgaaagttgcataaacaagaaatttcctatataccgttagagagtagataactatatactgtta

SEQ ID NO: 3598 - DNA, 1165 bp, Helianthus annuus
gcggggagtttatctttagtttgaaattgtaattttatattctttcttctccgttatcttatcattgactccgcccgcgtgttggtctggttcgttccaatcggataaaagaaggcctaggttttggtttaggtttggatcatgggaaacctattttgtttgtatcaagtagaccaatcgacagttgctattaaggaatcgtttgggaagtttgatgatgttttggagcctggatgtcactgtgttccatggatatttggtaaacagcttgctggtcagctgactctcagagttcagcagttggatgtcaagtgcgagactaaaacaaaggataatgtgttcgtcaatgttgtcgcttccatacaataccgggctctcgctgataaagcaagcgatgctttctataagctcagcaacaccaggtcccaaatccaagcctatgtgtttgatgtcataagagcttttgttccaaagctgaatctcgatgacacttttgagcaaaagaatgaaattgcaaaagccgttgaagaagaacttgaaaaggcgatgtctgcatacggatacgagatagttcagacattgatcgttgatatagaacccgatgagcatgttaagagggcaatgaatgagatcaatgctgctgcaaggttgcggatggcagctactgagaaggcggaagctgagaaaattctgcaaatcaagagagcggagggggaagcggagtccaaatacctatcgggtttgggtatagcccgtcagcgccaagccattgtggatggtttgagagacagcgtgttgggattctcggtgaatgttcctggaaccactgcaaaagatgtgatggacatggttctagtgacccagtattttgacacaatgaaggaaatcggtgcgtcttccaagtcgtcggccatatttcttcctcatggaccgggtgcagttcgtgatgtcgcctcccagatacgtgatggacttcttcaaggttcttctgccacttgaagtaattgtgttttacttccttcctttttggatgtaataagtgtaaaatcgtttaaaacttgaatattatgtgattgtaagttggaaaggatggtggttttatatataaataatagttttgatttgatttgatttgattgtatctatgactggtcacatagttttg

SEQ ID NO: 3599 - DNA, 1001 bp, Helianthus annuus
taggttttggatcatgggaaacctattttgtttgtatcaagtagaccaatcgacagttgctattaaggagtcgtttgggaagtttgatgatgttttggagcctggatgtcactgtgttccatggatatttggtaaacagcttgctggtcagctgactctcagagttcagcagctggatgtcaagtgcgagactaaaacaaaggataatgtgttcgtcaatgttgtggcttccatacaataccgggctctcgctgataaagcaagcgatgctttctataagctcagcaacaccaggtcccaaatccaagcctatgtgtttgatgtcataagagcttttgttccaaagctgaatctcgatgacacttttgagcaaaagaatgaaatcgcaaaagccgttgaagaagaacttgaaaaggcgatgtctgcatacggatacgagatagttcagacattgatcgttgatatagaacccgatgagcatgttaagagggcaatgaatgagatcaatgctgctgcaaggatgcggatggcagctactgagaaggcggaagctgagaaaattctgcaaatcaagagagccgagggggaagcggagtccaaatacctatcgggtttgggtatagcccgtcagcgccaagccattgtggacggtttgagagacagcgtgttgggattctcggtgaatgttcctggaaccactgcaaaagatgtgatggacatggttctagtgacccagtattttgacacaatgaaggaaatcggtgcgtcttccaagtcgtcggctgtatttcttcctcatggaccgggtgcagttcgtgatgtcgcctcccagatacgtgatggacttcttcaaggttcttctgccacttgaagtaattgtgttttacttccttcctttttggatgtaataagtgtaaaatcgtttaaaacttgaatattatgtgattgtaagttgaaaggatggtgggtgtatatataaataatagttttgatttgattcg

SEQ ID NO: 3600 - DNA, 1331 bp, Solanum lycopersicum
gaatttccacgcattttctggcccagttgggatcttctttcgcatatatatatatatatatatataatatatgtacaggctataacctcaaagctgagttgtgaattcttattattctgccgttcttgattttgtttcataattcaatatgggcaatttgttctgttgtgttcaagttgatcaatccactgttgcaattaaggagcagtttggcaagtatcaggatgtgcttgagccagggtgccactgtgtgccttggttcctcggaagccagttggctggtcatctctccctcagggtgcaacaactagatgtgcgctgtgaaaccaagacgaaggataacgtatttgtcaatgttgtcgcatcaattcagtatcgtgccattgccgacaaagcaaatgaagctttctacaagctaagtaacactaagggtcagattcaggcatatgtttttgatgtcataagagctagtgttcctaaactcattcttgatgatgtctttgagcaaaaaaatgaaattgccaaggctgttgaggaggaacttgagaaagctatgtcagcttatggatatgaaattgttcagacacttatcgttgatatagtaccagatgagcatgtgaagagagctatgaatgaaatcaatgctgctgctcggctgagggtggctgctaatgagaaggcagaggccgagaagatcttgcaaattaagagggctgaaggagaggccgagtctaagtatctctcaggattaggtattgcacgacaacgtcaagcaattgtggatggtctgagagacagtgtgctaggattttcagtcaatgtgcctggaactacggcaaaggatgttatggacatggtcctcgtaacccagtactttgacaccatgaaagaaattggcgcttccagcaaatcatccgctgtcttcatcccccatggacctggtgctgtaaaagaggtggcacagcagattcgtgatggacttcttcaggctactgttgggcattaaatctttgttgctcatgaatgttaatggatttcatatcaaagcaagtttttgtcaagttagtcttttctttcttaagaacatggaaatatgtggtgaagggattttgttagagattgtgaatcctatgactacctatgtttataaccagtttggtaaggttttgaatgtttaaagtattgtgtaaaaagtattttcaggttctataagattgttctacagcattgtacatctttgcctattcaacctaaagcttcgtgcatatattccttattgatttgttttgctgattggaaatgttaattcaatgttagttgctagtccctca

SEQ ID NO: 3601 - DNA, 1318 bp, Solanum lycopersicum
atgagatggcgatgggaacgagtagccaatccaattaatttgatatttacgaagtatcttctcctaataatattcgactccattacaatttccacatactttcttcttcatcaagtctctttcctccatagacttatccccaaatatataaactcacccatcttaactatcgaaatacccatttcgattcttcactccttcgctagctttgttgcttcgagtatgggcaatctattgggctgtgtacaagttgatcaatccaccgtcgcaattacagagcagtttggcaagtatcaagatgtgcttcagccaggttgtcactgtctgccttggtgcttcggattccagttagctggccatctctccctcagggtgcaacaattggatgttcgctgcgagacaaagacaaaggataatgtgtttgtcaatgttgtggcatcaattcagtaccgtgccctggcagacaaagcaaatgatgctttctacaaactaagcaacactaagggtcaaattcaggcctatgtttttgatgtcattagagcaagtgttccaaaactcaatcttgatgatgttttcgagcagaaaaatgaaattgccaaggctgtcgaggatgaacttgagaaggctatgtcggcttatggatatgaaattgttcaaacacttatagttgatatagaaccagatgagaatgttaagagagctatgaatgaaatcaatgctgctgctcggctgagggtggctgctaatgagaaagcagaggcggagaagattttgcaaattaaaagggctgaaggagaggcagaatcaaagtatctttcagggttaggtattgcacgacagcgtcaagcgattgtggatggtttgagagacagcgtgcttggattctcagtgaatgtgcctggaacctcagcaaaggatgtaatggacatggtccttttaacccagtactttgacaccatgaaagaaattggcgcttccagtaaatcatctgctgtcttccttcctcatgggcctggtgctgtaagagatgtggcaagccagattcgcgatggactccttcaagcttctgtggaccattaaatgtttctactttatcagaattgttacttgtgtttcacttgaagcagcctgtttcattttgtgtttactttctgttagtgtggatatgtttggcgagtttgacttcgtatttgtgaatgcctctagtatctgtatattgtaaagaatttaatatctccagacctttgaagaattatatactattaatagattgatgtaatatttctcctcgttaattgtacctgtttatttgttcctt

SEQ ID NO: 3602 - DNA, 1275 bp, Cicer arietinum
catatctttaatttgagttaaacaatggggaatctttttgttgtgtgcaagttgaccaatctacagtggctatgaaagaaggatttggacgatttgaagaagtgcttcagccgggatgccattgcatgccatgggttcttggaaacgaattgccggccatctctctcttcggcttcaacaattggatattcgatgtgagaccaagacaaaggataatgtctttgtaaacgttgttgcttcgattcagtatcgtgccttggtaaacaaggcaaatgatgcattttacaaacttagcaacacaagaagccaaattcaagcttatgtttttgatgtaattaggggaactgttccaaaactcaacttggatgatgcttttgagcagaaaatgaaattgcaaaagctgtggaagatgaacttgagaaggctatgtcggcttatggatatgaaattgttcaaacactgattgttgatatagagccagatgagcatgtgaagcgcgctatgaatgaaatcaatgctgctgcaagattgaggatggcagctaaagacaaggcggaggcagagaagatcttgcaaattaagcgagccgagggtgaggctgagtctaaatatctctctgggctgggtattgctcgccaacgtcaagccattgtggatggtttgagagatagcgtgcttggattttcagttaatgtaccggggacgactgcgaaagatgttatggatatggtccttgtcactcaatactttgatactatgaaagaaattggtgctgcctccaaggcttctgctgtgttcattccacatggacctggtgctgttcgcgatgtagctagccaaattcgtgatggacttctccagggttcttatcattagcttctatttctcctacatggtatctgatttgtatggaagtgtggttattttataatgcttaggttgtatctctgcagtatatatgtgatatgattttatatcagagtaagcttctgctgtgatcaaccaaatgttatggcatcactatatcagtcttgcaaagatatttttgtcattaagttaatccttcaatgatttaaaaccgtgtcacatttactcttaaggaaaatggtgacacaataccaatttgctaattgttttgtatctttgtgggattgatttggtgatgaaacctttggaggatgatttaaaggaattactcttgttttatactttttgtttgtaattctcattatatatatattaattttctacattataatgtatgcataactagac

SEQ ID NO: 3603 - DNA, 1064 bp, Euphorbia peplus
gtttcattcatgtcatagctaacctaagagtaagaaaaagggttactcattcttatagagaagatgggaaatctgctttgttgcgtccaagttgaccaatccacagtcgctgttcgggagcaatttggcaaatttgatcaaattcttgagcccggatgccattgcctaccttggtttcttggaagtcagattgccggttatctttccctcaggttgcagcagttggatgtccgttgcgagaccaaaactaaggataatgtatttgtcaatgttgttgcgtctattcaataccgtgcacttgctgataaagcaaatgaagctttctacaaactcaccaataccaggactcaaatccaggcctatgtttttgatgtaatcagggcgactgttccaaagcttaatttggatgatgcttttgagcagaagaatgaaattgcaagagctgtggaagaggaacttgaaaaggctatgtctgcttatggatatgagattgtgcaaactctcattgttgatatagagccagatgaacatgtaaagcgagcaatgaatgatataaatgcagcggtaagaatgaggatggcagctaatgaaaaggcagaggcagagaagattctacaaataaagagagcggaaggggaggcagaagccaagtatcttgctgggctgggtattgctcgtcagcgtcaggcaattgtggatggattaagagatagtgtgctgggattttctgaaaatgtgccagggaccactccaaaagatataatggacatggtcttggttactcagtactttgatactatgaaggaaattggggcttcttccaaatcttctactgtgttcattccccatggacctggagccattcgggatgttgctactcagattcgtgatggtcttcttcaggccactccccatcaccatttgtgatcttccgttgctttccagtcgtgtgttgtgctcacatttgcttctcttacctatatgcttgctttgtgattaatagcgtgttttttcttgtttaataacatctttataattggtaagactctgtataacactaacat

SEQ ID NO: 3604 - DNA, 1051 bp, Guizotia abyssinica
gacagaatcaaacatcaataaattgggtgttgtttgtttccttcatcgtcatcgtagatcatgggaaacctgtgctgtttgtatcaagtggatcaatcaacagttgttatcacagaatcatttgggaagtttgatgatgttttggagcctggatgccactgtgttccatggatatttggtaaacagattgctggtcaacttactctcagagttcagcagttggatatcaagtgtgagactaaaacaaaggataatgtgtttgtgaatgttgtggcttccatacaataccgtgcacttgctgaaaaagcaaacgatgctttttataagctcagcaacacaaaaacccaaatccaggcctatgtctttgatgttataagagcttttgtcccgaagctgaatctagatgatacttttgagcaaaagaacgaaattgcaaaggccgttgaacaagaacttgaaaaggctatgtctgcatacgggtttgagatagttcagacgttgatcgttgatatagaaccagatgagcatgtaaagcgggcaatgaatgagatcaatgctgctgcaaggttgaggatggcggctactgagaaagcggaagctgagaaaattctacaaatcaagagagcggagggggaagcagagtccaatacctgtcgggtttgggtgtggcccgacagaggcaggccattgtggacggtttgagagacagcgtgttgggattctcagtgaatgtgcctggaaccactgcaaaagatgttatggacatggttctagtgactcagtattttgacaccatgaaggaaataggtgcggcttccaagtcctcggccgtgttcatccctcacgggcctggtgctgttcgtgatgtagccacgcagatacgcgatggacttcttcaaggttctgctaccacttgatttgcatcttacatggacaggattttgacacactattgtattgttttaaatcatcatcatcatctatctgtttaaaatatcaaacaattattatgtgattgttgttggaaataagtattttgccaaatttcgga

SEQ ID NO: 3605 - DNA, 1072 bp, Platanus occidentalis
tagagagcatgggtaatcttttttgcttggtacaagtcgaccaatccactgtggctatcaaggagaaatttggaaagtttgatgatgtacttgagccgggatgccattgtttgccttggttccttgggagtcagctggcaggacatctctcacttatgttgcaacaattggatgtgaagtgtgagaccaagacaaaggacaacgtatttgtcaatgttgttgcatctatacaatacagagccctcgctgataaggcaagcgatgcattctataagctaagcaatacaagaacccaaatccaggcctatgttttcgacgtgataagagcaagtgttccaaagctcaatctggatgatgtttttgagcagaagaatgatattgcaagagctgtggaaaatgaacttgaaaaggctatgtctgcctatgggtatgagattgtacagacactaattgtagacatagagcctgatgagcatgtgaagcgggcaatgaatgaaatcaatgccgctgcaaggatgaggttggctgctaatgagaaggcggaggctgagaaaattctacaaattaaaagggctgagggtgaggccgagtctaagtatctgtcagggctgggtattgcccgccagcgtcaggctatagtagatggtctgagagacagtgttatgggtttcgcagttaacgtgccagggaccactgctaaggatgttatggacatggttcttgttacacagtatttcgataccatgaaagagattggtgcttccgctaaatcgtctgctgttttcatcccccatggacctggtgctgttcgtgatgttgcctcccagattcgagagggactgctccaggcatcctcctcccatcagtgataaggattttctcaaggttttcctggtttatgtttaaactggcagaactagttaatttgttttcgttttatggagcagtgccagttagtctcctgttgttgatacaagcgtttgatgaagtactcagttaacacagtagattgtgatattggataaataactgtgtttttgttctttctcaattgttcccatatattttataa

SEQ ID NO: 3606 - DNA, 1438 bp, Aquilegia formosa
catctcaccacaaagtctacctgatatgaaactatagtacttgatcagctctttttagtaaacttcaatcaaacggtccagatcaattcagagcttttagtaatggtaccacacactgactgaagactagcaattgatgattgagaaaatagtatcatcattcgccggtacaggagtcaggagtcaggagcagagtttcgtagaaagacgcaactcataaattatataatccagtagtagagcttgagagaaacacaccaaactccaaactgctaagaaaacttgtgttcaaaggaagaaggatttcaagacaagaaggcatgggtaacttcagttgttgtgttcaagtggaccaatccacagtagctgtcaaggagagatttgggaaatttcaagaggtaatggaaccaggatgccactgccttccttggtattgtggttctcgagttgctggtcatttgtcacttcgtttgcaacagcttgatgtgaagtgtgagacgaagacaaaggacaacgtgtttgttaatgtcgttgcatctatacaatatcgtgccttggccgataaagcaagtgatgcattttataagctgagcaatacaaggaatcaaattcaagcttatgtgtttgacgtgattagagcaagtgttccaaagcttaatcttgatgacacttttgagcagaaaaatgaaattgcaaaagctgtggaagaagaacttgaaaaggctatgtctgcctatggatatgagattgtacagaccctcattgttgatattgaaccagatgagcgcgtgaagcgagcaatgaatgaaattaatgctgctgctagaatgagagtggcagccaacgagaaggcagaggcagagaaaattttacaaattaagcgagctgagggggaagctgagtccaagtatctgtctggcttaggtgttgctcgccaacgtcaagcaatcgttgatggcctaagagacagtgtccttggtttctcagtgaatgtgccagggaccaccgcaaaagacgtcatggacatggtgcttgttacgcaatactttgacacaatgaaggagattggtgctgcctctaagtcgtctgctgtattcatccctcatggacctggtgctgttcgtgatgttgccacccagatcagagatggattacttcaggcatcatcctctacacagtgaattaccctttaagaagtttctagtgtcagacacaagtgttcccgtgtgtgtttgtttcagagtatatgtttagtgcttctcattttatctaggttcagttgttgatatccgtatgcttttacaaactttggttgctgtaggtatctggacatactatggagtatggatataaagaaaaaaatcagacttattgattggttgtttcgttaaattttgtgtagaccaacatgaaatctatcaaaagtgtagaggtgctc

SEQ ID NO: 3607 - DNA, 1376 bp, Musa acuminata
gtgaaggataatgttgccaacagcggcatccacttggcaataattgctattgtctgcttctttagatatcttattctgtgtgttgggagatagatagcatacctctcatcatcttctggcatctcgatttgatcttgtgtcatatttatctcgtatttccaggcgataaacgatgggtcaagcactttgctgtgtgacagtagatcaatcttctgtcgcaattaaggaatcattcggaaagtttgaggatgttcttctgccaggatgccattgtatgccttggttccttgggaaaaaagtttctgggcggctctcactaaggttgcaacagctggatgttaaatgtgaaacaaaaacaaaggataatgtttttgtgaatgttgtcgcatctgtacagtaccatgctctggctgagaaagcaagtgatgcattttacaagctgagcaacacaagatctcaaatacaagcctatgtgtttgacgtaatcagagcgagcgtcccaaaactgaacctggatgatgcttttgagcagaagaatgacattgcaaaggcagtggaaaacgaacttgagaaggctatgtcagcttatggttatgaaatcgtgcagacactcattgttgatattgaaccagacgtacatgtcaaacgagcaatgaatgaaatcaatgcagctgcaaggttaagggtggcagcgaatgagaaggctgaggctgagaagatcatccaaatcaagcgggcagagggcgaggcagaagccaagtatctgtcaggtctaggtattgcccgtcaacgccaagccatcgtagatggcctgagggacagtgtgctcggcttctcggtcaacgtaccaggcaccacagcaaaggatgtgatggacatggtcctaatcacacaatacttcgacaccatgaaggagatcggtgcacagtccaaatcttcggctgttttcatacctcatgggcctggctctgtccgtgatgttgcagaccagatccgtgatggactgcttcaagcatccactcacaactgaattcctcgtatataggtgccgtatggttctatcatcagttactagattgcatgtttgatgtgtgatactatggcctatgcttttctgtactttcgattgtgatgtcgagggaccagagactcgctagaaatggcattatgatacataatacatgtgtggctgtggaaatcgagatgtgcttcctgcatttgttgttcaaatgactggtatcactgattaagtcaacaggtgacgtgcagaagaataagctattgccataaacctctaggctttcttcttccaactgaagggcttcggtcatctacattggaacaaaaggcaccacggagcttatcaactcaccgag

SEQ ID NO: 3608 - DNA, 1019 bp, Capsicum annuum
atgggcaatttgttctgctgtgtgcaagttgatcaatcaacggttgcgattaaggagcaatttggcaagtatcgggatgtgcttgagccagggtgccactgtgtaccttggttccttggaagccagttggctggtcatctctccctcagggtgcagcaactagatgtgcgctgtgaaaccaaaactaaggataacgtctttgtcaatgttgttgcatcaattcagtatcgtgccctggcagacaaagctaatgaagcattctacaagctaagtaacactaagggtcagattcaggcatatgtttttgatgtcataagagcgagtgttccaaaactcaatcttgatgatgtatttgagcaaaaaaatgaaattgctaagtctgttgaggaggaacttgagaaagctatgtctgcttatggatatgaaattgttcagacccttatagttgatatagtaccagatgagcatgtaaagagagctatgaatgaaatcaatgctgctgctcgtctgagggtggctgctaatgagaaggcagaggctgagaagattttgcaaattaagagggctgaaggggaggctgagtctaagtatctctcgggattaggtattgcgcgacaacgtcaagccattgtggatggtctgagagacagtgtgctaggattttcagtcaatgttcctggaactacagcaaaggatgttatggacatggtcctggtaacccagtacttcgacaccatgaaagaaattggcgctgccagcaaatcatctgctgtcttcatcccccacgggcctggtgccgtaaaaaatgtggcacagcagattcgtgatggacttcttcaggcttctgttgggcattaagtacttattgctcatcaatgttaatgggtttcatatcaaagcaaactgttaaaagttttagtcttttctttcttaagtatatggcggtgagttgactttgttagatatttgtgaatcccagtgctacctatgtttataaatggtttggtaaggttttgaat

SEQ ID NO: 3609 - DNA, 938 bp, Ambrosia trifida
ggggaacctgttttgtttgtaccaagttgatcagtcgacggttgctattaaggaatcgtttgggaagtttgatgatgtgttggagccagggtgtcactgtgttccatggatatttggtaaacagcttgctggtcagcttactcttagagttcagcagttggatgtcaagtgcgagactaaaactaaggataatgtgtttgtcaatgttgtggcttcaatacaataccgcgctctggctgataaagcaagtgatgctttctataaactcagcaacacaaggtcccaaatccaagcctatgtgtttgatgttataagagcttttgtgccaaagctgaatcttgatgatacatttgagcaaaagaatgaaatagcgaaagctgttgaagaagaactcgaaaaggctatgtctgcttacgggtatgagatagttcagacattgatcgttgatatcgaaccagatgagcatgtaaagagggcaatgaatgagatcaatgctgctgcacggttgaggatggcggctactgagaaagccgaagctgagaaaatcctgcaaatcaagagagccgagggggaggcagagtccaaatacctatcaggattgggtatagcccggcagcgtcaagcaattgttgacggtttgagagacagcgtgctgggattcgcagtgaatgttcctggaaccactgcaaaagatgtgatggacatggttctggtgactcagtacttcgacacaatgaaggaaatcggtgcgtcttcgaagtcgtcagctgtgtttctccctcatggaccgggtgcggttcgtgatgtagcctcccagatacgtgatggacttcttcagggttctgctgccagttgattgtccctggagtttggagtgaaatttgcaagtatatgacttatttgtgttttgctttgattttcgtagagatgattttttt

SEQ ID NO: 3610 - DNA, 1437 bp, Aquilegia formosa
catctcaccacaaagtctacctgatatgaaactatagtacttgatcagctctttttagtaaacttcaatcaaacggtcagatcaattcagagcttttagtaatggtaccacccactgactgaagactagcaattgatgattgagaaaatagtatcatcattcgccggtacaggagtcaggagtcaggagcagagtttcgtagaaagacgcaactcataaattatataatccagtagtagagcttgagagaaacacaccaaactccaaactgctaagaaaacttgtgttcaaaggaagaaggatttcaagacaagaaggcatgggtaacttcagttgttgtgttcaagtggaccaatccacagtagctgtcaaggagagatttggaaaatttcaagaggtaatggaaccaggatgccactgccttccttggtattgtggttctcgagttgctggtcatttgtcacttcgtttgcaacagcttgatgtgaagtgtgagacgaagacaaaggacaacgtgtttgttaatgtcgttgcatctatacaatatcgtgccttggccgataaagcaagtgatgcattttataagctgagcaatacaaggaatcaaattcaagcttatgtgtttgacgtgattagagcaagtgttccaaagcttaatcttgatgacacttttgagcagaaaaatgaaattgcaaaagctgtggaagaagaacttgaaaaggctatgtctgcctatggatatgagattgtacagaccctcattgttgatattgaaccagatgagcgcgtgaagcgagcaatgaatgaaattaatgctgctgctagaatgagagtggcagccaacgagaaggcagaggcagagaaaattttacaaattaagcgagctgagggggaagctgagtccaagtatctgtctggcttaggtgttgctcgccaacgtcaagcaatcgttgatggcctaagagacagtgtccttggtttctcagtgaatgtgccagggaccaccgcaaaagacgtcatggacatggtgcttgttacgcaatactttgacacaatgaaggagattggtgctgcctctaagtcttctgctgtattcatccctcatggacctggtgctgttcgtgatgttgccacccagatcagagatggattacttcaggcatcatcctctacacagtgaattaccctttaagaagtttctagtgtcagacacaagtgttcgcgtgtgtgtttgtttcagagtatatgtttagtgcttctcattttatctaggttcagttgttgatatccgtatgcttttacaaactttggttgctgtaggtatctggacatactatggagtatggatataaagaaaaaaatcagacttattgattggttgtttctttaaattttgtgtagaccaacatgaaatctatcaaaagtgtagaggtgctc

SEQ ID NO: 3611 - DNA, 1033 bp, Cirsium arvense
ggatctctctcttagtctttgtttccatctattcacctcctataaacttttcaaaatctgggtcttcttcttcaagcttccacatcttcttctggaattttgttgaattggttgtaagatcatggggaatttattttgtctggttcaagtggaccaatccactgttgcaatcaaggaaacttttgggaaatttgctgatgttttagagcctggatgtcattgtgtcccttggatatttggaagtcagcttgctggttatcttactctaagagttcagcagttggatgttaaatgcgagacgaaaacgaaggataatgtgtttgtaaatgttgtggcttccatacaatatcgtgctctggctgataaggcaagcgatgccttctataaactcaccaacacgaggtcccaaatccaagcctatgttttcgatgttataagggcttttgttccaaagctcaatcttgatgatgcttttgagcaaaagaatcaaatagccaaggctgttgaagaagaacttgaaaaggctatgtctgcatatggatatgagatagttcagacattgattgttgatatagaaccagatgagcatgtgaagagagcaatgaatgagatcaatgctgctgcaaggatgaggatggcagccactgaaaaagccgaagccgagaaaatcctccaaatcaagagagccgagggggaggccgaggccaaatacttgtcgggattgggcattgcacgccagcggcaagccattgtcgacggtttaagagacagcgtgttagggtttgcggttaacgttcctggaaccactgcaaaagacgttatggacatggtgctagtgactcagtatttcgacaccatgaaggagatcggtgcatcctctaaatcctcagccgtgttcatccctcacggacccggtgcggttcgtgatgtcgctagtcagatacgcgatggacttcttcagggttcgcttgctaactgatttacaatttcgtccccccttgagttatgagtgaaacacgtttttgtacgtata

SEQ ID NO: 3612 - DNA, 928 bp, Cirsium arvense
ccgtataagatcatgggaaacctatgttgtttagttcaagtagatcaatccacagttgctatcaaggaagcttttgggaagtttgatgatgttctcgaacctggttgtcattgtgtcccttggatcttcggacgtcagcttgctgggcatctcacgctaaggattcagcagttagacgtgaagtgcgagaccaaaacgaaggataacgtctttgtgaacgtcgtggcttcgatacaatatcgtgctctggctgaaaaggcgagtgatgcgttctataaactcagcaacacgaggtcccaaatccaagcctatgtttttgatgttatacgagctagtgtcccaaagcttaatctagatgatgtttttgagcaaaagaatgatattgcaaaggctgttgaagaagaactagcaaaggcaatgtctgcttatggttacgagattgttcagacattgattgttgatatagaaccagatgagcgtgtgaagaaagccatgaatgagatcaatgcagctgcaaggatgaggttggcggctactgaaaaggccgaggccgacaaaattctccaaatcaagagagccgagggcgaggccgagtcgaagtacctgtcgggtttgggtatcgcacgccaacgccaagccatcgtggacggtttgagagacagcgtgttggggttctcggtcaacgtgcccggaaccacggctaaagacgtgatggacatggttctggtcactcagtatttcgacaccatgaaggaaatcggtgcttcttctaaatcctcggctgtcttcatcccgcatggacctggtgcagttcgtgatgtggctactcagatacgcgatgggcttcttcagggcaactcggccagctgatcgttaacttcgtctcgcttacgtttaaactttggagtgaaatgcaaatatggttttt

SEQ ID NO: 3613 - DNA, 1117 bp, Actinidia deliciosa
gtgttgttgtcttgtagaaattgtgcggatgtttccaaagatggacttgtggacctatatagactcgattacctctgattcgccaccaccattgagcctctgttttacatattcttgaattgattatagaattagaacatgggtaatctcttttgctgtgtaaaagtcgatcaatcaaaagttgcgatcaaggagaggttcgggaagtttgagaaagttcttgatccaggatgccactgcctcccttggttcctcggaagtcagctggccggtcatctctccctccgggtgcaacagttggatgttcgttgtgagaccaagacaaaggacaatgtatttgtcaatgttgtagcatctgtgcagtaccgtgcccttgctgacaaggcgaatgacgctttctacaagctcagcaacactcgaggccaaatccaggcctatgttttcgatgtaattagggcaagtgttccgaagctcaatttggatgatgtgtttgagcagaaaaacgaaatagccagggctgtcgaagatgaacttgagaaggcaatgtctgcttatggatatgagattgtacagacactgattgtggatatagaaccggacgagcaagtaaaacgggcaatgaatgaaataaatgcagcttcaaggctgagggtggcagctaatgagaaggcggaggcagagaaaattttacaaatcaagcgagctgaaggtgagtccgagtcaaagtacttgtcagggttgggtatcgctcgccaacgtcaagcaatcgtggatggtttgagagatagcgtgctgggcttctctgtcaacgtgccgggaactactgcaaaggatgttatggacatggtccttgttacccagtactttgacacgatgaaggaaattggcgctgcctccaaatcctctgccgttttcataccccatggacccggtgctgtgcgtgacgtggctactcagatccgtgatggacttcttcaagctgctgaacattgattttgtcagtctcaaggctgagggtggcagctaatgagaaggcggaggcagagaaaattttacaaatcaagcgagctgaaggtgagtccgagtcaaagtacttgtcaaggttgggtatcgctcg

SEQ ID NO: 3614 - DNA, 1086 bp, Quercus alba
tagtatcagcattcccgggatccacatatcagttaactgatgggttggggcacttttatgggaaaagccgccggcttgtgatttgtgaacccagagtttgagattacttgaaaagaaaattcctggtaagaattttatctatggtaccataaaaacacagctttctctctcttcatctacttgaaaagaaaattcctgatataataacacagtatacagaagatgggtaatctgctttgttttgtacaagttgaccaatccactgtggctatcaaggagaaatttggtaagtttgaggaagttcttgagccaggatgccatttcttgccttggtgccttggaagtcagctttctggtcatctcactcttcggttacagcaattggatgtgcgatgtgagactaagacaaaggacaatgtatttgtcaatgtcgttgcctctattcaataccgtgccctggcagacaaggcaagcgatgccttttacaaactcagcaacacaagaagccaaatccaggcctatgtgtttgatgtaatcagagcaagtgtcccaaagctcaccttggatgatgcctttgaacagaaaaatgacattgccaaagctgtagaagatgaacttgaaaaggccatgtctgcttatgggtatgaaattgttcaaacactcattgttgatatagaacccaatgttcaggtcaagcaagcaatgaatgaaatcaatgcagctgcaagaatgagggtggcagccaatgagaaggcagaggctgagaaaatcttgcaaattaagcgagctgagggtgaggctgagtcgaagtatttgtctgggctgggtattgcccgccaacgtcaagcaattgttgatggattgagagatagtgtgttgggcttctctgttaatgtgccggggaccacgccaaaggatgtcatggacatggttcttgttacccagtattttgacacaatgaaggaaattggtgttgcctcaaaatcctctgctgtgttcatccctcatggacctggtgctgttcgtgatgtagcatctcaaattcgtgatggacttcttcagggttctgttcaacattagggttac

SEQ ID NO: 3615 - DNA, 1025 bp, Capsicum annuum
gttaaaatgggcaatttgttctgctgtgtgcaagttgatcaatcaacggttgcgattaaggagcaatttggcaagtatcgggatgtgcttgagccagggtgccactgtgtaccttggttccttggaagccagttggctggtcatctctccctcagggtgcagcaactagatgtgcgctgtgaaaccaaaactaaggataacgtctttgtcaatgttgttgcatcaattcagtatcgtgccctggcagacaaagctaatgaagcattctacaagctaagtaacactaagggtcagattcaggcatatgtttttgatgtcataagagcgagtgttccaaaactcaatcttgatgatgtatttgagcaaaaaaatgaaattgctaagtctgttgaggaggaacttgagaaagctatgtctgcttatggatatgaaattgttcagacccttatagttgatatagtaccagatgagcatgtaaagagagctatgaatgaaatcaatgctgctgctcgtctgagggtggctgctaatgagaaggcagaggctgagaagattttgcaaattaagagggctgaaggggaggctgagtctaagtatctctcgggattaggtattgcgcgacaacgtcaagccattgtggatggtctgagagacagtgtgctaggattttcagtcaatgttcctggaactacagcaaaggatgttatggacatggtcctggtaacccagtacttcgacaccatgaaagaaattggcgctgccagcaaatcatctgctgtcttcatcccccacgggcctggtgccgtaaaaaatgtggcacagcagattcgtgatggacttcttcaggcttctgttgggcattaagtacttattgctcatcaatgttaatgggtttcatatcaaagcaaactgttaaaagttttagtcttttctttcttaagtatatggcggtgagttgactttgttagatatttgtgaatcccagtgctacctatgtttataaatggtttggtaaggttttgaat

SEQ ID NO: 3616 - DNA, 1135 bp, Nicotiana tabacum
  misc_feature (954)..(954): n is a, c, g, or t
  misc_feature (1004)..(1004): n is a, c, g, or t
  misc_feature (1007)..(1007): n is a, c, g, or t
  misc_feature (1009)..(1009): n is a, c, g, or t
  misc_feature (1042)..(1042): n is a, c, g, or t
  misc_feature (1053)..(1053): n is a, c, g, or t
  misc_feature (1057)..(1057): n is a, c, g, or t
  misc_feature (1060)..(1060): n is a, c, g, or t
  misc_feature (1066)..(1066): n is a, c, g, or t
  misc_feature (1079)..(1079): n is a, c, g, or t
  misc_feature (1081)..(1081): n is a, c, g, or t
  misc_feature (1102)..(1102): n is a, c, g, or t
gaattcaaaattcttcagacttttttgctgttcttgtgctttgttgcttgtttcgtaagtcagtatgggcaatttgttgtgctgtgtacaagttgatcagtccacagttgcaattactgagcaatttggcaagtatcaagatgtgcttcagcctgggtgccactgtctgccttggttccttggatttcagctggctggccatctctccctcagggtgcagcaactggatgttcgctgcgagaccaagacaaaggataatgtatttgtcaatgtagtggcatcaattcaataccgtgctcttgcagacaaagcaaatgatgctttctaccgactaaccaacactaagggtcaaattcaagcctatgttttcgatgtcataagagcaagtgttccaaaactcaatcttgatgatgtttttgagcagaaaaatgaaattgccaaggctgttgaggatgaacttgagaaggctatgtcggcttatggatatgaaattgttcagacacttatagttgatatagaaccagatgagcatgttaagagagccatgaatgaaatcaatgctgctgctcggatgaggttggctgctaatgagaaggcagaggctgagaagattttacaaattaaaagggctgaaggagaggcagagtcaaagtatctctcaggattaggtattgcacgacaacgtcaagcaattgtggatggtttaagagacagtgtgcttggcttctcagtgaatgtgcctggaacctcggcaaaggatgttatggacatggtccttttaactcagtactttgacaccatgaaagaaattggcgcttccagcaaatcatctgccgtgtttcttcctcatgggcctggtgttgtaagagatgtcgcaagccagattcgcgacggactccttcaagcttctactcagcattaaatgttctctgtcagatatgtcaatgtgtttcncttgatgcagctattttcccttttgtctttattttgtcaagtgtggatanatntngtgagattgactttgaagttgtgaatatactantatcctatgtncagnagnatgtangtttttgaagatntncagaccctttttgaagaattntgaattgctatctgatatttggcagcttacctt

SEQ ID NO: 3617 - DNA, 1227 bp, Valeriana officinalis
ctggcaggcaagtcgtttctttcctatatatacatatgcggcaaagatatcactcactccattatcgcttcggaccttgagaccttttcttcttcattctcaccttgctgcttcttcaactgttagaatgggtggaatcctgtgctgtgtccaagttgatcaatcaactgtagctattaaagagcattttggaagatttgacgaggtactcgaacctggctgtcattgtcttccttggttcctcggttatcaactcgccggaaatctcacccttcgtgttcaacaattggatgtccgttgcgagaccaagaccaaggataacgtgtttgtgaatgttgtagcatcgattcagtatcgagcaattgccgaaaaggcgaacgatgctttctacaaactcagcaacactcgctctcagatccaggcttatgtgtttgatgttatcagaggaactgttcccaagctcgatcttgatgccacttttgagcagaaaaatgatatcgccaaggcagtcgaagatgaacttgaaaaggccatgtctgcttatggatttgagatcattcagactctaattgttgatattgagccagatgagcatgtgaaaagagcgatgaacgagatcaatgccgctgcgaggatgaggatggctgcaacagagaaggcagaggctgagaagattctgcaaatcaagagagcggaaggggaagccgaatctaagtatctgtcgggattgggaattgcgagacagaggcaggccattgttgacggtttgagggacagcgtactaggtttctcggtaaacgttcccgggaccacagccaaggatgttatggatatggtgttggtcactcaatatttcgataccatgaaagagatcggcgcttcgtcaaagtcttcagccgtttttatccctcatggtcctggtgctgttcgtgatgttgctgctcagattcgtgatggccttcttcagggctcttcagttcagtaatatactgctttgtggattggaacatacgcgttgcatgcatacaatttggattttaggcatgctctcttttatcttttacatactttgttttgctttatatttttagtgtgggtgtgattttcggttattggtatataaaacactagatactgtgattaatacacaagcttttggacgaattatatcatatcaagtttgacgttttggtttcaagcgtcttgtttgcttatttgcgtttgagc

SEQ ID NO: 3618 - DNA, 1503 bp, Lactuca sativa
caagattccttttcattgatttgtttctttgtttgccacagttatgtattttcccattagattaatggcttggttttaagtgtttggatgagtttaaatgatcattcttgagtcgttatcatttcaaatcttttttaggtcttaaattgagaaatcttgtattcgtagctaaggtgtttgtggaaatttctctgcagtagaggctgcaaaagcgtctttcttaattatagtggctttggtgtaggatcatgggaaacctactgtgtttggttcaagtagaccaatctactgttgctatcaaggaatcatttgggaaatttgatgatgttttggagcctggatgtcattgtgttccttggatatttggaaaacaactagctggtcatctttctcttagagttcagcagttggatgtaaagtgtgagaccaaaacaaaggataatgtttttgtgaatgttgtggcttcgatacaataccgtgctcttgctgataaggcaagtgatgccttctataaactcagcaacacaaagtcccaaatccaggcttatgtttttgatgtcataagagcttttgtaccaaagcacaatttggatgatacttttgaacaaaagaatgaaattgccaaggctgttgagcaagaactcgaaaaggctatgtctgcgtatggatacgagatagttcaaacattgattgttgatatagaaccagatgagcatgtaaagaaagcaatgaatgagatcaacgcagctgcaagatttaggatggcagctactgaaaaagcagaagcggagaaaattcttcaaatcaagagagccgagggggaggcggagtcaaaatatttgtcgggattgggtatagcccgtcaacggcaggcgattgtggacggtttgagagacagtgtgttagggttctcggtgaatgttccaggaacgactgcaaaagatgttatggacatggttttagtgactcagtattttgacacaatgaaggacattggtgcatcttccaaatcatcggctgtgtttatccctcatggaccgggtgcggttcgtgaggtcgctaatcagatacgtgatggacttcttcagggttccgccaccacctaatgatttcgaactttatcgtgcaagtatatgtatatggttttgtttcttgcattcgtttgcctatagtttatatgtttgttttggttgagtcttcatgaaaaaaacaaaataaatatcggtcatggggtttgcttgttgggatgttcgggaatggggttcatctttttacgaaaatacgaaataaaaatgcaagatttttgtgtgtattcatctagaagtttaatgagtacaccatggtgtcattaatttgttctaatacatcccttgcttgaacccaagtcaggtagatttgtaatttaagcaatacgcttatgctcacgttagttggttccaaggtggtgtagagtttcaattccaatatagattgggtttttatgagatttgggcagttgtgtcg

SEQ ID NO: 3619 - DNA, 1011 bp, Nicotiana benthamiana
tgcagaatatgggcaatttgatctgttgtgttcaagttgatcaatccacagttgcaattaaggagcaatttggcaagtatcaggatgtgcttgagccaggttgccactgtgtgccttggttccttggaagccagttggttggtcatctctccctcagagtgcagcaactagatgtgcgctgtgaaaccaagacaaaggacaatgtatttgtcaatgttgtcgcatcaattcagtatcgtgccctggcggacaaagcaaatgatgctttctacaaattaagtaacaccaagggtcaaattcaggcttatgtttttgatgtcataagagcaagtgttccaaaactcaatctggataatgtctttgagcaaaaaaatgaaattgctaaggctgttgaggaggaacttgagaaagctatgtcagcttatggatatgaaattgttcagacacttatagttgatatagtaccagatgagcatgtaaagagggctatgaatgaaatcaacgctgctgctaggttgagggtggctgctaatgagaaggcagaagctgagaagattttgcaaattaagagggctgaaggggaggccgagtctaagtatctcgcaggcttaggtattgcacgacaacgtcaagcaattgtggatggtctgagagagagtgtgctaggattttcagtcaatgtgcctggaactaatgcaaaggatgttatggacatggtcctcgtaacccagtactttgacacaatgaaagaaattggtgcttccagcaaatcctctgctgtcttcattccccacgggcctggtgctgtaagagatgtggcacagcagatccgtgatggacttcttcaggcttctattgagcattaaatacttattgctcatgaatgttacacgggtttcacatcaagcaagcttttatcatttttagtcttttctttcttaaatatggaaatatgtggtgactttgactttgttatagattggtgaatccaaatactatctatgtttataa

SEQ ID NO: 3620 - DNA, 1116 bp, Ambrosia trifida
caataaccttttgcctataaataacacctgcaaagcaccttcgtcaccacgctattcggctccatcacccacccctcttttgtgtgatattatgggaaacctactctgtttggcgcaagttgatcagtcaactgttgctattaaggagacttttgggaagtttgatgatgttcttgagccgggttgtcattgtgtgccgtggattttcggaagtcggcttgttggatatcttactctcagggttcagcagttggatgtcaagtgtgagaccaaaacaaaggacaatgtctttgtcaatgttgtagcttcgattcagtatcgtgcgttgtctgataaggcgagtgatgcgtactacaaactcagcaacacaagggcccaaatccaggcctatgtttttgatgtcataagagctagtgttccaaagcttaatcttgatgatgtgtttgagcaaaagaatgaaattgctaagtctgtggaagaagaacttgaaaaggcaatgtctgcctatggttacgagattgttcaaacattgattgttgatatagaaccagatgagcatgtgaagagagcaatgaatgagattaatgctgctgcaaggctaaggttggctgctactgagaaagccgaggctgaaaagattctgcaaatcaagagagccgagggagaggctgagtccaaatacctttctggtttgggtattgcgcgccaacgacaggctattgtggatgggttaagagacagtgtgctgggtttctcggtcaatgtgcctgggaccacagctaaagacgtgatggacatggttctcgtgactcagtattttgacaccatgaaggaaattggggctgcatcaaaatcttctgctgtgttcatccctcatggacctggggctgttcgtgatgttgctactcagatacgcgatggtcttcttcagggcagtgctgctacttgactgtcaagactttgatggcccaaaccgtttaatgcaaccataaggagtacagtttcatgttttctttagtaacaatggtttatattttcaactgtgattggcttgcgagtttatgtgtgctatgaacgtgtatatagggttatgtaatgatgtctatctggatattt

SEQ ID NO: 3621 - DNA, 1183 bp, Amorphophallus konjac
cggtttccctgtttctgtgtcttgcgaggactcttgtttgcttatccttggtgtgttggttttgttgtggagccaggatcatactccagagcaaccatgggcaacttgctgtgctgtgtacaagttgaccagtctactgttgctattaaggaaagatttgggaagtttgaagaagtgcttgagccaggatgtcactgcataccttggttccttggcattcgactggctggtcaactcacactcaggttgcagcagctggatgtgaaatgtgagacgaaaacaaaggataacgtattcgtaaatgtcgtggcttctgttcaataccgtgctctggctaacaaggccgacgatgcgtactacaaactcagcaacacaagaagccaaatccaagcttatgtgtttgatgttattagagcaagtgtcccaaagctcgaccttgatgatgcatttgagcaaaagaatgagatagcgaaagcagtggagggtgagcttgaaaaggctatgtctaactatggctacgagattgtgcagacacttatcgttgatattgagccagacgtgcatgtgaagcgagccatgaatgaaataaatgctgctcaaaggctgaggatggcagcaaatgagaaggcggaagccgagaagatcctgcaaataaaacgggcagagggagaggctgaatcgaagtatctagctggacttggcattgctcgccaacggcaagcgatagtggacggtctgagagacagcgtgctcggcttctccgtcaacgtgccggggactacggcgaaggatgtgatggacatggtcttggtcactcagtacttcgacaccatgaaggagattggtgcatcttccaaatcatctgctgtcttcatcccccatggccccggtgctgtccatgatgttgctaatcaaatccgtgatggcttgcttcaagcctccgctcaggctcaccagtgaattgttcatcccttttaaaatgtgtatttagcccaagacgtccttctcaactcctgggcaggtttatcagggtcactgcaggattgggatgaagttggaagaatgttagaaccttggtgtcttgctttgctagcttctgaagttggaagttggaagaatgttagaaccttggtgtcttgctttgctagcttctgaatgtttatactttatatatatatatatc

SEQ ID NO: 3622 - DNA, 1230 bp, Artemisia annua
tactccgacgggggacaatttcttggtaattcatataaatccaatttctgttttttttatataaaatccactcaccaattctttcattcccactcctctttctttctttcttctcacgatcactgtgttgtttgttgctgaaatttgatcatgggacaagttttctgtttgtatcaagtagaccagtctacagttgctattaaggaatcatggggaaaatttgatgaagttttggagcctgggtgtcattgtgttccatggtttttgggcaaaaatcttgctgggcagatgacgcttcgtgttcagcagttggatgttaagtgcgaaactaaaactaaggacaatgtctttgtaaatgttgtggcttctattcagtaccgtgctttgtctgataaagcaagtgatgcgttctataagctcagcaacaccaggtcccaaatccaggcctacgttttcgatgtgataagagcttttgttccaaagcacaatcttgatgacacttttgagcaaaagaatgaaattgctaaggctgttgaagaagaactttcaaaggctatgtctacatatggatttgagatagttcagactttgattgttgatattgaaccagatgagcatgtgaagagagcaatgaatgagatcaatgctgctgcgaggttaaggatggctgctactgagaaagctgaagctgagaaaattctccaaatcaagagagcagaaggagaagccgaggccaagtacctgtctggtttgggtattgcccgccagcgccaggcaattgtagatggtttgagggacagtgtgttggggttctcagtcaatgttcctggaaccactgctaaagatgttatggacatggttctagtcactcagtattttgacaccatgaaggagattggtgcatcctctaaatcctcagctgtgtttatcccacatggacctggtgctgttcgtgatgtagcaactcagatccgtgatgggcttcttcagggtaacgctgccagttgatctacaacttcttccagtcaagtttgcaagtatatgactttaagctttacatctgtttgcttataggttatcttctttatgttttgatcttttttctgaatatatgaattaaaatgtgtaaattcgctgaatattttaaatgtctcacattggtttgcctatattttctctaaattttgtttgaaccttctgaaaatatgaatcaaaatgctatggtcacta

SEQ ID NO: 3623 - DNA, 1172 bp, Cichorium intybus
gggttattcacgtttccatcttcttcttcaccctccgtctcttcaacatctctttcccgctaaggtgtttgtggaaatgtctgtgcagtagaggctgcaaacgagtcttcttatagttgttttggtgtacgatcatgggaaacctatgttgtttggttcaggtagaccagtctacggttgccatcaaagaatcttttgggaaatttgatgatgttttggagcctggatgtcattgtgttccatggatattcggaaaacagcttgctggtcatcttactctaagagttcaacaattggatgtaaagtgtgagaccaaaacaaaggataatgtgtttgtgaatgttgtggcttcaatacaatatcgtgctctggctgataaggcaagtgatgccttctataaactcagcaacacaaagtcccaaatccaggcctatgtttttgatgttataagagcttttgtcccaaagcataatctggatgatacctttgaacaaaagaacgaaatcgccaaggctgttgaacaagaacttgaaaaggctatgtctgcatacggatacgagatagttcaaacattgattgttgatatcgaaccagatgagcatgtgaagaaagcaatgaatgagatcaatgccgctgcaagatttaggatggcggctactgagaaagctgaagctgagaaaattcttcaaatcaagagagccgagggggaggcggagtccaaatatttgtcgggtttgggtatagcccgccaacggcaggcgattgtggacggtttgagagacagtgtgttggggttttcggtcaatgttcctggaacaactgcgaaagatgttatggacatggttttagtgactcagtattttgacacgatgaaggacatcggtgcatcctctaaatcatcggctgtgtttattcctcacgggcctggtgcggtccgtgatgtcgccaatcagatacgtgacggacttcttcagggttcctcaaccaaggaatgagatccgcaagtatatatatggctttgttttgttactttcatttgcgtatagtttatatgtttggatttttatgaatatacgaaataatattggcagtgggttcggttttgggggacgcgcaaggatgttgtcttcttgtttattgtgaaaatatgaaataaaattttaatatttgtg

SEQ ID NO: 3624 - DNA, 1259 bp, Lactuca sativa
tttgtttctactttgtaatttgtatctgtctcaatcttgcatgtttctataaatctgtcgttcattacccgtaaccgttccctgtcttctgcaaccaccctccagctttcaacgtctctttcccgctaaggtgtttgtgcaaaagtctatgcagtagaggctgcaaagacgtgttcgtatagtggctttggtgtaggatcatgggaaacctactgtgtttggttcaagtagaccaatctactgttgctatcaaggaatcatttgggaaatttgatgatgttttggagcctggatgtcattgtgttccttggatatttggaaaacaactagccggtcatcttactcttagagttcagcagttggatgtaaagtgtgagaccaaaacaaaggataatgtttttgtgaatgttgtggcttcgatacaataccgtgctcttgctgataaggcaagtgatgccttctataaactcagcaacacaaaggcccaaatccaggcctatgtttttgatgtcataagagcttttgtaccaaagcacaatttggatgatacttttgaacaaaagaacgaaattgccaaggctgttgagcaagaacttgaaaaggctatgtctgcgtatggatacgagatagttcaaacattgattgttgatatagaaccagatgagcatgtaaagaaagcaatgaatgagatcaacgcagctgcaagatttaggatggcagctactgaaaaagcagaagcggagaaaattcttcaaatcaagagagccgagggggaggcggagtcaaaatatttgtcgggattgggtatagcccgtcaacggcaggcgattgtggacggtttgagagacagtgtgttggggttttcggtgaatgttccaggaacgactgcaaaagatgttatggacatggttttagtgactcagtattttgacacaatgaaggacattggtgcatcttccaaatcatcggctgtgtttatccctcatggaccgggtgcggttcgtgaggtggctaatcagatacgtgatggacttcttcagggttcctccaccaccacctgatgatttggaactttatcgtgcaagtatatgtatatggttttgtttcttgcatttgtttgcctatagtttgtatgtttgttttggttgagtcttcatgaaaaaaacaaaataatatcggtcgtggggtttgcttgttgggatgttagggaatggggttcatctttttatgaaaatacgaaataaaaatgcaagattttt

SEQ ID NO: 3625 - DNA, 1647 bp, Elaeis guineensis
agtatcagttgcagccagttgtctcactcgattatgggatttttattctgctatgctcaaatagatgtgtaggatcttagaaatttgaaccatagactgtgaagttctcataaacatatctgattgtaggactgaaggtaacgttacgtttgtaacaatgcttcttacacagattgtacccattagaaatatatttgcaattaataaacaggccattctgtttggtggttctcaaattatcactatattgaccaagcatgcccacatagtcgtagcttgcatcgcttaaaacttgatcatggaagaagcttgcagtgactgttgatggattctaatgggaatccaagcagcctcccattgatgtctccaaatacatgagcaaggcttgttgttgcttacaagtggatcagtcaactgtggctatcaaagaaacttttggtaggttcggtgatgtgcttcatcctggatgccactgcttaccttggtgtttagggcatcagattgctggctacctctcattgcgtgtgcaacaacttgatgttcgttgtgaaacaaagacaaaggataatgtgtttgtcactgttgttgcatctatacaataccgtgctcttgctgacaaggcatctgatgctttctacaaacttagcaacacaagggaacaaattcaatcttatgtttttgatgtcatcagagcaagtgttccgaagctgaatttagatgatgcatttgagcagaagaatgatattgcaagagctgtggaagatgaacttgaaaaggcaatgtcaatgtatggatatgagatagttcaaacactcattgtggatattgagcctgacgagcatgttaagagggcaatgaacgagatcaatgcagctgccaggctgagggtggcagcaaataaaaaggctgaagctgagaaaatactgcagatcaagcgtgctgaaggagatgcagaatccaagtacttagcggggcttggtatagcacgccaacgccaggccattgtggatgggctgagggacagcgtgcttgccttctctgtaaatgtacctgggaccacagccaaggatgtcatggatatggtgctggtgacacagtactttgacaccatgaaagagattggagcatcctcaaaggcctcttctgtgttcatccctcatgggcctggggctgtgagggacattgctgcacaaataagggatggcctcctccaagctagcaccactcagcagtaggaccaaatggaggctagtttcgtggggatggattagcagtttaaaacggttgattgtttcttttcttctaaagtgctttaatttggtgccggtatttggaagatgaagcagaatacaaaacataaggtgtgatatatattctttttattgttttgtgcatctcgtgagcatgttgtacgtgatttgctgaactagctattttcatgatactgtttatgagtgcatggttaaggcagcaatgatggagatgactgttattattattgtaatttcttatgttttgaacttgtttggttgctgttgtttgttgattttgctgaagctaataaattcctttgatgtcaaaaaaaaaaaaactaacgtagactagtcgaacgaacgacaacacgggaggtaagtgcccccccccccc

SEQ ID NO: 3626 - DNA, 1406 bp, Phaseolus coccineus
gcttataatttaagcaagagctcttccaagtcagctttgctttggaagcctttatcttgaggtgccattttgatcctcagtattttgcttctaagttgtaacttttccttgctctaattctctgtgttgatttaacagcaatggggaatcttttgtgttgtgtgcaagttgagcaatctacagtggctgtaaaagaaggatttggacgatttgagcaggtgcttcagccaggatgccattgcatgccatggttccttggcaaacaagttgctggtcatctctctcttcgactacaacaattggatcttcgatgtgagaccaagacaaaggataatgtctttgttaatgttgttgcgtcaattcaatatcgtgccctggcagagaaggccaatgatgctttttacaaactcagcaatacaaaaacccaacttcaggcatatgtttttgatgtaattagggcaagtgttccaaagctcaacttggatgatgcttttgagcagaaaaatgatattgccaaagctgtggaagaagaacttgagaaggctatgtcagcttatgggtacgaaattgttcaaacactgattgttgatatagacccagatgagcatgtgaagcgagctatgaatgaaatcaatgctgctgcaagattgagggtggcagctaatgagaaggcagaggcagagaagatcttgctaattaaacgagctgagggtgaggctgaatctaaatatctctctgggatgggtattgctcgccaacgtcaagcaattgtggatggattgagagatagtgtgcttggattctcagtcaatgtacctgggacgactgccaaagatgttatggacatggtcctggttactcagtattttgacaccctgaaagaaattggcgctgcctccaagtcttcttctgtattcattccacatggacctggtgctgttcgtgaagttgcttcccaaattcgtgatggccttcttcaggcttctcatcactagcttctactccacctagcgcctgtggttatatacttgtatttctctgcactgttttgtgatttggttttagaataaactgctaaattgatcctccaaaaattataacgtcaactgattaatcttctaaagaatttttccgtcaaattagtcccacaaatatctaaaactttaccacctttgttctaaaattagtctttatttatatctttgagggattgatttgttggccaaaatctttggaggaccagtttaaggacctttttttatctatactttcagacacaaagtaatactgtatactctgttgtctttgttttgaatcatgcataatcaaactatcaagtatctgtatatacaacttgtttagattgtggaagttgaacaataaatttcttatatacagttaaaaaa

SEQ ID NO: 3627 - DNA, 1519 bp, Medicago truncatula
atgattatcacccctaacatgggttttaaggaccggtgtgagttgttgtttttcaagtcgcttattattggcccacccacagcttcccttgtgaaccgaccttacacacacacacacacacaattcttttgttgttttgcagagagacagccaaaccaaacaacgaacgttgaaaagaaaatggggaatcttgtgtgttgtgtgcaagttgatcaatctcaagtggctatgaaagaaggttttggaaaatttgaaaaggtgcttcagccgggatgccattgcatgccatggttccttggaaaacgaattgctggtcatctctctcttcgggtacaacaattggatatcaagtgtgagacaaagacaaaggataatgtctttgtcaatgttgttgcttctattcaataccgtgccttggcagacaaggctaatgatgcattttacaaacttagcaacacaagaaaccaaattcaagcttatgtttttgatgtaattagggcaagtgttccaaaactcaacttggatgatacttttgagcagaaaaatgaaattgcaaaagctgtggaagaagaacttgagaaggctatgtcagcttatggatatgaaattgttcaaacactgattactgatatagagccagatgtccatgtgaagcgggctatgaatgaaatcaatgcagctgcaagaatgaggttggcagctaaagagaaggctgaagcagagaaaatcttgcaaattaagcgagccgagggtgaggctgagtctaaatatctctctgggttgggtattgctcgccagcgtcaagccattgtggatggtttgagagacagtgtgattggattttcagttaatgtaccagggacgactgcaaaagatgtcatggatatggtccttgtcactcaatactttgacactatgaaagaaattggggctgcctccaagtcttctgctgtgttcattccacacggacctggcgctgttcgtgatgtagctagtcaaattcgtgatggacttctccagggttctctatctcatcagtaacttttactcctcctgtttcgtatctgatttatgtgggagtgtggtgattttatagtgcttgtggttgtaacgcttcaatatgttatattatttagtacaagagtaaactggtaaattgatcctccaaatattttggcattggtatatcagtcttgcaaaaaataaaatttgtcattaagttaatccttcaatgatttgaaacaattgtcacattttctctcgaggaaaatggtgacgccaaatttaaaaatttggtaaatgttgtgtgttttaaatggatttattgatgataaattctttggaggatgatttaaaggaattactcttgttttatacttccagtttgcaactcttaatatagatagatatgagttttctacattataaattgatgcataactagactttcaattatccttgtatatacatgttttctacattgtgaaagttgaattcaaatgactttttatataccgtt

SEQ ID NO: 3628 - DNA, 938 bp, Medicago truncatula
atgcttcttcatctttcccttgcaacaactgaaaagaaaatggggaatcttgtgtgttgtgtgcaagttgatcaatctcaagtggctatgaaagaaggttttggaaaatttgaaaaggtgcttcagccgggatgccattgcatgccatggttccttggaaaaagaattgctggtcatctctctcttcgggtacaacaattggatatcaaatgtgagaccaagacaaaggataacgtctttgtcaatgttgttgcttctattcaataccgggccttggcagacaaggcgaatgatgcattttacaaacttagcaacacaagaaaccaaattcaagcttatgtttttgatgtaattagggcaagtgttccaaaactcaacttggatgatacttttgagcagaaaaatgaaattgcaaaagctgtggaagaagaacttgagaaggctatgtcagcttatggatatgaaattgttcaaacactgattactgatatagagccagatgtccatgtgaagcgggctatgaatgaaatcaatgcagctgcaagaatgaggttggcagctaaagagaaggctgaagcagagaaaatcttgcaaattaagcgagccgagggtgaggctgagtctaaatatctctctgggttgggtattgctcgccagcgtcaagcgattgtggatggtttgagagacagtgtgattggattttcagttaatgtaccagggacgactgcaaaagatgtcatggatatggtccttgtcactcaatactttgacactatgaaagaaattggtgctgcctccaagtcttctgctgtgttcattccacatggacctggtgctgttcgtgatgtagctagccaaattcgtgatggacttctccagggttctctatctcatcagtaacttctactcctcctgcttcatatctgatttatgtgggg

SEQ ID NO: 3629 - DNA, 1284 bp, Nicotiana tabacum
  misc_feature (4)..(4): n is a, c, g, or t
  misc_feature (1098)..(1098): n is a, c, g, or t
gccngggggggaattcaatcttctatctgtttctcaacatatttgagaaattacttattaaatacccaattaagtgtgatgccaaatgtataacttgcaatttcatttttctctttaaaaggaaaagaagtatagcacttgattattgattctgtaacttagttcaagataccatacatgtatgtagcataacatgtttgcttgttcttttattgttgaaaacaaaaaagattgctcttttatcttcttttttttttggtttgtttgttttgaaatcttgaattctttgttggtcttcttgaaattgttgggaaacagagagagaaaatggggaatctgctttgctgtgtacaagtggaccaatccacagtggctataaaggagagatttggcaagtttaatgatgtgcttgagcctggatgtcatttcttgccatggtgtatagggagtcagattgctggatacctaactttaaggttgcagcagcttgatgtgcgatgcgagacaaagtcaaaggataatgtatttgtaactgttgttgcttcaattcaatatcgtgctctggctgataaagctactgatgctttttacaagcttagtaatactggatcccagatccaagcctatgtgtttgatgttatcagagcgagcgttccaaagctaaatttggatgatgtctttgagcagaagaatcaaattgctaaagcagtggaggatgaacttgaaaaggcaatgtctgcttacggatatgagattgttcagacactcatagttgatatagagccagatgaacatgtcaagcgagctatgaatgaaatcaatgcagctgcaagaatgagagtagctgccaatgagaaagcagaagctgaaaaaattgtccagattaaacgagctgagggtgatgctgaggctaagtacctggcggggcttggggttgctagacaacgccaggccattgtagatggtttaagggacagtgttcttggcttctcaagtaatgtcccaggtacaagtgccaaggacgtcttggacatggtcctcatcactcaatattttgacaccatgaaggaaattggcgccacatctaaatcctcagcngtctttatcccacacggacctggtgctgttagtgacattgcagggcagattcgacatggattgctccagggtttagctgtcgagcaaaaaaatcttttataaatgtgtttcaccgtgtctcgtgtgcttgtgttttgtatgtaatgtttgttcttgatgtgattgtgatggccattgttgttcgtc

SEQ ID NO: 3630 - DNA, 1282 bp, Trigonella foenum-graecum
cagttaaacgaaaatggggaatcttgtgtgttgcgtgcaagttgaccaatctcaagtggctatgaaagaaggttttggaaaatttgaaaaggtgcttcagccaggatgccattgtatgccatggttccttggaaaacgaattgctggtcatctctctcttcgggtacaacaattggatatcaaatgtgagaccaagacaaaggataatgtctttgtcaacgttgttgcttctattcaataccgtgctttggcaaacaaggctaatgatgcattttacaaacttagcaacactaggaaccaaattcaagcttatgtttttgatgtaattagggcaagtgttccaaaactcaacttggatgatgtttttgagcagaaaaatgaaattgcaaaagctgtggaagaagaacttgagaaggctatgtcagcttatggatatgaaattgttcaaacactgattactgatatagagccagatgtgcatgtgaagcgggctatgaatgaaatcaatgcagctgcaagaatgaggctggcagctaatgacaaggctgaagcagagaagatcttgcaaattaagcgagctgagggtgaggctgagtctaaatatctctctgggctgggtattgctcgccaacgtcaagccattgtggatggtttgagagacagtgtgattggattttcagttaatgtaccagggacgactgctaaagatgtcatggatatggtccttgtcactcaatatttcgacaccatgaaagaaattggtgctgcctccaagtcttctgccgtattcattccacacggacctggtgctgttcgcgatgttgctagccaaattcgtgatggacttctccagggttctgtatctcatgagtagcttctgttcctcctacttcatatctgaatatatgggagtgtggtgattttataatgcttttggttgtaacagttaagtatgttatatgatgatttagtatcggagtaaacttcaaaactgaccctccacatattatggcatcactatatcagtcctgcaaaaaataaatttgtcattaagttaatccttcaaagatttaaaacaattgtcgcattatctctcaaggaaaatggtgacgaaaaaaattaaaatttggtaattgttttgtatctttgtgggatttacttggtgataaattctttggaggatgattttaaggaattactattgtattatacttccagtttgcaactcatattatagatgagttttctatattataattgatgcataactagactttcaact

SEQ ID NO: 3631 - DNA, 1376 bp, Trigonella foenum-graecum
aacaaataatacaatacagttctttcgtcgttttgaagcgcgacgattcattcagtaaaaccacgaaccgaacaattaaaagcaaatggggaatcttttgtgttgcgtgcaagttgaccagtctacagtggctatgagagaaggttttggaaaatttgaagaggtgcttcagccaggatgccattgtatgccatggttccttggaaagcgagttgccggtcatctctcccttcggctacaacaattggatataaaatgtgagaccaagacaaaggataatgtctttgtcaatgttgttgcttctattcaataccgtgccttggcagacaaggctaatgaagcattttacaaacttagcaacacaaggggccaaattcaagcttatgtttttgatgtaattagggccagtgttccaaaactctacttggatgacgcttttgagcagaaaaatgaaatcgcaaaagctgtggaagaagaacttgagaaggcaatgtcagcttatggatatgaaattgttcaaacactgattactgatatagagccagatgagcatgtgaagcgggctatgaatgaaatcaatgcagctgcaagaatgaggttggcagctaaggagaaagcggaggcagagaagatcttgcaaataaagcgagctgagggtgaggccgagtctaaatatctctctgggctgggtattgctcgccaacgtcaagccattgtggatggtttgagagacagtgtgattggattttcagttaatgtacctgggacgagtccaaaagatgtcatggatatggtccttgtcactcaatattttgacactttgaaagaaattggtgcttcctccaagtcttctgctgtgttcattccacacggacctggtgctgttcgcgatgttgctagccaaattcgtgatggacttctgcagggttctctatctcatcagtagcttctattcctcccacttcatatctgatttgaaggggagtgtggtgattttttaatgctttgtgtctctgcagtatgatatatgattttgtgtgaaagtaaactgttaatttgaccctccaaatattacagtatcaactatcggtcttgcaaagatatttttgtcttaaggtaatccttcaacaatttaaaaccttgtcacagattctcttaaggaaaatggtgacacaaaaatacaaatttgataactgttttgtatctttgtgggatcggtatggtgatgaagtctttggaggacgatttaatggaattactatggttttttactttcagtttgtaactcttattataggtacaagttttctacattataatgatatcaactatccctgtatatacaagttttctaaattgtgaaagttgcattcgat

SEQ ID NO: 3632 - DNA, 1220 bp, Gossypium hirsutum
aagctaagagaaaatgggtaatcttttctgttgcgtacaagttggccagtctacagtagccatcaaggagagatttggcaggtttgaggatgttcttgagccaggatgccattgcctaccatggtttcttggaagtcagcttgccggccacctgtcactaagattgcagcagttggatgttcgttgtgagacaaagactaaggataatgtatttgtcaatgttgttgcatctattcaataccgggcactggcagataaggcaagtgatgccttctacaaactcaccgatacaaggaagcagattcaagcctatgtttttgatgttattagggcaagcgttccaaagctaaatttggatgatgtttttgaacaaaaaactgaaattgctaaagctgttgaagaagaacttgagaaggctatgtctgcgtatgggtatgagattgctcaaacacttattgtggacatagaacctgatgtgcatgtgaagcgcgcaatgaatgaaatcaatgctgctgcaaggatgagggtggcagctaacgagaaggcagaggcagagaaaattctgcaaatcaaacgagctgaaggtgaggccgaatctaagtacttgtcagggctgggtattgctcgccagcgacaagctattgttgatgggctacgagatagtgtgcttggattctctgttaacgtccctgggactactgcaaaggatgtcatggacatggtcctggtcacccagtactttgacaccatgaaagaaatcggtgctgcttctaaatcttcggctgtgttcatccctcatggtcctggagctgttcgtgatgtcgccactcagattcgcgagggactcctccaggctgcacatcagtaactaatacacttatactgggttttgcttaaggccagcatgctttgtttttcttttttccggacactagttagttttggtatttgtctgtttagttattggtgccattttgtttagctgtggttgcttcttctttttttttatttttttgtatatatggtatggccctgaaaggggttgtgaagaacattgggtgcatagttttctataaagtagattttaagacacctttatgttggattttgtggatttaaatgttacctatactgcaatttgaaatttaatcttgaatttaatacgataatagacatgtaattttttctaagaacaacattaagcatttaatttacatata

SEQ ID NO: 3633 - DNA, 1051 bp, Zingiber officinale
  misc_feature (153)..(153): n is a, c, g, or t
  misc_feature (1009)..(1009): n is a, c, g, or t
gagaagtcgaggaaagccatgggccaagctttctgctgcgttcaagtagaccaatccacggtagcgatcaaggaatcctttgggaaattcgacgatgtgcttcagcctggatgccactgcttgccttggatcttcggcaagcgtgtcgccggncgcctctccctccgaatgaagcagctcgacgtcaaatgtgaaacaaagacaaaggacaatgtgtttgtgaacgttgtggcatccatccaataccgtgctctgccaaacaaagcaagtgatgctttctataggcttagcaacacacagtctcagatccaagcttatgtatttgacgtgataagagccagtgtgccaaagctcatcctggacgatacttttgagcaaaagaatgagatagccaaagctgtggaagaggaacttgagaaggccatgtctgcttatggcttcgagattgtgcagactctcatcgtcgatatcgaaccagatgagcatgttaaaagagccatgaatgaaatcaacgcagctgcaagattgagaatggcagcaaacgagaaggcggaagccgaaaagattgtgcagattaagaaggcggagggtgaagcggaggccaagtatttgtcgggcgtgggcattgcccgtcagcgccaagccatcgtggacggcctgagagacagcgtgcttggcttctctgtgaacgtgccaggaacaactccgaaggacgtgttggacatggtgctcatcacccagtacttcgacaccatgaaggagatcggagcacagtccaagtcctcgtcagttttcatccctcacggaccgggggccgtccgtgacattgctcaacaagtccgggacggccttctccaagcatctaccctttgattatcaaattaatggagagtaattaataagtgaaggttgtgtatcatcttgtgtgcttatatcgaactgccgggctgtaagtaaactaggtgtgtgcttaaacaattgtcttaattaaacgtgcttcagtttgttngtaaccaaatcgtttctgattttcaattcactcgcaagatct

SEQ ID NO: 3634 - DNA, 1514 bp, Gossypium raimondii
aagttgcttgataattaagttaggggaaaatatatttctttgaaaatccacgcattgtgggattcttcttcatcttctttcttgataccaaaaaaagctaagagaaaatgggtaatcttttctgttgcgtacaagttggccagtctacagtagccatcaaggagagatttggcaggtttgaggatgttcttgagccaggatgccattgcctaccatggtttcttggaagtcagcttgccggccacctgtcactaagattgcagcagttggatgttcgttgtgagacaaagactaaggataatgtatttgtcaatgttgttgcatctattcaataccgggcactggcagataaggcaagtgatgccttctacaaactcaccgatacaaggaagcagattcaagcctatgtttttgatgttattagggcaagcgttccaaagctaaatttggatgatgtttttgaacaaaaaactgaaattgctaaagctgttgaagaagaacttgagaaggctatgtctgcgtatgggtatgagattgctcaaacacttattgtggacatagaacctgatgtgcatgtgaagcgcgcaatgaatgaaatcaatgctgctgcaaggatgagggtggcagctaacgagaaggcagaggcagagaaaattctgcaaatcaaacgagctgaaggtgaggccgaatctaagtacttgtcagggctgggtattgctcgccagcgacaagctattgttgatgggctacgagatagtgtgcttggattctctgttaacgtccctgggactactgcaaaggatgtcatggacatggtcctggtcacccagtactttgacaccatgaaagaaatcggtgctgcttctaaatcttcggctgtgttcatccctcatggtcctggagctgttcgtgatgtcgccactcagattcgcgagggactcctccaggctgcacatcagtaactaatacacttatactgggttttgcttaaggccagcatgctttgtttttcttttttccggacactagttagttttggtatttgtctgtttagttattggtgccattttgtttagctgtggttgcttcttttttttttttttttttttttgtatatatggtatggccctgaaaggggttgtgaagaacattgggtgcatagttttctataaagtagattttaagacacctttatgttggattttgtggatttaaatattacctatactgcaatttgaaatttaatcttgaatttaatacgataatagacatgtaattttttctaagaacaacattaagcatttaattcacataaatttattattaattgaatatgattaacgctagttatcttatttgattgagaacttagaaaattgtgagtaactcattagtaaatactttattcgtgagaatagggataaaatgaaatcaaagtttcatgatattcaaaacagtatgctgattattttaagaactttttaagtaactatttagaagaatttgtgacagta

SEQ ID NO: 3635 - DNA, 1284 bp, Nicotiana benthamiana
  misc_feature (936)..(936): n is a, c, g, or t
  misc_feature (980)..(980): n is a, c, g, or t
  misc_feature (1072)..(1072): n is a, c, g, or t
gtctgcatcattgttaatatttctccaagagtatattccgtctattctccatttccacgaacttccttacaagtctctccccctcctccccccccccccccccgcccgcccgaaaccccccaacacacacacacacaaccaaacagctcatataaaaagacactccctccagctagcgaagcccaattcaaaaatcatcagacctttttgctgttcctgcgctttgttgcttgtttcgtaagtcagtatgggcaatttgttgtgctgtgtacaagttgatcaatccacggttgcaattacggagcagtttggcaagtatcaagatgtgcttcagcctggttgccactgtctgccttggttccttggatttcagctggctggccatctctccctcagggtgcagcaactggatgttcgctgtgagacaaagacaaaggataatgtatttgtcaatgtagtggcatcaattcagtaccgtgctcttgcagacaaagcaaatgatgctttctacagactaaccaacactaagggtcaaattcaagcctatgttttcgatgtcataagagcaagtgttccaaaactcaatcttgatgatgtttttgagcagaaaaatgatattgccagggctgttgaggatgaacttgagaaggctatgtcggcttatgggtatgaaattgttcagacacttatagttgatatagaaccagatgagcatgtgaagagagctatgaatgaaatcaatgctgctgctcggatgaggttggctgctaatgagaaggcagaggctgagaagattttacaaattaaaagggctgaaggagaggcagagtcaaagtatctctcaggattaggtattgcacgacagcgtcaagcaattgtggatggtttaagagacagtgtgcttggcttctcagtgaatgtacctggaacctcggngaaggatgttatggacatggtccttttaactcagtactttgacnccatgaaagaaattggcgcctccagcaaatcatttgccgttttccttcctcatgggcctggtgctgtaagagatgtggcaagccagattcgngacggactccttcaagcttttacggagcattaaatgttctctttcagaaatgttaatgtctttcccttgaaacagctattttccctgtctttattttgtcaagtgtggaaatatgtagtgagattgactttgaagttgtgaatatactattataccatgtacagaagcatgtaagtttttgaagatcttcagaccctttttgaagaattttg

SEQ ID NO: 3636 - DNA, 1269 bp, Elaeis guineensis
gacgacgacgacgactcgataaaaccacgcctcgctctctttctcttcggctccaccaggattcttcttcgcgtccggctcccgagttaagaaatggggcaggctttatgttgcttacaagttgagcagtcaactgtagctatcaaagaaacttttggtaggttcactgatgtgcttgatcccggatgccacttcttgccatggtgtctagggcagcagattgctggctatctctcattgcgtgtgcagcaacttgatgttcgttgtgaaacaaagacaaaggataatgtgtttgttactgttgttgcatctatacaataccgtgctcttgctgataaggcatctgatgctttctatagacttagcaacacaagggaacagattcaatcctatgtttttgatgtcatcagggcgagtgttccaaagctgaacttagatgatgtattcgaacagaagaatgatattgcgaaagctgtggaagatgaacttgaaaaggcaatgtcaatgtatggatatgagatagttcaaacactcattgtggatattgagcctgacgagcatgttaagagggcaatgaacgagatcaatgcagctgccaggctgagggtggcagcaaatgaaaaggctgaagctgagaaaatactgcagatcaagcgtgctgaaggagatgcagaatccaagtacttagcggggcttggtatagcacgccaacgccaggccattgtggatgggctgagggacagcgtgcttgccttctctgtaaatgtacctgggaccacagccaaggatgtcatggatatggtgctggtgacacagtactttgacaccatgaaagagattggagcatcctcaaaggcctcttctgtgttcatccctcatgggcctggggctgtgagggacattgctgcacaaataagggatggcctcctccaagctagcaccactcagcagtaggaccaaatggaggctagtttcgtggggatggattagcagtttaaaacggttgattgtttcttttcttctaaagtgctttaatttggtgccggtatttggaagatgaagcagaatacaaaacataaggtgtgatatatattctttttattgttttgtgcatctcgtgagcatgttgtacgtgatttgctgaactagctattttcatgatactgtttatgagtgcatggttaaggcagcaatgatggagatgactgttattattattgtaatttcttatgttttgaacttgtttggttgctgttgtttgttgatttt

SEQ ID NO: 3637 - DNA, 1289 bp, Platanus occidentalis
attgcactgattgccttaaatatgactttcctctgtgattttcttattcttgttttcctcagcttctcctctcttaatatgttttgggccttcttccctgcttagattccaagattattctgaagttcaagttctgcttagaatcatataatgggacaagcacttggctgtgttcaagtggaccaatcaaatgtagctatcaaggagactttcggaaagtttgatgaggttctcgagcctggctgtcactgcttgccttggtgttttggaagtcagatagctggcaaactttcattgcgtttgcagcaacttgatgttcgttgtgaaacaaaaactaaggataatgtctttgtcactgtggttgcatccattcaataccgtgcattggcagacaaagcagctgatgctttctataagctcagtaacaccaaggcacagatccaagcctatgtttttgatgttatcagagcgagtgtacccaagttggacttggattccacctttgagcaaaagaatgaaattgcaaaagctgtggaagaggagctggaaaaggctatgtcagcatatggttttgagatagtccagactcttattgtggatatcgagccagacgtgcatgtgaagagagcaatgaatgaaataaattcagctgctagactgagggtggcagcaaacgagaaggccgaagcagagaagataatgcagatcaaacgagccgagggagatgcggagtccaagtacctttcagggctaggtatagctcggcagcgccaggccattgtggatggattgagggacagtgtgcttgccttctctgtgagtgtgcctgggacaacggcaaaggatgtaatggatatggtgctggtgacccagtactttgatacaatgaaggagattggtgcatcatcaaagtcctcgtctgtgttcataccacatgggcctggtgctgtgaaggacattgcctcgcagattagggatggtctccttcaggccaacaccactcaacagtaggtttttaagtttgtgagacatgatgcttggaggtttggctactatattttctttgcacttgtggatggtttttagctcttgtcaaaggtaatctaatctctattggacttctttttttgtttgttttttatggaatatagttagagaacagtgaattgtcatgtaagtaaaatggctgtaagttacatattgttaatatatattgtcttggatgggttatggttttgtcacaactcacaagtaaattggacaaaatatatctgaaacttcaaggggat

SEQ ID NO: 3638 - DNA, 1059 bp, Nicotiana benthamiana
cccatccacaagaaagacccacgtcgtctctctgtttgcagcgaacggattgatctctgcagaatataatcaaagagagagacaatggggaatctgctttgctgtgtacaagtggaccaatccacagtggctataaaggagagatttggcaagtttaatgatgtgcttcagcctggatgtcatttcttgccatggtgtatagggagtcagattgctggatacctaactttaaggttgcagcagcttgatgtgcgatgcgagacaaagtcaaaggataatgtatttgtaactgttgttgcttcaattcaatatcgtgctctggctgataaagctactgatgctttttacaagcttagtaatactcgatcccagatccaagcctatgtgtttgatgttatcagagcgagcgttccaaagctaaatttggatgatgtctttgagcagaagaatcaaattgctaaagcagtggaggatgaacttgaaaaggcaatgtctgcttacggatatgagattgttcagacactcatagttgatatagagccagatgaacatgtcaagcgagctatgaatgaaatcaatgcagctgcaagaatgagagtagctgccaatgagaaagcagaagctgaaaaaattgtccagattaaacgagctgagggtgatgctgaggctaagtacctggcaggggttggggttgctagacaacgccaggccattgtggatggtttaagggacagtgttcttggcttctcaagtaatgtcccaggtacaagtgccaaggacgtcttggacatggtcctcatcactcaatattttgacaccatgaaggaaattggcgccacgtctaaatcctcagctgtctttatcccacacggacctggtgctgttagtgacattgcagggcagattcgacatggattgctccagggttcagctgttgagcaaaaaaatcttttataaatgtgtttcaccatgtctcgtgtgcttgtgatttgtatgtaatgtttcttcttgatgtgattgtgatggccattattgttcattatacatgtgtaattagat

SEQ ID NO: 3639 - DNA, 1447 bp, Ricinus communis
cttttgtatgctctcagattcctgaccaaagaggccccgttgaagcgaccaaaacagattaaagaacaaagagcacggctttgttaattccatctgaaacggaaaacgtatttctcgctcgtcaccttttcctagaaattacaattccttgcaatcgagttttctcctcctcctctccactatatgtatatatatacatgtgtatagaattctccctcactttcgtcttcttatctccgtgtttgcgttttagtgctttttcgcttttaatctaaacagaaaatgggacaagccctaggatgtgttcaagtggaccagtcaacagttgctatcaaggaaacctttgggaaatttgatgatgtgcttgaacctggttgtcattgtttgccttggtgtttgggaagccagttagctggtcacctctctttacgtgtgcagcagcttgatgttcgatgtgaaaccaaaaccaaggacaatgtgttcgttactgtggttgcttctattcaataccgagcactggcagaaaaggctgcagatgcattttataagctcagtaataccagagcacagatccaagcctatgtatttgatgttattcgggcaagtgttccaaagttggacttggattcagcctttgaacaaaagaatgatatagcaaaagctgtggaaaatgagcttgaaaaggccatgtcacattacggatttgagatagttcagactcttattgtggatattgagccagatgagcatgtgaagagggcaatgaacgagattaatgcagctgctagaatgagggtggctgccagtgaaaaagccgaagcagagaagatattgcagattaagcgagctgagggagatgcagagtcaaaatatctggcaggtcttggtatagctaggcagcgccaggccatcgtagatgggctgagagacagtgttctagctttctccgagaatgtaccagggaccagttcgaaggatgtcatggacatggttctggtgacacagtactttgataccatgaaggagattggtgcatcctcaaaatccagctctgtcttcattcctcatggacccggtgctgtgagagatattgccacacagatcagggatggtctgcttcaggccaactcgactcggtagaatctaaattttgtgaagcagtactgtagagggttttcttccacttttataaagtacagctaggccctgggttcatttcctttccttggtgcattttcttcgtttgaaggaaattctgggggaggggagaagtcccaggtgtcttttaagtaaataatcaatatgtatgcttggtagaattagtaatgaacttggtcagtgttgataatcatagaattaattttggtgctaaagatattttgaggatgttgattgtgtatatgatggatgatttgggttttcgaaatatttgagtccttaaatttga

SEQ ID NO: 3640 - DNA, 1443 bp, Ricinus communis
atgctctcagattcctgaccaaagaggccccgttgaagcgaccaaaacagattaaagaacaaagagcacggctttgttaattccatctgaaacggaaaacgtatttctcgctcgtcaccttttcctagaaattacaattccttgcaatcgagttttctcctcctcctctccactatatgtatatatatacatgtgtatagaattctccctcactttcgtcttcttatctccgtgtttgcgttttagtgctttttcgcttttaatctaaacagaaaatgggacaagccctaggatgtgttcaagtggaccagtcaacagttgctatcaaggaaacctttgggaaatttgatgatgtgcttgaacctggttgtcattgtttgccttggtgtttgggaagccagttagctggtcacctctctttacgtgtgcagcagcttgatgttcgatgtgaaaccaaaaccaaggacaatgtgttcgttactgtggttgcttctattcaataccgagcactggcagaaaaggctgcagatgcattttataagctcagtaataccagagcacagatccaagcctatgtatttgatgttattcgggcaagtgttccaaagttggacttggattcagcctttgaacaaaagaatgatatagcaaaagctgtggaaaatgagcttgaaaaggccatgtcacattacggatttgagatagttcagactcttattgtggatattgagccagatgagcatgtgaagagggcaatgaacgagattaatgcagctgctagaatgagggtggctgccagtgaaaaagccgaagcagagaagatattgcagattaagcgagctgagggagatgcagagtcaaaatatctggcaggtcttggtatagctaggcagcgccaggccatcgtagatgggctgagagacagtgttctagctttctccgagaatgtaccagggaccagttcgaaggatgtcatggacatggttctggtgacacagtactttgataccatgaaggagattggtgcatcctcaaaatccagctctgtcttcattcctcatggacccggtgctgtgagagatattgccacacagatcagggatggtctgcttcaggccaactcgactcggtagaatctaaattttgtgaagcagtactgtagagggttttcttccacttttataaagtacagctaggccctgggttcatttcctttccttggtgcattttcttcgtttgaaggaaattctgggggaggggagaagtcccaggtgtcttttaagtaaataatcaatatgtatgcttggtagaattagtaatgaacttggtcagtgttgataatcatagaattaattttggtgctaaagatattttgaggatgttgattgtgtatatgatggatgatttgggttttcgaaatatttgagtccttaaatttgataa

SEQ ID NO: 3641 - DNA, 1254 bp, Castanea mollissima
ttcccattctctctctctctctctctcagcaccaaaaccctcggagttttcggttagggagtgaaaaatgggtcaagctttatgttgtgttcaagtggaccagtcaactgtagccatcaaagaaacttttgggaagtttgatgatgtgcttgagcccggatgtcactgcttgccttgggttttgggacagcagttagctggccacctctctttgcgtgtgcagcagctggatgttcgatgtgaaacgaagacaaaggataatgtgtttgttactgttgttgcttccattcaataccgggccttggcagacaaagcttccgatgctttctacaaactcagcaacaccagagcacaaatccaatcctatgtctttgatgttattagagcaagtgttccgaagttggagctggattctgtttttgaacaaaagaatgagatcgcgaaagctgtggaagaggaacttgaaaaggccatgtcagcttatggatttgagattgttcaaactctcattgtggacattgaacctgatgaacatgtgaagagagctatgaatgagataaatgctgctgcaagaatgagggtggcagctaacgagaaggctgaagcagaaaaaatcctgcaaatcaaacgtgccgagggagacgccgaatctaaatatctggctgggcttggtatagcccgccagcgtcaagccattgtagatgggctgagggacagcgtgcttgctttttctgtgaatgtacctgggactacatcaaaggatgtcatggacatggttctggttactcaatatttcgacacaatgaaagaaattggtgcatcgtcaaagtccaattctgttttcatcccacacggaccaggagctgtgagagacattgcttcacagattagggatggcctccttcaaggaaataccgttcagaattagtgtcaaagtccaactctgctttcatcacacagggacctggagctgtgagagacttcacagattagggatggcctccttcaaggaaatattattcagaattactgacttttatcacagcatatatgttacatgagtggcttttcaatggaatatttgtgtattttattcttcttttcaactttcgtaagtattacatgagtgaagctaggagatagggagtgttttgcaagttgcaaactaagtgggatggtgtgtatacatggtcttgaacttggctatagtgtgataaatattctttatagtaaaaacggtattggtttgtgtaa

SEQ ID NO: 3642 - DNA, 1031 bp, Taraxacum officinale
atttccagctgcatctgatattctcatctttgtttgtatctctctttttctaatcttgcttctataaattgctttcgattcgcctttcccgtcctcttgttagtcttccacccacgctaaggtgtttgtgaaaatgtctgtgcagtagaggctgagtcttcttatagtggttttggtgtacgattatgggaaacctatgttgtttggttcaagtagaccaatctactgttgcaatcaaggaatcatttgggaaatttgatgatgttttggagcctggatgtcattgtgttccttggatatttggaaaacagcttgctggtcatcttactctaagagttcaacaattggatgtaaagtgtgagactaaaacaaaggataatgtgtttgtgaatgttgtggcttcgatacaataccgtgctttggctgataaggcaggggatgccttctataaacttagcaacacaaagtcccaaattcaggcatatgtttttggtgttataagagcttttgtaccaaagcacaacttagacgatacttttgaacaaaagaacgaaattgccaaagccgttgaacaagaactcgaaaaggccatgtctgcttatggatacgagatagttcaaacattaattgttgatatagaaccagatgagcatgtgaagaaagcaatgaacgagatcaatgcagctgcaaggtttagaatggcggcaactgaaaaagcggaagctgagaaaatccttcaaataaagagggccgaaggggaggcggaggccaaatatttagcgggcctaggtatagcccgtcaaaggcaggccatagtggatggtttgagagacagtgtgttagggttttcggtcaatgtccctgggaccaccgcaaaagatgtcatggacatggttttagtgactcagtattttgacacgatgaaggacattggtgcatcttctaaatcatcggctgtgtttatccctcatggtcctggtgcggttcgtgatgtggccaatcagatacgtgatgggcttcttcagggttcc

SEQ ID NO: 3643 - DNA, 1577 bp, Medicago truncatula
acttttagcatcattagtgagctagttagcttataattcaagctaactgtggaagaaacaacttttccaagtcagctttgatttgcaaatcctatcttttagttaatttgagttaaaagcaaatggggaatcttttgtgttgcgtgcaagttgatcagtctacggtggctatgagagaaggttttggaaaatttgaagaggtgcttcagccaggatgccattgcatgccatggttccttggaaaacgaattgccggtcatctctcccttcggctacaacaattggatataaaatgtgagaccaagacaaaggataatgtctttgtcaacgttgttgcttctattcaataccgtgccttggcagacaaggctaatgaggcattttacaaacttagcaacacaaggggccaaattcaagcttatgtttttgatgtaattagggccagtgttccaaaactctacttggatgatgcttttgagcagaaaaatgaaattgcaaaagctgtggaagaagaacttgagaaggctatgtcagcttatggatatgaaattgttcaaacactgattactgatatagagccagatgagcatgtgaagcgggctatgaatgaaatcaacgcagctgcaagaatgaggttagcagctaaggagaaagcggaggcagagaagatcttgcaaataaagcgagccgagggtgaggctgagtccaaatatctctctgggatgggtattgctcgccaacgtcaagccattgtggatggtttgagagacagtgtgattggattctcggttaatgtaccagggacaagtgcaaaagatgtcatggatatggtccttgtcactcaatactttgacactttgaaagaaattggggctgcctccaagtcttctgctgtgttcattccacatggacctggcgctgttcgcgatgttgctagccaaattcgcgatggacttctccagggttctcatcagtagcttctattcctcccacttcatatctgatttgtatggaagtgttgtgattttttaatgttttatgtctctgcagtatgatatactccctccatcctataataacggagccatttgtaaaaaaatatagtcccaagaatcttgactcatttcacttttcaatacaacattaattactttttttccaattataactctaattaatactactttcaccactttcaattcaatatttctactttacatttatcataaagaagaatgcaccaatacttgacaaagacactcaaaactatttttctctttcttttctttatacacttatcttaatctgtgtgaaatggaaaattggctcagttaaactgggacggagggagtatgattttgtgttagagtaaactgttaacttgatcctccaaatattacagtatcaactatcagttctgcaaagatatattttgtcattaaggtaatccttcaacaatttaaaaccatgtcacatattctattatggaaaatggtgacacaaaaatactaatttggtaattgttttgtatctttgtgggatcgatttggtaatgaagtatttgaagaactgtttaa

SEQ ID NO: 3644 - DNA, 1137 bp, Elaeis guineensis
aactcgcggtccttgaccgagcgagtgttcccaggattcttcttcgattcctgtttcctagtattgtcatcagttaagaaatggggcaggcttgttgttgcttacaagtggatcagtcaactgtggctatcaaagaaacttttggtaggttcggtgatgtgcttcatcctggatgccactgcttaccttggtgtttagggcatcagattgctggctacctctcattgcgtgtgcaacaacttgatgttcgttgtgaaacaaagacaaaggataatgtgtttgtcactgttgttgcatctatacaataccgtgctcttgctgacaaggcatctgatgctttctacaaacttagcaacacaagggaacaaattcaatcttatgtttttgatgtcatcagagcaagtgttccgaagctgaatttagatgatgcatttgagcagaagaatgatattgcaagagctgtggaagatgaacttgaaaaggcaatgtcaatgtatggatatgagatagttcaaacactcattgtggatattgagcctgacgagcatgttaagagagcaatgaatgagattaatgcagctgctaggctcagggtggcagcaaatgaaaaggctgaagctgagaaaatactgcagatcaagcgggctgaaggagatgcagaatccaagtacttagcagggcttggtatagcacgccaacgccaggccattgtagatggcctgagggacagcgtgctggccttctcagtaaatgtgcccgggacaacaccaaaggatgtcatggatatggtgctggtgacccagtactttgacaccatgaaagagattggagcatcctccaagtcctcgtctgtgttcatccctcatgggccaggggctgtgagggacattgctgcacaaataagggatggcctcctccaagccaacaccactctccagtaagaccaaatggatgctagttttccagttatgcagaatacgaaatgtgagatggtgtaaatagtgtgtttatataggtaagttatattgtctttagtgccttgttgattatgttttaggtgagttgttgaactagctattttcaaaacacagtttatgactgcactatcaaggtatatgggtggagataactattttt

SEQ ID NO: 3645 - DNA, 1685 bp, Populus trichocarpa
ctagctggttattatttgatgaaggtcccttatcagctgaaagcagggacagtcgtggtctggtttcgtttttctgcctagttgcctttctttagtagaaacaaaaggaatcaaatttagcatcacttcttaaggcacaagctactatcatacataaatcaatggagcagtatcgtagaaaatgctccggaaggccacttgtttattctttttccccccagctaatatgacatggattgataactacaagggctgtgatattaatcctcttccattgacttttgggtactggagaggtgatatatattatgttgtggggaacaaggcaggaaatttcttagatgattactgatataattaatcaattaacgcgtctatgagatatgctccaaataatacaggtcaagaacaatgttctgagccagaaaaacacttctcgtttttagctgtttcgaaatggcaggaaaggtcactgtttcccattagaatagtagcctggtgaaggcaatactggtggtaggtttctcttgtttttgaacgctttgaaacagctatatttatcctccgttctccatttgccttctccgtcatctgcactttctgtgaattaaagatatcagaaatcgcatacagaaatgggcaacctgttaggctgtgtaaaagtggaccaatccacggttgttatcaaggagagatttggaaagtttaatgaagttcttgaacctggatgccactgcatgccatggttccttggaagtcaggttgctggccatctcacacttcgattgcagcagttggatgttcgttgcgagacaaagacaaaggataatgtgtttgtcaatgttgttgcatcggtgcaataccgtgcccttgctcataaagcaagtgatgctttctacaaacttaccaacactcgatctcaaatccaagcctatgtttttgatgtgatcagggcaagtgttccaaaactactcttggatgatgttttcgagcaaaagaacgaaatagcaagagctgttgaagaggagcttgaaaaggccatgtctgcatatggttatgaaatcgtccagacactcattgttgatatagaacctgatgaacatgtgaaacgggccatgaatgagattaatgctgctgcaaggatgaggttagctgctaatgagaaagcagaagctgagaaaatcatccagattaagcgagctgagggtgaggctgagtccaagtacctagctggattaggtattgcccggcagcgccaggcaattgtggatggtctgagagacagcgtgcttggcttctctgataatgtgccaggaacttcagctaaggatgttttggacatggtgcttatcacacagtactttgacaccatgaaggagattggtgcgtccagtaaatcctcagcagttttcatccctcacggccctggttctgttagggacattgctacccagatcagagatgggctgcttcaggcatctgctcctcagtaactacctatacgttatggagcaaattccctatgctgttttgtgtgtttcttcatttaaactttaatcaaatggtatacgattgtgtaactgaagtagatacatacgagagctgctctcttgtatattctgtggttcttaatatatttgtgaattgcgtgcaattttcatccacatggttcactttgcttgtga

SEQ ID NO: 3646 - DNA, 1686 bp, Populus trichocarpa
ctagctggttattatttgatgaaggtcccttatcagctgaaagcagggacagtcgtggtctggtttcgtttttctgcctagttgcctttctttagtagaaacaaaaggaatcaaatttagcatcacttcttaaggcacaagctactatcatacataaatcaatggagcagtatcgtagaaaatgctccggaaggccacttgtttattctttttccccccagctaatatgacatggattgataactacaagggctgtgatattaatcctcttccattgacttttgggtactggagaggtgatatatattatgttgtggggaacaaggcaggaaatttcttagatgattactgatataattaatcaattaacgcgtctatgagatatgctccaaataatacaggtcaagaagaatattctgagccagaaaaacacttctcgtttttagctgtttcgaaatggcaggaaaggtcactgtttcacattagaatagtagcctggtgaaggcaatactggtggtaggtttctcttgtttttgaacgctttgaaacagctatatttatcctccgttctccatttgccttctccgtcatctgcactttctgtgaattaaagatatcagaaatcgcatacagaaatgggcaacctgttaggctgtgtaaaagtggaccaatccacggttgttatcaaggagagatttggaaagtttaatgaagttcttgaacctggatgccactgcatgccatggttccttggaagtcaggttgctggccatctcacacttcgattgcagcagttggatgttcgttgcgagacaaagacaaaggataatgtgtttgtcaatgttgttgcatcggtgcaataccgtgcccttgctcataaagcaagtgatgctttctacaaacttaccaacactcgatctcaaatccaagcctatgtttttgatgtgatcagggcaagtgttccaaaactactcttggatgatgttttcgagcaaaagaacgaaatagcaagagctgttgaagaggagcttgaaaaggccatgtctgcatatggttatgaaatcgtccagacactcattgttgatatagaacctgatgaacatgtgaaacgggccatgaatgagattaatgctgctgcaaggatgaggttagctgctaatgagaaagcagaagctgagaaaatcatccagattaagcgagctgagggtgaggctgagtccaagtacctagctggattaggtattgcccggcagcgccaggcaattgtggatggtctgagagacagcgtgcttggcttctctgataatgtgccaggaacttcagctaaggatgttttggacatggtgcttatcacacagtactttgacaccatgaaggagattggtgcgtccagtaaatcctcagcagttttcatccctcacggccctggttctgttagggacattgctacccagatcagagatgggctgcttcaggcatctgctcctcagtaactacctatacgttatggagcaaattccctatgctgttttgtgtgtttcttcatttaaactttaatcaaatggtatacgattgtgtaactgaagtagatacatacgagagctgctctcttgtatattctgtggttcttaatatatttgtgaattgcgtgcaattttcatccacatggttcactttgcttgtgat

SEQ ID NO: 3647 - DNA, 1059 bp, Scabiosa columbaria
gatatttatttccgtttgtcatttaccttttctctctctatatatattggggatccttcatatatatcctttcagttctcactagacgacttttcttccatcttcgtgtttatcgaatcgaaaaaatgggtggtatactttgttgcgtgcaagttgatcaatctactgtagcaatcaaggagcaatttgggaagtttgaggacgtgctggatccaggttgtcactgcctaccttggttccttggctatcaacttgctggccatctctcccttcgtgtgcagcagttggatgtgcggtgtgaaaccaagactaaggataatgtgtttgtcaatgtagtggcatccatacagtaccgtgccattgctgataaggccagtgaagctttctacaagctcagcaatacaagggctcagatccaggcctatgtttttgacgttataagaggaactgttccaaagatcaatcttgatgatgcttttgagcagaagaatgacattgctaaggctgttgaagacgaacttgaaaaggccatgtctggctacggatatgagattgttcaaacgcttattgttgatatagaacctgatgaacatgtgaagagagcaatgaatgaaatcaatgctgcggcccgattcaggatggctgctactgaaaaggctgaagctgagaaaattctgcaagtgaaacgagctgaaggtgaagcagagtccaagtacctttctggattgggtattgcacgccaacgccaagcaatagtggatggcttaagagacagtgtactgggtttctcggttaatgtgccagggaccacagcgaaggatgttatggacatggtccttgttactcagtattttgacacgatgaaggagattggtgcttcatctaaatcatcggctgttttcattccgcatggaccaggtgctgttcatgatattgctagtcagattcgcaatggccttcttcagggttcttctgctgatcatcattgattgtgtttgttctatcatatatgtgctaaatgtactcttggcaacacacttccattttaaagtttttggg

SEQ ID NO: 3648 - DNA, 1225 bp, Trigonella foenum-graecum
tttgcattgtatcggaacctacctagcttcctttatacattctcttctcttctctctctctcaagtctcactatattgttaaccgttttgaaggaacgattgattcactgatcaaaaccaaacaacgaacggttaaaagcaaatggggaatcttttctgttgtgtgcaagttggccaatctacagtggctatgaaagaaagttttggaaaatttgaagaggtgcttcagccaggatgccattgcatgccttggttccttggaaagagaattgctggtcgtctctctcttcggatacaacaattggatataaaatgcgagaccaagacaaaggataatgtctttgtcaatgttgtggcttctattcaataccgtgccttggcagacaaggccaatgaggcattttacaaacttagcaacacaaggagccaaattcaagcttatgtttttgatgtaattagagcatatgttccaaaactcaacttggatgatacttttgagcagaaaaatgaaatcgcaaaagctgtggaggatgaacttgaaaaggctatgtcagcttatggatatgaaattattcaaacactgattgttgatatagagccagatgagcgagtgaagcgggctatgaatgaaatcaatgctgctacaagattgaggatggcagctaatgagaaggcagaggcagaaaagatcttgcaaataaagcgagccgagggtgaggctgagtctaaatatctctctgggctgggaattgctcgtcaacgtcaagccattgtggatggtttgagagacagtgtgattggattttcagataatgtacccgggacgagtgcaaaagatgttatggatatggtccttgtgactcaatactttgacactatgaaagaaattggtgcttcctccaagtcttctgctgtgttcattccacacggacctggtgctgttcgcgatgtagctagccaaattcgtgatggacttctccagggttctcatcaatagcttctattcggcatacaccgtatctaatttgtatgggagtgtagtgaatttttaatgcttttggttgtaatggttcagtatgttatatgattttcttcattatgaaagttgcatccacgaatttttttatgtaatttttgagagtgctcaaatttaaatactatggtagtatgttttctacctcatgttgtttgcacaaaagaaaaattcttgctgctgtctccacct

SEQ ID NO: 3649 - DNA, 1067 bp, Allium cepa
aataaataaaatcacactgttagcaagaacagataatgggtaacttgttgtgctgtgtgcaagtcgatcaatctacggtagctgttaaagaacagtttggaaagttcgacgagattcttgatccaggatgccattgcatgccttggtttcttggtaaaagagttgctggttatctttcccttcgcgtgcaacaactagatgtcaaatgcgagactaaaactaaggacaatgtttttgttaatgttgttgcatccattcagtatcgtgctctggccagcaaggcaagcgatgcattttataggctgagtaatacaaggttgcaaatccaggcttacgtgtttgatgtgatcagggcgactgtcccgaagcttatactggatgatgttttgaacaaaagaacgacattgcaaaagcagttgaagatgaactcgagaaagctatgtctgcttatggatatgaaatcgtgcagaccctcattgttgatattgaacctgatgtcaatgtgaaaagggcaatgaatgaaatcaatgcagctgcaaggatgagattggcggcaaatgacaaggcagaagcagagaaaatcctgcaaataaaaagagcagaaggagaagcagaatcgaagtacctttcagggcttggaattgccaggcagcgccaggcaatagtggacggactaagggacagcgtccttggcttttcagtgaatgttcctggcaccaccgccaaagatgtaatggacatggtcctggttactcagtatttcgatactatgaaggagatcggcgctgcttctaagtcatctgctgtgttcattccccatggccctggcgctgtcagagatgtggctactcagataagggatggactgcttcaggcaaacgttgatcaataatttaaagtagattgctgcatagcttttgcgcgtgcttttagtgttgctttttttttctttctacgtggattgtgatttgttaagacttatgcttgctttttataatggttggtttgttgaacattccatcctggtttgactggtttcaatgtgcaattatatatatgtcttgttg

SEQ ID NO: 3650 - DNA, 1418 bp, Medicago truncatula
ctacctactaatctttgagatatttttccacaagtcttatctgctgcgaattaaaactaaaagtaatcccatatacttgtacgtagttttccccaattctgatgaatttctgttgacccaccaccgcttctgaacccacaccacagttaaaagaaaatggggaatcttttgtgttgtgtgcaagttgatcaatctacagtggctatgaaagagggttttggaaaatttgaagaggtgcttcagccaggatgccattgcatgccatggttccttggaaaacgaattgctggtcatctctctcttcggctacagcaattggatataaaatgtgagaccaagacaaaggataatgtctttgtgaacgtcgttgcttctattcaataccgtgccttggcagacaacgccaatgatgcattttacaaacttagtaacacaaggtcccagattcaagcttatgtttttgatgtaattagagcatatgttccaaaactcaacttggatgatacttttgagcagaaaaaatgaaatcgcaaaagctgtggaagaagaacttgagaaggctatgtcagcttatggctatgaaattgttcaaacactgattgttgatatagagccagacgagcatgtgaaacgggctatgaatgaaatcaatgccgctgcaagaatgagagtggcagctaaagaaaaggcagaggcagagaagatcttgcaagtaaagcgagccgagggtgaggctgaatctaaatatctccatggggtgggtattgctcgtcaacgtcaagccattgtggatggtttgagagacagtgtgattggattttcagttaatgtaccagggacaagtgctaaagatgtcatggatttggtccttgtcactcaatactttgacactatgaaagaaattggtgctgcctccaaatcttctgctgtgttcattccacacggacctggtgctgttcgcgatgtagtaagccaaattcgtgacggacttctccagggttctcatgagtagcttctattcctcctactttttatctgatctgtataagagtgcggtgattttttaatgctttttgtctctgcagtatgtcatatgactttgtgtgagggtaaactgctaatttggtcctccaaatattatggtatcacttatcgatcttgtaaagatatttttgtcgttaaggcaatccttcaatgatttgaaatgttttggatttggtgataaagtctttggagggcgatttagtgcaactactattgtattatacttgcagattgtaactcttattaccgatacgagttttgtacattataaattatgcacaactagatatcagatagccctgtataatgtatagacaagttttctaaattgtgaaagttgcattcgagaaaaaatttatatactgtttgggagt

SEQ ID NO: 3651 - DNA, 1245 bp, Amborella trichopoda
aatcttagcccattgacacctcactctgacgcaaacccatcgctggccattgaaggagtttctgcttcggtctgccgattatgccaaggaactgtttctctctgtaggctttctctctctagagtgagccatgggtcaatttctttgttgctgtattcaagtggaccagtcaactgtagctattaaagagaggtttgggcgatttgatgatgtgcttgagccaggttgccattgcatgccatggtttcttggtagccagcttgctggtcatctcacattacgtttgcaacaacttgatgttagatgcgaaacaaagaccaaggataatgtctttgttaccgtagttgcttccattcagtatcgtgcgcttgctgataaggcaagcgatgctttctacaagctaagcaatacaaggacacaaatccaagcatatgttttcgatgtgatcagggcaagcgttccaaagctcgacttggatgatgtctttgaacagaagaatgatattgccaaggctgtggaagatgaacttgagaaggcaatgtctgcttatggataccagatagtgcagactctgatagtggatattgaaccagatgagcatgtgaagagagctatgaacgagatcaatgcagcctcacgaatgaggttggctaccaaggagaaggcagaggctgagaaaataatccaaatcaaaagggcagagggtgaagcagaatccaaatacctcgctggtctcggaattgcacggcaaaggcaagccattgttgatgggttgcgagatagtgtacttggattttcagtgaatgtaccaggaaccactgctaaagatgttatggacatggtcctagttacccaatatttcgatacaatgaaagagataggggccacttcaaaatcatctgctgtgttcattcctcatggccctggtgctgttcgtgatgtagctgcacagattagggatggattgcttcagtcgcaagtccaccatgaatagtgagtgattaatccctcccctcaaatcccacttaaaaaaaaagctgcgttcctttgattgaactgtttaagtattgggatttctctgatctcccatgttatttcatgctctctctttctccatgctctttctataaagacttatagaaccttttgtgaatcagttggctgcttttctagtgagataatgttactttcgttgaatgtgataaaatctctgttgtttgcacttttccttgttcttttctgaat

SEQ ID NO: 3652 - DNA, 1336 bp, Catharanthus roseus
acaaataactgagtcaacggcactaaaatcaacggaattatgaaggtctgtccagtggaagaattatcttcttcttcatgtgaagattcaaatagggggatttcttcgttttcatttcctcttactggtattcatgtaacgacagcttcagtattcccattctcaaattcatctgcaactctccactcggctctcagcctcagcttaactgaatcttaagagtatggggaaccgattgtgctttgtgcaagtcgatcaatccacagtttcgattaaggaaaggtttggcaagtttgatgaagtgcttaatcctggctgccatttccttccgtggtgtttgggaagtcaaattgctggcaatctatctcttagggttcagcaactggatgttcgttgtgagactaagacaaaggacaatgtgtttgtcactgtagtggcatcaatacaataccgagccctggctgaaaaagcaagtgatgctttttacagactcactaatactagaaaccaaatccaagcctatgtctttgatgtcatcagagcaagtgttcctaagctgattttggatgatgtttttgagcagaagaatgatattgcaagagcagtagaagatgaacttgaaaaggctatgtctacttacggatatgagatcgttcagacccttatcgtcgatatagagccagacgagcatgtgaaacgagctatgaatgaaattaatgcagccgcaaggttgagggttgcagctaatgagaaagcagaagccgagaagattatccagatcaaacgagctgaaggggaggcagagtccaagtacttggcaggattaggtgttgccagacagcggcaagcaattgtggatggtctgagggacagtgtgcttggtttctcggggaatgtccctggtactactgccaaggatgttatggacatggtcctcgttactcagtatttgataccatgaaggaaattggtgcaacctcaaaatcctcagctgttttcattccacatggaccgggtgctgttcgtgacattgcccagcagatccgagatggattactccaagctactacatcccactagcaaccagaaattctgtgaagggggatttaagtctaccggcttttataaactctatgttgctttctttgtatattaacttaagtggcatttgtgtggatttgttaaggatcatcacgtagagaaatatctgcatgtgtgtgaatttgttatttgtattttttttttttgtcaggcgtgtaaatttgtagtatagtgtcaaggaaatattccctcttttttcatattatctcatattatttgcagacaattgtttaac

SEQ ID NO: 3653 - DNA, 1216 bp, Lactuca sativa
aaagactgcaaactatctccttctcctctaccatcctaccgccttgtgccagccaatccttctcctccatctttttactttgaacgtggatcttcgtaacaagtataagatcgatcatgggaaacctattatgtttggttcaagtggatcaatcgactgttgccattaaggaaacttttgggaagtttgatgatgttctccagccaggttgtcattgtgtgccttggatttttggaaggcggcttgctggacatctcaccctaaggcttcgccagttggatgtcaagtgcgagaccaaaacaaaggacaatgtctttgttaatgttgtagcttccatacagtatcgtgctctggctgataaggcaagtgaagcattctacaaactcaccaacacaagtacccaaatccaggcctatgtttttgatgttataagagctagtgttccaaagcttaaccttgatgatgtttttgagcaaaagaatgaaattgccaaggctgttgatcgtgaacttgaaaaggcaatgtccgcatacgggtttgagattgttcaaacattgattgtcgatatagaaccggatgaacgtgtgaagaaagcaatgaatgagatcaatgcagctgcacggatgaggttggcagctattgagaaaggtgaggcagagaagatacttcagataaaaagggctgaaggagaggctgagtcaaagtatttgtctggattgggtattgcacgacagagacaggcgattgtggatggtttaagagacagtgtgttggggttttcggttaatgttccagggacaacagctaaagatgtgatggatatggttttagtgactcagtattttgacaccatgaaggaaatcggtgctgcatccaaatcatctgcagtgttcatccctcatggacccggtgctgttcgtgatgtggctgctcagatacgcgatggacttcttatggggagtgccaccacttgatcctaatcctgatcctcaactatgttaatgtaacatatacttttggagtgacatatatgtataataacaatatatttttatgtttcttatgattgtgtttgtaactttgtatccatggatttttgtatagttgtgtgtttatgtatatttgccgcattaggtggtttgtagatatcggttttaattcaatgtctcatttagttttgtcttttgtttattcaaatctatgtgtttaaatggaa

SEQ ID NO: 3654 - DNA, 1365 bp, Manihot esculenta
ggggacgtgccacaaaaccttttgctttcacatttttctattctacttttatatatatatatatatatatgtaaacctccttgttcttggtcagtgatgaatccttgtatcttgcaaagaaaatgggacaagctctgggttgtattcaagtggaccagtcaactgtagctatcaaggaaacctttgggaagtttgatgatgtgcttgaacctggttgtcactgtttgccttggtgtttggggagccagttagctggtcatctctcattacgtgtgcaacagctggatgttcgatgtgaaaccaaaaccaaggacaatgtatttgttactgtggttgcttctgttcaataccgagcactggcagaaaaagctgcagatgctttctataagctcagcaataccagagcacagatccaagcctatgtctttgatgtcattagggcaagtgttccaaagttggagttggattcagcttttgaacagaaaaatgagatagcaaaagccgtggaagatgaacttgagaaggccatgtcacattacggatttgagatagttcagactcttattgtggatattgagccagatgagcatgtgaagagggcaatgaatgagatcaatgcagctgcaagaatgagggtggctgccaatgaaaaagctgaagcagagaagatattgcagatcaagcgagctgaaggagatgcagagtcaaaatacctggcaggtcttggtatagctaggcagcgccaggccattgtagatggactgagagatagtgtactagctttctctgttaatgtaccagggacaacttcaaaggatgtcatggacatggttctagtgacccaatactttgacaccatgaaggagattggtgcatcctcaaagtccaactctgttttcatacctcatggaccaggtgctgtgagagacattgctacacagatcagggatggtcttcttcaggccaattctaatcagtagcattacaagtttctatagcatttgaaggaatttggtggtattgtaaaaggctcttcgatcttgctttctctgcacaaattcctctatgcatgccctcaactggaaagtaatccctggagaaaaatatcgaagtttctaactataatccaagtgcatttctttatatgcttcgtggaattagtaatgaactaagctgcaatgttcatatttatattgaacttggttatggcgctaggatatttccgttatgttgatataaatacgtacttgtagtgttggatagcaagtttatgatcttttcgggtcaatggaacaatgtcttgttcattgttatgtggggaaaaatgtttaataaataattctgcattggtggaattgcttgagc

SEQ ID NO: 3655 - DNA, 932 bp, Cirsium arvense
ggtcttgatcagtataagatcatggggaacttattctgtttggttcaagtagatcaatccactgttgctatcaaagaaacttttggaaagtttgatgatgttctcgaccctggttgtcattgtgttccatggatcttcggaagtaagcttgctggtcatctcacactaaggattcagcagttagacgtcaagtgcgagaccaaaacaaaggacaatgtctttgtgaatgttgttgcttcaatacaataccgtgctctagccgagaaggcaaatgatgcattctataaactcagcaacactaggtcccaaatccaggcctatgtttttgatgttatacgagctagtgtcccaaagctttatcttgatgatgtttttgagcaaaagaacgatattgccaaggctgttgaggaagaacttgcaaaggcaatgtctgcatatggctatgagatcgttcaaacattgattatcgatatagaaccagatgagcgtgtgaagaaagcaatgaatgagatcaatgcggctgcaaggatgcggttggccgctactgagaaagctgaggccgacaaaattctccaaattaagagagccgagggtgaggctgagtcgaagcacctgtcgggtttgggtatcgcacgccaacgtcaagccatcgtggacggtttgagagacagtgtgttggggttctcggtcaatgtgcctggaaccacgactaaagacgtgatggacatggttctagtcactcagtatttcgacaccatgaaggaaatcggtgcttcttctaaatcatccgccattttcattcctcatggacccggtgcggttcgtgatgtggctacgcagatacgcgatggacttcttcagggcaactctgctagctagctgatcgataactttggttaatatatttatttaaactttggagtgaaatgcat

SEQ ID NO: 3656 - DNA, 1012 bp, Lactuca sativa
cagtcaatccttctcctccctctttttactttgaacttggatcttcataacaagtataagatcgatcatgggaaacctattatgtttggttcaagtagatcaatcgactgttgccattaaggaaacttttgggaagtttgatgatgttctccagccaggttgtcattgtgtgccttggatttttggaaggcggcttgctggacatctcaccctaaggcttcgccagttggatgtcaagtgcgagaccaaaacaaaggacaatgtctttgttaatgttgtagcttccatacagtatcgtgctctggctgataaggcaagtgaagcattctacaaactcaccaacacaagtacccaaatccaggcctatgtttttgatgttataagagctagtgttccaaagcttaaccttgatgatgtttttgagcaaaagaatgaaattgccaaggctgttgatcgtgaacttgaaaaggcaatgtccgcatacgggtttgagattgttcaaacattgattgtcgatatagaaccggatgaacgtgtgaagaaagcaatgaatgagatcaatgcagctgcacggatgaggttggcagctattgagaaaggtgaggcagagaagatacttcagataaaaagggctgaaggagaggctgagtcaaagtatttgtctggattgggtattgcacgacagagacaggcgattgtggatggtttaagagacagtgtgttggggttttcggttaatgttccagggacaacagctaaagatgtgatggatatggttttagtgactcagtattttgacaccatgaaggaaatcggtgctgcatccaaatcatctgcagtgttcatccctcatggacccggtgctgttcgtgatgtggctgctcagatacgcgatggacttcttatggggagtgccaccacttgatcctaatcctgatcctcaactatgttaatgtaacatatacttttggagtgacatatatgtataataacaatatatttttatgttgta

SEQ ID NO: 3657 - DNA, 1201 bp, Cucumis melo
gtttgacttaacttttgcttattcaattatttcaactccttgcaactgcggcaaaaggttgttccagacctaaattttgatttattcgatttcttttctggacatcaacagtgatttttgttgataactcagaatgggtcaagccttaggttgcattcaagtcgaccagtcaactgtagcaatcagagaaacgtttgggaaatttgacgatgtgcttcaacctggttgccattgtctaccatggtgccttgggagccagatagctggtcatctttctttacgtctccagcagcttgatgttcgctgtgagacaaagacaaaggacaatgtttttgtcactgtcgttgcctctattcaataccgagccctagcagacaaggcttcagatgctttttataagcttagtaatacaagagaacagatccaggcatacgtttttgatgttattagggcaagtgttccaaagttggacctagattctactttcgaacagaagaatgatattgcaaaggccgtcgaagatgagctggagaaggccatgtcagcttatggatacgagatagttcaaactctaattgtggacattgagccagatgagcatgtaaagcgagcaatgaatgaaataaatgcagctgcgagactgagagttgctgcaactgagaaagctgaggcagagaagatattgcagattaagagagctgaaggagatgccgaatccaagtatctggccgggcttggtattgcacggcagcgtcaagccattgttgacgggctcagagacagtgtactagcatttgctgaaaacgtccctggaacgacgtctaaggatgtcatggacatggttcttgtgactcaatacttcgacacgatgaaggagattggagcgtcatcaaagtctaattctgtgttcattccacatggacctggtgcagttaaagatattgcttcacagatcagggatggtcttcttcaagcaagccaaactcagtagatgggtcaagattgaagatacttgtgaagatggtatatatattaagtgtgtagaatatgatatttgtttgtgtatgggtttggttgttttgtttaatttgcaaatttatgttctgtgttacgactgatacatatagttatcttttaaatgaatagtgctctaaataaatagtcactctcttaatcaagtgattttaataataagcctttc

SEQ ID NO: 3658 - DNA, 1239 bp, Mimulus guttatus
aagaacgacttggctccttaaaatccacagcttggtttcgtgatcataaattgataaacattaaatactaaataatacctccccataataattacaccaccactctttaatccgagttcatttacaaaatctgaatttacacccaaaaaaatctttctacggttagaggtatttatcgggaaagaaaatgggtcaagctttcggttgtattcaagtggatcagtctacagttgccgtgaaggaacagtttggcaaatttgacgaggtactcgagcccggctgccattttctgccatggtgtatcggctatcaattagccggttcgctaacattgcgtttgcaacagcttgatgttcgttgtgaaacaaaaaccaaggacaatgtgtttgtcacggtggttgcttcgatccagtaccgagcattggcggacaaagcagccgatgcgttttataagctatccaacactaaagaacagatccaagcttatgtttttgatgtcataagagcgaccgtaccgaaactggatttggactcgacttttgagcagaagaatgacatagctaaagctgtggagaatgaacttgaaaaggcaatgtctgcgtatggtttcgagatagttcagacactgattgttgacattgaaccagatgctcaggtcaagagagcgatgaacgagataaacgcagccgctaggctaagggtagctgcaaccgaaaaagccgaagccgaaaaaatattacaaatcaaaagggcagagggagaggcagaatccaagtacttatcgggcctcggtatagcccgtcagcgtcaggccattgtagacggtcttagagacagcgtaatagccttctccgagaatgtacctggtacttcagctaaggatgtaatggatatggtactcgttacgcagtacttcgacactatgaaggaaatcggagcatcttcgaaatcatctgccgtttttatccctcacgggcctggagctgttaaggatattgctacacagattcgtgagggtcttcttcaggggtctgctgcgtctactagttaacgtttcgggggtgttttcgtctttttgttgctttgttagatatatataaatattgtgtattgcttttctttttcattgaatgtgtaagtttgatttttttttgtaattgtgcatgggttctttggctactgtaatgtgcaagtttgagttgattgttaccatctttttgaaatatttaatttttattc

SEQ ID NO: 3659 - DNA, 1267 bp, Mimulus guttatus
acattaaacaagaacgacttggctccttaaaatccacagcttggtttcgtgatcataaattgataaacattaaatactaaataatacctccccataataattacaccaccactctttaatccgagttcatttacaaaatctgaatttacacccaaaaaaatctttctacggttagaggtatttatcgggaaagaaaatgggtcaagctttcggttgtattcaagtggatcagtctacagttgccgtgaaggaacagtttggcaaatttgacgaggtactcgagcccggctgccattttctgccatggtgtatcggctatcaattagccggttcgctaacattgcgtttgcaacagcttgatgttcgttgtgaaacaaaaaccaaggacaatgtgtttgtcacggtggttgcttcgatccagtaccgagcattggcggacaaagcagccgatgcgttttataagctatccaacactaaagaacagatccaagcttatgtttttgatgtcataagagcgaccgtaccgaaactggatttggactcgacttttgagcagaagaatgacatagctaaagctgtggagaatgaacttgaaaaggcaatgtctgcgtatggtttcgagatagttcagacactgattgttgacattgaaccagatgctcaggtcaagagagcgatgaacgagataaacgcagccgctaggctaagggtagctgcaaccgaaaaagccgaagccgaaaaaatattacaaatcaaaagggcagagggagaggcagaatccaagtacttatcgggcctcggtatagcccgtcagcgtcaggccattgtagacggtcttagagacagcgtaatagccttctccgagaatgtacctggtacttcagctaaggatgtaatggatatggtactcgttacgcagtacttcgacactatgaaggaaatcggagcatcttcgaaatcatctgccgtttttatccctcacgggcctggagctgttaaggatattgctacacagattcgtgagggtcttcttcaggggtctgctgcgtctactagttaacgtttcgggggtgttttcgtctttttgttgctttgttagatatatataaatattgtgtattgcttttctttttcattgaatgtgtaagtttgatttttttttgtaattgtgcatgggttctttggctactgtaatgtgcaagtttgagttgattgttaccatctttttgaaatatttaatttttattcatttattttattatatata

SEQ ID NO: 3660 - DNA, 1663 bp, Quercus alba
aattttcattgcttagtagaatcagtctttatcagaagcgtttttgctatgtgggtctgtcttattgcattgctttctatttaagtaaaaatgtcttctttcttgttgttgcggtgtgaattggttcttttcatttttaatattcttggtttgttaagaatttcattcccagatagatactgcccgggtgatttttttacatgatgacagttataacttgtttgttctaactatatatgtagctgtttgattgattgtgagtttgatatcagttccaactatttttgttcacaagtgaaaaatgggccaagctttatgttgtgttcaagtggaccagtcaactgtagccatcaaagaaacttttgggaagtttgatgatgtgcttgatcccggatgtcactgcttgccttgggttttgggacagcagatagctggccacctctctttgcgtgtgcagcagctggatgttcgatgtgaaacgaagacaaaggataatgtgtttgttactgttgttgcttctattcaataccgggccttggcagacaaagcttctgatgctttctacaaactcagcaacaccagagcacaaatccaatcctatgtctttgatgttattagagcaagtgttccgaagttggagctggattctgtttttgaacaaaagaatgagatcgcgaaagctgtggaagaggaacttgaaaaggccatgtctgcttatggatttgagattgttcaaactctcattgtggacattgaacctgatgaacatgtgaagagagctatgaacgagataaatgctgctgcaagaatgagggtggcagctaatgacaaggctgaagcagaaaaaatcctgcaaatcaaacgtgccgagggagacgccgaatctaaatatctggctgggcttggtatagcccgccagcgtcaagccattgtagatgggctgagggacagcgtgcttgctttttctgtgaatgtacctgggactacatcaaaggatgtcatggacatggttctggttactcaatatttcgacacaatgaaagaaatcggtgcatcttcaaagtccaactctgttttcatcccacacggaccaggagctgtgagagacattgcttctcagattagggatggcctccttcaaggaaataccgttcagaattagtgccaaagtccaactctgttttcatcccacatggagctggagctgcgagagacattgcttcacagattagggatggcctccttcaaggaaataccagtcagaattagtgacttttattgcagcatatatgtttcatgagtggcttttcaatggaatacttgtgtcttttattcttcttcttttctactttcgtaagtattacatgagtaaagctaggagttagggagtgtcttgcaagttgcaactaagtggtgtggcgtgtatagatggtcttgaactctgccatagtgtgatcaatattctttatagtaaaaacgatattggtttgtgtaaatttgtggtatcctctggttttatgctattttgtaaatgttgtctgcattttgtgaatggttccctttgatgggtttgctttgagaacagaccaaaatttgcagtaataatggttacttagtagtacaatgatttaaaaaaaaaagttaattaatcgctagagacacg

SEQ ID NO: 3661 - DNA, 1180 bp, Silene vulgaris
aggaatacagcaatcacatatctctctctccctctttcttctgcacttgtattatttgccaccaactttttatttcttctctttgattaagccgaatttcaacaaaaggaatggggaatctgctatgctgtgttcaagttgaccaatcaacagttgctattgaggagagctttggaaaatacacagatgtgctggagccagggtgccattgtgtgccttggtttctgggttaccagatagccggcaagctcactcttcgtgttcagcagttggatgttcgttgtgagaccaaaaccaaggacaatgtgtttgtgaatgttgttgcatcaattcaatatcgtgccattgcggagaaagcaagtgatgcattttacaagctgagcaacactcgctcacagattcaggcttatgtttttgatgtgataagaggtactgttccacggctaaatttagatgatgtgtttgagcagaagactgaaattgccaaagcagttgctagtgagctagagaaagccatgtctcattacggatttgagattgttgaaacactcattgttgatattgagcccgatgaacaggtcaagcgtgctatgaatgaaatcaatgctgctgccaggttgcggctggcaacaagtgagaaggcagaagcagagaagatcatacagatcaaaagggcagaaggagaggcagaggccaaatatttatctggcctgggtattgccaggcagcgacaggccatcgtagatggacttagagacagtgtgttaggcttctcagttaatgttcctggaacttctgccaaggatgttatggacatggttctcgtcacccaatactttgacaccttgaaggaaattggggccagttctaaatcatcagcagtgtttatcccacacgggcctggcgctgtgcgtgatgttgccacccagatccgagatgggttgcttcaggcatcgtctatgtctacgtcttagcctacacccttgatcgagtttactgtttgttgtcctcctatcactttgtgaagaaaaaaaatataactattgtttgtgcctatttgagtttttgactatttttttttaatatttgaaagtcatttattcttgttttttagttaatgaaggtgaattgtaaatttgaatgtggtcttatggattttgtcgtcttcataatgaaattc

SEQ ID NO: 3662 - DNA, 1350 bp, Fragaria vesca
tttcaccgctacttcacaagaaagttaccccgaaacaagtgacggtaaaaatactcttccccatcgctttccttataaatatggagagaataaacctatttctctacagtctctttgtgaatcttctctctcatttcctcgctctcttgctttgttctacttctacaggatcacaaaatgggacagtgccttggttgtgtccaggtggaccagtcgactgttgcaatacgagaaacttttgggaagtttgatgatgttcttgaacctggttgccattgtttgccttggtgcttgggtagtgcaatagctggtcatctatcgctacgactgcagcaattggatgttcgctgtgaaacaaagaccaaggataatgtttttgttactgtggttgcttctattcaatatcgagctctggctgataaagcttcagatgccttctacaagctcagtaataccaggggccagatccagtcttatgtctttgatgttatcagggcaagtgttccaaaactggatctggattcaacctttgaacagaagaatgatatcgccaaagctgtggaagaagaacttgaaaaggccatgtcacattatgggtttgagatagtacagactttgattgtagatattgaaccagatgagcatgtgaagagagcgatgaatgagattaatgcagctgctaggatgaggttggctgctactgagaaagctgaagccgagaagatactacagattaagcgtgctgagggagaggcagagtccaaatatctgtcagggcttgggatagcaaggcagcgccaggctattgtggacgggctgagagacagtgtgctggccttctctgagaatgtacccgggacatcatcaaaggatgtcatggacatggttctggtgacccagtactttgacacaatgaaggagatcggtgcatcttcaaagtccaactcggttttcatccctcacggacctggtgctgtgaaagacattgcttcacagataagagatggtctcctccaaggaaattcatctcgttcgtaatgtcctgatacagaagtatgaagttggagttgcgacatctataagcttcaacgtattgtcagctctattatgcaaggcttattactaagactcggtttaggtgtgctgtctatattcgacatttatagtccttatattggtggatttgaacgttttactatgcttggttcatagttggtgctagaagcgattgagctcttatattacctattgtttggctgtttgcttattagttttcactttcgtgcaaccctcaaattcattttcatatctattgtccaccaatatatttatatatatatatattatttt

SEQ ID NO: 3663 - DNA, 1173 bp, Tripterygium wilfordii
agaatcagaaatgggacaagcattttgttgtattcaagtggaccaatcaaatgtagcaatcaaagaaacctttgggaaattcgatgatgtgcttgaacctggttgtcactgtttgccttggtttcttgggagccagttagctggtcacctttctttgcgtgtacagcaactggatgttcgatgtgagaccaaaaccaaggataatgtgtttgttactgtggtggcttccattcaataccgagccttagcagaaaaggcgtctgatgctttttataagttgagtaataccagagcacagatccaagcttatgtctttgatgttattcgggcaagtgttccaaagttggacctggattcaacctttgaacagaagaatgatatagcaaaagctgtggaagatgaacttgagaaggctatgtcgcattatgggtacgagatagttcagacacttattgtggatattgaaccagatgagcatgtgaagagagcaatgaatgaaataaatgcagctgctagaatgaggttggctgcaaatgagaaagctgaagcggagaagatattgcagataaagcgagcagaaggagatgctgagtcaaagtatttggcagggcttggtatagctcggcagcgccaagctatcgttgatgggctgagggacagtgtgcttgccttctctgaaaatgtaccagggacaacatcaaaagatgtcatggacatggttctggtgacccaatactttgacacaatgaaggagattggtgcatcctcaaagtccaactctgtgttcatcccacatggaccaggtgctgtgaaggacattgctgcacagataagggatggtcttcttcaagcaaacactactacttagtgctagttcaagatccaacttggacatgtggcttatgaaggtttgtattgtatatggagatttgatggcaaaaaataaagcatataagaaaagcagcagtactatgagatgcatttacatggttttagtagtagatttatatttgcagaggtacttgttagcacactattgtttgtgtatagattcctattaaactggattgtggtatatttctgaagtgttgtgacaaactcatgtaattatgtaaatatggttcttctgcttgtactaaaattctgaagataggatgccataacttttgaatg

SEQ ID NO: 3664 - DNA, 1400 bp, Prunus mume
ctttacacggtgacaaacaaatggctttcgcgcactcggaaaattcagcgaaatagctgtccgcgaaagcgactcgtaacttccccgcgaggcttaaggctcatccgaatttttatttacctttgtataagtatctatttctttgcaattcatttcccccaatttcacgtggttgtgggaatttgtgctctctctctctctctctctcttgccctcgctcgcttcctttctgttagatttgcagacgaacgcttccagttccgagacgtacatagctggaattctcactaaaatgggacaagctcttggttgtgttcaagtggaccagtctactgttgctatcagagaaacttttgggaagtttgatgatgtgcttgaacctggttgtcactgtttgccttggtgtttgggtagccagatagctggtcatctctctttacgtgtgcagcaattggatgttcgctgtgaaacaaagacaaaggataatgtttttgttactgtggttgcatctattcaataccgagctttagctgagaaggcttcagacgccttttacaagctcagcaataccagagggcagatccaatcttatgtctttgatgttatcagggcaagtgttccaaagttggatctagattcaacctttgagcagaagaatgacatagccaaagctgttgaagaagaacttgaaaaggccatgtcacattatgggtttgagatagttcaaacgctaattgtggatatcgaaccagatgagcatgtgaagagagcaatgaatgagatcaatgcagctgcaaggatgaggttggctgcaactgagaaagctgaagcagagaagatattgcagattaagcgagctgagggagaggcagagtccaaatatctgtcagggcttggaatagcaaggcagcgccaggccattgtggacgggctgagagacagtgtgctggccttctctgagaatgtgccagggacatcttcaaaggatgtcatggacatggttctggtgacccagtactttgacacaatgaaggagatcggtgcatcctcaaagtccaattcggttttcatcccacacggccccggtgctgtgagagacattgcttcacagatacgagatggcctccttcaagcaaatccacctcaggtgtaatgtaattacgtggtacgaagttggaggccggctctttaagcttccgatcagtgctattatgcaggactgaagtttgtgtgtgctttaggatctaagaatgtggtttctttagtatttgacatataacgtgtataatatgtaggtgatttctccatgcttcttgatacccggcctctaaagggtttgaactttatgtagtatagagaactgattcaatatatttggttggtttttgttagaggtgttt

SEQ ID NO: 3665 - DNA, 1582 bp, Theobroma cacao
gtggtttgtaaagcgacggcgcaaaatatcttctacgcgctgaaacagacaaaacgactagggaatagaaagacttgtctcttcccattccgtccctatcccaattcgtcgcactttctcatacgtcgtcgtctttccccgaaattgctttagttctaattcgaactattaaattatcatcaaggagtatcagattgcgcgactcgcgagcgaagagcaaactgtgttttcacgatttatttgcctctttctcggaatcttgaattccttcttgttaagaaaaatggggcaagttcttgggtgtattcaagtggagcagtcaactgtagctattacagaaacctttgggaagtttgatgaagtgcttgagcctggttgtcattgtttgccttggtgtttcggaaaacaggcagctggttttctctccttgcgtgtgcagcaactggatgttcgatgcgaaacaaaaaccaaggataatgtgtttgtgaatgtggttgcttcaattcagtaccgagccttagcagacaaggctcaagatgctttctataagctcagcaataccagagctcagatccaatcatatgtctttgatgttattagggctagtgttccaaagttggatctggattcagtatttgaacagaagaatgatattgccaaagctgtggaagaagaacttgaaaaggccatgtcgcattatgggttcgagatagttcagacccttattgtggatattgaaccagatgagcatgtgaagagggcaatgaatgagataaatgcagctgctagattgagggttgctgccaatgagaaggctgaagcagagaagatactgcaaatcaagcgagctgaaggagatgctgagtcaaagtatctggctggacttggtgtagctcggcagcgccaggctattgtagacggacttagggacagtgtgctggccttctctgtgaatgtacctgggacaacatctaaggatgtgatggacatggttcttgtgacccaatacttcgacacaatgaaggagattggtgcatcatcaaaatccaactctgttttcatcccacatggaccaggtgctgtaagagacattgctagtcaaatcagggatggccttctccaaggcagaaccattgagtagcctcaagtcttgcatagcattttggttaataacagtagggagtgggaatccgaattcggcctaagcatcgttacccctccttaatatgattgagatttatggttcaagtttcctttctaaatctttggactttctcaatatgtacaaatttcctttctaaatctttggactttctcaatatgtacaaaaacaatatagtaggagtagtacatgcttgttaacaaattgggtgttgagctttgttattgtacctaaagatatgacagtttttggttgtggataaaaagatttaatggcttttcatctgttgctaccacttgtgtattatatttgatacactgtcaatgaataatttctatacgtttatcatttagcattggtatatttacgagatagtaatatttgatccattatcgacaaatataaaccctaaaccctatt

SEQ ID NO: 3666 - DNA, 1142 bp, Cucumis sativus
cttttgctgattcaattatatcaactccttataactgcggcaaagggttgttccagacctaaattttgatttcttcgattttttcttttctggaatcaacagtaatttttgttgataactcagaatgggtcaagcccttggttgcattcaagtcgaccagtcaactgtagctatcagagaaacatttgggagatttgacgatgtgcttcaacctggttgccattgtctaccatggtgccttgggagccagatagctggtcatctttctttacgtctccagcagcttgatgttcgatgtgagacaaagacaaaggacaatgtttttgtcactgtcgttgcctctattcaataccgagccctagcagacaaggcttcagatgctttttataagcttagtaatacaagagaacagatccaggcatatgtttttgatgttattagggcaagtgttccaaagttggacctagattctacttttgaacagaagaatgatattgcaaaggcggtcgaagacgagctggagaaggccatgtcggcttatggatacgagatagttcaaactctaattgtggacattgagccagatgagcatgtaaagcgagcaatgaatgaaataaatgcagctgcaagactgagagttgctgcaactgagaaagctgaggcagagaagatattgcagattaagagagctgaaggagatgccgaatccaagtatctggccgggcttggtattgcacggcagcgtcaagccattgtcgatgggctcagagacagtgtactagcatttgctgaaaacgtccctggaacgacatctaaggatgtcatggacatggttcttgtgactcaatacttcgacacgatgaaggagattggagcgtcatcaaagtctaattctgtgttcatcccacatggacctggtgcagttaaagatattgcttcacagatcagggatggtcttctccaagcaagccaaacttagtagatgggtcaagattgaagatacttgtgaagatggtatattaagtgtgtagaatatgatatttatttgtgtatgggtttggttgttttgtttaatttgcaaatctgttctatgttatgacttacacgtatagttgtccttttaaattaatagtgctttaaat

SEQ ID NO: 3667 - DNA, 875 bp, Taraxacum officinale
gctgttcgatctttggtcataaaccacctcagccctcagtatataacaatcaaagatcatgggaaacctattctgtttagttcaagtagatcaatccacagttgcaatcaaggaaactttcggaaaattttccgatgttctcgaaccaggtttacactgcgtaccttggattttcggaagtcaagtcgctggacaactcacactacgtcttcaacaattagacgtcaaatgcgaaaccaaaacaaaggataatgttttcgtcaatgttgtcgcttcaattcaatatcgtgccctagctgataaagcaagtgacgcgttttataaactcagtaacacaagatcccaaatccaagcttatgttttcgatgtgataagagctagcgtcccaaaacttaacctagacgacgcatttgaacaaaaaaacgaaatcgcaaaagcagttgaagaggaattagaaaaagccatgtcagcatacggtttcgaaatcgtccagacactaatcgtcgatatagagccagacgagcacgtaaaacgcgccatgaatgaaatcaacgccgctgcgagactaaggatggcggctaccgaaaaggccgaagcggaaaagatacttcaaattaaaagagctgaaggagaagccgaatcgaaatacttgtctggactgggtatcgcgcgtcagagacaggcgattgtggatggtctgagagacagtgtattagggttttcagttaatgtccccgggaccacggctaaggatgtgatggacatggttttggtgactcagtattttgacacgatgaaagaaatcggtgcttcttcgaaatcgtctgcggtgtttattcctcatgggcctggggcggttcgtgatgtcgcgagtc

SEQ ID NO: 3668 - DNA, 1113 bp, Euphorbia peplus
atgggtaacctgttatgttgtgttcaagttgaccaatccacaattgcagtcaaggagacatttggcaagtatgatgaaatactccagcctggatgtcattgcatgccctggttccttggaagtcgggttgccggccacctctcccttcggttgcagcagctcgatgtccgttgcgaaaccaagacaaaggataatgtgtttgtgactgttgtggcctcgattcagtaccgccctcttgctcagaaagaaagcgatgctttctataaactcaccaataccaaaggccaaattcaagcttatgttttcgacgtgatcagggcaagcgttccaaaacttaacttggatgatgcctttgagcaaaaaaatgaaattgctaaggctgttgaggaggagctcgagaaggctatgtctgcttatggatatgaaattgttcagacacttattgtggatattgaacccgatgagcatgtaaagcgagcaatgaacgaaatcaatgcagctgcaaggatgagggtggccgcaaatgagaaagcagaggctgagaagatcgttcagataaagcgagcagaaggcgaggctgaatcaaagtatctgtcaggagtcggaatagcaaggcagagacaggcaattgtagatggtctaagagacagcgtcctcggattctcggttaatgttccagggactactgccaaggatgttttggacatggttttgatcacacagtactttgacactatgaaggaaattggagctgcaagtaaatcatcggcagtgttcattccccatggaccgggtgctgtcaatgatgtggctactcaaatccgaaacggattgcttcaggcacatcctcatcagtaatttagaggtgttgagcctagaatggacagtaaggaaggtatctaaataaaatgaatgtgtatgtatggagattaaaaaaaaggatgcttatgcagaaagtgctacttttatagtttctttgtgttaaagattgtggtgtagttgtttttatttctttattgaaattcatctagtttgctaattgctatcattcttgtcttagagacgtgattaatcgatgtccttaagcaaatattagttccgactatttttatt

SEQ ID NO: 3669 - DNA, 1015 bp, Euphorbia peplus
gaaaatgggacaagctctgggttgtgttcaagtggaccagtcaactgtagccatcaaggaaacatttgggaagtttgatgatgtgcttgaacctggttgtcactgtttgccctggtgtttgggtagccagttagctggtcacctctccttgcgtgtccagcaactggatgttcgatgcgaaactaaaaccaaggataatgtttttgttactgtggttgcttctatacaatatcgggcactagctggaaaggctgcagatgctttctacaagcttagcaatacgagagcacagatccaagcctatgtctttgatgttattagggcaagtgttcccaaattggagttggactcgacttttgaacagaagaatgacatcgcaaaagctgtggaacaggaacttgaaaaggccatgtctcattatggatatgagatagttcaaactctgatcgtggacattgaaccagatgaacacgtgaagagagctatgaatgagattaatgcagctgctagaatgagggtggctgccaatgaaaaggctgaggcggagaagattctgcagatcaagcgagctgaaggagaggcagagtccaagtatcttgcaggggttggtatagccaggcagcgtcaggctattgtggatgggctaagggacagtgttctagcattttctgagaatgtgccagggaccagctccaaggatgtgatggacatggttctggttactcagtatttcgataccatgaaggagattggtgcatcctccaaatcaagctctgttttcatccctcatggacctggtgcggtcagagacgtcgccactcagatcagggatggtcttcttcaggctagataaactcattagcctacagtatgtgggttttaaatacttttattatctttagatgattttatgttcatatgaaatttggtgggttattacactcttaggtatagtttttgagagctcgtgctctttggtgggttatttgggtcgcgtgcttagttggtaagaaat

SEQ ID NO: 3670 - DNA, 1055 bp, Flaveria ramosissima
ttgtttgtatcaagtggatcaatgactgttgctattaaggagtcttttgggaaatttgatgatgttttggagcctggatgtcactgtgttccatggatatttggtaaacagcttgctggttatctttctctcagagttcagcagttggatgtcaagtgtgagactaaaacaaaggataatgtctttgtgaatgttgtggcttcaatacaataccgcgctttggctgataaagcaaatgacgctttctataaactcagcaacacaaggtcccaaatccaggcctatgtgtttgatgttattagagcttttgttccaaagctgaatctggatgacacttttgagcaaaagaatgaaattgcaaaggcagttgaacaagaacttgaaaaggctatgtctgcatatgggtacgagatagttcagacattgattgttgatatagaaccagatgagcatgtaaagagagcaatgaatgagatcaatgctgctgcaaggttgagaatggcggctgctgagaaagcagaagctgagaaaattctgcaaatcaagagagccgagggggaagccgagtccaagtacctgtcgggtttgggtatagcccgccaacggcaagccattgtggatggtttgagggacagtgtgttgggattctcagtcaatgttcctggaaccactgcaaaagatgtaatggacatggttctagtgactcagtattttgacaccatgaaggaaatcggtgcgtcttccaagtcctcagctgtgtttctccctcatggacctggtgctgttcgtgatgtggcctcccagatacgtgatggactccttcaaggttctgctgccacttgatttgcagctcaatttgctcctcatgattggaatgaagttccttaactatatctgtttgtgttttacttcgagttttgtagagctaaacttctttttgtttgaacctttctttaagtgtaaattcatttaaaatttgaatatgtgctcgtcaaggattgtgtgatttcaggcttgtgtatatacacacatgcatcaaactcttgacaatcatc

SEQ ID NO: 3671 - DNA, 1404 bp, Prunus persica
ctttacacggtgacaaacaaattgccttccgcgcactcggaaaattcagcgaaatagctgtccgcgaaagcgactcgtaacttccccgcgaggctcaaggctcatccgaatttttacttacctttctgtaagtatctatttctttgtaattcatttcccccaatttcacgtggttttgggaatttgttctctctctctctctctctctctctctctctctctctctctctcgcttcctttctgttagatttgcagacgaacgcttccagttccgggacgtacatagctggaattctcactaaaatgggacaagctcttggttgtgttcaagtggaccagtctactgttgctatcagagaaacttttgggaagtttgatgatgtgcttgaacctggttgtcactgtttgccttggtgtttgggtagccagatagctggtcatctctctttacgtgtgcagcaattggatgttcgctgtgaaacaaagacaaaggataacgtttttgttactgtggttgcatctattcaatatcgagctttagctgagaaggcttcagatgccttttacaagctcagcaataccagagggcagatccaatcttatgtcttcgatgttatcagggctagtgttccgaagttggatctagattcaacctttgagcaaaagaatgacatagccaaagctgttgaagaagaacttgaaaaggccatgtcacattatgggtttgagatagttcaaacactaattgtggatattgaaccagatgagcatgtgaagagagcaatgaatgagataaatgcagctgcaaggatgaggttggctgcaactgagaaagctgaagcagagaagatattgcagattaagcgagctgagggagaggcagagtccaaatatctgtcagggcttggaatagcaaggcagcgccaggccattgtggacgggctgagagacagtgtgctggccttctctgagaatgtgccagggacatcatcaaaggatgtcatggacatggttctggtgacccagtacttcgacacaatgaaggagatcggtgcatcctcaaagtccaattcggttttcatcccacacggccccggtgccgtgagagacattgcttcacagatacgagatggcctccttcaagcaaatccacctcaggtgtaatgttattacattgtacgaagttggaggccggctctttaagcttccgattagtgctattatgcaggattgaagtttgtgtgtgctttaggatctaagaatgtggtttctttagtatttgacatataacgtatataatatgtaggtgatttctccatgcttgttgatacctgccctctaaagggtttaaactttatgtagtatagagaagcgattcaatatatttggttggtttttgttaga

SEQ ID NO: 3672 - DNA, 1097 bp, Citrullus lanatus
ctattagtttgttctttgtttgatgatcttgtacttctcttgttcaaatagttgataattcaaaatgggtcaagcctttggttgcattcaagtcgaccagtcaactgtagccatcagagaaacatttgggaaatttgatcatgtgcttcaacctggctgccattgtctaccatggtgctttggaagccaggtagctggtcatctttctttacgtgttcagcagcttgatgtccgctgtgagacaaagacaaaggataatgtttttgtcactgtcgttgcctctattcaataccgagccctagcagacaaggcttcggatgctttttataagcttagcaataccagagaacagatccaagcatatgtttttgatgttattagggcaagtgttccaaagttggacctagattctacttttgaacagaagaacgatattgcaaaggctgttgaagacgagctggagaaggccatgtcagcttatggatatgagatagttcaaactctgattgtggacattgagccagatgagcatgtaaagagagcaatgaatgaaataaatgcagctgcgagactgagagttgctgcaagcgagaaagctgaggcagagaagatattgcagattaagagagctgaaggagatgccgaatccaagtatctggctgggctcggtattgcacggcagcgtcaagcaattgtcgatgggctaagagacagtgtgctagcatttgctgaaaacgtccctggaacaacatctaaggatgtcatggacatggttcttgtgactcaatacttcgacacgatgaaggagatcggagcgtcatcgaagtctaattctgttttcatcccacatggacctggtgcagttaaagatattgcttcacagatcagagatggtcttctccaagcaagccgaactcagtagatgggaaaagattgaagacacttatgaagatggcacattaagtatatagaagatgatatttgtgtaatgggtttttggttgttttgttttatttgcaaatttctgtcctatgttttgagtgatacgtatagtttgattttaaataaatagggattaattgttttaaatgacaaaa

SEQ ID NO: 3673 - DNA, 1579 bp, Fagus grandifolia
gttgaagaagctttggcgaatcgatccaacggtctctgagatccaatggacacagaagatccaactctaactttgaaaccactcatgccgtcccttccaccaacccgctttacggaatcttcattgcaagagcgcgaggcgcgtctggtgcaataaccgcctgcatttctctgctctgctccttcactttctttccaaatttccgttacaaaccaacgcgtatatatatatatttctttttgggtaattatttgcctaattgcctcgcggtttctcacacatcgccgtcgttttttactgttacttattcgtctcccacaatctactataaatacagacatattttctcattcattttggctcaaattcgtaattccgattctccgattctcattctctctgtgaggcaaagtttcaattccacagttcggtagaataaaaaatggggcaagctctctgctgtgttcaagtggaccagtcaactgtagccatcaaagaaactttcgggaagtttgacgatgtgcttgagcccggatttcactgtttgccatgggtttttggacagcaggtagctggccacctctctttgcgtgtccagcagctggatgttcgatgtgaaacaaagacaaaggataatgtgtttgttactgttgttgcttctattcaataccgggccttatcagacaaagctgccgatgctttctacaaactcagtaataccagagcacagatccaatcctatgtctttgatgttattagagcaagtgttccgaagctggagctcgactctgtttttgaacaaaaaacgaaatcgcgaaagctgtggaagaggaactcgagaaggccatgtcagcttatggatatgagatcgttcaaacactcatcgtggacattgaacctgatgagcatgtgaaaagggcaatgaacgagataaatgccgctgctagaatgagggtggcagcaaacgagaaggcagaagcagaaaaaatcctgcaaataaaacgcgccgagggagatgctgaatcgaaatatctggccgggcttggcatagcccgccagcgtcaggccattgtagatggtctgagggacagtgtgctggctttctctgtgaatgtaccagggactacatcaaaggatgtcatggacatggttctggtgactcaatatttcgacacaatgaaagaaatcggtgcatcatcgaagtccaactctgttttcatcccacacggacctggtgctgtgagagacattgctacacagataagagacggcctccttcaaggaaattccatacagaattagtgtctcaagcccagcatatttgttggaggggtggattttctaatggtatatgaaactgattggtgcaaatatctaagagttgtgttccttttattcttcttcttttctacttttctaattacttacatgagtgtcttgtcaactgagtggtgtggtggtatacatgattgtgttgaacttagggtcgatagtattatattttgtctgtatcctctcgtaatatatttgttaatgttgtctggatttttgttatgtttccgtacctcgtcttattatt

SEQ ID NO: 3674 - DNA, 1198 bp, Zostera marina
tcgggggattttctgatttactgatttctccttccaactttccaagacgacacgcatcactcgacaatttatccgagatctaaagaaaatgggccaagcgttttgctgtcttcaagtggatcagtctactgtggctatcaaggaaagatttggaaagtttgaagaagtacttgagccaggatgtcatttctttccttggattttcggtattcagctagccggcaacctctcacttcgtgtccagcagctggatgttaagtgtgaaacgaagacgaaggataatgtttttgtaaatgttgttgcatctatacaataccgagctttgtctgaaaaggcaggtgatgctttttacaaactgagcaacactagggctcaaattcaagcttacgtctttgatgtgataagagcaagtgtcccaaaactctaccttgatgatgctttcgagcagaagaatgatattgcgaaatctgtggaggaggaactggagaaggctatgtctgcctatggttttgagattgtacaaactcttattgttgacatagagccagatgaacatgtaaaacgagcaatgaatgaaattaatgcagcctcgaggatgaggatggcggctagtgagaaggcagaagctgagaaaatccttcaaatcaagcgtgcagaaggtgaagctgaatcgaagtatctgtctggtcttggaattgcccgtcaacgtcaggcaatcgtagatggtttgagagacagtgttcttgggttctctgtaaatgtccctggaaccacagcgaaggatgtgatggacatggtcttggtgacacagtactttgatactatgaaagagataggcgctgcttcaaaatcttctgctgtttttatccctcatggtccaggtgcagttcgtgatgttgcgactcagattcgtgagggattgctccaggctacgtccacataacattgattattcctgtgaaattaaagctttggttgctttttctattgtctatgtcactcttgtgtcatgtgtgtagtgcatacaataagaaattaagaatatgcttaatttcttattatctaaacaaatgcatatagcttgaaaagtacaactttttaaatatgttttttgtcaagtgtttattttcttttggtatagtataagcataatcaatttatcatcctggttaacttaataatcagatcaagatttcgt

SEQ ID NO: 3675 - DNA, 1065 bp, Fagus grandifolia
gtgtacaagttgaccaatccacagtggctatcaaggagaaatttggcaagtttgacgaagtgcttgagccaggatgccattgcttgccttggttccttggaagtaagctttctggtcacctctctcttcggttgcagcaattggatgtgcgatgtgagactaagacaaaggacaatgtatttgtcaatgttgttgcatctattcaataccgtgccctggcggacaaggcaagtgatgccttttacaaactaagcaacacaagaagacaaatccaagcctatgtgtttgatgtaatcagagcaagtgtcccaaagctcaccttggatgctgcttttgaacagaagaatgagattgccaaagctgtagaagatgaacttgaaaaggctatgtctgcttatgggtatgaaatcgtacaaacactcattgtcgatatagaacctgacgagcatgtcaagcgagcaatgaacgaaatcaatgctgctgcaagattgagggtggcagtcaatgagaaggcagaggctgagaaaatcttgcaaattaagcgagctgagggtgaggctgagtctaagtatttgtctgggctgggtattgctcgccaacgtcaagcaattgtggatggcttgagagagagtgtggtgggattctctagtaatgtgccggggaccacaacaaaggatgtcatggacatggtccttgttacccagtattttgacacaatgaaggaaattggtgctgcgtcgaagtcgtctgctgtattcatcccacatggacctggtgctgttcgtgatgtagcgactcaaattcgtgatggacttcatcaggcttctgttcactagtagcgttagttttccattttttccctttgtgtgttgaaatgaagtccatgcatattgatgtttatctgcaagttgttcagtgtgttatataatctatcttgatgtaattatcatatctgtttgtgaattatgattattactgtacataggaggcttgaagatgtcccaaggattttactggtcttcaaacttttgagagttcttcatgctgaaacttgaatcttgtgga

SEQ ID NO: 3676 - DNA, 1964 bp, Citrus clementina
aaaagatatttgttttaagattggaaagtgacacgcaatccgataagaacacgaagtttgtctcatctcctcgcaatttctcggctggctcaatttcgtggaaaatactcccctctccactattagtttccaatttaacgcgggtacccacagttataaatattcaatacgcacgcacatattccttctcactctttcataattcatatattatgtgtattttaaaattaatctctcatctttccctcgtcactttcgcaaaatttgtttagttaaaagctttaggtaagcgaagatatttctttcgttattttgttttacgaaactgttaacattaaataaattacacagtttctgcggtttctacgtttatttatctctaatttcgtatttttggtaatttaatgctgttatgattcggtatgaaacgagagtaaaaaattaggtactgcatgaatgaattggagtttttagaagacgagttcggagttgaatttcggctttgcggattttagattgtggcatcgagatcgctttctgatgctgtcttgtaaatcatacgctgtttttattgaagctttgatgcttgcttaattccgatttcacttataattaaataggtataatcagaaaatgggacaagctttaggttgtattcaggtggatcagtcaactgtggccatcagggaaacctttgggaagtttgatgaggtgcttgaacctggctgtcactgtttgccttggtgtttggggagccaagtagcaggtcaactctcattacgtgttcagcagttggatgttcgatgtgaaacaaaaaccaaggacaatgtgtttgttaatgtggttgcttccgttcaataccgagccttggcagagaaggcttcagatgccttttataagctcagcaatactagatcgcagatccaagcgtatgtctttgatgttattagggcaagtgtaccaaagctggacctggatgcaacctttgagcagaagaacgacatagccaaagctgtggaagaggaactcgaaaaggccatgtctcattatggttatgagatagttcagactctcatcgtagatattgaaccagatgaacatgtgaagagagcaatgaatgagatcaatgcagcggccagattgaggctggctgcaaatgagaaagcggaagcagagaaaatattgcagatcaagcgtgctgaaggagaagcagaatcaaagtatttggcaggccttggtattgcacgtcagcgtcaggccattgttgatggcctgagggatagcgtgctagccttctctgagaatgtacctggaacatcttcaaaggatgtcatggacatggttctggtcacccagtattttgataccatgaaggaaattggtgcctcctcaaagactaactctgtgttcatcccccatggacctggtgctgtcaaagacattgcgtcgcagatcagggaaggtctccttcaggccaatgctaccatgtagtgagcttgtgccacctcaaagtcaaaactctgtttcatcccacatggagcgggggctaatcttccagtttggatatgtttttatttagcttgaagttgtgaagaagtttcgtaattgcctgtagtaccatctagcatattatgggaaagaagtttctgtcatcaggtaaataaagaatggtaaataatggtagataaagagtggtagataacgtaatatactttgatcgtgcatgcaaatgtgaaacttgaagtgtgctgtatgattggtgaatattgtgtcaattctgatttcgatgcgtgtatttatttatttagatttgaatgattgataacactcataataatggtaagaggaaatctatgtaaatacactaattctacagcgataaacaactgcgtgtttgtataaactgatgtaacattggtttgccggtagtttgctgtagcatgctttcatgctactttgcttat

SEQ ID NO: 3677 - DNA, 1390 bp, Eucalyptus grandis
gaatctgaccttcgtcgttgagcttatcaggaacaaacgacagcccggttcatctcgttttccgctggatcatttccaggctatttagggtggaatcaagatggaatcttgaaaaaccactccatccccaagaaatcgaaaaccggtgtggagataacatgggcaatctgttttgctgcatccaagttgatcaatccacggtagctatcagggagagatttggcaagtttgatgacgtacttcaaccgggatgccatttccttccctggtgtcttggaagccagctagcggggcatctctcacttcgagtgcagcagttggatgtgcgatgtgaaactaagacaaaagacaatgtctttgtcaatgttgttgcatctatccaatatcgtgcccttgcaaatcaggcaagtgatgccttttacaaacttaccaacacaaagggtcaaattcaagcctatgtttttgacgtgataagagcaagtgtcccaagactcaatttggatgatgtttttgagcaaaaaaatgaaattgccaaagcagtggaagatgaacttgagaaggctatgtctacatatgggtatgaaattgtgcaaacgctgattgttgatattgaaccagatgagcatgtaaagcgagcaatgaatgagattaatgctgctgcaagactaaggctagcagctaatgagaaggctgaagcagagaagattctgcaaatcaagagagctgaaggtgaggctgagtcaaagtatctttctgggcttggcattgcccgccagcgtcaagctattgtggatggtttgagagatagcgtactgggcttctcggaaaacgtgcccgggaccagtgccaaggatgtcatggacatggttcttgtcacccagtacttcgacaccttgaaggaaattggtgctgcatctaaaacctctgctgtgttcattccccatggtcctggtgccgttcgcgatgttgcctctcaaattcgtgagggacttcttcaagcttcctccgtcagctagttgcacatcggagtctcctcgaaatgaagatgatgccccaaaaaggaaggggagaagctttcttttggctttctaagtatatgttttcatgtgaatttgctgatgatgtcttctgaatatccattttgtttacgttttaaagtgatgatgtaagtactgtgtatatgaatcttgaaggtgttcctaaaacatagtcttcgtgcttctgcacagacatactgttttaagttgcttgtctgaaaaatcaactcggatttgccataatcaaggctagtgtcttaaagtggttgagagttttgcaggttttgtttgctcatttgactggaattctggtgcataaagacagttgatataaatcattcaattaatacaaa

SEQ ID NO: 3678 - DNA, 1235 bp, Actinidia deliciosa
atccacagctacgctctttcttggagggtaccaatctttcgtccgcaagaaatttcttcgaaagtgccgatctctgtctcacgcgtttgacgcaaggttgaactatgggtcaagcatttggttgcattcaagtggatcagtctacagttgctgttaaggagcaatttggaaagttcgatgatgtgcttgagcctgggtgtcactgcttaccctggtgtttgggttaccaggtagctggggagctgtcgttacgtgtgcaacagcttgatgttcgctgtgagacaaaaactaaggataatgtctttgttaacgtggttgcatccattcaataccgtgccatggcagacaaagcatctgatgctttctacaagctttccaacaccaaaggacaaatccaagcctatgtttttgatgttataagggcaagtgtaccgaagatggacttggattctacttttgaacagaagaatgatatagcaaaagctgtggaggacgaacttgaaaaggcgatgtctgcgtatgggttcgaaatagtccagactcttatcgtggatattgagccagatattaatgtgaagagggctatgaatgagataaatgcagctgctagaatgagggttgcagcaaatgagaaagctgaagcagagaaaatcttgcagatcaagcgagccgagggagaggccgaatccaaatacctttctgggcttggtattgctaggcagcgccaagctattgttgacggactgagggacagcgtgcttgctttctccgagaatgtgcccggaacatccgccaaggacgtcatggacatggtcctggtgactcagtacttcgacaccatgaaggagatcggggcatcctcaaagtcatctgcagtgttcatcccacatgggcccggtgcagtgagggacgttgcagcacagatccgagagggtcttcttcagggtgccagcgttcaacattaaagcttgtgagcattttggaaagtttggaggttggacttcctatagttaaatgactttgtgtggttgctgcttgaaatgtttatagaacatcatatatatcttgggggttaacttttctcagttactctatgatcttatccctagtatatatatatatatcgtttttaaactttgttttgtgagatgattttcccttgtaaaatctgatagtaatccgtacttgaagtttggtttgccattgattttttattattgtttattgtcatattt

SEQ ID NO: 3679 - DNA, 3326 bp, Citrus sinensis
aaaagatatttgttttaagattggaaagtgacacgcaatccgataagaacacgaagtttgtctcatctcctcgcaatttctcggctggctcaatttcgtggaaaatactcccctctccactattagtttccaatttaacgcgggtacccacagttataaatactaactacacacgcacatattccttctcactctttcataattcatatattatgtgtattttaaaattaatctctcatctttccctcgtcactttcgcaaaattcgtttagttaaaagctttaggtaagcgaagatatttctttccttattttgttttacgaaactgtagacattaaataaattacacagtttctgcggtttctacgtttatttatctctaatttcgtatttttggtaatttaatgctgttatgattctgtatgaaacgagagtgaaaaattaggtactgcatgaatgaattggagtttttagaagacgagttcggagttgaatttcggctttgcggattttagattgtggcatcgagatcgctttctgatgctgtcttgtaaatcatacgctgtttttattgaagctttgatgcttgcttaattccgatttcacttataattaaataggttattttcgttgctaatccagtttacattgatgccttgttaatttgtccctttgatctgtgatataattttcttaattttgttttagatataaataatcatataatatgtttggaatttaaataaataattagtatgatatgagctgcgtgaatttattaacttctgtgctgcattttttaataggaaataggactttgtatttagaacatttccactgccaactgttcagtgttgaaaagtagtttttcacttctttttagtgctcgttttatttgtattaaaaaaaaaatgctcatttatttatcttatcttatctactgacttgattagttaaagcatggtttgaattctcttgtgtctagcacccaatagaatgaaataaattatttcttttatatttattactctttattttttttaaagagtcaattttgtttgtatatccggccagttggtacctttcggatgaaatctagaaattgtcgtggtttggttgatgattcttctaatgagctgtaggtgctatataattgggtctcttttgcaagttgttaaattcatgctctgccatgccattagattaggtcaatggttttgaaattttcagcgaattttcttgtagaagaagaaacaattttaaagcaactatattgctaggctattacatgggtagttgataggaggtaggtattatttgggatagcttctctgatgtaattgagattttatacagggactggtttaatcacttctgtgggttcaccttgttcttgtaatattccatttacagacatctcgtatagagaagtttgctttgaagctgctttttccaatctgctgtgaagaactgtgtcaatttctgtctgttagcccctcttttttaatttatttctagtacgtagtgaatcttatttagtattgctttggctataaagctttagattgttttatgatagacaagcctttgtttcaatgtcagaaagagaaagaaatgcttggtaaggaaattgcatgatcacatgaatttgatttcatggtcataaaatttaggacaaaaattatgtgtgtttttgttctaatgttgctttttacgtttttgtttgactgcttaataggttacagatataattcacagctttcaagtttccattataccatctcaatgctattctgacatacgatagtttgtgtttaactggatttgtgatgttctggatgcatttgacagatagtgacagctttttcaagaaggccctctattctagttcttacatgggccaattcgttgaatttctattgcttttgcttcctttaattggtcaatagattatcattgattttcgtagctgttctgaattaggtagaatcagaaaatgggacaagctttaggttgtattcaggtggatcagtcaactgtggccatcaaggaaacctttgggaagtttgatgatgtgcttgaacctggctgtcactgtttgccttggtgtttggggagccaagtagcaggtcaactctcattacgtgttcagcagttggatgttcgatgtgaaacaaaaaccaaggacaatgtgtttgttaatgtggttgcttccgttcaataccgagccttggcagagaaggcttcagatgccttttataagctcagcaatactagatcgcagatccaagcgtatgtctttgatgttattagggcaagtgtaccaaagctggacctggatgcaacctttgagcagaagaacgacatagccaaagctgtggaagaggaactcgaaaaggccatgtctcattatggttatgagatagttcagactctcatcgtagatattgaaccagatgaacatgtgaagagagcaatgaatgagatcaatgcagcggccagattgaggctggctgcaaatgagaaagcggaagcagagaaaatattgcagatcaagcgtgctgaaggagaagcagaatcaaagtatttggcaggccttggtattgcacgtcagcgtcaggccattgttgatggcctgagggatagcgtgctagccttctctgagaatgtacctggaacatcttcaaaggatgtcatggacatggttctggtcacccagtattttgataccatgaaggaaattggtgcctcctcaaagactaactctgtgttcatcccccatggacctggtgctgtcaaagacattgcgtcgcagatcagggaaggtctccttcaggccaatgctaccacgtagtgagtttgtgccacctcaaagtcaaactctgtttcatcccacatggagcgggggctaatcttccagtttggatatgtttttatgtagcttgaagttgtgaagaagtttcgtaattgcctgtagtaccatctagcatattatgggaaagaagtttctgtcatcaggtaaataaagaatggtaaataatggtagataaagagtggtagataacgtaatatactttgatcgtgcatgcaaatgtgaaacttgaagtgtgctgtatgattggtgaatattgtgtcaattctgatttcgatgcgtgtatttatttatttagatttgaatgattgataacactcataataatggtaagaggaaatctatgtaaatacactaattctacagcgataaacaactacgtgtttgtataaactgatgtaacattggtttgccggtagtttgctgtagcatgctttcatgctactttgcttat

SEQ ID NO: 3680 - DNA, 1157 bp, Phalaenopsis aphrodite
gggtttcttaggagctctgatttcaagggcggagctaatataaaagctcaagtcaaagctcaagtttaagccatggggcagctgttatgttgcgtacaaatagaccaatccactgttgctattagagagcaattcggaaagtttgacgatgttctcgagcctggctgccattgcgtcccgtggttcatgggtagtcacatagccggctatctctccttacgattacaacaactagacgtgaaatgtgaaacaaagacgaaggataatgtttttgtcaatgttgttgcatccatacaataccgcgcgcttgccggtaaagcgaatgatgcattctacaagcttagcaacacaaggactcaaatccaggcttatgtgtttgatgtaatcagagctagcgttccaaaactcaacctggacgacgtttcgagcagaagaacgaaatcgcgagagccgtggaagacgaacttagagaaggccatgtctgcttatggctatgaaatagtgcagactctaattgtcgatattgaaccagatgagcatgtcaagagagccatgaatgaaatcaatgctgccgcgagactcaggtcggctgcgaacgagaaagccgaggccgagaaaatcatccagatcaagcgagctgagggcgaggccgaggcaaagtatctgtcaggtcttggaatagctcggcagcgtcaggcgatcgtcgacggattgagagacagcgtgttgggattttccgtcaatgtgcccggaacaacggcaaaggatgtgatggacatggtcctcgtcacgcaatatttcgacaccatgaaggagattggagccgcctccaagagctcggcggtgttcatccctcatggacctggagctgttcgagacgtcgccgatcagatccgagacgggctgctccaagcgaatcgggtctagtaagtttgcttggtttctaaaaggcatgaaaaaactaccaccatgaattttaagatgctttttttgtttcagttctgtgattattatagtgggagttgtgtgaaattgtggagcaggatctgcttttaactgtgaatttgaataatttgtgtattttctttatcgaagtttggctgttacagttgatcttatgttactcaattaacattgtgattagtataaatgtatga

SEQ ID NO: 3681 - DNA, 1342 bp, Populus trichocarpa
atcattgcatctgtctctttcttttcaaataaatccgatctaaaatgaaaattttcatcactttgtagcagacataggattataatagacgctggcaaattgccaattttgtcgttgctcattcatcaaaagaaaatatcacaaactctttatctctctctgttgtcatcagcaagaagaacaagaacaggacagaagaagaagaagaagagaagatgggtcaagcatttggttgccttcaagtggatcagtctaatgttgctattaaggaacagtttggaaagtttgttgatgtgctggagcctggatgtcactgcttgccttggtgttttggataccaagtggctggtggactttctcttcgcgtgcagcaactcgatgttagatgtgaaacaaaaactaaggataatgtatttgtcactgttgttgcatctattcagtatcgggccatggcagagaaagcatctgatgccttctataagctctccaacaccaaggcacaaatccaggcctatgtttttgatgtaatcagggcaagtgtgccaaaattgcttttggatgatacttttgagcagaaaaacgatattgcgaaggctgttgaaaacgagcttgaaaaggccatgtctgcctatgggtatgaaattgttcagacacttattgtggatattgagccggatattaatgttaagagagcaatgaatgagataaatgctgctgctagactgagggtggcagcaaatgagaaggcagaagctgagaaaatattgcagatcaagcgggctgaaggagaggcagagtccaaatacctatcagggcttggcatagctcgtcaacgtcaggccattgttgatggactgagggatagcgtgcttgccttctctgagaatgtgcctggtacgagtgccaaggatgtgatggatatggtgctggtgactcagtactttgataccatgaaggagattggggcatcctcaaagtcatcttctgttttcatccctcatggacctggcgcagtgagagacatcacttcacagattcgtgatggacttcttcagggaaattctgctcagtagtgatggaattcaagctttgaatggatttacttggttgatgtttggcatcttaagttttatctctagctttttcagagtttgtgatctgcaaataaggaagactgattatcgttgtgttcttttcatgtctatgaagcggtgcatacattcaggcaatggcttgtaagtagtatattggatttggaagatgtttaaatcagctggtacagatgtagttcccctactcgatatgctagtctctctgttataaattactgagtttatcttga

SEQ ID NO: 3682 - DNA, 1668 bp, Populus trichocarpa
atcattgcatctgtctctttcttttcaaataaatccgatctaaaatgaaaattttcatcactttgtagcagacataggattataatagacgctggcaaattgccaattttgtcgttgctcattcatcaaaagaaaatatcacaaactctttatctctctctgttgtcatcagcaagaagaacaagaacaggacagaagaagaagaagagaagatgggtcaagcatttggttgccttcaagtggatcagtctaatgttgctattaaggaacagtttggaaagtttgttgatgtgctggagcctggatgtcactgcttgccttggtgttttggataccaagtggctggtggactttctcttcgcgtgcagcaactcgatgttagatgtgaaacaaaaactaaggataatgtatttgtcactgttgttgcatctattcagtatcgggccatggcagagaaagcatctgatgccttctataagctctccaacaccaaggcacaaatccaggcctatgtttttgatgtaatcagggcaagtgtgccaaaattgcttttggatgatacttttgagcagaaaaacgatattgcgaaggctgttgaaaacgagcttgaaaaggccatgtctgcctatgggtatgaaattgttcagacacttattgtggatattgagccggatattaatgttaagagagcaatgaatgagataaatgctgctgctagactgagggtggcagcaaatgagaaggcagaagctgagaaaatattgcagatcaagcgggctgaaggagaggcagagtccaaatacctatcagggcttggcatagctcgtcaacgtcaggccattgttgatggactgagggatagcgtgcttgccttctctgagaatgtgcctggtacgagtgccaaggatgtgatggatatggtgctggtgactcagtactttgataccatgaaggagattggggcatcctcaaagtcatcttctgttttcatccctcatggacctggtgcagtgagagacatcacttcacagattcgtgatggacttcttcagggaaattctgctcagtagtgatggaattcaagctttgaatggatttgcttggttgatgtgtggcatattaagttttatctctagctttttcagagtttgtgatctgcaaataaggaagactctgattatcgttgtgttcttttcatgtctatgaagcggtgcatataatcaggcaatggcttgtaagtagtatattggatttggaagatgtttaaatcagctggtacagatgtagttcctctactcgatatgctagtctctctgttataaattactgagtttatcttgaaaagcaggctgatgcatatgcattttctctttgcatctaatctaatgtggagttgctctttcatggcccggcttccagaggcagagttttgggaaagaatgaactctagccctaggactataatttgtttaccaactgaaggtgggagatgtgagagacatttggctgattttcgagccagctagatatccaatatagctttaggcttcgtgttccacggagttctcaaacgatgaagctgcagttgacctgagttgtgtcatggaacctttctaatattaaacttgcacgttaaatatgacaaaaatattttatgatttttttgac

SEQ ID NO: 3683 - DNA, 1364 bp, Silene vulgaris
ggtttgggattttgtaatcgtgtgacgattgtgatttgagatgatattatatacttttccacaaaatttgatttcacactaaaacattgactatatttacaatgttgtgtgcctatatattggaataatcttgttagttgatgtatcgtatttttcggcttgattgagattagggtgtgaggaattttgacttctgaaatctttgatcgattgtttgttggcatagttgtcgaatttgaacgaaatcatgggacaagttttgggatgtgttcaagtggatcagtcaactgtagctatccgagaaacatttggaaagtttgacagtgttcttgagccaggatgtcactgtcttccctggtgccttggcagtcagttagctggtcatctcaccttgcgtgtgcagcaacttgatgttcgctgtgaaaccaaaacaaaggataatgtgtttgtcactgtggttgcatctgtacaatatcgagcattggcggaaaatgcaggagatgcattttataaactcagcaacactagggaacagattcaagcttatgtcttcgatgttatccgtgccagtgtccccaaattgctacttgataatgcttttgagcagaagaatgacattgcaaaggctgttgaagaagagcttgaaaaggccatgtcagcttatgggtatcagattgtgcaaactcttattgtggacattgaacctgacgtgaatgtaaagagagctatgaatgagattaatgcagctgctagaatgagagtggccgcaaatgagaaggctgaagccgaaaaaattctgcaaatcaagagagccgagggagaggccgagtccaaatatctttcagggctgggtattgcacgacaacgtcaggcaattgttgatgggttgagggacagtgttctgaacttctctgagaatgtcccggggacaactgccaaagacgtgatggacatggttctagtaactcagtactttgacacgatgagggagataggtgcttcatccaagtcttctgccgtgttcattcctcatggtcctggggccgttaaagacgttgcttctcaaatcagggacggtcttcttcagggaaatgtaatggagagatagaggaggtctctctctcttgcttcggtctcgtgctgcaatgaaatatttgctgtaaatgtcagttctggagtttgatacagttatatctcaagtaaggaagtaaataatggttggtaagtagtaaagcgacgttaaatcgatttggtgtgatgtttgataactatgtttaaacagttcatttgcgttctcacgacttcatagaatttctatgcagctttcggattttgtgtcatgttcataattcagtacttttgct

SEQ ID NO: 3684 - DNA, 1466 bp, Glycine max
gctggccagcacttcgtaaatccacttatctgaaattgtgaacagtattgttcttgcgttgtttcggagggtcaattgtttggttgagcaaaaatctgaaattcaatttcagttgaaagcaaatggggaatcttttttgttgtgtgaaagttgatcaatctacggtggctatgagagaaggatttggacgatttgagaaggtacttcagccgggatgccattgcatgccatggttccttggaaaacaacttgctggtcatctctctcttcggctacagcaactggatcttcgttgtgagaccaagacaaaggataatgtctttgtcaacgttgttgcttctattcaatatcgtgccctggcagagaaggccaatgatgctttttacaaactgagcaatacaaagacccaaattcaagcctatgtttttgatgtaattagggcaagtgttccaaaactaaacttggatgatgcttttgagcagaaaagtgaaattgccagagctgtggaagaagaacttgagaaggctatgtcagcttatgggtatgaaattgttcaaacactgattgttgatatagatccagatgtgcatgtgaagcgggctatgaatgaaatcaatgctgctgcaagattgaggttggcagctaatgagaaggcagaggcagagaagatcttgctaatcaaacgagctgagggcgaggcagagtctaagtatctttctggtctgggtattgctcgccaacgtcaagcaattgtggatggcttgagagatagtgtgcttggattctcagttaatgtacctgggacaagtgcaagagatgtcatggacatggtccttgtcactcagtattttgacactatgaaagacattggtgctgcctccaagtcttctgctgtgtttattccacatggacctggtgctgttcgtgatgtagctagtcaaattcgagacggacttcttcaggcttctcatcagtagcctctactccacctagatcttgtatttggtttgtatgggagtatgtttgaagctatagcgcctgtggttgtatacctgtatttctgtgcagtgtgttttgtgattttgttttagaataaactgcaaaattgatcttccaaagattatggcatcacctcattaatgtttttaagatttttgttatcaaattagtcccacaaatatctaaaatgttaccacatttgttcacatagaggactaaagaagtggtaacacaaaataatttagtatttgatttgtatctctgtgggattgatttgttgaccaaaatctttggaggaccagttcaaggacttactctatcgatttatactttcagtttcaggcagtcaagtaatactgtatattctgttgtctatattgtggatcatgcataactaaactatcaagtatccctgtatatacaagttgtctaaattgtgaaagttacatatacaagaaatttcctat

SEQ ID NO: 3685 - DNA, 1573 bp, Glycine max
aaaatatatatagaaaaattattatcacatccatgtcaagttcacggttttgtcggggatggtggattggtttagacttataaagtcgtcttttgctggccagcacttcgtaaatccacttatctgaaattgtgaacagtattgttcttgcgttgtttcggagggtcaattgtttggttgagcaaaaatctgaaattcaatttcagttgaaagcaaatggggaatcttttttgttgtgtgaaagttgatcaatctacggtggctatgagagaaggatttggacgatttgagaaggtacttcagccgggatgccattgcatgccatggttccttggaaaacaacttgctggtcatctctctcttcggctacagcaactggatcttcgttgtgagaccaagacaaaggataatgtctttgtcaacgttgttgcttctattcaatatcgtgccctggcagagaaggccaatgatgctttttacaaactgagcaatacaaagacccaaattcaagcctatgtttttgatgtaattagggcaagtgttccaaaactaaacttggatgatgcttttgagcagaaaagtgaaattgccagagctgtggaagaagaacttgagaaggctatgtcagcttatgggtatgaaattgttcaaacactgattgttgatatagatccagatgtgcatgtgaagcgggctatgaatgaaatcaatgctgctgcaagattgaggttggcagctaatgagaaggcagaggcagagaagatcttgctaatcaaacgagctgagggcgaggcagagtctaagtatctttctggtctgggtattgctcgccaacgtcaagcaattgtggatggcttgagagatagtgtgcttggattctcagttaatgtacctgggacaagtgcaagagatgtcatggacatggtccttgtcactcagtattttgacactatgaaagacattggtgctgcctccaagtcttctgctgtgtttattccacatggacctggtgctgttcgtgatgtagctagtcaaattcgagacggacttcttcaggcttctcatcagtagcctctactccacctagatcttgtatttggtttgtatgggagtatgtttgaagctatagcgcctgtggttgtatacctgtatttctgtgcagtgtgttttgtgattttgttttagaataaactgcaaaattgatcttccaaagattatggcatcacctcattaatgtttttaagatttttgttatcaaattagtcccacaaatatctaaaatgttaccacatttgttcacatagaggactaaagaagtggtaacacaaaataatttagtatttgatttgtatctctgtgggattgatttgttgaccaaaatctttggaggaccagttcaaggacttactctatcgatttatactttcagtttcaggcagtcaagtaatactgtatattctgttgtctatattgtggatcatgcataactaaactatcaagtatccctgtatatacaagttgtctaaattgtgaaagttacatatacaagaaatttcctatataccgttagaga

SEQ ID NO: 3686 - DNA, 1159 bp, Zostera marina
ccaagacgacacgcatcactcgacaatttatccgagatctaaagaaaatgggccaagcgttttgctgtcttcaagtggatcagtctactgtggctatcaaggaaagatttggaaagtttgaagaagtacttgagccaggatgtcatttctttccttggattttcggtattcagctagccggcaacctctcacttcgtgtccagcagctggatgttaagtgtgaaacgaagacgaaggataatgtttttgtaaatgttgttgcatctatacaataccgagctttgtctgaaaaggcaggtgatgctttttacaaactgagcaacactagggctcaaattcaagcttacgtctttgatgtgataagagcaagtgtcccaaaactctaccttgatgatgctttcgagcagaagaatgatattgcgaaatctgtggaggaggaactggagaaggctatgtctgcctatggttttgagattgtacaaactcttattgttgacatagagccagatgaacatgtaaaacgagcaatgaatgaaattaatgcagcctcgaggatgaggatggcggctagtgagaaggcagaagctgagaaaatccttcaaatcaagcgtgcagaaggtgaagctgaatcgaagtatctgtctggtcttggaattgcccgtcaacgtcaggcaatcgtagatggtttgagagacagtgttcttgggttctctgtaaatgtccctggaaccacagcgaaggatgtgatggacatggtcttggtgacacagtactttgatactatgaaagagataggcgctgcttcaaaatcttctgctgtttttatccctcatggtccaggtgcagttcgtgatgttgcgactcagattcgtgagggattgctccaggctacgtccacataacattgattattcctgtgaaattaaagctttggttgctttttctattgtctatgtcactcttgtgtcatgtgtgtagtgcatacaataagaaattaagaatatgcttaatttcttattatctaaacaaatgcatatagcttgaaaagtacaactttttaaatatgtttttttgtcaagtgttttatttttctttttggtatagtataagcataatcaatttatcatccctggtttaaacttaaataatcagatcaaga

SEQ ID NO: 3687 - DNA, 1061 bp, Nicotiana benthamiana
ttgtcttcttgaaattgttgggaaacagagagagacaatgggaaatctgctttgctgtgtacaagtggaccaatccacagtggctataaaggagagatttggcaagttcaatgatgtgcttgagcctggatgtcatttcttgccatggtgtattggcagccagattgctggataccttactttaaggctgcagcagcttgatgtgcgatgcgagacaaagtcaaaggataatgtatttgtaactgttgttgcttcaattcaatatcgtgctctggctgataaagctactgatgctttttacaagcttagtaatactcgatcccagatccaagcctatgtgtttaatgttatcagagcgagcgttccaaagctaaatttggatgatgtctttgagcagaagaatcaaattgctaaggcagtggaggatgaacttgaaaaggcaatgtctgcttatggatatgagattgttcagacactcatagttgatatagagccagatgaacatgtcaagcgagctatgaatgaaatcaatgcagctgcaagaatgagagcagctgcgaatgagaaagcagaagctgaaaaaattgtccagattaatcgagctgaaggtgatgctgaggctaagtacctagcagggcttggggttgctagacaacgccaggccattgtggatggtttaagggacagtgttcttggcttctcaagtaatgtcccaggaacgagtgccaagggcgtcttggacatggtcctcatcactcaatattttgacaccatgaaggaaatcggtgccacttctaaatcctcagcagtctttatcccacatggacctggtgctgttagtgacattgcagggcagattgaacatggattgctccagggttcaactgtccagcaacaaaatcttatgtaaatgtgtttcaccatgtctcgtgtgcttgtgttttgtgtgtaatgtttcttcttgacggccattattgttcgttatacatgtgtaattagatgcagtttttaaagtctcagtgtaaaagtcaggttttaatgattcgttcacatattgctac

SEQ ID NO: 3688 - DNA, 1292 bp, Papaver somniferum
ataacgaatcatggtaactattttcctgcgattcatttttgcctaaaattttctctaacttctggcatatcagtttaattgaccaatttatgtggtggagtatctgtaacatggtcgttcttttccctttggtcttatggaaaagaaaatcatacatgtatcatcacaatccttgtattctaaatcagtcataactgttggttgacatggagtctgtattttttatatcagaaacaacagaaaatgggtaatctattgtgctgtgtacaagttgaccaatcgaaagttgctattaaggaaagattcggcaagtttgaggaagttcttgacccaggatgtcattgcttaccgtggtttcttggtagtcaaattgctggtcatctcaccctaagggttcaacagctggatgtcaaatgcgagactaagacaaaggataatgtatttgtcaatgttgttgcatctatacaatatcgagctttagcagagaaggcaagtgatgcattctacaaactgagcaatacgaggggccaaatccaagcctatgtttttgatgtaatcagagctagtgttccaaagctcattttggatgatgttttcgagcaaaagaacgatattgctagagcagttgaagaagaacttgaaaaggctatgtctgcttatggatatgagattgttcaaacccttattgttgatatagaaccggatgtgaacgtgaaacgggcaatgaatgaaatcaatgctgctgcaaggctacggttggcagcaacggacaaggcagaggctgagaagatattacagattaagagagcagagggtgaggctgaatctaaatacctcgctggactgggtattgctaggcagcgtcaagccattgttgatggtctcagagacagtgtagtagggttctcaactaatgttcctgggacctctgcaaaggatgttatggacatggttctagtaacacaatactttgacacgatgaaggaaattggtgcaaactcaaaaacatctgcagtgtttatccctcatgggccaggtgctgttcgtgacgtggtaactcagattcgtgatggacttcttcagggatcttctgctcacatgacataaagccatgattcactccccggccagctgtagacgcattcacctcaaaatgcagcaaccaaggggatacctctttttttagcgctcaactgtacgcgtgtgtatattcatgtttcactttgatttttgttgcatttgcatatgttatgtttgccctttgggattaatatagtgtgacttaattgttt

SEQ ID NO: 3689 - DNA, 1092 bp, Nicotiana benthamiana
cttttttgctgctcctgtgcatttttgcttgtttcgttagtcagcatgggcaacatgttgtgctgcgtaaaagttgatcaatccacggttgcaattacggagcagttcggcaagtatcaaaatgtgcttcagcctggttgccactgtctcccttcgttcctgggatttaaggtagctggtcatctctccctcagggtgcagcaactggatgttcgctgcgaaaccaagacaaaggataatgtatttgtcaatgtagtggcatcagttcagtaccgtgctcttgcaaacaaagcaaatgatgctttctacagactaaccaacactaagggtcaaattcaagcctatgttttcgatgtcataagggcaagtgttccaaaactcaatattgatgatgttttcgagcagaaaaatggaattgccagggctgttgaggatgaacttgagaaggctatgtcggcttatggatatgaaattgttcagacgcttattgttgatattgaaccagatgagcatgttaagagagctatgaatgaaatcaatgctgctgctcggatgagggtggctgcgaatgaaaaggcagaggctgagaagattttacaaattaaaagggctgaaggagaggcagagtcaaagtatctctcagggttaggtgttgcacgacaacgtcaagcaattgtggatggtttaagagacagtgtgctcggcttctcagtgaatgtgcctggaacctcggcaaaagatgttatggacatggtccttttaactcagtactttgacaccatgaaagaaattggcgcctccagcaaatcatctgccgttttccttcctcatgggcctggtgctgtaagagatgtggcaagccagattcgtgacggactccttcaagcttctactgagcgttaaatgttcactctcagaaatgtcaatgtgtttcctttgaagcagctattcccttctgtctttattttgtcgagtgtggaaatatgttgtgagattgactttgaagttgtgattagtactatcctatgtacagaagtatgtaaatttttgaagatcttcagacccttttttgaagaattatgaattgctatc

SEQ ID NO: 3690 - DNA, 1673 bp, Amborella trichopoda
accctatccgtctccattataaacaaagttttctctctctaaactccaaagcgcgcgaccacaattattttccctatgctcggtactctgtttctcaggcgttcgtccataattagggttaggattttctaattttaaacccttgtaaacgcaattttttggcccgtcttttattgcctgtccttttctgtaatttttcggagattaccttgctgtttcgtgatcgtttgccttcctttataaataattgagcagagtgctttttctccattaagggttcattcttcattttctgaagtcaagcaatggggcaattgttttgttgtctgcaagttgatcaatctaatgttgccattagagaacaatttgggaagtttgatgatgtcctagaacctgggtgccattttctgccctggtgcctgggaagccaggtggctggttaccttacactgagggtgcagcagctcgatgttcgatgtgagacgaaaactaaggacaatgtatttgtcacggttgttgcatctatccaataccgagccttggcagataaggcttctgatgctttctataagctcagcaacacgaaaaatcaaatccaagcttatgtttttgatgttatcagggccagtgttccaaagctcaaccttgatgatgcatttgagcaaaagaatgaaatcgcaaaggctgtggaggaggagcttgagaaggccatgtcggcatatggttatgagatagtccagacacttattgttgacattgaaccagatgcacgagtgaaacaggcaatgaatgaaatcaatgcagcttctagaatgagagttgcagccaacgagaaagctgaggctgagaaaatcctccaaatcaagagggcagagggtgaagcagagtccaagtatctctctggtcttggaattgcaagacaaaggcaagcaattgtcgatggtctgagagagagtgttatcgcgttctcttccaatgttccaggtacttctgctaaagatgttatggacatggttttggtgacccaatactttgacacaatgaaagagattggggcctctgcgaagtcctcttcagtgttcattccacatgggcctggcgctgttcgtgatgttgcgtcgcagatcagggatgggcttcttcaggccaacttggggtgaagactctctctctagcgtgctctcttatgccctctctggcttgtcgcctctctctgtgcagcttcgtatctctctatagcctgctgttatgccttgtttctctcatgctgatgcgcctctctcagtctgtgtgtgcacacgtgccttcctctctcagtttgtgtgtgctcgcccgccttccgcaacatgttttgaggacttatttgcatgtatgatattggttttctccactttttcatttggagtggtttatatgtgatggtttgtggagcttcttgtatggcaaagctgtctacttttgtctattattaaagccaattggttgaacacctaaactggagatctctctcattttggttttgcgtatgtctatatggttttgtggaggtggggtgtataaagacacatgtactttttgtctttgactctgtcattcaatgcacactactttaaaatagttcgtgacattgtttataaaaattgagttgcttgttcttggtgactaaaaattga

SEQ ID NO: 3691 - DNA, 1672 bp, Amborella trichopoda
accctatccgtctccattataaacaaagttttctctctctaaactccaaagcgcgcgaccacaattattttccctatgctcggtactctgtttctcaggcgttcgtccataattagggttaggattttctaattttaaacccttgtaaacgcaattttttggcccgtcttttattgcctgtccttttctgtaatttttcggagattaccttgctgtttcgtgatcgtttgccttcctttataaataattgagcagagtgctttttctccattaagggttcattcttcattttctgaagtcaagcaatggggcaattgttttgttgtctgcaagttgatcaatctaatgttgccattagagaacaatttgggaagtttgatgatgtcctagaacctgggtgccattttctgccctggtgcctgggaagccaggtggctggttaccttacactgagggtgcagcagctcgatgttcgatgtgagacgaaaactaaggacaatgtatttgtcacggttgttgcatctatccaataccgagccttggcagataaggcttctgatgctttctataagctcagcaacacgaaaaatcaaatccaagcttatgtttttgatgttatcagggccagtgttccaaagctcaaccttgatgatgcatttgagcaaaagaatgaaatcgcaaaggctgtggaggaggagcttgagaaggccatgtcggcatatggttatgagatagtccagacacttattgttgacattgaaccagatgcacgagtgaaacaggcaatgaatgaaatcaatgcagcttctagaatgagagttgcagccaacgagaaagctgaggctgagaaaatcctccaaatcaagagggcagagggtgaagcagagtccaagtatctctctggtcttggaattgcaagacaaaggcaagcaattgtcgatggtctgagagagagtgttatcgcgttctcttccaatgttccaggtacttctgctaaagatgttatggacatggttttggtgacccaatactttgacacaatgaaagagattggggcctctgcgaagtcctcttcagtgttcattccacatgggcctggcgctgttcgtgatgttgcgtcgcagatcagggatgggcttcttcaggccaacttggggtgaagactctctctctagcgtgctctcttatgccctctctggcttgtcgcctctctctgtgcagcttcgtatctctctatagcctgctgttatgccttgtttctctcatgctgatgcgcctctctcagtctgtgtgtgcacacgtgccttcctctctcagtttgtgtgtgctcgcccgccttccgcaacatgttttgaggacttatttgcatgtatgatattggttttctccactttttcatttggagtggtttatatgtgatggtttgtggagcttcttgtatggcaaagctgtctacttttgtctattattaaagccaattggttgaacacctaaactggagatctctctcattttggttttgcgtatgtctatatggttttgtggaggtggggtgtataaagacacatgtactttttgtctttgactctgtcattcaatgcacactactttaaaatagttcgtgacattgtttataaaaattgagttgcttgttcttggtgctaaaaattga

SEQ ID NO: 3692 - DNA, 1293 bp, Aquilegia formosa
gcttggtgaaatctattttgggaaacgcgccacggtagttcatcacgatttcgatgatcttgaactgagtctgagtcggagtcggtccctcagcaacaacaacataacacaacacgactctttcattaaaaatcataataaaactatcttttcgtttcacttttcgtttgtttgtatagaaagataaaaccctagaaatcatcaaatcatcattatactttttgctctcttaacaatgggaaatgttttctgcgcacaagtggatcagtcaactgttgcaattaaggaaacctgggggaagtttgatgaaattctcgaacctggttgtcacttcttgccttgctgcttgggacaatcaatagctggttatctttctctgcgtgttcaacaacttgacgtacgctgtgaaacaaaaaccaaggataatgttttcgtcactgttgttgcatctatccagtatcgtgcgttggctgataaagcgagtgatgcgtactacaagctcagcaatactagagctcagattcaagcctacgtttttgatgtcatcagggcaagtgtgccaaaattagatttggattccacttttgagcaaaagaatgatatcgccaaagctgtcgaagatgaactcgagaaggcaatgtcactctacggatatgaaatagtccagactcttattgtggatattgaaccagatgagcacgtgaagagggcaatgaacgagatcaatgcagctgctaggatgagagcagcagcgaatgagaaggctgaagcagagaagatacttcagatcaagcgagctgaaggagaggctgaatctaagtatctggctggggtaggtatagctaggcagcgtcaggctatagtagatggattgagagacagtgtgcttgctttctcttctaatgttcctggaacgtcttctaaggacgtcatggacatggtcctgataacccagtacttcgataccatgaaggagattggagcatcgtcaaagtcctcgtcagttttcattcctcatggtcctggtgctgtcaaggacattgcttcgcagatacgagatggcctccttcaaggagaggctggcagtcaccactgaagattgacatctgggttctttaatattatttgtgatttggaatgagctgttggtataggtacgacctcttttagatgtccataatgttgtaagtaaactatagatggaatatttcacagttctgaaacttgtgttggcaacttggttttgttgtgaatcttgaaaagggtatttgaaactagctacctaggaaaggg

SEQ ID NO: 3693 - DNA, 1310 bp, Beta vulgaris
aataacttcttagttgttagttgttactaagggaagtccttttctcacgatattgcttactataagttataactggagacagctttctctttttcgtgcttgtcaaattccctcactgcgattctcacttttcgattttcgtaggtttttctttctcatttgatcttcaagagaaccaaaccatgggacaagctttgggatgtgttcaagtggaccagtcaactgtggcaattagcgagagatttggaaagttccaagatgtgctagatcccggatgtcactgtgttccatggtgccttgggagccagttggctggtcaacttaccttgcgtctacagcaacttgatgttcgctgtgaaaccaaaactaaggataatgtttttgtcacagtggttgcatctgtgcaatatcgagcactggcagaaaaggcagcggatgctttctataagctcagtaacactagggaacagatccaagcttatgtctttgatgttattcgtgctagtgttcccaaactgtaccttgactctgcatttgagcagaagaatgatattgcaaaggctgttgaagaagagctggagaaggccatgtcagcttacggctatgagatagttcaaactcttatcgtggatatcgaacctgatgtgaatgtcaagagagcaatgaatgagatcaatgcagctgctagaatgagactcgcggcaaacgagaaggctgaagcagaaaagatactgcaaataaagagagctgaaggagaggcagaagctaaatatctgtcagggctgggtatagctaggcagcgtcaagctattgttgatgggctgagagacagcgtgctcaacttctctgagactgttcctggcacaagtgctaaggatgtcatggacatggttctagtgacccagtactttgacacaatgaaagagatcggtgcgtcatcaaagtcatccgctgtgttcattcctcacggtccaggcgctgtaaaggacattgcaactcaaattagagatggcctccttcagggaaacacaatggagaggtagtaaggttaagatgttgatctttgccctcatcaagtttgctgtatatgtccagtatgcatttcaatggagtcatcttattctgtggtaaatgatgtatagaaattgcttggtgcgtttagatatgaagaaggggaggggggatttaatttggtattgttcagacattatattggtattttgcagctttgataggattactgaaactggttttattaatgtttgtgctaaataatctttctattagattcagctacttttgaagcaaaa

SEQ ID NO: 3694 - DNA, 1224 bp, Cucurbita pepo
ttttctgttgcatctctgttctcgccttccttcgattcccacgcaatcctttccaattcccattttaaagaatccatttcacagttgttgttcattctttatcccctttcctcgcagatttccgtgatctgaatccttttcccttttcgattctcccaccgggaagcataatacttttaagttgataactctaaaatgggtcaagcacttggttgcattcaagtcgaccagtcaactatagccatcagagaaacatttgggaagtttgatgacgtacttgaacctggttgccattgtctaccttggtgccttggaagccaggtagctggttatctctctttacgtgtccagcaacttgatgttcgctgtgagacaaagacgaaggataatgtttttgtcaccgtcgttgcctctattcaataccgagccctggccgacaaggcttcagatgctttttataagctaagcaatacaagagaacaaatccaagcttatgtctttgatgttattagggcaagtgttccaaagttggaccttgattcaactttcgaacagaagaatgatattgcaaaagctgtggaagacgaactggagaaggccatgtcagcttatgggtatgagatagttcagactctgattgtggacattgagccagatgagcatgtaaagagagcaatgaatgaaatcaatgcagctgcgagaatgagagttgctgcaaatgagaaagctgaagcagagaagatactgcagattaagagagccgaaggagacgctgaatccaagtatctggcagggctcggtattgcacggcagcgtcaagccattgttgacgggctcagagacagcgtgctagcatttgccgaaaacgtccctggaacgacatctaaggatgtcatggacatggttcttgtgacccaatacttcgacacgatgaaagaaatcggagcatcgtcaaagactaattcggttttcatcccacacggacctggtgcagttaaagatataacttcacagatcagagatggtcttctccaaggaagccgaactcagtagattggtgaggattgaagatgggatacaaaagtatataaaagattgcatgtgaataatgggtttggtggttggtttgtttgtttaagctgcaaatttctgtcctatgtagatttgtttgaataaatttctgtttctcttaattgatctaacaaagcgtattgatattaattt

SEQ ID NO: 3695 - DNA, 1167 bp, Zingiber officinale
ataaagcgatctccgctgcacttctttgtagtcttctttaagtttgcccgtcaaatttctggtggtaaacaatgggacaactgctttgctgtgtacaagttgatcaagcaactgtcgcaatcagcgagcaatttggcaagtttgatgctgtccttcagccaggatgcaattgtgtgccatgggttactggtaagcgaattgctggtcatctctcactgagattgcaacagttggatgtcaagtgtgaaacaaaaacaaaggataatgtttttgtaaatgtcattgcctcagtgcaataccgtgctatgaccaacaaggcgagtgatgctttttacaaactgaccaatacaagaactcagattcaggcttatgtctttgatgtaatcagagccacggtaccgaagctcaatctggatgatgtatttgagcagaagtctgaaattgccaaagcagttgaggatgaactggaaaaggctatgtcagcttatggatatgaaatagtgcaaacattaattgttgatattgagccagatgaacatgtaaaacgtgcaatgaatgaaattaatgctgctgcaagattgaggatggctgcaaacgagaaggccgaagcagagaagatcatccagataaagcgggctgagggcgaggcagaggccaagtatctctcaggtttaggtatcgctcgacaacgccaagccatcgtggatggacttagggacagtgtcctaggcttctctggaaatgttccaggcacctcacctaaggatgtgatggacatggtgctgataactcaatattttgataccatgaaggagattggtgcgtccaacaaatcatctgctgtatttgtcccccatggacctggcgctgttcatgatatcgcacagcaaatgcgggatggcattcttcaagcttccttgagcaagtaactatcatgtctgaccgactccgaggacaggctggatccgaggttcggggcgtctacatacaaaaccaatgcattagtgttgatgaacttgttgccgtattgatgtgtggggattgtgtgatatcttagtaagctgtgaatcttctgctactcttttcaagtcttatgggtaatggttgcaatactagttgaatgaactattaaatgtacatgcttttacatagcagtcagtgttgcag

SEQ ID NO: 3696 - DNA, 1609 bp, Vitis vinifera
atgctccacttattaaacatttttgttattttaaaaaatataatattcatatttaaccttgaaaggggaccgaatgccccatattttagaagtttcttggcattgtgccattctcgcttccaagctcacaaatatcttatcggtctatctctatcgcccttatatattaccaccctttctctctgctctcaattctcttcttctcctcatcgctccctctgtatcggatcggggttccatagactcttaagaatcattacaatgggacaagctttttgttgtattcaagtggaccagtctaatgtagctatcaaagaacaatttggaaagtttgatgaggtgcttgaacctggttgccattgtttgccatggtgttttgggagccagttagctggtcatctttcattgcgtgtgcagcagctagatgttcgatgtgaaacgaaaactaaggataatgtttttgttactgttgttgcatctattcaatatcgagccttagcagaaaaggcatctgatgctttctataagctcagcaacaccagagcacagatccaagcctacgtctttgatgtaattagagctagtgttccaaagttagacctggattcaacctttgaacagaagaatgaaatagcgaaagctgtggaagaggaacttgaaaaggcaatgtcagcttatggattcgagatagttcaaacacttattgtggatatcgaaccagatgagcatgtgaaaagagcaatgaatgagataaatgcagcttcaagaatgaggttggctgctactgagaaggccgaagctgagaagatattgcagataaagcgagctgagggagatgcagaatccaagtacctggctgggcttggcatagctcggcagcgccaggccattgtagatgggcttagggacagtgttcttgccttctctgtgaatgtgccagggacttcatcaaaggatgtcatggacatgattctggtgacccagtactttgacacattgaaggatataggtgcatcctcaaaggcttcgtctgttttcatcccacatgggccaggtgctgtgggagacattgcttcacaaattagggtaggtctccttcaggctgagacagcaaaacattagcattaaatttaatcatttaatcccatggcccttgtctagttccaatggtatgcctaaagattagtgtgctatactgctattgtctgaagttgcttttacattgctttctattctaggttgtaattgaatactgtaggagaaaatgtgtgtaagtagtaaataatggagaagggtgatgttccatgcggttagggcattgtggtaaagatgtttatataaatatgttggattggaaaccggaatcctttgtgatgtaactgttgggttactatttgttctgactatcgcaagtgccgcaatagtctgttgaaaacaaattaaatgctggatctgtctcaggttcttggcatttcgcatataccatattgttttctgagtttatatggttagggcctattagtggctatttgtctcacggatcaaagcaatgactttagtgctgcaccgcaattatacaatttttgtttctttgactgatttgcattag

SEQ ID NO: 3697 - DNA, 1036 bp, Pseudoroegneria spicata
gggaactttgatagtgtgcttgagccaggatgccactgtctgccttggatctttgggaaacgtgtagttggccatctcacactcaggttgcagcagctggatgtgcgctgtgaaactaagacaaaggacaatgtgtttgtcacagttgttgcatcgattcagtaccgacctctggctggcaaagaaagtgacgcatactacaaactgaccaacacaagatcccagattcaagcctatgtctttgatgtgatcagggcaagtgttccaaagctcaacctggatgatgctttcgtgcagaagaacgatatagcaaaggctgtggaggatgaacttgaaaaggctatgtcagcatatggctttgagatcgtgcagaccctcattgtcgacatcgagccagatgcgcatgtcaagcaggcgatgaatgagatcaatgcagctgcaaggatgagggtggctgcaaacgagaaggcggaggctgagaagattgtccagatcaagcgtgccgagggtgaagcagaggccaagtacctgtccggcctcggtatcgcccgccagcgccaggccattgtggatggcctgagggacagcgtcctgggcttctcagtcaatgtgcctggcaccactgcaaaggacgtgatggacatggtgctgatcacccagtactttgatactatgaaagagattggagcatcctccaagtcctcggcggtgttcatcccccatggccctggtgcggtgcgtgacatcgctacgcagatccgcgacggtcttcttcaaggccagtctgcctctgacaactagcagttggcttcgctggcatgaactttgaagctggtggtggtttgtggtttggtagctattgcctacagtactgtctaatatgatgcatgccgtattattatgaacttatatggaaccatgtgtggatcgtggcatgccatgccttaggttgatgtgcggtaacaaaacctttaaccttgtgggaatgcaggatgatataagtgtgttatgaaatgttggtgatgaacttgatcta

SEQ ID NO: 3698 - DNA, 1506 bp, Oryza sativa
attagaagcagttctcttttggatggagggagtattaattttggcatgcttgcggataggcacaaagaaacagggacggtttatacttgataagcagcggcggaagcccccacgattttcagaatttgccctcctcacttctatacttcaatccccttcctttatttttttttttgggaggggccgaggcaaccgtcgccactccgacgatcccgtcccatccgccgccgccgccggagatttcctcgagataagccatgggtcaagcactcggtttggtacaagtagatcaatcgacagtagccatcaaggagtcctttgggaagtttgatgaggttcttgagcctggatgccactttttaccctggtgcatagggaagcagatcgctggatatctttccttgcgtgtgcagcagctggatgtccgttgtgaaacaaagactaaggacaatgtttttgtcaatgttgtggcatctgtgcaataccgtgctcttgctgagaaggcatcagacgccttttacaggcttagcaacaccagggagcaaatccagtcgtatgtttttgatgtgatcagggctagtgttccaaagatgaacttggatgatgcatttgagcagaagaatgagatcgcaaaagctgtggaagatgagcttgaaaaggcaatgtcaatgtatggttatgagattgtgcaaactcttattgttgatattgaaccagatgagcatgttaagagagcaatgaatgaaatcaacgcagctgctaggctgagggtggcagccaatgagaaagctgaagcagagaagattcttcagatcaagagagctgaaggagatgcagaatccaagtacttggctggtctgggtatcgcaaggcagcgtcaggctatagtggatgggctgagagacagtgttcttgccttctccgagaacgtgcctgggacctctgccaaggatgtcatggatatggttctggttacgcaatacttcgacaccatgaaggagataggagcctcatccaagtcctcttcagtgttcatccctcacgggccaggtgccgtcaaagatatcgctgcgcagataagagatggtcagctccaggccaaattgatctaagaggatggcagggaatggatgttctggatttcttgggcattacgaaagtctgcagtaataccttatctacgtattcgatattttgtgagataaaaacttaggcaaaagaagttctattgtaagtatcacatgcacgcgtgcttcagtaccgtttgttcatagtaattcctgaggttatttccctagacgagtgtcaatatacttcttgaattgcatgtttctgtaaataattcctaagtgttaccgggctgtttggaattatttgcatgttgatgttagtgaccttaagtaatgtcccatcttattatgtgatgtcatgatgatttccagaatgctagagtttaatactgcttgtggagaaatatcaaatactccctccgttttgagattacct

SEQ ID NO: 3699 - DNA, 1283 bp, Trigonella foenum-graecum
tcttgtgtgttgcgtccaagttgaccaatccaaagtggctatgaaagaaggttttggaaaatttgaaaaggtgcttcagccaggatgtcattgcatgccatggttccttggaaagagaattgctggtcatctctctcttcgggtgcaacaattggatataaaatgcgagaccaagacaaaggataatgtctttgtcaatgttgttgcttcgattcaataccgtgccttggcagacaaggctaatgatgcattttacaaacttagtaacacaaggaaacaaattcaggctaatgttttggatgtaatcagggcaagtgttccaaaactctacttggatgatgcttttgagcagaaaaatgaaatcgcaaaagctgtggaggaagaacttgagaaggctatgtcagcttatggatatgaaattgttcaaacactgattactgatatagagccagatgagcatgtgaagcgggctatgaatgaaatcaatgctgctgcaagaatgaggttggcagctaaggagaaggctgaggcagagaagatcttgcaaattaagcgagccgagggcgaggctgaatctaaatatctctctgggctgggtattgctcgccaacgtcaagccattgtggatggtttgagagacagtgtgattggattttcagttagtgtaccagggacaactgcaaaagatgtcatggatatggtccttgtgactcaatattttgacaccatgaaggaaattggtgctgcctctaagtcttctgctgtgttcattccacacggacctggtgctgttcgtgatgttgctagccaaattcgtgatggacttctccagggttctgtatctcatgagtagcttctattcctcctacttcgtatctgatttctaagggagtgtggtgattttataatgctttatgtctatgtagtatatgactttgtatcagagtaaactgagaactcgatcctccgaatattatgctattactatatcagtcttgcaaagatatatttgtcattaagttaatccttcaatgatgtaaaacattgtcacattttcttcttaaggaaaacggtgacacaaaaatacaaatttggtaattgttttgtatcgttgtgggattaatttgatgataaattctttggagaatggtctaaatgaattactctagttttatagtaatttcagtttggaactctttttatagataactagaccatcaactctttctacagtataattgatgcataactagaccatcaactatccctgttattgcttattc

SEQ ID NO: 3700 - DNA, 1209 bp, Vinca minor
ctaataattaatcctttcatttttttggaagtaaataaaagatagatataactcttcatagtgattgttattggaattcatcttcaaccacacaccgcttttctccgctcctcttagattctatagaatggggaacctgttttgcttgacccaagttgatcaatcccaagttgccattaaagagaaatttggcaagtttgacgatatacttgagcctggttgccatttccttccgtggtgtttggggagccagattgctggctatctgtctctaagggtgcagcaactggatgtacgttgtgagaccaagacaaaggataacgtgtttgtcaatgtggtagcatcaatacaataccgtgccctggctgataaagcaagtgatgctttttacagactcactaatactagagcccaaatccaagcctatgtttttgatgtcatcagagcaagtgttccaaagatgaatctcgatgatgcctttgagcagaagaatgaaattgcaagagcagtggaagatgaactcgcaaaggctatgtctgcttatggatatgagattgttcagaccctcatcgtcgatatagaaccagatgagcatgtgaaacgcgctatgaatgaaattaatgcagctgctaggttcagggttgcagctaacgagaaggcagaagctgagaagataatccagatcaaacgagctgaaggagaggcagagtccaagtacttggcgggattaggtattgccagacagaggcaagcaattgtggatggactaagggacagcgtgctcgggttctctgtgaatgtcccaggaactactgccaaggatgtcatggacatggttcttgtcacccaatattttgataccatgaaggaaattggtgcatcctccaaatcctcggctgttttccttccgcatggacctggtgctgttcgtgacgttgcccagcagatacgagatggactactccaagcaacaacagctcaccagcaagcaaatcttctctaaagggtttttctgcatttatgaacgatcttcctctctgtctcctgtttaaagatattttagttttgagttttgttggaaactactacatagagaaatatctgtgcatacttacgtgggtgttagcagagaaatgtttatttgttagtttcctacataaagtgttcattttatggttcaacaaataaattgtgcttacaagcatatga

SEQ ID NO: 3701 - DNA, 1571 bp, Fagus grandifolia
gttagtaagaaagactttggtcgaatcgatccaaccggtactctgagataccaactaggacacagaagaatccaactactaacttttagtaaaccaacctccatgccgtcccttccctaccaacccgcctttacggtaatacttctattgcaagagcgcgaggcgcgtctggtgcaataaccgcctcgcatttcttctgctctgctccttctacttctttcctaacttaccgttacaaaccaaacgacgtatatatatatatatatatatatatatttttttttggggtaatatttgcctaattgcctcgcggtttctcacacatcgccgtcgtttttactgttaattattcgtctcccacaatctactataaatacagacatattttctaattcattttgtctcaaattcgtaattccgattctccgattctcattctctctctgtgaggcaaagtttcaattccacagttcgctagaataaaaaatggggcaagctctctgctgtgttcaagtggaccagtcaactgtagccatcaaagaaactttcgggaagtttgacgatgtgcttgagcccggatttcactgtttgccatgggtttttggacagcaggtagctggccacctctctttgcgtgtccagcagctggatgttcgatgtgaaacaaagacaaaggataatgtgtttgttactgttgttgcttctattcaataccgggccttatcagacaaagctgctgatgctttctacaaactcagtaataccagagcacagatccaatcctatgtctttgatgttattagagctagtgttccgaagctggagctcgactctgtttttgaaacaaaaaacgaaatcgcgaaagctgtggaagaggaactcgagaaggcatgtcagcttatggatatgagatcgttcaaacactcatcgtggacattgaacctgatgagcatgtaaaaagggcaatgaacgagataaatgccgctgctagaatgagggtggcagcaaacgagaaggcagaagcagaaaaaatcctgcaaataaaacgcgccgagggagatgctgaatcgaaatatctggccgggcttggcatagcccgccagcgtcaggccattgtagatggtctgagggacagtgtgctggctttctctgtgaatgtacccgggactacatcaaaggatgtcatggacatggttctggtgactcaatatttcgacacaatgaaagaaatcggtgcatcatcgaagtccaactctgttttcatcccacacggacctggtgctgtgagagacattgctacacagattagagacggcctccttcaaggaaattccatacagaattagtgtctcaagcccagcatatatgttggagggtggattttctaatggtatatgaactgattggtgcaaatatctaagagttgtgtccttttattcttcttcttcttttctacttttcaaattttactacatgagtgaagctatgggagttgttttgctaactgaggtggtgtggtgtatacatgattgtgttgaacttgggcatagtattatatttgctgtatcctc

SEQ ID NO: 3702 - DNA, 2632 bp, Elaeis guineensis
cgaatttttatatcctcttccaaatgtttggtccaggttgtttatgctttactggtccaggttttaacagataaagattagcatactcgtagcaccaggtttggattagtgtcttgctgaccggcgggcagcatgttgacttttgaaaagtcttacagcttttgttgttttgctaatagaaatattctctcccacaccatttatttatataaaccaggttgcaatatccacttttgttctaggatagcattctcgcagctgttttgaaggtaatcttccgatgccagatgtatcttattgatgttcattatagttctcaaaatcaattacttgtgatgctattttgtcttgagggttgtggcttaaaacctgttgtgctgtgcaaaaggactttggggtgcgtttggtttgggaaaaaagcaggatcaggaggtctatttatgctggttaaaggtgtctattccttatgtacgaattacaaggggaggttggaatagttttattcatggaataaagcactcttgtataccttcctgccttttttcatggacgaaacaccgtcggcctagaactgcttcagaacttttagtccaacagaaacaggagttacttgcggaatattccaaaaagaatgagtattcctatttcctgtaccgaacacagcccttgagtttctgaaaaggacatggaattggtgaatgaagtatctgatgattatagaataatgatttctgtacttatattaaatgtcaagactagggattatgtgttactctctctctctctctctctctctgtgtcgtctgtctgagacttaagtttcacgtttaactgttgcctctttcttaatatgcatgtgtgaccctgattatcaatgattctgtgaagctatctttccacctaacatttacaggctggcacatatttggttttaaaagttcatatgaattatatgtatttttgtccttcacaccatattgagtggtagatgaaggatattggtttttatgatgtggagatgattatcttgttcctgatgtataaactccatgaaatattactgcaagtgatatcgatattttttttccaccaccgtagggacatggcttcactggcctagtttgagcattttgatatatgagtatcagttgcagccagttgtctcactcgattatgggatttttattctgctatgctcaaatagatgtgtaggatcttagaaatttgaaccatagactgtgaagttctcataaacatatctgattgtaggactgaaggtaacgttacgtttgtaacaatgcttcttacacagattgtacccattagaaatatatttgcaattaataaacaggccattctgtttggtggttctcaaattatcactatattgaccaagcatgcccacatagtcgtagcttgcatcgcttaaaacttgatcatggaagaagcttgcagtgactgttgatggattctaatgggaatccaagcagcctcccattgatgtctccaaatacatgagcaaggttgatagcgcttgttgttgcttacaagtggatcagtcaactgtggctatcaaagaaacttttggtaggttcggtgatgtgcttcatcctggatgccactgcttaccttggtgtttagggcatcagattgctggctacctctcattgcgtgtgcaacaacttgatgttcgttgtgaaacaaagacaaaggataatgtgtttgtcactgttgttgcatctatacaataccgtgctcttgctgacaaggcatctgatgctttctacaaacttagcaacacaagggaacaaattcaatcttatgtttttgatgtcatcagagcaagtgttccgaagctgaatttagatgatgcatttgagcagaagaatgatattgcaagagctgtggaagatgaacttgaaaaggcaatgtcaatgtatggatatgagatagttcaaacactcattgtggatattgagcctgacgagcatgttaagagagcaatgaatgagattaatgcagctgctaggctcagggtggcagcaaatgaaaaggctgaagctgagaaaatactgcagatcaagcgggctgaaggagatgcggaatccaagtacttagcagggcttggtatagcacgccaacgccaggccattgtagatggcctgagggacagcgtgctggccttctcagtaaatgtgcccgggacgacaccaaaggatgtcatggatatggtgctggtgacccagtactttgacaccatgaaagagattggagcatcctccaagtcctcgtctgtgttcatccctcatgggccaggggctgtgagggacattgctgcacaaataagggatggcctcctccaagccaacaccactctccagtaagaccaaatggatgctagttttccagttatagcgctgttattgggaatatgcagaatacgaaatgtgagatggtgtaaatagtgtgtttatataggtaagttttattgtctttagtgccttgttgattatgttttaggttagttgttgaactagctattttcaaaacacagtttatgactgcactatcaaggtatatgggtggagataactatttttatcattattaattctttgttggtaaaattata

SEQ ID NO: 3703 - DNA, 5345 bp, Malus domestica
cgcggataaagataaaaccctctcgcccaaaatttccactcccttcgcggccctataaatatccacttctctgcaattcctatttcccaaatttcacgtggccgcttctcgtcttcgctaacctcgcagacaaacgcttccatcctgagaaaatgggacaagttcttggttgtgttcaagtggaccagtctactgttgctatcagggaaacttttgggaagttcgatgatgtgcttgaacctggctgtcactgtttgccatggtgtttgggtagccagatagctggtcatctctctttacgtgtgcagcaattggatgttcgttgtgaaacaaagacgaaggataatgtttttgttactgtggttgcctctgttcaataccgagctttggctgagaaggcttctgatgctttttacaagctcagcaataccagagggcagatccagtcttatgtctttgacgttatcagggcaagtgttccaaagttggacctagattcgacctttgagcagaagaatgatatagccaaagctgtggaagatgaacttgcaaaggccatgtcgcattatgggtttgagatagttcaaacactaattgtggatatcgaaccagatgagcatgtgaagagagcaatgaatgagataaatgcagctgctaggatgaggctggctgcaaccgagaaagctgaagcagagaagatactgcagattaagcgagctgagggagaggcggagtccaagtacctgtcggggctcggcatagcaaggcagcgccaggccattgtggacgggctgagagacagtgtgctggccttctctgagaacgtacccgggacatcatccaaggatgtcatggacatggttctggtgacccagtacttcgacacattgaaggacatcggtgcgtcctcaaagtccaactcggttttcatcccgcacggacccggtgctgtgaaagatatctcttcacagataagagacggcctccttcaaggaagtcggcaacgtgtcacagagcagcacctaaaagccgaatatgcccgaagcaacctctcgtacgattctcgaggtcatcaaagcaccgaacctctcctccaaatcaacggccacaaacccgtacctctacccagaacaggatccaacggcccacgcctctcctctcagtctcagcaatcacccttttttggggttctagattttatccatttcgcttcttcgtcttctaactagaacacaaatccagctctgatttctctgaaattttccttccaaattttctcgagaaacaatcatggtgaagggcccaggactctacctcgatatcggcaagaaagccagagatcttctttacaaggattaccagagcgaccacaagttcaccgtcaccacttacacttccaccggagttgcaatcagttcgaccggaatcaggaagggtgatctgtatttgggggatgtcagtactcagctgaagaacaagaacatcacaactgatgtgaaagttgacaccaactctaacgttatcacgaccattactgttgatgaaccttcacctggtctcaaggcaatctttagctttattgcacctgaccagagatctggcaaggtggaactccaatatcagcatgagtatgctgggataagtaccagcattggtttgactgccaatccgattgtgcacttttctggggttgtggggaacaatcttctctctctgggaaccgatctttctttcgacactgcctctgggaactttaccaaagtgaatgcagggttgaatttcacccattctgacctcattgcttccctgttactgaacgataaagctgatactattactgcttcctactaccacactgtaagcccactcaccaacactgctgttggtgcggagctgtcccatagcttttcaagcaatgaaaacagcctcacaatcggcacagcgcatgcacttgaccctctaaccacagtgaaggctcgggtgaataactacggcagggcaagcgctctcatccagcacgagtggcgtcccaagtcattcttcaccatctcaggagaggtcgataccagggcaatagagaagagcgcaaaggatagagcccctcctccaccactaccgtcgacagaaacccagccaccgccttccgccgtcgaagcacccattaaagctcagctcttctttcactgcttttccaaagaagctagtagtctccaatggccgcagcttctgcaacttccagcctcccactctcagtgtcagagctgcctccaccgatacagccaccgtcgaggccaccgaattcgccgacgccttctacaaggagaccttccctctcaagcgaactgaagtggtggagggaaagatgatcgtgaaattagataatgggaaggatgcaaagaattgggtgctgactgtgggttgtaatcttcctggaaaatgggttcttcactggggagttaattatgtggatgacgtcggcagtgaatgggatcagcctcctagtgaaatgagaccagctggttcagtttccatcaaggactatgcaatagagacacccttgaaggaatcgttgtcgccggtgggaggcgatacatctcacgaagtgaagattgatgttacacccaacagcgcaatcgcagcgataaattttgttctcaaggatgaagaaaccggtgcctggtatcagcatagagggagagactttaaagtgcctttcgtgggctacctgcaagacgatgacaatgtagttggagcaacaagggccttgggcgcgtggtcaggaactttgggaaaactatccaatgtgtttgtcaaagcagaaacatcaaattccaaagatcaagaaagcagcagtgaatccagagaccctcaacagaaaactatgcgtctagaaggattctatgaagaactgccaattgcaaaagaaattgctgttaaccattcagcaactgtttccgttaggaagtgccctgagactactaagaatcttctatacttggaaacagatttacctgatcatgctgttgttcactggggagtttgcagagatgatgctaaaagatgggaaattccagctgccccgcatccaccagaaacagtagttttcaaggacaaggctttgcggactcgattacagcaaagggaggatggaaatggatgttctggactgtttaccttggaagaaggactcgcaggatttctttttgttttcaaactaaatgaaactatgtggttgaattgtgtgggcaatgacttctacatcccccttttaagctcaaataactcaattgctgtgcaaaatgaggttcagtctgaagatgctcaggtacctgacagaagtagagaaactaattttactgcatataccgatggtataatcaatgaaataaggaacttggtgagtgatatttcctctgagaagagtcaaaggaaaagatccaaagaagcacaagaaaccattcttcaagaaatagaaaaattggctgctgaagcgtatagtatcttcagaactactgttccaactctaccggaggaaatcattgcagaaactgaaaaggtgaaagtcgcccctgccaaaatatgctcggggacaggaacaggttttgaaatattgtgccaaggttttaactgggaatctagtaaatctggaagatggtacgaggaactcaaaagtaaagctgcagaattatcctcactaggtttcactgtgatttggttcccacctcctacagattctgtgtcgcctcaagggtacatgccgagggatttatacaatatgaactccagatatggaaatatggacgaactgaaggagactgtgaagacattccatgatgccggtttaaaagttcttggagatgctgttctgaatcaccgttgtgcagaatatcagaatcaaaatggtgtttggaatatatttggtggtcgtttaaattgggatgaacgtgcagttgttgcagatgatccacattttcagggtaggggcaacaaaagtagtggagatagttttcatgctgccccaaacattgatcattcacaagattttgtgaggaaggatatcagagaatggttatgctggctaagggacgatattgggtatgacggatggaggcttgatttcgttagaggattttggggtggctacgtcaaggactacatggatgccagtgagccctactttgccgtaggcgagtattgggattccctaagttatacatacggggaaatggatcacaatcaagatgcacacaggcagagaattgttgattggatcaacgctactaatggaacttgtggtgcattcgatgtcacaacaaaagggattctccatgcagcactggaaagatgcgagtattggcgattgtcagatgagaagggtaagcctccaggggttcttggatggtggccatctcgtgctgtcactttcatagagaatcatgatactggttctactcagggtcattggaggtttccaaataaaaaagaaatgcaaggatatgcatacattttgactcatccgggaacacctacagttttctatgaccacattttctctcactaccaatctgaaattgctgctctgatctctctcagaaaccggaacaagctcaactgtcggagtagagttaaaatcaccaaggcagaaagagacgtctacgcggccatcattgatgaaaaggtcgccatcaaaatcggaccaggtcattacgaacctgctagtggacctcaaaattggaataaaagccttgagggaagagactacaaggtctgggaagcgtcataaattttttctgcaccggtatgtatgtaacttcgagtgtataaggtttgagtaccggatgattcaataaggaagttcccatatttacattgtaagcaaatcaaaggatgccgagatagagtaatatgtacttctctctagaggtctggctgacacccttgaattgaagttgtttcggcagacattttccgaatttaagggactgtagacgctcaactgaggacgagacgggccagcctgcttcagcagcacagaatcgcggccagtcggctgagtgtggaagtggtgagcatggtactgggttccaagggcagtgctccatcttacacacactgttgactctccaacttatactgatgcttttaaccaataatgtataaattggtgcatgccagtgactcgtggtccatgaacgttgagtgagtttcctatctgaacttttattctgtctcacattgctccagtccatcaactttatgcatggactcgttaattttttagtattgttcttgaaacaggatgatcgatatatcgttaatatgtgatccatatattatatatggaa

SEQ ID NO: 3704 - DNA, 1341 bp, Aquilegia formosa
gcttggtgaaatctattttgggaaacgcgccacggtcgttcatcacgatttcgatgatcttgaactgagtctgagtctgagtctgagtcggagtcggtccctcagataaattcgcaacaacaacataacacaacacgactctttcattaaatcataataaaactcttttcgtttcacttttcgtttcacttttcgtttgtttgtatagaaagataaaaccctagaaatcatcaaatcatcattatactttttgctctcttaacaatggggaatgttttctgcgcacaagtggatcagtcaactgttgcaattaaggaaacctgggggaagtttgatgaaattctcgaacctggttgtcacttcttgccttgctgcttgggacaatcaatagctggttatctttctctgcgtgttcaacaacttgacgtacgctgtgaaacaaaaaccaaggataatgttttcgtcactgttgttgcatctatccagtatcgtgcgttggctgataaagcgagtgatgcgtactacaagctcagcaatactagagctcagattcaagcctacgtttttgatgtcatcagggcaagtgtgccaaaattagatttggattccacttttgagcaaaagaatgatatcgccaaagctgtcgaagatgaactcgagaaggcaatgtcactctacggatatgaaatagtccagactcttattgtggatattgaaccagatgagcacgtgaagagggcaatgaacgagatcaatgcagctgctaggatgagagcagcagcgaatgagaaggctgaagcagagaagatacttcagatcaagcgagctgaaggagaggctgaatctaagtatctggctggggtaggtatagctaggcagcgtcaggctatagtagatggattgagagacagtgtgcttgctttctcttctaatgttcctggaacgtcttctaaggacgtcatggacatggtcctgataacccagtacttcgataccatgaaggagattggagcatcttcaaagtcctcgtcagttttcattcctcatggtcctggtgctgtcaaggacattgcttcgcagatacgagagggcctccttcaaggagaggctggcagtcaccactgaagattgacatctgggttctttaagattatttgtgatttgcaatgagccgttggtataggtacgacctcttttagatgtccataatgttgtaagtaaaactatagatggaatacttcacagttctgaaacttgtgttggcaacttggttttgttgtgaatcttgaaaagggtatttgaaactagctacaggaaagggaaaaatcatatttgagtatt

SEQ ID NO: 3705 - DNA, 904 bp, Secale cereale
cagactcactgccacttcaccgtcaccgctccccctttccccactcttctccaaccccggacggaggtatgggcaatctgtgctgctgtgttcaggtcgatcagtctaccgtggccatcagagagcagtttgggaagtttgacagtgtgcttcagccaggatgccactgcctgccttggatcttagggaaacgtgtagttggccatctcacactcaggttgcagcagctggatgtgcgctgcgaaactaagacaaaggacaatgtgtttgtcactgttgttgcatcaattcagtaccgtcctctggctggcaaagaaagtgacgcatactacaaactgaccaacacaagatcccagattcaagcctatgtttttgatgtgatcagggcaagtgttccaaagctcaacctggatgatgctttcgtgcagaagaacgatatagcaaaggctgtggaggatgaacttgaaaaggctatgtcggcatatggctttgagattgtgcagaccctcattgtcgacatcgagccagacgcccatgtcaagcaggcgatgaatgagatcaatgcagctgcaaggatgagggtggctgcaaacgagaaggcggaggctgagaagatcgtccagatcaagcgtgccgagggtgaagcagaggccaagtacctgtccggcctcggtattgcccgccagcgccaggccattgtggatggcctgagggacagcgtcctgggcttctcagtcaatgtgcctggcaccactgcaaaggacgtgatggacatggtgctgatcacccagtacttcgatactatgaaagagattggcgcgtcctccaagtcctcggccgtcttcactccccatcggccctggtgcggttcgtgacatcgccacgcagctccgcgacggtcttc

SEQ ID NO: 3706 - DNA, 944 bp, Secale cereale
aatgcccgactatttagggccgcgccgcggtaggaagggagggtgggcactgggcacacacacagactcactgccacttcaccgtcaccgctcccccctttccccactcttctccaacccccggacggaggtatgggcaatctgtgctgctgtgttcaggtcgatcagtctaccgtggccatcagagagcagtttgggaagtttgacagtgtgcttcagccaggatgccactgcctgccttggatcttagggaaacgtgtagttggccatctcacactcaggttgcagcagctggatgtgcgctgcgaaactaagacaaaggacaatgtgtttgtcactgttgttgcatcaattcagtaccgtcctctggctggcaaagaaagtgacgcatactacaaactgaccaacacaagatcccagattcaagcctatgtttttgatgtgatcagggcaagtgttccaaagctcaacctggatgatgctttcgtgcagaagaacgatatagcaaaggctgtggaggatgaacttgaaaaggctatgtcggcatatggctttgagattgtgcagaccctcattgtcgacatcgagccagacgcccatgtcaagcaggcgatgaatgagatcaatgcagctgcaaggatgagggtggctgcaaacgagaaggcggaggctgagaagatcgtccagatcaagcgtgccgagggtgaagcagaggccaagtacctgtccggcctcggtattgcccgccagcgccaggccattgtggatggcctgagggacagcgtcctgggcttctcagtcaatgtgcctggcaccactgcaaaggacgtgatggacatggtgctgatcacccagtacttcgatactatgaaagagattggcgcgtcctccaagtcctcggccgtcttcactccccatcggccctggtgcggttcgtgacatcg

SEQ ID NO: 3707 - DNA, 1442 bp, Fagus grandifolia
agttgaagaagctttggcgaatcgatccaacggtctctgagatccaatggacacagaagatccaactctaactttgaaaccactcatgccgtcccttccaccaacccgctttacggaatcttcattgcaagagcgcgaggcgcgtctggtgcaataaccgcctgcatttctctgctctgctccttcacttctttccaaatttccgttacaaaccaaacgcgtatatatatatatattatttatttttttttaggtaataattgctaattgcctcgcggtttctcacacatcgccgtcgtttttactgttaattattcgtctcccacaatctactataaatacagacatattttctaattcattttgtctcaaattcgtaattccgattctccgattctccgattctcattctctctctgtgaggcaaagtttcaattccacagttcgctagaataaaaaatggggcaagctctctgctgtgttcaagtggaccagtcaactgtagccatcaaagaaactttcgggaagtttgacgatgtgcttgagcccggatttcactgtttgccatgggtttttggacagcaggtagctggccacctctctttgcgtgtccagcagctggatgttcgatgtgaaacaaagacaaaggataatgtgtttgttactgttgttgcttctattcaataccgggccttatcagacaaagctgctgatgctttctacaaactcagtaataccagagcacagatccaatcctatgtctttgatgttattagagctagtgttccgaagctggagctcgactctgttttagaaacaaaaaaacgaaacgacgaaagctgtggaagaggaactcgagaaggccatgtcagcttatggatatgagatcgttcaaacactcatcgtggacattgaacctgatgagcatgtagaaaagggcaatgaacgagataaatgccgctgctagaatgagggtggcagcaaacgagaaggcagaagcagaaaaaatcctgcaaataaaacgcgccgagggagatgctgaatcgaaatatctggccgggcttggcatagcccgccagcgtcaggccattgtagatggtctgagggacagtgtgctggctttctctgtgaatgtacccgggactacatcaaaggatgtcatggacatggttctggtgactcaatatttcgacacaatgaaagaaatcggtgcatcatcgaagtccaactctgttttcatcccacacggacctggtgctgtgagagacattgctacacagattagagacggcctccttcaaggaaattccatacagaattagtgtctcaagcccagcatatttgttggaggggtggattttctaatggtatatgaaactgattggtgcaaatatctacgagttgtgtccttttattcttcttcttttctacttttctaatta

SEQ ID NO: 3708 - DNA, 1397 bp, Musa acuminata
cattgctcggaaggcatcaagaaatgggctcgaaacgaaacggaaagccaccaccgcgccggtcgccctctccaccactttaccaaagcgacaattcccttttctctctttataataaccctaatcgcctcctcctcctcttccatctctgattcgcccttcaccactcgatcagacagcaatgggccaggcattttgttgcattcaagtggaccagtcaactgtggccatgagagaaacttttgggaagtttgatcatgtgcttgagcccggatgccacttcctgccatggtgtttggggaaacagattgctggttatctttcactccgtgtgcaacaacttgatgttcgttgcgaaacaaagacaaaggataatgtatttgttacggttgttgcttctatccaatacaatgctattgctgaccaggcatctgatgcattctacaggctcagcaacacaaaggagcaaatccaatcctatgtttttgatgtcatcagggctagtgttccaaagctgaatttggatgatgtgtttgagcagaagaatgatatcgctagagctgttgaagatgagcttggaaaggcaatgtcatcatatggttacaaaattgttcaaacactaatcgtggatatcgagcctgataatcacgtgaagaaagcaatgaatgagatcaacgcagcttctagaatgagagttgcagcaaatgaaaaagctgaagcggagaagatactgcagattaagcgggctgaaggagaagcagaatctaagtacttgtctggcttgggtatagcacggcaacgccaggccattgtggatggcctgagggacagcgtgcttgccttctctgtcaacgtgccaggaaccacagctaaggatgtcatggacatggttctggtgacacagtatttcgacacaatgaaggagatcggggcctcctcgaaatcctcttctgtgttcattccccatggccctggggctgtgagggacattgcttcccaagttagagatggccttctccaaggtagcgccatccattgaacagaagaaataagggatggcattggagtcagcagtttagattggtattgtttgtattatcagttgtcttctaaagtagcatcttattcggtatagatggagtcgaaggtataatacgcaggtattagtaatcagatatggtgtcagaaaagatgaattgctggaaagaacaatatttggttgtgtaggtgctcttagtgtatatggctaagtagtgttttgtgaacctatgctaccaagaaatttgcagctatggctactgaatataaatgctctacttgtagggattttgtttctctaagattttgtttgaattacaattacttatgaagccatgtgtactgtttaaaatgaccac

SEQ ID NO: 3709 - DNA, 1079 bp, Brassica juncea
tggcgatcaaagaaacgtttgggaagttcgaagacgttcttgagcctggttgccatttcctcccatggtgtcttggtcagcaagttgctggttacctctctctgaggcttcagcaactggatgttcgctgcgagaccaagacaaaggacaatgtgtttgttaatgttgttgcatccattcaataccgtgccttggctaataatgccaatgatgctttctacaaactcagtaacactaggagccagatccaagcttacgtctttgatgttatcagagcgagtgtccccaagctgattctggatgatgtctttgagcagaagaatgaaattgccaaagctgttgaagaggagctcgagaaggcaatgtctgcttacggttttgagattgtccaaactctcattgttgacatcgagcctgacgaacatgtcaaacgagccatgaacgaaatcaacgctgctgcaaggatgaggttggctgccaacgaaaaggctgaggctgagaaaatcctgcagatcaagcgcgctgaaggtgaagccgaggccaagtacctttctggtcttggtatcgctcgtcagaggcaagccatcgttgacgggctacgcgacagtgtcttgggcttctctgtgaatgttcccgggacaactgctaaagatgtcatggacatggtgctcgttacgcagtactttgacaccatgaaggagattggtgccagttccaaatcctctgctgtgttcattccccacggaccaggagcggttcgtgatgtggctactcagatcagagatggcctccttcaaggctcgttcgcagaccagtcttgaattagatggactgatcattatatgttatctactaagcttgctgtgtgttgagatcatatgatcttgtgctgagaaactctcatgcttttaggttcttttatttttcgttaatatatatttcaagtacgacgtactatttgggtgtacaaccaaaaatcgcaattagtaatcaattaatctacatggattatatgttgatcatattcaaatttgcgattacattagatgctacataaaattaaaaaaaaaaaaaaaaaa

SEQ ID NO: 3710 - DNA, 1254 bp, Citrus clementina
tttttacttaattaaaaaaaattaagcttattaaacactcaaaccacaatcatcatagttcttctttaactttcagagcagctaaagcccaagtgtcacgaacaaaaatccttttaaaagaaaaaagtaaccactttggttgttaagccacatttgtttcttgtttcaaaagcaactcttttgcaggttgcagttttgaaagatgggtcaaacgttgggctgcattcaggtggagcagtcaaaagtagtcatcagagaacaatttggaaagtttgatcatgtgcttgaacctgggtgtcaatgcttgccttggtgccttggctacaaggtagctggtcggctttcactccgggtgcaacaactggatgttaaatgtgaaacaaagactaaggataatgtttttgtcaatgtggttgcttccgttcaatatcgtgccttggctgataaagcttatgatgctttctataagctctccaacaccaggggccaaatccaagcctatgtctttgatgttatcagggcaagcgtaccaaaactgaacttagatgccgcctttgagcagaagaatgaaattgccaaagccgttgaagaggagctcgaaaaggccatgtctcattatgggtatgagatagtgcagactcttattgtggatattgagccagatgttcatgtaaagagagcaatgaatgagatcaatgcagctgcaagactgaggctggcagcaaatgagaaggctgaggcagagaagatattgcaaatcaaacgagctgaaggggaggctgaggcaaaatacctgtccggacttgggatagcacgtcagcgccaggctattgttgatgggttaagagacagtgtgcttgccttctctgagaatgttcctggaacaacctccaaggatgtcatggacatggttctggtgactcaatactttgacaccatgaaggagatcggagcatcctcgaagtcctcatctgtttttatcccacatggacctggtgctgttaaggacattgctacacaaatcagggagggactccttcaggccaatcaagttcagaagtagatattctgctgatatgcaaagtcctttactagtcctagtgcttatcatagtcctgcatttggtgtttctaatatctaaactttattagtattttattccaagcaccgtcctttgttatattattacttgcacaatggggggaaaaaaagggctcgagtgaaatcatttgtatatgcaatatgcttccgtta

SEQ ID NO: 3711 - DNA, 1222 bp, Fagopyrum esculentum
agtctgaatttgctttaactgaatttttcgatatctcttgaaacgtgggattttctgtatcccgaattataatcttcaaagctgcatccgcctccttgttgtcatcacaatcatcgagctttctctgactgcaccgtccctcaaagaaataagagataagcgatgggacaagcgtttggttgtatgcaagtggatcaatcaactattgctatcaaagaaacttttgggaagtttgatgaggtgcttgaaccaggatgtcactgggtgccctggtgtcttgggagccagatagccggtcttctgagcttgcgtgtccagcaacttgatgttcgatgtgaaactaaaaccaaggacaatgtctttgtgactgtggttgcatctgttcaatatcgagcaatgggagacaaggcatcagatgccttctataaactgagtaacacaagggagcagatccaagcttacgtctttgatgttattcgtgcaagtgtgccaaagttgatcctagatgatacatttgagcagaagaatgacatagcaaaagctgtggaagatgaacttgagaaggccatgtcagcgtatggatacgagatagtccagactcttatagtagatatcgagccagatgtgcacgtcaagagagcaatgaacgaaatcaatgcagctgctaggatgagagtggcagcaaacgagaaggcagaagccgagaagattctacagattaagaaagcggaaggggaggccgagtcaaagtacctttctggtctcggtatagccagacagcgtcaagccattgtagacggtctcagggacagcgtgctcaatttctcaacaaacgtacccggtacaacagctaaggatgtcatggacatggtccttgttacacagtactttgacacaatgagggagatcggagcttcctccaagtcatcctcggtgttcattccccatggccctggtgccgtcagggatgttgcttcccagataagggaaggacttcttcagggtaatgctggacagtagatgcgtataagataagagtggtttatggtgtgattttagttgaataacgttatacattggggttgtaagtaaagttgtttggttttaagtaagaggtttgttaattacactgcgatacttgatggtttgcttattttctgtctgacaagagttcttcaatcaaattgtgaaaacgttgctattgttgtggccgtaactgtga

SEQ ID NO: 3712 - DNA, 1254 bp, Citrus sinensis
tttttacttaattaaaaaaaattaagcttattaaacactcaaaccacaatcatcatagttcttctttaactttcagagcagctaaagcccaagtgtcacgaacaaaaatccttttaaaagaaaaaagtaaccactttggttgttaagccacatttgtttcttgtttcaaaagcaactcttttgcaggttgcagttttgaaagatgggtcaaacgttgggctgcattcaggtggagcagtcaaaagtagtcatcagagaacaatttggaaagtttgatcatgtgcttgaacctgggtgtcaatgcttgccttggtgccttggctacaaggtagctggtcggctttcactccgggtgcaacaactggatgttaaatgtgaaacaaagactaaggataatgtttttgtcaatgtggttgcttccgttcaatatcgtgccttggctgataaagcttatgatgctttctataagctctccaacaccaggggccaaatccaagcctatgtctttgatgttatcagggcaagcgtaccaaaactgaacttagatgccgcctttgagcagaagaatgaaattgccaaagccgttgaagaggagctcgaaaaggccatgtctcattatgggtatgagatagtgcagactcttattgtggatattgagccagatgttcatgtaaagagagcaatgaatgagatcaatgcagctgcaagactgaggctggcagcaaatgagaaggctgaggcagagaagatattgcaaatcaaacgagctgaaggggaggctgaggcaaaatacctgtccggacttgggatagcacgtcagcgccaggctattgttgatgggttaagagacagtgtgcttgccttctctgagaatgttcctggaacaacctccaaggatgtcatggacatggttctggtgactcaatacttcgacaccatgaaggagattggagcatcctcgaagtcctcatctgtttttatcccacatggacctggtgctgttaaggacattgctacacaaatcagggagggactccttcaggccaatcaagttcagaagtagatattctgctgatatgctaagtcctttactagtcctagtgcttatcatagtcctgcatttggtgtttctaatatctaaactttattagtattttattccaagcaccgtcctttgttatattattacttgcacaatggggggaaaaaaagggctcgagcgaaattatttgtatatgcaatatgcttccgtta

SEQ ID NO: 3713 - DNA, 4209 bp, Musa acuminata
atggagtcaatctcctccgccgcctcttcctctcgccgtcctgccagcttcttcacccaagccaatgctctccttcgcaagaatctcaccttccagaaacggaacctgaagaccaacatcgggatcgtcgcgttccccatctttatctgcgtcctgatcgtcctcattcagcaagtgatcaacaacgagctgaacaaggataagttccaatgcgggtgccagggaggcgactgcggcctccagtactcgacgctggatcaggtcgacacttgccccatttcaagccctcctgagtggtccgctctcatccaagttcctcgcccccagtatcgcgccgtcagaactgacttttctcaatctgccgacttgcccgatgagtcctgcagagcttcccagtcctgtcccgcggcagtgctcctcactggcggtaaccgatccctcgcgcaaagtatctcttcctctgcgttgaatttctcggattatcccagtagtttgtcgaatgtcatcctcgggacggatacacctaccgagaacacacaattcattgaaccagcttttgtctctgacaggcccttttatgtagtccaaccgcaatgcacaacaaacgcaacaagtccaatttcgtttaaaaacgccaacatatcgattgagctagggttagagtgtgttcaaggtttgactttgtggcgcgataattcatcattgataaatgatgagttgtttaagggttatcgacagggaaattcagagaggaaggcaaatgagttcattgcagcctatgacttcttgaattctgacgagaatggtttcaatttaaacatttggtacaactcaacctataataatgacactggttttgttgaagttgcattggttcgtgttcctcgcacagtgaatgcggcctccaatgcctacctgaagtttcgaaaaggtgctggtgcaatggtaatgtttgattttgttaaagaaatgccaaaaacgggaacagaccggaggtttgacttttcttctcttcttggtccattattcttcacgtggatcattgagctactcttcccagttattctcacatatgttgtctatgagaggcaacaaaagttaagaatcatgatgaaaatgcatgggctaaaggatggaccttactggttcatatcgtacatttattttttctctctatcatcagtctacatgatatgttttgtgatatttggctctataatagggctaaaatttttcagattgaatgactacagcatacaagttgtgttctatttcatttacataaacttgcagatagcactggcctttcttatagcacctttcttttctgctgtgaaaactgccacagtgtttggttacaattatgtattcggttctggcttattgggagagttcctcttgcgtttttttattgaagataccagcttcccaagaggttggattctagtcatggagcttgttcctggattttccttgtatcgtgggctatttgagttttcacagtattcttttagtggagattctatggggacttctggtatgaagtggggagatttagatgatagtcaaaatgggatgaaagctgtgttgattataatgtttgttgagtggctagttctgcttgtagttgcattctacttggatcagttaataggaggtggaatcaggaaggatccttttttttttctacgctatttccagaagaagtcttcagtatcccaaagaaagcctagttttcagagacaaggatccaaagtttttgttgaaatggagagacctgatgtttctcaagaaagagaagttgtggagcaactgctactggaatccagttttagtcatgcagtcatttctgataatctcaaaaaagtctaccctggacgggatggaaatccagacaaacttgcagttcgagggctgtctcttgctttacctaatggtgaatgttttggcatgcttggccctaatggtgctggaaaaactacctttatcaatatgatgattgggcttattacaccgacctccggcactgcttatgttcagggagtggacataaggaccaatatggacgaaatttacacaagcatgggtgtatgcccacagcatgacttgctttgggagacattaactggcagagaacatctattattttatggtcgactgaaaaaccttaaaggtgctgcattgctgcaggcagttgatgaatctttgaagagtgtaaatttgttttatggtggtgttggagataaacaagctggaaaatatagcggtggaatgaaaaggaggctgagtgtcgcaatttcactgattggtgatcctaaggtcgtgtacatggatgaaccaagcacaggactagacccagcatcaagaaacaacttatggaatgttgtgaagaatgcaaaaagagaccgggcaattatactcacaacacactccatggaggaagccgaggtattgtgtgatcgtctgggcatctttgttgatggaggtttccagtgcataggaaatccaaaggagctcaaggctaggtacggtggatcgtatgtcttcacaatgaccacatctgtaaacgaggaagaggaggttgaaagcttagttcggcagctatctccaagtgcaaacaagatatatcatatttctgggacccaaaaattcgagttgcccaagcaggaggtcagaattgctgatgtcttccgagcagtcgagatcgcaaagagtaaattcacgattcacgcatggggtctggctgacaccacattggaagatgtcttcatcaaagttgccaaaggcgcacaatcgttgaattcttcggaacatccaaggagcccttccttccccctttggttttccgcccctataatccccccttcttctgtcgtcgggcggcgcgatccatcttctctgccaattcgctttacaaggcgagcctctggcgttctgttttctgacacaacttttcgtggcaaagagaaagaaatggggcaagctctgggttgtgtacaagtggaccagtcaactgttgccgttagagaaacttttggaaagtttgatgagattcttgaacctgggtgtcatttcttgccctggtgtatagggaggcaaattgctgggtatctttcactgcgtgtgcagcaacttgatgtccgttgtgaaacaaagacaaaggataacgtgtttgtcaccgttgttgcgtctgttcaataccgtgctctcgctgggaaggcatctgatgctttctacaggcttagcaacacaagagaacaaattcaatcctatgttttcgatgtcatcagggctagtgttccaaagctgaacttggatgatgcatttgaacagaagaatgatattgctaaagctgtagaagatgagcttgaaaaggcagcaatgtcaatgtatgggtatgagattgttcaaaccttgattgtggatattgaacctgatgaacatgtcaagagggcaatgaatgagattaatgcaggcaagtggtttatagtttggactgctcggctgcgggtggcagctaatgagaaagctgaagctgaaaagatactgcagatcaaacgagcagaaggagatgcggaatcgaagtacttggccggattaggtatagcaagacaacgccaggccattgtggatggcctgagagatagcgtgcttgctttctcagtaaatgtaccaggaacaacagccaaggatgtcatggacatggtcttagtgacgcaatactttgataccatgaaggagattggagcctcctcgaagtcctcttctgtgttcatcccccatgggcccggagctgtgagagacattgctactcagatcagggatggccttcttcaagccaatacacttcagtaagaggaagaaggagacacgggtccatgttccggagactttgccataatgtttgggtatttaaaccttttaagtagtgtttgatttaagtgtgccgtggatgtataaataatgcagcagttaatatctgtgtctgtggtgtcaataagtttcttgttagggtatacgagtgtattggtctattatgctcttagcaatgaatgccttgtgaatttggttctgtagatatcaacttgctttctgtgtaattactaaagccagatatgtcgttagttacggtgatctgatctgacgacatcaccgggcagagttgaaagtcccggtgctggttgtcagacctgggaatcattctattca

SEQ ID NO: 3714 - DNA, 1336 bp, Vaccinium corymbosum
tttcgctaatcctcgcaacactccgcaccaaaaccctccataacattactgcattgaaaggaaagaatcgacaatgggacaagcttttggttgcattcaagtagaccagtccactgtggctatccgagaaacttttgggaagtttgatgctgtgcttgatcctggttgtcatcttatgccttggtgtattgggaagcaaacggccggtatcctttcactacgagtgcagcagctagacgttcgttgtgaaacaaagacaaaggacaatgtctttgtcactgtggttgcttctgttcaataccaagccttggctgaaaaggcttctgatgcattctataagctaagcaacacaaaggagcagatccaggcctatgtctttgatgttatcagggcaagtgtgccaaagttggagctggattcagtctttgagcagaagaatgagattgcaaaagctgtggagaatgaacttgaaaaggccatgtcccattatggattcgaaattgttcaaaccctcatcgtggatattgaaccagatgagcttgtgaaaagatccatgaatgaaattaatgcagcttctagactgaggcttgctgcaaccgagaaggccgaagcggagaagatactgcaaattaagcgtgccgagggagaggcagagtccaagtacctatctggtcttggcatagctcgacagcgcaatgccattgtggacgggctgagggacagtgtgcttgccttctccaccaatgtcccagggacaacttccaaggacgtcatggacatggttttggtcacccagtattttgacaccatgaaggagatcggcgcctcctctaagtcttcctctgtcttcatcccccatggacctggggcggtgagagacattgcttcgcaaatcagggacggtctccttcagggccaaacaacggcatgttaaagttcaacactggaaagttggggttatgaggatttctataaggtcgatcgtggttgtgcttatcaaatggttgccaatttcggagagttccacgatggtttcttcttttcgatactattgctcatctactgcataacgcgagcaaatagtagttgttcaggttttggggtgttccattcgtatatatcgcgcgtctactttcttataatacagcaatatgatgttatcgataacatcctaatggtagtgattcctattagagagctgttacgtgctattgtattttgcagagttttaatgttgtttctggagttttgcatatgcagatgtagtctgtgaaaactgaataagttatgtgattgccttcttggactctggtgatttttcaagtcaatttcatca

SEQ ID NO: 3715 - DNA, 1150 bp, Allium cepa
gtggaaatgggtcaggcattatgttgtgtacaagtggaccaatcaactgtagcagtgaaagaaacgttcggaaagtatgatgatattctccaacctggttgtcacttcttaccatggatttttggtcagcaaattgctggatacttgtcattacgtgtacaacaacttgatgttcgatgcgaaactaagactaaggataatgtctttgtgactgttgttgcttctattcaataccgtgctcttgctgagaaggcatctgatgctttctacaaacttagcaacacaagggagcaaatccagtcatatgtttttgatgttataagggctagtgttcccaaactgatcttagatgatgtctttgaacagaaaaatgatattgcaaaagctgtagagaatgaacttgaaaaggccatgtcaacatatggatacgagattgttcaaacgctgattgtggatattgagccagatgaaatggttaagagagcaatgaatgagattaatgcagctgcaaggatgagggtagcagcaaatgaaaaggcagaagcagaaaagatactgcaaataaagagggcagagggtgatgcggaatcaaagtatttagctgggctgggtatagcacgccagcgccaagcaatagttgatgggttaagagacagcgtgcttgcattctctgtgaacgtgcctggaactacttccaaagatgtgatggacatggtgttggtcactcaatattttgacaccatgaaagacattggagcatcctccaaatctacttctgttttcatccctcatggacctggagctgtcagggacattgcatctcagattagggatggcctacttcaaggaagttccactaataattgatggtactagtgctagaaactaatgattgtatatgatgcttttgtttggtatgaagaattgtactgtacacgcttgaatttgttggttgtttatatgttgatgccttgggtgggtgtcaaggcattttagagtttagcaattaaacatgtttggagttgcttattatgaagtgaatgcacatggttataaattattatagattaatgtgtcgttctcttataggtctgtatgtatatctcccgctctattgtaacggaggttctgaggtagtgaaacttatttt

SEQ ID NO: 3716 - DNA, 1448 bp, Malus domestica
ccgaggtggaggtggcgctgtgcccacagaacttgcatttcacgcacataggaaaattccgcgcaaagctgtccccgaaagcgacccgtaacttcttccttctcgcggataaagattaaaacccctcgcccaaaatttccacttcctcccctactcccccatatagatatctacttctcaagcttcgcagacaaacgcttccatttcagagaagatgggacaagctcttggttgtattcaagtggaccagtccactgttgctatcagggaaacttttgggaagtttgatgatgtgcttgcacctggatgtcactgtttgccttggtgttttggtagccaggtagctggtcgtctctccttacgtgtgcagcaattggacgttcgttgtgaaacaaagacaaaggataatgtttttgttactgtggttgcttcaattcaataccgagctttggctgagaaggcttctgatgccttttacaagctcagcaataccagagggcagatccaatcttatgtctttgatgtgattagggcaagtgttccgaaattggacctagattcaacctttgagcagaagaatgatatagccaaatctgtggaagaagaacttgaaaaggccatgtcacattatgggtttgagatagttcaaacactaattgtggatatcgaaccagatgagcacgtgaagagatcgatgaatgagattaatgcagctgctaggatgagggtggccgcaagtgagaaagctgaagcagagaagatactacagattaagcgagctgagggagaggcagagtccaaatatctgtcggggcttggcatagcaaggcagcgccaggccattgtggacgggctgagagacagcgtgctggccttctctgagaacgtacctgggacatcatccaaggatgtcatggacatggttctcgtgacccagtactttgacacaatgaaggagattggtgcatcctcaaagtccaattcggttttcatcccacacggaccaggtgctgtgagagacattgcgtcgcagataagagacggactccttcaaggaagttcgattcaggagtaatgcccttgggcgcggcactgaatgccagcgcagttacgctagactcgaatttgtgtgtgctgtaggatctaagagagtgtggacactctcacgtatataatatgtagggtgaattttctgtgcttgttaatatcttggttttgaaactcaagggtgttgtttcgactttataatatagtcgaagaagcaattcgaactatttatcttgctccatttgtggtttaagggtctttttgatattataaaagagaaagggtttttatgatgattggtccatgaaatttcatcgttaattgagttctgcagactagtgtgttgaattgagaattttgagagattttaatgaatttataaatatatgaatttttatgga

SEQ ID NO: 3717 - DNA, 1134 bp, Persea americana
ttctgcaactgttgttggtgtaagaagtaaaaaaaatggggcaagcacttggttgtgtacaagtggaccagtcaactgttgctatcaaagaaaactttgggaagttcaatgacgtgcttgagcctggatgtcactgtgtgccttggtgtttcggcagccaggtagctggacatctttcgttgcgtatacagcaacttgacgttcgttgtgaaacgaaaaccaaggataatgtatttgtcactgttgttgcatccattcaatttcgtgctttggcggaaaaagcagaggatgccttttataggctcagcaacactaggtcacaaattcaagcttatgtctttgatgtcattaggtcaagtgtcccgaagttgaacttagatgatgcctttgagcagaagaatgacattgccaaagctgtagaagacgaacttgaaaaggccatgtcacattatggatttgagatagttcagacgcttattgtggatattgaaccagatcagcgtgtaaagggagcaatgaatgagatcaatgcagctgcgagactgagggtggcagcgaatgagaaagctgaagctgagaagattctacagattaagaaagctgaaggagatgcggagtccaagtatctggcaggccttggtgtagctcgccagcgccaggccatcgtggatggcctgagggagagtgtgcttgcattctctaccaatgtgcacgggacaacagccaaggatgtgatggacatggtgttagttactcagtattttgacaccatgaaagagattggtgcgtcctcaaaatcctcatccgtgttcatcccacatgggcctggtgctgtcagggacattgtgtctcaaataagagatgggcttcttcagggcagtcagcactgatgtttgcatttgttccaccttagtacatgagttctgttgaggttggtgtttgtccaaaaaggatttatatagggttgttttgttttcgtttcctcatagtcggattatatccatgcatatatgctttcttgttcttctgggttaaagacttaaaactcatttgaattgtagggttactgggtataacctgtcaggtgtcaatagcaggatgctatatgcaagcggtttatatgacagtgatggt

SEQ ID NO: 3718 - DNA, 1162 bp, Fagopyrum esculentum
aaacgtgggattttctgtatcccgaactaaaatcttaaagttgcctctcgcgtccttgttgtcatcacaatcgtcgaccttcctctgaccacacctttcgtcaaagaaataagagagaagcgatgggacaagcattcggttgcattcaagtggatcaatcaactattgctattaaagaaacttttggaaagtttgatgaggtgcttgatccaggatgtcactgggtgccctggtgtcttggaagccagatagccggtcttctgagcttgcgcgtccagcaacttgatgtccgatgtgaaactaaaaccaaggacaatgtctttgtgactgtggttgcatctgttcaatatcgagcaatgggaaacaaggcatctgatgccttctataaactaagtaacacaagggagcagatccaagcatatgtctttgatgttattcgtgcaagtgtgccaaagttgatcctagatgatacatttgagcagaagaatgacatagcgaaagctgtggaagatgagcttgagaaggccatgtcagcttatggatacgagatagtccagactcttatagtggatatcgagcctgatgtgcacgtcaagagagcaatgaatgaaatcaatgcagctgctaggatgagagtggcagcaaacgagaaggcagaagccgagaagattctacagattaagaaagctgaaggggaggcagagtccaagtacctttctggtctcggtatagccaggcagcgtcaagccattgttgatggtctcagggacagcgtgctcaacttctcaacaaacgtccccggtacaacagctaaggatgtcatggacatggtccttgttacacagtactttgacacaatgagagagatcggagcttcctccaagtcatcctcagtgttcattccccatggccctggtgccgtcagggacgtcgcttcccagataagggaaggacttcttcagggtaatgctggacagtagacgcgtataatataagagtggtttatggtgtgattttagttgaataacattttacattggggttgtaagtaaagttgtttggttttaagtaaggtttgttaattacaccggaatactttaccgtttgcctattttcagtctgagaatcttagtagtaaactttattgattatgagttcttac

SEQ ID NO: 3719 - DNA, 841 bp, Lactuca sativa
  misc_feature (644)..(644): n is a, c, g, or t
  misc_feature (698)..(698): n is a, c, g, or t
gctgttcgatctttgtcttgcaccacctcagtataaaatcatgggaaacctcttctgtttagttcaagtagatcaatccactgtagccatcaaggaaacttttgggaaattcgatgatgttcttgagcctggtttacattgcgtcccttggattttcggaagtcaggttgctggacaactcacactaaggcttcaacagttagatgtcaagtgcgagaccaaaacaaaggacaatgtttttgtgaatgttgtagcttcaattcagtatcgtgccctagctgataaagcaagtgacgccttctataaactcagcaacacaaggtcccaaatccaagcttatgtttttgatgtcataagagctagtgtcccaaagctcaacctagacgatgcttttgaacaaaaaaatgaaatcgccaaagctgttgaagacgaacttgaaaaggcaatgtctgcatatgggtttgagatcgttcagacattgatagttgatattgaaccggatgagcacgtgaagagagcaatgaacgagatcaacgcagctgcaaggtttaggatggcggctactgagaaggctgaggctgagaagatacttcagataaagagggctgaaggagaggctgagtcaaagtatttgtctggattgngtattgcgcgtcagagacaagcaattgttgatggtttgagagacagtgtgttgngtttttcagttaatgttcctgggacaactgctaaagatgtgatggatatggttttggtgacacagtattttgatacgatgaaggaaatcggggcttcatctaaatcatctgctgtgtttataccacatggccctggtgctgtt

SEQ ID NO: 3720 - DNA, 1277 bp, Lotus japonicus
atttcttcttatcctttctttctcgctcggtaaagattgagcaattcttgttcaatttcttgtgttgtcatcccttgttcattcttcctcattatttaatatcgaatgctcttgaattctagattgttcattcactagggttttatggggttttgaagaattgcagttagaagcaaatggggaatcttttctgctgtgtgcaagtggaccaatccacagtggctatcaaagaaagatttggacgatttgaagaagttcttcagccagggtgccactgcttgccatggatccttggaagtcaacttgccggtcatctctctattcgtgtgcagcaactagatgttaaatgcgagaccaagacaaaggataatgtctttgtcaatgttgttgcttcagtgcaatatcgtgccctgtctgagaaggccagtgatgctttctacaaacttagcaatacaaagacccaaatccaagcctatgtttttgatgtaattagagcaagtgttccaaaactcctcttggatgatgcttttgaacagaaaaatgatatcgccaaagctgtggaagaggagcttgagaaggccatgtcagcttatggatatgaaattgttcaaacactgattgttgatattgagccagatgagaacgtgaagcgggctatgaatgaaatcaatgctgctgcaagattgaggctggcagctactgataaggcagaggcagagaagatcttgcaaatcaagcgagctgagggtgaggctgagtctaagtacctccatggtgtcggtattgctcgccagcgtcaagcaattgtggatggtttgagagacagcgtgctcggattctccggtaatgtaccagggacgactgcaaaagatgtcttggacatggtccttgtcactcagtatttcgacactatgaaagaaattggtgctacctccaagtcttctgctgttttcattccccatggacccggtgctgttcgtgatgtagcaagccaaattcgtgatggacttcttcaggcttctcatcactagtttctactccaccaagctcttgtgtcaggtttgtctgtggacatacatgataatgctctatgtatgtgtgtggttgtctttctttgaagtatgttcagtggttttgttatatttgataatcagactgtcatgtaaatattatcctacagggaacctattgtgaatgataagttttcaactatctatatatatatactggatttttaagtgtatgtttgaattctattgaaattcctttgccaaaat

SEQ ID NO: 3721 - DNA, 1156 bp, Allium cepa
  misc_feature (776)..(776): n is a, c, g, or t
ctcaatttcctgatccagcaaagaagcaaagctcaaatttctcccaagttgccaatctatcgattctcggttgttcagattcactcagtgtggaaatgggtcaggcattatgttgtgtacaagtggaccaatcaactgtagcagtgaaagaaacgttcggaaagtatgatgatattctccaacctggttgtcacttcttaccatggatttttggtcagcaaattgctggatacttgtcattacgtgtacaacaacttgatgttcgatgcgaaactaagactaaggataatgtctttgtgactgttgttgcttctattcaataccgtgctcttgctgagaaggcatctgatgctttctacaaacttagcaacacaagggagcaaatccagtcatatgtttttgatgttataagggctagtgttcccaaactgatcttagatgatgtctttgaacagaaaaatgatattgcaaaagctgtagagaatgaacttgaaaaggccatgtcaacatatggatacgagattgttcaaacgctgattgtggatattgagccagatgaaatggttaagagagcaatgaatgagattaatgcagctgcaaggatgagggtagcagcaaatgaaaaggcagaagcagaaaagatactgcaaataaagagggcagagggtgatgcggaatcaaagtatttagctgggctgggtatagcacgccagcgccaagcaatagttgatgggttaagagacagcgtgcttgcattctctgtgaacgtgcctggnactacttccaaagatgtgatggacatggtgttggtcactcaatattttgacaccatgaaagacattggagcatcctccaaatctacttctgttttcatccctcatggacctggagctgtcagggacattgcatctcagattagggatggcctacttcaaggaagttccactaataattgatggtactagtgctagaaactaatgattgtatatgatgcttttgtttggtatgaagaattgtactgtacacgcttgaatttgttggttgtttatatgttggatgccttgggtgggtgtcaaggcattttagagtttagcaattaaacatgtttggagttgcttattatgaagtgaatgcacatggttataaattattataa

SEQ ID NO: 3722 - DNA, 1335 bp, Carica papaya
ctttttcttgcttttcacacctttaattatataaccagaacattcttctttacgagcactgagttgcaaggaccttgttgatccttaagtttacattgaagaaaatgggacaagttcttggttgtgttcaagttgaccagtctactgtagcaattaaagaaacctttgggaagtttgatgatgttctggagcctggttgtcactgtttgccttggtgtttggggagccagttggcaggtcatctctcgttacgtgtgcaacagttggatgtccgttgtgaaacgaaaactaaggataacgtgtttgttacagtggttgcttccattcaataccgagcgttagctgacaaagctgcagatgctttctacaaacttagcaataccagagcacagattcaagcctacgtttttgatgttattagggctagtgttccaaggttggacttggattcctcttttgcacaaaagaacgagattgccaaagctgtggaagatgaacttgagaaggccatgtcgcattatggatttgagatagttcagactctcatagtggatattgaaccagatgaacatgtaaagagagcaatgaatgagataaacgctgctgctagaatgagagtggcagcaaatgataaagctgaagcagagaagattttgcagatcaagaaagctgagggagatgcagaatccaagtatctagcgggtctcgggatagctcggcagagacaggccatagttgatgggctaagagacagtgtgctagccttctctgaaagtgtacctggtacaacatcgaaggatgtcatggacatggttttggtgacccagtactttgacaccatgaaggagataggtgcagcttcaaagtctaactctgttttcattccccatggaccgggtgctgtaagagacattgcttcacagatcagggacggtcttcttcaggctaatactactactcgctgattcaagcctagaattttgctaggtggtattatctattctgccttcatattttctctttgatataaataggggaattacatgcatgacgctcttatgttcatagtattgaattgtgtcttgtgatattgttataagatgttgataggagtttccaatggtatataatcggaggcttcatctggttttcttttatcatgcatttctgatttacaagacttgctgggctttatacggaataatggatagcctagttgattgcgctctggaaggggcgacttttggcttggccgtctttggtcgttgtatgtcaatagatatattacagttttatgaataaataatgcagtatagttgtaaacaatggggtttt

SEQ ID NO: 3723 - DNA, 1380 bp, Phalaenopsis aphrodite
gtatccgccccttcttactgcttaatttcactttcctcttctgcgattttgactgctgggtctccttgttgaggggaagaaatgggccagctactatgttgcctgcaagtggagcaatcaactgtagcaatcaaagagagttttggaaagtttgatgatgttcttgagccaggcattcatcttgttccatggattctaggaaaaaaggtggccggctacctttccctccgtgtgcagcagcttgatgttcgctgtgagaccaaaactaaggacaatgtttttgttacagttgtagcatcagtacagtaccgtgcactggcaaacaaggcagctgacgccttctacaagctcagcaacacaagagaacaaattcagtcatatgtttttgatgtaatcagggctagtgttccaaaattaaacatagatgctgtgtttgagcagaagaatgatattgcaaaagctgtggaagatgagcttgaaaaggcaatgtcgacttatggatatgaaatagttcagacactcattgtggatattgagcctgatgaacatgtgaagagggctatgaatgagataaatgcagcggcgagactgaggctggcggcaaacgagaaggctgaagcagagaaaatcctacagataaagagggcggaaggcgaagctgaatcgaaatacctagccgggctcggcatagctcgccagcgtcaggccattgtcgacggactaagagacagcgttctcgcattctctgctaatgtgcccggaacttcggccaaggatgtcatggacatggtgttgatcactcagtacttcgacaccatgaaggagatcggtgccgcctccaagtcttctgccgtcttcatcccccacggccctggagctgtcagggatgtcgccgcccaggtcagggatggtcttcttcagggtggtgcttttcattgagttggggtttttcagggttggtttgttttcagcatttggtgtgtttgatttcttatgtttataaaggtttggttttttttttttgaagatttgcatacatatataccaccttggctatatgcatgaaagggtgtctttcatatgaaaagctaatggtctttattggtaggaattgtatagtgcttttgattttgtttttgtgtggatttgtaatgtattttgatggtgaacttttaatggaagtttatttgtgctgtaaatgtcaatatttgtcttggtatataaaaaaaaaaacaaccttacttaacatagaacatacaacacaactagcgtgaaacaaaaccaaccctacgaaaccgaaaaaccctacatagtaaagaacaccaccctacgagaaagaaccaccccttccgacgtacggcgggccggacgaattacccc

SEQ ID NO: 3724 - DNA, 1174 bp, Lippia dulcis
aaaattgtaaaaccacagttgaaagttcgaggctacctgtttctgatctgtcttcaatcagttgtctatattgaaaaaatgggtcaagcgcttggttgtgttcaagtagatcagtctactgttgctgtgaaggagcaatttggcaagtttgaagaggtgctagagcctggctgtcattgcctgccgtggtgttttggctaccaattggctggtaccctatcgttacgtttacagcagctcgatgtccgttgtgaaacaaaaactaaggacaatgtgttcgttaatgtggttgcttcgatccaataccgagcattggctgacaaagcatctgatgcatattataaactttctaacacaaaagagcagatccaagcatatgtttttgatgtcatcagggcaagcgtaccaaaactggatctggacgccacttttgagcagaaggatgatatagctagagctgtagaaaacgaacttgaaaaggctatgtctgcttatggctttgagatagtgcagactctgattgttgacattgagccagatgctcaagtcaagagggccatgaacgagataaatgcagctgctcgactcaggcttgctgcgactgagaaagccgaagctgagaaaatcttgcagatcaaaagagctgagggagaggctgagtccaagtacctgtcagggctgggtatagctcgtcagcggcaggccatcgtagacggactgagggagagtgtgctcgctttctcggagaacgttcctgggacgacctctaaggatgtcatggacatggtccttgtcactcagtacttcgacacgatgaaggaaattggtgcttcgtccaagtcctctgctgtcttcatccctcacggacctggggccgtcaaggatattgccactcagatccgcaacggcctccttcagggcgagagcgccatgtcttcttaatcggtctcgtcttgatgccccgttgtcagtgtcccgagtttgtgtaattatgttgatgtgcgtttattgtcatgtcagtagacgatcatatttagcatttgaagatttgttttctcatcaaatatgtaattatgttactttgggtgctgctttggctattgtgagacggaatgtttatatattccggtatgtataagcgttcgagttatctttttccgagatcaaaaaagaa

SEQ ID NO: 3725 - DNA, 1247 bp, Rosa hybrid cultivar
tattttcgaacagaatcagaaaatgggacagtgccttggttgtatccaggtggaccagtctactgttgcaataagggaaacttttgggaagtttgatgatgtgctcgaacctggttgtcattgtttgccttggtgtttgggtagcgcagtagctggtcatctctctctacgagtgcagcaattggatgttcgctgtgaaacaaagaccaaggataacgtttttgttactgtggttgcttctattcaataccgagctttagctgacaaagcttcagatgccttctacaagctcagcaataccagggggcagatccagtcttatgtctttgatgttattagggcaagtgttccaaagttggatctagactcaacctttgaacagaagaatgatatcgccaaagctgtggaagaagaacttgaaaaggccatgtcacattatgggtttgagatagtacaaacattgattgtggatatcgaaccagatgagcatgtgaagagagcgatgaatgagattaatgcagctgctaggatgaggttggctgcatctgagagagctgaaggagataagatactacagattaagcgagctgagggagaggcagagtccaaatatctgtcagggcttggcatagcaaggcagcgccaggctattgtggatgggctgagagacagcgtgctggctttctctgagaatgtacctgggacatcatcaaaggatgtcatggatatggttctggtgacccagtacttcgatacaatgaaagagatcggtgcatcttcaaagtccaattcggttttcatcccacacggacctggtgctgtgaaagacattgcttcacagataagagatggtctccttcaaggaaattcaactcaccagtaaagtcctaatacgaactatgaagttggaggtgcggcgtctataagcttcaacggttacttgttagctctatcgtgcaaggcaactaagaatcaatttgggtgtgctttcgtcatttgacatacatggtatataggaggtggatttgaacgtttttatatgcttgttcatagttggttgtctatattttattcagttagaagcgatgtgaactatggctggtttagtttttttctgagcagcagggtttctcttttgaaaaccatacctgaataagcctagaattcgttcagataggccaagtattatgtagtaatgccaaggtgattatttggttattatgtagtaatgccaaggtgattttgtg

SEQ ID NO: 3726 - DNA, 2963 bp, Sorghum bicolor
tgactcacggtttgtttggctggccagccgcgtggcgtgggtacagaggaagcttaataaaaaaggaaaaagattcacggccttatcttgtagctctaggaggtctttgccgcttatcttcgttcccctgacaaatccatgctacacttcttcaccatccatggagcagatgtggtaactacttctctcctctatcattgggtgcggacactgctcatcttcacctcgcctctcatccttctcctcttctcctccatggtgaatcaggcctggccagcccctgcggaggtagcagcactggcgcgcttggccgaaagatgtggccggcggcacgggcgcatctggccgcatttgcgagggaggcgacggtgccggcaccacggccagcaagcatggaggcaacgctcatccttctcctcttctcctccatggtgaatcgggcctggccagcccctgcggaggcagcagcactggcgcgcttggccgaaagatgtggctggcggcgcgggcgcatctggctgtgcttgcgggggaggcgacggtgcgggcaccatggccagcaagcacggaggcggcggcacgggtcctctttgattctttatctatttttctcgtttgatctcctcttcggcgctgttatttatttatcaacttgatgtattcagaaagacggattcgggtttggatttggaagctgattttgattcagttttggtttggttccttgccttatacttgagaagttttgccttattgagttattctgatttggatttgtatcctattggagatagaagatgtgaatcgtctgattcggatttgtatctatactatatcctgaacatgagaagacgtcagtgatttgatttgagaagttttacctgattgagttattctaatttggatttgtatcgtattggagatagaagacatgaatcgtctgatttcggacagaaatcctagcagactaaaactttgacttccaatgaggacgggcggacgcggacgggcaggcagaagaatagggtggcagactgaaattttggctctttatagataggtatagaagagttatagattagtttttattttcgactatatttaatgttttatgtgccgtaaaatttaatatgacgagaaatctcgaaaattgtttgtttttttaactaataaagaaggctaaaaaaggcgacgatattttttcgtgtctggtcgtctggacccggttccagcgcggatatcgatcgggatcccgaaggcgacaagggggtccttctccttcacgttccctggccgagcagggacatccggcaggcggtgggcagactggagcggcgcaacttccccgcggtcccgccccgattcccttgtcatctctagcaaatctttctccggtcgcccttccctctctcccagtcccagacgcgcagcaattccgccataaataccggcgatcgagggcctcggacaacccagtcgacggagcagcgcggcggccggacgagggcaaacccttctcttctcaatactctactagtctgcgcctggatccccctccggaggaagataagacatgggtcaagcacttggtttggttcaagtggatcaatccacagtagccatcaaagaatcttttgggaagtttgacgaaatactagagcctggatgccacttcttgccatggtgcatagggaagcaaattgctgggtatctgtcactccgtgtgcagcagcttgatgtccgctgcgaaacaaagacaaaggataatgtctttgtcaatgttgtggcttctgtgcaatatcgtgcccttgccgataaggcatctgatgcattttacaggcttagtaacaccagggagcaaatccagtcatatgtctttgatgtcatcagggcaagtgttccaaagatgaacttggatgatgcctttgagcagaagaatgaaatcgccaaagctgtagaagatgaacttgaaaaggcaatgtcgatgtatggatacgagattgtgcagactctgattgttgatattgagcccgatgagcatgtgaagagagccatgaatgagatcaatgcagctgctaggctgaggttggctgccaccgagaaagctgaggcagagaagatactgcagatcaagagagctgaaggtgatgcagaatccaagtacttggccggtctaggtatcgcaagacagcgccaggctatagtggatgggctgagagacagtgttcttgctttctctgagaatgttcctgggacctctgcaaaggatgtcatggacatggttctggtgacccagtacttcgacaccatgaaggagatcggggcctcatccaagtcctcgtcggtcttcatccctcatggaccaggtgctgtcagagacatcgcagcgcagataagggatggtcagctccaggccagtctgctgtgagcacgttgatgcatacttttgacattcccatcagtaaagaagtacatatacctcatgagacaagtaaaacttattagggataatgtgagtactttcatatcagtagtgcttgttcgttctatctatctggtacgtgtgattatttattatcgagataaatgttatataggtttgtagaacaagatgagggccagttgctgtaaaaatttgtcatgccgtggtactgtttggaacttatctaagctattatggagcctgaggacactcctccatcaaactattttgtgataacctgcttctctgttatcgtgaatgagaatctcatctccattttctgtgcccagattaagtggaaattctgagatttgagtactgacgtgaatgcaacctgtgtgtaatttgtgagagtggatttgaaacttgggtattctcacttccataaagtcgaatccatagacttaaaatatagctaattgcactacaagtcagcaactttatttgttttctagaatatagatttctaattgaaatgcca

SEQ ID NO: 3727 - DNA, 856 bp, Flaveria ramosissima
gttatcccctgcaacaatccttcattcgaataatatcatgggcaatttattgtgcttggttcaagtagatcaatccactgttgcaattaaggagacttttgggaagtttgatgatgttcttgagcctgggtgccattgtgtgccgtggatattcggaagccggcttgcggggcatctcacactcagggttcagcagttggatgtcaagtgtgagaccaaaacaaaggacaatgtctttgtcaatgttgtagcttcggtacagtatcgtgctctttctgaaaaggcgagtgatgcattctacaaactcagcaacacgagggcccaaatccaggcctatgttttgatgttataagagctagtgttccaaagcttaaccttgatgatgcgttgagcaaaagaatgaaattgctaaggctgtggaagaagaacttgaaaaggcaatgtctgcatacggtttgagattgttcaaactctgattgttgatatagaaccagatgagcatgtgaagagagcaatgaatgagatcaatgcagctgcaaggctgaggatggcagctgctgagaaagccgaggctgagaaaattctacaaatcaagagagctgagggtgaggcagagtccaagtacctctctggtttgggtattgcacgccaaagacaagccaattgtggatggattacgagacagtgtcttgggtttctcagtcaatgtgcctggaaccacagctaaagacgtgatggacatggttctagtgactcagtaatttgacaccatgaaaggaaattggcgctgcatccaagtcatctgctgtgttcaatccctcatggacctggtgctgttcgtgatgtggctactcag

SEQ ID NO: 3728 - DNA, 1261 bp, Antirrhinum majus
  misc_feature (1011)..(1011): n is a, c, g, or t
  misc_feature (1018)..(1018): n is a, c, g, or t
  misc_feature (1020)..(1020): n is a, c, g, or t
ggaaaattcgtctggcattatcaatttcccaaattacaaaggcaatgcgatgagcgtgttcgacctgttgtagggttgaattgtctcatttaagtaattagtacagcaaatacactaacaccaattttgcctatatatgatattgccagtacatagtttcagaatttgagcatattttcccccaaattcacttgcctgttctttctctctcgttgtgctgttggaaatatgggtcaaacacttggttgcattcaagtcgatcagtctaatgttgctgtgaaagaacatttcggcaaattcgatgaagtccttcagcctgggtgccattgcctaccttggtgtcttggctaccaggtagctggttcactaacattgcgggtacagcagattgatgtccgttgtgaaacaaaaacaaaggacaatgtgtttgtaactgtggttgcatcaattcagtaccgagcactggcagaaaaagcatctgatgcattttataagctgtctaacacaaaagaacagatccaagcatatgttttcgatgtcataagggcaagtgtaccaaaattggatttggattcaacttttgagcagaagaatgacattgccaaagctgttgaagatgaacttgaaaaggccatgtctgcgtatggttatgagatagtgcaaactttgattgttgacattgaaccagacgctcaagtaaagagagccatgaatgagataaatgctgctgctaggctcagggttgctgctactgagaaggctgaggccgagaaaatcttgcagatcaagagagcagagggagaagccgaatctaagtacttatcaggtatcggtatcgctcgtcagcgtcaggccattgttgacgggttaagggacagcgtgcttgctttctcagaaaacgtgcctggaacctccgccaaggatgtcatggacatggttctcatcacacaatactttgacactatgaaagaaattggagcatcgtcaaagtcatctgctgtgtttgttccncatggancnggtgctgtcaaagacattgctactcagattcgtgatggtcttcttcaggccgagagtgttgggcattagtgacattttgcataaaatttggatttgcataacttggatgctatattgggtgtttgaattttagttggattttaattttagtatatgtaaagaatggtgcgcgtatattttgttgtggtgtatgaaagaatgatgatagctgggtttgagaagttaagtatgtttgtggatt

SEQ ID NO: 3729 - DNA, 1582 bp, Fagus grandifolia
aaaagcaaatggtctaaaacccgtttttgatacttgctttctctctgagcagctgtggcctgtgggagctcttctcctatctgtctatatataaagattgatccgaaatttgaggatcataataatagagtaacacagcacaattcatagctctgctttaattttctcttttctttctctctcatttttttcgctacaaagaatcgaagtatgggtcaagcattaggttgccttcaggtggaccagtcaaatgtggttatcagggaacagtttggaaagtttagtgatgtgcttgagccagggtgtcactgcttgccttggtgtcttggataccaggtagctggtggactctctttgcgtgtgcaacaacttgatgttcgatgtgaaacaaaaactaaggataatgtctttgtcaatgtggttgcgtctatccaatatcgtgccatggctgaaaaagcatctgatgctttctataagctcaccaataccagggagcagatacaatcctatgtttttgatgttatcagggcaagtgtgccaaaattgaacttggatgctgtctttgagcagaagaatgacatagcaaaagctgtggaagaagagctggaaaaggccatgtctacttatgggtatgaaatcgtccaaacacttattgtggacatagagcccgatgtccatgtgaaaagagcaatgaatgagataaatgcagccgctagaatgaggctggcagcaaatgagaaggccgaggccgagaaaatattgcagatcaagaaagctgaaggagaagcagaatctaaatacttgtcagggcttggcatagctcgccagcgccaggccattgttgatgggctgagagacagtgtacttgccttctctgagaatgtgcctggaacaactgccaaggatgtcatggacatggtgctggttacgcaatatttcgacacgatgaaggagattggggcatcctcaaaatcctcatctgttttcatcccacatgggcctggtgcagtcagagacgttgcttcacaaatccgagacggtcttcttcaatcccattctgtcgagagttgaagactaatataagctttgcttgggattatacatataagtaatataagctgttatatatggactaacttgttggttgtcaggcaaggtttaaatttgactgctacttatagcaagaccttttataatgcttttgttctcttaaatttgtcatctttgataacacaatgagatttgagatggtgtgtaattatgttaatagtttaatggtattgtaggttcttctacttaaatagtaactttgttataggtcacatacaagggtgtcaaatgttcaaaggtgaaatgctatttgcagttggcatacttacagacttgtttggaggcatattgacgacgaacctgtgagtggtggatcaccttttagaagcagagacaaccatttgcatggatgtgtggttgtagatattctttcttgacattggaacgagactttgggcatggtttctcctgaaaacacaaactggggtgctttggtgctaacatgttttaatccttgtccatgccaggagtc

SEQ ID NO: 3730 - DNA, 998 bp, Chelidonium majus
ctctcgtaccgtgtttttcattgacagggttgaacaatggggcaagcactttgttgtcttcaagtggatcagtctactgtagctatcaaagaaacttttgggaagtttgatgatatccttgaacctggctgtcatttcttgccttggtgctttgggagccaggtagctggctaccttacattgcgtgtgcagcagctcgatgtccggtgtgaaacaaaaactaaggataatgtttttgtcactgttgttgcatcgattcaataccgtgccttggctgataaggcatctgatgctttctataagctcagtaacaccagggaacagatccaagcctatgtttttgatgttatccgtgcaagtgtgcctaagctggacttggattcaacctttgagcaaaagaatgacattgcaaaaactgtcgaacaagagcttgaaaaggccatgtcacattatggatacgagatagttcaaactcttattgtggatatcgagccagatgtacatgtgaagagagcaatgaatgagataaatgcagctgctagaatgaggatggcagcaactgagaaggctgaagcagagaagatattacaaatcaagcgagcagaaggagaggcagaatcgaagtacttatctggtctgggtatagctcgacaacgccaggccattgtagatggacttagggacagtgtactcgccttctctgtgaatgtcccaggtacttctgccaaggatgtaatggacatgattttggttacccagtacttcgatacaatgaaggaaatcggggcatcatcaaagtcttccacagtcttcattcctcatggacccggtgccgtgaaggacatcgcctctcagataagggaaggactcttgcagggcaatgccgcagatttgcagtagtatgaagtttgatacttagattactttctaatagttcatagtggaggatttactacgttggttttatgaccaaattgcccgttctttcaacttgtttt

SEQ ID NO: 3731 - DNA, 1096 bp, Curcuma longa
tctttgtagtcttctttaagtttgctcgtcaaatttctggtggtaaacaatgggacaactgccttgctgtgtgcaagtcgatcaagccactgtcgcaattagcgagcaatttggcaagtttgatgctgtccttcagccaggatgcaattgtgtgccatgggtttttggtaagcgaatagctggtcatctctcactgagattgcaacagttggatgtcaagtgtgaaacaaaaacaaaggataatgtttttgtaaatgtcattgcctcagtgcaataccgtgctatggccaacaaggctagtgacgctttttacaaactgaccaatacaagaactcagattcaggcttatgtctttgatgtaatcagagccacggtaccaaagctcaatctggataatgtatttgagcagaagtctgaaattgcaaaagcagttgaggatgagctggaaaaagctatgtcaacttatggatttgaaatagtgcaaacattaattatagatattgagccagatgaacatgtaaaacgtgcaatgaatgaaatcaatgctgctgcaagattgagggttgctgcaaatgagaaggcagaagctgagaagatcatccagataaagcgggctgagggcgaggcagtggccaagtatctctcaggcttaggcattgctcgacaacgccaagccatcgtggatggactcagggacagtatcttaggctcctctggaaatgttccaggcacctcacctaaggatgcgatggacatggtgttgataactcaatattttgacaccatgaaggagattggtgcgtccaacaaatcatctgctgtatttgtcccccatggacctggcgctgttcgtgatatcgcactgcaaatccgggatgacatgcttcaagcttccttgagcaagtaactatcgtgtctgaccgagtccaagaacaggtggccgaggtgcgtttacatacatgagcaatgcattagtgttgatgaacttgttgctgtattgatgtgtggggattgtgtgatatcttagtaagctgtgaatcttctactactcttttcaagtcttgtggttgttggtgatggttgcaatactagttga

SEQ ID NO: 3732 - DNA, 1180 bp, Eschscholzia californica
agagtgagaaaaatgggtcaagcgctatgttgttttcaagtggatcaatctaatgttgctataaaggaaacttttgggaaatttgatgaagttcttgaacctggttgtcacttccttccatggtgtttaggtagtcaagtagctggttatctttcattgcgtgttcagcaacttgatgttcgttgcgaaacaaaaactaaggataatgtttttgtgactgttgttgcatccattcaataccgtgccttggctgataaggcatctgatgctttctataagctcagcaacacccgggaacaaatccaagcctatgtgtttgatgttatcagggcaagtgtgccgaagttggacttggattcaacatttgagcaaaagaatgacatcgcaaaaacagtagaagtagagcttgaaaaggccatgtcacactacgggtacgagatagttcagactcttattgtggatatcgagccagatgtgcatgtcaagagagcaatgaatgagataaatgcagctgcaagaatgagggtagcagcaaacgaaaaagctgaagcagagaagattattcagatcaagcgagcagaaggagatgcagaatcgaagtacttagcaggtttaggtatagcgcgacagcgccaagccattgtagatggactgagagacagtgtgcttgccttctctgtcaatgtccccggtacaactgccaaagacgtcatggatatggttctagtcacacaatacttcgacacgatgaaagatattggagcatcatcaaaatcatcggccgttttcattcctcatggaccaggtgccgtaaaagacatcgcctctcagattagggaaggcctccttcagggtaatgccgccaactgagctttgatataaaagattttgaagttctaggcttcttggttatttccctgatgtgaatagacagttattgttttagagttgggtctgtgtggtatatatactctctagtccttcgaggcaatacagatatatccgtattgtttactgacatactcgtattaaatatttttatgctgctagctcgtattaaatgttgggatatacggtgttgaatcagttggaaataatacctgaataccattttgtcctgccgaaaaaaaaaacaaacgtaggtagggacgagacgacacacgggaggaggagccccccc

SEQ ID NO: 3733 - DNA, 1373 bp, Eucalyptus grandis
tcaatttcgccccccgagaaaaaaagcagccataataaagagcgtgaagaaaaactcaaccaggtccgtatctctctctctctcttctcttctcttctgtctctctcctttctctctcctctgcgcaaaattcatggcgacgaaagcgaccgtcgggttccgagcggtttcgcttcccgcgggaagtggtttcctcgcagtttcctaccgtccgccctccgcgatttttcccgtgttttcgtttacgtcgtccgcgccattgtagagcatccgcagtgatcttcgttgtctcgccgcccttccgccgtcgttgaggtgatcgcagaacggagaaatgggacaagcgttgggatgcattcaggtggaccagtcaactgtagctatcaaggaaacttttggcaagtttgatgatgtgctagatcctggatgccactgtttgccctggtgcttggggagccaggtggctggtcacctctctttacgtgtacagcagctggatgtccggtgcgaaactaagacaaaggataatgtctttgtcactgtggttgcgtccatccaatatcgagctctggcacaaaaggcatctgatgctttctataggctcagcaacaccagggcgcagattcaagcctacgtctttgatgtcattcgtgcaagcgttcccaagctggaacttgattcgacatttgaacagaagaatgaaatagcaaaagctgtagaggaggaacttgagaaggctatgtcagcttatggatatgagattgttcagactctaattgttgatatagaaccagatgaacatgtgaagcgagcaatgaatgagataaatgcagctgcacggttgagagtggccgcaactgagaaagctgaggcagagaagattctgcagatcaagcgagctgagggagatgcagagtccaaatacttggctggacttgggatagcgaggcagaggcaggctattgtggatggtctgagggacagcgtgctggctttctccgagaatgttccgggaacttcatcaaaagatgtcatggatatggtcctggtcacccaatacttcgacacaatgaaggaaattggtgcatcttcgaaatccagctctgttttcatcccacatggtcctggcgctgtgagagatgttgcggtccagatcagggagggtctcctacaggcacatgcggcgcagtgagtccgagcacatatagggggatgtgttttcactctgtccgttgccgtattttttttacctatccaagtcaaaaagatttgaactgtcgatctggtcatattatttgaggagaatgtattatataatttcaataatattacaatatcggtgtatatactaagaatgttgtctggaggcttct

SEQ ID NO: 3734 - DNA, 858 bp, Lotus japonicus
caaatgggaaatctgctatgttgtgtgcaaattgaacaatcaacggtggctataaaagaaaaatttgggagatttgaagaggttcttgagccgggattccattgcgtgccaatgttccttggagatagactggctggtcatctctctcttcgcctacaacaattggatatccaatgtgagaccaagacaaaggataatgtctttgttaatgttgttgcctctattcaatatcgcgccctggcggacaaggctagtgatgctttttacaaacttagcaatacaaggacccaaattcaggcctatgtttttgatgtaattcgagcatatgttccaaaactcaacttggatgatgcttttgagcagaaaaataaaattgccaaagctgtggaagaagaacttgagaaggctatgtcaggttacggatatgaaatcgttcaaacactgattattgatatagagccagatgttcatgtgaagcgggctatgaatgaaatcaatgctgctgcaagattgaggttggcagctactgagaaggcagaggcagagaagattttgcaaatcaagcgagccgagggtgaggccgaggctaaatatctttctggtctcggcattgcgcgccaacgccaagcaattgttaatggcttgagagacagtgtgcttggattcgcagtgaatgtaccggggacaagtgcaaaagatgtcatggacatggtccttgtcactcagtattttgacacaatgaaagagattggtgctgcctccaagtcctctgctgtgtttattcctcatggacccggtgctgttcgcgatgtagctagtcaaatccgcaatggacttcttcaggcttctcatcagtag

SEQ ID NO: 3735 - DNA, 1692 bp, Zea mays
atatgaatctaacatatgggtcaaaaaatatatctatatcttaatctatcggatcgcatccaaggtatatggaatccccgaattaaattgtcatccctactttctatacagacgccacgccacctccttccccttcgatatttttatttttttttggttggatctagcgtgacggcaaagacggtgtatcgaagggtcgacaatggttacgacgatcggtagtccatagcagcggcgggcgcaacttcgacccggttttcttcccatatatctgtcaaatccttctccggttgccctccatcggcagcaatttccgccatagataccggcgatcgagggcctcggacaacccaatcgacggagcagcgcggcggcaggagagggcaaacccttttcttctcagtactctacttgtctgcgcctggatcccctccgcaggaagataagacatgggtcaagcactcggcttgattcaagtggatcaatcgacagtagccatcaaggaaacttttgggaagtttgacgaggtcctagagcctggatgccacttcttgccatggtgcatagggaagcaaattgctgggtatctgtcactgcgtgtgcagcagcttgatgtccgctgcgaaacaaagacaaaggataatgtcttcgtcaatgttgtggcatctgtgcaatatcgtgcccttgccgataaggcatctgatgcattttacaggcttagtaacaccagggagcaaatccagtcatatgtttttgatgtcatcagggcaagtgttccgaagatgaacttggatgatgcctttgagcagaagaatgaaatcgccaaagctgtagaaaatgaacttgaaaaggcaatgtctatgtatggatacgagattgtgcagactctgattgttgatattgagcctgatgagcatgtgaagagagctatgaatgagatcaatgcagctgctaggctgaggttggctgccagcgagaaagctgaggcagagaagatactgcagatcaagagagccgaaggtgatgcagaatccaagtacttggcgggtctgggtatcgcaagacagcgccaggctatagtggatgggctcagagacagtgttcttgctttctctgagaatgtgcctgggacctctgcaaaggatgtcatggacatggttctggttacccagtacttcgacaccatgaaggagattggggcctcgtccaagtcctcgtcggttttcatccctcatggaccaggtgctgtcagagacatcgcagcgcagataagggatggtcagctccaggccagtctgctgtgagcacgttggaaaaggcatgcttttgacattcccatcagtaaagaagtacatatacatcatgaggagtaaaaaaaaacttactagcgataatgtgagtacagcttgttcgttctatctatatggtgcatgtgattattattatggagattaatgttaaataggttcgcatgtattgtgccagaacaaggctaaggaccagtttgcgtaaaaaaatgtatgtttggaacttatctaagttttggagcctgaggaaacccctccatcctgtgcaaactattttgtggtaccctgcttctctgttatcgtgaatgagaatctcatgttcattttctgtgcccagattaagaggaaattctgggatttgattactgacgtggatgcatcctgt

SEQ ID NO: 3736 - DNA, 1335 bp, Glycine max
gcatctacttgttgtgaatcaacataaatattccgttttgcgtttctctgcctaaaaggattgaaagatgggtcaagcactaggttgctatcaagttgatcagtcaaatgtggctatcaaggagcattttggaaaatttgatgatgtcctagaacctggatgtcattgcctgccttggtgtcttgggtaccagattgctggtagtttgtcactgcgtgtgcagcaacttgatgttcgatgtgagacgaaaaccaaggacaatgtctttgtcactgtggttgcatctgtgcaataccgagctgtgtctgagaaagcatctgatgcattctataggcttaccaacacaagggagcagatccaatcatatgtttttgatgtcatcagggccagtgtaccaaagttggagttggattctgtctttgagcagaagaatgatatagcaaaggctgtggaggaggagcttgagaaggccatgtcaacctatggatttgagatagtccagactctcattgttgatatagagcctgatgttaatgtcaagagagcaatgaacgagattaacgcagctgctagattgaggttggctgcaaatgagaaggctgaagcagaaaaaatactgcagatcaaaaaagctgagggagaagcagaatccaaatatctgtcaggactcggtatcgctcgccaacgtcaagccattgtggatggactgagggacagtgtgcttgctttctctgagaacgtgcctgggacaacagctaaagatgtcatggacatggtgctggtgactcaatactttgacaccatgaaagagattggagcatcttcaaagtcctcatctgttttcataccacatggtcctggcgcagttaaggacattgccatgcagattcgggatggtctgcttcaggccaccacttcacagaattaagctttcctggagttgtaaataacaaatagtagcgtgccagattttttttcagtaaatgcttttcttgtttgaacttaaaatgtctgcatctttactcttatattggatagattcatggcagtgtctatttttatgcgtgtaagtactgatgtgcagttttgaatacttgtttgaggatagtcttaatgtcaagttgcttgtgaatcatattatttgggggtttgttatgtaagaattacttcccagaggatgtgcttttctttcagtcctgtcttgcaagtgaatgtgtaaatttgtagttctctatatttactatttgatgtacattgtttccacctctcttggcttcttgaaagtgccccttactattattttttttaaggtgcttaatgcataggcatttccta

SEQ ID NO: 3737 - DNA, 1466 bp, Glycine max
aaaataattaatattatattaaaaagttaaaatataattatttttaagacaaatatattttctcttcttttaaaaagattttttataaaaaaaaatccaaacgatatataaacaagtgtgctctgctctatgcatctacttgttgtgaatcaacataaatattccgttttgcgtttctctgcctaaaaggattgaaagatgggtcaagcactaggttgctatcaagttgatcagtcaaatgtggctatcaaggagcattttggaaaatttgatgatgtcctagaacctggatgtcattgcctgccttggtgtcttgggtaccagattgctggtagtttgtcactgcgtgtgcagcaacttgatgttcgatgtgagacgaaaaccaaggacaatgtctttgtcactgtggttgcatctgtgcaataccgagctgtgtctgagaaagcatctgatgcattctataggcttaccaacacaagggagcagatccaatcatatgtttttgatgtcatcagggccagtgtaccaaagttggagttggattctgtctttgagcagaagaatgatatagcaaaggctgtggaggaggagcttgagaaggccatgtcaacctatggatttgagatagtccagactctcattgttgatatagagcctgatgttaatgtcaagagagcaatgaacgagattaacgcagctgctagattgaggttggctgcaaatgagaaggctgaagcagaaaaaatactgcagatcaaaaaagctgagggagaagcagaatccaaatatctgtcaggactcggtatcgctcgccaacgtcaagccattgtggatggactgagggacagtgtgcttgctttctctgagaacgtgcctgggacaacagctaaagatgtcatggacatggtgctggtgactcaatactttgacaccatgaaagagattggagcatcttcaaagtcctcatctgttttcataccacatggtcctggcgcagttaaggacattgccatgcagattcgggatggtctgcttcaggccaccacttcacagaattaagctttcctggagttgtaaataacaaatagtagcgtgccagattttttttcagtaaatgcttttcttgtttgaacttaaaatgtctgcatctttactcttatattggatagattcatggcagtgtctatttttatgcgtgtaagtactgatgtgcagttttgaatacttgtttgaggatagtcttaatgtcaagttgcttgtgaatcatattatttgggggtttgttatgtaagaattacttcccagaggatgtgcttttctttcagtcctgtcttgcaagtgaatgtgtaaatttgtagttctctatatttactatttgatgtacattgtttccacctctcttggcttcttgaaagtgccccttactattattttttttaaggtgcttaatgcataggcatttccta

SEQ ID NO: 3738 - DNA, 1316 bp, Saccharum officinarum
gacaagacacaagaagaggccgttctcgttccctggccgagcaggacatccggcaggcggcggcagcccacgggaactgccttgcggaactggagactggagcggcgcaacttccccccagataagacatgggtcaagcacttggcttgattcaagtggatcaatccacagtagccatcaaggaatcttttgggaaatttgacgaaatcctagagcctggatgccacttcttgccatggtgcatagggaagcaaattgctgggtatctgtcactccgtgtgcagcagcttgatgtccgctgcgaaacaaagacaaaggataatgtcttcgtcaatgttgtggcatctgtgcaatatcgtgcccttgccgataaggcatctgatgcattttacaggcttagtaacaccagggagcaaatccagtcatatgtctttgatgtcatcagggcaagtgttccaaagatgaacttggatgatgcctttgagcagaagaatgaaatcgccaaagctgtagaagatgaacttgaaaaggcaatgtctatgtatggatacgagattgtgcagactctgattgttgatattgagcccgatgagcatgtgaagagagccatgaatgagatcaatgcagctgctaggctgaggttggctgccaccgagaaagctgaggcagagaagatactgcagatcaagagagctgaaggtgatgcagaatccaagtacttggccggtctgggtatcgcaagacagcgccaggctatagtggatgggctgagagacagtgttcttgctttctctgagaatgttcctgggacgtctgcaaaggatgtcatggacatggttctggtgacccagtacttcgacaccatgaaggagattggggcctcatccaagtcctcgtcggtcttcatccctcatggaccaggtgctgtcagagacattgcagcgcagataagggatggtcagctccaggccagtctgctgtgagtacgttgaaaaatgcatgctttagacattcccatcagtaaagaagtacatatacctcatgagacaagtataacttattagggatgatgtgagttcttgtgcatcaatactgcttgttcgttctatttatctggtacgtgtgattattattatcgagatcaatgttatataggtttgcatagaacaaggataagggccggttgctgtaaaaatttgtcatgccgtggtactgcttggaacttatctaagttgtggagcctgaggaaactcctcaagcttctctgttatcgtgaatgaaaatctcatcttcattttctgtgcccagattaagcc

SEQ ID NO: 3739 - DNA, 1267 bp, Triphysaria pusilla
cttagggagtttttttttgttttaaagctcctcgacagctacacttttttattttactctatttcgaatcataatttcataaattctcaaacccctatacagaaaattctctagcttagcctattcatcttctctccagtctattatcggtagcttttagtagggaaaagaaatgggcaatacgcttggttgtgttcaagtggatcagtctacagttgctgtaaaggaacattttgggaagtttgtcgatgtgcttgagcccgggtgtcattgcctgccgtggtgcgtcggctatcagttagccggtactctaacgttacgtgtgcagcagctcgatgtccgttgcgaaaccaagactaaggacaatgtttttgtcactgttgttgcttcaatccagtaccgagcaatggcggaaaatgcagctgatgcgttctataagctttctaacacaaaggaacagatccaatcatatgtttttgatgtcataagggcaagcgtaccaaaactggatttggattctactttcgagcaaaagaatgacatagctaaagctgtggagagtgaacttgaaaaggcaatgtctgcttatggatatgaaatagtccagactctgatcgttgacattgaaccagatgctcaagtcaagagagccatgaatgagattaatgctgctgcaaggctcaggcttgctgcgaccgagaaagctgaagccgagaaaatcctgcagatcaagagagccgagggagaagccgaagccaagtacttgtcgggcatgggtatagcccgtcagcgtcaggccattgtggacgggctgagggacagtgttctcgcgttctcagacaatgtgcccggcacatcggctaaggacgtgatggacatggtcctcgtcactcaatactttgacaccatgaaggagatcggggcgtcgtcgaaatcgtcggctgtgttcataccgcacgggccaggggctgtcaaggatgttgcttcgcagattcgcgagggccttctgcaggggcaaagtgtcagtcactagattaacgatgaggactcggttttcgggcttcttttatggtatcttttatatatgcaggtgtgcgtgtgtatctgtgattatgtttaagtttgttttgtaagtgggagttggtatatggattcagtttggcaattgtaagttgtggtgtgaagctgtttctagtcatggatgcatagttaccttttatatgattgtatatgcattattgttcaatgaagaaacttatgttgaaaa

SEQ ID NO: 3740 - DNA, 1333 bp, Vigna unguiculata
cgcgggaattcgattagcgtggtcgcggccgcggtacgcgggggcacttacttactgcacatattataaaggttcattcctgtgtttctcagcttaaaagaattgaataatgggtcaagcattcggttgctatcaagttgatcagtcaaatgtggccattaaggagcattttggaaaattttctgatgttctagaacctggatgccattgtctgccttggtgtcttgggtatcagatcgctggtggtttgtcactgcgtgtgcagcaacttgatgttcgatgtgagacgaaaacaaaggataacgtctttgtcactgtggttgcgtctgtgcaataccgagctgttgctgagaaagcatctgatgcattctataggcttaccaacacaagggagcagatccaatcatatgtttttgatgttatcagagccagtgtaccaaagttggagttggattctgtctttgagcagaagaatgatatagcaaaggctgtggaggaggagcttgagaaggccatgtcaacttatggatttgagatagtccagaccctcattgttgatattgagcctgatgttaatgtcaagagagcaatgaacgagattaatgcagctgctagattaaggttggctgcaaatgagaaggctgaagcagaaaaaattctgcagatcaagaaagctgagggagaagcagaatccaagtatctgtcaggactcggtatagcacgccaacgtcaggccatcgtggatggcctgagggacagcgtgcttgccttctcttcgaacgtgcctgggacaacagctaaagatgtgatggacatggtgctggtgactcaatactttgacaccatgaaagagataggagcatcttcaaagtcgtcgtcggtgttcataccgcatggccctggcgccgtgaaggacattgccgtgcagatcagggatggtcttcttcaagctagtgcttcacagacaaattaagctttcttggagttgtaaataacatagtgtgtgtgtgtcttttgtgtgaacttagaatgtctgtatcttttcgtgtttctattttgtatgtgttcataatacatcttaagtattgatgtgcagttttctttaatacttgtgttgaggatagttttgatgtcaagctgtttgtgaatcatattgttggaggatatgttatttaagaattacgttccaaaagatgtgttctatcttgaaagttgtaaagtgaatgtgtaaaaatgcggttctctatgtttactatttttgttgcatatgctttcacctctttgcttattgtaaagaatatgaagaattttgaaagggtaaatgatttctttt

SEQ ID NO: 3741 - DNA, 1252 bp, Vaccinium corymbosum
aggtagcctttatatataaatatttgtgttttcgtttcaagaatttatactcgcagtttttagggtttctttattctatacttgaaggaaaaacaattcaaactatgggtcaagcattgggttgtgttcaagttgatcagtctacagttgccattaaggagcattttggaaggtttgctgaagtccttgagcctggctgtcactgcttaccctggtgtttggggtaccaggtagctggggaattgtcattacgtgtgcagcagcttgatgttcgctgtgaaacaaaaaccaaggataatgtctttgttaatgtggttgcatccattcaataccgcgcagtggcagataatgcatccgatgctttctataagctttccaataccaagggacaaatccaggcttatgttttcgacgtcatcagggcaagtgtaccaaagatggagttggattctgcttttgagcaaaagaatgatatagcaaaagctgtggaggaagaacttgaaaaggccatgtctgcttatggatacgaaatagtccagactcttatcgtggatattgagccagatattaatgtcaagagggcaatgaatgagataaatgcagctgctagaatgagggttgcagcaaacgagaaggccgaagcagagaaaatactgcagatcaagcgagctgagggagaggcggaatctaaatacctctcagggcttggtattgctaggcagcgccaagccatcgtggatgggctgagggacagtgtgctggccttttctgagaacgtgcccggaacaacatccaaggatatcatggacatggtgttggtcactcaatacttcgacaccatgaaggagattggggcttcctccaagtcctctgcagttttcatcccgcatggacccggcgcggtgagagatgtcgcatcacagatccgagagggccttcttcaggccggaagtgttcagcattagcttttgagcaataatgaaattgccggtactttctatgtgatactaaagtggtatttcatataggatgttaatctcgggtatatgctgcaaatataaggtgaaaattgtgcagtacagaatggtctttgaatttggttttcgttttgatgtgtttaactcagtgagtggatgaatttatatcgtatagttcgttatttggagattggtttgccttgttataaaattctactttcatagctgttctctaattccattgtccaggtgattttcttgtcttccttatcgag

SEQ ID NO: 3742 - DNA, 1510 bp, Panicum virgatum
taatggaatgttttgtaggcatgaccaatatattgtttctgaatctgcatccttgcttgaagttgcaattggttaattatgaatgagtttgtccaatcatagcttccagcatacatttatcttgactcattaattttagtccagtgatgctatctattatttttaagtatgccagctgtttgtatggtactgaaagtaaagttctcatccgcttatattaattatagaattcatgccaactgtgagccaagtcaagattgtgcagatatgttgagatgctagtatttgttcttattagcagatgactttagtaaattccactgttcctttgtagataagacatgggtcaagcacttggtttgattcaagtggatcaatcgacagtagccatcaaggaatcttttggaaagtttgatgagatcctagggcctgggtgccacttcttgccatggtgcatagggaagcaaattgctgggtacctttcactgcgtgttcagcagcttgatgtccgctgcgaaacaaagacaaaggataatgtcttcgtcaatgttgtggcatctgtgcaataccgtgcccttgcggacaaggcgtctgatgccttttacaggcttactaacaccagggagcagatccagtcatatgtctttgatgtcatcagggctagtgttcctaagatgaacttggatgatgcatttgagcagaagaatgaaattgctaaagctgtggaagatgaacttgaaaaggcaatgtcaatgtatggatatgagattgtgcagactctgattgttgatattgagcctgatgagcatgtgaagagagccatgaacgagatcaatgcagctgctaggctgagggtggctgccaatgagaaagctgaagcggagaagatcctgcagatcaagagagctgaaggtgatgcagaatccaagtacttggccggtctgggtattgcaaggcagcgccaggctatagtggatgggctgagagacagtgttctcgccttctctgagaatgtccctgggacctccgccaaggatgtcatggacatggttctggtgacccagtattttgacaccatgaaggagattggggcatcttccaagtcatcttcggtcttcatccctcatggacctggcgccgtgaaggacatcgctgcacagataagggacggacagctccaggcaagcatgctgtgagagagcactggaaaaaaaatgcatgctttgaatattcccatcagtaaagaagtccaagagccagtacaatatctagttatttgagtaaaagttaggcatatggtagcaatgtgagtaagtacagcttgttcattctatgcgtcacgtatgtttattatctagatgtatgctatgtaggattgcatggattgtgcctggaaatgataaagacctatttgttactgtaaaaattcgtcattgcatcgtactgtttggaactacctacctcttaagttttcgagcccgagcaaagtccttaagctattttgtgctac

SEQ ID NO: 3743 - DNA, 1334 bp, Vigna unguiculata
  misc_feature (32)..(34): n is a, c, g, or t
cgcgggaattcgattagcgtggtcgcggccgnnntacgcgggggcacttacttactgcacatattataaaggttcattcctgtgtttctcagcttaaaagaattgaataatgggtcaagcattcggttgctatcaagttgatcagtcaaatgtggccattaaggagcattttggaaaattttctgatgttctagaacctggatgccattgtctgccttggtgtcttgggtatcagatcgctggtggtttgtcactgcgtgtgcagcaacttgatgttcgatgtgagacgaaaacaaaggataacgtctttgtcactgtggttgcgtctgtgcaataccgagctgttgctgagaaagcatctgatgcattctataggcttaccaacacaagggagcagatccaatcatatgtttttgatgttatcagagccagtgtaccaaagttggagttggattctgtctttgagcagaagaatgatatggcaaaggctgtggaggaggagcttgagaaggccatgtcaacttatggatttgagatagtccagaccctcattgttgatattgagcctgatgttaatgtcaagagagcaatgaacgagattaatgcagctgctagattaaggttggctgcaaatgagaaggctgaagcagaaaaaattctgcagatcaagaaagctgagggagaagcagaatccaagtatctgtcaggactcggtatagcacgccaacgtcaggccatcgtggatggcctgagggacagcgtgcttgccttctcttcgaacgtgcctgggacaacagctaaagatgtgatggacatggtgctggtgactcaatactttgacaccatgaaagagataggagcatcttcaaagtcgtcgtcggtgttcataccgcatggccctggcgccgtgaaggacattgccgtgcagatcagggatggtcttcttcaagctagtgcttcacagacaaattaagctttcttggagttgtaaataacatagtgtgtgtgtgtcttttgtgtgaacttagaatgtctgtatcttttcgtgtttctattttgtatgtgttcataatacatcttaagtattgatgtgcagttttctttaatacttgtgttgaggatagttttgatgtcaagctgtttgtgaatcatattgttggaggatatgttatttaagaattacgttccaaaagatgtgttctatcttgaaagttgtaaagtgaatgtgtaaaaatgcggttctctatgtttactatttttgttgcatatgctttcacctctttgcttattgtaaagaatatgaagaattttgaaagggtaaatgatttctttta

SEQ ID NO: 3744 - DNA, 1053 bp, Fagopyrum esculentum
ttttgaagctctctctccataactgcgaggcagatagaagataagtgtcatggggcaagctatcggacttcttcaagtggaccaatcgactgttgcaatcaaagaaaactttgggaaattcgatgatgtgctagatcctgggtgtcattgggtaccatggtggtttgggagtcaaatagctggtattctatccttacgtgtgcagcaactcgatgttcgttgcgaaaccaagactaaggataatgtgtttgtcacggtggttgcatccattcagtaccgggcaatggcagaaaaggcagctgattcattttacaaactcagtaacacaagggagcaaatccaagcttatgtgtttgacgtaattcgtgcaagtgtaccgaagctgaacctggatgatacatttgaacaaaagaatgatattgcaaaagctgtagaaaatgagcttgagaaggccatgtcaaattacggttatgagatagtccagacactcatagtggacattgagcctgatgtgcatgtgaagagagccatgaatgagatcaatgcagctgctaggatgagagtggcggcaaatgagaaggcagaagctgagaaaatcctgcagataaagaaagccgagggagaggcggaagcaaagtatctggcaggtctgggaatagcgagacagcgtcaagccatcgtagacgggttgagggaaagtgttatcaacttctcaagcaacgtgccagggacaacagccaaggatgtcatggacatggtcctcgtaacccagtactttgacacaatgagagagatcggggcttcatccaagtcgtcatctgtgttcattcctcacgggccaggtgctgtcaaggacatcgctgtccaaatcagggatggtcttctacagggtaatgctgctcagcaatagcgcgctaatctctgctaatggcttgtgtgtgttttgaaaatggtgtcacatattgagtatatttttatggtttgtgtggattttgatcaataacgcaggatactgggtacgagtaagaagctatgtagtaaaaaatggatttt

SEQ ID NO: 3745 - DNA, 1218 bp, Arachis hypogaea
ggtgggctttgcgctttgtatatatgtaccacactccatcctaaggaagattcatagaaatatcttccatcttttcttctttctcggtaaaccctagaactgaaggatgggtcaagcacttggttgctatcaagttgaccagtcaaatgtggctatcaaggagcattttggaaaatttgatgaaattctggagcctggatgccattgcttaccttggtgtcttggttaccagatagctggtgcactatcactacgagtgcagcagcttgatgttcgatgcgaaacgaaaaccaaggacaatgtatttgtcactgtggttgcgtccgtgcaataccgagctgtggctgacaaagcatctgatgccttctataggctttcaaacacaagggggcagatccaatcatatgtttttgatgttattcgggccagtgtgccaaaattagagttggatgcggtgtttgaacaaaagaatgatatagcaaagtctgttgaggaggagcttgataaggccatgtctacctacggatatcagatagtccagaccctgattgtggatatcgaacctgacactaatgttaagagagccatgaatgagatcaatgcagctgctagactgagggtggctgcaaatgagaaagctgaagcagaaaagattctgcaaatcaagaaagctgagggagaggcagagtccaaatatctgtcgggactcggtatagctcgccaacgccaggccattgtggacgggttgagggacagcgtccttgcattctctgaaaacgtgcctggaacaacggccaaggatgtgatggacatggtactggtgactcagtactttgatactatgaaggaaatcggtgcatcttcaaagtcctcatcggtgttcatacctcacggccctggtgcagtgagggacattgctacgcagattcgagacggcctccttcagggaaatgcctcacagaacttaatttaaagcttttgccaggaatggtaaaagtgacaagataatgtgcatgttagtttttctttccgggtgaatactcattgtgaatgcttggtgtctatgcttatattgttttataaaatagtaaggagtgaataggagaaagtatagtatgcaataacatatgcttatattcaattttgaatgtatagtttgatgacaatcatatatcaaaattgcttggcaattggcaatcgtattattattattattgt

SEQ ID NO: 3746 - DNA, 1244 bp, Plantago ovata
aagtttgacgaagtcctcgaaccgggatgccattgcttgccttggtttctggggaagcagctggctggtcacctctctctgaggttgcagcaattggatgtcaagtgtgagacgaagacaaaggacaatgttttcgtcaatgttgtggcatcgatacagtatcgtgccctttctgacaaggctagtgatgcgttttacaagctcagcaacactaggagtcaaattcaggcctatgtctttgatgtcataagagcaagtgtgccaaaacttcttcttgatgatgcttttgagcagaaaaatgaaattgctaaggctgttgaggatgaacttgaaaaggcaatgtctgcctatggttatgaaattgttcaaacgctaattgttgacattgaaccagatgagcatgttaagagagctatgaatgagatcaatgcagctgcaaggatgaggttggctgctaatgagaaagcagaggctgaaaagattttgcagatcaaaagagctgaaggtgaagcagaggccaaatatctctctggcttgggtattgctcgacaacgtcaggcaattgttgacggacttagagacagtgtgctaggcttctcagttaatgtgcctggcaccactgcaaaggatgttatggatatggtcctcgtcacgcaatatttcgatacaatgaaggagatcggtgcttcctctaaatcttctgctgtcttcatccctcatggaccaggtgctgtacgtgatgtggctgctcagattcgtgatggacttcttcagggtggttcagtgaactagtatgtctttacttgtgcacttgtttgtgagtaagttgagatacaattgttttcgtgatggttatcgtgttacatacgtcgtttttattatattgttgatatagttacagttcaaaactactagtagggctattattacttggttcaaagaaatgtacatgtcttacagaataagctttgggaagtacggaagtgcttttcattgctttcccttgacttgtcaagaatactaaaaccatgttattggtgtgttgagcatttttaaagtccactatgttttcgtaatggcttgagaagtttctaaacgttgtcatgttattgagaatgctttctatgctgaaatgccactatgacgtgtgacctgatgcttcagtcccaacttgttccgttacacgaaatatgatattttgcatttagggttcttcttgcttttgcaacttttaggggaacttg

SEQ ID NO: 3747 - DNA, 1012 bp, Fagopyrum esculentum
aaatgggaaacctattttgctgtatcagagttgaacaatccaacgttgccataaaggagagatttggcaagttcaatgatgtgcttcagccagggtgtcactgtgtgccctggtttattgggacgagattgcggggaaactcactcttcgtgtgcagcaattggatgtcaaatgcgagaccaaaactaaggataatgtctttgtgaatgttgttgcctcaattcagtaccgtgccatgtctgataaagctaatgatgcgttttataagcttaccaatacgagaacccaaatccaagcttatgttttgatgtgataagaggtagtgctccaaggctcaatattgatgatgtgtttgagcagaagggtgaaattgctaaagcagttgaggaagagctcgaaaaggctatgtcggcttatgggtttgagatcgttcagacgcttataactgatattgagcctgatgaacatgtgaagcgtgcaatgaatgaaatcaatgctgctgcaaggatgaggttggctgctaaacgaaaaagcggaggcagacaagatcatacaaataaagagagacggaaggagaggcagaggcaaagtaccttgctggactcggaattgcaaggcaaagacaagcaatagtagacggtctaagagacagtgtgattggcttctcggtaaatgtaccaggaacaactgctaaggatgtcatggacatggttcttgtgactcagtatttcgacaccatgaaggagattggtgcttcttctaagtcatctgctgtgttcatccctcacgggcctggtgccgtccgtgatgttgccactcagattcgtgatggactgttgcaagcttcgtcgactcctggacttgctcagtaatgaagttgttaatggcttttgaggattgatgagtttattcatatgaattgctaagtaagaatcataaaaactctttgtttatattttactgatttaagctgcgaaatgatttgtaaattaatgtttcgtttgtgtttcca

SEQ ID NO: 3748 - DNA, 1085 bp, Fagopyrum esculentum
actcgtctgtcatcctcttggcctgaacctcgcttcattatcttcctcattccaatctcaaagaacccagaaggaaatgggaaacttattttgctgtatcagagttgaacaatccaatgttgccataaaggagaggtttggcaagttcaatgatgtgcttcagccagggtgtcactgtgtgccctggtttattggggacgaggttgcggggaagctcactctccgtgtgcagcaattggatgtcaagtgtgagaccaaaacgaaggataatgtctttgtgaatgttgttgcctcaattcagtaccgtgccatgtctgctaaagctagtgacgcgttttataagcttaccaatactagaacccaaatccaagcttatgttttgacgtgattagaggtagtgtgccgaggctctatattgatgatgtatttgagcaaaagggtgaaattgctaaagcagttgaggaagagcttgaaaaggctatgtcagcttatgggtttgagatcgttcagacgcttatcactgatattgagcctgatgaacatgtgaagcgtgcaatgaatgaaatcaatgctgctgcaaggatgaggttggctgctaacgaaaaagcagaggcggacaagatcatacaaataaagagagccgaaggagaggctgaggcgaagtaccttgctggactcggaattgcaaggcaaagacaagcaatagtagacggtcttagagacagtgtgattggcttctcagtgaatgtaccaggaacaactgctaaggatgtcatggacatggttcttgtgactcagtatttcgacaccatgaaggagattggtgcttcttccaagtcatctgctgtgttcatccctcacgggcctggtgcggtccgtgatgttgccactcagattcgtgatggactgttgcaagcttcgtcgacccctggacttgcttagtaatgaagttgttaatggctttcgaagattgatgagtctagttatatgaaatggcaaagtaagaatcataaaactctttgtttatattttacttgttcaagctgcgaactgatttgtaaattgatgtttggtttgtgtttcca

SEQ ID NO: 3749 - DNA, 1499 bp, Phaseolus coccineus
tcaaaatattcttgtttatctttaattcaaaaatagataaacttttattattttaatatttgttctctacttaattttgtattattaaaatataattattttccttttcaaaattgtttctcttttcatattggagaaatattaatatttagttttttcaataatatatttctcttttcttaaaaaattataaaaagatgtatattatataaagtgtgcattgagctgtgtgctttgcactttgcatctacttgctgtggatttattatacattcgtgagtttctcagcctgaaagaattgaaggatgggtcaagcattcggttgctatcaagttgatcagtcaaatgtggccatcaaggagcattttggaaaattttctgatgttctagaacctggatgtcattgccttccttggtgtcttggttatcagatcgctggtggtttgtcactgcgtgtgcaacagcttgatgttcgatgtgagacgaaaaccaaggataacgtctttgtcactgtcgttgcgtctgtgcaataccgagctgttgctgataaagcatctgatgcattctataggcttaccaacacaagggagcagatccaatcgtatgtttttgatgttatcagggccagtgtaccaaaattggagttggattctgtctttgagcagaagaatgatatagcaaagtctgtagaggaggagcttgagaaggcaatgtcaacttatggatatgagatagtccagaccctcattgttgatattgagcccgatgttaatgtcaagagagcaatgaacgagattaatgcagctgctagattaaggttggctgcaaatgagaaggctgaagcagaaaaaattctgcagatcaagaaagcagagggagaagcagaatccaagtatctgtcaggacttggtatagctcgccaacgtcaggccattgtagatggactgagggacagtgtgcttgccttctccgagaacgtgcccggaacatcagctaaagatgtcatggacatggtgctggtgactcaatactttgacaccatgaaagagataggggcatcttcgaagtcatcgtcggtgttcataccacacggccctggcgccgtcagggacatcgccgtgcagatccgggatggtcttcttcaggctagtgcttcacacacaaattaagcttcattggagttgtaaataacatagtatgtgtctcttttttttgtttgaacttagaatgtctgcatcctttcctctttctatattgcatggttcatagccagtgcctatttttacatctgaagtactgatgtgcagttttttcctttgatacttgtgtggaggatagttttgatgtcaagctgtttgtcaattatattgttggaggatatgttatctaagaattactttccaaaagatgtgttcttcttgagttctatcttgtaagttgtaaaatgaatgtttaaaattgtacttctctatattttctattttcattgcacattgatt

SEQ ID NO: 3750 - DNA, 1270 bp, Nicotiana benthamiana
tcaggacacgtcacgcaaaaaccgtttgagtgctaccgttttcagaatcatttcttttttcttaaaataattatatatgtagctgtatgtagtctatgttttatcttcttgagcaagtaattattactcttttacctttgctttttcacgcttttgctcacttcacagatttgaactatgggtcaagcgctctgttgcattcaagtagatcagtcaactgttgctgtgaaagaacacttcggtaagtttgacgaagtgctggagccagggtgtcactgcttgccttggtgtcttgggtatcaggtccctggttatctctcattgcgactacagcagcttgatgttcgttgtgagacaaaaacaaaggacaatgtttttgtgactgttgtagcatccattcagtacagagcgttagcagaaaatgcagctgatgcattttacaagctctctaacaccaaaggacagatccagtcctatgtttttgatgttataagggccagtgtgccacgattggggttggatgctgcatttgagcagaagaacgaaattgctaaagcagtagaggaagaacttgaaaaggctatgtctgcttatgggtatgagattgtgcaaaccctcattgtggatatagagccagatccccatgtcaagagggcaatgaatgagattaatgctgctgcaagactacgtgttgctgcgaatgagaaggccgaagcagagaaaatattgcagatcaagagagctgaaggagaagctgaatccaagtatttatcagggcttggcattgctcgacagcgtcaagccattgtggatggccttcgagacagtgtgattgctttctcagagaacgtgcctggaacaacagcgaaagatgtgatggacatggttcttgttactcaatattttgatacgatgaaggagattggagctacttccaagtcatctgctgtgtttattccccatggaccaggtgctgtcaaagacattgcttctcaaatccgcgagggtcttcttcaggctgaaagtattcagcgttagtttaacaaagctaaggataattgttagtcctgtgtggtttgttgcttttagttcagtcttgatacggtagctttacttgtgttcgtgcttatagaatccatagattgatgtatgccacgtttggttttaccatctggtttataggttgtttatcaactatgctgacaaacgaagttttgcagttgattgattatattgctgtacgatgtctctctaggcattttttaggtat

SEQ ID NO: 3751 - DNA, 3063 bp, Panicum virgatum
cacctccgaaatcacttaaatggtcatatttgtccggtttgaatgactctcgttacttaaaaagttaaaagtcgatctttatatgatagtttgagaatttaaacttcacatatatcattaaaaaacaactaccctcaaatgcaaaccagcccattcacacggtcaaacatcatcatcatcatcatcctcgtcatccgcgatcctaaacaaaagccaaacataaaacaaacgaaagacgatatttttgcttctggccccagtggccccagagcaaccgaggcaccgagcacgcctctcggccagcggcggcacacgggaaccggagacacgagcgattccgtccccaatttccttcgcatccatcgcaatcctcttcccgaaaaccccaatcgccccacttccctcccagacgcgcagcaattccgccataaataccggttgatcgagggcgggagagagcgcacccgccggagcagcgcgcggaggaacgaggccaaacccttcctcagctttcgtctgcgcctggggggatccttcctccggaggaagaaggtaactaaaccgccaccgtgtcaccccctcccctcccctcactctcgcccagacccctagccagttagtctcctctttgcggcggcgccggccgtcgcggccgggtaggtaggcgaccccgcccctcggttcttgtgacgggggccgcatttgtccggtaatttctagtgcgctggacgggttacggtcttgtagaggaggaatttcttttctcctttcgtggctggtttcttggggatttctccttattgggacgcgtttcttggaaatctcgccggccctctgctccttcaactccgtccacttcaggcaacgattgttttttgtgtggcggctcccaagctgatgtttttttcttcgaaaagatcaagctgatgattttcggttgcttcttcggattcgacccctattcttgtcctgcgggctttgtggaattgtggtggtgtgtggccgcggcttggaaccaaccttgcggtctccgtggcctcaacgaagtgagccgacaaatctgcggcaccgacgtgcgctgattgtccttagcattccacgctgtttactgttcaggcacggcttcgaagttttcaggtgtcctagtcaaacacgcattttaaaatattttttcagatttagttcaatgctacccttttcttttggtgcccaccttcgcagcttataattaattgcatggctgctgggcaccgttgggaattttccactggtgttggatacacagataagataggccagcaagtggcagcgcgtcctgttcttgttcagttgtatatcctgttctttttttttgcgggtagttgtatatcctgttcatgtttaattgtcatagggcagatacacactggctgggccatgaaagattgcgacgtgcttatcactagtccttggcttagtcttgcgggtttgtgcattgacttctgacaaaaaaaaagagtcgttggaggcatcatgttgatttgtccacacctttgctggcaacaatttccagcgttggttctcttgccttgctcgctggcatctggccatttgcatgatgtatccatctcccaagtccttccatgtatccacttgtctttacagtctctcgactatatatgcattgtcggtctacctcctgtagataaagaaagccctggagctgataaaccttgcatctcctcattgagcttgttgtcatatattgtagataagacatgggtcaagcacttggtttgattcaagtggatcaatcgacagtagccatcaaggaatcttttggaaagtttgatgagatcctagggcctgggtgccacttcttgccatggtgcatagggaagcaaattgctgggtacctttcactgcgtgttcagcagcttgatgtccgctgcgaaacaaagacaaaggataatgtctttgtcaatgttgtggcatctgtgcaataccgtgcccttgcggacaaggcgtctgatgccttttacaggcttactaacaccagggagcagatccagtcatatgtctttgatgtcatcagggctagtgttcctaagatgaacttggatgatgcatttgagcagaagaatgatattgctaaagcggtggaagatgaacttgaaaaggcaatgtcaatgtatggatatgagattgtgcagactctgattgttgatattgagcctgatgagcatgtgaagagagccatgaatgagatcaatgcagctgctaggctgaggctggctgccaatgagaaagctgaagcagagaagatcctgcagatcaagagagctgaaggtgatgcagaatccaagtacttggccggtatgggtattgcaaggcagcgccaggctatagtggatgggctgagagacagcgttctcgccttctctgagaatgtccctgggacctccgccaaggatgtcatggacatggttctggtgacccagtattttgacaccatgaaagagattggggcatcttccaagtcctcttcggtcttcatcccgcatggacccggcgccgtgaaggacatcgctgcacagataagggacggacagctccaggccaggatgctgtgagagagcactacatgctttgaatattcccatcagtaaagaagttcaagagccactacaatatctagttatttgagtaaaagttaggcatatggtagcaatgtgagtactcgcacttcagtacagcttgtttcattctctgtgtcacgtatgtttattatctagatggatgctatgtaggactgcatggattgtgtcaggaaaggataaagacctgtttgttactgtaagcttttgtgctgccctggtgttctcttgtggtgaatgagcaaatatcatgtctattttctgagcccagattaagcgctggaaattatgtgagcttattcattatctgtgtgattcctgatgctagcgcacataaaatgcttgatgaaattcgatgggttgcatagcttgcatttgcagtactccatttcaaccaagtatatatgcaaaaaagaaaaaagaaaaa

SEQ ID NO: 3752 - DNA, 1543 bp, Phaseolus coccineus
tcaaaatattcttgtttatctttaattcaaaaatagataaacttttattattttaatatttgttctctacttaattttgtattattaaaatataattattttccttttcaaaattgtttctcttttcatattggagaaatattaatatttagttttttcaataatatatttctcttttcttaaaaaattataaaaagatgtatattatataaagtgtgcattgagctgtgtgctttgcactttgcatctacttgctgtggatttattatacattcgtgagtttctcagcctgaaagaattgaaggatgggtcaagcattcggttgctatcaagttgatcagtcaaatgtggccatcaaggagcattttggaaaattttctgatgttctagaacctggatgtcattgccttccttggtgtcttggttatcagatcgctggtggtttgtcactgcgtgtgcaacagcttgatgttcgatgtgagacgaaaaccaaggataacgtctttgtcactgtcgttgcgtctgtgcaataccgagctgttgctgataaagcatctgatgcattctataggcttaccaacacaagggagcagatccaatcgtatgtttttgatgttatcagggccagtgtaccaaaattggagttggattctgtctttgagcagaagaatgatatagcaaagtctgtagaggaggagcttgagaaggcaatgtcaacttatggatatgagatagtccagaccctcattgttgatattgagcccgatgttaatgtcaagagagcaatgaacgagattaatgcagctgctagattaaggttggctgcaaatgagaaggctgaagcagaaaaaattctgcagatcaagaaagcagagggagaagcagaatccaagtatctgtcaggacttggtatagctcgccaacgtcaggccattgtagatggactgagggacagtgtgcttgccttctccgagaacgtgcccggaacatcagctaaagatgtcatggacatggtgctggtgactcaatactttgacaccatgaaagagataggggcatcttcgaagtcatcgtcggtgttcataccacacggccctggcgccgtcagggacatcgccgtgcagatccgggatggtcttcttcaggctagtgcttcacacacaaattaagcttcattggagttgtaaataacatagtatgtgtctcttttttttgtttgaacttagaatgtctgcatcctttcctctttctatattgcatggttcatagccagtgcctatttttacatctgaagtactgatgtgcagttttttcctttgatacttgtgtggaggatagttttgatgtcaagctgtttgtcaattatattgttggaggatatgttatctaagaattactttccaaaagatgtgttcttcttgagttctatcttgtaagttgtaaaatgaatgtttaaaattgtacttctctatattttctattttcattgcacattgatttcacctccctttgtttcttgagagggtaatttatatctttaaag

SEQ ID NO: 3753 - DNA, 1587 bp, Castanea mollissima
agcccttgttcttttggtggatattgaaacaaaggcaagttagattcctgatattattctctttcacctttctcctttcctattcccaaggaacaaatcagatttagctcattaaaaccataacttaaaaaataataattcaaattgtttgctttctatttatattgaaagaagtggttcaataactctttaactccattcaattctctctctctctctctctctctctctctgtgtctatctctgtgtgagctcagctcctatatatatatccagaattgagaatcgtaaaaattgagtgtgacacatcaaaattcacagctcttgtgaatatctatatctctctgtgtcatcttccttgttcctttcctgttttctctttaagaatttaagcatgggtcaagcattcggttgtcttcaggtggaccaatcaaatgtgattatcagggaacattttggaaagttcgatgatgtgctggagccagggtgtcactgcctgccttggtgtcttggataccaggtggctggtggactctcattgcgtgtgcaacaacttgatgttcgatgtgaaacaaaaacaaaggacaatgtctttgtcactgtggttgcatctgttcaatatcgtgctgtggctgacaaagcatctgatgctttctataggctcaccaataccagggagcagatccaatcctatgtgtttgatgttatcagggcaagtgtgccaaaattgaacttggatgctgtctttgagcagaagaatgacatagcaaaagctgtggaagacgagctggaaaaggccatgtccacttatgggtatgaaatcgtccaaacactaattgtggatattgagcctgatccccatgtgaaaagagcaatgaacgagataaatgcagctgctagaatgagggtggcagcaaatgacaaggcagaggcagacaaaatcttgcagatcaagaaagctgagggagaagcagaatcaaagtacttgtcagggcttggtatagctcgccagcgccaggccattgttgatgggctgagggacagtgtacttgccttctctgagaatgtgcctggaacaactgccaaggatgtcatggacatggtgctggttacccaatactttgacacaatgaaggagatcggggcatcctcaaagtcctcatctgtgttcatcccacatgggccaggagcagtcagagacgttgcttcacagatccgagagggtcttcttcaagctcagtctctcaagagttgaagacaaatataagcttggcttgggattttgcctacgaactccatatcaacaaatataagcttggcttgtgattttatacctacgaagagtacactaatataactttgatgggttaactggatgcgtgttttgctagatttgtattttactcctgcttatagcaaaaccttttataatgcttatgttttaaatttgtcctctttgataacacatcattgaggaggtggtgtgtaattatgttaaagtaagaaagctacaatttaaatggtagaaaccaacaatatccttcaaccattaacataattacacaccacctcctcaatgatgtgtta

SEQ ID NO: 3754 - DNA, 1275 bp, Gossypium hirsutum
cagcgtagtattttattcaaactttttggggctcttcaattccgatttctcaccttcttttaggtatttcaaagaaaatggggcaggctcttgggtgtattcaagtggagcagtcaactgtagctataacagaagcatttgggaagtttgatgatgtgcttcagcctggttgtcattgtttgccgtggtgtttcgggaaacaggcagccggtactctctccttgcgtgtgcagcaactggatgttcgatgtgaaacaaaaaccaaggataacgtgtttgttaacgtggttgcttcaattcaataccgagccttagctgaaaaggcacaagatgctttctataaactcagcaacactagagcccagattcaatcctatgtctttgatgttattagggcaagtgttccgaagttggagctggatgcagtatttgaacagaagaatgatatagcgagagctgtggaagaggaacttgaaaaggccatgtcacattatgggtacgagattgttcagactcttattgtggatattgaaccagatgagcatgtgaagagggcaatgaatgagattaatgcagcggcaagaatgagggtggctgccaatgagaaagctgaagcagagaagatattgcagatcaagagagcagaaggagatgccgagtcaaagtatctggctgggcttggtgtagctcggcagcgacaggctattgtagatggacttagagacagtgtgctggccttctctgagaatgtacctggtacatcatcaaaggatgtcatggacatggttcttgtgacacagtacttcgacacaatgaaggagatcggtgcatcgtcaaaatccaactctgttttcatcccacatgggccaggtgctgtaagagacattgcttctcaaatcagggatggtcttcttcaagcaagccaaaacaactgagtaccctcaagtgttgcgtagtagattgggcaacccagcatagtattgtttagtcattctactcgagaacaatggccttcttgatatgcatttgagtgataatccgagtttggcaaaacggttgttatacgtcttaatagctcaaggttttaaggttcagatttcctttataaattaggttattatatattgtttgtgaaaaaataatgatagtattagcactttattattgtacctaaagaaaatgtgacccggtttatgaatttgtataaaatgtttttatggctttgtacctaaagatgtgatacaatttgagatatgatcaacaaatcaacaaaat

SEQ ID NO: 3755 - DNA, 1028 bp, Eucalyptus grandis
atgggaaatctgttttgctgcgtccaagttgatcaatccacggtagctatcaaagagagatttggcaagttcgatgaggtgcttcaaccaggatgccatttccttccctggattagtggaagccggctagtggggcatctctcacttcgagtacagcagttggatgtgcgatgcgaaaccaagacaaaagacaatgtctttgtcaatgtcgtcgcatctgtgcaatattgtgctcttgcaaatcaggcaagcgatgccttttacaaacttagcaacacaaagggtcaaattcaagcctatgtgtttgacgtgataagagcaagtgttccaagactccttttggatgatgtttttgagcagaaaaatgaaatagccaaagcggttgatgttgaactcgagaaggctatgtctacatatgggtatgagattgtgcaaacgctgattattgacattgaaccagatgtgtatgtaaagcgagctatgaatgagattaatgctgctgcaagactaagggtagcagccaacgagaaggctgaagcagagaagattctgcaaatcaagagagctgaaggtgaggctgagtcgaagtatcttgctgggcttggtattgcccgccagcgtcaggcgattgtggatggtttgagagatagcgtactgggcttttcagaaaatgttcccgggaccaacgccaaggatgtcatggacatggttcttgtcactcagtactttgacaccatgaaggaaatcggtgctgcatctaaatcctctgccgtcttcattccccatggtcctggtgccgttcgtgatgttgcctctcagattcgtgagggacttcttcaagcttcctccgtcagctagttacacgtcagagtctactcgaaataaggatgaagcccaaataaggaaggggagaagcttttgttggctttctgtgtaaatgtttccgcgtgcatttgctgatgatgacttctgaatatctgttttgtttgagcattcggagtgatttaagcactgagtacatgaatctt

SEQ ID NO: 3756 - DNA, 1580 bp, Setaria italica
cccagttccacccaggacagccatcgtgtcacctcctcccccgccgagcagggtcgggccacccagccagcggcaggcagcccacgggaactggaaacttggagcaattccgtcccaaatttccttgccatccatactccatagcaatcctcttccaatcgcccttcccctcgcagacgcggcagcgattccgccataaataccggtcgatcgagggagaaagagagaaggcaatcgacggaggagcgcgcggaggaaacgaggccaagcccttcgtcagttatcgcctgcgcctggggttcatccggaggaagaagataagacatgggtcaagcacttggattgattcaagtggatcaatcaaccgtagccatcaaggaatcttttggaaagtttgatgagatcctagggcctgggtgccacttcttgccatggtgcataggcaagcagattgctgggtatctttcactgcgtgttcagcagcttgatgtccgctgcgaaacaaagacaaaggataatgtcttcgtcaatgttgtggcatctgtgcaataccgtgcccttgctgacaaggcctctgatgccttttacaggcttactaacaccagggagcagatccagtcatatgtctttgatgtcatcagggctagtgttcctaagatgaacttggatgatacatttgagcagaagaatgaaatcgctaaagctgtggaagatgaacttgaaaaggcaatgtccatgtatggatatgagatcgtgcagaccctgattgttgatattgagcctgatgagcatgtgaagagagccatgaatgagatcaatgcagctgctagactaagggtggctgccaacgagaaagctgaagcggagaagatcctgcagatcaagagagccgaaggtgatgcagaatccaagtacttggccggtctaggtatcgcaaggcagcgccaggctatagtggatgggctgagagacagcgtcctcgccttctctgagaatgtccctgggacctctgcaaaggacgtcatggacatggttctggtgacccagtacttcgacaccatgaaggagatcggggcctcttccaagtcctcttctgtcttcatccctcatggacctggtgccgtcaaggacatcgcggcacaaataagggacgggtcgcttcaggccaagttggtgtgagagagcatcgaaaagcgcctttgacattcgcatcagtaaagaagttcagagccactacaattctacatatcttgtgaattgagtaaaaattagggataaggtagtaatgtgatgagtacttgcacttcattacagcttttgtttattctgtctgctacgtgtgtttattatctagagggaatataggattgcatggattgtgccagtaaaggataagtgcctgttgctgtaaaaattcgtcatgtcatcgtactatttggaactatctaagctggcgaggctgaggaaacgccttcatcaagcttttttgtgctaccctgatgctctgttgtggttaatgagggaatgtcatgttcattttctcacagattaagcagtggaaattatatcatctttgtgct

SEQ ID NO: 3757 - DNA, 1470 bp, Gossypium raimondii
cagagaaaacgagtccgtagactaaacgtctccaattccttttccattgtttcctagcagattcttcttatacgccgtcgtttcctggaaattgcataatcttaattatattactatataaaccatatcttttggcagcagaataacagcacactttgtataaaaaacaaaacagcatactgtattttactcaaactttttggtactcttcaattccgatttctcaccttcttttagaaaatggggcaggctcttgggtgtattcaagtggagcagtcaactgtagctataacagaagcatttgggaagtttgatgatgtgcttcagcctggttgtcattgtttgccgtggtgtttcgggaaacaggcagccggtactctctccttgcgtgtgcagcaactggatgttcgatgtgaaacaaaaaccaaggataacgtgtttgttaacgtggttgcttcaattcaataccgagccttagctgaaaaggcacaagatgctttctataaactcagcaacactagagcccagattcaatcctatgtctttgatgttattagggcaagtgttccgaagttggagctggatgcagtatttgaacagaagaatgatatagcgagagctgtggaagaggaacttgaaaaggccatgtcacattatgggtacgagattgttcagactcttattgtggatattgaaccagatgagcatgtgaagagggcaatgaatgagattaatgcagcggcaagaatgagggtggctgccaatgagaaagctgaagcagagaagatattgcagatcaagagagcagaaggagatgccgagtcaaagtatctggctgggcttggtgtagctcggcagcgacaggctattgtagatggacttagagacagtgtgctggccttctctgagaatgtacctggtacatcatcaaaggatgtcatggacatggttcttgtgacacagtacttcgacacaatgaaggagatcggtgcatcgtcaaaatccaactctgttttcatcccacatgggccaggtgctgtaagagacattgcttctcaaatcagggatggtcttcttcaagcaagccaaaacaactgagtaccctcaagtgttgcttagtagtttgggcaacccagcatagtattgtttagtcattctactcaagaacaatggccttcttgatatgcatttgagtgataatccgagtttggcaaaacggttgttatacgtcttaatagctcaaggttttaaggttcagatttcctttataatttaggcttattatatattgtttgtgaaaaaataatgatagtattagcactttattattgtacctaaagaaaatgtgacccggtttatgaatttgtataaaatgtttttatggctttgtacctaaagatgtgatacaatttgagatatgatcaacaaatcaacaaaatgctaaatgccaattgccagggtgttaattca

SEQ ID NO: 3758 - DNA, 1244 bp, Ipomoea nil
ggtggtatggtattctaattcctacccacgtataaatactctgtaaattctaattgtaccctactttaccgccaggaaagttgccggaaatttctaactccctcgttgctgtcttttcttcgaaggtttgaacaatgggtcaatcacttggatgtcttcaagtagatcagtccactgtggctgtgatggagcactttggcaaatttgatgatgtgttggagcctgggtgtcattgtgttccttggtgtttgggatatcaatctgctggtactctttctctgcgtgtgcaacagattgatgttcgttgtgaaacaaaaacaaaggacaatgtctttgtgactgtggttgcatccattcagtaccgagccttggcagaaaaggcttctgatgcattttacaagctttcgaacacaaagtcacagatccaatcatatgtatttgatgtcatacgggccagtgtgcctagattgaatttggatgctgcatttgagcagaagaatgaaatagctaaagcagtggaggatgagctagagaaggctatgtctacctatggatttgagattgtccagaccctcattgtggatatagagcccgatattcatgtaaagagggcaatgaatgagataaatgctgctgcaaggcttagggttgccgcaaatgaaaaggctgaagctgagaagatactgcagatcaagaaagctgagggtgaagcagagtcaaaatacctgtcaggacttggcattgcacgtcagcgccaagcgattgtggatgggctaagagacagtgtccttgcattctcagagaatgttcccgggacaacagcaaaagacatcatggacatggttctggtgactcaatatttcgacacaatgaaggagattggctcatcttcaaagtcctcttctgtgtttatcccacatggtccaggtgctgtgaaagacatttcctcacaaattcgggagggtcttcttcaggccagtagtattaaaccttagtttgacggggatttgtggtaacttcatatgctactttctacttacagttgttcaaagcttgtggtttgatatatacctgactatgcctttactttcctctttattgtatattcccatggattttaggatttgtgtttttagtctggacgaaaggtaattgctcgagtgcttaatattgaaacttttagttagagtatgccatatgtccatcatccacgtgttaatatgtacacatgcattgtgggatat

SEQ ID NO: 3759 - DNA, 1201 bp, Medicago truncatula
agggtttccaatacttacttctttcgtgtatatataggaatcacttaatcgcttacaccaacttgtcaattaattaaaatttcaatttcaatcaaagttgcagtctttatctctctctctctctagctacaactgaaaggattgaaagatgggtcaagcattaggatgcgttcaagttgatcagtccaatgttgctatcaaagagcactttggaaaattcgctgatgttttggaacctggatgtcattgtctgccttggtgtcttggttaccagattgctggtggattatcgcttcgtgttcagcaacttgatgttaaatgcgagacgaaaactaaggataatgtctttgtgaatgtggttgcatctgtacaataccgtgctgtggctgacaaagcgtctgatgccttttatcggctcaccaacacaagggaacagatccaatcatatgtttttgatgttataagggccagtgtgccgaagttggaattggatgctgtctttgagcagaagaatgatattgcaaaggctgttgaagaggagcttgagaaggcgatgtcaatgtacggatatcagatagtccagactctcattgttgatattgagcctgatgttaatgtcaagagagcaatgaacgagatcaatgcagctgcaagaatgaggttggctgcgaacgagaaggctgaagcagaaaagatattgcagatcaagaaagctgaaggagaagctgagtccaaatatctgtcaggactcggtatagctcgccaacgtcaagcaattgttgacggactgagagacagcgtgcttgcattctcagagaatgttcccggaacaactgctaaagatgtcatggacatggtgttggtgactcaatacttcgacaccatgaaggaaattggtgcatcctcaaaatcgtcatctgtgttcattccacatggtcctggtgctgtcagggacattgctgtgcagattagagatggtcttcttcagggaaatgctgcaaacttataagtgcttattggagttattataaacagcatatattatatagtaatgcttcttatgtttgaatgctttgcatttttatacttatattttagagatgaatataatactctagttttaaagtctgagtggtaatttgcaatttttcagtctttatttgttaatacactactattagaggattattattacttttca

SEQ ID NO: 3760 - DNA, 1439 bp, Pennisetum glaucum
gagcagcgagcagggccaacccagcctgcggcggcagggcagcacacgggaacttgataccggagcaattccgtcccaaatttcccatccattgcaatcctccttccccgtaaagttccccatcgtcgtttccctcgcagacgcggcagcgattccgccataaataccggtcgatcgagggagagagaacgcaatcgacggagcaccgcgtggaggaaacgaggccaagcctttcgtcagcgccgcgtggggatcctccggaggaaagaagatataagacatgggtcaagcacttggattgattcaagtggatcaatcgacagtagccatcaaggaatcttttggaaagtttgatgagatcctagggcccgggtgccactttttgccctggtgcataggaaagcaaattgctgggtatctttcactgcgtgttcagcagctggatgtccgctgcgaaacaaagacaaaggataatgtcttcgtcaatgttgtggcatctgtgcaataccgtgcccttgctgacaaggcgtctgatgccttttacaggcttactaacaccagggagcagatccagtcatatgtctttgatgtcatcagggctagtgttcctaagatgaacttggatgatgcatttgagcagaagaatgaaatcgctaaagctgtggaagatgaacttgaaaaggcaatgtccatgtatggctatgagatcgtgcagaccctgattgttgatattgagcctgatgagcatgtgaagagagccatgaatgagatcaatgcagctgctagactgagggtggctgccaacgagaaagctgaagcggagaagatcctgcaaatcaagagagccgaaggtgatgcagaatccaagtacttggctggtctgggtatcgcaaggcagcgccaggctatagtggatgggctgagagacagtgtgctcgccttctctgagaatgtccctgggacctctgccaaggatgtcatggacatggttctggtgacccagtacttcgacaccatgaaggagatcggggcctcttccaagtcctcttctgttttcatccctcatggacctggtgtcgttaaggacattgcggcacagataagggacggatcgctccaggccaagtttgtgtgagagagcattgggaagcgcctttgacattcgcatcagtaaagaagttcagagctgctacaaattcaacatatcctgtgaattgagtaaaaattagggataaggtagtaatgtgagtacttgcacttcattacagcttttgtttattctgtccgccacgtgtgtttattatctggagggcatataggattttgcctggttcgtgccaggaaatgataaggactgtactgctgttgctgtaaaaattcgtcatgtcatcatactatttggaactatctaagctggcgagcctgcggaaatgccttca

SEQ ID NO: 3761 - DNA, 1515 bp, Cajanus cajan
atccactaattaaatttaaatttataagcaagtgtgttttccacttctcatctacttgcagggggttattgatactaagattcaatacagcgtttctctccgaaaagaattgaaggatgggtcaagcattcggttgttatcaagtagatcagtcaaatgtggctatcaaggagcacttcggaaaattttctgatgttctagaacctggatgtcattgcctgccttggtgttttgggtatcagattgctggtcgtttgtcactgcgtgtgcagcaacttgatgttcgatgtgagacaaaaacaaaggataatgtctttgtcactgtggttgcatctgtgcaatatcgtgctgtgtctgagaaagcttctgatgcattctataggcttaccaacacacgggagcagatccaatcatacgtgtttgatgttatcagggccagtgtaccaaaattggagttggattctgtctttgagcagaaaaatgatatcgcaaaggctgtagaggaggagcttgagaaggccatgtcaacttatggatatgagatagtccagaccctcattgtggatatagagcctgatgttaatgtcaagagagcaatgaacgagattaatgcagctgctagattgaggttggctgcaaatgagaaggctgaagcggaaaaaattctgcagatcaagaaagctgagggagaagcagaatccaaatatctgtcaggactcggtatagctcgccaacgtcaggccattgtggatggactgagggacagtgttcttgcattctctgagaatgtgcccgggacaacagctaaagacgtcatggacatggtgctggtgactcagtactttgacaccatgaaggagataggggcatcttcaaagtcttcatcagtgttcataccacacggtcctggtgcggttaaggacatcgctgtgcagattcgggatggtcttcttcaggcaagcgcgacaaattaagctttcctggggctgtaaataacaaatagtatgtgtcagattttgtcaggaaatgctgtgtgtaaactttgaatgtctgcgtctttactcttatagcagtgtgtttacttttatacctgaagtgctgatgtgcagttttgaattcctgttttattgtctagttgcttgtcaatcatactgttggaggctttgttatataacaattgcttcccgtaagattttctttttttggttcctatcttgtaagttggaagtgaatgtgtaaatttgcagtgctctatgtatacaatttagttcacctctctcttcttggcttcttgaaagtgccccttagtttttcctaatgtatatgcgaaatcatacttattagaaacgtaattagttggaagacagtgaagagtttgttagtagatgcctattagttagttatttgcttactatcgatataagtcgtgttactggactagctgtttttctctctggtgttttgttgactgttgttcagcttctattggcttaatatgatagtgattactggttt

SEQ ID NO: 3762 - DNA, 1239 bp, Oryza sativa
atggagctctcaaaaccccaaagcaaatcaaagctgcaaccgctcacgaatcatctcctctcagtgtttacttcggcgaatttgaattcttcgtcggattctcctctgcctcgatcgaaggtaagacatgggtcagtgtttgggtttagtacagattgatcagtcaactgtagccatcaaagaaaatttcggcaagtttagtgaggttctagagcctgggtgccacttcttaccttggtgcataggacagcaaattgctggttacctctcactgcgtgtgaagcagctggatgtccgctgcgaaacaaagacaaaggacaatgtctttgtcactgttgttgcatctgtgcaataccgtgctcttgctgacaaggcatctgatgccttctacaaactaagcaacaccagggaacaaatccagtcgtatgtctttgatgtcattagagctactgttccaaagctgaacttggatgatgcatttgagcagaagaatgatattgcaaaggctgttgaagatgagcttgaaaaggcaatgtctgcatatgggtatgagattgtgcaaactctgatcattgatattgagcctgatgtccatgtcaagagagcaatgaatgagatcaacgcagctgcaagattgagggtggcagccaatgagaaagccgaagccgagaagatactacagatcaagaaagctgaaggagaggcagagtccaagtacctggctggtgtcggtatcgcgaggcagcgtcaggccatagtggatgggctgagagacagcgtgctcgccttctcggagaatgtccctggaaccactgcaaaggatatcatggacatggttcttgttacccagtactttgacaccatgaaggagattggggcctcctccaagtccacctcagtgttcatcccccatggccccggagcagtcaaggatgtcgcggcgcagataagagatggcctcctccaggccaatgccgaacgcaatgactgaatgatggcttcggttttgcaagcagcatggagttcttcatcactatcctagaaacatatcgtgtgagattaaatgttacagcaatggttaagtggagtatattttaggtctacacgcatgcaaatctctctttaagttgtggatcttatacttgttacctactagatgagtagatggttgttaagactttcatgagttgcgctaaaccatttgtcagacatatattataatactggttggtatatcac

SEQ ID NO: 3763 - DNA, 1276 bp, Glycine max
ttgctgtgaagtgtgaattaaaatatattcaattttgcgtttctctgcctaaaaggattgaaagatgggtcaagcattcggttgctaccaagtcgatcagtcaaatgtggctatcaaggagcattttggaaaatttgatgatgtcctagagcctggatgtcactgcctgccttggtgtcttgggtaccagattgctggtagtctgtcgctgcgagtgcagcaacttgatgttcgatgtgagacgaaaaccaaggacaatgtctttgtcaatgtggttgcatctgtgcaataccgagctgtgtctgagaaagcatctgatgcattctataggcttaccaacactagggagcagatccaatcatatgtttttgatgtcatcagggccagtgtaccaaagttggagttggattctgtctttgagcagaaaaatgatatagcaaaggctgtggaggaggagcttgagaaggccatgtcaacctatggatttgagatagttcagactctcattgttgatatagagcctgatgttaatgtcaagagagcaatgaacgagataaacgcagctgctagattgaggttggctgcaaatgagaaggctgaagctgagaaaatactgcagatcaagaaagcggagggagaagcagaatccaaatatctgtcaggactcggtatcgctcgtcaacgtcaggccattgtggatggactgagggacagcgtgcttgctttctctgagaacgtgcccgggacatcagctaaagatgtcatggacatggtgctggtgactcaatactttgacaccatgaaagagataggagcatcgtcaaggtcctcgtctgtgttcatacctcacggtcctggggcagttaaagacattgccgtgcaaattcgggatggtctccttcaggccactgcctcacagaattaagctttcttggagttgtaaataacaaatagtatgtgtgtcaggtttttttcaggaaatgcttcttttgtttgaacttataaagtctgcatctttactcttcttatatttgatagattcatagcagtgtctattttatgtgtaagtactgatgtgcagttttgaatacttgtttaaggatagtcttaatgtcaagttgcttgtgaatcattaaggaatttgttatgtaagaattacttcccaaaagatgtgtttttcttttagtgtcctatcttgcaagtggatgtgtaaatttgtagttctctatatttactatttgctgcacaatgattctacctctcttggcttcttgaa

SEQ ID NO: 3764 - DNA, 1345 bp, Glycine max
gtaattttctcttttttaaaatagatatactatattttttataaaaaaaatcccaacaatatatacagctttgcactttgcatctacttgctgtgaagtgtgaattaaaatatattcaattttgcgtttctctgcctaaaaggattgaaagatgggtcaagcattcggttgctaccaagtcgatcagtcaaatgtggctatcaaggagcattttggaaaatttgatgatgtcctagagcctggatgtcactgcctgccttggtgtcttgggtaccagattgctggtagtctgtcgctgcgagtgcagcaacttgatgttcgatgtgagacgaaaaccaaggacaatgtctttgtcaatgtggttgcatctgtgcaataccgagctgtgtctgagaaagcatctgatgcattctataggcttaccaacactagggagcagatccaatcatatgtttttgatgtcatcagggccagtgtaccaaagttggagttggattctgtctttgagcagaaaaatgatatagcaaaggctgtggaggaggagcttgagaaggccatgtcaacctatggatttgagatagttcagactctcattgttgatatagagcctgatgttaatgtcaagagagcaatgaacgagataaacgcagctgctagattgaggttggctgcaaatgagaaggctgaagctgagaaaatactgcagatcaagaaagcggagggagaagcagaatccaaatatctgtcaggactcggtatcgctcgtcaacgtcaggccattgtggatggactgagggacagcgtgcttgctttctctgagaacgtgcccgggacatcagctaaagatgtcatggacatggtgctggtgactcaatactttgacaccatgaaagagataggagcatcgtcaaggtcctcgtctgtgttcatacctcacggtcctggggcagttaaagacattgccgtgcaaattcgggatggtctccttcaggccactgcctcacagaattaagctttcttggagttgtaaataacaaatagtatgtgtgtcaggtttttttcaggaaatgcttcttttgtttgaacttataaagtctgcatctttactcttcttatatttgatagattcatagcagtgtctattttatgtgtaagtactgatgtgcagttttgaatacttgtttaaggatagtcttaatgtcaagttgcttgtgaatcattaaggaatttgttatgtaagaattacttcccaaaagatgtgtttttcttttagtgtcctatcttgcaagtggatgtgtaaatttgtagttctctatatttactatttgctgcacaatgattctac

SEQ ID NO: 3765 - DNA, 1508 bp, Panicum virgatum
agtggccccagagaaaccgaggcaccgagcacgcctctcggccagcggcggcacacgggaaccggagacacgagcgattccgtccccaatttccttcgcatccatcgcaatcctcttcccgaaaaccccaatcgcaccccttccctcccagacgcgcagcaattccgccataaatacggttgatcgagggcgggagagagcgcacccgccggagcagcgcgcggaggaacgaggccaaactcttcctcagctttcgtctgcgcctggggggatccttcctccggaggaagaagataagacatgggtcaagcacttggtttgattcaagtggatcaatcgacagtagccatcaaggaatcttttggaaagtttgatgagatcctagggcctgggtgccacttcttgccatggtgcatagggaagcaaattgctgggtacctttcactgcgtgttcagcagcttgatgtccgctgcgaaacaaagacaaaggataatgtctttgtcaatgttgtggcatctgtgcaataccgtgcccttgcggacaaggcgtctgatgccttttacaggcttactaacaccagggagcagatccagtcatatgtctttgatgtcatcagggctagtgttcctaagatgaacttggatgatgcatttgagcagaagaatgatattgctaaagcggtggaagatgaacttgaaaaggcaatgtcaatgtatggatatgagattgtgcagactctgattgttgatattgagcctgatgagcatgtgaagagagccatgaatgagatcaatgcagctgctaggctgaggctggctgccaatgagaaagctgaagcagagaagatcctgcagatcaagagagctgaaggtgatgcagaatccaagtacttggccggtatgggtattgcaaggcagcgccaggctatagtggatgggctgagagacagcgttctcgccttctctgagaatgtccctgggacctccgccaaggatgtcatggacatggttctggtgacccagtattttgacaccatgaaagagattggggcatcttccaagtcctcttcggtcttcatcccgcatggacccggcgccgtgaaggacatcgctgcacagataagggacggacagctccaggccaggatgctgtgagagagcactggaaaaaaatgcatgctttgattattcccatcagtaaagaagttcaagagccactacaatatctagttatttgagtaaaagttaggcatatggtagcaatgtgagtactcgcacttcagtacagcttgtttcattctctgtgtcacgtatgtttattatctagatggatgctatgtaggactgcatggattgtgtcaggaaaggataaagacctgtttgttactgtaagcttttgtgctgccctggtgttctcttgtggtgaatgagcaaatatcatgtctattttctgagcccagattaagcgctggaaattatgtgagcttattcattatctgtgtgattcc

SEQ ID NO: 3766 - DNA, 1239 bp, Nicotiana tabacum
gtcacgcaaaaaccgtttgagggctaccatttttcagaatcatttctgatttcagcatttcttttttcttaaaaaaattatatatagctgtatgtagtctctgtttatcttcttgagcaagaaattgttactctttagcctttccttcttcacgcttttgctcacttcacagatttgaactatgggtcaagcgctcggttgcattcaagtagatcagtcaactgttgctgtgaaagaacacttcggtaagtttgatgaagtgctggagccagggtgtcactgcttgccttggtgtcttgggtatcaggtccctggttatctctcattgcgagtacagcagcttgatgttcgatgtgagacaaaaacaaaggacaatgtttttgtgactgttgtagcatccattcagtacagagcgttagcagaaaatgcagctgatgcattttacaagctctctaacaccaaaggacagatccagtcctatgtttttgatgttataagggccagtgtgccacgattggggttggatgctgcatttgagcagaagaacgaaattgctaaagcggtagaggaagaacttgaaaaggctatgtctgcttatgggtatgagattgtgcagaccctcattgtggatatagagccagatccccatgtcaagagggcaatgaatgagattaatgctgctgcaagactacgtgttgctgcgaatgagaaggccgaagcagagaaaatattgcagatcaagagagctgaaggagaagctgaatccaagtatttatcagggcttggcattgctcgacagcgtcaagccattgtggatggtcttcgagacagtgtgcttgctttctcagagaacgtgcctggaacaacagcgaaagatgtgatggacatggttcttgttactcaatattttgatacgatgaaggagattggagctacttccaagtcatctgctgtgtttattccccatggaccaggtgcggtcaaagacgttgcttctcaaatccgcgagggtcttcttcaggctgaaagtattcagcattagtttaaaaaagacttaaggataattgatagtcatgtgtgatttgttgcctttagttcagtgttgatacggttgctttacgtgtgttcgtgcttatagaatccatagattgatacatgccccctttggttttaccatctggtttataggttgtttatcaactatgctgacaaacgaagttttgcagttgattatattgc

SEQ ID NO: 3767 - DNA, 1248 bp, Trigonella foenum-graecum
ttccaatacttacttctttcgtgtataaatacgaatcactaatagcttgcaccaacttgtgaattaattaacagtttcaatctttatctctctctctctagaactgaaagaattgaaagatgggtcaagcactaggatgcgttcaagttgatcagtccaatgttgctatcaaagagcactttggaaaatttgctgatgttttggaacccggatgccattgtttgccttggtgtcttggttaccagatagctggtggcttatcgcttcgtgtccagcaacttgatgttaaatgcgagacgaaaaccaaggataatgtctttgtgaatgtggttgcatctgtacaataccgcgctgtagctgataaagcgtctgatgcgttttataggctcaccaacacaagggaacagatccaatcatatgtttttgatgttataagggctagtgtaccaaagttggaactcgatgctgtgtttgagcagaagaatgacatagcgaaggctgttgaagaggagcttgagaaggcgatgtcaatgtacggatatcagatagtccagactctcattgttgatattgagcctgatgttaatgtcaagagagcaatgaacgagatcaatgcagctgcgagaatgaggttggctgcgaacgagaaagctgaagcagaaaaaatacttcagatcaagaaagctgagggagaagctgagtccaaatatctgtcagggctcggtatagcccgtcaacgtcaagctatcgtggacggactgagagacagcgtgctcgcgttctctgagaatgtacctgggacaacagctaaggatgtcatggacatggtcttggtgacacagtattttgatacaatgaaggaaattggtgcatcctcaaagtcttcatctgtgttcataccacatggtcctggtgctgtcagagacattgctgtgcagatcagagatggtcttcttcaaggaaatgctgcaaacttataataagtgcttttggaaatgctgcaaacttataagtgcttttggagttattataaatagcatatattatacagtaatgcttcttatgtttgaatgctttgcatttttattcttatattttagagatgaatataagactctagttttaaattctgagtggtaatttgcaaattttcattttttggttgttaatactattgttagaggattggtattacttttcaaaaatatttgcttttgttcctattttataaaagaatgtgtaaattcc

SEQ ID NO: 3768 - DNA, 1279 bp, Juglans hindsii x Juglans regia
  misc_feature (5)..(6): n is a, c, g, or t
  misc_feature (335)..(335): n is a, c, g, or t
  misc_feature (1159)..(1159): n is a, c, g, or t
  misc_feature (1222)..(1222): n is a, c, g, or t
  misc_feature (1239)..(1239): n is a, c, g, or t
ggggnnaagcgagagcgtggaaactgagaaagtaagaaactactctttctctctctctcggccatacgaaacagatccaaaaccatagctcttatttatctctctcggtgatcttcaagatcaaagtatgggtcaagcattcggttgcattcaagtggaccagtcaaatgtagttgtcagggaacattttggaaagtttgatgatgtgcttgagccagggtgtcactgcttgccttggtgccttggataccaggttgctggtagcctcacactgcgtgttcaacaacttgacgtacgatgcgagacaaaaactaaggataatgtctttgtcaatnttgtggcatctgttcaataccgtgccattgctgaaaaagcatctgatgctttctatagactcaccaataccagggaacagatccagtcctatgtttttgatgttataagggcaagtgtcccgaagttgaacttggatgctgtgtttgagcagaagaatgacatagcgaaagctgtggaagaggagctggaaaaggctatgtctacttatgggtttgaaatagtccagacccttattgtggatatagagccggatgttcaagtgaagagagcaatgaacgagataaatgcagctgctagattgaggttggcagcaaatgagaaggccgaagccgagaaaatattgcagatcaagaaagctgaaggagaagcagagtcgaagtacttgtcagggcttggcatagctcgccagcgccaggccattgttgatggcctgagggacagtgtacttgccttctctgacaatgtgcctggaacaactcccaaagatgtcatggacatggtgctagtgactcaatactttgacacgatgaaggagattggggcgtcctcaaagtcgtcgtccgttttcatcccacatgggcctggtgcagtgagagacgttgctacacaaattcgagagggtctccttcaggctagttctgtggaaaaaccaatataagctctgatggagtacgtgatgcgtgtttggtatgtaggttttatattgaactgctactcatgagcagatctttattttgctttgtttgttttgggctctctcttctttgatcacataacagataaagtgatggtctcaaagtaacttgatggccgaaggataatntagttcccaataggaactgtgtgtaattattcgaatgcaaagtgattagtgtgtgtaatttcnccccgaatgtctctctngttatgcttgaaccagggaatataaactgagtatttatga

SEQ ID NO: 3769 - DNA, 1212 bp, Brassica rapa
agaacagaacagaacagcagatcagactctcacttacgaaaacaaacacggaaaataacaaatgggtcaagttttaggatgtgtccaagtcgaccagtcgaccgttgcaatcaaagagacgtttggcaaattcgacgacgttctcgagccaggctgtcactgtttgccatggtgcttagggagtcaagtcgctggtcacctttccctgcgtgttcaacagctcgatgttcgctgcgagaccaaaactaaagataatgtgttcgtcaccgttgttgcttcgattcagtaccgcgccttggctgagagtgctcaagatgctttttacaagcttagcaataccaggaaccagattcaagcttatgtctttgatgtgatccgagcaagtgtgcctaagctggatctagactccacctttgaacagaagaacgacattgctaaaaccgttgagagtgagcttgagaaggctatgtcgcattatggatatgagatagttcagacgcttatcgtggatatcgagcctgatgtgcatgtcaagagagctatgaatgagatcaatgctgcttcaaggatgagagaggcagcgagtgagaaagcagaggcagagaagatacttcagatcaagagagctgaaggagaagctgagtccaagtacctttcaggtcttggtattgcccgccagagacaagccattgtggatggtctgagaaacagtgttctggccttctccgagtctgtaccagggacatcttccaaagacgtcatggacatggttctggtcactcagtactttgatactttgaaggagattggtgcgtcttcgaagtcaaactcggtgttcataccgcacggtccaggcgctgttaaggacattgcttcacagataagggatggtcttcttcaggggaacgctgctgctgagtaagaggtcataaaagtacaaagctctatcagggtttagttgtgtttctattgttgaaagtccttatggattccttttaaaattacatatcgttggtttgtttatggcttgtggacgggatcatatgtttggttttagttatgttttgggcttgagagtatttgaagcaatttggtttactaaaaactaaatatcttatttacaaaaatttatatgcgagtgaagcgttatcttttcttctgaaagataacactgattcttatttctattttttgttcaagactttggtttca

SEQ ID NO: 3770 - DNA, 1156 bp, Brassica napus
cagactctcacttacgaaaacaaacacggaaaataacaaatgggtcaagttttaggatgtgtccaagtcgaccagtcgaccgttgcaatcaaagagacgtttggaaaattcgacgacgttctcgagccaggctgtcactgtttgccatggtgcttggggagccaagtcgctggtcacctttccctgcgtgttcaacagctcgatgttcgctgcgagaccaaaactaaagataatgtgttcgtcaccgttgttgcttcgattcagtaccgggccttagctgagagtgctcaggatgctttttacaagcttagcaacaccaggaaccagattcaagcttatgtctttgatgtgatccgagcaagtgtgcctaagctggatctagactccacctttgagcagaagaacgacattgcgaaaaccgttgagagtgagcttgaaaaggctatgtcgcattacgggtatgagatagtccagacgcttatcgtggatatcgagcctgatgtgcacgtcaagagagctatgaatgagatcaatgctgcttcgagaatgagagaggcagctagtgagaaagcagaggcggagaagatacttcagatcaagagagctgaaggagaagctgagtcgaagtacctttcaggtcttggtattgcccgccagagacaagccattgtggatggtctgagaaacagcgtgctggccttctccgaatctgttccagggacgtcttccaaagacgtcatggacatggttctggtcactcagtacttcgacactttgaaggagattggtgcgtcttcgaagtcaaactcggtgttcataccgcacggtccaggcgctgttaaggacattgcttcacagatcagggatggtcttcttcagggaaacgctgctgctgagtaagagatcataaaagtacaaagctttatcagggtttagttgtgtttctattgttgaaagtccttgtggattccttctaaaatacatatcgttggtttgtttatggcttgtggacgggatcatatgtttggttttagttatgttttgggcttgagagtatttgaagcaatttggggttctaaaaactaaatatcttatttacaaaaatttatatatgcgagtgaagctgattatcttttcttctgaaagataagactga

SEQ ID NO: 3771 - DNA, 1084 bp, Brassica napus
gagaacagaacagcagatcagactctcacttacgaaaacaaacacggtttggaaaataacaaatgggtcaagttttaggatgtgtccaagtcgaccagtcgaccgttgcaatcaaagagacgtttggcaaattcgacgacgttctcgagccaggttgtcactgtttgccatggtgcctagggagtcaagtcgctggtcacctttccctgcgtgttcaacagctcgatgttcgctgcgagaccaaaactaaagataatgtttttgtcaccgttgttgcttcgattcaataccgtgctttagctgagagtgctcaggatgctttttacaagctcagcaacaccaggaaccagattcaagcttatgtctttgatgtgatccgagcaagtgtgcctaagctggatctagactccacctttgagcagaagaacgacattgcgaaaaccgttgagagtgagcttgagaaggctatgtcgcattacggatatgagatagttcagacgcttattgtggatatcgagcctgatgtgcatgtcaagagggctatgaatgagatcaatgctgcttcaaggatgagagaggcagcgagtgagaaagcagaggcggagaagatacttcagatcaagagagctgaaggagaagctgagtccaagtacctttcaggtcttggtatagcacgtcagagacaagccattgtggatggtctgagaaacagcgtgctggctttctctgagtctgttccagggacatcttccaaggacgtcatggacatggttctggtcactcagtactttgacactttgaaggagattggcgcgtcttcgaagtcaaactcggtgttcataccgcacggtccaggcgctgttaaggacattgcttcacagataagggatggtcttcttcagggaaacgctgctgctgagtaagaagagatcataaaagtacaaagctttcttcagggtttagttgtgtttctattgttgaaagtccttatggattccttttaaaattacatatcgttggtttgtttatggcttgtggacgggatcatatgtttggttttagttatgttttgggcttgagagta

SEQ ID NO: 3772 - DNA, 1072 bp, Brassica napus
ggagaacagagcagaacagcagatcagactctcacttacgaaaacaaacccggaaaataacaaatgggtcaagttttaggatgtgtccaagtcgaccagtcgaccgttgcaatcaaagagacgtttggcaaattcgacgacgttctcgagccaggctgtcactgtttgccatggtgcttagggagtcaagtcgctggtcacctttccctgcgtgttcaacagctcgatgttcgctgcgagaccaaaactaaggataatgtgttcgtcaccgttgttgcttcgattcagtaccgcgccttggctgagagtgctcaagatgctttttacaagcttagcaataccaggaaccagattcaagcttatgtctttgatgtgatccgagcaagtgtgcctaagctggatctagactccacctttgaacagaagaacgacattgctaaaaccgttgagagtgagcttgagaaggctatgtcgcattatggatatgagatagttcagacgcttatcgtggatatcgagcctgatgtgcatgtcaagagagctatgaatgagatcaatgctgcttcaaggatgagagaggcagcgagtgagaaagcagaggcagagaagatacttcagatcaagagagctgaaggagaagctgagtccaagtacctttcaggtcttggtattgcccgccagagacaagccattgtggatggtctgagaaacagtgttctggctttctctgagtctgttccagggacatcttccaaggacgtcatggacatggttctggtcactcagtactttgatactttgaaggagattggtgcgtcttcgaagtcaaattcggtgttcataccgcacggtccaggcgctgttaaggacattgcttcacagataagggatggtcttcttcaggggaacgctgctgctgagtaagaggtcataaaagtacaaagctttcttcagggtttagttgtgtttctagtgttgaaagtccttatggattccttttaaaattacatatcgttggtttgtttatggcttgtggacgggatcatatgtttggttttagttatgttttggg

SEQ ID NO: 3773 - DNA, 1055 bp, Eucalyptus grandis
tgtgaagataccatgggcaatctgttttgctgtgtccaagttgatcaatctacggtagctatcaaggagagatttggcaagtttgatgatgtacttcaaccaggatgccattgccttccctggattcttggaagccagctagcggggcatctctcacttcgagtgcagcagttggatgtgcgatgtgaaactaagacaaaagataatgtctttgtcaatgttgttgcatctgtgcaatatcgtgctcttgcaaatcaggcaagtgatgccttttacaaacttagcaacaccgagggtcaaattcaagcctatgtgtttgacgtgataagagcaagtgttccgagactcaatttggatgatgtgtttaagcagaaaaatgaaattgccaaagcagttgaagacgaagttgagaaggccatgtctacatatgggtatgagattgtgcaaacactgattgttgacatcgaaccagatgggcatgtaaagcgagctatgaatgagattaatgctgctgcaagactaaggctagcagctaatgagaaggctgaagcagggaagattctccaaatcaagagagctgaaggtgaggctgaatcaaggtatcttgccgggcttggtattgcccgccagcgtcaggcgattgtggatggattgagagatagtgtactgggcttctcagaaaacgtgcctgggaccagtgccaaggatgtcatggacctggttctcatcacccagtactttgacaccatgaaggaaatcggtgctgcgtctaaatcctctgctgtgttcattccccatggtcctggtagcattcgcgatgttgcctctcagattcgcgagggacttcttcacgcttcctccgtcagctagttggacaacggagaccactggaaaggaggatgaagcccgaaaaaggaaggggagaagctttgtttggctttctatgtaaatgttttcacgtgcatttgctgatggtgtcttctgaatgtcccatttcgtttgacctttcggagttgtgattcaagcaccgtgtttgtgaatcttgaacgtgttct

SEQ ID NO: 3774 - DNA, 1341 bp, Quercus alba
ccgtttttcaattctctctgtgtctctgtctgtgagctctgctcctctatatatatatccagaattgggaatcgtaataaattaagtgtggcacatcaaaattcacagctcttgtgaatatctatatctctgtgtcatcttcagttttcgctgctttcctgttttctctgcaagaatttaagtatgggtcaagcattcggttgtctccaggtggaccagtcaaatgtgattatcagggaacattttggaaagttcgatgatgtgctggagccagggtgtcactgcctgccatggtgtcttggataccaggtggctggtggactctcattgcgtgtgcaacaacttgatgttcgatgtgaaacaaaaacgaaggacaatgtctttgtcactgtggttgcatctgttcaatatcgtgctgtggctgacaaagcatctgatgctttctataggctcaccaataccagggagcagatccaatcctatgtgtttgatgttatcagggcaagtgtgccgaaattgaacttggatgctgtctttgagcagaagaatgacatagcaaaatctgtggaagacgagctggaaaaggccatgtccacttatgggtatgaaatcgtccaaacactaattgtagatattgagcctgatccccatgtgaaaagagcaatgaacgagataaatgcagctgctagaatgagggtggcagcaaatgacaaggcagaggcagacaaaatcttgcagatcaagaaagctgagggagaagcagaatcaaagtacttgtcagggcttggtattgctcgccagcgccaggccattgttgatgggctgagggacagtgtacttgccttctctgagaacgtgcctggaacaactgccaaggatgtcatggacatggtgctggttacccagtactttgacacaatgaaggagattggggcatcctcaaagtcctcctctgtgttcatcccacatgggccaggagcagtcagagacgttgcttcacagatccgagagggtcttcttcaagctcagtctctcaagagttgaagacaaatataagcttggcttggattttgcctacgaactccatatcaacaaatttaagcttggctcgtgattttttacctacgatgagtacactaatataagtttgttggattaacttgatgtgtgttttgctggatttgtattttactgctacttatagcaagaccttttataatgcttatgttttaaatttgtcctctttgataacacatcattgaggaggtggtgtataattatgttaatggttgaaggatattgttggtttctactatttaaattgtagctttcttactataa

SEQ ID NO: 3775 - DNA, 1315 bp, Quercus alba
tctctctgtgtctctgtctgtgagctctgctcctctatatatatatatatccagaattgggaatcgtaataaattaagtgtggcacatcaaaattcacagctcttgtgaatatctatatctctgtgtcatcttcagttttcgctgctttcctgttttctctgcaagataatttaagtatgggtcaagcattcggttgtctccaggtggaccagtcaaatgtgattatcagggaacattttggaaagttcgatgatgtgctggagccagggtgtcactgcctgccatggtgtcttggataccaggtggctggtggactctcattgcgtgtgcaacaacttgatgttcgatgtgaaacaaaaacgaaggacaatgtctttgtcactgtggttgcatctgttcaatatcgtgctgtggctgacaaagcatctgatgctttctataggctcaccaataccagggagcagatccaatcctatgtgtttgatgttatcagggcaagtgtgccgaaattgaacttggatgctgtctttgagcagaagaatgacatagcaaaatctgtggaagacgagctggaaaaggccatgtccacttatgggtatgaaatcgtccaaacactaattgtagatattgagcctgatccccatgtgaaaagagcaatgaacgagataaatgcagctgctagaatgagggtggcagcaaatgacaaggcagaggcagacaaaatcttgcagatcaagaaagctgagggagaagcagaatcaaagtacttgtcagggcttggtattgctcgccagcgccaggccattgttgatgggctgagggacagtgtacttgccttctctgagaacgtgcctggaacaactgccaaggatgtcatggacatggtgctggttacccagtactttgacacaatgaaggagattggggcatcctcaaagtcctcctctgtgttcatcccacatgggccaggagcagtcagagacgttgcttcacagatccgagagggtcttcttcaagctcagtctctcaagagttgaagacaaatataagcttggcttggattttgcctacgaactccatatcaacaaatttaagcttggctcgtgattttttacctacgatgagtacactaatataagtttgttggattaacttgatgtgtgttttgctggatttgtattttactgctacttatagcaagaccttttataatgcttatgttttaaatttgtcctctttgataacacatcattgaggaggtggtgtataattatgttaatggttgaaggatattgttggtttctactatttaaa

SEQ ID NO: 3776 - DNA, 1344 bp, Quercus alba
cattttcactctctctccacctacctctgcaactttttgtgaggagcattaaaatttagatatgggtaacctattttgttgtgtgaaaatcaaccagtccacagttgctgtaagggagagatttggaaagtatgatgatatacttgagccaggatgccattgtgtaccttgggttactggaagtaagcttgctggccttgtctcacttcggttgcagcagttggatgttcgctgtgagacaaagacaaaggacaatgtatttgttaatgttgttgcatctgttcaataccgtgttctggctaataaggcttatgatgctttctacaaactcagcaatcctagaacccaaatccaagcctatgtatttgatgtgatcagaggtgcagttccaaagctagagttagatgatgtctttgagcaaaaaaatggcattgcgaaagctgttgaggatgagcttgaaaaggctatgtctgcttacggatatgagattgttcagacgctcattgttgatatagaaccagatgagcacgtgaagcgatccatgaatgaaattaatgctgctgcaaggatgaggttagcaactaacgagaaagcagaagcagagaaaattatacagattaagcgagcagagggtgaggccgaatccaagtatctctcaggactgggaattgcccggcaacgccaggcaattgtggatggtcttagagagagtgtcatcggcttctcagtcaatgtgccagggactactgctaaggatgtgttggacatggtccttatcacacagtactttgacaccatgaaggaaattggtgcttcctctaaatcctcagcagtgttcatcccacatggaccaggtaccgtgcatgatgttgccacacagattcgagatgggctgcttcaggcctctcaccaacaatcataaaagtttcatggaggttttcctcagggatctgaagcaggtattgtgcgtgtaagtgtgctctcttcagcgctttctactctgtagttggttgtgtttaaaccttaaagcattattcaggagtttgctttgttggtaatgcaaatttgaaatttcacaagtttaagcttgtaattaaaagttctatgttattccgttatctgatgtatattaactgattatgctaagaaatatacatggtggagcaattttagaagtagccagcagcattcttgattattgaagatttgattttttacttctaaaacaagttgcaggatgaaggatagggctaaatgatgcaactgattcgtttctctgcaacaaggaaaatgcaccaatagttatagaggaagagaacctttcagcaggttggggtagttaat

SEQ ID NO: 3777 - DNA, 1023 bp, Platanus occidentalis
aaaataaaaaaaaaaaaaatctccaaataccaactgcgtacaaaccacggtgatgcaatagccaggaagttttgcgattacagtagcccacaggaaacaaagaaagtgtgaaggaaattgtattctgagaccaggaacggagagcatgggtaacctttgttgctgtatacaagtcgaccaatccacagtggctatcaaggagagattcggaaaatttgatgaaatacttgagccaggatgccattgtttgccttggttccttgggagtcagctagctggacatctcacacttaggttgcagcagttggatgtgcggtgcgagaccaagacaaaggacaatgtatttgtcaatgttgttgcatctattcagtaccgtgccttggctaataaggcaagtgatgctttttataaactaagcaatacaagaacccaaatccaggcctatgtttttgacgttataagagccagtgttccaaagctcaatctggatgatgtttttgagcagaagaatgaaattgcaaaagctgtggaagatgagcttgaaaaggctatgtctgcttatgggtatgagattgtacagacattaattgttgacatagagcctgatgagcatgtgaaacgggcaatgaatgaaatcaatgctgctgcaaggatgagggtggcagctaatgagaaggcagaagctgagaaaattctacagattaagcgagctgagggtgaggctgagtctaagtatctgtcagggttgggaattgcccgtcagcgccaggcgattgtggatggtctgagagatagtgtgttgggtttctccgtcaatgttccagggaccactgcaaaggacgttatggacatggttcttgtcacacagtactttgacaccatgaaggaaattggtgctgcctctaaatcctctgccgtttttcatcccccatggacctggtgctgttcgtgatgttgccacccagattcgagatggactacttcaggcatcctctcatcagtaatacgtacttttccaaggtt

SEQ ID NO: 3778 - DNA, 1238 bp, Papaver somniferum
cttcgcctcaagaagcattttcattaccggttcaagtaatagtattagcagaatctggattggaaaaaatgggacaagcactatgctgtgttcaagtggatcagtcaactgtagccattaaagaaacatttgggaaatttgatgagattttgcaacctggatgtcatttcttgccatggtgtctcggaagtcaaatttctggttatctttcattgcgtgttcagcaacttgatgttcgttgtgaaactaaaactaaggacaatgtttttgtgactgttgttgcatccattcagtaccgtgccttggctgatagtgcatctgatgctttttataagctcagcaacaccagggaacagatccaagcgtatgtttttgatgttatccgggcaagcgtgccgaagttggaattggatgcaacctttgagcagaaaaatgacatagcacgagctgttgaagaagagcttgcaaaggccatgtcaaattatggttatgagatagttcagactcttattgtggatattgagccagatgtgcatgtgaagagggcaatgaacgagataaatgcagctgctagaatgaggttggcagcaaatgaaaaggctgaagcagagaagattttacagatcaagcgagccgaaggagaggcagaatcgaagtacttatctggtttaggtatagctcgacaacgccaggccattgtggatggattgagagacagcgtacttgctttctctgcgaatgtctctggtacgactcccaaggatgtaatggacatggttctggttacacagtattttgacacaatgaaggagattggggcatcatcaaaatcctcagctgttttcattccacatggacctggcgccgtgagggatgttgcctctcagatcagggatggactcttgcaaggtagctccagcctgatctagtgcgaatgttcaatgttgcacagtatctataaaaaaaaaaccttgtttgtcaggttttgttattactatgatgtgaataattagttttcaaggatgcactagtatttggttcagtttgctttattttgttgtcgtattttgataaaaatccgcgtgggattgtaagtaatacgtagatggggagaaaaggtcactgttaaagcttgtcgatattttctgctattccatacttctcttggttataactcattttgatattatcggtgaccaatgacacttgaatcaggaaaggagttttgccagccaaaa

SEQ ID NO: 3779 - DNA, 1044 bp, Primula obconica
ttggttgcattcaagtggatcagtccactgtggctattagagaaacttttggaaaatttgataaagtgcttgaacctggctgccacatcatgccttggtgtattggcaggcaaatggctggtctcctttccttgcgtgtgcagcaactagacgttcgttgtgaaacaaagactaaggacaatgtttttgtcactgttgtcgcttctattcaataccgagctttggcggagaaggcttctgatgctttctataagttgagcaacaccaaagagcagatccaagcatacgtctttgatgttatcagggcaagtgttcctaagttggagcttgattcaacctttgagcagaagaacgacatagcaaaagctgtggaaaatgaacttgaaaaggccatgtctcattatggctatgaaattgttcaaaccctcattgtggatatcgagccagatgtgcgtgtgaagacagcaatgaatgagatcaatgcagctgcaagaatgagagtggctgcaactgaaaaggccgaggcagaaaagatactgcaaataaagcgagcggagggagatgccgagtccaagtacttggctgggcttgggatagccagacagcgacaagcgatcgtggatggtctgagggacagcgtgctcgcgttttcgtccaatgttcctgggacatcgtccaaggatgttatggacatgatactaataactcagtactttgatactataaaggagatcggtgcttcttccaaggcttcttctgtgtttattccccatgggcctggggctgttaaagatatcgctactcagatcagggacggtctcttacagggccaggcaatggagcgttgagatatttgtatttgtgaatattttaatatagttttaggttgtggtggtgacgtgaagcgtttacgtgttgtgtttgtattacaattcgagatttctgagtgtttgtatctaaaagttggtttaaactgtttggtctgtgtgcacaaagaaactgctatttgtatcataatcgagttgttacattgcacaattttct

SEQ ID NO: 3780 - DNA, 1054 bp, Eutrema parvulum
ctccttgcgttatttctgatgttctgtttttcatttgcttgattgattcagatacaaaaatgggtcaagctttgggatgtatccaagttgatcagtcgactgtggcaatcaaagagacttttgggaaattcgacgatgttctcgagccaggttgtcactgtttgccatggtgcttgggaagtcaagtagctggtcacctttcattgcgtgttcaacagctcgatgttcgttgcgagacaaaaactaaggataatgtgtttgtcaccgttgttgcttccattcaataccgtgccttagctgagagtgcgcaagatgctttttacaagctcagcaacacgaggaatcagattcaagcttatgtctttgatgtgatccgagcaagtgtacctaagctgaatctagactcaacttttgagcagaaaaacgacattgcaaaaaccgttgagagtgagcttgaaaaggctatgtctcattacgggtatgagatagttcagacgcttattgtggatatcgagccagatgtgcacgtcaagagggcaatgaatgagatcaacgccgcttcgagaatgagagaggcagcgagtgagaaagcagaggcagagaagatactgcagattaagagagccgagggagaagccgaatcgaaatacctttcaggtctgggtatcgcccgtcagagacaagccattgtggatggtctgagaaacagtgtgctcgccttctctgagtctgttccagggacatcttccaaagacgtcatggacatggttctggtcactcagtactttgacacgttgaaggaaattggagcgtcttccaagtcgaactcggtgttcataccgcacggtccaggcgctgttaaggacattgcttcacagatcagggatggtcttcttcagggtaacgctgctgcgtaagagagatctcaaagtacaaagctttcttcaggggtttagcttgtgttgttactagagtttttatctttagcgtttggcttttctattttgtgaagtccttatgattccttaagatacttaatcgtttgtgtatgtta

SEQ ID NO: 3781 - DNA, 1119 bp, Triphysaria pusilla
gaaattccgccattactgacggagatcagaatcactgtcctttttcctcttcaagcggctgcacaaaccctcctcacaaggtctgaaaaatgggtcagttactctgttgtgttcaagtcgatcagtcaacccttgctgtgaaggagcagtttggtaaattcgacaaagttctcgagcctgggtgtcactgcttgccctggtgtttcggatacaagctggctggtaaactatcgcttcgagtgcaacaaatcgatgttcgatgcgaaacaaaaactaaggacaatgtctttgtgactgtggtcgcctccatccaatatcgtgctgtggctgataatgcagccgatgcattttataagctgtctaacacacgggcacaaattcaagcttatgtttttgatgttatcagagccactgtgccaaggttggaattggattctgtttttgaacagaaaaacgatgtagccaaagctgtggaggatgaacttgaaaaggctatgtctgcttatggatttgaaatcgtccagacgctcattgttgacatagaaccagatgttcacgtgaagagagccatgaatgagatcaatgcagctgctaggatgagagtcgctgcgaatgagaaggctgaagcagaaaagattctccaaatcaagaaagccgagggcgaagccgagtccaaatacctgtcaggccttggtatagctcggcagcgtcaagccatcgtcgatgggcttcgtgacagcgtcttagccttctccgagaacgtgcctgggaccacggctaaggatgtgatggacatggttctggtgactcagtatttcgacacgatgaaggaaatcggagcgtcttcaaaatcttcagccatttttgtgccgcatgggcctggggctgtgaaggatgttgcgtcgcagatccgtgaagggcttcttcaggcagagagcgttcataagtagtaaaaggtaagtaatttggttgatgcagttggttaaacctatggtttgtttagttttaacatttaagagttgttttgggagctatcacgtttatttagtagcttgatgagtataactataaataaattagtatctgcatttctgtttatatggaaaaaaaaaaaaaaaa

SEQ ID NO: 3782 - DNA, 1049 bp, Vinca minor
atggggaacctgttttgcttgacgcaagttgatcaatcccaagttgccattaaagagaaatttggcaagtttgaagatatacttgagcctggttgccatttcctcccgtggtgtttgggaagccagattgctggctatctatctctaagggtgcagcaactggatgtacgttgtgagaccaagacaaaggataacgtgtttgtcaatgtggtggcatcaatacaataccgtgccctggctgataaagcaagtgatgctttttacagactcactaatactagagcccaaatccaggcctatgtctttgatgtcatcagagcaagtgttccaaagatgaatctcgatgatgtctttgagcagaagaatgaaattgcgagagcagtggaagatgaacttgaaaaggctatgtctacttatggatatgagattgttcagaccctcatcgtcgatatagaaccagatgagcatgtgaaacgcgctatgaatgaaattaatgcagctgcaaggatgagggttgcagctaatgagaaggcagaagctgagaagataatccagatcaaacgagctgaaggagaagcagagtccaagtacttggcggggcttggtattgccagacagcggcaagcaattgtggatggtctaagggagagtgtgatcgggttctcggtgaatgtcccagggaccacttccaaggatgttatggacatggttctcgtcacccagtattttgataccatgaaggaaattggcgcatcctccaaatcctcagctattttccttccgcatggacctggtgctgttcgcgatgttgctcagcagatacgagatggacttctccaagcaacaacagctcacccccaaccaaatcttctctaaaggatttttctgctatcttgctttctgtttgtctgtttaaaagataattttatttgagtttgttggagactaccgtatagagaaatatctgtgcgtatatatgtgggtgttaagagaatcgtcaaacagtgaaggatttgctagcttcccatgtaaagtactcgttttatggt

SEQ ID NO: 3783 - DNA, 1145 bp, Humulus lupulus
cttagtcatcgacgccttccaaaatcaagtggcaaaccattttgccagcttactataaagatactcttttaatatcgattctttatatctctgtgttcatatcttggaaacttgttgaaagatataatgggcaatctactctgttgtatacaagtcgatcagtcaacggttgccatcaaagaaagatttggcaagtttaatgatgttcttgagccaggatgccattgtctaccatggattttggggtctcaactggctggccatctctctcttcggttgcagcagttagatgttcgttgcgagaccaaaacaaaggataatgtgtttgtcaacgttgttgcttctgtacaataccgtgttatcatcgacaaggctagtgaagcttactacaaacttagcaatccccggacccaaatccaagcctatgtttttgatgtgatcagagctagtgtcccaagctaaacttggatgatgttttgagcagaaaaatggaattgctagagctgtggaggatgagcttgaaaaggctatgtgtgcttacggatatgaaatagttcagacactcattgttgatatcgaaccagatgaacatgtgaaacgatctatgaatgaaatcaacgcagctgcaaggatgaggttggcaactaatgagagagcagaagcagagaaaatcatacagattaagcgagcagagggcgaggctgaatccaagtatctgtctggtgtaggcatagctaggcagcgacaggcgatcgttgatggcctgagagagagcgttgttggtttctccttgaacgtgccgggaaccactgccaaagatgtgttggacatggtccttctaacacagtattttgacaccatgaaagaaataggtgcctcctccaagtcctccacagtgttcatcccccatggaccaggggtcgtacgagatgttgccactcagattcgagatgggctgcttcaggcaacctcatctactcacgaccatttgtaaagaatcgttgtacaatgcccttgtccccaataagttggcttaatatgcctgcttgctaagcttatttagcatgtcaatcatcataggctgcataatggtgagctgaaataggccgaatatatcgtactaaaggaatttatggcttgtttgc

SEQ ID NO: 3784 - DNA, 1095 bp, Olea europaea
gatcgagtaatgtaatcttaccattggatacctctctgaatctcaaaccctagactttctctctgttattgcgaaagatgggtcaagcatttggttgcgttcaagtggatcagtctaccgttgcagtgaaggacattttggcagatttgatgatgtactcgagcctgggtgtcattgcttgccttggtgtctggggtatcagttggcaggttcactatcattgcgtgtacaacagcttgatgtccgttgcgaaaccaaaactaaggacaatgtgtttgtgactgtggttgcttcaattcagtaccgagccttgtcggaaaaagcagctgatgcattctataagctttctaacacaaaggcacagatccaggcatatgttttcgatgtcatcagagcaagtgtcccaagattggatctggattctactttcgaacagaagaatgacatagccaaggctgtggaggatgaacttgcaaaggccatgtctgcctatggatttgagatagtgcagaccctgattgtggacattgaaccagatgcacaggttaagagagccatgaatgagataaattcagctgctaggctcaggctggctgcaaatgagaaggccgaagctgaaaaaatactgcagatcaagagagctgagggagaagctgaatctaaatatttgtcagggcttggcattgctcggcagcgccaggccattgtagatggcctcagggacagtgtgctcgccttctcagcaaatgtgcccggaacaacctccaaagatgtcatggacatggttctcgtcacgcagtattttgatacaatgaaggaaattggagcatcgtcgaagtcttctgccgtgttcatcccacacggacctggtgctgtcaaagatattgctgcacagattcgggagggacttcttcaggctgaaagtgtcaaccagtaaatgcaaagtttagcgtaagagtcgtatgacatagttgtcctcattaaggatgtttcttgtgtgctgattggtttctttatgctacaagtttggaggaaaatcatcatgatacgctggtatctgtatatctcatattaccttactctatgctagtatgg

SEQ ID NO: 3785 - DNA, 1326 bp, Sarracenia psittacina
gtcctgcgataacactcggcttcaaatatccctttcgcactcgtcgtctccgtcctctcttcacgcgtttacggaagtatcgaaggatgggtcaagcattgggttgcgttcaagtggatcagtctacagttgcagttaaggagcagtttggagtttgatgatgtgcttgagcctgggtgtcactgcttgccatggtgtttggggtaccagttagctggggaattatcgttacgtgtgcaacagctagatgttcgctgtgaaacaaaaccaaggataatgtctttgttaatgttgtcgcatccattcaataccgtgccttggcagaaaaagcatctgatgctttctacaagctttccaacaccaaaggacaaatccaagcctatgttttgatgttattagggcaagtgtaccaaagatggacttggattccactttggagcagaagaatgaaattgcaaaagctgtggaggaagaacttgaaaaggctatgtctgcatatgggtatgaaatagtccaaactcttactgtggatattgagcctgatattaatgtgaagagggcaatgaatgagataaatgcagctgctagaatgagggttgctgcaaatgagaaggctgaagcagagaaaatattgcagatcaagcgagccgagggagaggccgagtctaaatacctttcagggctcggtattgctaggcagcgccaagctatcgtggacggactgagggacagcgtgcttgctttttcctccaacgtacccggaacatccgccaaagacgtcatggacatggtgttggtgactcaatacttcgacaccatgaaggagatcggggcatcctcaaagtcctctgcagttttcatcccacatgggcccggtgcagtgagagatgtcgccgcgcagatccgcgagggtcttcttcaggccgacagtgttcagcactagcttgtaagcagatggcattagcttgtgagcaaatgggaagctaaaggttggaccttccaggtttcctttttatagttactgaatttcatgtttgattgctgctgaaatgttgattggtaatcgtcatgttttgcattaattttctctttttttaaaagtggtatataattgtgggatttgaatcctcgtatgtgatgcacatatagttttgtggttgcacagtatggtttgtaaacttggtttttattaggatatgaattaccttgtaactggaaaggatgatggtaattcttatttgaagttttggtttgctgttgccctttgatttcgggaacggggagcctgtgtgggtacaaatttgaatggttttggatctacttaat

SEQ ID NO: 3786 - DNA, 1259 bp, Lotus japonicus
caatctttgcgtctctctctcactgtgcatcgaaagaattgaaagatgggtcaagcattgggatgtgttcaggtggatcagtcaaatgtggctatcaaggagcattttggaaagttttctgagattctggaacctggatgtcattgcttgccttggtgtcttgggtaccagatagctgggggactttcactacgtgtgcagcaacttgatgttcgctgtgagacaaaaaccaaggataatgtttttgtcactgtggttgcgtctgtgcaataccgagctgtggctgacaaagcatctgatgccttctataggctcaccaacacaagggaacagatccaatcatatgtttttgatgttatcagggccagtgtgccaaagttggagttggattctgtctttgagcagaagaatgacattgccaagtctgttgaagaggagctggagaaggctatgtcaacctacggatatgagatagtccagaccctcattgttgatatcgagcctgatgttaatgtcaagagagccatgaacgagatcaacgcagctgccagaatgaggttagctgcaaatgagaaggctgaagctgaaaagattctgcagattaagaaagctgagggagaggcagagtccaagtatctgtcaggactcggtattgctcgccagcgccaggccattgtggatgggctgagggacagtgtgcttgcattttctgagaatgtgcctgggacatcagctaaagatgtcatggacatggtgctggtgactcaatactttgacaccatgaaggagattggggcatcttcaaagtcctcatctgtgttcattccacatggccctggtgcagttagggacattgctgtgcagatccgcgatggtcttcttcagggcaatgctgcacacatttgagatgaaggttttctggaatgtagatagcatatagtatgaaactatgaatgcttgtcaggttttcttaaattctggtgaattgtcgataatagataacagaagtacctctgctgtttaaatgattgcatctttgctcctattatactgtgcagctgaacgcctagttctatatcatgagtgctatagttgctattttgaacgttcctttggattagtcattgttttttggacaaagttattagtcatattatgaaagggttgttattaatatccccaaaatacactgcgttatatgaaaatgtattaattctttgttttccatattatttattcagtgcatacagattctcctc

SEQ ID NO: 3787 - DNA, 1003 bp, Panicum virgatum
gcagaattcaattaatccatatagttgtcaaccatctgttgtggactcttttaccggcaaggcgtatgcacgcaggattgcaggaacaagaagcaacagatagaagacagacattagaatggggaaactactggcagcaatcggcaagttcttctgctttgtacaggtgaaccagtcaacagtaggcatcaaagagagatttgggaaatttgaggaagttctcaatcctggatgccattttatgccatggatcattggaaaccgtgtcaccggtcagctcactctaaggcttaggcagcttgatgtccgctgcgagacaaaaacaaaggataatgtttttgttactgttgttgcatccatccaatatcgagcaatggaagacaaagcaagtgatgcatactacaagctgagcaacccaagagctcaaattcaagcatatgtcttcgatgttataagggcaagtattcctaaactagaactggatgatgcttttgagcaaaagaatgaaatagcaaaagctgtggaggaggagcttgaaaaggcaatgtttgcttatggttatgagattgtgcaaacactcattgttgatatagaaccagatgagaaagttaaaagggctatgaatgaaattaatgctgctgcaagactccgtgtcgcagcaaatgagaaggcagaggcagagaagatagttcagatcaagagggctgagggtgaggccgaagccaagtatctctctggccttggcatagcaaggcagcgtcaagccatagttgatggactaagagatagtgtgcttggctttagcggtaatgtgcctgggacttcagctaaggatgtgatggatttggttctgctcactcaatactttgacaccatgaaagagatcggagcagcatccaaatcttctgctgttttcctcccacatggtcctggtgctgttgcagatattgccggtcagattcgtgatggatttcttcagacatctactcagcaggcaaagtga

SEQ ID NO: 3788 - DNA, 1122 bp, Ipomoea batatas
gccgggggtaccctactttaccgtcaggaaagtagccggaaatttctaactcccgcgttgctgtcgtttctccgaagatttgaacaatgggtcaatcacttggatgtcttcaagtagatcagtccactgtggctgtgatggagcaatttggaaaatttgatgatgtgttggagcctgggtgtcactgtgttccttggtgtttggggtatcaatctgctggtactctttctctgcgtgtgcaacagattgatgttcgttgtgaaacaaaaactaaggacaatgtctttgtgactgtggttgcatccattcagtaccgagccttggcagaaaaggcttctgatgcattttacaagctttcgaacacaaaggcacagatccaatcatatgtatttgatgttatacgggccactgtgcctagattgaacttggatgctgcatttgagcagaagaatgaaatagctaaagcagtggaagatgagctagagaaggctatgtctgcctatggatttgagattgtccagaccctcattgtggatatagagcccgatattcatgtaaaaagggcaatgaatgagataaatgctgctgaaggcttagggttgccgcaaatgaaaaggctgaagctgagaagatactgcagatcaagaaagctgagggggaagcggaatcaaaatacctgtcaggacttggcattgcacgtcagcgccaagcgattgtggatgggctaagagacagtgtccttgcattctcagagaatgttcccaggacaacagcaaaagacatcatggacatggttctggtgactcaatatttcgacacaatgaaggagattggctcatcttcaaagtcctcttctgtgtttatcccacatggtccaggtgctgtgaaagacatttcctcacaaattcgggagggtcttcttcaagccagtagtattaaaccttagtttgacggggatttgtggtaacttcatatgctactttctacttacagttgttcaaagcttgtggtttgccctaggaagatgaacatttatacccgactatgcctttactttcctcgtattgtatattcccttggattttaggatgtgtatttaccctaggaagattagtacttgac

SEQ ID NO: 3789 - DNA, 1001 bp, Raphanus sativus
gggcagaatcagagacgctcacttgcgaaaaaaaaaacacgggaaaaataacaaaatgggtcaagttctaggatgtgtccaagtcgatcagtccactgttgcaatcaaagagacgttcgggaagttcgacgacgttctcgagccaggttgtcactgtttgccgtggtgcatagggagtcaagtcgctggtcacctttccctgcgtgttcaacagctcgatgttcgctgcgagaccaaaactaaagacaatgtgtttgtcaccgtcgttgcctccattcagtaccgtgctttagctgagagtgctcaagatgcgttttacaagcttagcaacaccaggaatcagattcaagcttatgtctttgacgtgatccgagcaagtgtgcctaagctggatctagactcaacctttgagcagaagaacgacattgccaaaaccgttgagagtgagctcgaaaaggctatgtcgcattacgggtatgagatagtccagacgcttattgtggatatcgagcctgatgtgcatgtcaagagagctatgaatgagatcaacgctgcttcgagaatgagagaggcagctagtgagaaagcagaggcagagaagatacttcagatcaagagagccgaaggagaagctgagtccaagtacctttcgggtctcggtatagcacgtcagagacaagccatcgtggatggtctgaggaacagcgtgctggccttctccgagtctgttccagggacgtcttccaaggacgtgatggacatggttcttgtcactcagtactttgatactttgaagggattggtgcgtcttccaagtcgaactcggtgttcataccgcacggtccgggtgctgtcaaggacattgcttcgcagatcagggatggtcttcttcagggaaacgctgctgctgagtgatgatgagtgagtggtgagagattttaataagtacaaaagccttttcttcagggtggtttagttggtgttgctacttatttgttttt

SEQ ID NO: 3790 - DNA, 896 bp, Sarracenia psittacina
ggcaagtttgatgatgttctcgagcctggttgtcatttctaccttggtatctcggaagtcggatcgccggtcatctaacctccgattgcagcagttggatgtccgatgcgagacgaagacaaaggacaacgtgtttgtgaatgttgttgcgtctatacaatacagagccttagctgataaagctagtgatgccttttaccgactcagcaatacgagatcccaaattcaagcctatgtctttgacgtgataagagcaagtgttccgaagctaaacctagacgatgttttcgagcaaaaaacccaattgcaaaagctgtggaagatgagcttgcaaaggctatgtctgcttacggatacgagattgttcagacactcatcgttgatatagaaccagatgagcgtgtgaaaagggccatgaatgaaatcaatgctgccgcaaggttgagggtagcagctaacgagaaagcagaagcagagaaaattgtccagattaagcgagcagagggtgatgctgagtctaagtacttgtcaggactgggcattgcaaggcagcgccaggcgattgtggatggtctcagagacagcgttcttggcttctctgtgaatgtgccaggaacttctgccaaggatgtcttggacatggtcatggtgacacagtacttcgacaccatgaaagaaatcggggcttcctccaagtcgtcagcagttttcatcccgcacgggcccggcgcagttcgtgacgttgctgggcagattcgggatgggctacttcagggctctgttcaccaggaccacaagcttctatagacttaatttcacaacaataattgtgtgtaatgttaagtttgtttataatgtcaattgcattaataagctgtttatttctggagcacctc

SEQ ID NO: 3791 - DNA, 1109 bp, Artemisia annua
aacaaaataaaattcaatcattcttatcttgtttctcagtcttgtagaccctaactcacctaattcaaacatttgatcatgggccaagcacttgggtgcattgtagtggatcagtctactgtagctgtgaaagaacattttggcaagttcgataatgtacttcaacctggttgtcactgtttgccttggtgcttggggtatcagatggctggtaagctgtcgttgcgtgtcaatcagcttgatgttcgttgcgaaacaaaaacaaaggacaacgtctttgttaatgtggttgcttcaatacagtatcgtgccttgtctgaaaaggctgctgatgctttctataaactctcaaacacaaagcaacaaattcaagcttatgtttttgatgtgattagggctagtgtaccaaagctgcttttggatgacgtgtttgtgcagaaaaacgatatcgcaaaaggtgtggaagaagagcttgagaaggccatgtctggttatggtttcgagattgtgcaaactctgattgttgacatagaacccgatcaacatgtgaagcgatccatgaatgagatcaatgcagctgctagaatgagagttgctgcaaatgaaaaggcagaagctgaaaagattctacaaatcaagcgtgcagaaggtgaagcagaatccaaatacctatctgggcttggtattgctagacagcgccaagccattgtggatggtcttagggacagcgtgcttgctttttctgagaacgtgccaggaacatcagccaaggatgttatggacatggtgctggtcactcagtactttgacaccatgaaagacataggggcttcatcaaagtctagtgctgtgttcattccccatggacctggtgcagtcaaagatattgctgatcagatccgtgacggtctccttcaagctcaaggtgtttaagcatagtttacggcttcgttctcaagaattttattgacgtggtgattacataatatagtgtactcttctatgaacatattaggatattgggatttaatgatcgtgtgaaatgcatatataactcaagtactcaaccttaatacttcatcaatatgactatattatcgatgtttctt

SEQ ID NO: 3792 - DNA, 1110 bp, Brassica oleracea
  misc_feature (75)..(75): n is a, c, g, or t
ggaatcagactctcacttacgaaaacaaacacggaaaataacaaatgggtcaagttttaggatgtgtccaagtcnaccagtcgaccgttgcaatcaaagagacgtttggaaaattcgacgacgttctcgagccaggctgtcactgtttgccatggtgcttggggagccaagtcgctggtcacctttccctgcgtgttcaacagctcgatgttcgctgcgagaccaaaactaaagataatgtgttcgtcaccgttgttgcttcgattcagtaccgggccttagctgagagtgctcaggatgctttttacaagcttagcaacaccaggaaccagattcaagcttatgtctttgatgtgatccgagcaagtgtgcctaagctggatctagactccacctttgagcagaagaacgacattgcgaaaaccgttgagagtgagcttgaaaaggctatgtcgcattacgggtatgagatagtccagacgcttatcgtggatatcgagcctgatgtgcacgtcaagagagctatgaatgagatcaatgctgcttcgagaatgagagaggcagctagtgagaaagcagaggcagagaagatacttcagatcaagagagctgaaggagaagctgagtcgaagtacctttcaggtcttggtattgcccgccagagacaagctattgtggatggtctgagaaacagcgtgctggccttctccgagtctgttccagggacgtcttccaaagacgtcatggacatggttctggtcactcagtactttgacactttgaaggagattggtgcgtcttcgaagtcaaactcggtgttcataccgcacggtccaggtgctgttaaggacattgcttcacagatcagggatggtcttcttcagggaaacgctgctgctgagtaagagatcataaaagtacaaagctttatcagggtttagttgtgtttctattgttgaaagtccttatggattccttttaaaatacatatcgttggtttgtttatggcttgtggacgggatcatatgtttggttttagttatgttttgggcttgagagtatttgaagcaatttggggttctaaaaactaaagatcttattacaaaaatt

SEQ ID NO: 3793 - DNA, 1575 bp, Brachypodium distachyon
tcttctccaacggtgatttagaatagtcgtctccaacagcacacaggaaggcaaaaggaaataccccagtacgcggaattactgtgcgataaattgcagctcgatttggaggcggaagaaaccaaccgagagcggagaacgacggccggacggagggcacgaaccaaatcaaatccgaccaaagctcgtcagtcgtcgagataagccatgggtcaggtgcttggtttggtacaaattgatcaatcgacagtagccatcaaggaatcttttggaaagtttgatgcgatcctggaacctggatgccactgcttgccatggtgctttggaaagcagattgctggatatctttcgctgcgtgtgcagcagcttgatgtccgatgtgaaacaaaaactaaggataatgtctttgtcaacgttgtggcatctgtacagtaccgtgctcttgctgacaaggcatctgatgccttctacaggcttagcaataccagggagcaaatccagtcctatgtcttcgatgtgatcagggctagtgttccaaagatgaacttggatgatgtatttgagcagaagaatgaaatcgcaaaggctgttgaggatgaacttgaaaaggcaatgtcagcatatgggtatgagattgtgcaaactttgatagttgatattgagccagatgaacatgtgaagagagccatgaatgagatcaacgcagctgctagaatgaggttggcggccactgaaaaagctgaagcggagaagatacttcagatcaagagagccgaaggagatgctgagtccaagtacctggctggtctgggtatcgcaaggcagcgccaggctatagttgatgggctgagagacagcgttcttgccttctctgagaatgtgcctgggacttcttccaaggatgtcatggacatggtcttggtgacccaatattttgacactatgaaggatatcggggccacgtccaaaacctcggcagtcttcatccctcacgggccaggtgctgtcaaagatatcgcttcacagataagagatggtcagctccaggccaagatgggttaaaattgccggaaaatggtgttcatttcacaagaagtccgcagtccacaacaatatcctcatagctaaatattttgtgagatgaaacttaaggaaacaatactattattttgtgagtggcacagtatatcttattcttctactaagtgaggttatccctagatgaatgtttatagacttccattgttgcatcactagtttctgtaaaaataatactacgttgtgtaatggtcatgtttgccagttgcatagaagtgagaccgaggagaaacatcttatatattatatttataatcttcaggctattatgctagactgttcatgctattctctatggaacttatgtattttggaggaatcgaaacattcatttgttaactactgtataaaattctgttgctttgaagctgcgccatcttaggactaatggcgctgcatctttttgcttgataaaaagttctttgggcatctgtatttgctgaccgattatgtgaactaaattggaatgattttttt

SEQ ID NO: 3794 - DNA, 1317 bp, Cicer arietinum
atactaaaacatcgtattcaaaagatagattcaattcaaatgcttcacgaaagggtttacaaatactctttggtgtatctatatatatagtttaattatataagcatttagtagttcgcacttatttggattaattaaaaatttcgatctgtgtctccaagtgcaggattgaaagatgggtcaagcattgggttgttatcaagtagatcagtcaaatgttgcgatcaaagagcagttcggaagatttgttgatgttcttgaacctggatgccattgcttgccctggtgtcttggttatcaaatagctggtggattatcgcttcgagtgcagcaactcgatgtcaaatgcgagacaaaaaccaaggataatgtctttgtcatggtggttgcatctgtacaataccgcgctgtggctgacaaagcatccgatgcgttttacaggctcaccaacacaagggagcagatccagtcatatgttttcgacgttataagggccagtgtgccaaagttggaactggatgcagtctttgagcagaagaatgatatagcgaaggctgtcgaagacgagcttgagaaggcgatgtctaactacggatacgagatagtccagactctcattgttgatgtagagcctgatgttaatgtcaaaagagcaatgaatgaaatcaatgcagctgcaagactgaggttggctgcaaacgacaaagccgaagcagaaaagatactgcagatcaagaaagccgagggagaagccgagtcaaaatatctgtcaggactcggtatagctcggcaacgtcaggccatcgtggacggactgagggacagtgtgcttgcgttctcagagaatgtacccgggacatcagctaaagatgtgatggacatggtattggtgactcaatactttgacaccatgaaggaaattggtgcatcttcaaagtcttcatctgtgttcataccacatggtcctggtgctgttagagacattgctgtgcagattagagatggtctccttcagggaaatgcggcaaatttataagtgtttatggagttatataaattgcatagcattgctttttatcgcaccaacttctgagtgaaagtgtttctgatattaaacacgtgtcgatgtcggatattgacacgtatcatgtttatattgaaccatttttattttctcgaattattatcattagcgttttttgtatttgtgtcgtgttcaaagtctttgtgtgtgtcatgtttcatagtttgttatgtttgaatgattgtatatttttcttttatattgtaaagatgaatatcagaatctctagctaa

SEQ ID NO: 3795 - DNA, 1682 bp, Cicer arietinum
catattagttataagtacagtgtctttaaactgatgaactaaattcaaaataaggttcattcatgaaatcaattatatccatattttgatattaattaaagagttgttggagatgtgataattaatttttttcataaaaatagaaagaatttttttttcttttactctttttttctttatataaacttttaccttttttaatacaaaaacatcgtattcaaaagatagattcaattcaaatgcttcacgaaagggtttacaaatactctttggtgtatctatatatatagtttaattatataagcatttagtagttcgcacttatttggattaattaaaaatttcgatctgtgtctccaagtgcaggattgaaagatgggtcaagcattgggttgttatcaagtagatcagtcaaatgttgcgatcaaagagcagttcggaagatttgttgatgttcttgaacctggatgccattgcttgccctggtgtcttggttatcaaatagctggtggattatcgcttcgagtgcagcaactcgatgtcaaatgcgagacaaaaaccaaggataatgtctttgtcatggtggttgcatctgtacaataccgcgctgtggctgacaaagcatccgatgcgttttacaggctcaccaacacaagggagcagatccagtcatatgttttcgacgttataagggccagtgtgccaaagttggaactggatgcagtctttgagcagaagaatgatatagcgaaggctgtcgaagacgagcttgagaaggcgatgtctaactacggatacgagatagtccagactctcattgttgatgtagagcctgatgttaatgtcaaaagagcaatgaatgaaatcaatgcagctgcaagactgaggttggctgcaaacgacaaagccgaagcagaaaagatactgcagatcaagaaagccgagggagaagccgagtcaaaatatctgtcaggactcggtatagctcggcaacgtcaggccatcgtggacggactgagggacagtgtgcttgcgttctcagagaatgtacccgggacatcagctaaagatgtgatggacatggtattggtgactcaatactttgacaccatgaaggaaattggtgcatcttcaaagtcttcatctgtgttcataccacatggtcctggtgctgttagagacattgctgtgcagattagagatggtctccttcagggaaatgcggcaaatttataagtgtttatggagttatataaattgcatagcattgctttttatcgcaccaacttctgagtgaaagtgtttctgatattaaacacgtgtcgatgtcggatattgacacgtatcatgtttatattgaaccatttttattttctcgaattattatcattagcgttttttgtatttgtgtcgtgttcaaagtctttgtgtgtgtcatgtttcatagtttgttatgtttgaatgattgtatatttttcttttatattgtaaagatgaatatcagaatctctagctaatttccaatttttgtttgttaatagtctttatgtcaatgccagtgacattagaggatcgatattactttccaaaatatatgttttctttcttgtaactatgttttctatgtcaaaaatatttacttttgttctatcctattttatattttataaaagaatatgtaa

SEQ ID NO: 3796 - DNA, 1198 bp, Cirsium arvense
tcttatttgtctttataacctggtaactttttcggtttcttcttcttatatatatctcgtatcacaaacagtattctcgtacgacagaatcttattcttatcaataacgaaattgagttgaaatactcgataagttttctagaggaaatttggtaaaagttagctggggcataaattagtaacactttaatactcgattcacaatgggaaatgcgttcggatgcatccaagtggaccaatcaaccgtagccatcaaagaaacattcgggaagtttgatgacatccttactcctggttgtcattgcatgccttggtgcttaggccagcagttagcaggttacctttctcttcgggtgcaacagcttgatatccgatgtgaaacaaagacaaaggataatgtttttgtgacggtggttgcttcagttcaataccgagcactggcagataatgcatcagatgcattctataaacttagcaacactagggagcagattcaagcctatgtgtttgatgttattagagctagtgttccgaggattgagctagatttggtctttgagcagaaaaacgatatagcaaaaagcgtggaggacgaacttgaaaaggccatgtctacttatggctacgagattgttcaaacgctcatagttgatattgagcctgacgaacttgtcaagaaatcgatgaacgagatcaatgcagctgcaaggatgagggtggcagccaacgaaaaggccgaagccgagaaaatcctgcaaatcaagcgggctgaaggggaagccgaagctaaatacttatcaggcctcgggatagcaaggcaacgtcaggccatcgttgacgggttacgggatagcgtggtcgggttctcgtctaacgtccccgggacgtcggccaaagatgtgatggacatgatcctagtcactcagtatttcgacacaatgaaagagatcggtgcatcatcgaaatcgacatcggtgttcatcccacacggaccgggggcggtcagagatgttgctgctcagatcagagatggtctgcttcaaggaaatgccccttagatgtgatcattccttgtttgcccctctgaatgagtctggtttggtcccaaaataaaaggagagaaattaattacgagtaaatttgtcattttggttaagtggaaagtataataattgtgtatagttaaaaactttgttat

SEQ ID NO: 3797 - DNA, 1039 bp, Fraxinus spp
aggagaaagatgggtcaagcacttggttgcgttcaagtggatcagtctactgttgcagtgaaggaacattttggcagatttgatgatgtgctcgaacctgggtgtcattgcttgccgtggtgtctggggtaccaattggcaggttcactatcattgcgtgtacaacagcttgatgtccgttgcgaaaccaaaactaaggacaatgtgtttgtgactgtggttgcttcaattcagtaccgagccttgtctgaaaaagcagctgatgcattctataagctttccaacacaaaggcacagatccaggcatatgtttttgatgtcataagagcaagtgtcccaagattggatctggattctactttcgaacagaagaatgacatagccaaggctgttgagaacgaactcgaaaaggccatgtctgcctatggatttgagatagtgcagacgctgattgtggacattgaaccagatgcacaggtgaagagagccatgaatgagataaattcagctgctaggctcaggcttgctgctaacgagaaggccgaagctgacaaaatactgcagatcaagagagctgagggagaagctgaatctaaatacttgtcagggcttggtattgctagacagcgccaggccattgtagatggcctcagggacagtgtgctcgccttctcagcaaatgtgcctggaacaacctctaaagacgtcatggacatggttcttgtcacgcagtattttgatacaatgaaggaaattggagcatcgtcaaagtcctctgccgtgttcatcccacacggacctggtgctgtcaaagatattgctgcacagattcgggagggtcttcttcaggctgaaagtgtcaaccagtagttaatgcaaaggtttatggtaggagtcgtacgacatagttgtcttcattaaggatgtttcttgtgtgcaggtaggtttctttatgctataagtttggaggaaaatcatcatgagttgctgctgcttgtatatctcatattacctaccctatgctagtatagtgctaaga

SEQ ID NO: 3798 - DNA, 1253 bp, Tropaeolum majus
gggatgtaacttcatatttctttcttcttccccacgtaccgagaatgagtgaaggagacagtactcgatatcactctctgtgattggatttgaaacgtgtaaaagataacttctccattaattgtggaatattcaacctcaaaaacgaagaagagacgaggcagcttccgacttttttccaatctcgggacgctaggttatacccctttctgcaacatttcccggaagaaaatgggacaagctttgggatgtattcaagtagaccagtcaactgtagccattaaagaaacctttgggaagtttgatgatgtgcttactcctggatgtcactgtttaccttggtgtttaggaagccaagtggccggtctcctctctttgcgtgtgcagcagctggatgttcgctgtgaaacaaaaactaaggacaacgtttttgtcgtagtggttgcttccattcaatatcgagctgttgcagaaaaagctgaggatgctttctacaaacttagcaataccagggaacagattcaagcctatgtttttgatgttataagggccagtgttccaaagttggaattggatgcagcctttgaacaaaagaatgacattgctaaagctgtggagaacgaactcgaaaaggctatgtcacattatgggtttcaaatagttcagacacttatagtggatatcgaaccagatgtgcatgtaaagagagcaatgaatgagataaatgctgctgctagaatgagagtggctgcaaatgagagagccgaagcagagaagatattgcagatcaagaaagctgagggagaggcagagtctaagtatctacaagggcttggcatagctcggcaacgccaagcgattgttgatgggctgagggacagtgtgctagccttctccgaaaatgtacctggaacatcttcaaaggatgtcatggatatggttcttgtgacccagtactttgacacgatgaaggacattggtgcttcttcgaaatctaccgctgttttcatcccacatgggccaggtgccgtgaaagacattgcttcgcaaataagggatggtcttcttcaaggaaataccgttcagtaatgttgatttcaacgctctgtctcgacttatggttttagtttctctgtcttgataaataatagtatggaaacctttagggtacatattggtctacgtatacttttggaactaagcttgtacgtttttcgtcggataatagttgtatatagtcggtaagtttcatt

SEQ ID NO: 3799 - DNA, 1236 bp, Solanum tuberosum
cgaaaccttttgcttaccatattgagaggcctcttctgaattcagtctctcccacttatagctctactttgtctttcacaaacaaatttgcttcttcacttgacagatttggactatgggtcaaacactcggttgcattcaagtagatcagtcaactgttgctgtgaaagaacaatttggtaagtttgatcaagtgctggagccagggtgtcactgtttgccatggtgtcttgggtatcaggttgctggttcactctcattgcgagtgcagcagcttgatgttcgctgtgagaccaaaacgaaggacaatgtttttgttactgtagtagcatccattcagtacagagccttagcagagaacgcggcagatgcattttacaagctttcaaacaccaaaggacagattcagtcctatgtttttgatgttataagggccagtgtgccacgaatggggttggatgctgcatttgagcagaaaaatgaaattgctaaagctgtagaggaagagcttgaaaaggctatgtctgcttatgggtatgagattgtccagaccctcattgtggatatagagccagatatccatgtcaagagggcaatgaatgagattaatgctgctgcaagactccgtgttgctgcgaatgagaaggctgaagcagagaaaatactgcagatcaagaaagctgaaggagaagctgaatccaagtacttgtcagggcttggcattgctcgacagcgtcaagccattgtggatggtcttcgagacagtgtgcttgccttctcagaaaacgtacctggaacatcaccaagagatgtgatggacatggttcttgttactcagtattttgatacaatgaaggagattggagcttcttccaagtcatctgcagtgtttattccccatggaccaggtgctgtcaaagatgttgcttctcagatccgggagggtcttcttcaggctgaaagtattcagcattagtttaataaaggtgaaggataattgatagtcttgtgtggtttgatgctcttttagcttagtattgatacggtagctttatttgtgttgtgcttatgtagtccatagattgatacacgcaacgtttggttttagtagcttgtgtataggtgttaccaactaagctggcaaacaaaaagttctgcagttgattgtgtttatcttgttagatgtctctataggaattttaggtatttacttgccaagagtaaatcacatcactt

SEQ ID NO: 3800 - DNA, 1029 bp, Primula obconica
ggagaggttcggaaagtttgaggatgttcttgagccagggtgccactgcttgccttggtttctcggtagccagattgcaggtcgtctctctctccgccttcaacagttggatgttcgctgcgagactaaaacaaaggatagtgtgtttgttaacgttgttgcatcgatacaataccgtgctctagcagataaggctaatgatgccttctacaagttaagcaacacaagggctcagatccaggcttatgtttttgatgtcatcagagcctttgtaccgaagctcaatttggatgatactttcgagcagaaaaatgaaattgccaaagcagttgaagaagaactcgaaaaggctatgtctgcctacggattcgaaattgtacagaccttgattgttgatatagaaccggacgagaatgtcaagcgggctatgaatgagataaatgctgctgcaaggatgaggttggcagctacagagaaggcagaggccgagaaaatcctacaaatcaaaagggccgaaggagaagcagaagcaaagtacttatcaggtttaggtatcgctcgccaacgccaagcaattgttgatgggttgagagacagtgtgctaggattttctggaaatgtccctggtacaagtgctaaagatgtcatggacatggtgcttgtaactcagtattttgatactctcaaggaaattggggcttcgtctaaatcatctgctgtttttataccccacggcccaggggctgtaaaagacgttgctgatcagatccgtgatgggcttctccaaggccaagcttccctgaaataactaaaatttaaattttgaacaagtggtgttttttatgtctgggttgtgtgaatttcgcgttttccatgtcgtaaagcttgttttattttcagttcagatggtgcgcataccggaggttaaatactgtatattgttttctgtttcttgaaactggtttgtgttagatgttgattggtgctggtattttggatacggtggaacagtgtcgtttgttttgaagg

SEQ ID NO: 3801 - DNA, 1235 bp, Solanum phureja
aaaaccttttgcttaccatattgagaggcctcttctgaattcagtctctcccacttatagctctactttgtctttcacaaacaaatttgcttcttcacttgacagatttggactatgggtcaaacactcggttgcattcaagtagatcagtcaactgttgctgtgaaagaacaatttggtaagtttgatcaagtgctggagccagggtgtcactgtttgccatggtgtcttgggtatcaggttgctggttcactctcattgcgagtgcagcagcttgatgttcgctgtgagaccaaaacgaaggacaatgtttttgttactgtagtagcatccattcagtacagagccttagcagagaacgcggcagatgcattttacaagctttcaaacaccaaaggacagattcagtcctatgtttttgatgttataagggccagtgtgccacgaatggggttggatgctgcatttgagcagaaaaatgaaattgctaaagctgtagaggaagagcttgaaaaggctatgtctgcttatgggtatgagattgtccagaccctcattgtggatatagagccagatatccatgtcaagagggcaatgaatgagattaatgctgctgcaagactccgtgttgctgcgaatgagaaggctgaagcagagaaaatactgcagatcaagaaagctgaaggagaagctgaatccaagtacttgtcagggcttggcattgctcgacagcgtcaagccattgtggatggtcttcgagacagtgtgcttgccttctcagaaaacgtacctggaacatcaccaagagatgtgatggacatggttcttgttactcagtattttgatacaatgaaggagattggagcttcttccaagtcatctgcagtgtttattccccatggaccaggtgctgtcaaagatgttgcttctcagatccgggagggtcttcttcaggctgaaagtattcagcattagtttaataaaggtgaaggataattgatagtcttgtgtggtttgatgctcttttagcttagtattgatacggtagctttatttgtgttgtgcttatgtagtccatagattgatacacgcaacgtttggttttagtagcttgtgtataggtgttaccaactaagctggcaaacaaaaagttctgcagttgattgtgtttatcttgttagatgtctctataggaattttaggtatttacttgccaagagtaaatcacatcactt

SEQ ID NO: 3802 - DNA, 1064 bp, Eutrema halophilum
ccttgatattccgctcgtcaatcctctcgtcttctcggaaagaaaatattatgggtcaagttttgggatgtgtccaagttgatcaatcgactgtagcaatcaaagagacttttgggaaattcgacgacgttcttgagccaggatgtcactgtttgccatggtgcttgggaagtcaagtcgctggtcacctttcactgcgtgttcagcagctcgatgttcgctgcgagacgaaaactaaggataatgtgtttgtcactgttgttgcttccattcaataccgtgccttagcggagagtgctcaagatgctttttacaagctcagcaacacgaggaatcagattcaagcttatgtctttgatgtgatccgagcaagtgtacctaagctggatctagactcaacctttgagcaaaagaacgacattgcaaaaaccgttgagagtgagcttgaaaaggctatgtcccattacgggtatgagatagtccagacgcttattgtggatatcgagccagatgtgcatgtcaagagggcaatgaatgagatcaatgccgcttcgaggatgagagaggcggcgagtgaaaaagctgaggcagagaagatacttcagatcaagagagcagagggagaagctgaatcgaaatacctttcaggtatgggtatagcccgtcagagacaagccattgtggatggtctgagaaacagtgtgctcgccttctctgagtctgttccagggacatcttctaaagacgtcatggatatggttctggtcactcagtactttgacacattgaaggagattggtgcgtcttccaagtcaaactcggtgttcataccgcacggtccaggagctgttaaggacattgcttcacagatcagggatggtcttcttcagggtaacgctgctgattcgtgatctcaaagtacaaagctttcttcagggcttagttgtgttgatacttagtagagctttcttcatggtttagttgtgttgcaacttggtattatttatctttagcggtttggctttctattttgtgaaggataccttaaaatacttatcgttggt

SEQ ID NO: 3803 - DNA, 1093 bp, Valeriana officinalis
ttacacgcgaatatctagacggacgtgtgtttttacatgttctgttgtgtttaaattcaaaagatttgaaggatgggtcaaacacttggttgcatacaagttgaccagtcaaatgtggctgtgaaggaacaatttggtaagtttagcgacgtacttgagccaggatgtcactgcatgccttggtgttttggttataagctagccggtaaactatctctgcgcgttcagcaactcgatgttcgttgtgaaactaaaactaaggacaatgtatttgtaactgtcgttgcatctattcagtatcgtgctatgtcagagaaggcagctgatgctttctataagctctccaataccaagggacagatccaagcatacgtatttgacgtgattcgggcttgtgtgcctaagttgcttttggatgctacatttgaacaaaagaatgacattgccaaagcagtggaagaagaattggaaaaggccatgtctgcctatggttacgagatcgtccagaccctaattgtggacattgaaccagatgctcaagtaaagagggccatgaacgaaattaacgcagctgctagactaagggtggcggcaaatgataaggcagaagccgagaaaatactgcagataaagcgagcagaaggagaagccgagtcgaagtatctctcaggactgggtatcgctagacagaggcaagctatagtggatggtctaagagacagtgttatcgctttctcagagaacgtgcctggaacgtcggctaaagatgtcatggacatgattctcatcactcaatacttcgacaccatgaaagaaatcggagcttcttcaaaatcatctgctgtcttcattcctcacggtcctggtgctgttaaggatatcgcttctcagattcgcgatggtcttcttcaaggtggcagtacttcctaggttcttatagttttcttatcaaactcggttataagtgtggtgtgatgtgattatcagtgtgctttaatacggtaggttttgaattccatttagtacaaaatacgaattagctcagggtcagtcttttgaatatgcatgcttgtttggtatgtaagatattatc

SEQ ID NO: 3804 - DNA, 1309 bp, Cephalotaxus harringtonia
gcgaaaatttccaggaaccagggcttcttgctttcaggctttttctccatgcttttattctgattaggcgcggaaaggctttaaatatctcatgtattttggatctaatgttcgctgtgagtaaattttgacgattctagccgctaaagtttgatcgagagcttcgctttcctcgaaattgactcaaagttggaataacaaaatggggcaattattatgctgctgtgtacaagtggagcagtcaactgttgccatgaaagagagatttggacgctatgaagaagttcttgagccagggtgccactgtcttccctggtttctgggaagtcaaattgggggccatctttctttacgggtacaaaaactggatgttcgatgtgaaacaaagaccaaggataatgtattcgtgacagtgattgcttctgtgcaataccgtgcccttctggagaaagcaagtgatgctttttataagctaagcaatacaagggagcaaatccaagcttatgtatttgatgtcattaggtcgagtgtcccaaagatgaacctcgatgatgtttttgagcaaaagaatgaggtagctaaagctgttgaagatgaactcgaaaaggctatgtcaacctatggatttgagattgtgcaaacacttattgtggatatagaacctgatgaaactgtgaagagagccatgaatgaaataaatgcagctgcaagaatgagagtggcaacacgagacaaagctgaggcagagaaaattttgcaaatcaagcgagcagaagcggaagcagaatcaaagttcttatcaggacagggtattgctcgacaacgacaagcaattgtggatggcctgagggacagtgtacttgctttctcagtcaatgtgcctgggacaactgccaaagatgtgatggatatggtgttggtgacgcagtattttgacacaatgaaagagatcggagcatcttcaaagtcttcagcagtattcataccacatggacctggtgcagttcgtgatgttgccgaacagatcagagatggactgcttcaggcacaagcgaattgagtgttgtgatactcctggataatactacttttgagatttccaatttcagctagaaatactaaaagctagtttaactacatagctttcttatttccattgttgatacccaatttgtatttccttttttccctctgaatatgtcgatagacatggtgcatatattcatggagtgttgtactgtggaataaggtacacatgtgccacagtgttgtaaattgtttcttgttcttttacaattcttataagcgc

SEQ ID NO: 3805 - DNA, 983 bp, Gossypium raimondii
agcacactttgtataaaaaactaaaaacaagacatactgtattttacttcaaactttttggttactcttctaattccgatttcttcaccttcttttagtaaataggggcaggctcttgggtgtattcaagtggagcagtcaactgtagctataacagaagtcattttgggtaagtttgtatgatgtgcttcagcctggttgtcattgtttgccgtggtgtttcgggaaacaggcagccggtactctctcctttgcgtgtgcagcaactggatgttcgatgtgaaacaaaaaccaaggataacgtgtttgttaacgtggttgcttcaattcaataccgagccttagctgaaaaggcacaagatgctttctataaactcagcaacactagagcccagattcaatcctatgtctttgatgttattagggcaagtgttccgaagttggagctggatgcagtatttgaacagaagaatgatatagcgagagctgtggaagaggaacttgaaaaggctatgtcacattatgggtacgagattgttcagactcttattgtggatattgaaccagatgagcatgtgaagagggcaatgaatgagattaatgcagcggcgagaatgagggtggctgccaatgagaaagctgaagcagagaagatattgcagatcaagagagcagaaggagatgccgagtcaaagtatctggctgggcttggtgtagctcggcagcgacaggctattgtagatggacttagagacagtgtgctggcattctctgagaatgtacctggtacatcatcaaaggatgtcatggacatggttcttgtgacacagtacttcgacacaatgaaggagatcggtgcatcgtcaaaatccaactctgttttcatcccacatgggccaggtgctgtaagagacattgcttctcaaatcagggatggtcttcttcaagcaagccaaaaacaactgagtaactgccgcggctga

SEQ ID NO: 3806 - DNA, 1337 bp, Panicum virgatum
tttttggcttgtaccataagcttcattcaagaagtacctctagttgatactgtagttgcttctatatctgagctacctatgctcggatgacaaatataagacatgggtcagattttgggtttagtgcaagttgatcagtcaactgtagccatcaaagaaacttttggcaagttcaatgaggtcctggagcctggttgccactttctaccctggtgcatagggcagcagattgctggttacctctccttgcgtgtgcggcagctggatgtccgctgtgaaacaaagacaaaggacaatgtctttgtcactgttgttgcatctgtccaatatcgtgctcttgctgataaggcatccgatgccttctacaagctgagcaacaccagggaacaaattcagtcatatgtatttgatgtcattagagctactgttccaaagctggacctggacgatgcatttgagcagaagaatgatattgcaaaagctgttgaagatgagcttgaaaaggcaatgtctacatatggctatgagatcgtgcaaacgctcattgttgatattgagcctgatgaccgtgtcaagagagcaatgaacgagatcaatgcagctgctaggatgagggtggcagccagtgagaaagctgaggccgagaagatactccagatcaagaaagccgaaggagaggctgaatccaagtacctggctggtgtgggtattgcaaggcagcgtcaggccattgtggacgggctgagggacagtgtgctcgccttctcagagaatgtccctggcaccactgccaaggacatcatggacatggtcctggtcacccagtacttcgacaccatgaaggagattggagcctcatccaagtcctcttcagtgttcatcccccatggtcctggagctgtcaaagatgtggcggcgcagataagagatggcctcctgcaggccaatctgcagtgagagggctctgagggggaaaagaagattggttttgattgcaaagcagtgtcgacggcatctgttatatggtgctatgaagttgtgaattatatgatatagatagacttgcatggtttgtgaaatgttagtaggctttatatcgactggagcacttgcgagtgagcctagatatccaaacctgtcatagtgtcagttattttggtgacctcctactatgctatatatttgtgtggaaagtccatctggataggactcagagctattaattgaaagtgcagcttctcagaattctgtgttttttggctgcagtgatgttcttttgcaaaatctttggaatgacaagatgtctgttattttatgaaattgtttttgtgggctcc

SEQ ID NO: 3807 - DNA, 1284 bp, Panicum virgatum
caggtatcttttttgtgcagataagacatgggtcagattttgggtttagtgcaagttgatcagtcaactgtagccatcaaagaaacttttggcaagttcaatgaggtcctggagcctggttgccactttctaccctggtgcatagggcagcagattgctggttacctctcattgcgtgtgcggcagctggatgtccgctgtgaaacaaagacaaaggacaatgtctttgtcactgttgttgcatctgtccaatatcgcgctcttgctgataaggcatccgatgccttctacaagctgagcaataccagggaacaaattcagtcatatgtttttgatgtcattagagctactgttccaaagctggacctggacgatgcatttgagcagaagaatgacattgcaaaagctgttgaagatgagcttgaaaaggcaatgtctacatatggctatgagatcgtgcaaacgctgattgttgatattgagcctgatgaccgtgtcaagagagcaatgaacgagatcaatgcagctgctaggatgagggtggcagccagcgagaaagctgaggccgagaagatactccagatcaagaaagccgaaggagaggccgagtccaagtacctggctggtgtgggtatcgcaaggcagcgtcaagccattgtggacgggctgagggacagtgtgcttgccttctcagagaacgtccctggcaccactgccaaggatatcatggacatggtcctggtcacccagtacttcgacaccatgaaggagattggagcctcatccaagtcctcttcagtgttcatcccccatggtcctggagctgtcaaagatgtggcggcgcagataagagatggcctcctgcaggccaatctgcagtgagagagggtcctgaggattaaaaaaaagaggattggttttgattgcaaagcagtgtcgacggcatctgttatatggtgctatgaagttgtgaattatatgatatagatagacttgcatggtttgtgaaaggttagtaggtttcatatcgactggagcacttgcgattattttggtgacctcctactatgctatatacttgtggaaagtcaatttggataggactcagcttaatattgaaagtgcagctactgagaattctgtggtttttgccgcagtgatgttcttttgcaaaatctttggaatgacaagatgtctgttattggatgaaattgtttttgtgggctccattctgatggactgcaaagttagcacattttgatgctgtcagttaagttattctac

SEQ ID NO: 3808 - DNA, 1367 bp, Amorphophallus konjac
ccgctgcgctctccatttctccactccattcctccatacagaaagatctgctgctcgcggcccctgcttcaggtggtgaggctccgactcccccacctgcagattcttctcaagaatcaaagcaatggggcaggctttttgctgcttacaagtagaccagtcgactgttgctatcaaggaaaattttggtaagttcgatggtgtgctggagcctggatgccactgcctgccatggattctagggagtcaggtcgctggatctctctccctgcgtgttcaacagcttgatgtacgttgtgaaacaaaactaaggataacgtatttgtcactgttgttgcatctgttcaatatcgtacattggctgagaaggctgttgatgctttttataggctcagcaacaccagggagcaaattcaatcctatgtttttgatgtcatcagggcaagtgtaccaaaattggacttggatgatgtctttgagcagaagaatgagattgcaaaagcagtagaaaatgaacttgaaaagtccatgtcaacatacggttacgagatagtccagacacttattgtggatattgagccagatgaacgcgtgaagaaagcaatgaacgagataaatgcagcttccagatttcgggtggcggccaatgagaaagcagaagcagaaaagattctgcagataaagcgagccgaaggggatgcagaatccaagtatttgttaggtttgggtgtagcccggcagcgccaggcgatcgttgatggactgagggacagtgtgctcaacttctcactaaatgtacctgggacaacagccaaggatgtcatggacatggttctgctgacccaatacttcgacacaatgagggagatcggtgcctcatcgaaggcatcttctgtgtttatccctcatggacctggtgctgtgaaggacatagctgcgcagataagggatggcctccttcaggctaacactcagcagaggggcaattgaatgtgtgccttaacatggcatatgaacgtcaacttgctccttgagtgacagataaacaattaaacaaactggagggatgtagatactctgaatgcatatataagcagttgagttggtaaaggtattacctgatggttctgttgctcctttactggcgtagttccatatggagtttgttgataattcctttagcttactctttttacttacctatatttattggtgaaagtttgctgaagccatagattcagtacagaatgcccctgttattctagaaactttggtagccgtcttgtgccatattttttctgtgacgtgtgagcagttgctccactgggtcttttttccttttcctttcttctgggatgtaagccgag

SEQ ID NO: 3809 - DNA, 911 bp, Manihot esculenta
aatttaatatgggtcaagcatgtggttgcattcaagtggagcaatcaaaagttgttatcagggaacactttgggaagtatgatgctgtgctggagcctggctgccactgcatgccgtggtgcctgggatacaaagtgtctggtaaactttctctgcgtgtccaacaacttgatattaagtgcgaaacaaaaacaaaggataatgtatttgtcaatgtggttgcctctattcaatatcgtgctttggcagaaaaagccgcagacgcctactataagctctccaacaccaaagctcagattcaagcctatgtttttgatgttatcagggcaagtgttccgaagttgagcttggatgctgcttttgaacagaagaatgaaattgcaaaagctgttgaagatgaacttgaaaaagccatgtctgcatatggatttgaaatagtgcagactcttattgtggatatagaaccagatactcatgtgaagaaggcaatgaacgagataaatgcagctgcaagacagagagtggcggcaagtgaaaaggcagaaggagttaaaatattgcagataaaacgagcagaaggagaagcagaatccaaatacctttcagggattggcatagctcgtcagcgccaggcgatagttgatggactaagagatagtgtgcttggattctctgagaatgttcctggaacaagtgctaaggatgtgttggatatggtgctgttgactcaatactttgatacaatgaaagaaattggagcatcctcaaaatcctcatctgttttcattccacatggccctggtgcagtgagagatattgcatcgcagattcgtggtggacttcttcaggggaactctgcaaatcagcgcttcagcggatgtatggaaacttgtgtgcctgctaatgagtaa

SEQ ID NO: 3810 - DNA, 1234 bp, Setaria italica
tgtttcaagacagatattagaatggggaaactaccggcagcaatcggcaggttcttctgctttgtacaggtgaaccagtcaacagtaggcatcaaagagagatttgggaagtttgaggaagtcctcaatcctggatgccattttatgccatggatcattggaaaccgagtcactggtcagctcacactaaggcttaggcagcttgatgtccgctgtgagacaaagacaaaggataatgtttttgttactgttgttgcatccattcaataccgagcaatggaagacaaagcaagtgatgcatactacaagctcagcaacccgaaagctcaaattcaatcatatgtctttgatgttataagggcaagtgttcccaaactagaactggatgatgcttttgagcaaaagaatgaaatagcaaaagctgtggaggaggagcttgagaaggcaatgtctgcttatggttatgagattgtgcagacactcattgttgatatagaaccagatgagaaagttaaaagggctatgaatgaaattaatgctgctgcaagactccgtgtcgcagcaaatgagaaggcagaggcagagaagatcattcagatcaaaagggctgagggtgaggccgaagccaagtatctctctggccttggcattgcaaggcagcgtcaagccatagttgatgggctaagagatagcgtgcttggctttagtggcaatgtgcctgggacttcagctaaggatgtgatggatttagttctgctcacgcagtactttgacaccatgaaagagatcggagcagcatccaaatcttctgcagttttcctcccacatggtcctggtgctgttgcagatattgccagtcagattcgtgatggatttcttcaggcatctactcagcaggcaaagtgatagattgcattgaaagcgaaaattccattaaacatgaatctagattggcaagttttcctgctactttgtcataattgagtgggcttttacatgccttgagaatatagtgtgagattgttaaagtatcaagcttgtatagtttgtgcttatagaataggtgttctgtgtacagatgcctcatataaagaatgaagtgtgagcaccttacaagaatctagttaattattgtggtgtgaatgtgtgggcatacgagagctctaaaatataatgttgtcgtatcttttgtaacttcgatacacagctttgatttcagagacttgagtagtca

SEQ ID NO: 3811 - DNA, 1124 bp, Mimulus guttatus
accttcttctcaatatcactctctctctctactttctctctctaactagcggcatcagaaaccctttcttcagaggtcttaacaatgggtcaagcactctgctgtgttcaagttgaccagtcaaccgttgctatgaaggaacatttcggtaaatttgattctgttcttgatcctggctgtcactgcttgccatggtgtttcggttaccagatggccggtaccctttcacttcgtgtgcaacagctagatgttcgttgcgaaacaaaaactaaggacaatgttttcgtgactgtggtggcttccatccaataccgagctgtggcacaaaatgcgtctgatgcattttataagctcactaacacaaaggcacagatccagtcgtatgtttttgatgtcatcagagccagtgtgccgagattgttattggattctgtctttgaacaaaagaatgaaatagccaaagctgtggaggaagaactcgaaaaggccatgtctgcttacgggttcgaaatcgtccagaccctaattgttgacattgaaccagacgttcatgtcaaacgagccatgaacgaaatcaacgcagctgctaggatgagggtagctacaaacgagaaggccgaagcagagaagattctccaaatcaagaaagccgagggcgaagcagagtcaaagtacctgtctggacttggtattgctcgacagaggcaagcgattgtggatgggcttcgagacagtgtgctggcattctcggagaatgtacccggtacaagtgcaaaggatgtaatggacatggttctcgtgactcagtactttgacacaatgaaggaaatcggagcttcatcaaagactagtgccgtttttatcccacatggacctggtgctgttaaagacatcacctcgcagattcgcgagggtcttcttcaaggtcagagtgttgttgatcagtagtcagagacttttaggagaaatttgctttcggactttattttcgagatggcttttgtgtaactagtttacttttaagggttggagttatttttgtttataattaggctagtgagattgtgtgattggattgtctgcatatgttgatgaagctaggttttcttttgttctcctctttt

SEQ ID NO: 3812 - DNA, 1084 bp, Arachis hypogaea
gggttcctaaaagatggggctagctcttggttgtcttcaagtggaccagtcaacggtagctatcaaggaagtttttgggaagttcgatgatgtgcttgaacccggttgccactttgtgccttggtgtcttggcaatcaagtagctggttacctttctttgcgtgtgcagcagcttgatgttcgctgcgaaaccaagacgaaggacaatgtctttgtcaccgttgttgcttccatccaatatcgagcacttgcagaaggtgccgtagatgcattttacaagcttagcaataccagagcacagattcaagcctatgtctttgatgttattagggcaagtgttccaaagatggaactagacgcctcttttgaacagaagaatgaaattgcgaaagctgtagaggaagaacttgaaaaggcaatgtgtgcttatggctatgagatagttcagactcttattgtggatatcgaaccagatgagcatgtcaagagagccatgaacgagataaatgctgctgcgagattgagggtggctgcaaatgagaaggccgaggcggagaagattctgcagattaagagagcagaaggagaagcggagtcgaagtatctagcagggcttggaatagcccgtcaacgccaagccattgttgatggcctgagggacagcgtgctagccttttcagagaatgtccctgggacaacatcaaaggatgtcatggacatggttctggtcacccaatattttgatacattgaaggaaatcggtgcatcctcaaaatccaattctgttttcgttccacatggaccgggagctgttaaagatatttcttcacaaattagagaaggtcttcttcaaggaaatgtggcttaatcttgaaatttagcattcacatcagtggacagttgagtttagcctctcaactttagctgcatattttcttgtttttgccatgacttctaagctgtttgctatgctttcaatatttttcctttttctctttccttttggttccattggaaaacatgtccccgtattttgaatgtttgttatattacaacagactcatctgttagaaatataaataat

SEQ ID NO: 3813 - DNA, 1130 bp, Raphanus sativus
  misc_feature (32)..(32): n is a, c, g, or t
  misc_feature (881)..(881): n is a, c, g, or t
  misc_feature (884)..(884): n is a, c, g, or t
  misc_feature (956)..(956): n is a, c, g, or t
  misc_feature (960)..(960): n is a, c, g, or t
  misc_feature (962)..(962): n is a, c, g, or t
  misc_feature (976)..(976): n is a, c, g, or t
  misc_feature (979)..(979): n is a, c, g, or t
  misc_feature (998)..(998): n is a, c, g, or t
  misc_feature (1017)..(1017): n is a, c, g, or t
  misc_feature (1048)..(1048): n is a, c, g, or t
  misc_feature (1071)..(1071): n is a, c, g, or t
ttcgcgtctctcgtctctaattcattgtttcntggaaaaataacaaaaaatgggtcaagttctaggatgcgtccaagtcgatcagtccactgttgcaatcaaagagacgttcgggaagttcgacgacgttctcgagccaggttgtcactgtttgccctggtgcatagggagtcaagtcgctggtcacctttccctgcgtgttcaacagctcgatgttcgctgcgagaccaaaactaaagataatgtgtttgtcaccgtcgttgcttccattcagtaccgtgctttagctgagagtgctcaagatgctttttacaagctcagcaacaccaggaatcagattcaagcttatgtctttgacgtgatccgagcaagtgtgcctaagctggatctagactcaacctttgagcagaagaacgacattgccaaaaccgttgagagtgagctcgaaaaggctatgtcgcattacgggtatgagatagtccagacgcttattgtggatatcgagcctgatgtgcatgtcaagagagctatgaatgagatcaacgctgcttcgagaatgagagaggcagctagtgagaaagcagaggcagagaagatacttcagatcaagagagccgaaggagaagctgagtccaagtacctttcgggtctcggtatagcacgtcagagacaagccatcgtggacggtctgaggaacagcgtgctggccttctccgagtctgttccagggacgtcttccaaggacgtcatggacatggttctggtcactcagtactttgatactctgaaggagattggtgcgtcttccaagtcgaactcggtgttcataccgcacggtccgggtgctgttaaggacattgcttcgcagatcagggatggtnttnttcagggaaacgctgctgctgagtgattatgagtgagtgatgagagattttaataagtacaaaagccttttnttcngngtggtttagttggngtngctacttatttatttttcntttagcggttgggcttttntagtattgaagtccttatggattgcttatcnttggtagactggatcatgtttanggttttgggctttgatagtatatgacgcaatttgggtttaagtacagagttttattatc

SEQ ID NO: 3814 - DNA, 1064 bp, Scabiosa columbaria
tatttccaagtctccttcctctccgttcaccttcgatttctaactaacttcaactctaagaagcctgcagatttgaaaaatgggtcaaacgttgggttgcatccaagtagaccaatctaatgtggttgttaaggaacactttggtaggtttgatgagatacttgatccaggctgtcactgcatgccttggtgtcttgggtatcagatagctggtcaactatctttgcgtgttcaacaacttgatgtccgatgtgaaactaaaactaaggacaatgtttttgtcactgtcgttgcatctattcagtatcgtgctctagctgagaaggcatctgatgctttttataagctctccaatacaaagggacagattcaagcctatgtctttgatgtcattagggcaagtgtgccgaagttgcttttggatgatgcttttgaacagaagaatgacatagccagagcagtagaagaagaactagagaaggccatgtctgcctacggttatgaaattgtccagaccctcattgtggacattgaacctgatgcccaagtaaagagggccatgaacgagatcaatgcagctgctagaatgaggttagctgcgaacgaaaaggctgaagcagaaaagatactgcagataaagcgtgcagagggagaagcagagtccaaatacctttctggtcttggtatagctcgacagcgccaagcaattgtggatggactaagagacagtgtcattgccttctctgagaacgtgcctggaacatcagccaaggatgttatggatatggtgctggtgactcagtactttgatacaatgaaagaaattggtagttcctcaaaagcctcagctgtgtttattccccatggccctggtgctgttaaggatatcgcctcccagatccgtgatggtcttcttcaaggcaacatggcgcagtagatatggcaagtgttatagaacatgaagttggttttgggtgtggataaagtgatggtttctattgaactatataggtttctattaaaagttgttttaattagttgaatattttagggaagatggtttg

SEQ ID NO: 3815 - DNA, 1321 bp, Glycine max
ctttaccttattccttcgctcccactttccttctcttttcctcttaatttctaactccctccctataagtataattatcatcatcttttcttttcaattttcattgacactctctttgctattatcaaattcaagttctcattatcaaggtgttttgatctgttgagggggtttaatactgaaaatgggacaagtgttaggttgcgtgcaagtggatcagtcaagtttggccatcaaggaggttttcgggaagtacgatgatgttctcgaacctggttgccactgtgttccatggtgtttcggcagtcgtgtggctggtgctctttctttgcgtgtcaaacagctagatgttcgctgtgaaaccaagactaaggacaatgtctttgtgactgtggttgcttctatccaatatcgagcattggcagaaaaggcagtggatgcttactacaaactcagcaataccagatcacagattcagtcctatgtctttgatgttatcagagcaagtgttccaaagatggaactagatgctacttttgagcagaagaatgaaattgcaaaagcagtggaggaagaacttgaaaaggctatgtcagcttatgggtatgagatagttcagacgcttattgtggatattgagccagatgagcatgtgaagagagccatgaatgagattaatgctgctgcaagattgagggtggctgcaaatgagaaagctgaagcagagaagatattgcagataaagcgagcagaaggggatgcagaatcaaagtacctagcaggccttgggattgctcgtcagcgccaagccatagtagatggcctgagggacagtgtgctggctttctctgagaatgttcccgggacaacatcaaaggatatcatggacatggttctcatgacccaatattttgacacaatgaaggacattggtgcatcctccaaatccaatgctgttttcattccacatggacctggtgctgtacaagacgttgcttcacaaattaggaatggtcttctccaaggaaatgcaacacagtcttgaaggattgacatcacatactactactctactagtagttgagcttcccaaccatatgcatatatcttctcaaccacatccaaacgttttttgttttttatatatatgtcgttgccatctttgtcctctgggtttctatctagttcaatcctttttagtttgtgaatatagtaatgatagtgggcaaaattgctttatttgtgatttatagtttgtgtttgcgttaatgttatgtagatttatcctttgctttgtcttctatgagaatgagaattaccg

SEQ ID NO: 3816 - DNA, 1934 bp, Glycine max
aaaaataattaatattatagtaaaaatcagagggagtagtatagtatcattatcaatccacgctttgcctcctttcgcggtagaacgacgcggtaacgacgatgacaaggtgcgttgtattttactattttggtgcatttggattctgaaaactgaaaaccttgcgaagctgctttatcactgccattactttaccttattccttcgctcccactttccttctcttttcctcttaatttctaactccctccctataagtataattatcatcatcttttcttttcaattttcattgacactctctttgctattatcaaattcaagttctcattatcaaggtgttttgatctgttgagggggtttaatactgaaaatgggacaagtgttaggttgcgtgcaagtggatcagtcaagtttggccatcaaggaggttttcgggaagtacgatgatgttctcgaacctggttgccactgtgttccatggtgtttcggcagtcgtgtggctggtgctctttctttgcgtgtcaaacagctagatgttcgctgtgaaaccaagactaaggacaatgtctttgtgactgtggttgcttctatccaatatcgagcattggcagaaaaggcagtggatgcttactacaaactcagcaataccagatcacagattcagtcctatgtctttgatgttatcagagcaagtgttccaaagatggaactagatgctacttttgagcagaagaatgaaattgcaaaagcagtggaggaagaacttgaaaaggctatgtcagcttatgggtatgagatagttcagacgcttattgtggatattgagccagatgagcatgtgaagagagccatgaatgagattaatgctgctgcaagattgagggtggctgcaaatgagaaagctgaagcagagaagatattgcagataaagcgagcagaaggggatgcagaatcaaagtacctagcaggccttgggattgctcgtcagcgccaagccatagtagatggcctgagggacagtgtgctggctttctctgagaatgttcccgggacaacatcaaaggatatcatggacatggttctcatgacccaatattttgacacaatgaaggacattggtgcatcctccaaatccaatgctgttttcattccacatggacctggtgctgtacaagacgttgcttcacaaattaggaatggtcttctccaaggaaatgcaacacagtcttgaaggattgacatcacatactactactctactagtagttgagcttcccaaccatatgcatatatcttctcaaccacatccaaacgttttttgttttttatatatatgtcgttgccatctttgtcctctgggtttctatctagttcaatcctttttagtttgtgaatatagtaatgatagtgggcaaaattgctttatttgtgatttatagtttgtgtttgcgttaatgttatgtagatttatcctttgctttgtcttctatgagaatgagaattaccgataggctcatttttcctagtggatagtgctttcaaatcagatgacgagtttgccctacgagaaattgggaagacattgtcctggattaaggacaatgtatgcatcacaagttgagccaaccatttctagaccagatataattttcttagtgttacaagttgagtcaatatatgcagcaacctcgcattcctgacttacatgcgatccatcacttgatagttgatatcatgtatctcaaactcaaagtagctcctgctcaaggactattgtttcttgtttcgaatcctcttaatttgtgtgcctatgtcgatgatgactaggttagttgcttggaaactttctaggcaatgcgctgatctctttggaagtccaagaagcctactgtgtccaaatctgcaatttgcaagtgaactggtgtagctca

SEQ ID NO: 3817 - DNA, 1284 bp, Panicum virgatum
ggatctccaccacctccccccacctcacacacacatacccaacccaaaaaccccaaccgcgtcggccgtcggctacagctttaccctcgcgcctcgcttcagcccggttccgcgctcaaggatcgatcggctgagataagacatgggtcagattttgggtttagtgcaagttgatcagtcaactgtagccatcaaagaaacttttggcaagttcaatgaggtcctggagcctggttgccactttctaccctggtgcatagggcagcagattgctggttacctctccttgcgtgtgcggcagctggatgtccgctgtgaaacaaagacaaaggacaatgtctttgtcactgttgttgcatctgtccaatatcgcgctcttgctgataaggcatccgatgccttctacaagctgagcaacaccagggaacaaattcagtcatatgtatttgatgtcattagagctactgttccaaagctggacctggacgatgcatttgagcagaagaatgatattgcaaaagctgttgaagatgagcttgaaaaggcaatgtctacatatggctatgagatcgtgcaaacgctcattgttgatattgagcctgatgaccgtgtcaagagagcaatgaacgagatcaatgcagctgctaggatgagggtggcagccagtgagaaagctgaggccgagaagatactccagatcaagaaagccgaaggagaggctgaatccaagtacctggctggtgtgggtattgcaaggcagcgtcaggccattgtggacgggctgagggacagtgtgctcgccttctcagagaatgtccctggcaccactgccaaggacatcatggacatggtcctggtcacccagtacttcgacaccatgaaggagattggagcctcatccaagtcctcttcagtgttcatcccccatggtcctggagctgtcaaagatgtggcggcgcagataagagatggcctcctgcaggccaatctgcagtgagagggctctgagggggaaaagaagattggttttgattgcaaagcagtgtcgacggcatctgttatatggtgctatgaagttgtgaattatatgatatagatagacttgcatggtttgtgaaatgttagtaggctttatatcgactggagcacttgcgagtgagcctagatatccaaacctgtcatagtgtcagttattttggtgacctcctactatgctatatatttgtgtggaaagtccatctggataggactcagagctattaattgaaagtgcagcttctcaga

SEQ ID NO: 3818 - DNA, 1005 bp, Fagopyrum esculentum
ataagtgtcatggggcaaaactatcggacttcttcaagttgaccaatcgactgttgcgatacaaagaaaacttttgggaaatttgatgatgttctagatcctgggtgtcattgggtaccatggtggtttgggagtcaaatagctggtattctatctttacgtgtgcagcaactcgatgttcgttgcgaaacaaagactaaggataatgtgtttgtcacggtggttgcatcaattcagtaccgggcaatggcagaaaaggcagctgattcattttacaaactcagtaacacaagggagcaaatccaagcttatgtgtttgatgtgattcgtgcaagtgtaccgaagctgaaactggatgatacatttgtacaaaagaatgatattgcgaaagctgtagaagatgagcctgagaaggccatgtcgaattatggttatgagatagtccagacactcatagtggacattgagcctgatgttcatgtgaagagagccatgaatgagatcaatgcagctgctaggatgagagtggcggcaaacgataaggcagaagctgagaaaatcctgcagataaagaaagctgagggagaagcggaagcaaagtatctggcgggtctgggtatagcgagacagcgtcaagccatagttgatgggttgagggaaagtgttatcaacttctcaagcaatgtgccagggacaacagctaaggatgtcatggacatggttctcgtgacccagtactttgacacaatgagagagattggggcttcatctaagtcgtcgtctgtgttcattcctcacgggccaggtgctgtcaaggacatcgctgttcaaatcagggatggtcttctacagggtaatgctgctcgggattagtgcgctaatcgaggcttattgtttgtgttttggaaatggcgtcacatattgagtatgttttttatggtttgtgtgggttttgaccaataacgttggatactgggtacgagtaagaaactgtgtagtaaaaaa

SEQ ID NO: 3819 - DNA, 1189 bp, Sequoia sempervirens
gccgaagaaactgggaaaaaatttgctggctcagtactcggcaataacaaaatggggcaatatttatgctgttgtgtacaagtggagcagtcaaatgttgccttgaaagagagatttggacgctatgaggaagttcttgaaccaggatgccattgtcttccatggtttttagggagtcaaattggaggccatctttctttgcgggtacaaaagctagatgttcgttgtgaaacaaagactaaggataatgtatttgtgacggtgattgcttccgtgcaataccgtgctctcctagagaaagcaagtgatgcattctataaactaagcaatacaagggaacaaatccaagcttatgtatttgatgtcattagatcaagtgtcccaaagatgaacctcgatgatgtttttgagcaaaagaatgaggtagctaaagctgttgaagacgaacttgaaaaggctatgacaacctatggctatgagattgtgcaaacgcttattgtggatatagaacctgatgaaactgtgaagagagcaatgaatgaaataaatgcagctgcaagaatgagagtagcaacaagagacaaagctgaggcagagaaaattttgcaaatcaagcgagcagaagctgaagcagaatcaaagttcttatcaggacagggtattgcccgacaacgacaagcaattgtggatggtctaagggatagcgtccttgctttctctgttaatgtccctgggacaactgcaaaagatgtgatggatatggtgttagtgacacagtattttgacacaatgaaagagattggagcttcttcaaagtcttcatcagtcttcataccacatggacctggtgcagttcgtgacgttgctgaacagatcagagatggactgctacaggcacaggcacaggctcactgagtgttgtgtttctactacaaagctacaacatattcaagtacagacagtttgggcgtgtttaagatggaaaccagttcaaagctacaggagggttattctgatattttaaaattggtaagtttgtaaactttgttatgatatatagaaatgttgttttcgttggacctttctcttaccatgccatgagaaggctagaatgaaaacacttagaagagtgagttggagattctgagttttcagcattgatgcattgtaacaacttttttaaggtggt

SEQ ID NO: 3820 - DNA, 1176 bp, Secale cereale
ccagttagctcaaatcttcagcagtggttgtggcaccagtgctcaaagatcagaagagaggttaatagataagaatgggcaaactagttgcagcaataggcaagttgctctgctgtgtacaagtggaccagtcaacagtagccatcaaggaacgatttgggaaatttgaggatgtgcttgatccggggtgtcactgcgtgccatggattatcggaagccgtgttagtggtaagcttacacttaggcttaggcaaatggatgttcgctgcgagacaaagacaaaggataacgtttttgttacaattgttgcatccattcaataccgagcaatggaggacaaagcaaatgatgcgtattataagctgagcaacccgaaatctcaaatccaatcttatgtctttgatgttataagagcaagcattcccaaactacaactggatgatgttttcgagcaaaagaacgacatagcaaaatctgtggagcaggagcttgagaaggctatgtttgcttatggctatgagattgtgcagacactaattgttgatatagagccagatgaaaaggttaaaaaggctatgaatgaaattaatgccgctgcaagaatgcgtgttgcggcaaatgaaaaggcagaggcagaaaagatcgttcaaatcaagagagctgagggagaggctgaagctaagtatctctctggacttggaattgcaaggcagcggcaggcaatagttgatggcctcagagacagtgtgcttggcttttctggcaatgtgcctgggacttccgccaaggatgtgatggacttggttctgctcactcaatactttgataccatgaaagagatcggtgcttcatccaaatcttctgcagttttcctcccgcatggcccaggtgctgttgcagacattgccagtcagattcgcaatggatttcttcaggcgtccacacataatgcctgaactgaacccatgtgtacaagaatttgaattggtgaggtcattcctacatgctcctggtttgacataagaaaatggtcctttaagcgtgtgataatattgtgtgagtttgtgacttgtgagatatctacaaaagcttgtaaaatggtttgtattttataatgtatcagctggatgtattgaatgattgttgtgtggctatactcaggcttcaagaaaataa

SEQ ID NO: 3821 - DNA, 1278 bp, Sarracenia psittacina
aggaaacgcttcttccatgattcgccacgcccatgtaaagtatccttgttacccttctctgaggtagttgaaagttgaattagaacatgggaaatctactgggttgtgtacaagttgaacaatccacagttgctatcaaggagaggtttggcaggtttgaggaagtacttgatccagggtgccactgcgtaccttggttccttggaagtcagctggctggccatctttctgtccgcgtgcagcagttggatgttcgttgtgagaccaagacaaaggacaatgtattcgttaatgttgtggcatcggtgcagtatcgtgcccttgcaggcaaggccagtgatgctttctacaaactcaccaacacacgaagccaaatccaggcgtatgtttttgatgtaattagggcaagtgttccgaatctcaatttggatgatacttttgaacacaaaaataaaatagccaaagcggttgaagatcaacttgagaaggcaatgtctgcttatgggtatgagatcgtacagacactgattgttgacatagaaccagacgaacgtgtaaagcatgcaatgaacgaaatcaatgcggctgcaaggcagagggcggcagctaatgatagggcagaggctgagaaaattctacaaataaagcgagctgaaggcgaggctgagtcgaagtacctttcggggttggtatcgcccgcaacgtcaagcaattgttgatggtttgagagatagcgtgctaggcttctctggcaacgtgccgggaactactgcaaaggatattatggacatggtcctcgtcacccagtacttcgacactatgaaggaaattggtgctgctgccaaatcctctgctgttttcataccccatggacctggtgcggtgcatgatgtggctgctcagatccatgatggacttcttcaagcttctccacattgatcttcttaaagttgtgtttggcctagcttttttgtagtatttttggcctttttgtgtgtgtaaaaagtagatataaaaaaatgttaaaaaagccaactaattacaatggtaggccaaacaagtggactttttaaaaggctttttagcaaaaagcttataaaaaagcttggccaaatatagacttcatctcttaaatctgttccaattttggatcagaaaaggacttattttccaacttgctggtcttgtttggtttgatttcatgggattgtcttgcttccataactataactgtatattcctaaaattcataacaaatgttatatagtaacatggttt

SEQ ID NO: 3822 - DNA, 1239 bp, Triticum aestivum
acaatccgaactatcttcaccagttatctcaaatcttcagcagtggctgtggtgccagtgctcaaagatcaaaagagaggttaataaataagaatgggcaaactagttgcagcaataggcaagttgctctgctgtgtacaagtggaccagtcaacagtagccatcaaggaaagatttgggaaatttgaggatgtgcttgatcccgggtgtcactgtgtgccatggattatcggaagccgtgtcagtggtaagcttacacttaggcttaggcaaatggacgttcgctgtgagacaaagacaaaggacaatgtttttgttacaattgttgcatccattcaataccgagcaatggaggacaaagcaaatgatgcgtactataagctgagcaacccaaaatctcaaatccaatcttatgtctttgatgttatcagagcaagcattcccaaactacaactggatgatgtttttgagcaaaagaacgacatagcaaaatctgtggagcaggagcttgagaaggctatgtttgcttatggctatgagattgtgcagacactaattgttgatatagagccagatgaaaaggttaaaaaggctatgaatgaaattaatgccgctgcaagaatgcgtgttgcggcaaatgagaaggcagaggcagaaaagatcgttcaaatcaagagagctgagggtgaggctgaagctaagtatctctctggccttggaattgcaaggcagcggcaggcaatagttgatggcctcagagacagtgtgcttggcttttctggcaatgtgcccgggacttccgccaaggatgtgatggacttggttctgctcacccaatactttgacaccatgaaagagatcggtgcttcatccaaatcttctgcagttttcctcccgcacggcccaggtgccgttgcagacattgccagtcagattcgcaatggatttcttcaggcgtccacacataatgcctgaactgaacccatgtgtacaagaatttgaattggtgaggtcattcctacaggctcctggtttgacataagaaaatggtcctttaagcgcgtgataatattgtgtgagtttgtggcttgtgaggtatctataaaagcttgtaaaacggtttgtattttattgtgtactatcagctagtccgtagataaatggagcatggggacttaagatggatgtattgaatgattatcatgtggctatacttaggcttctgagaaaataatgttt

SEQ ID NO: 3823 - DNA, 1324 bp, Triticum aestivum
ataaaagcactccccatgctcctagataattcaagacaaaatccagttatcccatatcctcttcaacaatccgaactatcttcaccagttagctcaaatcttcagcagtggttgtggtgccagtgctcaaagatcagaagagaggttaatagataagaatgggcaaactagttgcagcaataggcaagttgctctgctgtgtacaagtggaccagtcaacagtagccatcaaggaacgatttgggaaatttgaggatgtgcttgatccggggtgtcactgtgtgccatggattatcggaagccgtgtcagtggtaagcttacacttaggcttaggcaaatggatgttcgctgcgagacaaagacaaaggataacgtttttgttacaattgttgcatccattcaataccgagcaatggaggacaaagcaaatgatgcgtattataagctgagcaacccaaaatctcaaatccaatcttatgtctttgatgttatcagagcaagcattcccaaactacaactggatgatgtttttgagcaaaagaatgacatagcaaaatctgtggagcaggagcttgagaaggctatgtttgcttatggctatgagattgtgcagacactaattgttgatatagagccagatgaaaaggttaaaaaggctatgaatgaaattaatgccgctgcaagaatgcgtgttgcggcaaatgaaaaggcagaggcagaaaagatcgttcaaatcaagagagctgagggagaggctgaagctaagtatctctctggccttggaattgcaaggcagcggcaggcaatagttgatggcctcagagacagtgtgcttggcttttctggcaatgtgcctgggacttccgccaaggatgtgatggacttggttctgctcactcaatactttgacaccatgaaagagatcggtgcttcatccaaatcttctgcagttttcctcccgcatggcccaggtgctgttgcagacattgccagtcagattcgcaatggatttcttcaggcgtccacacataatgcctgaactgaacccatgtgtacaagaatttgaattggtgaggtcattcctacaggctcctggtttgacataagaaaatggtcctttaagcgcgtgataatattgtgtgagtttgtgacttgtgagatatctacagaagcttgtaaaatggtttgtattttataatgtatcagctagtccttagatatccgtagataagtgcctaaatatatacaaaatggagcatggggacttaagatggatgtattgaatggttgttgtgtggctatacttgagcttctgagaaaata

SEQ ID NO: 3824 - DNA, 1312 bp, Panicum virgatum
gcagaattcaattaatccatatagttgtcaaccatctgttgtggacgctttcaccggcaaggcgtacgcacgcaggaacaagaagcaacagacattagaatggggaaactactggcagcagtcggcaagttcttctgctttgtacaggtgaaccagtcaacagtaggcatcaaagagagatttgggaaatttgaggaagttctcaatcctggatgccattttatgccatggatcattggaaaccgtgtcaccggtcagctcactctaaggcttaggcagcttgatgtccgctgtgagacaaaaacaaaggataatgtttttgttactgttgttgcatccatccaatatcgagcaatggaagacaaagcaagtgatgcatactacaagctgagcaacccaaaagctcaaattcaagcatatgtcttcgatgttataagggcaagtattcctaaactagaactggatgatgcttttgagcaaaagaatgaaatagcaaaagctgtggaggaggagcttgaaaaggcaatgtttgcttatggttatgagattgtgcaaacactcattgttgatatagaaccagatgagaaagttaaaagggctatgaatgaaattaatgctgctgcaagactccgtgttgcagcaaatgagaaggcagaggcagaaaagataattcagatcaagagggctgagggtgaggctgaagccaagtatctctctggccttggtatagcaaggcagcgtcaagccatagttgatgggctaagagatagtgtgcttggctttagcggcaatgtgcctgggacttcagctaaggatgtgatggatttggttctgctcactcaatactttgacaccatgaaagagatcggagcagcatccaaatcttctgctgttttcctcccacatggtcctggtgctgttaaagatattgccggtcagattcgtgatggatttcttcaggcatctactcaggaggcaaagtgataattgcattgatagcgagaattccataaacatgaatctcgattagcaaggctattagtttgtcataactgtgattggtcctttacatgccttgagaatattgtgtgagatcgttaaagtatcaagcctgtatatgcttatagattaggaggtctgtgtaaagatgtctcatatacaaaatgtagtgtgatcaccttacaagaatctagttaattatagtggtgtgaatgtgtgaccaagcatgcgagagctttcatatctttcgcaacttcgatacacagctttgttttcacagactccagaagtccattgtaaggttacacatata

SEQ ID NO: 3825 - DNA, 1518 bp, Sarracenia psittacina
tattgaaggatgggtcaagcattgggttgcgttcaagtggatcagtctacagttgcagttaaggagcagtttggaaagtttgatgatctgcttgagcctgggtgtcactgcttgccatggtgtttgggataccagttagctggggaattatcgttacgtgtgcaacagctagatgttcgctgtgaaacaaaaaccaaggataatgtctttgttaatgttgtcgcatccattccatacgtgccttggcagaaaaagcatctgatgctttctacaagctttccaacaccaaaggacaaatccaagcctatgtttttgatgttattagggcaagtgtaccaaagatggacttggattccacttttgagcagaagaatgaaattgcaaaagctgtggaggaagaacttgaaaaggctatgtctgcatatgggtatgaaatagtccagactcttattgtggatattgagcctgatattaatgtgaagagggcaatgaatgagataaatgcagctgctagaatgagggttgctgcaaatgagaaggctgaagcagagaaaatattgcagatcaagcgagccgagggagaggccgagtctaaatacctttcagggctcggtattgctaggcagcgccaagctatcgtggacggactgagggacagcgtgcttgctttttcctccaacgtacccggaacatccgccaaagacgtcatggacatggtgttggtgactcaatacttcgacaccatgaaggagatcggggcatcctcaaagtcctctgcagttttcatcccacatgggcccggtgcagtgagagatgttgccgcgcagatccgcgagggtcttcttcaggctgacagtgttcagcagtagcttgtaagcagatggcattagcttgtgagcaaatgggaagctaaaggttggaccttccaggtttcctttttatagttactgaatttcatgcttgattgctgctgaaatgttgattggtaatcgtcatgttttgcattaattttctcctttttttttttaaagtggtatagaattgtgggatttgaatcctcgtatgtgatgcacatatagtcttgtggttgcacagtatggtttgtaaacttggttttcattacgatatgaattaccttgtaactggaaaggatgatggtaattcttatttgaagttttggttttgtctgttgccctttgatttcgggtaatggggagcctgtgtggatacaaatttgaatggttttggatctcttataatttgtattagaattgtttagttttttctactcgtcgattagttaattcttgtgaaaattaggtccattggagttcgttttatatatatatatatatgagcatatcagtagtgaaaaaaacccattgaattctaaaattttgagattaaaatacaaaattgacctgattttttacatgaattacctactcaatgagtgaagaaaaataaagagttccgatcaaattataaagaatccataatcattcaaatttgtgctca

SEQ ID NO: 3826 - DNA, 1256 bp, Triticum aestivum
aacaagtgatcagaagcgcttccccagttggcatcatcctgcagacagcgtttaggatgggcatcatctttatctcccactatatatgtatgtgcagcatgcttcgtctagttcccaacttcccaagaacaccctcaagcatacaagccttgggtttctactctgcactgaactaattgataagcataaaccatgggtggggtacttggtttgatacagattgatcaatcaacagtagccatcaaggagaccttcgggaagtttgatgccatcctgcaacctggatgccactgcttgccatggtgcctagggcagcagattgctggatatctttctctgcgtgtgcaacagcttgatgtccgatgcgaaacaaaaacaaaggataatgtctttgtcaacgttgtggcatctgtgcagtaccgtgctcttgctgacaaggcatctgatgccttttacaggcttagcaacaccagggagcaaatccagtcctatgtctttgatgtgatcagggctagcgttccaaagatgaacttggatgatgtatttgagcagaagaatgaaatagcaagggctgtggaggatgaacttgaaaaggcaatgtctgcctacgggtacgagattgtgcaaactctgattgttgatattgaaccagatgaacatgtgaagagagccatgaatgagatcaatgcagctgctaggatgaggctggcagccactgagaaagccgaggccgaaaagattcttcaaatcaagagggctgaaggtgaggcagaatcgaaatacttggctggtgtgggtattgcaaggcagcgccaggccatagtggacgggctgagagacagtgttctggccttctctgagaatgtgcctgggacctcttcgaaggatgtcatggatatggttttggtgacgcagtattttgatacgatgaaggacattggggcctcttcaaagtcttcagcagtgttcatccctcacggacctggcgctgtcaaagacatcgcttcgcagatacgagatggtcagctccagggcaggatggtttgaggagtgttggaaaatggataccacttttatatgcatactttaagtacatacagcttattcttatactatgtgtgaggtgaggttgtgcctagatggatgttaatatcagtacttgctttggttgtgccacccgtttctgtaaaaaatatcagttgtgctatcactgtgttcgcagctatttgtgtattgagagtgttatatgttactat

SEQ ID NO: 3827 - DNA, 1253 bp, Triticum aestivum
caacccatccaagcggcagcagggcagacggccggcgacgaaccaatccagccagccgaactcgtcagcgcgcagcagcctctcccgcgagataaaccatgggtggggtacttggtttgatacagattgatcaatcaacagtagccatcaaggagaccttcgggaagtttgatgccatcctgcaacctggatgccactgcttgccatggtgcctagggcagcagattgctggatatctttctctgcgtgtgcaacagcttgatgtccgatgcgaaacaaaaacaaaggataatgtctttgtcaacgttgtggcatctgtgcagtaccgtgctcttgctgacaaggcatctgatgccttttacaggcttagcaacaccagggagcaaatccagtcctatgtctttgatgtgatcagggctagcgttccaaagatgaacttggatgatgtatttgagcagaagaatgaaatagcaagggctgtggaggatgaacttgaaaaggcaatgtctgcctacgggtacgagattgtgcaaactctgattgttgatattgaaccagatgaacatgtgaagagagccatgaatgagatcaatgcagctgctaggatgaggctggcagccactgagaaagccgaggccgaaaagattcttcaaatcaagagggctgaaggtgaggcagaatcgaaatacttggctggtgtgggtattgcaaggcagcgccaggccatagtggacgggctgagagacagtgttctggccttctctgagaatgtgcctgggacctcttcgaaggatgtcatggatatggttttggtgacgcagtattttgatacgatgaaggacattggggcctcttcaaagtcttcagcagtgttcatccctcacggacctggcgctgtcaaagacatcgcttcgcagatacgagatggtcagctccagggcaggatggtttgaggagtgttggaaaatggataccacttttatatgcatactttaagtacatacagcttattcttatactatgtgtgaggtgaggttgtgcctagatggatgttaatatcagtacttgctttggttgtgccacccgtttctgtaaaaaatatcagttgtgctatcactgtgttcgcagctatttgtgtattgagagtgttatatgttactatatggttattatactataatttctatgttgctactagtattttcattcaaatcttggaaaccttggaattttggagattgttctgaagctcc

SEQ ID NO: 3828 - DNA, 1111 bp, Triticum aestivum
ccaacccatccaagcggcagcagagcagacggccggcgacgaaccaatccagccagccgaactcgtcagcgcgcagccgcccttcccgcgagataaaccatgggtggggtacttggtttgatacagattgatcaatcaacagtagccatcaaggagacttttgggaagtttgatgcgatcctgcaacctggatgccactgcttgccatggtgcctagggcagcagattgctggatatctttctctgcgtgtgcagcagcttgacgtccgatgcgaaaccaagaccaaggataatgtctttgtcaacgttgtggcatctgtgcagtaccgtgctcttgctgacaaggcatctgatgccttttacaggcttagcaacaccagggagcaaatccagtcctatgtctttgatgtgatcagggctagcgttccaaagatgaacttggatgatgtatttgagcagaagaatgaaatagcaagggctgtggaggatgaacttgaaaaggcaatgtctgcctacgggtacgagattgtgcaaactctgattgttgatattgagccagatgaacatgtgaagagagccatgaatgagatcaatgcagctgctaggatgaggttggcagccactgagaaagccgaggcggaaaagattctgcagatcaagagggctgaaggtgaggcagaatcgaaatacttggctggtgtgggtattgcaaggcagcgccaggccatagtggacgggctgagagacagtgttctcgccttctctgagaatgtgcctgggacctcttcgaaggatgtcatggatatggttttggtgacccagtacttcgataccatgaaggacattggggcctcttccaagtcttcagcagtgttcatccctcacgggcctggcgctgtcaaagacatcgcttcgcagatacgagatggtcagctccagggcaggatggtttgaggagtgttggaaaatggatgccacttttatatgcatacttttaagtacatacagcttattcttatactatgtgtgaggtgaggtgaggttgtgcctagatggatgttaatatcagtacttgcttgggttgtgcaactcgtatctgtaaaaagtaaaa

SEQ ID NO: 3829 - DNA, 1104 bp, Triticum aestivum
taccctgcactgaactaattgagaagcataaaccatgggtggggtacttggtttgatacagattgatcaatcaacagtagccatcaaggagacttttgggaagtttgatgcgatcctgcaacctggatgccactgcttgccatggtgcctagggcagcagattgctggatatctttctctgcgtgtgcagcagcttgacgtccgatgcgaaaccaagaccaaggacaatgtctttgtcaacgttgtggcatctgtgcagtaccgtgctcttgctgacaaggcatctgatgccttttacaggcttagcaacaccagggagcaaatccagtcctatgtctttgacgtgatcagggctagcgttccaaagatgaacttggatgatgtatttgagcagaagaatgaaatagcaagggctgtggaggatgaacttgaaaaggcaatgtctgcctacgggtacgagattgtgcaaactctgattgttgatattgagccagatgaacatgtgaagagagccatgaatgagatcaatgcagctgctaggatgaggttggcagccactgagaaagcggaagcggagaagatactccagatcaagagggctgaaggtgaggcagaatcgaagtacttggctggtgtgggtattgcaaggcagcgccaggccatagtggacgggctgagagacagtgttctcgccttctctgagaatgtgcctgggacctcttcgaaggatgtcatggatatggttttggtgacgcagtacttcgataccatgaaggacattggggcctcttccaagtcttcagcagtgttcatccctcacgggcctggcgctgtcaaagacatcgcttcgcagatacgagatggtcagctccagggcaggatggtttgaggagtgttggaaaatggatgccacttttatacgcatacttttaagtacatacagcttattcttatactatgtgtgaggtgaggttgtgcctagatggatgttaatatcagtacttgcttggattgtgccactcgtttctgtaaaaaatataagttgtgctatcactgcgttcaccactatttgtgaattgagtgtgttatatggttattatacta

SEQ ID NO: 3830 - DNA, 1294 bp, Zostera marina
tataaaagagggttcaatttgttcaactactccgttcctcttttcattccatcctccaaagacttatcggatttgaaaatggggcaggcacttggatgtatccaagtggatcagtcgacaatagctatcgaagaaggttttggtaagtttgacgaagtgcttcaacctggatgtcactgtgtgccatggtgttttggtaaaaacatagttggatatcttagtttacgaatacagcaactcgatgttcgttgcgaaacaaaaaccaaggataatgtatttgttactgttgttgcttctattcaataccgcgcattacctgaaaaggcagaagatgcttattacaagctaagcaacaccagggagcaaatccaagcatatgtttttgatgtcatcagggcaagtgtgccaaaattgattttagatgacgtatttgagcagaagaatgatattgctaaatctgtcgaggaagagctttccaaggccatgtcaacttatggatacgagatagttcagacactcattgtagatattgaacctgatgaacgtgtaaaaagggccatgaatgagataaattccgctgcaaggctgagggtggctgcgaatgaaaaggctgaagcagagaaaatactgcagataaagcgtgctgaaggagatgcagagtcgaagtacctgtctggtctgggaatagcacggcagcgtcaggcaattgttgatggattgagggaaagtgtgcttgctttctccggtaatgtaccaggaaccaccgcaaaggaagtcatggatatggttctagttactcaatactttgataccatgaaagagattggagcttcttcaaagtcatcttctgtgttcattccacacggtcctggtgctgtcaaggacgtcgtctcacagatcagggatggtcttcttcaggccaacgaggccgggaattaatatcgtgtgttaaatctgaagtccactacgtgtttatatggttttatcaaatcccatcattcttatctacaaatccactaaacagtttgatttaatttggtttggtttgtctgtgtttgtattgtacatcaggtattttcttgttttgtgtgcttttaaaaacctcattgaaatctttacatcaacttcctaagatgtataggaatgttatttgtaagtatagggtttgtgaacatgatctgtatagctttcttttgtgtgaattatgatttctgaaaactatttgctctggaagatttagaagacttgattcttataaaatgcaataaaaaagttatatcttcagagtatgaaa

SEQ ID NO: 3831 - DNA, 1371 bp, Arabidopsis thaliana
attttagtaccagtcgtggtataaatattaacacttactgattgccgagagacgaaagaggaaaatcccaacaataaagagcaaaagatcttacagctcataatatttcgttaattatcaaattgctaataggtaatttcgcggaatcttcctttgtaatttcctccaactttctctgctttgcttataattgcgtctttgcttcctcctttacctttacgcggcacatagattattctctccaagagaaaaaaatgggtcaagctttgggttgtattcaagttgatcagtcgaatgtagcaatcaaagagacttttgggaagtttgacgaagttcttgagccgggttgtcactgtttgccatggtgtttgggaagtcaagtcgctggtcacctttctttacgtgttcaacagctcgatgttcgctgcgagacaaagactaaggataatgtgtttgtcacggttgttgcttccattcaataccgtgccttagcggagagtgctcaagatgctttttacaagctcagcaacacaaggaatcagattcaagcttatgtctttgatgtgatccgagcaagtgtacctaagctggatctagactctacctttgagcaaaagaatgacattgcaaaaaccgttgagactgagctcgaaaaggctatgtcgcattacgggtatgagattgttcagacactgattgtggatatcgagcctgatgtgcacgtcaagagggcaatgaatgagatcaatgctgcttctagaatgagagaggcagcgagtgagaaagctgaggcagagaagattctgcagatcaagcgtgctgagggagaagctgaatcgaaatacctttcaggtatgggtatagcccgtcagagacaagccattgtggacggtctgagaaacagcgtcctcgccttctccgagtctgttccaggaacatcttccaaagacgtgatggatatggttcttgtgactcagtactttgacacattgaaggaaattggtgcttcttcgaagtcaaactcggtgttcataccgcacggtccaggcgctgttagggacattgcttcacagatcagggatggtcttcttcagggtaactctgctgctgagtagagaaatgtctcaaagtacaaaaaggctttttcagagttttagagttgtgttactacttgctactcagtttatcttttagcggttggctctatatgggttcttaaatttcttatcgtttctctcttctaggcttgtggacttgatccattttcttgttttatgggtttgtggatagagtttgggcttgaaaaatatttgtgttattttgggttttaatgtcgttaactcgttattaatgtttaaacagtggttaaag

SEQ ID NO: 3832 - DNA, 2003 bp, Brachypodium distachyon
ggaagtgacactaacaaaaaccacctgctttgctgccgagcatatatataccgtaatcccctgggcaagcggaaaaccccaaactccctccgatttcttccggccaaatcattggcgtcctcatctgctctcgaagattcaggataaatcatggctgggattttaggtttagtgcaggttgatcagtcaactgtggccataaaagaaacttttgggaaatttagtgaggtgctggagcctggttgccacttcttaccttggtgcataggacagcggattgttggttacctctcactacgtgtgaaacagctagacgtccgctgtgaaacaaagacaaaggataatgtctttgtaactgttgttgcttctatccaataccgtgcccttgcggataaggcgtcagatgccttctacaaactaagcaacacaaagcaacaaatccaatcctacgtctttgatgttatcagagccactgtcccgaagctgggactggatgatgcatttgagcaaaaggatgacattgcaaaagctgttgaagaggagcttgaaaaggcaatgtctatgtatgggtatgagattgttcaaactctgattgttgatatcgagcctgatgtgcatgtaaagagggctatgaatgagatcaatgcagctgctagaatgaggtcagcaaccaatgagaaagctgaagctgagaagataattcagattaaaagagctgaaggagaagctgagtccaagtacttggctggtgtgggtattgcaaggcaacgtcaggctatagtggatgggctgagagacagtgtccttgccttctcggagaatgtccctggtaccactgcaaaggatgtcatggacatggtcctggtcactcaatacttcgacaccatgaaagagattggggcctcatccaagtcctcttcagtgttcatcccccatggtcctggagccgtcaaagatgtcgcatctcagataagagatggtctcctccagtccaatattgtctaagaggaccctggaaaggatggatggcttctgttttccaagagttgtgaatttctgcatcgctgtcctaagaatgtagtatgcgataaatgttagggaacatcaacaatttatccacatgcacgcactactgtcagttttacacgttgttattatctagataattgcccagtaagacttagatagccagacaactgtcttgaatggtacttgttgcaagtgagcctggatgaccattctttgcatatcatttggtgatactctactatgctgcatgagtgtatgttgatctgttcactccatctggaccagattgagcttaattgattttgagcagtttgttctagtgagcaaccttgagtcttacgtaccgagagccttgtgattgtgactagccttactaagagtctttcggcagcggtggcaggtcggccagtattgtcccaggtgcaattgtgttccatgatgtcgttgtggatgtttgttacggattttgtttggtcttctgctatttaactgggcaactcaccttgctttattaatggattgtgttctttgtccggttttctgccaattaactaggcaactcttttcgctttattaatggattgtgtactttggattcctgtaagaaaaaggaaaattcaccatgtaaaattacacataccgatttattaggtatgtacatgataaagagcagtcttctgcagttagcactggcactaatgctatacagtacaaatacacttatgtggtaataatgctcgagtgcgctgctaaaatggcaggtgaaggaatgaggggatcaggggaatgagcaagatcaagggcaccaggttcgcaggcttctgatcgagcaagtcgggcatggcggttgcgtctggcgttggaagctgaggccctgcagattccaggtctccaggtactcctttctccactcttcccgtagctcctcagaatcgcggtaccattgcctgataagtaaattcagatcataagtg

SEQ ID NO: 3833 - DNA, 3952 bp, Cannabis sativa
gtagcaaccgaatcaataaattttcagtgtattatgatagtctatcaacattgttccattgtttattgagagagaaaggtgaaagagaaaatgggacaagccttaggctgtgttcaagtggatcagtctaacgttgctattaaggaaacatttgggaagtttgatgatatacttgaaccaggatgtcattgtgtgccctggtttttcggaagcaacctggctgggcagctctcgcttcgtgttcagcagctagatgtccgttgtgaaacaaagacaaaggataatgtctttgtcactgttgtagcttctattcaataccgtgctatagcagagaaggcttctgatgcattctataagctcagcaataccagagcacagatccaatcttatgtttttgatgttatcagggcaagtgttccaaagctagatctggattcaacatttgagcaaaagaatgatatagcaaaagctgttgaagaggaacttgaaaaggccatgtcccattatggatttgagatagtccagacgcttattgttgatattgaaccggatgagcgtgtgaagagagcaatgaatgagattaatgcagctgctagaatgagggtagctgctaatgaaaaagctgaagcagagaagattctgcagattaagcgagcagagggggatgcagagtccaaatatctggcagggcttggcatagctcggcagcgccaagcaattgttgatgggttgagagacagtgtgctggccttctcttctaatgtacctgggacatcatcaaaggatgtcatggacatggttctagtgactcagtacttcgacacaatgaaagagattggtgcatcgtcaaagaccaattcagttttcattcctcatggaccgggtgttgtgagagacgttgcctcacagataagggacggctttattcaggcaaatgtcaattaggattgtagtaagtaatgtagatacatatgaatagtttgttttttgtacggacatacattttaagattgttcttagcgtgtctgactttcctttttcatttcgttgagcaaataaataaacccaccgtcgttgattgtaattgcaacatatttcaatgtaaagcgtattgattgtttgtccataaaacattaacctatcgtgttgttcacatgttaaacctatacttatttcacataacatatttttataccatgatccatctgattagtaagtatcatttaggttaaacctaaattcgacccataacctgaagtgccactcctacaatttactctttaaatccacaaggcatcaaaacgttttgcaccacgtagatgattagtttcttctagaatacttggctaaaaccgtatgtaaccaaagacgatatcaagttaataatggtgaaaccaaaaactacccagcaaaagaatttaggtcattatagagtaagatgtagcaacaatcttaaccagactatttgctttgtttcccgccaattgtgacaacaatgtaaataaaattttaaaaaatgggaaattgacattggtttgtgccaattattttatacaacccataaccaccacatataacgaaaccaataagcataacaccacacccaaagttcatcggaaatgttccagtcccttcctcttattcctgtccatgaagctcaaagaaaaaaccaacctttcgaatggaattagtctcaaggcttgagtaccaaagctagaccaacctttgcactcttttcaattgccctggtatccacttctcctgagatggtgaagagagactttgggcgccactcatgttgaataagagcacttgccttcccataattgttcactctagctttcaaattggtcaagggatcaagtgcgtgttgtgtgccaatagtgagagtgttttcattgcttgaaaagctatgggaaaactctgcaccaacgttagtgttggtaagggggcttacagtatggtagtacgatgcagtaagggtgtcacctttatcatttctgcaaatatcgcacaactaggaataaatatttgcctgaaaagattaagcaagtaataaataagaaaaacaactcacaatatcagggaagcaatgagatcattgtgaatgaaattcaatcctgtattaaatttggtgaagttcccagatgctgtatcaaaggacaaatctgttccaactgccaaagaattgtttccaatcacaccagaaaagttgacactaggatttgcggtcaatccaatgctagtgctgatcccagcatactcgtgctgatattggagctcaacctatcacaccaaaatcgcgatatatggtttatgaataccaaaaagatctgccgattaatacagacatgttcacatcaacttcaaaacaataaagttactccttaccttcccagatctctgatcgggagcaataaagctaaagattgtcttaagtccaggtgctggttcatcaacggtgatggtggtgataagctatagattcatgtcccaacatttttcaaaagatcagcaacttaaaatcttataatttatcagcataatgatgacttttactcaagaattagattaaaagtataaccaaaaaaaattgtagtttatctaaacttacattagagttagtgtcaacttttatgtcagtcgtgatattcttgttcttcaactgagtgctcaaatctgccaaaaatagctcgcctttcttaactccagttgaagtaattgcctgagacgagtatgaattttgcatattagagaccatcataactatccaaaaccaatactattaacggactatggaagagtaatgctagtacaatagcatataaaaagcaaaaaaaaaccaaatgattccagaagacgtaaaaataaggcaggaagataagaaaaaagacattgcataactattgtttatagtatttggtacatgcatattatagtaaaaaaaaacactacaaatgaaatccgtattgaagtggtttaactaaccatggttaatttcaaagaaatataatttttttacaaagaaagtcaaaaatggatcaattgttcagcttgtttagtttttttcagcaaacttaatagctcaaaaacatggtttcacaaacatatacgttgcttattcaattacactaaaaattccattcactacaagtgataaatccattaagctttcttcttgagcttcccagaagatgtaagcaaaatcctatcgcaataccgtattaccttaaagttcactatcaacaataaaagagtgcataaacatattttacatgaaaacgaagtcaactctagataattagtcatccatcagaattcaattgtttttcctccgaattcaaaacctccatttaaatatatctatacataacatcaaaattaaaagaaaaaaaaatacggatatgcaataataatcactttaaaagaaagcttacaactccgttagaagtataggtagtgacagtaaacttatgatcagcctgataatctctgtacagaagatctgcaaaacgtaattgatttcacaaaaatgtaattagaccttgaatatatctatatacatataaatataacataaatcagaaagactgacctctggctttcttgccaatatcggtatagagacctggtcctttcaccatttttttccccgagaaaattcgaagggcgataaagggggaaaggagatagtttggaatcggaaccagttgtattgtactgtttgaaattaggggcagaaaatgagagaaatggagtatagaagacgaaaccctaggttcggtctacggtgcattgtttgatttggaccgttggatcatgtattgggtaagattcgcatcgctggccgtcaatctggttgtgataggggttttgggccttgttgagttttatgacctcgagaatcgggacaaattgggttcggcatattcgcctcatggtctttttctgc

SEQ ID NO: 3834 - DNA, 1274 bp, Cenchrus ciliaris
cacaaaaccccaatcgcgtcggctcccccaacctcctctgctttacccctctctgctccgcgccgctccggctccgcgcgcaaggatcgatcggccaagagataagacatgggtcaggttttgggtttagtgcaagttgatcagtcaactgtcgccatcaaagaaacttttggcaagttcagtgaggtcctggagcctggttgccatttcctaccctggtgcatagggcaacagatttctggttacctctccctgcgtgtgcggcagctggatgtccgctgcgaaacaaaaacaaaggacaatgtctttgtcactgttgttgcatctgtccaataccgtgcgcttgctgaaaaagcatctgatgccttctacaagctgagcaacaccagggaacaaattcagtcatatgtatttgatgtcattagagctactgttccaaagctggacttggatgacgcatttgagcagaagaatgacattgcaaaagctgttgaagatgagcttgaaaaggcaatgtctgcctatggctatgagattgtgcaaactctgattgttgatatagagcctgatgatcgtgtcaagagagcaatgaacgagatcaatgcagctgctaggatgaggttggcagccagcgagaaagctgaggctgagaagataatccagatcaagaaagctgaaggagaggccgagtccaagtacctggctggtgtaggtattgcaaggcagcgtcaggccattgtagacgggctgagggacagtgttcttgccttctcggagaacgtccctggcaccactgccaaggatatcatggacatggtcctggtcacccagtacttcgacaccatgaaggagattggggcatcatcaaagtcctcttcagtgtttatcccccatggtcctggagctgtcaaggacgtcgcggcacagataagagatggcctcctgcaggccaatcagtgagagggccctgagaaaagaaagtattggtttcgattgcaaacgcaatgttgagggcaccagtaatgtggtgctttaaacttgcgaattatattatatagctagacttgcatgttttttgaactgtcagtaggcttttatattgactgcagcagttgcgagtgagcctgaatactatatggttgtgtggaaagtccatctggattggacttggagcttaatattgaaagttaagcttccgagaattctgtgtttttttgctgcagtgatgttcttctgcaaaatctttggaatgacaagatatctgttgctggtga

SEQ ID NO: 3835 - DNA, 1411 bp, Leymus cinereus x Leymus triticoides
  misc_feature (7)..(10): n is a, c, g, or t
ttttccnnnnagacgcgcaagaacttgcagccagctataagttgtggggagaggcggaagaagaagccaaccaaaccaagcggcaagcagagcagacggccggccggacacgggacgacgaaccaatccaaccagccaaactcgtcagcacgcagcgcagcagcccagccacccttcgccgcgagataaaccatgggtggggtacttggtttgatacagattgatcaatcaacagtagccatcaaggagacttttggaaagtttgatgcgatcctggaacctggatgccactgcttgccatggtgcctagggcagcagattgctggatatctttcgctgcgtgtgcagcagcttgacgtccgatgtgaaacaaagactaaggataatgtctttgtcaacgttgtggcatctgtgcagtaccgtgctcttgctgacaaggcatctgatgccttttacaggcttagtaacaccagggagcaaatccagtcctatgtctttgatgtgatcagggctagcgttccaaagatgatcttggatgatgtatttgagcagaagaatgaaatagcaagggctgtggaggaggaacttgaaaaggcaatgtctgcctatggatacgagattgtgcaaactctgattgttgatatcgagccagatgaacacgtgaagagagccatgaatgagatcaatgcagctgctaggatgaggttggcagccactgagaaagctgaagcggagaagatacttcagatcaagagggctgaaggagaggcagaatccaagtacttgtccggtctgggtattgcaaggcagcgtcaggccatagtggacgggctgagagacagcgtcctcgccttctccgagaatgtgcctgggacttcttccaaggatgtcatggatatggtcttggtgacgcaatacttcgacacgatgaaggatatcggggcctcttccaagtcttcagcagtgttcatccctcacgggcctggcgccgtcaaagacatcgcttcacagatacgagatggtcagctccagagcaggatggtttgaagagtgttggaaaatggatgctacttctatatgcatacttttaagtacatacagcttattcttatactatatgtgaagttgtgcctagatggatgttaatatcagtacttgcttgggttgtgccactcgtttttctgtaaaaaatatcagttgtgctatcactgtgtttgccactatttgtgaattgagtgtgttatatggttattacactataatttccatgctgctactagttttttcattcaactctctgaaaccttggaattttggagattgttccgaagctccctacactgtaaaatttagccaaataggcccccagtttctcgttcttactacttaatgatatgttctttggtattta

SEQ ID NO: 3836 - DNA, 1204 bp, Petunia hybrida
ctttttgcttctctgctctattgttcacttcacagaattgaagtatgggtcaagcgcttggttgcattcaagtagatcagtcaactgttgctgtgaaagaacaatttggtaagtttgatgaagtgctggagccaggatgtcattgcttgccttggtgttttgggtatcaagtccctggttacctcccattgcgagtgcagcagattgatgttcgttgcgagacaaaaacaaaggacaatgtttttgtgactgtggttgcttccattcaatatcgagccttagcagaaaaagcagctgatgcattttacaagctttctaacaccaaaggacagatccagtcctatgtttttgatgttataagggccagtgtgccacgaatggaattggatgctgcatttgaacagaagaatgatcttgccaaagcggtggaggaagaacttgaaaaggctatgtctgcttatggatatgagattgtccagacactcattgtggatatagagccagatattaatgtcaagagggcaatgaatgagataaatgctgctgcaagactccgtgttgctgcgaatgagaaagctgaagcagagaaaatattgcagatcaagaaagctgaaggagaggctgaatccaagtacttgtcagggcttggtattgctcgacagcgtcaagccatcgtggatggcctccgagacagtgtgcttgctttctcagaaaatgtgcctggaacaacagcaaaagatgtgatggacatggttcttgttactcaatattttgatacaatgaaagaaatcggagcttcttctaagtcatctgcagtgtttatcccccatggaccaggtgctgtcaaagacgttgcttctcagatccgcgagggtcttcttcaggctgcaagtgttgggcaataagactaatgaagatgtagggataattgatagttgtgtgtggttcgatgcttttagttaattttgatacagtagatgctttatgtgtattaatgcgcataaaatccatagtttggtacatgctacgtctggttttaccatctactagtatatagattatttaccaactagttgctgacaaacggatagttttacagttgatcgtcatttctctgtctccaatagacatttcaggtatgattgttgccaagggtagattagctgctaattgaattagtcaaggtttctttgcccaaaaaaaa

SEQ ID NO: 3837 - DNA, 1150 bp, Raphanus sativus
  misc_feature (112)..(112): n is a, c, g, or t
ggacatcctcctcaagtagtttcgccgccgctgtccgaaaaaaaaaagaagagggtagtttcgctgtaccttccttcgtccttccctttaaacaaaaacaatgggtcaagtnttaggatgtgtgcaagttgatcaatcgactgtagcaatcaaagagacttttgggaagttcgacaatgttctccagccaggttgtcactgtatgccatggtgcttaggtagtcaagtcgctggtcacctttcattgcgtgttcagcagctcgatgttcgctgcgagaccaaaactaaggataatgtgtttgtaaccgttgttgcatccatacaataccgtgccttagctgaaagtgctcaagatgctttttacaagctcagcaacaccaggaaccagattcaggcttatgtctttgatgtgatccgagcaagtgttcctaagctggacctagactcaacctttgagcagaagaatgacattgccaaaaccgttgagagtgagcttgaaaaggctatgtcccattacgggtatgagatagtccagacgcttattgtggacattgagccagatgtgcatgtaaagaaggcaatgaatgagatcaatgccgcttcgagaatgagagaggcagcgagtgagaaagctgaagcagagaagatactgcagatcaagagagccgagggagaagctgaatcgaaatacctttcaggtcttggtatagcacgtcagagacaagccattgtggatggtctgagaaacagcgtgcttgcattctctgagtctgttccagggacttcttccaaagacgtcatggacatggttctgatcactcagtactttgacacacttaaggatattggggcgtcttccaagtcaaactccgtgttcataccgcacggtccaggcgctgttaaggacattgcttcacagatcagggatggtttacttcaggggaaagctgctgagtaagaagatgtcaaagtacaaaactttcttcagggttttagctgtttgtgtttctactttgtttttgtctttcgttttctgttttgtgaagtgtcttattagtctggcgttttacttgaatctctctcaataaagccatcttcttcagtagttgataatatcaattttctctaataacaacaaaaactatattcc

SEQ ID NO: 3838 - DNA, 1231 bp, Sorghum bicolor
cttggagttaggatatgctcggatgacaaatgaacggccttgcctttacactcttgtcctttacgtatgcattattggactgctggtagcatacatgacagacatcttattgtgtgcagataagacatgggtcaggctttgggtttagtgcaggttgatcagtcaactgtagccatcaaagaaaacttcggcaagttcagtgaggtcctggagcctggttgccacttcctgccctggtgcatcgggcagcagattgctggttacctctccttgcgtgtgcgccagctggatgtccgctgtgaaacaaagacaaaggacaatgtctttgtcactgttgttgcatctgtccaatatcgtgctctcgctgaaaaggcatctgacgccttctacaagctgagcaacactagggaacaaattcagtcgtatgtatttgatgtcatcagagctactgttccaaagctggacttggacgatgcatttgagcagaagaatgacatcgcgaaagcagtcgaagaggagcttgaaaaggcaatgtctatgtacggctatgagatagtgcaaacgctaattgttgatattgagcctgatgaccgtgtcaagagagcaatgaacgaaatcaatgcagctgctagaatgagggtggcagccagtgagaaagctgaggctgagaagatactccagatcaagaaagccgaaggagaggcggaatccaagtacctggctggtgttggtattgcaaggcagcgccaggccattgtggacgggctgagggacagtgtgctcgccttctcagagaacgttccaggcaccactgccaaggacatcatggacatggtcctggtcacccagtactttgacaccatgaaggagattggggcctcctccaagtcctcttcagtgttcatcccccatggccctggagctgtcaaggatgtcgcggcgcagataagggatggcctcctgcaggctaaactgcagtgagaggaccctgagaaaaaggattggttctgattcgcagaggggtgagggcatcggttcaatggtgctataaaattgctaattataatatagctagactttgcatggtttgcaaaagcttagttgtgacctgtgagtgagcctgggtatccaaacctgtcagctatttggtgatattctatgctctatgttctgcgtggataatcctatgggtcagactcagtttatagcattgaaagtgcaacttttgaga

SEQ ID NO: 3839 - DNA, 1198 bp, Triticum aestivum
ggccggagggaggcgaaagaagaagccaagcaaaccaagcggagagcagagcagacggccggccggacggggggacgaaccaatccaaccagccaagctcgtcagcacgcggcgcagcagcccagctacccttgccgcaagataaaccatgggtggggtacttggtttgatacagattgatcaatcaacagtagccatcaaggagacttttgggaagtttgatgcgatcctgcaacctggatgccactgcttgccatggtgcctagggcagcagattgctggatatctttctctgcgtgtgcagcagcttgacgtccgatgcgaaaccaagaccaaggataatgtctttgtcaacgttgtggcatctgtgcagtaccgtgctcttgctgacaaggcatctgatgccttttacaggcttagcaacaccagggagcaaatccagtcctatgtctttgatgtgatcagggctagcgttccaaagatgaacttggatgatgtatttgagcagaagaatgaaatagcaagggctgtggaggatgaacttgaaaaggcaatgtctgcctacgggtacgagattgtgcaaactctgattgttgatattgagccagatgaacatgtgaagagagccatgaatgagatcaatgcagctgctaggatgaggttggcagccactgagaaagccgaggcggaaaagattctccagatcaagagggctgaaggtgaggcagaatcgaaatacttggctggtgtgggtattgcaaggcagcgccaggccatagtggacgggctgagagacagtgttctcgccttctctgagaatgtgcctgggacctcttcgaaggatgtcatggatatggttttggtgacgcagtacttcgataccatgaaggacattggggcctcttccaagtcttcagcagtgttcatccctcacgggcctggcgctgtcaaagacatcgcttcgcagatacgagatggtcagctccagggcaggatggtttgaggagtgttggaaaatggatgccacttttatatgcatacttttaagtacatacagcttattcttatactatgtgtgaggtgaggttgtgcctagatggatgttaatatcagtacttgcttgggttgtgccactcgtttctgtaaaaaatatcagttgtgctatcactgtgttcgcagctatttgtgtattgagagt

SEQ ID NO: 3840 - DNA, 1454 bp, Triticum aestivum
tttgccctagacgcgtaagaaacttgcagccagatataagtcggggaggggccggagggaggcgaaagaagaagccaagcaaaccaagcggagagcagagcagacggccggccggacggggggacgaaccaatccaaccagccaagctcgtcagcacgcggcgcagcagcccagctacccttgccgcaagataaaccatgggtggggtacttggtttgatacagattgatcaatcaactgtagccatcaaggagacttttgggaagtttgatgcgatcctgcaacctggatgccactgcttgccatggtgcctagggcagcagattgctgggtatctttctctgcgtgtgcagcagcttgacgtccgatgcgaaaccaagaccaaggacaatgtctttgtcaacgttgtggcatctgtgcagtaccgtgctcttgctgacaaggcatctgatgccttttacaggcttagcaacaccagggagcaaatccagtcctatgtctttgacgtgatcagggctagcgttccaaagatgaacttggatgatgtatttgagcagaagaatgaaatagcaagggctgtggaggatgaacttgaaaaggcaatgtctgcctacgggtacgagattgtgcaaactctgattgttgatattgagccagatgaacatgtgaagagagccatgaatgagatcaatgcagctgctaggatgaggttggcagccactgagaaagcggaagcggagaagatactccagatcaagagggctgaaggtgaggcagaatcgaagtacttggctggtgtgggtattgcaaggcagcgccaggccatagtggacgggctgagagacagtgttctcgccttctctgagaatgtgcctgggacctcttcgaaggatgtcatggatatggttttggtgacgcagtacttcgataccatgaaggacattggggcctcttccaagtcttcagcagtgttcatccctcacgggcctggcgctgtcaaagacatcgcttcgcagatacgagatggtcagctccagggcaggatggtttgaggagtgttggaaaatggatgccacttttatacgcatacttttaagtacatacagcttattcttatactatgtgtgaggtgaggttgtgcctagatggatgttaatatcagtacttgcttggattgtgccactcgtttctgtaaaaaatataagttgtgctatcactgcgttcaccactatttgtgaattgagtgtgttatatggttattatactataatttctatgttgctactagtattttcattcaaatcttggaaaccttggaattttggagattgttctgaagctcctcccactgaggcccccagtttctcgttcttactacttatgatatgttctttggtatttagattttgtgtgcgttcatcgtattgtcatgtgaagcgcagttcattgtattg

SEQ ID NO: 3841 - DNA, 1259 bp, Zostera marina
tcttttcattccatcctccaaagacttatcggatttgaaaatggggcaggcacttggatgtatccaagtggatcagtcgacaatagctatcgaagaaggttttggtaagtttgacgaagtgcttcaacctggatgtcactgtgtgccatggtgttttggtaaaaacatagttggatatcttagtttacgaatacagcaactcgatgttcgttgcgaaacaaaaaccaaggataatgtatttgttactgttgttgcttctattcaataccgcgcattacctgaaaaggcagaagatgcttattacaagctaagcaacaccagggagcaaatccaagcatatgtttttgatgtcatcagggcaagtgtgccaaaattgattttagatgacgtatttgagcagaagaatgatattgctaaatctgtcgaggaagagctttccaaggccatgtcaacttatggatacgagatagttcagacactcattgtagatattgaacctgatgaacgtgtaaaaagggccatgaatgagataaattccgctgcaaggctgagggtggctgcgaatgaaaaggctgaagcagagaaaatactgcagataaagcgtgctgaaggagatgcagagtcgaagtacctgtctggtctgggaatagcacggcagcgtcaggcaattgttgatggattgagggaaagtgtgcttgctttctccggtaatgtaccaggaaccaccgcaaaggaagtcatggatatggttctagttactcaatactttgataccatgaaagagattggagcttcttcaaagtcatcttctgtgttcattccacacggtcctggtgctgtcaaggacgtcgtctcacagatcagggatggtcttcttcaggccaacgaggccgggaattaatatcgtgtgttaaatctgaagtccactacgtgtttatatggttttatcaaatcccatcattcttatctacaaatccactaaacagtttgatttaatttggtttggtttgtctgtgtttgtattgtacatcaggtattttcttgttttgtgtgcttttaaaaacctcattgaaatctttacatcaacttcctaagatgtataggaatgttatttgtaagtatagggtttgtgaacatgatctgtatagctttcttttgtgtgaattatgatttctgaaaactatttgctctggaagatttagaagacttgattcttataaaatgcaataaaaaagttatatcttcagagtatgaaaaaa

SEQ ID NO: 3842 - DNA, 1034 bp, Centaurea maculosa
  misc_feature (8)..(8): n is a, c, g, or t
  misc_feature (29)..(29): n is a, c, g, or t
  misc_feature (80)..(80): n is a, c, g, or t
  misc_feature (204)..(204): n is a, c, g, or t
  misc_feature (345)..(345): n is a, c, g, or t
  misc_feature (354)..(354): n is a, c, g, or t
  misc_feature (432)..(432): n is a, c, g, or t
  misc_feature (498)..(498): n is a, c, g, or t
  misc_feature (867)..(867): n is a, c, g, or t
  misc_feature (873)..(873): n is a, c, g, or t
  misc_feature (892)..(892): n is a, c, g, or t
taatactntcttgcaaatcttcttgatcngtataagatcatgggaaacctatgctgtttagttcaagtagatcaatccantgttgctatcaaggaagcttttgggaagtttgatgatgttctcgaacctggttgtcattgtgtcccttggatcttcggacgtcagcttgctgggcatctcacgctaaggattcagcagttagangtgaagtgcgagaccaaaacgaaggataacgtctttgtgaacgttgtagcttcgatacaatatcgtgctctggctgaaaaggcgagtgatgcgttctataaactcagcaacacgaggtcccaaatccaagcctacgttttngatgttatncgagctagtgtcccaaagcttaatcttgacgatgtttttgagcaaaagaatgacattgccaaggctgttgaagaagancttgcaaaggcaatgtctgcatatggttacgagattgttcagacattgattgttgatatagaaccngatgagcgtgtgaagaaagccatgaatgagatcaatgcagctgcaaggatgaggttggcggctactgaaaaggccgaggccgacaaaattctccaaatcaagagagccgagggcgaggctgagtcgaagtacctgtcgggtttgggtatcgcacgccaacgtcaagccatcgtggacggtttgagagacagtgtgttggggttctcggtcaacgtgcccggaaccacggctaaagacgtgatggacatggttctagtcactcagtatttcgacaccatgaaggaaattggtgcttcttctaaatcctcggcgtctcatcccgcatggacccgtgcggtcgtgatgtgctactcagaacgcgacggctcntcaggnactccgccagctgatcgtnactcgcctcgctacattaacttggagtgatgcaatgcttttgttctgatggttaatgtgacttatggtgcattgtgtatgcagtagttagatgggtccgcagcaaaaatccgataaagggcctatatctacagagggcctat

SEQ ID NO: 3843 - DNA, 2496 bp, Distylium racemosum
tttgcaaaggaagtcaaggaagtaacatatcttcctttcctaccgcccttaagttccggtgaacttccgtggttggatggaggggaatacggatttcgcaaggggattcagatgacagaagaaattaaggagatcgattgggtactcttcaactccttctacgagatagaagctccggtagtagatgagttgtcgaaagaattgagtgtgtatccaataggtcctctgatttcctctgagtttctggaaggcgacaggggaaggacgaacaaggtcatcccaagcttgtgggcggataatttggaatgtttacagtggttagataaacagtctacccagtctgtgatttatgtgtcatttggaagtattgcagtttggggcgaaagggttgtggaagagcttgctttgggactggaggccacgcaacggccttttctatgggttgttcgttccgatctaatggatggcagaaaggctgattttcctacgggattcttggaacgcgtcagagataaagggtgtattgtgtcctgggcgtcacagctagaggtgttagcccatccttcgatagcatgttttgtgacgcattgcgggtggaactcctcacaggaaagcattaccatgggagtgcctatgctctgttgtccttattttgcagatcagtttttaaatcgccgatatattgtggatgtatggaaagtgggactgcctttgaatccgaataacgagggaattatagaaaaggcggagtttaccaaaactgtggagacactgctggtgggcgaagagggtttggagataagaatggaagtgcgcaaattgaagagaattgcgagagatgcggtgaaggaaggcggaacctcatacaacaactataattcatttgtcaatgcaatgaaaaacacaacatgactgatctgaactagttatctatcctctataactggttattatgttatatggcacagaacatactcagtgaattttgacgggtttcaatgaatttggcttgaaaattcgtaagaacagaatggggcaattattatgttgctgtgtacaagtggagcagtcaaaagttgcaatgaaagagagatttggacggtttgaagaagttcttgaaccagggtgccactgccttccatggtttctggggagtcaaattggaggtcaactttcattacgggttcaaaagttggatgtccgttgtgaaacaaagaccaaggataatgtatttgtgacagtgattgcctctgtgcaataccgtgcccttttagagaaagcaagtgatgcattttataagctaagcaatacaagggagcagattcaagcttatgtctttgatgtcatccggtcaagtgttccaaagatgaatctggatgatgtttttgagcaaaaaaacgaggttgccaaagctgttgaacaggaactggaaaaggctatgtcaacctatggatttgagatcgtacaaacgcttatcgtggatatagaacctgatgaaactgtaaagagagcaatgaatgaaataaatgcagctgcaagaatgagggtagcaacacgtgacaaagctgaggctgagaaaattttgcaaatcaagcgagcagaggctgaagcagaatcaaagtatttatcaggactaggtattgcacgacaacgacaagcaattgtggatggtttgagggatagtgtacttgctttctcagttaatgtgcctgggacaacagccaaagatgttatggatatggtcttggtgacacagtattttgacactatgaaagaaataggagcatcatcaaagtcttcagctgtattcataccccatggacctggtgcagttcacgatgttgctgaacagataagagatggactgcttcaggcacagcagattcgttgagcactgtgagtattgtgatgcttgtaatgagagaagcaaccacatattttgtgaagatttagacctttagatgctacctagctttcttatttacaatgattccattgttaatatgctttttgaattgccttttccctttctctgacattttgataaacatggagcatattgttatctagttctgtattttggaattgatgctgaagtgtgttgcatatgtttataaatttattgtggtttttcttggcattgctactgctgtggaacatatggcgtctaccttttgagaaactatatatgacacaacaatgtattgtgaaatgaattgatcatgtactccaatactacactgaatctatttacactttcaaaaaactaacataaggaaacctaagtaaagcctttggccacttttatatcccatgatacatttgcagactccaatcacatagtcttccttttaggctgtagcatggaacctttaggtctgatgcttgaaccactagatgaaaaattcaacttccccccacaacttgaggtcattgttgagaagcttttaacagaagttgtagatgaatttgagttcattacatgctttggagctg

SEQ ID NO: 3844 - DNA, 1196 bp, Triticum aestivum
agacaacgtttgggatgagcattatctctgtctcccactatatatgtatgtgcagtgtgcttcgtatagaccccaacttcccaagaacaccctcaagcatacaagccttgggtttctaccctgcactgaactaattgagaagcataaaccatgggtggggtacttggtttgatacagattgatcaatcaacagtagccatcaaggagacttttgggaagtttgatgcgatcctgcaacctggatgccactgcttgccatggtgcctagggcagcagattgctggatatctttctctgcgtgtgcagcagcttgacgtccgatgcgaaaccaagaccaaggacaatgtctttgtcaacgttgtggcatctgtgcagtaccgtgctcttgctgacaaggcatctgatgccttttacaggcttagcaacaccagggagcaaatccagtcctatgtctttgacgtgatcagggctagcgttccaaagatgaacttggatgatgtatttgagcagaagaatgaaatagcaagggctgtggaggatgaacttgaaaaggcaatgtctgcctacgggtacgagattgtgcaaactctgattgttgatattgagccagatgaacatgtgaagagagccatgaatgagatcaatgcagctgctaggatgaggttggcagccactgagaaagcggaagcggagaagatactccagatcaagagggctgaaggtgaggcagaatcgaagtacttggctggtgtgggtattgcaaggcagcgccagccgatagtggacgggctgagagacagtgttctcgccttctctgagaatgtgcctgggacctcttcgaaggatgtcatggatatggttttggtgacgcagtacttcgataccatgaaggacattggggcctcttccaagtcttcagcagtgttcatccctcacgggcctggcgctgtcaaagacatcgcttcgcagatacgagatggtcagctccagggcaggatggtttgaggagtgttggaaaatggatgccacttttatatgcatacttttaagtacatacagcttattcttatactatgtgtgaggtgaggtgaggttgtgcctagatggatgttaatatcagtacttgcttgggttgtgcaactcgtatctgtaaaaatatcagttgtgctatcactgtgttcgcaactatttgtgaa

SEQ ID NO: 3845 - DNA, 1157 bp, Arabidopsis lyrata
tgattgccgagagaagcaaaaaggaaatcccaacaataaaaagcaaaagatcttactcatcataataattcgttaattgtcaaattgctaacaagtaaattcgcggaaccttccttcgtaatttcctccaactttctctctttgcttattataattgcgtctttgcttcctcctttacctttacgcggcacatagattattctctccaagaaaaaaaaaatgggtcaagctttgggttgtattcaagttgatcaatcgaatgtagcaatcaaagagacttttgggaaattcgacgaagttcttgagccgggttgtcactgtttgccatggtgtttgggaagtcaagtcgctggtcacctttccttacgtgttcaacagctcgatgttcgctgcgagacaaaaactaaggataatgtgtttgtcacggttgttgcttccattcaataccgggccttagcggagagtgctcaagatgctttttacaagctcagcaacacaaggaatcagattcaagcttatgtctttgatgtgatccgagcaagtgtacctaagctggatcttgactcaacctttgagcaaaagaatgacattgcaaaaactgttgagactgagcttgaaaaggctatgtcgcattacgggtatgagattgttcagacactgattgttgatatcgagcctgatgtgcacgtcaagagggcaatgaatgagatcaatgctgcttctaggatgagagaggcagcaagtgagaaagctgaggcagagaagattctgcagatcaagagagctgagggagaagctgaatcgaaatacctttcaggtatgggtattgcccgtcagagacaagccattgtggacggtctgagaaacagtgtactcgccttctccgagtctgttccaggaacgtcttcgaaagacgtgatggatatggttctggtcactcagtacttcgacacattgaaggaaattggtgcttcttcgaagtcaaactcggtgttcataccgcacggtccaggtgctgttaaggacattgcttcacagatcagggatggtcttcttcagggtaactctgttgctgagtaaagaggtctcaaagtagaaaggcttttcagggtttagagttgtgttgttgcttcttagtttatctttagaggtttgac

SEQ ID NO: 3846 - DNA, 1243 bp, Hordeum vulgare
gaagacaaaatccagttatcccatatcctcttcaacaatccgaactatcttcaccagttatctcaaaatcttcagcagtggctgtggtgccagtgctcaaagatcaaaagagaggttaataaataagaatgggcaaactagttgcagcaataggcaagttgctctgctgtgtacaagtggaccagtcaacagtagccatcaaggaaagatttgggaaatttgaggatgtgcttgatccagggtgtcactgtgtgccatggattatcggaagccgtgtcagtggtaagcttacacttaggcttaggcaaatggacgttcgctgtgagacaaagacaaaggataacgtttttgttacaattgttgcatctattcaataccgagcaatggaggacaaagcaaatgatgcgtactataagctgagcaacccaaaaactcaaatccaatcttatgtctttgatgttatcagagcaagcattcccaaattacaactggatgatgtttttgagcaaaagaatgacatagcaaaatctgtggagcaggagcttgagaaggctatgtttgcttatggctatgagatcgtgcagacactaattgttgatatagagccagatgaaaaggttaaaaaggctatgaatgaaattaatgccgctgcaagaatgcgcgttgcggcaaatgagaaggcagaggcagaaaagatcgttcaaatcaagagagctgagggagaggctgaggctaagtatttgtctggccttggaattgcaaggcagcggcaggcaatagttgatggcctcagggacagtgtgcttggcttttctggcaatgtgcctgggacttccgccaaggatgtgatggacttggttctgctcactcaatactttgacaccatgaaagagatcggtgcttcatccaaatcttctgcagttttcctcccacatggcccaggtgctgttgcagacattgccagtcagattcgcaatggatttcttcaggcgtccacacataatgcctgaactaaactcatgtgtacaagaatttgaattggtgaggtcattcctacaggctccgggtttgacagacgaaagtggttctttaagcacgtgataatattgtgtgagtttgtgacttgtgagatatctacaaaagcttgtaaattggtttgtatttcataatgtatcagcttgtccttagatgtccgtagataaatgcctaaatatatatgaatgtattgcatgattattgtgtg

SEQ ID NO: 3847 - DNA, 1403 bp, Hordeum vulgare
aagacaaaatccagttatcccatatcctcttcaacaatccgaactatcttcaccagttatctcaaaatcttcagcagtggctgtggtgccagtgctcaaagatcaaaagagaggttaataaataagaatgggcaaactagttgcagcaataggcaagttgctctgctgtgtacaagtggaccagtcaacagtagccatcaaggaaagatttgggaaatttgaggatgtgcttgatccagggtgtcactgtgtgccatggattatcggaagccgtgtcagtggtaagcttacacttaggcttaggcaaatggacgttcgctgtgagacaaagacaaaggataacgtttttgttacaattgttgcatctattcaataccgagcaatggaggacaaagcaaatgatgcgtactataagctgagcaacccaaaaactcaaatccaatcttatgtctttgatgttatcagagcaagcattcccaaattacaactggatgatgtttttgagcaaaagaatgacatagcaaaatctgtggagcaggagcttgagaaggctatgtttgcttatggctatgagatcgtgcagacactaattgttgatatagagccagatgaaaaggttaaaaaggctatgaatgaaattaatgccgctgcaagaatgcgcgttgcggcaaatgagaaggcagaggcagaaaagatcgttcaaatcaagagagctgagggagaggctgaggctaagtatttgtctggccttggaattgcaaggcagcggcaggcaatagttgatggcctcagggacagtgtgcttggcttttctggcaatgtgcctgggacttccgccaaggatgtgatggacttggttctgctcactcaatactttgacaccatgaaagagatcggtgcttcatccaaatcttctgcagttttcctcccacatggcccaggtgctgttgcagacattgccagtcagattcgcaatggatttcttcaggcgtccacacataatgcctgaactaaactcatgtgtacaagaatttgaattggtgaggtcattcctacaggctccgggtttgacagacgaaagtggttctttaagcacgtgataatattgtgtgagtttgtgacttgtgagatatctacaaaagcttgtaaattggtttgtatttcataatgtatcagcttgtccttagatgtccgtagataaatgcctaaatatatatgaatgtattgcatgattattgtgtgggtatacttgggcttctgagaaaataatgtttccacatattcttttaatttaatatatatctttggtttcgtatatttcagcaataattatacaatagctcatcttagtctcactgaatttccttagatagcactactcacaatcaaaatctgcagtcgga

SEQ ID NO: 3848 - DNA, 1138 bp, Fraxinus spp
gaatagacgtacgacttaataaccttcccgttacggagtacctcgtcgtattctcctaccgtcgaattacattctctctctctctctctctctctactattgaaaaaatgggccaaacacttggttgcgtacaaatcgatcaatctactgttgccatgaaggaacattttggtaagttcgcaatgtgcttgagcctggatgccattgcttgccttggtgtgtggggtaccagttggctggttcactatctctgcgggtacaacagcttgacgtgcggtgtgaaacaaaaacttaaggataatgtgtttgtgactgtggttgcatcaatccaatatcgagccatggcggaaaaagcggctgatgcattttacaagctgtctaacacaaaggaacagatccaagcatacgttttcgacgtcataagggcaagtgtaccaagattagatttggattctaccttcgaacagaagaatgacatagccaaagctgttgaaaatgaacttgaaaaggccatgtctgcttatggatatgaaatagtgcagaccctgattgtggacattgagccagatgctcaggttaagagatccatgaatgagataaatgcagcggccaggctccgagttgctacaaacgagaaggctgaagcagagaagatattgcagatcaagaaagctgaaggtgaagctgaatctaaatacttgtcggggcttggaattgctcgtcagcgccaagccattgtagatggtctaagggacagcgttcttgccttctcagaaaatgtgcctggaacaacagctaaggatgttatggacatggttctcgttacacaatactttgataccatgaaggatattggagcatcatcaaagtcgtccgctgtgtttatcccacatggacctggtgctgtgaaagatgttgctgcacagattcgggagggtcttctacaggctgaaagtggtgggcagtagaggttttccagagatccattgaatcgttactgtttctctgtttaaagtgtgtggatgtgttctgattaattcagtatgtgtaaatgaaaaacttctgtgagatgctgttgcatataaatttcttaacagtgttcataaatgttgagctgtgtactcatataatatagttt

SEQ ID NO: 3849 - DNA, 1152 bp, Pennisetum glaucum
gatcgatccccacaaaaccccaatcgcgtcggctcccctgctttaccctctgctccgcgtcgctccgcctccgcgcaagaatccataggggccaagacatgggccaggttttgggtttagttcaagttgatcagtcaactgtcgccatcaaagaaacttttggcaagttcagtgaggtcctggagcctggttgccacttcctaccctggtgcatagggcagcagattgctggttacctctccctgcgtgtgcggcagctggatgtccgctgcgaaacaaaaacaaaggacaatgtctttgtcactgttgttgcatctgtccaataccgtgcgctttctgaaaaagcatccgatgccttctacaagctgagcaacaccagggaacaaattcagtcatatgtatttgatgtcattagagctactgttccaaagctggacttggatgatgcatttgagcagaagaatgacattgcaaaagctgttgaagatgagcttgaaaaggcaatgtctgcctatggctatcagatcgtgcaaactctgattgttgatattgagcctgatgaccgtgtcaagagagcaatgaacgagatcaatgcagctgctagaatgaggttggcagccggtgagaaagctgaggctgagaagataattcagatcaagaaagctgaaggagaggccgagtccaagtacctggctggtgtgggtattgcaaggcagcgtcaggccattgtggacgggctgagggacagcgttcttgccttctcagagaacgttcctggaaccactgccaaggatatcatggacatggtcctggtcactcagtactttgacaccatgaaggagattggggcctcatcaaagtcctcttcagtgttcatcccccatggtcctggagctgtcaaggatgtcgcggcacagataagagatggcctcctgcaggccaatcagcagtgagacggccctgagaaaagaaagtatttttggtttcgattgcaaaagcaacgttgcggacaccggttatgtgctgctttaagctttaaacttgtgaattgcatgatatatagctagactttgcatggtttgtgaattgtcagtaggcttttatattgattggagcacttgcgagtgagcttataatattgatagtgcaact

SEQ ID NO: 3850 - DNA, 1438 bp, Quercus alba
aaaacgaacgaaagcgagagaaatataacagagaaccgtttttcaattctctgtctctctctgtgtctctgtgtgtgagctctctcctatatatatatatccagaattgggaatcgtaataaattaagtgtggcacatcaaaattcacagctcttgtgaatatctatatctctgtgtcatcttcagttttcgctgctttcctgttttctctgcaaggtatataatttaagtatgggtcaagcattcggttgtctccaggtggaccagtcaaatgtgattatcagggaacattttggaaagttcgatgatgtgctggagccagggtgtcactgcctgccatggtgtcttggataccaggtggctggtggactctcattgcgtgtgcaacaacttgatgttcgatgtagaaacaaaaacgaggacaatgtctttgtcactgtggttgcatctgttcaatatcgtgctgtggctgacaaagcatctgatgctttctataggctcaccaataccagggagcagatccaatcctatgtgtttgatgttatcagggcaagtgtgccgaaattgaacttggatgctgtctttgagcagaagaatgacatagcaaaatctgtggaagacgagctggaaaaggccatgtccacttatgggtatgaaatcgtccaaacactaattgtagatattgagcctgatccccatgtgaaaagagcaatgaacgagataaatgcagctgctagaatgagggtggcagcaaatgacaaggcagaggcagacaaaatcttgcagatcaagaaagctgagggagaagcagaatcaaagtacttgtcagggcttggtattgctcgccagcgccaggccattgttgatgggctgagggacagtgtacttgccttctctgagaacgtgcctggaacaactgccaaggatgtcatggacatggtgctggttacccagtactttgatacaatgaaggagattggggcatcctcaaagtcctcctctgtgttcatcccacatgggccaggagcagtcagagacgttgcttcacagatccgagagggtcttcttcaagctcagtctctcaagagttgaagacaaatataagcttggcttggattttgcctacgaactccatatcaacaaatttaagcttggctcgtgattttttacctacgaagagtacactaatataagtttgttggattaacttgatgcgtgttttgctggatttgtattttactgctacttatagcaagaccttttataatgcttatgttttaaatttgtcctctttgataacacatcattgaggaggtggtgtataattatgttaatggttgaaggatattgttggtttctactatttaaattgtagctttcttactaaaaaaaaaaaaaaaagttaattaatcgcgatctagaactagtgacacgcgag

SEQ ID NO: 3851 - DNA, 1346 bp, Avena sativa
gtcggcagaggaagggaaggaaatcccccggacgcgcaagaactgtgccataaattgcagcgcgatttggaggcggaaggagaccaaaccgagcagaacagacggccggccgaacccaatccaaccaatctcgagagaaggcagcagcagcccgcggtgttcatcctacggttcgtttcctactcgccctacgataagcaatgggtcaggcaattggtttgatacagattgatcaatcaacagtagccatcaaggagacttttggaaagtttgatgctattctggagcctggatgccactgcctgccatggtgcatagggcagcagattgctggatatctttcgctgcgtgtgcagcagcttgatgtcaaatgtgaaacaaagaccaaggataatgtctttgtcaatgttgtggcatctgtgcagtaccgtgctcttgctgataaggcatctgatgccttttacaagctcagcaacacccgggagcaaatccagtcctatgtctttgatgtgatcagggctagcgttccaaagatgatcttggatgatgtatttgagcaaaaaaacgaaatagcaaaggctgtggagaatgaacttgaaaaggcaatgtccgcctatgggtatgagattgtgcaaactctgattgttgatattgagccagatgtaaatgtgaagagagccatgaatgagatcaatgcagctgctaggatgaggttggcggccactgagaaagctgaagcggagaagatactccagatcaagagggctgaaggagatgcggaatccaagtacctggctggtctcggcattgcgaggcagcgacaggccatcgtcgatgggctgagggacagcgtgctggctttctctgagaatgtgcccgggacctcttccaaggatgtgatggacatggttttggtgacccaatattttgacaccatgaaggacattggtgcctcgtccaagtcatcagctgttttcatccctcatgggccaggtgctgtgagagacatcgctgcacagatcagagatggtcagctgcagggcaggatggtttaagagtgctggaaactggacattttcaacttcccaagcagaagaccccaacaatctagctacatattttgtgagatgaaacttagagaaatattttatattttgtgagtaccaaatgcatgcatgtttaagtgcagtttattctactactatatgtgaggttgtgcctagatgaatgttaatatacttgttactaaaattttactactcctgtataaatcttggttgtgtaatcattaagtttgccactatttgtgaattgagtctgaaagaaaaatttcaacttattatata

SEQ ID NO: 3852 - DNA, 1200 bp, Pseudoroegneria spicata
aagcggcagcagagcagacggccggccggacgcgggacgacgaacaaatccagccagccaaactcgtcagcgcgcagccgcctttcccgcaagataaaccatgggtggggtacttggtttgatacagattgatcaatcaacagtagccatcaaggagacttttgggaagtttgatgcgatcctgcaacctggatgccactgcttgccatggtgcctagggcagcagattgctggatatctttctctgcgtgtgcagcagcttgacgtccgatgtgaaacaaaaacaaaggataatgtctttgtcaacgttgtggcatctgtgcagtaccgtgctcttgctgacaaggcatctgatgccttttacaggcttagcaacaccagggagcaaatccagtcctatgtctttgatgtgatcagggctagcgttccaaagatgaacttggatgatgtctttgagcagaagaatgaaatagcaagggctgtggaggatgaacttgaaaaggcaatgtctgcctacgggtacgagattgtgcaaactctgattgttgatattgagccagatgaacatgtgaagagagccatgaatgagatcaatgcagctgctaggatgaggttggcagccactgagaaagctgaagcggaaaagatacttcagatcaagagggctgaaggagaggcagaatcgaagtacttggctggtgtgggtattgcaaggcagcgccaggccatagtggacgggctgagagacagtgttctcgccttctctgagaatgtgcctgggacctcttcgaaggatgtcatggatatggttttggtaacgcaatactttgatacgatgaaggacatcggggcctcttccaagtcttcagcagtgttcatccctcatgggcctggcgctgtcaaagacatcgcttcgcagatacgagatggtcagctccagagcaggatggtttgaggagtgttggaaaatggatgccacttttatatgcatacttttaagtacatacagcttattcttatactatatgtgaggtgaggttgtgcctagatggatgttaatatcagtacttgcttggattgtgccactcgtttctgtaaaaaatatcagttgtgctatcactgcgttcgccactatttgtgaatcgagtgtgttatatgttactacatggttattatactataatttctatgttgctacta

SEQ ID NO: 3853 - DNA, 1243 bp, Secale cereale
tcggggagggccggagggaggcagaagaagaagccaagccaagcggagagcagagcagacggccggccggacgaaccaatctaaccagccaagctcgtcagcacgcggcgcagcagcagcccggctaccctcgccgcaagataaactatgggtggggtacttggtttgatacagattgatcaatcaacagtagctatcaaggagacttttgggaagtttgatgcgatcctgcaacctggatgccactgcttgccatggtgcctagggcagcagattgctggatatctttctctgcgtgtgcagcagcttgacgtccgatgcgaaacaaaaaccaaagataatgtctttgtcaacgttgtggcatctgtgcagtaccgtgctcttgctgacaaggcatctgatgccttttacaggcttagcaacaccagggagcaaatccagtcctatgtctttgatgtgatcagggctagcgttccaaagatgaacttggatgatgtatttgagcagaagaatgaaatagcaagggctgtggaggatgaacttgaaaaggcaatgtctgcctacgggtacgagattgtgcaaactctgattgttgatattgagccagatgaacatgtgaagagagccatgaatgagatcaatgcagctgctaggatgaggttggcagccactgagaaagctgaagctgaaaaaatccttcagatcaagagggctgaaggtgaggcagaatccaaatacttggctggtgtgggtattgcaaggcagcgccaggccatagtggacgggctgagagacagtgttcttgccttttctgagaatgtgcctgggacctcttcgaaggatgtcatggatatggttttggtgactcagtacttcgatacgatgaaggacattggggcctcttccaagtcttcagcagtgttcatccctcacgggcctggcgctgtcaaagacatcgcttcgcagatacgagatggtcagctccagagcaggatggtttgaggagtgttggaaaatggatgctacttatatatgcatacttttaagttattcttatactatatgtgaggtgaggttgtgcctagatggttgttaatatcagcacttgcttgggttgtgccactcgtttctgtacaaaatatcagttgtgctatcactgtgttcgccactatttgtgaattgagcgtgttactatatggttattaattattatgctctatatggtggtgctagtttttcagtc

SEQ ID NO: 3854 - DNA, 1148 bp, Secale cereale
gacggccggccggacgaaccaatctaaccagccaagctcgtcagcacgcggcgcagcagcagcccggctaccctcgccgcaagataaaccatgggtggggtacttggtttgatacagattgatcaatcaacagtcgccatcaaggagacttttgggaagtttgatgcgatcctgcaacctggatgccactgcttgccatggtgcctagggcagcagattgctggatatctttctctgcgtgtgcagcagcttgacgtccgatgcgaaacgaagaccaaggataatgtctttgtcaacgttgtggcatctgtgcagtaccgtgctcttgctgacaaggcatctgatgccttttacaggcttagcaacaccagggagcaaatccagtcctatgtctttgatgtgatcagggctagcgttccaaagatgaacttggatgatgtatttgagcagaagaatgaaatagcaagggctgtggaggatgaacttgaaaaggcaatgtctgcctacgggtacgagattgtgcaaactctgattgttgatattgagccagatgaacatgtgaagagagccatgaatgagatcaatgcagctgctaggatgaggttggcagccactgagaaagctgaagcagaaaaaatcctgcagatcaagagggctgaaggtgaggcagaatccaaatacttggctggtgtgggtattgcaaggcagcgccaggccatagtggacgggctgagagacagtgttcttgccttttctgagaatgtgcctgggacctcttcgaaggatgtcatggatatggttttggtgactcagtacttcgatacgatgaaggacattggggcctcttccaagtcttcagcagtgttcatccctcacgggcctggcgctgtcaaagacatcgcttcgcagatacgagatggtcagctccagagcaggatggtttgaggagtgttggaaaatggatgctacttatatatgcatacttttaagttattcttatactatatgtgaggtgaggttgtgcctagatggttgttaatatcagcacttgcttgggttgtgccactcgtttctgtacaaaatatcagttgtgatatcattgcgttcgccactatttgtgaattgagcgtgttactatatggttatta

SEQ ID NO: 3855 - DNA, 1177 bp, Secale cereale
ggacggccggccggacgaaccaatctaaccagccaagctcgtcagcacgcggcgcagcagcagcccggccaccctcgccgcaagataaaccatgggtggggtacttggtttgatacagattgatcaatcaacagtagccatcaaggagacttttgggaagtttgatgcgatcctgcaacctggatgccactgcttgccatggtgcctagggcagcagattgctggatatctttctctgcgtgtgcagcagcttgacgtccgatgcgaaacgaagaccaaggataatgtctttgtcaacgttgtggcatctgtgcagtaccgtgctcttgctgacaaggcatctgatgccttttacaggcttagcaacaccagggagcaaatccagtcctatgtctttgatgtgatcagggctagcgttccaaagatgaacttggatgatgtatttgagcagaagaatgaaatagcaagggctgtggaggatgaacttgaaaaggcaatgtctgcctacgggtacgagattgtgcaaactctgattgttgatattgagccagatgaacatgtgaagagagccatgaatgagatcaatgcagctgctaggatgaggttggcagccactgagaaagctgaagcagaaaaaatcctgcagatcaagagggctgaaggtgaggcagaatccaaatacttggctggtgtgggtattgcaaggcagcgccaggccatagtggacgggctgagagacagtgttcttgccttttctgagaatgtgcctgggacctcttcgaaggatgtcatggatatggttttggtgactcagtacttcgatacgatgaaggacattggggcctcttccaagtcttcagcagtgttcatccctcacgggcctggcgctgtcaaagacatcgcttcgcagatacgagatggtcagctccagagcaggatggtttgaggagtgttggaaaatggatgctacttatatatgcatacttttaagttattcttatactatatgtgaggtgaggttgtgcctagatggttgttaatatcagcacttgcttgggttgtgccactcgtttctgtacaaaatatcagttgtgctatcactgcgttcgccactatttgtgaattgagcgtgttactatatggttattatactctatatggcggtgctagttttttc

SEQ ID NO: 3856 - DNA, 1180 bp, Secale cereale
aagccaagccaagccaagccaagcggagagcagagcagacggacggccggccggacgaaccaatctaaccagccaagctcgtcagcacgcggcgcagcagcagcccggccaccctcgccgcaagataaaccatgggtggggtacttggtttgatacagattgatcaatcaacagtcgccatcaaggagacttttgggaagtttgatgcgatcctgcaacctggatgccactgcttgccatggtgcctagggcagcagattgctggatatctttctctgcgtgtgcagcagcttgacgtccgatgcgaaacgaagaccaaggataatgtctttgtcaacgttgtggcatctgtgcagtaccgtgctcttgctgacaaggcatctgatgccttttacaggcttagcaacaccagggagcaaatccagtcctatgtctttgatgtgatcagggctagcgttccaaagatgaacttggatgatgtttttgagcagaagaatgaaatagcaagggctgtggaggatgaacttgaaaaggcaatgtctgcctacgggtacgagattgtgcaaactctgattgttgatattgagccagatgaacatgtgaagagagccatgaatgagatcaatgcagctgctaggatgaggttggcagccactgagaaagctgaagcagaaaaaatcctgcagatcaagagggctgaaggtgaggcagaatccaaatacttggctggtgtgggtattgcaaggcagcgccaggctatagtggacgggctgagagacagtgttctcgccttttctgagaatgtgcctgggacctcttcgaaggatgtcatggatatggttttggtgactcagtacttcgatacgatgaaggacattggggcctcttccaagtcttcagcagtgttcatccctcacgggcctggcgctgtcaaagacatcgcttcgcagatacgagatggtcagctccagagcaggatggtttgaggagtgttggaaaatggatgctacttatatatgcatacttttaagttattcttatactatatgtgaggtgaggttgtgcctagatggttgttaatatcagcacttgcttgggttgtgccactcgtttctgtacaaaatatcagttgtgctatcactgcgttcgccactatttgtgaattgagcgtgttactata

SEQ ID NO: 3857 - DNA, 1264 bp, Secale cereale
tttgggaagtttgacagtgtgcttcagccaggatgccacctgcctgccttggatcttagggaaacgtgtagttggccatctcacactcaggttgcagcagctggatgtgcgctgcgaaactaagacaaaggacaatgtgtttgtcactgttgttgcatcaattcagtaccgtcctctggctggcaaagaaagtgacgcatactacaaactgaccaacacaagatcccagattcaagcctatgtttttgatgtgatcagggcaagtgttccaaagctcaacctggatgatgctttcgtgcagaagaacgatatagcaaaggctgtggaggatgaacttgaaaaggctatgtcggcatatggctttgagattgtgcagaccctcattgtcgacatcgagccagacgcccatgtcaagcaggcgatgaatgagatcaatgcagctgcaaggatgagggtggctgcaaacgagaaggcggaggctgagaagatcgtccagatcaagcgtgccgagggtgaagcagaggccaagtacctgtccggcctcggtattgcccgccagcgccaggccattgtggatggcctgagggacagcgtcctgggcttctcagtcaatgtgcctggcaccactgcaaaggacgtgatggacatggtgctgatcacccagtacttcgatactatgaaagagattggcgcgtcctccaagtcctcggccgtcttcactccccatggccctggtgcggttcgtgacatcgccacgcagatccgcgacggtcttcttcagggccagtctgcctctgacaactagtagtttgcttcgccggcatgaactttgaagctggtggtggtttgtggtttgctagctattgcctacagtactgtcttatatgatgcatgccgtataattatgacttatatggaaccatatgtggattgtggcttaggtcgatgtgcggtaacaaaaccttttaacctattgggaatgcaggatgatataagtgtgttaagaaatgctggtgatgaacttgatctaatgcttttgaccttaacgtttaaaaaaaaaaaagaaaaaaaaaaagaaaaaaaaaaaacaaaaaaaaaaaagaaaaaaaaaaacaaaaaaaaaaacaaaaaaaaacaaaaaaaaaaaacaaaaaaaaagaaaaaaaaacaaaaaaaagaaaaaactaaaataaaacaagtaactagataagatactacagatacagtagacagacagacgacgtagatagagatacgataggat

SEQ ID NO: 3858 - DNA, 1586 bp, Picea glauca
catatatattatattttttagttttagaaaaccctctccaacaggagattttgaataccatatcctgttgctgcaagctgcaaaggaaagcgcggactgttgcgaatcttcataagttccggtcaacaactttaatttcggtaaatcgggttaaatgttgataatagggcattttttaatattcagggaattatgagggcgtagcaaaagatctcttcagcttcaagtcaatacttttgatttactcgaaattgaccgagattcagggtcgtatgttctattagcagatcgtattaatgtttttggcgtctgatcagacctgtacatcattcttcataccatctcatcttgacagctttgttacgtttcaggtacaggaataaacaaaatggggcaattattctgttgtgtacaagtggagcagtcagaagtggctatgaaggagacatttggacgctttaatgaagttcttgagccaggatgccactgtctgccatggatttttgggcaacaaattgcaggtcatctttccttacgggtacaaaagctggacgtgcgatgtgagacaaagacaaaggataatgtatttgtgactgtaattgcatctgtgcaataccgtgccattttagacaaagcagaggatgctttttataagcttagcaatacaagggagcagatccaagcttatgtctttgatgtcattcgtgcaagtgtcccaaagatgaatttggatgacttttttgagcaaaagaatgatgttgctagagctgttgaagaggaacttgaaaaggttatgacaaactacggatttgagatagtgcaaactctcattgttgatattgagcctgatgaacttgtgaagagagcaatgaatgaaataaatgcagctgcaagaatgagggtggcaacaaaagacaaagctgaggcagagaaaatcttgcaaattaagcgagcagaaggtgaagcagaagcgaagtatttatctggattgggtattgctcgtcaacggcaagcaatagtggatggccttagggatagtgtacttgctttctcagacaatgtgcctgggacaactgcaagagaggtgatggacatggtcttggtgacacaatattttgacacaatgaaagagataggagcatcttcaaagtcatcaacagtattcatcccccatggacctggtgcagttcgtgatgttgctgaggagatcagaaatggattacttcaggcacaggcccgttaaacattataaaagcacatcatgaggtgtcgaatttcagaataaaagcacattatgtgcaacaatgtttatggcttaccgtttgccttttaagtagtattttttttatacaaggaattcttacatgcttctggtattgttttatgttaagtatgaagtgcctacttaatatataataagtaggcactcaaccttgtatatgaaatgttaataataaaatatgcatataatgtgtggtggtgcatagccatcttttcggttctattaacaaagacaaacgttctgcatggatggaaagatgagtaagtattaattattaatgtgtacaattgtgttgtgtaaaaaa

SEQ ID NO: 3859 - DNA, 1198 bp, Panicum virgatum
  misc_feature (195)..(195): n is a, c, g, or t
  misc_feature (236)..(236): n is a, c, g, or t
  misc_feature (295)..(295): n is a, c, g, or t
  misc_feature (789)..(789): n is a, c, g, or t
ggcagaattcaattaatccatatagttgtcaaccatctgttgtggacgctttcaccggcaaggcgtacgcacgcaggaacaagaagcaacagacattagaatggggaaactactggcagcagtcggcaagttcttctgctttgtacaggtgaaccagtcaacagtaggcatcaaagagagatttgggaaatttgnggaagttctcaatcctggatgccattttatgccatggatcnttggaaaccgtgtcaccggtcagctcactctaaggcttaggcagcttgatgtccgctgngagacaaaaacaaaggataatgtttttgttactgttgttgcatccatccaatatcgagcaatggaagacaaagcaagtgatgcatactacaagctgagcaacccaaaagctcaaattcaagcatatgtcttcgatgttataagggcaagtattcctaaactagaactggatgatgcttttgagcaaaagaatgaaatagcaaaagctgtggaggaggagcttgaaaaggcaatgtttgcttatggttatgagattgtgcaaacactcattgttgatatagaaccagatgagaaagttaaaagggctatgaatgaaattaatgctgctgcaagactccgtgttgcagcaaatgagaaggcagaggcagaaaagataattcagatcaagagggctgagggtgaggctgaagccaagtatctctctggcttggcatagcaaggcagcgtcaagccatagttgatgggctaagagatagtgtgcttggctttagcggnaatgtgcctgggacttcagctaaggatgtgatggatttggttctgctcactcaatactttgacaccatgaaagagatcggagcagcatccaaatcttctgctgttttcctcccacatggtcctggtgctgttaaagatattgccggtcaaattcgtgatggatttcttcaggcatctactcaggaggcaaagtgataattgcattgatagcgagaattccataaacatgaatctcgattagcaaggctattagtttgtcataactgtgattggtcctttacatgccttgagaatattgtgtgagatcgttaaagtatcaagcctgtatatgcttatagattaggtggtctgtgtaaagatgcctcatatacaaaatgtagtgtgatcaccttacaagaatctagttaat

SEQ ID NO: 3860 - DNA, 1657 bp, Pinus pinaster
agaaaaagaggaagtaataacaaattggactggcagaaccttgaagcttttacggttggcatcaatcaataaaggatgcaaggcatctatccccaccaatttctttacagagcgtgatgtttttatgaatttaattgtgaccaagtaatcttcctcttcatcaccaacattccgaagtcccatgccaaaccattatcctcagtggaaaggagttctatcagcttatgaaagaaactgatcccttgctaaattattgaagtatccaactctttttaacgggaaccctctaaattccactcgattcaaagctatttccttggtagattgacccaccgtgaagaaaagaaagaatacggaaaattctcttgaaaagccaaaacaaatgcccctcttcacaggcctttgaaaagcacgcaacttgtatgactgtccaatgaacctgccattgccagtgttttctgaagaagtgtcccttgcattgcatgatgcagtgccctctctttaatgaaaagcgtgccctcttttgtgaataggcgtgaagatcagccttccattactgcgctgtcctctcaattcaggtcgtgtatgtgctattagcagttcgtatcaaggttttcgcatctgatccgacctgtgcatcattctttatcccatctcatcttgacggctttgttacttttcaggtacaggaataaataaaatggggcagttattatgctgtgtacaagtcgatcagtcacaagtggctatgaaggagacatttggacgctttaatgaagttcttgagccaggatgccactgcatgccatggatttttgggcaaaaaattggaggttatctttccttgagggtacaaaagctggatgtgcgatgtgagacaaagacgaaggataatgtatttgtgattgtagttgcatctgtgcaatatcgtgccattttagggaaagctgtggatgcttttataagcttagcaatacaagggagcagatccaagcttatgtttttgatgtcattcgggcaagtgttccaaagatgaacttggatgattttttcgagcaaaagaatcatgttgctaaagctgttgaacaggaacttgaaaaggttatgacaaactacgggtttgagatagtgcaaactctcattgttgatatagagcctgatgaaactgtgaagagagcaatgaatgaaataaatgcagctgcaagaatgagggtagcaacaaaagacaaagctgaggcagagaaaatcttgcaaatcaaacgagcggaaggtgaagcagaagcaaagtatttatcgggattgggtattgctcgtcaacggcaggcaattgtggatggccttagggacagtgtacttgctttctcagacaatgtgcctgggacaactgcaagagaggtgatggacatggtcttggtgacacaatattttgacacaatgaaagagataggagcatcttcaaagtcatcagcagtattcctcccccatggacctggtgctgttcgtgatgttgctgagcaaatcagaaatggattacttcaggcacaggcccgttaaacatcatagaagcacatcatgaagtattgaattcagaataaaggcacatcacgtacaacaatggttataggtcacctttttcctttgaaggattaatattatg

SEQ ID NO: 3861 - DNA, 1267 bp, Olea europaea
cggagaattaggattactattgccagcacgatgattcagttttccagagcaccattaaattctatccgggtgctgcctgtcccatcagattagtgattgtcaatggagtgaacatgtgggtagtgtataatctatatggatgaaatttgaaagaggaatgacgacgataaataccgtcccgtaggagcactgcgattctccatcgtggaaattcaatcatctatttttatccttctctgtctactattgaaaaaatgggccaaatacttggttgcgtacaaattgatcaatctaatgttgccgtgaaggaaaattttggtaagttcgacaaagtgcttgagcctggatgccattgcttgccttggtgtgtggggtaccagttggctggttcactatctctgcgtgtacaacagcttgatgtgcggtgtgaaacaaaaactaaggataatgtgtttgtgactctggttgcatcaatccaatatcgagccatgccggaaagagcggctgatgcattttacaagctgtctaacacaaaggaacagatccaagcatatgtttttgatgtcataagggcaagtataccaagattagatttggattctacctttgaacagaagaacgacatagccaaagctgtcgaaaatgaacttgaaaaggccatgtctgcttatggatatgaaatagtgcagaccctgattgtggacattgagccagattctcaggttaagagagccatgaacgagataaatgcagctgccaggctccgagttgctgcgaacgagaaggctgaggctgagaagatattgcagatcaagaaagccgaaggtgaagctgaatccaaatacttgtcggggcttggaattgctcgtcagcgccaagccattgtagatggtctaagggaaagcgttcttgccttctcggaaaatgtgcccggaacaacagctaaggatgtcatggacatggttctcattacccaatactttgataccatgaaggaaattggagcatcatcaaagtcgtccgctgtgtttatcccacatggacctggtgctgtgaaagatgttgctgcacagattcgggagggtcttctacaggctgaaagtgttgagcagtagaggttttccggagatccattgcatcgttgctgtttctctatttaaagtgtgtggacgtgttctgattaatgcagtatgtgtaaatgaagaacttctatgagatgctggtgaatatgaatatcttagaagtgtttgtaaatgttttttcgtcc

SEQ ID NO: 3862 - DNA, 1073 bp, Prunus mume
agttgcagaactgaaaaatgggccaagcacttggttgcattcaagtgaaccagtcaaaagttgctgtgagggaacaatttgggaagtttgatcatgtgcttgaaccaggatgtcactgcttgccctggtgtttcgggtacaagatagccggtgagctatcactgcgtgtgcgccaacttgaagttcgatgtgaaaccaagaccaaggacaatgtgtttgtcaatgtggttgcatctattcagtatcgtgccttaccggaaaagatagcggatgctttctataagctctctaatgccaactcacagattcaggcctatgtgtttgatgttatcagggcaagtgtacccaaactggagttggatgctgtctttgagcagaagagcgacatagcaaaagctgttgaagaggagcttgcaaaggcgatgtctacttatggttatgaaatagtccagacccttattgtggatattgtgcctgacgttcatgtgaagagagcaatgaatgagatcaatgcagctgcaagacacaggttggcagcaaaagaaaaggctgaagcagagaagatactgcagatcaagcgagctgaaggagaggcagagtccaagtacttggcagggcttggcatagcccgccagcgccaggctattgttgatgggttgagggatagtgttcttgtcttctctgagaatgttcctggaacatcagccaaggatgtcatggacatggtgctggtgactcaatactttgacaccatgaaggagattggagcatcctcgaagtcctcgtctgttttcatcccgcatgggccaggtgctgtgagggatgttgcttcacagattcgggagggtctccttcaagctgatcatgctaaggagtagaagggatacttgaaactcctaatatgcaaaaattttagtattgaagaataggttgttcttgttcactgctactcatatgcaaaactttgttatggttttctcctcttggtgatagaacacaattaatggttacattatgtagtagatgcggttggaggatataccactctaaagtaaaatatatgctgctttgaa

SEQ ID NO: 3863 - DNA, 1245 bp, Brassica rapa
gtaatctcctctcactctccccttctcttcctttttacaatacgcgtctctggttcctatataacagtttttgtagtttccttgattctataggatctcttcactttctcggcaactaattttattctcttactgttcacaattttgaaaacaaaaacaatgggtcaagttttaggatgtgtccaagttgatcagtcgactgtagcaatcaaagagacttttgggaagttcgacgatgttctccagccaggttgtcactgtatgccatggtgcttaggtagtcaagttgctggtcacctttcattgcgtgttcagcagctcgatgttcgctgcgagaccaaaacgaaggataatgtgtttgtcaccgttgttgcttccattcaataccgtgccttagctgagagtgctcaagatgcattttacaagctcagcaacactaggaaccagattcaagcttatgtctttgatgtgatccgagcaagtgttccgaagctggacctagactcaacctttgagcagaagaacgacattgccaaaaccgttgagagtgagcttgaaaaggctatgtctcattacgggtatgagatagtccagacgcttattgtggatattgagccagatgtgcatgtcaagaaggcgatgaatgagatcaatgccgcttcgagaatgagagaggcagcgagtgagaaagctgaggcagagaagatactgcagatcaagagagccgagggagaagctgaatcgaaatacctttcaggtcttggtatagcacgtcagagacaagctattgtggatggtctgagaaacagtgtgcttgcattttctgagtctgttccagggacttcttccaaagacgtcatggatatggttctggtgactcagtactttgacacacttaaggatattggagcgtcttccaagtcaaacgcggtgttcataccgcacggtccaggcgctgttaaggacattgcttcacagatcagggatggtctacttcaggggaaagctgctgagtaagaagatgtggaagtataaaactttcttcagggtttagctgttgtgttgttactttgtttttatatctttgtctttttgttttgtaaagtccttgaaatactttttgagtatctcaccaatggaagtgtcttataagtctgacgttttacttgaatctcactcaataaagctatcttcttcaatagttgatcatatctattttctctaataacaacaactatattctaa

SEQ ID NO: 3864 - DNA, 1213 bp, Hordeum vulgare
ggggaggcggaagaagaagccaacccaaccaagcgttcaagcagagcagacgaccggccggacgcgggacgacgacgacgacgtaccaataccaatccaaccagcaagccaagctcgtcggcgcccacccttcgccgcaagatagaccatgggtggggtacttggtttgatacagattgatcaatcgacagtagccatcaaggagacttttggaaagtttgatgcgatcctgcaacctggatgccactgcttgccatggtgcctggggcagcaggttgctggatatctttctctgcgtgtgcagcagcttgacgtccgatgtgaaactaagaccaaagataatgtctttgtcaacgttgtggcatctgtgcagtaccgtgctcttgctgacaaggcatctgatgccttttacaggcttagtaacaccagggagcaaatccagtcctatgtctttgatgtgatcagggctagcgttccaaagatgaacttggatgatgtatttgagcagaagaatgaaatagcaagggctgtggaggaggagcttgaaaaggcaatgtctgcctacggatacgagattgtgcaaactctgattgttgatattgagccagatgaacatgtgaagagagctatgaatgagattaatgcagctgctaggatgaggttggcagccactgagaaagcagaagcagaaaagattctgcagatcaagagggctgaaggcgaggcagaatcaaagtacctggctggtgtgggtattgcaaggcagcgtcaggcgatcgtggacggtctgagagacagcgttctcgccttctctgagaatgtgcctgggacttcctccaaggatgtcatggatatggttttggtgacgcaatatttcgacacaatgaaagatattggagcatcttccaagtcttcagcagtgttcatccctcacgggcctggcgccgtcaaagacatcgcttcacagatacgagatggtcagctccagggcaggatggtttgaggagtgttggaaaatggatgccacttctatatgcatacttttaagtacatacagcttattcttatagtactatatgtgagattgtgcctagatggatgataacatcagtacttgcttgggttgtgccactcgtttttctgtaaaaaatatcagttgtgctatcactgtgcttgccaccatttgtgaattgagtgtgtatggttattactc

SEQ ID NO: 3865 - DNA, 1424 bp, Hordeum vulgare
cgacgcgcaagaacttttctcccagcttataagtggcggaggaggggaggcggaagaagaagccaacccaaccaagcgttcaagcagagcagacgaccggccggacgcgggacgacgacgacgacgtaccaataccaatccaaccagcaagccaagctcgtcggcgcccacccttcgccgcaagatagaccatgggtggggtacttggtttgatacagattgatcaatcgacagtagccatcaaggagacttttggaaagtttgatgcgatcctgcaacctggatgccactgcttgccatggtgcctggggcagcaggttgctggatatctttctctgcgtgtgcagcagcttgacgtccgatgtgaaactaagaccaaagataatgtctttgtcaacgttgtggcatctgtgcagtaccgtgctcttgctgacaaggcatctgatgccttttacaggcttagtaacaccagggagcaaatccagtcctatgtctttgatgtgatcagggctagcgttccaaagatgaacttggatgatgtatttgagcagaagaatgaaatagcaagggctgtggaggaggagcttgaaaaggcaatgtctgcctacggatacgagattgtgcaaactctgattgttgatattgagccagatgaacatgtgaagagagctatgaatgagattaatgcagctgctaggatgaggttggcagccactgagaaagcagaagcagaaaagattctgcagatcaagagggctgaaggcgaggcagaatcaaagtacctggctggtgtgggtattgcaaggcagcgtcaggcgatcgtggacggtctgagagacagcgttctcgccttctctgagaatgtgcctgggacttcctccaaggatgtcatggatatggttttggtgacgcaatatttcgacacaatgaaagatattggagcatcttccaagtcttcagcagtgttcatccctcacgggcctggcgccgtcaaagacatcgcttcacagatacgagatggtcagctccagggcaggatggtttgaggagtgttggaaaatggatgccacttctatatgcatacttttaagtacatacagcttattcttatagtactatatgtgagattgtgcctagatggatgataacatcagtacttgcttgggttgtgccactcgtttttctgtaaaaaatatcagttgtgctatcactgtgcttgccaccatttgtgaattgagtgtgtatggttattactctataatttccatgctgctactagttcttccttcaactctctgaaaccttggaattttggagattgttcttacttctgaagctccctacatcgtaaaatttagccgaataaccccagtttctcgttcttgtactacgtaatgatatgttcttttgtatttagattttgt

SEQ ID NO: 3866 - DNA, 1322 bp, Cirsium arvense
gggacacgacagaatcttatctattacagaattgagttgaaatactggatacgatttcttgaggaggtttggtaaaaaaatagctggggagtaaactaataacagtttaatactcaattcacaatgggaaatgcgttcggatgcatccaagtggaccaatcaaccgtagccatcaaagaaacatttgggaagtttgatgatatccttactcctgggtgtcattgcatgccttggtgcttaggacagcagttagcaggttacctttctcttcgggttcaacagcttgatattcgctgtgaaacaaagacaaaggataatgtttttgtgacggttgttgcttcagttcaataccgagcactggcagataaggcatcggatgcatactataaacttagcaacactagggaacagattcaagcctatgtgtttgatgttattagagctagtgtcccgaggatagagctagatttggtctttgagcagaaaaacgatatagcaaaaagcgtggagaacgaacttgaaaaggccatgtctgcttatggctacgagatagttcaaacgctcatagtcgatattgagcctgacgaagttgtcaagaaatccatgaacgagatcaatgcagctgcacgaatgagggtggcggccaacgaaaaggctgaagcggaaaaaatcctgcaaataaagcgagcggaaggggaagcagaagcgaagtacttatcgggcctagggatagcaaggcaacgtcaagccatcgttgatgggctaagggagagtgtggtcgggttctcgtctaacgtccctggaacatcggctaaagatgtgatggacatgatcctagtgactcagtactttgatacgatgagagagatcggttcgtcatcaaaatcgacatccgtgttcatcccacatggaccgggggcggtcaaagatgttgctgctcagatcagagatggtctgcttcaaggtaatatgactcggatgtaaccattcctatggtgcacctctgaatgagtgagtctggtctggtctgaatctgatctcaaaataagtgtgtttaatttcaaaaaaagataaccgaattcttaaatctacccttaattaatgtatagatatttaagagatgtggagagagataaattgattaagggtgaagatgtcgttttggtaagtgtaataattatatatgtctataactttatgttgcatttatggttctttagggttaaggaatattttgttgaatcttataaaagcagaccatttatatgtatcttgtcctgaaaatagttatttaaaaaagaagtaatatatatataagatct

SEQ ID NO: 3867 - DNA, 1263 bp, Setaria italica
ggcttccccagctttaccctctgctctgctgcttcgctccggctgcgcgtgcaaagaatcgatcggaaaagataagacatgggtcaggttttgggtttagtgcaagttgatcagtcaactgtcgccatcaaagaaacttttggcaagttcagtgaggtcctggagcctggttgccacttcctaccctggtgcatagggcagcaggttgctggttacctctccctgcgtgtgcggcagctggatgtccgctgtgaaacaaaaacaaaggacaatgtcttcgtcactgttgttgcatctgtccaataccgtgcgcttgctgataaagcatctgatgccttctacaagctgagcaacaccagggaacaaattcaatcatatgtatttgatgtcattagagccactgttccaaagctggaattggatgacgcatttgagcagaagaatgacattgcaaaagctgttgaagaggagcttgaaaaggcaatgtctacatatggctatgagatcgtgcaaactctgattgttgatattgagcctgatgaccgtgtcaagagagcaatgaacgagatcaatgcagctgctaggatgaggttggcagccagcgagaaagctgaggccgagaagataatccagatcaagaaagctgaaggagaggccgagtccaagtacctggctggtgtgggtattgcaaggcagcgtcaggccattgtggacgggctgagggacagcgttcttgccttctcagagaacgtccctggcaccactgccaaggatatcatggacatggtcctggtcacccagtacttcgacaccatgaaggagattggggcctcatcgaagtcctcttcagtgttcatcccccatggtcctggagctgtcaaggatgtcgcggcacagataagagatggcctcctgcaagccagtcagtgagagggccctgagaaaagaaagtattggttttgattgcaaaagcaatgttgagggcactggttatgtggtgctttaacttgtgttatatgatatagctagacttgcatggtttgtgaatggtcagtaggcttttatattgattggaccacttgcgagtggatatcctatatgttagcgtggaaagtccatttggatcgaactcggagcttaatattgaaagtgcagcttctgacaagatgtttgttgctggtgaaattgtttttgtaggctccattttgatggactgcaaagtggtaattggcaaattttgatgctcagttagatttgttccac

SEQ ID NO: 3868 - DNA, 1370 bp, Avena sativa
ggcccgttttcagattctattccaacggcgattgaacactgttcccactcggcagaggaagggaaggaaatcccccggacgcgcaagaactgtgccataaattgcagcgcgatttggaggcggaaggagaccaaaccgagcagaacagacggccggccgaacccaatccaaccaatctcgagagcaggcagcagcagcccgcggtgttcatcctacgataagcaatgggtcaggcaattggtttgatacagattgatcaatcaacagtagccatcaaggagacttttggaaagtttgatgctattctggagcctggatgccactgcctgccatggtgcatagggcagcagattgctggatatctttcgctgcgtgtgcagcagcttgatgtcaaatgtgaaacaaagaccaaggataatgtctttgtcaatgttgtggcatctgtgcagtaccgtgctcttgctgataaggcatctgatgccttttacaagctcagcaacacccgggagcaaatccagtcctatgtctttgatgtgatcagggctagcgttccaaagatgatcttggatgatgtatttgagcaaaaaaacgaaatagcaaaggctgtggagaatgaacttgaaaaggcaatgtccgcctatgggtatgagattgtgcaaactctgattgttgatattgagccagatgtaaatgtgaagagagccatgaatgagatcaatgcagctgctaggatgaggttggcggccactgagaaagctgaagcggagaagatactccagatcaagagggctgaaggagatgcggaatccaagtacctggctggtctcggcattgcgaggcagcgacaggccatcgtcgatgggctgagggacagcgtgctggctttctctgagaatgtgcccgggacctcttccaaggatgtgatggacatggttttggtgacccaatattttgacaccatgaaggacatcggtgcctcgtccaagtcatcagctgtgttcatccctcatgggccaggtgctgtcaaagacatcgctgcacagatcagagatggtcagctgcagggcaggatggtttaagagtgctggaaactggacattttcaacttcccaagcagaagaccgcaacaatctagctacatattttgtgaaatgaaatttagagaaatattttatattttgtgagtactaaatgcatgcatgtttaagtgcagtttattctactactatatgtgaggttgtgcctagatgaatgttaatatacttgttactaaaattttactactcgtttctgtataaatcttggttgtgtaatcattaagtttgccactatttgtgaattgagtctgaaagaaaaatttcaacttatat

SEQ ID NO: 3869 - DNA, 1169 bp, Arachis hypogaea
ggggaaggctaagttcataggaggatattccattcaatagaaagaattgaaagatatgggtcaagctttaggttgtattatagttgggcaatcaaatgtggctattaaggaacactttgggaaatttgatgatattctgcaacctgggtgtcactgcctgccttggtgcctcggataccagatagccggcggcctttccctccgtgtgcagcaactcgatgtcaaatgcgagacaaaaaccaaggataatgtgtttgtcaatgtggttgcttccgtgcaataccgcgccttggccgataaagcatctgacgccttctataggctcaccaacacaaaggaacagatacagtcctatgttttcgacgttatcagggcaagtgtgccaaagttggagctggatgctgtctttgagcagaagaacgacatagcaagggccgtcgaagatgagcttgaaaaggccatgtctgcttatggatatgagattgttcagacccttattgttgatatagagcctgatgttcatgtcaagagagctatgaatgagattaatgcagctgctagattaaggctagctgctaatgaaaaggctgaagcagagaaaatacttcagatcaagaaagccgagggagaagccgagtccaaatacctgtcgggacttggaatagctcgacagcgccaggccattgtggatggactgagggacagtgtgcttgcattctccgagaacgtgcccgggacgacagcaaaagatatcatggacatggttctggtgacacaatacttcgacacaatgaaggaaattggtgcttcttcaaagtcctcagcagtgttcataccacatggtcctggtgctgttagggatgtttctgagcaaatcagagatggtttacttcaggccaatgcctcaccaaatctcttaaattaagcctttttctggaattgtgaatgacaatactaatgtatattgtgtgtgtgtgtgtgtgctttctggataattgatgcttttgtgcttgattttgtgttttaaagactagttgttaaagctttcaatattaaagattggtggaagcctgcaaggattacttagattttctttaattatgtcttatttgtgtgtgtttaaatttacattttgtatattcttgctaacaattaaaattgccttagac

SEQ ID NO: 3870 - DNA, 885 bp, Prunus persica
ctgaaaaatgggccaagcacttggttgcattcaagtgaaacagtcaaaagttgctgtgagggaacaatttgggaagtttgataatgtgcttgaaccaggatgtcactgcttgccctggtgtttcgggtacaagatagccggtgagctatcactgcgtgtgcgccaacttgaagttcgatgtgaaaccaagaccaaggacaatgtgtttgtcaatgtggttgcatctattcagtatcgtgccttaccggaaaagatagcggatgctttctataagctctctaatgccaactcacagattcaggcctatgtgtttgatgttatcagggcaagtgtacccaaactggagttggatgctgtctttgagcagaagagcgacatagcaaaagctgttgaagaggaacttgcaaaggcgatgtctacttatggttatgaaatagtccagacacttattgtggatattgtgcctgacgttcatgtgaagagagcaatgaatgagatcaatgcagctgcaagacacaggttggccgcaaaagaaaaggctgaagcagagaagatactgcagatcaagcgagctgaaggagaggcagagtccaagtacttggcagggcttggcatagcccgccagcgccaggctattgttgatgggctgagggatagtgttcttgtcttctctgagaatgttcctggaacatcagccaaggatgtcatggacatggtgctggtgactcaatactttgacaccatgaaggagattggagcatcctcaaagtcctcgtctgttttcatcccgcacgggccaggtgcagtgagggatgttgcttcacagattcgggagggtctccttcaagctgattatgctaaggagtagaagggatacttgaaact

SEQ ID NO: 3871 - DNA, 910 bp, Secale cereale
aaacgtagtaccggtaaccggaccttttaagggtaccggcggacccggccgggtacgggtaacgggagggttagggcgtacgacctacgacctacgactcactgccacttcaccgtcaccgctccccctttccccactcttctccaaccccggacggaggtatgggcaatctgtgctgctgtgttcaggtcgatcagtctaccgtggccatcagagagcagtttgggaagtttgacagtgtgcttcagccaggatgccactgcttgccttgggtcttagggaaacgtgtagttggccatctcacactcaggttgcagcagctggatgtgcgctgcgaaactaagacaaaggacaatgtgtttgtcactgttgttgcatcaattcagtaccgtcctctggctggcaaagaaagtgacgcatactacaaactgaccaacacaagatcccagattcaagcctatgtttttgatgtgatcagggcaagtgttccaaagctcaacctggatgatgctttcgtgcagaagaacgatatagcaaaggctgtggaagatgaacttgaaaaggctatgtcggcatatggctttgagatcgtgcagaccctcattgtcgacatcgagccagatgcgcacgtcaagcaggcaatgaatgagatcaatgcagctgcaaggatgagggtggctgcaaacgagaaggcggaggctgagaagatcgtccagatcaagcgtgccgagggtgaagcagaggccaagtacctgtccggcctcggtattgcccgccagcgccaggccattgtggatggcctgagggacagcgtcctgggcttctcagtcaatgtgcctggcaccactgcaaaggacgtgatggacatggtgctgatcacccagtacttcgatactatgaaagagattgg

SEQ ID NO: 3872 - DNA, 1173 bp, Pseudoroegneria spicata
aaccccaggcgcccaacgattttccttccggcgaaaccatccgactcctcgtcttcttggtcgccgaggctcaggataaaccatgggtggcgttttgggtttagtgcaggttgatcagtcaactgtagctatcaaagagacttttgggaagtttaatgaggtcctggagcctggttgccacttcttgccttggtgcatagggcagcggattgttggttacctctcactgcgtgtgaaacagctagatgtccgctgtgaaacaaagaccaaggataatgtctttgtgactgttgttgcttctgtccaataccgtgcccttggtgataaggcatctgatgccttctacaaactgagcaacacaaagcaacaaatccagtcctacgtctttgatgttattagagccactgtcccaaagctggagctggacgatgcatttgtgcagaaggatgacattgcaaaagctgttgaagaggagcttgaaaaggcaatgtctatgtatggctatgagattgtgcaaactctgatagttgacatcgagcctgatgtgcatgtcaagagggcaatgaatgagatcaatgcagcttccagaatgaggtcagcagccaatgacaaagctgaggctgagaagatacttcagatcaagagagcagaaggagaagccgagtcaaagtacttggctggtgtgggcattgcaaggcagcgtcaggctatcgtggacggtctgagggacagcgtcctcgccttctcggagaacgtccctggcaccactgcaaaggacatcatggacatggttctggtcacccagtactttgacaccatgaaagagattggggcctcatccaagtcctcttcagtgttcatcccccatggtcctggagccgtcaaggatgtcgcgtcgcagatcagagatggtctcctccaggccaatactctctaaagaggtccatggaaaaggatgggttctgttttgcaagagttgtgaagttcttcatcattcaccattaccctaaaaacatattttatgcgatagatattagtctaggtcgtgagtaatttatctacgtgtgtgaactactgcgttaagttgtgaattttacacggtgtgaactactacctagataatcagacttgcatggagtgggtttctataagaaaagtttagccagattccta

SEQ ID NO: 3873 - DNA, 905 bp, Oryza sativa
cgtacatcaaaatgggaaaattggtggcagcaataggtaaattgctctgctgtgtacaagttgaccagtcaacagtaggcatcaaggaaagatttgggaaatatgaggaggtgcttgatcctggatgtcactgcgtgccatggattattggaagccgtgttgctggtgagcttacactaaggcttaggcagctagatgtacgttgtgagacaaagacaaaggacaatgtttttgttacggttgttgcatccattcaatatcgagcaatggaggacaaagcaagcgatgcatactacaagctgagcaacccaaaatcccaaatccaatcttatgtctttgatgttatcagggcaagtattcccaaactagaattggacgatgcttttctgcaaaagaatgaaatagcaagagctgtggaggaggagcttgagaaggcaatgctagcttatggttatgagattgtgcaaacactgattgttgacatagaaccagatgagaaagttaagagggcgatgaacgaaattaatgctgctgcaaggctacgtgttgcagcaaatgagaaggcagaggcagagaagatcattcagatcaagagggccgagggagaggctgaagccaagtatctgtctgggcttggtattgcaaggcagcggcaggctatagttgatgggctaagagacagtgtacttggcttctctggcaatgttcctgggacttcagctaaggatgtgatggatttagtcctgctgacgcagtactttgacactatgaaagagatcggttcaacatccaaatcttcagcaattttcctccctcatggccctggtgctgttgcagatattgccagtcagatccgtgatggatgtcttcaggctcatcaaacaaagtgaaaaatccaaggaagc

SEQ ID NO: 3874 - DNA, 1737 bp, Picea glauca
ttaattaaattaatcccccccccccccggtaacatctaatttttaggacaacaaatgccaaccgatccaatccgtttcctgcggagcgatcatctttgaatggtgcccacgttcagagtcagatgtatactcattgaatgtgaaataatggagaataaaaagggacagcgatagaacactccaagccacgcaacattgtcccttaaagcatgaagagttttttttaagaaaagcctctcccagtaaagactgggtaccagcgctgtccccgtcgttgtaaattcaatcgagtagccgtcagcattcaggtcgtgtatgtgctattagcagttccggttcgtatcaaggtttttggcatctgatcagacccgtgcatcattcttcatcccagctcatcttgacagctttgttactcttcaggtacaggaataaataatatggggcagttattctgctgtatacaagtggatcagtcacaagtggctatgaaggagacatttggacgctttaatgaagttcttgaaccaggatgccactgtctgccatggattttggggcaaaaaattggaggtcatctttccttacgggtacaaaagctggatgtgcgatgtgagacaaagacgaaggataatgtatttgtgactgtaattgcatctgtgcaataccgtgccattttagagaaagcagtggatgctttttataagcttagcaatacaagggagcagatccaagcttatgtctttgatgttattcgggcaactgtcccaaagatgaacttggatgatttttttgagcaaaagaatcatgttgctaaagctgttgaacaggaacttgaaaaggttatgacaaactatgggtttgagatagtgcaaactctcattgttgatatagagcctgatgaaactgtgaagagagcaatgaatgaaataaatgcagccgcaagaatgagggtagcaacaaaagacaaagctgaggcagagaaaattttgcaaatcaaacgagcggaaggtgaagcagaagcgaaatatttatctggattgggtattgctcgtcaacgacaagcaattgtggatggccttagggacagtgtaattgctttctcagacaatgtgcctgggacaactgcaagagaagtaatggacatggtcttggtgacacaatatttcgacacaatgaaagagataggggcatcttcgaagtcctcggcagtattcatcccccatggacctggtgcagttagtgatgttgctgagcagatcagaaatggattacttcaggcacaagcccattaaacatcatataagcacatcatgaagtgtcgaattcagaataaaggagcatcgtgtgcagcaatgtttatagattaccttttgccttttaaggagtatttttttcgttttttttcatacaaggaattcttacagattttttggtattgtttttatgtttatgtacgaagtgcctatgtaccatatatgaagtaggcactcaaccttgtatatgaaatgttaatcaagaaaatatgcatatagtgtttggcagtgcatagctgtcttttcagttgtattaacaaagaaaggagttatgcatggaagtgaagatgggtaagtattaattataaatgtattacatttgtgtcttgtgaaaaggtcagcaaacttggggaatagaatcacagattgaagttctcagagatccattgaagttgcaataacagatttgaagtttgcgttaata

SEQ ID NO: 3875 - DNA, 2167 bp, Cannabis sativa
aaaaagaaaaaaaaaacaagatcagattatatcaaaggattcacatgatgggatcagctgcttagtcatccacgccttccaaaatcaagtggccaatttactataaagacaccctttttaatatcaactctttatacctctttgttcatatcttccaaacttgttaaaagaaataatgggcaatctattatgttgtataaaagttgatcagtcaacagttgctgtcaaagaaagatttggcaagtttactgaagtgcttgagccaggatgccattgtctaccatggattttgggctctcaactcgctggtcatctctctcttcggctacaacagttagatgttcgttgcgagaccaaaacaaaggataatgtgtttgtcaacgttgttgcatctgtacaataccgggttatcatcgacaaggctagtgaagcttactacaaactcagtaatccccggactcaaatccaagcctatgtttttgatgtgatcagagctagtgttcctaagctgaacttggatgatgtttttgagcaaaagaatgaaatcgctagagctgtggaagatgagcttgaaaaggctatgtgtgcttatggatatgaaatagttcagacactcattattgatatcgaaccagatgaacatgtcaaacgatcaatgaatgaaatcaatgcagctgcaaggatgaggttggccactaatgagagagccgaagcagagaaaatcatacagattaagcgagcagagggcgaggctgaatccaagtatctgtctggtgtaggcatagctaggcagcgacaggcgatcgttgatggcctgagagagagcgtggttggtttctccctcaacgtgccgggaaccactgccaaagatgtgttggacatggtccttctaacacagtattttgacaccatgaaagaaattggagccacctcaaagtcttcaacagtgttcatcccccatggaccaggcgtcgtaagagacgtggccactcagattcgagatgggctgcttcaggcaacctcaacctcatctcctcacagtcactcttgaggaatcgatgtacaaaatgtttgtgctgaataagttggcctacttgctaagatttatttagcaaagctctcatcatagactacattatggtgactgaaataggtcgaacaacataccatatactaaaagaatttcttgcttgttttacttattttgtccataactgaatttttgccaaaaaatgaaaaagaaaaaacaaagaacacaaggcatagggaatataaatagccatcaaaattggaaatgaagctcaactcaaaaccccctccataactggtttcatcaccctctttcaggagtgtgtcaataggagtaatagttcaaaacggtctatgacaccaagaacatttattttttacaacaggaaaaaaggaaaccgccaagaaattaataatgtaccataaagacttgtttcaaggaggaaaaaaaacagaatccacaatttgaattaaagagaagtcagtctgaaatctgaacggactactatgctaagctcctcaatggtgaaccctgccatggtgaccaattggaaataactcactcatggcttgagaaccaaagccaatccaaccttagcactcttttcaatggccttggtgtctacatccccagaaatggtgaagaatgactttggtcgccactcgtgctggataagagcactagccttgccaaggttgttcactcgcgctttcacagaggtcaatggatccaatgcatgctgggcaccaactgtgaatgtattctcgttggatgagaagctatgggttgcctcagcaccaaccgcggtgctagtgaaaggattaacaatgtgatagtatgaggcactcaaggtgtcacctttgtcgtttacagtcaatgaagctagtaggtcggcattggtgaagctcaatccaccattgaatttggtgaaatttccagtttttgagtcaaatgagacatcagtgccaagtgcaacagcattggttccaataacaccagaaaagttgacaataggattagctgtcaacccaacactggtgcttatacctgcatactcatgcaaatactggagttccacctgtttaaaaaaaggtataaaacggtagtttcagtactgattcgagtcaggtcgtgtca

SEQ ID NO: 3876 - DNA, 1045 bp, Vigna unguiculata
ggaaatgttgggttgatacaaaggcatatacaaaaaactgtgtttgtggcactccttttccttccctctaactttcagggttccgaaagaatatagatgggtctggctctgggttgtcttcaagtggagcaatctacggtggccatcaaagagatttttggcaaatatgatgatgtgcttcaacctggtttccactgtgtaccatggttctttggcactcaaatagctggttacctttctttgcgtgtgcaacagctagatgttcgctgcgaaacaaaaacaaaggacaatgtttttgtcactgttgttgcgtctattcaatatcgagcgctggcagagaaggcagatgatgctttttacaagcttagcaataccagggaacagatccaggcctatgtctttgacgtcattcgggcatgtgttcctaagatggatctagatgcctcatttgagcagaagaaagaaattgcaagagctgttgaggaagaacttgaaaaggctatgtctgcctacggatatgagatagtccagactcttattgtggatattgaaccagacgagcgtgtgaagagagccatgaacgagataaatgctgctgcaagattgagggttgctgcaaatgagaaagctgaagcagagaagattctgcagattaaaaaggctgaaggagaggcagaatcaaagtatttagcagggcttggaatagctcggcagcgtcaagccatagtagatggtctgagggacagtgtcctagccttctcagaaaatgtccctgggacatcatctaagatgtaatggacatggttttggtgacccaatactttgacacgttgaagagattggtgcgtcctcaaaatccaattctgtttttgttccacacggaccaggtgctgtaagagatattgcttcacagttcagagatggtcttctacaaggaagtatgactcggtcttgaggccacaaatatcacattactagaactataggaaccttctctctttcaaactctatccatatatacattttaattttgtctgtgactgtt

SEQ ID NO: 3877 - DNA, 1302 bp, Podocarpus macrophillus
agtttctgtgaacccaagactcctttaaattattgcataaaagaagtccaagacttttcgaaggagggacgaaatttctttcaagctttttcagttcggtgaagaattccgagaaacccccgtgaggcacagggaaagcaaaatgggacagttattatgctgttgtatacaagtagagcagtcaaatgttgccatgaaagagagatttggacgatatgaagaagttcttgagccagggtgccactgtcttccatggtttctggggagtcaagttggaggttatctttctttacgggtacaaaagcttgatgttcgttgtgaaacaaaaacaaaggataatgtttttgttacagtgattgcttctgttcaataccgtgcccttctggagaaagcaagtgatgctttttacaagctaagcaatacaagagagcagattcaagcttatgtttttgatgtcatcaggtcgagtgtcccaaagatgaatctggatgatgtttttgagcaaaagaatgaggttgctaaagctgtggaagaggaactcgaaaaggctatgtcaacctatggatttgagatcgtgcaaacacttattgtggatattgagccagatgaaactgtgaaaagagccatgaatgaaataaacgcagctgcaagaatgagggtagcgacacgagacaaagctgaggcggagaaaatcttgcaaattaaacgagcagaagctgaagcagaatcgaagtatctatcaggagtaggtattgctcgacaaaggcaagcaattgtggatggcctgagggacagcgtacttgcattctcagttaatgtacctggaacaacagcaaaagatgttatggatatggtgttggtgacacaatattttgacacaatgaaagaaataggagcctcttcgaagtcgtcatctgtcttcataccccatggacctggtgcagttcgtgatgtcgctgagcagatcagagatggactgcttcaggcgtcacagattcattgaaaactacgatgccccctggtgcaaagccaaatccgcaacaacttttaaattcgcaaaagccaggatatgttttacttttggatttccggttcacttttggctagagatatgtgaagacataaaaccttgtgatactgcatagctttcttatttcctatgtttccagtgttcatatacgcttggcatttgcttttgtcatttttctttggcaatgttgatagacatggagtatatgttaatatgactttggaataaaggcacatttgctatagtaaagtttacagattgactttttaaac

SEQ ID NO: 3878 - DNA, 1253 bp, Hordeum vulgare
gtctggttcagcggaaaaccccgggcgcccaacgattttccttccggcgaaaccatccgaatcctcgtcgccttcctgctcgccgaggctcaggataaaccatgggtggcgttttgggtttagtgcaggttgatcagtcaactgtagctgtcaaggaaacttttggtaagtttaatgaggtcctggagcctggttgccacttcttgccttggtgcatagggcagaggattgttggttacctctcactgcgtgtgaaacagctagacgtccgctgtgaaacaaagactaaggataatgtctttgtgactgttgttgcttctgtccaataccgtgcccttgttgataaggcatctgatgccttctacaaactgagcaacacaaagcaacaaatccagtcctacgtctttgatgttattagagccactgtcccaaagctggagctggacgatgcatttgtgcagaaggatgacattgcaaaagctgttgaacaggagcttgaaaaggcaatgtctatgtatgggtatgagattgtgcaaactctgatagttgacattgagcctgatgtgcatgtcaagagggcaatgaatgagatcaatgcagcttctagaatgaggtcggcagccaatgacaaagctgaggctgagaagatacttcagatcaaaagagcagaaggagaagccgagtccaagtacttggctggtgtggggattgcaaggcagcgtcaggctatcgtcgacggactgagggacagcgtgctcgccttctcggagaatgtccctggcaccactgcaaaggacatcatggacatggttctggtcacccagtacttcgacacgatgaaagagatcggagcctcatccaagtcctcttcagtgttcatcccccatggtcctggagccgtgaaggatgttgcatcgcagatcagagatggtctcctccaggccaatactctctaaaggggtccatggaaaaggatgggttctgttttgcaagagttgtgaagttcttcatcattcatcattatcttaaaaacatattatattatgtgataggtattaggtgagatcgtgagttatttatatgtgtgcatgaactactgcgtttaagttgtgaattttacacggtgtgaactatactacctagataatcagacttgcatggagtgggtttctgtaagaaaagtttagccagattcctattcgttgctactcgcaagtgagcctggatgtttaccagtcttatcttaattattt

SEQ ID NO: 3879 - DNA, 1324 bp, Hordeum vulgare
cccaggagggttctggttcagcggaaaaccccgggcgcccaacgattttccttccagcgaaaccatccgaatcctcgtcgccttcctgctcgccgaggctcaggataaaccatgggtggcgttttgggtttagtgcaggttgatcagtcaactgtagctgtcaaggaaacttttggtaagtttaatgaggtcctggagcctggttgccacttcttgccttggtgcatagggcagaggattgttggttacctctcactgcgtgtgaaacagctagacgtccgctgtgaaacaaagactaaggataatgtctttgtgactgttgttgcttctgtccaataccgtgcccttgttgataaggcatctgatgccttctacaaactgagcaacacaaagcaacaaatccagtcctacgtctttgatgttattagagccactgtcccaaagctggagctggacgatgcatttgtgcagaaggatgacattgcaaaagctgttgaacaggagcttgaaaaggcaatgtctatgtatgggtatgagattgtgcaaactctgatagttgacattgagcctgatgtgcatgtcaagagggcaatgaatgagatcaatgcagcttctagaatgaggtcggcagccaatgacaaagctgaggctgagaagatacttcagatcaaaagagcagaaggagaagccgagtccaagtacttggctggtgtggggattgcaaggcagcgtcaggctatcgtcgacggactgagggacagcgtgctcgccttctcggagaatgtccctggcaccactgcaaaggacatcatggacatggttctggtcacccagtacttcgacacgatgaaagagatcggagcctcatccaagtcctcttcagtgttcatcccccatggtcctggagccgtgaaggatgttgcatcgcagatcagagatggtctcctccaggccaatactctctaaaggggtccatggaaaaggatgggttctgttttgcaagagttgtgaagttcttcatcattcatcattatcttaaaaacatattatattatgtgataggtattaggtgagatcgtgagttatttatatgtgtgcatgaactactgcgtttaagttgtgaattttacacggtgtgaactatactacctagataatcagacttgcatggagtgggtttctgtaagaaaagtttagccagattcctattcgttgctactcgcaggtgagcctggatgtttaccagtcttatcttaattatttggtgatactctactatggtgtttgtattttatgctgagtttatctcggtcgcattgagctt

SEQ ID NO: 3880 - DNA, 1208 bp, Cirsium arvense
ggggaagggtattttcgtcaattacaaatacttgtacgtcacgcggaatcaaaccaacggcagaagaaacctccttgacagagggtgtgcacccgtaaactctgacatctcaatctcaccaagaaaagtaaaatcaacttttcaatctcatctttgattcttgaagccctaacgatcgcaagatttaaatcatgggtcagtcacttgggtgcattcaagttcagcagtctactgtagctgttaaagagcattttggtaagtttgatgacgtacttcagcctggctgtcactgtttgccatggtgcttggggtatcggttggctgggaagctatcgttgcgtgtgaatcagattgatgttcgttgtgaaaccaagacaaaggataatgtctttgtcaccatggttgcttctatacagtatcgtgctttgtctgataaggctgctgatgctttctacaagctctcaaacacaaagcaacaaattcaagcttatgttttcgatgttattagggctagtgtaccgaagctgcaattggatgacgtttttctgcagaagaatgatatagcgaaaggtgtggaagaggagcttgaaaaagccatgtccggttacggttttgagatcgtgcaaactttgattgttgatattgaaccggatccacatgtaaagagatccatgaacgagatcaatgcagcttcccgaatgagagtggctacaaacgaaaaagctgaagccgaaaagattctgcaaatcaaacgtgctgaaggagaagcggaatccaaatacctatctgggctcggtatcgctaggcagcgacaagccatcgtggacggtcttagagacagcgtgcttgctttttccgataacgtccctggaacatcggccaaggatgttatggacatggtgttgctgactcaatatttcgacaccatgaaagagatcggagcttcttctaaatcttctgctgtttttctacctcatggaccgggggcggtgaaagatatagcttcgcaaatccgtgagggtctccttcaggccgagagcgttcatgaatagtttacaggtacgtttttttcttcctgatcttttatattgacgaatacgtaaataattgggattttgatgaatattttaggattttgtaaagaaggtgaaaatatgtgtgtgtataggttttgatactatcgtaatatacttgattggtgtcgaatt

SEQ ID NO: 3881 - DNA, 923 bp, Cleome spinosa
cccagaaagggaggactgaagattcctctgagaaacgcagttttcgatttgggtaattcctcaaggaaaatgggtcaagcttttgggtgtatccaagtggaccagtcgaaggttgcaatcaaagagactttcgggaaatatgacgaggttcttgagcccggttgccattgtttgccgtggtgcttgggaagccaggtggccggctacctctccttacgtgttcagcagctcgacgtccgctgcgagacaaaaaccaggatatgtttttgtcacggtggttgcttccattcaataccgagccttagctgacaaggcccaagacgccttttacaagctcagcaacacaagggctcagattcaggcttacgttttcgacgtcatccgggcaagtgttcctaggctggacttggattcaacctttgagcagaaaaacgatattgcaaaggctgttgagagtgaactcgaaaaggctatgtcgcattatggctacgagatagttcagacactgatagtggatatcgagccagacgtgcatgtgaagagagccatgaatgagataaatgccgctgctagactgagagtggcagcgaatgagaaagcggaggcagagaagatactgcagataaagaaagcggaaggagaggcagagtcgaagtaccttgcgggattgggcatagcccgacagagacaagccatagtggacggtctgaggaacagcgttctcgccttctctgagaaggttccagggacatcttcaaaggatgtcatggacatggttctggtcactcagtactttgacacgttgaaagagataggggcatcttccaaatccaactcggtcttcatcccccatggtccaggagccgtcaaagacattgcttcgcaggttagggaaggtcttctgcaagcaagttcttctgcgt

SEQ ID NO: 3882 - DNA, 914 bp, Gerbera hybrid cultivar
ggttgtcattgcgtgccttggatattcggtagtcagcttgctgggcatctcaccctaaggcttcagcagttggatgttaagtgcgagactaaaacaaaggacaatgtctttgtcaatgttgttgcttcgattcagtatcgtgctctggccgataaggcaagtgatgccttctataaactcagcaacacaaggtcccaaatccaggcctacgtttttgatgttataagagctagcgttccaaagcttaatctagacgatgcttttgagcaaaagaatgaaattgccaaggctgttgaagaagaactcgaaaaggcaatgtctgcatatgggtacgagatcgttcaaacactaattgttgacatagaaccagatgaacacgtgaagagagcaatgaacgagatcaatgcagctgcaaggctgaggatggcagcaactgagaaagccgaggctgaaaaaattctccaaatcaagagagctgaaggcgaggctgagtccaagtacctctctggtttgggtatcgcacgtcagcgtcaagccatcgtggacggtttaagagacagcgtgttggggttctcggtcaacgtgcctgggaccacggctaaggacgtgatggacatggttctagtcactcagtatttcgacaccatgaaggagattggtgcagcctctaaatcctctgctgtgttcatccctcacgggcctggtgcggttcgtgacgtggctaaccaaattcgcgacggggttcttcaggggtcggccaccacaagattttcgggtatttagcaaaaagcaatgtggaggatagttttatgtttatatcatttgactttgcgagtttggggtttatttgctgtttatatgtttataaatattatcacacccgaaagggtaaaaaaatttgtggtttgtctact

SEQ ID NO: 3883 - DNA, 1245 bp, Zea mays
agcccctcctaaatttttttctagatccgtccctgtttgccgctgtgtttagctctcttccccgcaaggatccatcgatcggtcggacaggataagacatgggtcagattttgggtttagttcaggttgatcagtcaactgtagccatcaaagaaaattttggcaagttcagcgaggtcctggagcctggttgccacttcctgccctggtgcatagggcagcagattgctggttacctctccttgcgtgtgcgccagctggatgtccgctgcgaaacaaagacaaaggacaatgtctttgtcactgttgttgcatctgttcaatatcgcgctcttgctgataaggcatctgacgccttctacaagctgagcaacaccagggaacaaatccagtcatacgtatttgatgtcatcagagctactgttccgaagctgggcttggacgatgcatttgagcagaagaatgagatcgcaaaagcagtggaagaggagcttgaaaaggcaatgtctacttatggctatcagatcgtgcaaacgctaattgttgatattgagcctgacgaccgcgtcaagagagcaatgaacgagatcaatgcagctgctaggatgagggtggcagccagtgagaaagctgaggctgagaagatactccagatcaagaaagccgagggagaggcggaatccaagtacctggctggcgtgggtattgcaaggcagcgccaggccattgtggatgggctgagggacagtgtgctcgccttctcagagaacgttccaggcaccactgccaaggacatcatggacatggtcctggtcacccagtactttgacaccatgagggagattggggcctcctccaagtcctcttcggtgttcatcccccacggtcctggagctgtcaaggatgtctcggcgcagataagagatggcctcctgcaggctaatctgcactgagggtaccctgagaaaacgaaggattcagagggatgagggcatcggtcctatgatgctataaaattgtcaattatagactatatatgatatatagaggcaggcttgattgatttgtaaaagcatagttaagcaccgattgagctataagtgcacttgtgagtgagcctgggtatccaaacctgtcagctatttggtatgtatatgttctgcgtgcaaaatcctactgtagccatagcgttgaacaggaagaattgtaaatggatttggtgagtttatcaatcaggttactgca

SEQ ID NO: 3884 - DNA, 1271 bp, Elaeis guineensis
ttcggcttcggtatttatgcgggactttcctaatgcggaaatcatgtggttatcctcttcgtctttccctttcccgtctccatcatttaattctcctattgtgcgaaatttccaagtagtttcgtcttctcacccacctctctattctcatttacatgatgccttgttcctctctcgccaccgttctgtagctctttcaagtgccaattctttttttctttgaggcacaaaaatgggacaggtttttggttgcatacaagttgaccagtcaactgtagccatcaaggaaagttttgggaagtttgatgatgtgcttgatcctggatgccacttcttgccatggtgtttggggagtcgggttgctggttatctttcattacgtgtgcagcagcttgatattcgttgtgaaaccaaaacaaaggataatgtattcgtcactgttgttgcatctatacaatacaaagccatgtctgataaggcagttgatgctttctataagcttagcaacaaaaaggagcagatccaatcctatgtttttgatgtcatcagggctagtgtcccaaagttgaacttagatgatgtctttgagcagaaaaatgatattgcaaaatctgtggaagatgaacttgagaaggcgatgtcaacatatggatacaagattgtccaaacactcattgtggatattgagcctgatgtgcatgttaagagagctatgaatgagataaatgcagctgctaggatgagggtggcagcaaatgagaaagctgaagctgagaagatactgcaaatcaagcgggctgaaggtgatgcggaatccaagtacttagcagggctgggcatggcacggcaacgacaggccattgtggacggtctgagggatagcgttcttgcattctcaggaaacgtgcctggaaccacagcaaaagatgttctggacatgattctagttacccagtactttgacaccatgaaggagatcggtgcacactcgaagtcttcagctgtgtttatcccacatggccctggggccgtgaacgacatcgcatctcaggttagagatggattcctccaggccaaaaccactccatgaagtggccttaagaagcaatattggccaatgccattgcaaagaaactttggggaataaacatgtggatgtcttgcttgtagctgcgaacgttttggtcagctaggtgaaattaataacttacattattgccgtgatgctattgccgagtgaacacgaagcaattatagtttatcatgttgcc

SEQ ID NO: 3885 - DNA, 1015 bp, Secale cereale
gccagatataagtcggggagggccggagggaggcagaagaagaagccaagccaagcggagagcagagcagacggccggccggacgaaccaatctaaccagccaagctcgtcagcacgcggcgcagcagcagcccggctaccctcgccgcaagataaaccatgggtggggtacttggtttgatacagattgatcaatcaacagtagccatcaaggagacttttgggaagtttgatgcgatcctgcaacctggatgccactgcttgccatggtgcctagggcagcagattgctggatatctttctctgcgtgtgcagcagcttgacgtccgatgcgaaacgaagaccaaggataatgtctttgtcaacgttgtggcatctgtgcagtaccgtgctcttgctgacaaggcatctgatgccttttacaggcttagcaacaccagggagcaaatccagtcctatgtctttgatgtgatcagggctagcgttccaaagatgaacttggatgatgtatttgagcagaagaatgaaatagcaagggctgtggaggatgaacttgaaaaggcaatgtctgcctacgggtacgagattgtgcaaactctgattgttgatattgagccagatgaacatgtgaagagagccatgaatgagatcaatgcagctgctaggatgaggttggcagccactgagaaagctgaagcagaaaaaatcctgcagatcaagagggctgaaggtgaggcagaatccaaatacttggctggtgtgggtattgcaaggcagcgcgagccgatagtggacggctgagagacagtgttcttgccttttctgagaatgtgcctgggacctcttcgaaggatgtcatggatatggttttggtgactcagtacttcgatacgatgaaggacattggggcctcttccaagtcttcagcagtgttcatccctcacgggcctggcgctgtcaaagacatcgcttcgcagatacgagatggtcagctccagagcaggatggtttgagg

SEQ ID NO: 3886 - DNA, 1156 bp, Secale cereale
ctcctcgccgaggctcaggataaaccatgggtggcgttttgggtttagtgcaggttgatcagtcaactgtagctatcaaagaaattttgggaagtttaatgaggtcctggagcctggttgccacttcttgccttggtgcatagggcaacggattgttggttacctctcactgcgtgtgaaacagctagacgtccgatgtgaaacgaagacgaaggataatgtctttgtgactgttgttgcttctgtccaataccgtgcccttgttgataaggcatctgacgccttctacaaactgagcaacacaaagcaacaaatccagtcgtacgtctttgatgttattagagccactgtcccaaagctggagctggacgatgcatttgtgcaaaaagatgacattgcaaaagctgttgaagaggagcttgaaaaggcaatgtctatgtatgggtatgagattgtgcaaactctgatagttgacattgagcctgatgtgcatgtcaagagggcaatgaatgagatcaatgcagctgctagaatgaggtcggcagccaacgacaaagctgaggctgaaaagattctccagattaaacgagcagagggagaagccgagtcaaagtacttggctggtgtggggattgcaaggcagcgtcggagcgtatcgtggatggtctgagagacagcgtcctcgccttctcagagaacgtccctggcaccactgcaaaggacatcatggacatggttctggtcacccagtacttcgacacgatgaaagagattggggcgtcatccaagtcttcttcggtcttcatcccccatggtcctggagccgtcaaggatgtcgcatcgcagatcagagatgggctcctccaggccaatactctctaagcgagggtcatggaaaaggagcttctgttttgcaagagttgtgaagttcttcatcattcagcattaccctaaaaacatattttatgcgatagatattaggcaaggtcgtgagtaatttatctacgtgtgtgaactactgcgttaagttgtgtaattttacatggtgtgaagtactactacctagataatcaggcttgcatggagtgggtttctgtaagataagtttagccagattcctgaatggcacttgttgctacttgcaagtgagcctggg

SEQ ID NO: 3887 - DNA, 1161 bp, Phaseolus coccineus
acacaaaacaaactgtgttggtggcactcctttttcttccctcaaaccttcagggttccaaaagaatatagatgggtctggctttgggttgtcttcaggtggaacaatctactgtagctatcaaagaggtttttggcaaatatgatgatgtgcttgaacccggtttccactgtgtgccctggttctttggcactcaaatagctggttacctttctttgcgtgtgcaacagctagatgttcattgcgaaacaaaaacaaaggacaatgtttttgtcactgttgttgcatctattcaatatcgagcgctggcagaaaaggcagttgatgccttttacaagcttagcaataccagggaacagattcaggcctatgtctttgatgttattcgggcatgtgttcctaagatggatctagattcctcatttgagcagaagaaagaaattgcaagagctgttgaggaagaacttgaaaaggctatgtctgcttacggatatgagatagtccagactcttattgtggatattgaaccggacgagcgtgtgaagagagccatgaacgagataaatgctgctgcaagattgagggtggctgcaaatgagaaagctgaagcagagaagattctgcagattaaaaaggctgaaggagatgcagaatcaaagtatttagcagggcttggaatagctcggcagcgtcaagccatagtagatggtctgagggacagtgtgctagccttctcagagaatgtccctgggacatcatctaaggatgtaatggacatggttttggtgacccaatactttgacactttgaaggagattggtgcgtcctcaaaatccaattctgtttttgttccacatggaccaggtgctgtaagagatattgcttcacagtgtagagatggtcttctacaaggaagtatggctcgatcttgaagccacaaatatcacattactataactataggaaccttctatcttccaaactctatccatatatacattttaattttgtctatcactgttaagtttgaactatttctgaacgattataagccttcccacatccactgtctttccatccatgatttctttttatttgtgaatagtcaaacattgtactgttctttttccctttgaagtaaaaataaatttgcttagctta

SEQ ID NO: 3888 - DNA, 1334 bp, Amsonia hubrichtii
gttcatgcatactattcttatgctggattagcctgtaatgaatgctggttattgaatataaactgatgatatctcttcttgtcttttcacgcacgatatatataatttcgctcttcagaagcctactcaaaccctaagcaccacaacgattgttactgcctgcaaggttatactatgggtcaaacattgggatgcattcaagttgatcaatctactgttgctgtaaaggaacactttggtaagtttaataaggtgcttgagcctggatgccactgcttaccttggtgtttgggttataagttggctggttcactatctttgcgtgtgcaacagcttgatgttcgttgtgaaacaaagactaaggacaatgtctttgtgaccgtggttgcttccattcaatactgcgccttggcaagaaaggctgctgatgcgtattacaaactaacaaacaccagggcacagatccagtcctatgttttcgatgtcatcagggcaagtgtgccaaggttggaactggattctgtctttgtacagaagaatgagatagctaaggctgtggaggaagagcttgaaaaggcaatgtctacatatggtttcgaaattgttcaaaccctcattgtggacatagaaccagatgttcatgtgaagagagccatgaatgagattaatgcagctgctagaatgagggttgctgcaaatgaaaaggctgaagcagagaaaatattacaaatcaagaaagctgagggtgaagctgagtctaaattcctttcggggcttggtattgctcggcagcgtgaagctattgttgatgggctgcgggactctgtactttccttctcagagaatgtacctggaacttcagccaaagatgttatggacatggtgttggtaactcagtattttgatactatgaaggagattggagcatcatctaaatcatctgctgtgtttgtcccacatggacctggtgctgtgagggacattgccacacaaatcaggaatggtcttcttcaggctgagagtgcatcatattagctacatgggttgcttgataagcattgccaagaatatggagttggatgctcaagtatgtcatggttgtttagtttggttttctctaaagtgagccagcatttcacactactctctgtatatatttaaccttttaccgtaggctttgattacatgcaatgattagttcagccctggaatggcatttgctttcatgtggttaatgcaatttactacgtttctcaagagtactgttgttgcaaaccagtctctctctctctaaagaaagaataatcctttttcacctttctagtttgagtggt

SEQ ID NO: 3889 - DNA, 1094 bp, Brassica napus
aaaacaatgggtcaagttttaggatgtgttcaagttgatcagtcgactgtagcaatcaaagagacttttgggaagttcgacgatgttctccagccaggttgtcactgtatgccatggtgcttaggtagtcaagtcgctggtcacctttcattgcgtgttcagcagctcgatgttcgctgcgagaccaaaacgaaggataatgtgtttgtcaccgttgttgcttccattcaataccgtgccttagctgagagtgctcaagatgcattttacaagctcagcaacactaggaaccagattcaagcttatgtctttgatgtgatccgagcaagtgttccgaagctggacctagactcaacctttgagcagaagaacgacattgccaaaaccgttgagagtgagcttgaaaaggctatgtctcattacgggtatgagatagtccagacgcttattgtggatattgagccagatgtgcatgtcaagaaggcgatgaatgagatcaatgccgcttcgagaatgagagaggcagcgagtgagaaagctgaggcagagaagatactgcagatcaagagagccgagggagaagctgaatcgaaatacctttcaggtcttggtatagcacgtcagagacaagctattgtggatggtctgagaaacagtgtgcttgcattttctgagtctgttccagggacttcttccaaagacgtcatggacatggttctggtgactcagtactttgacacacttaaggatattggagcgtcttccaagtcaaacgcggtgttgataccgcacggtccaggcgctgttaaggacattgcttcacagatcagggatggtctacttcaggggaaagctgctgagtaagaagatgtggaagtataaaactttcttcagggtttagctgttgtgttgttactttgtttttattctttgtctttctgttttgtaaagtccttgaaatactttttgagtatctcaccaatgggagtgtcttataagtctgacgttttacttgaatcttcactctaaataacgtatactcttcttaaacgtaaaaaaaactagtagactcgacacggacacacgcggagtag

SEQ ID NO: 3890 - DNA, 1086 bp, Festuca arundinacea
  misc_feature (878)..(878): n is a, c, g, or t
  misc_feature (887)..(887): n is a, c, g, or t
ggcacgagggacggagggacgaaccaatccaaccaatctcgagagtaggcagcagcccctggtgcgtgttcatccttgttatcctctgtctcgccctacgataagccatgggtcaggcacttggtttgatacagattgatcaatcaacagtagccatcaaggagacttttggaaagttcaatgcgattctggagccgggatgccactgcttgccatggtgtatagggcagcagattgctggatatctttcgctgcgtgtgcaacagcttgatgtcaaatgtgaaacaaagactaaggataatgtctttgtcaacgttgtggcatctgtgcagtaccgtgctcttgcagataaggcatctgatgccttttacaagcttagcaacaccagagagcaaatccagtcctatgtcttcgatgtgatcagggctagtgttcctaagatgatcttggatgatgtatttgagcagaagaacgaaatagcaaaggctgtggaaaatgaacttgaaaaggcaatgtctgcctatgggtatgagattgtgcaaactctgattgttgatattgagccagatgtaaatgtgaagagagcgatgaatgagatcaatgccgctgctaggatgaggttggcagccactgagaaagctgaagcggagaagatactccagatcaagagagctgaaggtgatgcagaatccaagtatttagctggtctgggaatcgcaaggcagcgccaggccatagtcgatgggctgagagacagtgttcttgctttctctgagaatgtgcctgggacctcttccaaggatgtgatggacatggttttggtcacccaatattttgataccatgaaagacattggtgcctcgtccaagtcatcagcngtgttcatncctcatgggccaggtgctgtcaaagacattgctgcgcagatcagagatggtcagctccagggcaggatggtttaggagtgttggaaaatggatattttcaactttcaaagcagaagaccacagcagtctccatagctacatattttgtgaggagaaacttagataaatatttatattttgtgagtaccgactgcatgca

SEQ ID NO: 3891 - DNA, 1564 bp, Cajanus cajan
cggttggaccgaacgcggctaaagtgtatactttcctatcctcgtgcatttggattctgaaaacaactgaaaatcatgcgaaactgtcttatcattgccattactttacctcattccttcgctctctctttcctcctcttttcatcttccagcttctgaactccctatatataccattaccatcttttcttttcttttcattctcattattattatctttgttctgtatttcacaaccaagtactgaacttctctggttgtattgaggagaatcctcttttcattctcattgtttgtgttggaggtttagtgaggatgggacaagtgtttggttgcgtgcaagtggatcagtcaagtgtggcaatcaaggaagggttcgggaagtacaatgatgttcttgaccctggttgccactgtgtgccttggtgtttcggcagtcgtgtggctggtgccctttctttgcgtgtcaaacagctcgatgttcgctgtgaaactaagacaaaggacaatgtctttgttactgtggttgcttctatccaatatcgagtattggcagaaaaggcagtggatgcttattacaaactcagcaataccagtgcacagatacaatcctatgtctttgatgttatcagagcaagcgttccaaggatggaactagatgctacttttgagcagaagaatgatattgcaaaagctgtggaggaagaacttgaaaaggctatgtcagcttatgggtacgagatagttcagactcttattgtggatattgagccagatgagcatgtaaagaaagccatgaatgagataaatgctgctgcaagattgagggtggctgcaaacgagaaagcagaagcagagaagatattgcagatcaagcgagcagaaggcgatgcagaatcaaagtacttagcagggcttggcgttgctcgtcagcgccaagccatagtagatggactgagggacagtgtgcttgctttctctgagaatgtgcctggcacaacatcaaaggatatcatggacatggttctcatgacccaatactttgacacaatgaaggacattggtgcatcctcaaaatccaatgctgttttcattccacacggacctggtgctgtaaatgatgttgcttcacaaatcagggatggtcttctccaaggaaatgcaacactgtcttgaagacttgcatattatacctctactctagtagtttaaagtttaaacagcttcacaactatgtgcataagcacttaaaagtaaacaaaactgtcttgcaaatagaagttatattattggtggtttgtgtttgttttaatgttatgttatgtagagttatccttggctttgtctactatcagagttagcctttgagaagcctcgactacagaatgtgcactcacaaaacctttgggctttggttaggtttatgaaggtgctggccttcttataagtttgtgaaatttattaaaaataaatcataaatttttaatgtaatgatttgagtttgagttttaaatatgtagttggttatatactatataaaaaaattcaaaatatataaatattg

SEQ ID NO: 3892 - DNA, 1292 bp, Pseudotsuga menziesii
aacaggcgtgccgcgtggagatcatccttctgttaccgagtagtcctcttaattcaggtcgtgtatgtgctattagcagttcgtatcaaggtttttggcatctgatcagacctgtgcatcattttccatcccatctcatcttgacagctttgttacgcttcaggtacaggaataaataaaatggggcagttatgctgctgtatacaagtggagcagtcacaagtggctatgaaggagacatttggacgctttaatgaagttcttgagccaggatgccattgccttccatggatttttgggcaaaatattggaggtcatctttccttacgggtacaaaaactggatgtgcgatgtgagacgaagacgaaggataatgtatttgtgactgtaattgcatctgtgcaataccgtgccattttagagaaagcagtggatgctttttataagcttagcaatacaagggagcagatccaagcttatgtctttgatgtcatccgggcgagtgtcccaaagatgaacttagatgaattttttgagcaaaagaatcatgttgctaaagctgttgaacaggaactcgaaaaggttatgacaaactatgggtttcagatagtgcaaactctcattgttgatatagagcctgatgaaactgtgaagagagcaatgaatgaaataaatgcagccgcgagaatgagggtagcaacaaaagacaaagctgaggcagagaaaatcttgcaaatcaaacgagcagaaggtgaagcagaagcaaagtatttatctggattgggtattgctcgtcaacggcaagcaattgtggatggccttagggatagtgtacttgctttctcagacaatgtgcctggtacaactgcaagagaggtaatggacatggtcttggttacacaatatttcgatacgatgaaagagataggagcatcatcaaagtcatcagcagtattcatcccccatggacctggtgcagttcgtgatgtggctgagcagatcagaactggattacttcaggcacaggcccatcaaacatcataaaagcacatcatggagtgttgaatttcagaatagaggcatatcgtgtgcaccgatgtttatacattaccttttgcctttgaagtttgtttgctttttttgatttgtttttgtttttgtattatattatattaatctatttttcaaaatgtcaaacaaagaattcgtacagatactttggtattattttatattatgtatgaatcacactcaactttgtatatgaaatgttaataaagaaaataggcaca

SEQ ID NO: 3893 - DNA, 1323 bp, Secale cereale
cgatcttccttccggcgaaaccatccggctcatcgtcttcctcctcgccgaggctcaggataaaccatgggtggcgttttgggtttagtgcaggttgatcagtcaactgtagctatcaaagaaacttttgggaagtttaatgaggtcctggagcctggttgccacttcttgccttggtgcatagggcaacggattgttggttacctctcactgcgtgtgaaacagctagacgtccgatgtgaaacgaagacgaaggataatgtctttgtgactgttgttgcttctgtccaataccgtgcccttgttgataaggcatctgacgccttctacaaactgagcaacacaaagcaacaaatccagtcgtacgtctttgatgttattagagctactgtcccaaagctggagctggacgatgcatttgtgcaaaaagatgacattgcaaaagctgttgaagaggagcttgaaaaggcaatgtctatgtatgggtatgagattgtgcaaactctgatagttgacattgagcctgatgtgcatgtcaagagggcaatgaatgagatcaatgcagctgctagaatgaggtcggcagccaacgacaaagctgaggctgaaaagattctccagattaaacgagcagagggagaagccgagtcaaagtacttggctggtgtggggattgcaaggcagcgtcaggctatcgtggatggtctgagagacagcgtcctcgccttctcagagaacgtccctggcaccactgcaaaggacatcatggacatggttctggtcacccagtacttcgacacgatgaaagagattggggcgtcatccaagtcttcttcggtcttcatcccccatggtcctggagccgtcaaggatgtcgcatcgcagatcagagatgggctcctccaggccaatactctctaagcgagggtcatggaaaaggagcttctgttttgcaagagttgtgaagttcttcatcattcagcattaccctaaaaacatattttatgcgatagatattaggcaaggtcgtgagtaatttatctacgtgtgtgaactactgcgttaagttgtgaattttacatggtgtgaagtactactacctagataatcaggcttgcatggagtgggtttctgtaagataagtttagccagattcctgaatggcacttgttgctacttgcaagtgagcctggatgtttaccagtcttatcttaattattatttggtgtatactacaaaaaagtaaaaaaaaaaaataactaactagacgttgtatacactacggtcgtgagactagccaagacacacaggagtagtaggagg

SEQ ID NO: 3894 - DNA, 1299 bp, Secale cereale
tacgccacgcagccacaatccccaggttcagcgctgaagaagcggaaaccccaggcgcccaacgatcttccttccggcgaaaccatccggctcatcgtcttcctcctcgccgaggctcaggataaaccatgggtggcgttttgggtttagtgcaggttgatcagtcaactgtagctatcaaagaaacttttgggaagtttaatgaggtcctggagcctggttgccacttcttgccttggtgcatagggcaacggattgttggttacctctcactgcgtgtgaaacagctagacgtccgatgtgaaacgaagacgaaggataatgtctttgtgactgttgttgcttctgtccaataccgtgcccttgttgataaggcatctgacgccttctacaaactgagcaacacaaagcaacaaatccagtcgtacgtctttgatgttattagagccactgtcccaaagctggagctggacgatgcatttgtgcaaaaagatgacattgcaaaagctgttgaagaggagcttgaaaaggcaatgtctatgtatgggtatgagattgtgcaaactctgatagttgacattgagcctgatgtgcatgtcaagagggcaatgaatgagatcaatgcagctgctagaatgaggtcggcagccaacgacaaagccgaggctgaaaagattctccagattaaacgagcagagggagaagccgagtcaaagtacttggctggtgtgggcattgcaaggcagcgtcaggctatcgtggatggtctgagagacagcgtcctcgccttctcggagaacgtccctggcaccactgcaaaggacatcatggacatggttctggtcacccagtacttcgacacgatgaaagagattggggcgtcatccaagtcttcttcggtcttcatcccccatggtcctggagccgtcaaggatgtcgcatcgcagatcagagatgggctcctccaggccaatactctctaagcgagggtcatggaaaaggagcttctgttttgcaagagttgtgaagttcttcatcattcagcattaccctaaaaacatattttatgcgatagatattaggcaaggtcgtgagtaatttatctacgtgtgtgaactactgcgttaagttgtgaattttacatggtgtgaagtactactacctagataatcaggcttgcatggagtgggtttctgtaagataagtttagccagattcctgaatggcacttgttgctacttgcaagtgagcctggatgtttaccagtcttatcttaattattatttggtgatactctac

SEQ ID NO: 3895 - DNA, 2474 bp, Abies balsamea
agacaacgataccttaatttttcctagaaaaagtagtctacattgcatggaacattgcagtcacatggtggagagcctgcactcgagtgttaataatcggtgtaggacaatatctttaacccaaattttaagaatttcacaattttcgagaatttctgatcatctcaagtttgcgggtaggtaattatcagcgtgaaaatggctagtaaggagactgtatgtgtgactggggctagtgggttcattgggtcatggattgttcgtttgctactagaacgaggctactctgtgcagggaactgttcaagatctcggaaatgagaaggagactaagcatttggtagccatggaaggagccaaggagagactaaaattgtttcaaatagacctactggattatggttctatcgaggctgccattaatgggtctgttggtgttttccatttagcgtctccttgtattgtcgaagaagtcaaggacccacaatcccagcttttggatcctgctgtgaagggtaccatgcatgtcttgcaagcagcccaaaaagccaaagtgagacgattggttttaacctcctcaatctctgcaatcattcccagtccgaactggccttcagatgtgccgaaggatgagaactgttggactgatcttgattactgcaaacaaaatgggatttggtatcctgcatcaaaaacacttgctgaaaaagcagcttgggattttgccaaagaggttggtttggatgtggttgttatcaatccaggaactgtgatgggaccgattctgcctccagcaatcaatgccagtatgggcatgttacttcatcttcttcaaggtggcacagatggatatcagaatttttgcatgggcttcgtacatgtaaaagatgttgcagaaggacatatcttactatatgaaaccccatcagcatcaggaaggcacctttgtgttgaagcaataacccattggagtgactttgctgagacggtagcaaaattatatcctgaatataaaatacacaggttcacagaagtgacacaacctggtctgttacgagttcagaatggtgcaaagaaattgattgacctgggccttgtttttacacccatggagcaaataattaaagactcagtttctagtttaaaagaaaaaggtttttttaattgaatgatgacaatctttgtgttatcagatcttattatagtgaaaacaaaggccagtggccttcctatccacctggaaaaggaaatatatctgaattagtcaacgtggaccactgatttgacgatcatcggtttcgactctatatcatgcatgttagcttctgtgggacggttgtcaacatatttatctggactagtattaagctcttattattatataagaaagcatttgtatatgtaagatacaagctaaagctaaccataaaacatatggtttgattataacgaggaatgtggtaaataggaaactaaaatatatttaaggtgaaaaaaaaaaaaaaaaactaccttcataggaaaaaggtaagctattaacattgttgcagacaatgtgcttttaatctgaatttcgacactttatgaagtgcttttatgatgtttaatgggcctgtgcctgaagtaatccatttctgatctcctcagcaacatcacgaactgcaccaggcccatgcgggatgaatactgttgatgcctttgaatgtgctcctatctctttcattgtgtcaaaatattgtgtcaccaagaccatgtccatcacctcttttgcagttgtcccaggcacattgtctgagaaagcaagtacactatccctaagaccatccacaattgcttgccgttgccgagcaatacccaatccagataaatacttcgcttcggcttcaccttccgctcgtttgatttgcaagattttctctgcttcagctttgtcatttgttgctaccctcattcttgcagctgcatttatttcattcattgctctcttcaccgtttcaacaggctctatatcaacaatgagagtttgcactatctcaaatccgtaatttgtcataaccttttcaagttcctgttcaacagctttagcaacgtgattcttttgctcaaaaaaatcatccaagttcatctttgggacggttgcccgaatgacatcaaaaacataagcttggatctgctcccttgtattgctaagcttataaaaagcatccactgctttctctaaaatggcacggtattgcacagatgcaattacagtcacaaatacattatcctttgtctttgtctcacatcgcacatccagcttttgcacccgtaaggaaagatgacctccaatttgttgcccaaaaatccatggcatacagtggcatcctggctcaagaacttcactaaagcgtccaaatgtctccttcatagccacttgtgactgctccacttgtatacagcagagtagctgccccatttttatttatttatgta

SEQ ID NO: 3896 - DNA, 2025 bp, Setaria italica
cacacaacgaacgcgaacaaggaaatggccgccgcgccgcagcacgtccgcgcggcccctctcgcccgcgccctccgcgcgcgcgccaccgccaccgccaccgccaccgccgccgccgcgccgcccaagtctcaatctcagggggtgacttctcgccgcgcgctactcggcctctcagagcctgagctccgccagctcgccctcgacctcggccagcaaagctacagggggaagcagctgcacgacctcctctacaagtccagggccagccaaatccaagacttcaactacgtgcccaaggcgttccgggaggcgctgctcggcgctggctggaccgttggccgctcgccggtgcaccatgccgtcactgcctcggatggcactaccaagatacttctcaagttggaggataaccgcttgatcgagacagtagggattcctgtcgatgatgacagcaaaggctcttctaggctcactgcctgtgtttcatcacaggttggctgccccttgcgttgctcattctgtgccacgggcaagggaggcttcgccaggaaccttcgaccacatgagattgttgaacaggtgttggccatcgaggagatgttcaaacacagggtcacaaatgttgttttcatggggatgggcgagcccatgttgaacctcaagtcagttctagaagcacacaggtgtttcaataaggaactcaaaattgggcaaaggatgatgacaatctccacagtaggtgttcccaacacaataaaaatgctagcatctcacaagcttcagtcaacactggcagtgagcctgcatgccccgaaccagaagctgcgcgaaacaattgttcctagcgcaaagtcttaccccttgggagcactaatggatgactgcaagagttacttccttgaaactggacgcagggtatccttcgagtacactctgctagctgggatcaatgatgaaaaggagcacgccgaagaacttgcagaactgcttcatacatgtggaggtggttatcatgtgaacctaattccctataatccaattgaaggctctgaatacaagaggccatacagaaaagtggttcaagcgtttgttgatgcattagaagcacggaagataactgtcagtgttcgacagacccgggggctagatgctaacgcagcctgtggtcagctgagaaatgaattccagaagaatccgcttcttgaatcttcgccctcagagcccagcctcgtacctgcttgatggcaggactggagtacgtgtagatcatcacaacattttttaaagccgtttcaggaatgcgaggtttctgtttcaatgagaaaataggtgttgtaagtttgcaactattaagtcaagcaaattatgtagacagacagctatggaattttgaaacactgttgtgcctcactaaatcatgtagacagagcttacattggatgtcatgaattgcaattctcagtagccatgcttgtctcagatcttgccaaaaaaaaaagggtcgtttttacaacaggacgttgtatccacccccaggcagcttacattagatgtcacgaattacaattctcaatagatcttacaaaaacatgtcttttttttttacaagaagacattgtatcgcctccctgggagatattcacgaccaatttcttcaatgatgatttgttttgtgctactctatacccttggcaattttactgtgcggacacaaactgaaagctcaaaaagctaaaaagttaacgcctctatgattgccacaattctgttcaggaggttcagggcaaacaccgtatcttcagaattcaccttagcagtaagttccagtggccccgaggcatgcccttccgcaaggatcgtaattaggcaaggtttcaaagtgctcgggatttcactgctgaatctccagcataagccagatgtgtcgtcaacattgaaggtaactggcatatccattgaaacaaggtgcacgttggcgttgctcagtatttttgatgcaacactctgggctacttgaaggtt

SEQ ID NO: 3897 - DNA, 1574 bp, Zea mays
gccctttaaagaggcccaaatgaaagaaaataacatgtgaagggcaaaaaaaatctaaagagccagactctgcccaatccgtaatccaggatgaaatggctgcgccccagcacgtccgcgccgctcccctcgcacgcgcgctccgcgctaccgccaccgccaccgccaccgccaccgcctccgtccccgtacccgttcccgtccccgccggcatcaagtctcaggggacttcccgccgcgcactgctcggcctatcggagcctcagctccgccagcttgccatcgatctcggccagcaaagctaccggggcaagcagctgcacgacctcctctacaaatcaagagccaagcaaatccaagaattcaaccacgtgcccaaggcgttccgggaggcgttgcttggcgctgggtggagtgttggccggtcgccagtgcaccacgccgtcacagcctcggatggcactaccaagatacttctcaagttggaggataaccggttgatcgagacagtggggattcctgtcgatgatgacaacaaaggctcttctaggctcactgcctgtgtttcatcacaggtcggctgcccccttcgttgctcattttgtgccacggggaagggagggtttgcaaggaaccttcaaccacatgagattgttgaacaggtgttggccatcgaggagacgttcaaacacagggtgacaaatgttgtgttcatggggatgggtgagcccatgatgaacctcaagtcagttctagaagcacaccaatgcttcaataaggaactaaaaattgggcaaaggatgatgacaatatctacagttggtgttccaaatacaataaaaatgctagcatctcacaagcttcagtcaacgctggcagtcagtctgcatgccccaaatcagaagctgcgggagacgattgttcctagcgccaagtcttaccccttgggagcactaatggatgactgcaagagttacttccttgaaactgggcgcagggtatccttcgagtacactctgctagctgggattaacgatgaaaaggagcatgccgaagagctagcagaactacttcgtatgtgtggaggtggttaccatgtgaacctgattccctataacccaattgaaggctccgagtacaagagaccttacagaaaagtggtccaagcctttgttgatgctttagaagcacgcaagataaccgttagcgttcgacggacccgtgggcttgacgctaacgcagcctgtgggcagctgaggaatgagtttcagaagaatccactacttgagattgaaccgtcaccctccacagagcggaccctcgtagctgcttaattgaaacacctatcaggttgatgcagcatgttcaagcatacggaatcgtcatttaatttatggggacattaggtgttgtaaagtgacagcaagttatgcataacgctagagaattttggaacgttctgtccgtgcccatctgatgtcatgagtggcaattacggaattaccacacttgtctcagatattataaacccatctttgttacagaaagtcaccagaaatgaactcctactgtcc

SEQ ID NO: 3898 - DNA, 1632 bp, Triticum aestivum
ccggcgacccacgcttccgcccacgcgtccggcagcagcaggaaaaagaatggccgcgccgcagtaggtccgcgccgtgcgcctggcgcgtgcgctccgcctccgcacgcgcgcctccgccgcccccgccgccgcgccggagacgtcccgccgcgcgctcctcggcctcacggagcccgagctccgccagctcgccgtcgacctcggccagcaaagctaccgggggaagcagctgcacgacctcgtctacaagaacagggccaagcaggtggaggagttcgcctacgtgccaaaggtgttccgggaggcgctggtcggcgcgggatggaacgtgggccggtcgccggtgcaccacgccgtcacggccaccgatggcaccaccaagatacttctcaagctggaggacaacagactggtggagacggtggggatccccgttgacgacaggggcacgcctagactcacagcctgcgtttcatcgcaggttggctgccccttgcgttgctcgttctgtgccactgggaagggagggtttgcgagaaacctcaaggggcacgagattgtcgagcaggtattggccatagaggagtcgttcaaacacagggtgacaaatgtagtgttcatggggatgggtgagcccatgctgaacctcaaagcagttctggaggctcaccaatgcttgaataaggaactaaagattgggcaaaggatgatgacaatctcaacagtaggtgttcccaacacgataagtaagctagcatctcacaagcttcagtcgacactggcagtcagcctgcatgccccaaatcagaggttgcgtgaaacaattgttccaagtgcaaaggcatatcctctggaagcactaatggatgactgcaagaattattttctcgaaactggacgcagggtctccttcgagtacaccctactagctgggattaatgatgaaaaggcacacgctgaagaacttgcagcgctgctgcatgcatgtggaggtggttatcacgtgaacctgattccctataacccggtagaaggctctgagtacaagaggccttacagaaaagcgattcaagcgtttgttgatgcgctggaatctcggaagatcacagtcagcgttcgacagacccgtgggcttgacgctaatgcggcttgtgggcagctcaggaatgagttccagaagaatcctctgcttgaatcgtcaccaccctctgagcccaaccaactgctggagtcgtctacgccctcagagtccagcctcgttcctgcttagtgcaggaaatctacctcaattatgagaaatcgagattgttgtgaatttctggattctaaagttcacacaggccctgaattgctctgctcatacatagatcaccggcttataagttataaagctgattaggatgcagccttctgtggccttcggtgtgagaggctcctgttcagttgagatttgaaggattttctttgagatatgaagtgttctgcgtgaagttaggatatgtatttgatacaagttatgtatatgggtagagaattttggaacaaatagcatgtatggtattgaagctgccaaatcttattccattaatgtctgaatttcaatataaccatcctccaaaattttaaaat

SEQ ID NO: 3899 - DNA, 2317 bp, Brachypodium distachyon
aacctcccccagtctcctgccatgcaagcaagcgaagcaacccacctcgcacacctccagagcaacgagaagaagaaacaacccattcctctctctcgccgtcgccaatggccttcgtcggcggcggcgctgcagcagcggccgctctcgccgttgccttcctgctccccctcctcgccgccgcctccgactccgaccacaagtaccaagaggaagatccggttacgctctgggtgaacaaggttggtccctataacaacccgcaggagacgtacaactactacagccttccattttgccacaagtcagataaccctgtgcacaaatggggagggcttggtgaggtcctcggagggaatgaactgattgatagccagattgacataaaattcagaaagaatgttgataaggataccatatgttcgatggaacttgatcctgacaaggccaagcaattatcagatgcaattgagaattcatactggtttgaattcttcatcgatgatttgcctctctggggttttgttggagaagcagataaaaacaatgataacaaatattttcttttcactcacaagaacattctcatcagatacaatggcaatcagattatccatgttaatcttactcaagaaagtccaaagcttattgatgcgggtaaggcattggatatgacatattctgtcaagtgggaaccaacaaatgtaatgtttgctcatcgctttgatgtataccttgactatcctttctttgaacaccagatacattggttttcaatcttcaattcttttatgatggttatctttctcagtgggctagtgtcgatgatattgatgcgcactctaagaaatgattatgcaaagtatgcccgtgatgatgatgatctggaaactctggaaagagatgtcaatgaagaatctgggtggaagcttgttcatggggatgttttccggcctcctcgcagtttagctcttctttcagctctcgtcggtattggtacacagttgtccgctcttattctgctagtgattctgttggcaatcatcggaatgttgtacattgggcgaggagctatcgtcacaacattcattgtttgttatgcacttacttcattcatttctggatatgttagtggtgccctatactcacgacatggggggaagaactggatcaagtcaatgatcatgacagcatcactgttcccatttatgtgctttggaattggcctagcgctcaacactgttgctatattctaccgatcattagctgctataccatttggcacaatggtggttatgttcatcctttgggccttcatctctttccctcttgctcttttgggaactgttgttggtagaaactggagtggtgccccaaataatccatgcagagtgaagactattccgcgtcctatccctgagaagaaatggtacctcacgccttctgtaattgcccttatgggaggattgcttcctttcggcagtatcttcatcgagatgtacttcgtcttcacatcgttttggaattacaaggtgtactatgtatacgggttcatgttgctggtctttttgatcctcctaattgtcaccatctgtgtaacaattgttggtacatacttcttgctcaatgctgagaattaccactggcaatggacctcattcttctctgctgcttccactgccgtttatgtttacctctactccatatactattacaatgtgaagaccaagatgtcaggattcttccagacaagcttttacttcggctacactttgatgttctgcctaggtttaggaacactttgcggtgctgtaggataccttggatcgacattgttcgtgagaaggatatacaggaacataaagtgtgactaaagattggccacaattatactggtggggggaaactgtctatcaattcctcgtttcgacgagggggcattgtttctgtggccaagaagccagggcatttgtgaaatctgatcattatttgacagcaagctgggcagccgtggtttttatgtgttcttgtcccttttgttccatctgcgcccctcttcggggctaaaaattttcatgctcaatgagttatatagttgtgatcatagttgctaagtagtagtctagtatatacagcagttgttattcttaaacccaatgggacatgtattttgtcttgtaaaactgtaagatcgatgatactagtgatatttgataatgaacactgctcgaagtatatttatcatgcttgtgctttctgggacgcaaaactacagaaagaaaattggatgattcagttagtcgttctttcttctaca

SEQ ID NO: 3900 - DNA, 2347 bp, Setaria italica
ccatgcagcagtcccccctctcttccgtcgcatacctctccaaacacaaggggcgagaagaactgaggcacgagcaccgcccccgcgccggccggccattcccttcgccaatggcctccgccggcggcgccgcgctcgccgccctcgcgctcctcgtcctcctccccgtcgccgcggcctccgattccgaccacaagtaccaagcggatgagcctgtgacgctctgggtgaacaaggttggtccgtacaacaacccgcaggagacttacaactactacagcctcccgttctgtcacgcaacagaaaaccatgtgcacaagtggggagggcttggcgaggtccttggtggcaatgaactcatcgatagccagattgacatcaagttcagaaagaatgttgataaggccaccatttgttctcttgatcttgatcttgacaaggccaagcaattatcagatgcgattgaaaacttatattggttcgaattcttcatcgatgatttgcctctgtggggctttgttggagaggcagacaggaacaacgataacaaatattttcttttcacccacaagaatattgtcatcagatacaatggcaatcagattatccatgttaatcttactcaagaaagtccaaagcttattgacgcaaataaggcaatggatatgacatattctgtcaagtgggaaccaacaaacataacatttgctcatcgctttgatgtgtacctggactatcctttctttgaacaccagattcactggttctcaattttcaattctttcatgatggttatctttctcactggacttgtgtcaatgatattgatgcggactctaagaaatgattatgcaaaatatgctcgtgatgatgatgatattgaaactctggaaagagatgtcaatgaagaatctggatggaagcttgtacatggtgatgttttcagacctcctagaaatctagttcttctttcatctcttgttggtattggcacacagttggcagcacttattcttctagtaattttgctggcaatcatcggaatgttgtacattgggcgaggagctattgtcacaacattcattgtttgttatgctcttacttctttcatctctggatatgtcagtggcgcactatactcacggcatggagggaaaaactggatcaaggcaatggccatgacagcatcacttttcccatttatgtgctttggaattggcctagtgcttaacaccattgctatattctatggatcattagctgccataccattcggtacaatggtggtcgtattcatcctgtgggccttcatctctttccctcttgcccttttgggaaccgttgttggtagaaactggagtggtgccccaaacaatccgtgcagagtaaagactattcctcgccctattcctgagaagaaatggtatctcacaccatctgtcattgcccttatgggaggactgcttcctttcggtagtatcttcattgaaatgtactttgtcttcacatcattttggaactataaggtgtactatgtttatgggttcatgttgctggtctttctgatcctcataattgtaaccatctgtgtgacaattgttggtacatatttcttgctaaacgctgagaactaccactggcagtggacttcattcttctctgctgcttccactgctgtgtatgtttacctatactccatatattattaccacatgaagaccaagatgtcaggattcttccagacaagcttctacttcggctacactctaatgttctgcctaggtttaggaacactgtgtggtgccgtaggatatcttggatcaacattgtttgtgaggaggatctacaggaatataaagtgtgactaaatgaagaaaatgacaaccccaatttggatgagtggggagaaactgcatacaagagccttgtttctttgaggtttgaggatcattcattcatctatcctgcagccgagaagccagggcatttttgtggaatatatgattttcgggacagctgcaagcccttctcttgtccttttttacttcacttcgatcctgcttggggcggtgataaattttcatgttgaattagttatatagcagcattgtagttgttgagtagtagctctagtatatatcacaattgttatccttgaacccattgaaatctgtatttatgggtataaactgtatcatccacattaccagatgtttgatgataaacacaattccaaaagatcagtcctattctgtcttaggcttgagcattttgagaggtaaaatcatgagggaaaaaagaggctcggttggtgtaactgaaagtaaaaattgcaatagtactgtat

SEQ ID NO: 3901 - DNA, 2341 bp, Sorghum bicolor
caaaaacctcgggcttcccctgccttccatgcagcagtccccctttccttccccttccgtcgccctccgcactcctccaaaacacaacgagaaaaacagagagacgaccaccgctccgcgccggccggccattccatccggcaatggcctccgccgcgggcgccgcatctgccgccatcgccctcctcatcctcctacccctcgccgccgcctccgactccgaccacaagtaccaagcagaggagcctgtgacgctctgggtgaacaaggttggtccgtacaacaatccccaggagacatacaactactacagcctcccattttgccatgcgtcagaaaaccatgtgcataagtggggaggacttggcgaggtccttggtgggaatgaactcattgacagccagatcgacataaagttcagaaagaatgtcgataaggccacaatttgttcgctcgacctggatcttgtcaaggctaagcaattgtcagatgcgattgagaactcgtattggtttgaatttttcattgatgatttgcctttgtggggttttgttggagaggcagacagaaacaatgataacaaatatttcctattcacccataagaatatcgtcatcagatacaatggcaatcagattatccatgttaatcttactcaagaaagcccaaagcttattgatgtgaacaaggcattggacatgacatattctgtcaaatgggaaccaacagacataacatttgctcaccgctttgatgtgtatctggactatcctttctttgaacaccagattcactggttctcaattttcaattctttcatgatggttatctttctcactggactagtgtcaatgatactgatgcggactctaagaaatgattatgcaaagtatgcccgtgatgacgatgatattgaaactctggaacgagatgtcaatgaagaatctggatggaagcttgtacatggtgatgttttccggcctccttgcaatctagttcttctttcagctcttgttggtattggtacacagttggcagcactgattctactagtgattttgttggcaatcattggaatgctgtacattgggcgaggagctattgtcacaacattcattgtttgctatgctcttacttcattcatctctggatatgtcagtggtgcactatactcacggcatggagggaaaaactggatcaaggcgatggccatgacagcatcacttttcccatttatgtgctttggaattggcctagggcttaacactattgctattttctatggatcattagctgccataccatttggtacgatggtggttgttttcatcctgtgggctttcatctctttccctcttgcccttttgggaactgttgttggtagaaactggagtggcgccccaaacaatccctgtcgggtaaagactattcctcgacctattcctgagaagaaatggtacctcacaccctcagtcattgcgcttatgggaggactgcttccatttggtagtatctttattgagatgtactttgtcttcacatccttctggaactataaggtctactatgtttacgggttcatgttgctggtctttctaatcctcataattgtcaccatatgtgtaacaattgtcggaacatatttcttgctaaatgcggagaactaccactggcaatggacttcattcttctctgctgcttccactgctgtgtatgtttacctctactccatatattattaccacatgaagaccaagatgtcaggattcttccagacaagcttctacttcggctacactctaatgttctgcctaggtttaggaacactatgcggtgccgttgggtatcttggatcgacattgtttgtgaggaggatctacaggaacataaagtgtgactaagtgaagataatatcgccccattttgggtcagtgcagagaaactgtatggcagagccttatttgattgggcgatcactgattctacaaccaagaagccagggcgttgtgtggaatgtgatcatcgtttggcgctgagctgaaagccatgtatttcaattcttgtcatttttgtttctctcctatctcttctgggcttgggcaggcaacaaattttcatgttcaattagttatatacagtagtaattgtagttgttgagtagtaggtctgtagcatataccacaattgttatccttgaacccagtgatacctcagattgatgggtataaactgtaacatttacattacttgatgtttgacgatgaacacagttccaaaagaatcatgtttggtactggagggtcgagattttttgagagtctaagtcatcaaagaaaaaaat

SEQ ID NO: 3902 - DNA, 2343 bp, Panicum virgatum
cggctgccctggcctgacccctctgcacgcctctccagcacacaagcggggaaaagagcagagacacgagcaccgcccagcgccgcgccggcccggcccggccattcactccgccaatggcctccgccggcgtcgccgcgctcgcgctcctcgtcctcctccccgtcgccgcggcctccgactccgaccacaagtaccgagccgatgagcccgtgacgctctgggtgaacaaggttggcccgtacaacaacccgcaggagacgtacaactactacagcctcccgttctgccatgcaacagaaaaccatgtgcacaagtggggagggcttggtgaggtcctcggtgggaatgaactcatcgacagccagattgacataaagttcaggaagaatgtggacaagggcaccatttgttctcttgatcttgatgctgacagggccaagcaattatcagatgcaattgaaaactcatattggtttgaattcttcatagatgatttgcctctgtggggttttgttggagaggcagacagaaacaatgataataaatatttccttttcacccacaagaatattgtcatcagatacaatggcaatcagattatccatgttaatcttactcaagaaagtccaaagcttattgatgcgaataaggcaatggacatgacatattctgtcaagtgggaaccaacaaacataacatttgctcatcgctttgatgtgtacctggactatcctttctttgaacatcagattcactggttctcaattttcaattctttcatgatggttatctttctcactggactagtgtcaatgatactgatgcggactctcagaaatgattatgcaaaatatgctcgtgatgatgatgatattgaaactctggaaagagatgttaatgaagaatctggatggaagcttgtgcatggtgatgttttcaggcctcctagaaatctggttcttctgtcatctcttgtcggtattggcacacagttggcagcacttattctgctagtaattttgctggcaatcattggaatgttgtacgttgggcgaggagctatcgtcacaacattcattgtttgttatgctcttacttcgttcatctctggatacgtcagtggtgcactatactcacggcatggggggaaaaactggatcaaggcgatggccatgacagcatcatttttcccatttatgtgctttggaattggtctagtgcttaacactattgctatattctatggatcattagctgccataccatttggtacaatggtggttgtttttatcctgtgggccttcatctctttccctcttgctctttcgggaactgttgttggtagaaactggagcggcaccccaaacaatccatgcagagtaaagactatccctcgtcccattcctgagaagaaatggtacctcacaccatctgttattgcacttatgggaggactgcttccttttggtagtatcttcattgagatgtactttgtcttcacatcgttttggaactataaggtgtactatgtttatgggttcatgttgctggtctttctgattctcatagttgtaaccatctgtgtaacaattgttggtacatatttcttgctaaacgctgagaactaccactggcagtggacttcattcttctctgctgcttccactgctgtatatgtttacctctactccttatattattaccacatgaagaccaagatgtcaggcttctttcagacgagcttctacttcggctacaccctaatgttctgcttaggcttaggaacactatgtggtgccgtaggatatcttggatcgacattgttcgtgaggaggatctacaggaatataaagtgtgactaaatgaagaaaatgtcaaccagaatcctgagtggggaaggaaactgcataccaggccttgtttctttgaagaccattcattcatctatctgccgccaagaagccagggtgttttttttttgtggaatatgatttttttgggacgagctgcaagcccttcacttgtcctctttgtttctctttgatctcgcttggggcgataaattttcatgttagttatatagcagcattgtagttgttgattaggagctctagtatatattacaattgttattcctgaacagctgaacccattggaacctgtattgatgggtataaactgtaacatccacgttacctgatgtatgatgataaacacaattccaaaagatcaatccttttcagccttaagcttaagcattttgagaggataaatcatgaggtaaattacaaaaaaaaggctcggtttgtgtaactggaagtgaaattagattaacactgt

SEQ ID NO: 3903 - DNA, 2277 bp, Zea mays
ttccatgcagcagtccccccttcgtgtcgcactcgcacagtcgcactccataaggcaaggaggaaaacagagagacgaccaccgctccgcgccggccggccattccatccggcaatggcctccgccgccggtgctgcgttcgccgccatcaccctcctcatcctcgtacccctcaccgccgcttcggactccgaccacaagtaccaagcagcggagcctgtgacgctctgggtgaacaaggttggtccgtacaacaatccgcaggagacatacaactactacagcctcccattttgccatgcgtcagaaaaccatgtgcataagtggggaggactcggcgaggtccttggtgggaatgagctcattgacagccagatcgacataaagtttggaaagaatgttgataaggccacaatttgttcgctagacctcgatcttgtcaaggctaagcaattgtcggatgcgattgagaactcatattggtttgaatttttcattggttttgttggagaggcagacagaaacaatgataacaaatatttcctattcacgcacaagaatattgtcatcagatacaatggcaatcagattatccatgttaatcttactcaagaaagcccaaagcttattgatgtgaataaggcattggatatgacatattctgtcaaatgggaaccaacaaacataacatttgctcaccgttttgatgtgtatctggactatcctttctttgaacaccagattcattggttctcaattttcaattctttcatgatggttatctttctcactggactagtgtcaatgatactgatgcggactctaagaaatgattatgcaaagtatgcccgtgatgatgatgatattgaaactctggaacgagatgtcaatgaagaatctggatggaagcttgtacatggtgatgttttccggcctccttgcaatctagttcttctttcagctcttgttggtattggtacacagttggcagcactgattctactagtgattttgttggcaatcattggaatgctgtacattgggcgaggagctattgtcacaacattcattgtttgctatgctcttacttcattcatctctggatatgtcagtggtgcattatactcacgtcatggaggaggagcagggaaaaactggatcaaggcaatggccatgacagcatcacttttcccatttatgtgctttggaattggcctggtgcttaacactattgctattttctatggatcgttagctgccataccatttggtacgatggtggttgttttcatcctgtgggccttcatctctttccctcttgcacttttgggaactgttgttggtagaaattggagtggtgctccaaacaatccctgtagggtgaagactattcctcgccctattcctgagaagaaatggtacctcacaccatctgtcattgcgcttatgggaggactgcttccttttggtagtatctttattgagatgtactttgtcttcacatcgttctggaactataaggtctactatgtttatgggttcatgttgctggtctttctgatactcatcattgtcaccatatgtgtaacaattgtcggtacatatttcttgctaaatgcggagaactaccactggcaatggacttcattcttctctgctgcttccactgcggtgtatgtttacctctactccatatattattaccacatgaagaccaagatgtctggattcttccagaccagcttctatttcggctacactctaatgttctgcctaggcttaggaacactatgcggtgccgtcgggtatcttggatcgacattgtttgtgaggaggatctacaggaacataaagtgtgactaagtgaagataatatcgccccattttgggtcagcgcagagaaaatgtatggcagagccttatttgattgagcgatcactgattctaaaaccaagaacgcaggtcattttgtgaaatatgatcgttgcttggcgccgagctgaaagccatgtttttctattcttgtcctcgtttctctctgatttcttctggacttggacaggcaacaaattttcatgttgaattagttatatatatagcggtggttgtagttgttgagtagttctgtagtatataccacaattgttatccttggccccaatgatacctcagattgatgggtataaactgtaacatttacattacctgatgtttgacgatgaacacagttccaaataatcatgttcggtactggaggatcgagatttttgagaggca

SEQ ID NO: 3904 - DNA, 2133 bp, Panicum virgatum
cctgatcaccgctgctgtttcttgcagtaccaagcagatgagcccgtgacgctctgggtgaacaaggttggcccgtacaacaacccgcaggagacgtacaactactacagcctcccgttctgccatgcaacagaaaaccatgtgcacaagtggggagggcttggcgaggtcctcggtgggaatgaactcatcgacagccagattgacatgaagttcaggaagaatgttgacaagggcaccatttgttctcttgatcttgatcctgacaaggccaagcaattatcagatgcgattgaaaactcatattggttcgaattcttcatcgatgatttgcctctgtggggttttgttggagaggcagacagaaacaatgataacaaatatttccttttcacccacaagaatattgtcatcagatacaatggcaatcagattatccatgttaatcttacccaagaaagtccaaagcttattgatgcgaataaggcaatggacatgacatattctgtcaagtgggaaccaacgaacataacatttgctcatcgctttgatgtgtacctggactatcctttctttgaacatcagattcactggttctcaattttcaattctttcatgatggttatctttctcacgggactagtgtcaatgatactgatgcggactctcagaaatgattatgcaaaatatgctcgtgatgacgatgatattgaaactctggaaagagatgtcaatgaagaatctggatggaagcttgtgcatggtgatgttttcaggcctcctagaaatctggttcttctgtcatctcttgtcggtattggcacacagttggcagcacttattctgctagtaattttgctggcaatcatcggaatgttgtacattgggcgaggagctatcgtcacaacattcattgtttgttatgctcttacttcgtttatctctggatacgtcagtggtgcattatactcacggcatggggggaaaaactggatcaaggcgatggccatgacagcatcactttttccatttatgtgctttggaattggtctagcgcttaacactattgctatattctacggatcattagctgccataccattcggtacaatggtggttgtttttatcctgtgggccttcatctctttccctcttgctcttttggggaccgttgttggtagaaactggagtggcgccccaaacaatccgtgcagagtaaagactatccctcgtcctgttcctgagaagaaatggtacctcacaccatctgtcattgcacttatgggaggactgcttcctttcggtagtatcttcattgagatgtactttgtcttcacatcgttttggaactataaggtgtactatgtttatgggttcatgttgctggtctttctgatcctcataattgtaaccatctgtgtaacaattgttggtacatatttcttgctaaacgctgagaactaccactggcagtggacttcattcttctctgctgcttccactgctgtttatgtttacctgtactccatatattattaccacatgaagaccaagatgtcaggcttctttcagacgagcttctacttcggctacaccctaatgttctgcttaggtttaggaacactatgtggtgccgtaggatatcttggatcaacattgttcgtgaggaggatctaccggaatataaagtgtgactaaatgaagaaatgtcaagccaatcctgaggagtgggggaggaaactgcataccagagccttgtttctttgaggaccattcattcatgtatctgccactgccaccaagaagcagggcgtgttttttgtggaatatgattttttgggacgagctgcaagcccttcacttgtcctctttgtttctctttgatcttgcttggggcgataaattttcatgttagttatatagcagcgattgtagttgttgagtaggagctctagtatatatcacaattgttatccttgaacccatgtgaacctttattgatgggtataaactgtaacatccacgttacctgatgtatgatgataaacacaattccaaaaggtcaatccttttcagccttaggcttgagcattttgaggttaaattatgaagtaaattacaaaaaaaaggcct

SEQ ID NO: 3905 - DNA, 2241 bp, Panicum virgatum
gtactgtactatactgtactgtactgtgctttaatttacttaacctcttattcgtattccatgatcttttatataaagagaaaaaagaagatgataggagtatgcggttacaatgtatacattttcatggtcttcttccatgccattaaatgggatttgagaaaaatataaagtgctctgtataaatgctctgtttcatggcaaatattctcaaataccgcgttccacagggacctcttcgcaaaactgcggccattcattctgcctacctcctccgtatgaggcagctcgtgctcgttcgggactgagacacacccgaacgttcgcggccgcctccctccgcccagatctcgccgccgacgagatgctccgccgcggcgtgctcctcctggcggccgtcctcctcgccgtcgcgcgcccacctcacgcatatgcatccgaggccgaccacaagtacaaaacagaagaaccggttaagctatgggtaaacaaagttggaccttacaataaccctcaagaaacatacaactattacagcctcccattttgccaaccatctgaaaaccccacacataaatggggtggactgggagaggtcctcggtggaaatgagctgatcgatagtcagattgatatcaaattcttaaaaaatgtggacaagggccccatatgcacaattgaccttgatgctcaaaaggttcagcagttttctgatgccattgagagctcatattggtttgagcttttcatagatgatctgccattgtggggtttcgttggggaaactgacaaaaacaatgagaacaagcactacctttacactcacaagaacattgttgttaaatacaatggtaacaggataattcatgtcaatctcacgcaagagtcacctaagcttcttgaagctggtaaaaagttggatatgacatattcagtaaagtgggtgcaaacaaatgtggcatttgcacggcgttttgaagtttacttggactacccattctttgaacatcagattcattggttctccatcttcaattcattcatgatggttattttcttgactggtttagtgtcaatgatattgatgaggacactaagaaatgattatgcaaaatatgctcgtgaagatgacgacttggaatcccttgagcgagatgttaatgaggaatctggatggaagcttgtccatggcgatgtatttcggcctcctcgtggcctggtgtttctttctgcccttgttggtattggcactcagctggcagctcttatcctgcttgtgattgtgttggccatagttggcatgttatatgttggacgaggagctatcatcacaacctttattgtgtgctatgctcttacatccttcatctctggatatgttagtggtggcctctattcaaggaatggtggtaaaaactggataaagtccatgatccttacggcatccctttttccattcttgtgcttctcaattggattagtgttaaacaccattgctatcttctaccgatcattagcagctataccatttggtacaatggttgtcatatttgttctttgggctttcatctccttcccattggtgcttttgggaactgtagttggcagaaactggagtggtgctcccaacaatccatgccgtgtgaaaacgattccacgtcctattcctgaaaagaagtggtaccttacaccttcagttatttcattgatgggtgggcttctcccattcggcagcatcttcattgagatgtactttgtgttcacttccttctggaactacaaggtgtactatgtttatggcttcatgctattggtgtttgtcatccttataatagtcaccatatgtgtcactattgtgggtacttatttcctgttgaatgctgagaactatcactggcaatggacatcattcttctctgctgcttctaccgccttgtatgtatatttatactccatatactattatcatgtgaagacaaagatgtcaggcttcttccagacaagcttctactttggttacaccctgatgttctgtcttggattgggaatactttgcggtgctgttggctacgtgggctctactctatttgtgaggagaatctacagaaatatcaaatgcgactaaatttctgcaccttgctgatagaggctgttagcaaattatgtcttgtcgcagtctggtgcggagtaatactgtatctgattaacttctgaaactacacaggagtcgctctccctctg

SEQ ID NO: 3906 - DNA, 2468 bp, Setaria italica
ttttcctccgtatgaggtacctcgtgctcgttcggcactgagacacacccgcacgctcgcggccgcctccctccgcccagatctcgccgccgacgatgctccgccgcggcgtgctcctcctcgttgccgtcctcctcgccgtcgcgcgcctgccgcacgcgtacgcctccgaggccgaccacaagtacaaagcagaagaacctgttaagctatgggtaaacaaggttggaccatacaataaccctcaggaaacgtacaactattacagcctcccattttgtcaaccatctgaaaaccccacacataaatggggtgggctgggagaggtcctcggtggaaatgagctgatcgatagtcagattgatataaaattcttaaaaaatgtggacaagggcctcatttgcacaattgaacttgatgctcaaaaggttcggcaattttctgatgctattgagagctcatattggtttgagcttttcatagatgatctgccattgtggggttttgttggggaaactgacaaaaacaatgagaacaagcattatctttacactcacaagaacattgttgttaaatacaatggtaacaggataattcatgtcaatctcacgcaagagtcgcctaagcttcttgaagctggtaaaaagttggatatgacatattcagtaaagtgggtgcaaacaaatgtggcatttgcacggcgttttgaagtttacttggactacccgttctttgaacatcagattcactggttctccatcttcaactcattcatgatggttattttcctgactggtttagtgtcaatgatattgatgaggacactgagaaatgattatgcaaaatatgctcgtgaagatgacgacttggaatctcttgagcgagatgttaatgaggaatctggatggaagcttgtccatggagatgtatttaggcctcctcgtggcctggtgtttctttctgcctttgttggtattggcactcagctggcagctcttatcctgcttgtgattgtgttggccattgttggcatgttatatgttggacgaggagctatcatcacaacctttattgtatgttatgctcttacatccttcatctctggatatgttagtggtggcctgtattcaaggaatggtggcaaaaactggataaaatccatgatccttacggcatccctttttccatttttgtgcttctcaattggattagtgttaaacaccattgctatcttctaccggtcattagcagctataccattcggtacaatggttgtcatatttgttctttgggctttcatctccttcccgttggtgctattgggaactgtagttggcagaaactggagtggtgctcccaacaacccatgccgtgtgaaaacaattccacgtcctattcctgaaaagaagtggtaccttacaccttctgttatttcattgatgggtgggcttctcccctttggcagcatcttcattgagatgtactttgtgttcacttccttctggaactacaaggtgtactatgtttatggtttcatgctgctggtgtttgtcatactcataatagtcaccatatgtgtcactatcgtgggtacttatttcttgttgaatgctgagaactatcactggcaatggacatcattcttctctgctgcttctacagccttgtatgtatatttatactccatatactattatcatgtgaagacaaagatgtcaggcttcttccagacaagcttttactttggttacaccctgatgttctgtcttggattggggatactttgtggtgctgttggctatctgggctctactctatttgtgaggagaatctacagaaatatcaaatgcgactaaatttctgctcattgctgatagaggctgttcacaatcatatcttgttgcagtctggtgcagagtaatacttgattctgattaacttttgaaaccacacaggaggtcgctctccctctgtttactccttttttggcttatctatttcctccatggaactgccctgataaatgtatacctattagttggggaattagtcttgaggactggaaagtacatgtaggttctttttttgtgaggcctcttttggtcagttgtaggagttcattgatgaatattaccgcagtgcagattccagtgggctagatttgcccctcttatgaattgtcacatccagttttcatacccccttgtagtataagcaagctaatatattgaagttacatatattcttaatgggtttgatttgctttgtgttgctgttgcaacttgtatattgaggcagacatcagcagatgtatgtttcagctgcttgggtttacttcctcgcagttttttttttggaagccatatgccaattatagatccagagttcagtagtttgtcgtggactgtttatgtaaggtcgtttgcgcagtggccggcagatttcccttcatgaatcctggttattta

SEQ ID NO: 3907 - DNA, 3057 bp, Sorghum bicolor
ggcctatgctgcatttacactgttttgtcgtgatttttctcatgtttgcctcgtgattactcttttctcacatcttaaacattctcgcatacagaattacagtaacaacattttcacaagggcttgtgcggaaaaaaacctctcctctgcctacctcctccgtatgaggcagctcgtgctcgttcgagactgagaggcacccccgcagccgcctcgcaccgcgcagatctcgccgccgacgagatgctccgccgcggcgtgctcctccaggcggccgtccacctcctcctcctcctcgccgtcgcacgctcgcccctcgcgtacgcctcggaggccgaccacaagtataaaacagaagaaccagttaagctatgggtaaacaaggttgggccttacaataaccctcaagagacttacaactattacagtctcccattttgtcaaccatctgaaaacccttcacataaatggggtggtctcggagaggtccttggtggaaatgagctgattgatagtcagatcgatataaagttcataaaaaatgtggacaagggggccatttgcacaattgaacttgatgctcaaaaggttgagcaatttgctaatgccattgaaaactcatattggtttgagcttttcatagatgatctgccattgtggggttttgttggggagactgacaaaaacaatgagaacaagcactacctttacactcataagaacattgttgttaaatacaatggtaacaggataattcatgtgaatctaacgcaagagtcacctaagcttcttgtagctggtaaaaagttggatatgacatattcagtcaagtgggtgcaaacaaatgtagcatttgcacggcgtttcgaggtttacttagactacccgttctttgaacaccagattcattggttctccatcttcaattcattcatgatggttattttcttgactggtttagtgtcaatgatattgatgaggacactaagaaatgattatgcaaaatatgctcgtgaagatgacgatctggaatcacttgagcgagatgttagtgaggaatccgggtggaagcttgtccatggtgatgtgttccgacctcctcgcagcctggtgtttctttctgcccttgttggtattggcactcagctagcagctcttatcctgcttgtgattgtgttggccattgttggcatgttatatgttgggcgaggagctatcatcacaacctttattgtgtgctatgctcttacatctttcatctctggatatgttagtggtggcctctattcaaggaatggtggcaaaacctggataaaggctatggtccttacggcatcactttttccattcttgtgtttctcaattggattggtgttaaacactattgctatcttctaccgatcattagcagctataccatttggcacaatggttgtcatgtttgttctttgggctttcatctccttcccgttggttctattggggactgtagttggtaggaattggagtggtgctcccaacaacccatgtcgtgtgaaaacgatcccacgccctattcctgagaagaagtggtaccttacaccttctgttatttcattgatgggtggacttctccccttcggcagcatcttcattgagatgtactttgtattcacttccttctggaactacaaggtgtactacgtctatggtttcatgttgctggtctttgtcatcctcataatagttaccatatgtgtcactattgtgggtacttatttcttgttgaatgctgagaactatcattggcaatggacatcattcttctctgctgcttctaccgccttgtatgtatatctatactctatatactattatcatgtgaagacaaagatgtcaggctttttccagacaagcttttactttggttacaccttgatgttctgtcttggattgggaatactttgcggtgctgttggatatttgggctccactctatttgtgaggagaatctacagaaatatcaaatgcgactaaacttggtcgaggctgttagcatgtcttgtcacagtacggtgcagagtaataccttgagcttctgattaattttgaaactacacaggaggttgctctcccttcggttactcttaatcttttttttggcctatcttccgccatggaagtgtggaactgccctgataaatgtatacctattagttggggaattagtcagagtactggaaagtacatgtaggttctttttgtgtggcctctcttggtcaattgtaggagtacattgatgaatattaccgccgtgcagattccagcgggctagaattgcccctcttatgagttgccacatccagttttcatatcccccttgtagtataagtaggctaatatattgaagttaagtatatcttaatgtgtttgatttattttttgttgttgcacttgaaagtatattgaagattttgaagtagacttcagcagttcagcacatgtatcagctgctttggttggtttgcagaattctagaccgaatgacaattgtagacctatctacgtctagtttgactgtggggcagtatttgtgaagggcactgggcacttttgcagcgatcatccatttcttcttccactgccagaagtaactaattgtctcctgtccatatgccatgatctagcaattgtactaattctattactacagaatgtatcattaatgcctggactatatattgttttcattttagtactagtttttttgttctctttggttcgcatgatgtttaatttcgagcttatcccaacttgtttgacactaaagggtataagccttcgatgtgttgggtaggaactctcaatcttgtaatcacagctgtgtagcgtccaccacagctggaatatttttgtagagtttgcacactgaattcagaaaaatacttttggtagcacgtttcctacattgcacatccgctaccgcaacagtgcttcaaggagctgtagtattgccattcatttaactattggtcgttttatttttggggtatagtcaggtgctagtgtagtgtataa

SEQ ID NO: 3908 - DNA, 2199 bp, Panicum virgatum
tccctccgcccagatctcgccgccgacgagatgctcagccgcggcgtgctactcctggcggccatcctcctcaccgtcgcgcgccttccccacgcgtatgcatccgaggccgaccacaagtacaaaacagaagaaccggttaagctatgggtaaacaaagttggaccttacaataaccctcaagaaacatacaactattacagcctcccattttgccaaccatctgaaaaccccacacataaatggggtggactgggagaggtcctcggtggaaatgagctgatcgatagtcagattgatatcaaattcttaaaaaatgtggacaagggccccatatgcacaattgaccttgatgctcaaaaggttcagcagttttctgatgccattgagagctcatattggtttgagcttttcatagatgatctgccattgtggggtttcgttggggaaactgacaaaaacaatgagaacaagcactacctttacactcacaagaacattgttgttaaatacaatggtaacaggataattcatgtcaatctcacgcaagagtcacctaagcttcttgaagctggtaaaaagttggatatgacatattcagtaaagtgggtgcaaacaaatgtggcatttgcacggcgttttgaagtttacttggactacccattctttgaacatcagattcattggttctccatcttcaattcattcatgatggttattttcttgactggtttagtgtcaatgatattgatgaggacactaagaaatgattatgcaaaatatgctcgtgaagatgacgacctggaatcccttgagcgagatgttaatgaggaatctggatggaagcttgtccatggagatgtatttcggcctcctcgtggcctggtgtttctttctgcccttgttggtattggcactcagctggcagctcttatcctgcttgtgattgtgttggccatagttggcatgttatatgttggacgaggagctatcatcacaacctttattgtgtgctatgctcttacatcctttatctctggatatgttagtggtggcctatattcaaggaatggtggcaaaaactggataaagtccatgatccttacggcatccctttttccattcttgtgcttctcaattggattagtgttaaacaccattgctatcttctatcgatcattagcagctataccatttggtacaatggttgtcatatttgttctttgggctttcatctccttcccattggtgctattgggaactgtagttggtagaaactggagtggtgctcccaacaacccatgccgtgtgaaaacgattccacgtcctattcctgaaaagaagtggtaccttacaccttcagttatttcattgatgggtgggcttctccccttcggcagcatcttcattgagatgtactttgtgttcacttccttctggaactacaaggtgtactatgtgtatggcttcatgctgctggtgtttgtcatccttataatagtcaccatatgtgtcactattgtcggtacttatttcttgttgaatgctgagaactatcactggcaatggacatcattcttctctgctgcttctaccgccttgtatgtatatttatactccatatactattatcatgtgaagacaaagatgtcaggcttcttccagacaagcttctactttggttacaccctgatgttctgtcttggattgggaatactttgcggtgctgttggctacatgggctccactctatttgtgaggagaatctacagaaatatcaaatgcgactaaatttctgtaccttgctgatagaggctgttagcaaattatgtcttgccgcagtctggtgcggagtaatacttgattctgattaacttctgaaactacaccggaggtcgctctccctctgtttactcctcttttggcttatctatttcctccatggaactgccctgataaatgtatacctattagttggggaattagtctgaggtgaggactggaaagtacatgtaggttcttttttgtcaggcctcttttggggtcagttgtaggagttcattgatgaatattgctgcagtgcagattccagtgggctagatttgcccttcttatgaatttgccacatccagttttcataccctctttgtagtataagcaagctaatatatttaagtaacatatattcttaatgggttt

SEQ ID NO: 3909 - DNA, 2418 bp, Musa acuminata
ctcggtttcgtcctccgttacgagcatttagagactccctcctctccgcccaccgcgcgttcagatccggcagcggcgatgctttccggcgctcgatctctctcttccctccccgccgctttccacctcttcctcctcctcttcctcgccgcctcagcttccgcctccgagtccgaccacaagtaccaagctgaagacccggttactctctgggtaaacaaggttggcccttacaataaccctcaagagacatataattattacagccttccattttgtcatccatctaagaaccttgcacacaagtggggtgggctaggggaggtcctcggtggaaatgaactgattgacagccagatccagataaagtttcaacgcaatgttgaaaaaggctccatttgtgctcttgagcttgatgatgcaaaagttgcgcaattcacaagtgctatagagaactcatattggtttgaatttttcattgatgacttgccgttgtggggttttgttggagagagtgataaaaacaacaaagataagcattatctttacacacacaaaaacattgtcatccaacacaatggaaatcagattattcatgtcaatctcactcaagaaagtcctaaacttctggaagttgggatgaaattggatatgacatattcagtcaaatggttgccaactgatgtggcattttctcgccgttttgaagtttatttggattaccctttctttgaacaccagattcactggttctctatcttcaattctttcatgatggttattttcctcactggcctggtatcaatgatattgatgaggactctcagaaatgactatgcaaaatatgcgcgtgaagatgatgatcttgagactctggaaagagatgttagtgaagaatctggatggaaacttgttcatggtgatgtctttcgacctccacgcaggctggttcttatttcagctcttgttggtaccggtgctcagctggcaatgcttgttcttctagtaattttgttggcaattattggaacattatacattgggcgaggagctattgttaccacttttatagtgtgctatgctcttacctcatttatttcgggctatgtcagtggtggactttactcacgtaatggtggtaaaagttggataaaggcaatgatcctcgcagcatcattgtttccatttttgtgctttgggattggcttcatgcttaacacaatcgctatattttatggatcactagcagctattccatttgggacaatggtggttgtgttcatattatgggctttcatctcctttccattgacacttctaggcactgttgttggtaggaactggagtggtgcaccaaacaacccatgccgtgtgaagaccattcctcgtcctatccctgagaagaaatggtatcttacaccttctgttgtgtcacttatgggaggattgcttccatttggtagtatcttcattgagatgtactttgtcttcacatcattctggaattacaaggtatattatgtgtatgggtttatgctacttgtttttctgatcctcataattgtgaccatttgtgtgaccatagttggcacatactttttgttgaatgctgagaactatcactggcagtggacttcattcctttctgctgcctcaacagctgtctatgtatacctttactctgtatattactactatgtgaagaccaagatgtcagggtttttccagactagcttctactttggctacaccttaatgttttgtttgggattaggaatactgtgtggtgctgtgggttatcttggctctactctattcgtgagaaggatttacagaaacattaaatgtgactagctgcagccacaaccggaagattaataccatatcctccctacaaaattttgaaacagacagaatgttaatcaggttgatagttggattgccgatatgagctaatgctgcttgtgcaaattgtatgcgagggatgcgctagcttcattcttttttttttttttgtactttcctttcacaattgttttctttctgttttggacttgagattttaattcttttttaggttacatttggtcatcagccttaatatacctatagcctagtcaagcattaatcttcctctcgaaaacatggtcagacaccttttcttgtatgcatcgcagcatattatacttggatttattacatccattctgtactggaagtgattgccatttttgttataatcctgatcatatttttgcaagcatctgttctcactttagatgagctggttcttcgtaatctcatccattttctttttttttaaatattgttacatattgagttatacgaatgaaactcgccacaacttgcttgccacaactgaaacggacatccacttgtgcttattgatatgaaatc

SEQ ID NO: 3910 - DNA, 2540 bp, Musa acuminata
cccaaccacaaccccttcgcgtttagattgaacgagtggaaagaaagcccaaaggagaaggcctcgcccggtctcttcctcgacattaagcttcgaacgcgcctcgccccaccttcgctccccccctcccaccgcgctctgctctcagatccgggcggtgccatgctttccggcgccagatctcgcccttccctctccgccgccttcctcgtagtcctcgcggtctccgctttcgcctccgagtccgaccacaagtaccaagctgaagaaccagttacactctgggtaaacaaggttggcccttacaataaccctcaggagacatataattatcacagtcttccattctgtcaaccatctgagaatcctgcacataagtggagcgggctaggggaggtcctaggtggaaatgaacttattgacagccagttccagataaaatttcaaagaaatgttgacagaggttccatttgtacgattgaacttgatgccacaaaagtgaagcaatttgctgatgctatagagaactcatattggtttgagttcttcatagatgacttgcctatgtggggttttgttggagagactgacaaaaacaacaaagataaacgttatcttttcacacataaaaatatcatcatccaacataatgagtatcagattattcatgtcaatctcactcaagaaagtcctaaacttttggaggcaggaaaaagattagatatgacatattcagtcaaatggctgccgacaaatgttacatttgctcgccggtttgaggtttacttggattaccctttctttgagcaccagattcactggttctctatcttcaattcattcatgatggttattttcctcactggcctggtatctatgatattgatgagaactctcagaaatgattatgcaaaatatgctcgtgaagatgatgatcttgagactctggaaagagatgtgagtgaagaatctggatggaaacttgttcatggggatgtctttcggcctgcccgtactttggttcttctttcatctcttattggtactggtgcccagttggcaatgcttgtactcctggtaattttgttggcgattattggaacattatacattgggcgaggatctatcactacaactttcatagtctgctatgctcttacctcattcatttcaggctatgtcagtggtggactttactcacgtaatggtggtaaacattggataaagtctatgatcgtcacagcatcattgtttccatttatgtgctttgggattggcttcatacttaacacaatcgctatattctatggatcactagcagctattccgtttgggacgattgttgttgtgttcatattatgggctttcatctcatttccactagcacttttaggcaccgttgtgggtaggaactggagtggttcaccaaacaatccatgccgtgtaaagaccattcctcgtcctatccctgagaagaaatggtatcttacaccttctgttgtttcactaatgggaggactgcttccatttggtagcatcttcattgagatgtattttgtcttcacatcattctggaattacaaggtatattatgtgtacggctttatgttactggtcttcctgatcctcataattgtcaccatttgtgtgactatagtgggtacatatttcttgcttaatgctgagaactatcactggcagtggacttcattcttttctgctgcttcaactgccgtctatgttttcctttactctatatattactactatgtgaagaccaagatgtcaggctttttccagactagcttctactttggctacactttgatgttttgtctgggattagggatactttgtggtgccgtgggttatctcggctctactttatttgtgagaaggatttacagaaacataaaatgtgactagccctaaaacacaaccagaagaccgatatcatatgctgggccacaaaattttgaaacaaccagaaggccagggtgaaaggtgggtttgctggtgggaggaattgctagctctgtttccctcctgttttggactttgcaggatgtcacatttttctttccattgctttccgcagtagcctctcaatgtgcttaatctagttaataaataacttggtctacttccagcacttttctttatcatgtacttgtgacattagtgacaaagcagggccatcatccagtggtggctacacatgtaactcattatagtaggacactcttgtggtagaagttattgtcatttattgaagtattaagaaggttacaaatggaggatcgagaaccttttcatcacagtttgcagcattctagaatctacatctcttaattcttctagcactgtaaattttgtgctgtgtcatctctgagttgatacatatgtagaagcattttgttatatgaactttgaaagcatgtcagcttcaatatcgaaatcatagtcatcacagttatgctatgaaaaattcttctgggagttgctattcctctgcactcgtagcgtttgcattgtaacac

SEQ ID NO: 3911 - DNA, 2557 bp, Elaeis guineensis
gcggtgcctctaccccttcccggtcgttggtccgttccggtcgacgtcggtctacgggaccggccggtcgtcgtggtcaactactagacgtaaggaacaacgggttacgtacttacgtcgttcgtcgtcctctcctctctctctctctctcaatcgagctagcgagcagccgaagggattaactaaagaggagcctgagctccgcgctctcagatccggccgcggcgatgcactccgccacacgatctctgcttcccctcctcgccctccttctcctcctcgtcgccggcgccgtggcctccgagtttgatcacaagtacaaagctgatgaccctgtcacactctgggtaaacaaggttggcccctataataatcctcaggaaacctacaactattacagccttccattttgccagccatctgaaaaccctgcacacaagtggggtggacttggggaagttctgggtggaaatgaactgatagacagccaaattgagatgaagtttcaaagaaatgttgagaagggctctatttgtgcacttgagcttgatgctgcaaaggtgaagcatttcacagatgcaatagttaactcatattggttagaattcttcatcgatgatttgcctttatggggctttgtcggggagacggacaaaaataatgaaaataaacattttcttttcacacacaagagtattgttattagatacaacaacagtcagataattcatgtcaatctcactcaagaaagtcctaaacttttggaagctgggaagacattagacatgacatattcagtaaaatggtcaccgacagatgtaacatttgcacgtcgttttgatgtgtacttggattaccctttttttgagcaccagattcattggttctccattttcaactcttttatgatggttattttcctcactggcctggtgtccatgatattgatgcgaactctcagaaatgattatgcaaaatatgctcgtgaagatgacgacctggagactctggaaagagatgtgagtgaagaatctggatggaagcttgttcatggagatgtctttcggcctcctcagagtttggttcttctttctgcccttgttggtactggtgcccagctggcaatgctcgttcttctggtaattgtgttggcaatcattggaatgctgtacattgggcgaggagctatcgtcacaactttcattgtgtgttatgctctcacatcattcatttcaggctatgttagtggtggactttactcgcggaatggtggtaaaaactggataaagtcaatgattctttcagcctcactgtttccttttatgtgctttgggattggcttcctactaaacacaattgctatattctatggatcactagcagctataccatttgggacaatggtggttgtgttcattctttgggctttcatctccttccctctggcacttttaggtactgttgtgggtaggaactggagtggctccccaaataatccatgccgtgtgaagaccattcctcgtcctattccggagaagaaatggtatcttacaccttccgttgtctcactcatggggggcttgcttccttttggcagcattttcattgagatgtattttgtcttcacgtccttctggaactacaaggtgtactatgtttatggctttatgttgctagtattcctgatcctcataattgtcacagtatgtgtgaccattgtgggaacatacttcttactaaatgccgaaaactatcactggcagtggacttctttcttttctgcagcttcaactgctgtctatgtgtacctttattctatatattactataatgtgaagaccaagatgtcaggctttttccagactagcttctattttggctacactctaatgttttgtctcggtctaggaatactttgtggtgctgtgggatatcttggatctacattatttgttagaagaatttacagaaacatcaagtgtgattagccagtgccaaatcccaaaggttgaccatatgccagctatgctttgttgagacaacatcatttgggggtaaaaggtggatcgcttacggaatataatgacgcctcgtgaaactgcaagggcggcccatgcattcttcgtttactttttctccagtttttcccttccaatctctggacttggatggctttgcttttttccgcatgctgtaggcaatagcgtccatatacttatttcgtacaggagtagttttaatttactggaaagcaccccttttttatttcttgtctggtgttacgttggacccaaagcagggtcatcctctgctaacggacagacaaatactagttttctttcctctctttatccctataatctcctctgtcatctaatcaatatttctgttgctgcttgtcaaaaaaaattagaaccgttcagttcatttgtagtacggaagttgcttttgtcaccatgtcatatatggttttattgatttctcttgatatctgtagtcaattcgaatgaaattggtagctagagtttcttggattttccatcaaatagaggttgtt

SEQ ID NO: 3912 - DNA, 2597 bp, Oryza sativa
cattccacaggcacctcccgcaaaaacaccgaaggtccccgtatgaggaggcagctcgtgctcgggcggcgagactgagacgagacgcgagaccaaaccctcccctccccgaccgcgccccgcccagatctcgccgccgacgagatgcatcgccgcggcggccaccacctccacctcctcctcgccgccgccgtcgtcctcctcctcaccgtcgcggggctgcccctcgcttccgcctccgagtccgaccacaagtacaaagctgaagaaacggttaaactctgggtaaacaaggttggcccgtacaataacccgcaagaaacttacaactattacagcctcccattttgtcagccatctgaaaaccccgcacacaaatggggtggtctcggagaggtccttggcggcaatgagctgatcgatagtcaggttgatataaagtttttaaaaaatgtggagaagggtcccatttgcacaattgaacttgatgacaacaagattcaacaatttactgatgccattgaaaggtcatattggtttgaactcttcatagatgatcttccattatggggttttgttggtgagactgacaaaaacaacgaaaataagcactacctctacacacacaagaacattgttgttaaatacaatggtaacaggataattcatgtcaatcttactcaagagtcacctaagcttcttgaagctggcaaaaaattggacatgacctattcagtgaagtgggtgcaaacaaacgttgcatttgcacgacgttttgaagtttacttggactacccgttctttgaacatcagatccattggttctccatcttcaattcgttcatgatggttattttcttgactggattggtatcaatgatattgatgaggacgctgagaaatgattatgcgaaatatgctcgtgaagatgatgatctggagtcgcttgaaagagatgttagtgaggaatctggttggaagcttgtccatggagatgttttccggcctcctcgtagcttggtgtttctttctgcttttgttggtattggcactcagctggcggctcttattctgctcgtgattgtattggccattgttggcatgttatatgttggacgaggagctatcatcacgaccttcatcgtgtgctacgcccttacatctttcatttctggatatgttagtggtggcctctactcaaggaatggcggcaaaaactggataaagtctatgatccttactgcatccctttttccgttcttgtgcttttcgattggattggtgttgaacaccattgctatcttctaccgttcactggcagccataccatttggcacaatggttgtcatatttgtcctgtgggctttcatctcttttcctttggttctattgggaactgtagttggtagaaattggagtggtgctcccaacaatccctgtcgtgttaagacaattccacgtcctattcctgagaagaagtggtatcttacaccctctgttatctcattgatgggtggactactccccttcggcagcatcttcatcgagatgtactttgtgtttacttcattctggaactacaaggtttattatgtatatggtttcatgctgctggtttttgttatcctcataatagtcaccatatgtgtcactattgtgggtacttatttcttgttgaatgctgagaattaccattggcaatggacatcattcttctccgctgcatctactgccttgtatgtctacctatactcaatatactattatcacgtgaagacaaagatgtctggcttcttccagacaagcttctactttggctacaccttgatgttctgcctcggactaggaattctttgcggtgctgttggctatctaggatctactctctttgtgaggagaatctacagaaacatcaaatgcgactaaattgctactctgaacatcaaatgtgaccaaagggctactccgttgccgatagatcctatcagcgaagtgtgtgttgctggcgcaggtccattgtggagtaatgctcataagattctgatcaacttttggaagctatacaggagattgttctccctttgttttaccttttctttttatgtttttcttttacttcatttttcttcttggagctggcctcataaatgtatacctcattagttcaggaattagtctcagtaccgggaagtacatttagattctcattttgtggtggcctcttttggccagtagtaggatatcattgatgaatattggtgcagtgtggatccaatccagtggctagaattgcccctcttatgaatcgctatacatccaattttggcatagccttgtagtatatgcaaactaatacattcaagttagatatatatggcctgaatgggtgaagttctatttcttcccctgcaggtactgttgaaacatgaattcgacatgattattatttagcctttggtctgagttttcatccttgctgaattgtctctgtgtttacagcatcagaaatcaagcgtacactgaaaatagacaaatgtgtcatccacatctgtaatgttttgcttgtttaggtaccttgctttatgatagtatcagca

SEQ ID NO: 3913 - DNA, 2682 bp, Musa acuminata
aagtcccaaacgagacgtctctctctctctctctctctctctctctctccactgtgctccgctctcagatccggccgcggccatgcctcccggtgcccgatctctgccgtacctctcggccgccttcctccttttcctcctcgtcgcctcggcttccgcctccgagtccgatcacaagtaccaagctgaagaccccgttacactatgggtaaacaaggttggcccttacaacaaccctcaagagacatataactattatagccttccattctgtcagccatctgagaaccctgcgcataagtggagtggtctgggggaggtcctaggtggaaatgaactgattgacagccatatcccaataaaatttcaaaggaatgttgacaaaggttccatatgtacaattgaacttgatgccacaaaagtgaagcaattcatcgatgccatagataactcttattggtttgaattcttcatagatgacctgcctttgtggggctttgttggagagactgacaaaaacaacaaagataaacattatcttttcacacataaagatattgtcatccaacataagggatatcagattattcatgtcaatctcactcaagcaagtcctaaacttttggaggtgggaaaaaaattagatatgacatattcggtcaaatggctgccaacaaatgtaacatttgcccgccgttttgaggtttacttggattaccctttttttgagcaccagattcactggttttctatcttcaattctttcatgatggttattttcctcactggcctggtatctatgatattgatgagaactctccgaaatgattatgcaaaatatgctcgtgaagatgatgatcttgagactctggaaagagatgtgagtgaagaatctggatggaaacttgttcatggggatgtcttccgacctcctcgcagtttggttcttctttcaactcttgttggtaccggtgcacaattggcaatgcttgttctcctagtgattgtgttggcaattgtcggaacattatacattgggcgaggatctatcattacaactttcatagtgtgctatgctcttacctcattcattgctggctatgttagtggtggactttactcacgtaatggtggtaaaaattggataaaggcaatgattgtcacagcatcattgtttccatttatgtgctttgcaattggcttcgtacttaacacaattgctatattctatggatcactagcggctattccattcgggacaatgatggttgtgtttgtattgtgggctttcatctcatttcctctagcacttctaggcactgttgttggtaggaactggagtggttcgccaaacaatccatgccgtgtgaagaccattcctcgtcctatccctgagaagaaatggtatcttacacctttcgttgtctcacttatgggaggactgcttccatttggtagcatattcattgagatgtattttgtcttcacatcattctggaattacaaggtctattatgtgtatggctttatgctactggtcttcttgatcctcataattgtcaccatttgtgtgactatagtgggaacatatttcttgctaaatgctgagaactatcactggcagtggacttcattcttttctgctgcttcaactgctgtttatgtgtacctttactctatatattactaccacgtgaagaccaagatgtcaggctttttccagactagcttctactttggctacactctaatgttttgtttgggtttaggaattctttgtggtgctgtgggttatcttggctctactttatttgtgagaagaatctacagaaacataaaatgcgactagccacaagcacaacctgaaggcttatatcatgtgctgggttatgaaattttgaattagcggaacttaggggtgaaaggtggattgatgaaaaatctggtggtaattgttgaaattgtatgggagggatgcactaccttcttttttaactttctttcacggttgtttctgttttgttatggacttagcaggatgttttgcaattttcttttcccattgtttcactcgacagcctcccagtgtactcagcctagtcaacaaataacttaatctactttatagaacacacagcaacttctttatcatgtttacatgactttagttgcaaagcaggaccgtccagtagttatgggcaacttctttagttgcattgcagctcataataacactaggatactttaatttttctctaacacaataccaagattatacgatcgatctacttcatggtggaagttatgcctattataatattgaatgttttagcagtcctagtgattacaacatttttgcttatcggtatctggttaaatcatacaagtggttgctatctatttcatagtggtcatggtgtgtgcttttaagctagaaaattttcaatccctgtttctttcggcttttagaacattgtgtacattgatgtttgtatattcatttggtttatatagtattggcagcttgtatcttcagtctgaaacattcacatatattatttcctcctatgaacaattatcatctgttgaattaggttatggctaaaaggagccctatcattttgaataggtaaatagattgtactgtgcgtctagtctcaggtatctatagttgttgactgc

SEQ ID NO: 3914 - DNA, 2258 bp, Gossypium hirsutum
aactcatcagcgtagtgcaccggacctgcagatccgaccatcgtcggctatgtcttcctcagtcttctccgccgtccgatctttctctctcttcgccttccttttcctcttcctctctcccgctctcgcttccgagtcagatcacaagtatcaatcagatgacccagttaccctctgggtgaataaagttggtccatacaacaatccacaagaaacatacaactattacagccttccattttgtcatccgggtaccaaccctgctcacaagtggggtggtcttggtgaggtccttggtggaaatgaactaattgatagccaaatcgatataaagttccaaaagaatgttgacaaaagtactatttgccaattggaacttgatgaagcgaaggtcagacagttcaaggatgctattgaaaacagttattggtttgaattctttatggatgatctgcctttatggggctttgttggtgagctgcatcctgataagaacagtgataatggcaagcatgtcctctacactcataagaatattgttattaaatacaataaggaccagattattcatgtcaatctcactcaagagagtccaaaaccactggaagcagggcgagtattggacttgacatactctgtcaaatggcttcaaactaatgtcacttttgctcgtcgctttgatgtttatttggactatcctttctttgagcaccaaattcattggttctctgttttcaattcattcatgatggttatcttcctcactggtttggtgtcaatgatcttgatgcgaactctgagaaatgactatgcaaagtatgctcgggaagatgatgatctggaaagcttggaaagggatgtgagtgaagaatctggttggaaactcgttcatggtgatgttttccgacctcctcgctatttggccctgctttctgctgttgttggcacaggtgctcagctagcgatgcttgttctccttgtcatcctattggcaattgtgggaacgttgtatgtcgggagaggagcaattgtcacaacttttattctttgttatgcttttacatcattcatttctggttacgtaagtggtggaatgtactcacgcaatgggggtaaaaattggataaaggctatgatccttacagcatctctgttcccatttatgtgctttgggattggttttatcttgaacacaatcgccatattttatggatctctagcagcaattccttttggtacaatggtggttgtttttgtgatttgggctttcatttcattccccttggcccttcttggtacagttgttggaagaaattggagtggtgctccaaataatccatgccgtgtgaagaccattcctcgcccaattccggaaaagaaatggtatcttacaccctctgtggtctctatgatgggagggcttctgccatttggcagcatattcattgaaatgtattttgtcttcacatccttctggaattacaaggtttattatgtctatggctttatgctgttggtcttcttgattctaatcattgtgaccatttgtgtgacaatcgtgggaacatatttcctgctaaatgctgagaactaccattggcagtggacatcattcttctctgctgcctcaactgcaatctatgtctatttgtactccgtctactactaccatgtgaaaaccaagatgtcaggcttcttccagaccagcttctacttcggatatactttgatgttttgtcttggtttgggaattctctgtggagccgttggttatctcggttctaatctgtttgtaaggaggatctacagaaacatcaagtgcgactaaatccttaaaatgtttgaaagtataaccatcagcgcttctatgagcatttttatttgtcgtctgaggcaataaacgatgatgagatgaaacttccagccaggaggggggtatgggtcaagacctagcaaaatcctagagatgagaaatcacagggtttgagggtaagggggagttggtatttgtgggtttccatgcgattttgctttttctatttgcctcatttctatttttacacaaaatgtaatcgaagcctgatttagaatgctgaaaaaaccagttaaaaaaatattactctttggttatacttttttgtccttcaccccttctgcatatacgtgtgtcctgtctgtaagaactcaaaatggctaaaatatctgcacattttgttaggggataaaggaacttctcaaagaattcagcatatgttttt

SEQ ID NO: 3915 - DNA, 2271 bp, Zea mays
gcccaaaattacggcccctctctttctctctctgactacctccgtatgaggcagcttgtgctcgttcgagactgagacaccccaacacgcctccctcagcgcagatctcgccgccgccgagatgctccgccgcggcgtgcttcttctcgcggccatcctcatcgccgtcgcacactcgcccctcgcgtacgcctcggaggccgagcacaagtataaaacagaagaacctgttaagctatgggtaaacaaggttgggccttacaataaccctcaagaaacttacaactattacagtctcccgttttgtcaaccatctgaaaaccctgcacataaatggggtggtctcggagaggtccttggtggaaatgagctgattgatagtcagatcgatataaagttcataaaaaatgtggacaagggggccatttgcacaattgaacttgatgttcaaaaggttcagcaatttgctaatgccattgaaaactcatattggtttgagcttttcatagatgatctgccattgtggggttttgttggggagactgacaaaaacaatgagaaaaagcactacctttacactcacaagaacattgttgttaaatacaatggtaacaggataattcatgtgaatctaacacaagagtcacctaagcttcttgaagctggcaaaaagttggatatgacttattcagtgaagtgggtgcaaacaaatgtggcatttgcacggcgctttgaggtttacttagactacccgttctttgaacaccagattcattggttctccatcttcaattcattcatgatggttattttcttgactggtttagtgtcaatgatattgatgaggacactaagaaatgattatgcaaaatatgctcgtgaagatgatgatctggaatcacttgagcgagatgttaatgaagaatccgggtggaagcttgtccatggtgatgtgttccggcctcctcgtggccaggtgtttctttctgccctagttggtattggcactcagctggcggctcttatcctgcttgtgattgtgttggccattgttgtcatgttatatgttgggcgaggagctatcatcacaaccttcattgtgtgctacgctcttacatctttcatctctggatatgttagtggtggtctctattcaaggaatggtggaaaaaactggataaaggctatgatccttacagcatcactttttccattcttgtgtttctcgattggattgttgttaaacactattgctatcttctaccgatcattagcagctataccatttggcacaatggttgtcatgtttattctttgggctttcatctccttcccgttggttctattggggactgtagttggtagaaattggagtggtgctcccaacaacccgtgtcgtgtgaaaacgatcccgcgcccaattcctgaaaagaagtggtaccttacaccttctgttatttcactgatgggtggacttctccccttcggcagcatcttcattgagatgtacttcgtattcacttccttctggaactacaaggtgtactacgtctatggtttcatgttgctggtgtttgtcatcctcataatagtcaccatatgtgtcactattgtgggtacttatttcttgttgaatgctgagaactatcattggcaatggacatcattcttctctgctgcttctaccgccttgtatgtgtatctatactctatatactattatcatgtgaagacaaagatgtcaggatttttccagacaagcttctactttggttacaccttgatgttctgtcttggattgggaatactttgcggtgctgttggatatttgggctccaccctatttgtgaggaggatctacagaaatatcaaatgcgactaaacttggtctaggctgctagcatgtcttgtcacaatatggtgcagagtaataccttgagcttctgattgacttcggaaattacacaggaggttgctctccctttcgttactcttttcatcttttttggcctatcttcctggacgtgtggaactgcccatgataaatgtatacctagttggagaattagtcagagtactggaaagtacatgtaggtttttttggtgcggcctctctcggtcaattgtaggagtacattgatgaatattactgcagtgcagattccagtgggctagattcgcccctcttatgactgtttctaactacgtaccctctccgtcccaaattagaattcgttttagggaattaatgaattcatacaatagttgatc

SEQ ID NO: 3916 - DNA, 2214 bp, Elaeis guineensis
gatcttgacccgaaagaggccaaaggggcgaagcttcgccagaccgcctcgtcctccgatcgctgagatccggccgcggcgatgatcgctaccgccagatccctcgctctcgccgccgccgtcctcctcgccgctgcaaccgcggcgtccgcctccgagtccgaccacaagtatcaagttgatgatcctgtaactctctgggtaaacaaggttgggccatataataatcctcaagagacatataattattacagccttccattttgccagccatcagggaatcctgcccataagtggggaggactcggcgaggttctgggtggtaatgaactcattgacagccagattgagataaagtttcaacgaaatgttgacaagcgctttatttgtcggcttgaacttgatgctgcgaaggtaaagcagttcaaggatgcaatacagagctcgtattggtttgaattcttcatggatgatttgcctctgtggggctatgttggggagattgacaaaaagaatgaaaataagctctatctttttactcacagcaatattcttgtacaatacaatggtgagcggattattcatgtcaatcttacccaagagtctcctaaacttgtggaagttgggaaaactttggacatgacatactcagtcaaatggatgcagactgatgtaacatttgcacgccgttttgatgtttacttggaccatcctttctttgagcaccagattcactggttttccattttcaattcttttatgatggttattttcctcaccggccttgtatcaatgattttgatgcgaactcttagaaaagactatgcaaaatatgctcatgaagatgatgatctggagagtctggagagagatgtgaatgaagaatctggatggaagcttgttcatggtgatgtcttccgcccccctcgcaatttagttcttctttcagctgttgttggtactggtgctcagctggcattgcttgttctcttggtaattttgttggccatcattggaatgctgtacatagggcgtggagctattgtcacgacgttcatagtttgctatgctcttacttcattcatttcaggctatgtgagtggaggactctactcccggagtggaggtaaaaactggataaagtcaatgattctcacagcatcattgttcccttttatgtgctttggaattggcatcgtactcaacacaattgctatcttctaccggtcactagcggctatcccctttggaacaatggtggttgtgttcataatttgggcctttatctcctttcctctggcacttttaggtactgttgttggtagaaactggagtggttctccaaacaatccatgccgtgtgaagaccattcctcgccccatccctgaaaagaaatggtatctcacacccactgttgtctcactcatgggtggtctgcttcctttcggtagcatattcatcgagatgtactttgtcttcacttccttctggaattacaaggtgtactatgtctatggtttcatgttactggttttcctgatccttattattgtcaccgtatgtgtcacaatagtgggcacatatttcttgctgaatgctgagaactatcattggcagtggacttcgttcttctcagctgcttccacagctgtttacgtatatctctactctgtgtattactatcatgttaagaccaagatgtcaggctttttccagaccagcttctattttggctacaccctgatgttctgtttgggcttaggaatactatgtggtgccgtggggtatcttggctccaacatgtttgtcagaaggatctacagaaacatcaaatgtgattagcaaaaccctggatctggagacttaggattgcatgctggaagtcatcgtggatgaagcagcctctttggcaaaacgtggattgctgatagaaattgatgatgcgttgaaaatttcatggaagggtcctacgtttgttttctttgaatttttcctcttgttatccatctaatttctggacatgtcacgctcttcaatttttattctactggctgttggtgacagccatcatatacttattttagtacaggtgtagcgttataatcttgtagaaattacactcaagcgtgatagtctatacttttgttttgggggatttggtttcaagctgggccatgtcaccctcaaaaaataaatatacatgcacttataatg

SEQ ID NO: 3917 - DNA, 2391 bp, Brachypodium distachyon
ccctgtcccggttcggtcgttcgtgcgtactacgacgagtcgacgagtcagctcgtggtgctccttcgggcgacactgagagaggagacgagagtcgagagatcaaccctccatcatctccgcccagatctcgccgccgccgacgagatgcgcctcctcctcgtcctcgtcatcgcggccctcctcgccgtcgcgtgcacgccccttgcgtccgcctccgagtccgaccacaagtacaaagttgatgaatcggttaagctctgggtaaacaaggttggcccgtacaataatcctcaagaaacgtataactattacagccttccgttttgtctaccatctgaaaaccctgcacacaaatggggtggtcttggagaggtcctaggtggaaatgagctgattgatagtcagattgatataaagttcttaaaacatgtggagaagggccccatttgcacaattgaacttgatgctaaaaaggttcagcaatttactgatgccattgaaagttcatattggtttgagcttttcatagatgatctgccattgtggggttttgttggggagactgacaaaaataatgaaaacaagcactatctttacactcacaagaacgttgttgttaaatacaacggtaacaggataattcatgtcaatctcactcaagagtcacctaagcttcttgaagctggtaaaaagctggacatgacatattcagtgaagtgggtgcagacaaatgtggcatttgcgcggcgttttgaagtttacttggactatccgttcttcgaacaccagattcattggttctccatcttcaactctttcatgatggttattttcttaactggtttagtatcaatgatattgatgaggaccctgagaaatgattatgcaaaatatgcacgtgaagatgatgatctggagtcgcttgagagggatgttagtgaggaatctggatggaagcttgtgcacggagatgtatttcggcctcctcgcagcctgatgtttctttctgctgttgtcggtattggcactcagttggcggctcttatcatgcttgttattgtattggccattgttggcatgctatacgtcggacgaggagccatcatcacaaccttcatcgtgtgctacgctcttacatctttcatttctggatatgttagtggcggtctttactcaaggaatggtggcaaaaactggataaagtctatgatccttactgcgtcccttttcccattcttatgcttttcaattggactagtgttgaacaccattgctatcttctaccattcattagcggctataccatttggcacgatggttgtcatatttgttctctgggctttcatctctttccctttggtgctattgggaactgtagttggtcgaaactggagtggtgctcccaataacccatgccgcgtgaagacaatccctcgtcctattcctgagaagaagtggtaccttacaccttctgttatctcattgatgggtgggcttctccccttcggcagcatcttcattgagatgtatttcgtgttcacgtcattctggaactacaaggtgtattatgtttatggtttcatgttactagtctttgtcattctcctaatagtcacaatatgtgtcaccattgtgggcacttatttcttgttgaacgctgagaactaccattggcaatggacatcgttcttctctgctgcatctactgccttgtatgtatatctgtatgctatatactattatcacgtgaagacaaagatgtcaggatttttccagactagcttctacttcggctacaccttgatgttctgtcttgggctagggatactttgtggtgctattggctatctggggtctactctctttgtgaggagaatctacagaaacattaaatgcgactaaattgccactctgatgctggtagacgccattagcacttagcagatcatgtgttgtcgcaggtccagtgtggagtaacgtattctaattaacttttgggaattatacaggaggttgctctccattacatttttctgttttctttttggtctatctctgacatggaactggccccataaaatgtatacctatattagttcaggaactagcttcagtactgaaaattacatctaggtctcttttttgcggcgacctacattggtcaatagcaagacatcgttgatgaatattgctgcagtgcaggttccagttgactagatttcgcctctagtatgactttgtagtttgtatcttgtgtggagttattttctggcaatcaaattcgatctcacctgacacctagattcgtatgcgggcagagagagtggtttgcattcaaaccgattttgtacggacactttgcaaattcgaggactatattgggcttcg

SEQ ID NO: 3918 - DNA, 3904 bp, Vitis vinifera
tgaaaatgtaagggagtcgcaaatctagaataccgactctctctctctcttctcgctccgttgatttcactctctctccgccgattgccatggcctccgccgtcggatccgccgccctttccctccttgctctgtacctcgccctccttctcctcctctcgccggcctctgcctccgactacgatcacaagtatcagcagaatgaaccggttaccctttgggtaaataaggttggaccttacaataatccacaagaaacgtacaattattatagtcttccattttgtcgtcctcctggcaaagctgttcacaaatggattggccttggtgagctcctgggcggaaatgagcttattgaaagccagattgatataaagtttcaaaaaaatgtggacaagggtgtgatatgtcaacttgaacttgatgaagcaaaggtcaaacagttcaaggatgctattgagaataattattggttggaattcttcgtggatgatctgcctttgtggggttttgttggtgagctgcatcctgataaaaacagtgataacaagcacgtgcttttcacacataagaatatcaacattacatacaacaaaaatcagattattcatgttaatctttctcaagagaacccaaaaccgatggaagcaggaagaacattagacatgacatattctgttaaatggattcctactactgtcacttttgctcgtcgttttgatgtttatctggattaccctttctttgaacaccagattcattggttctccatttttaattctttcatgatggttatcttcctcactggtttggtgtcaatgatcttaatgcgaacccttagaaatgactatgctaaatatgctcgggaagatgatgatctggagactctggaaagagatgtgagtgaagagtctggctggaagcttgttcatggggatgttttccggcctcctcccaatttagttctactttcagctgttgttggcacaggtgctcagctagcgttgcttgttctccttgtcatcttattggcaattgttgcaatgttgtatatcgggagaggagcaattgtcacaacttttatagtatgttatgctctgacatcattcatttcgggttatgtgagtggtgggatgtactcacgcaatggtggtaaaacctggattaagtcgatgattctcactgcatcactttttccatttatgtgctttgggattgggttcttgttgaatacaattgctatattctatgggtctttagcagctattccctttggaactatggtagttgttttcttcatttgggctttcttctctttccctctggcactacttggcacggttgttggtagaaactggagtggtgctccaaataatccttgtcgtgtgaaaactattcctcgtccaatccctgagaagaaatggtatctcacaccatctgttgtctcaatgatgggaggtctgctaccctttggcagcatatttattgagatgtactttgtcttcacatccttctggaattacaaggtgtattatgtctatggctttatgctactggttttcctgattctcataattgtcactgtttgtgtgacaatagtgggaacatacttcttgctaaatgctgagaactatcactggcagtggacttcgttcttctcagctgcttcaacagctgtctatgtatacttgtattctatatattactactatgtgaagactaagatgtcaggcttcttccaaaccagcttctacttcggatacaccctgatgttttgccttggtttaggaatcctctgtggagctgttggatatctgggctctactttgttcgtcaggaggatctacagaaacatcaagtgtgactaggtcacctggaggacaaatagggctgatagtgcttccctgagcttttagattgttgattcagaaataaaaatttgagaggaagcctctggtcatcaacactacggtaaaaaacaaaaatcacagggtttaggatggtgctgtatttttctttctcaggcttgggaagctctgagaatttttttttttccttctcttcccccccaccccctcaaaatggatgttgtatttttcttcctcaggcttgggaagctctgagaatttttctttcttctcttccccccaccccctcaaaatggatgtaagtgaaagcccgtctttactcaatttagaatccagagattgtttccataatttggaaagcttagcatgatgataaaaaaactcacctgtcatttagatatcctctttcctccctctacaaatcatgtaagaactattgcctaattcccctcctgttttgtcatttacacatctttgggactacgtatatggggggaaggggttcggaagaagtgaattttgtgcttgtgaactatgtgcatacaacgattacttctatctatatctccagtatttgagtttgcaaaacttgatttcatttcgtttctctttctaatgcccctgcaatccttttcataataatcatggtgtttgcaacaaagcaatcaattctctcattctagaactctctcccattttctggttgagctaatgtttcaggcatcttatgattcttcctataaaactttatgaggtcacaaattgtaacaaggaagatactggattgacaagtccccgctggtggataatgaaaaaagtcgcctgtttagttgttttgggcgttgttgctacaccataattggactttgtggtgcggtttaggacaaaaccacgtccatatgtattttgtgtggaaagcagcaaacgttgaggctgatgggaaccattaggcatttttcattttgtaagtgaatggaaatatacgaatgaagcacccaagaaaaacccagcattcagaaaataggaggccacatttgagtgaaggattgtggccaccacagtcacccaataaactggtgattgtgataaagagataaagtgcaccacaccgttttgccacgtggcagataggattctatgcaaccttctctatttctacttcccttggtatattcttcgctagtctctcctccacacacaagcacagagacaacgctgttgcattatcacatctaagagagaaatggcaacactttcaggcgccatggtgagcacctccttcatccggaggcagccggtgacgagcctccgtgctctgccgaatgtgggtcaggctctgtttgggttgaaagccgggcgagggagggtaacagccatggctgtttacaaggtgaagctgatcacaccagagggggcgaaggagtttgagtgcccagatgatgtttacgttctggaccacgcggaggagattggtattgatctgccctactcgtgccgtgctgggtcttgctcctcctgcgccgggagggtggtggaaggcactgtggatcagtctgacgggagcttccttgaggatgagcagatggaggaaggatgggttctgacttgtgttgcttatcctcagtccgatcttgtgattgagacccacaaggaggaggagctcactgcttaagagcagttcacatatgttctccctccctctctttctgtctcctcctctgttttgttgcctggattagcttaatttcagagcttatgattgttgtatttctgaactttgtaattgtaatgtttctttttggctcattttagtcataaatgagattatatcgggtttggctgccaaacctcctcctctctctttgtagtcattgattcatggatgcacttcatgtttacatccactagctctcctttcgagactaagaaaaattcatgctccccctgctggggtgtgatgaatgtgactaaacaggacgataaggtcctaattgaaagttctgttttccaccccaaagtcttaaccaggaatcaca

SEQ ID NO: 3919 - DNA, 2433 bp, Prunus persica
aacaaaattagaaaaaatggagatgcgttccgaagtcgcaactctctctttctgaagactttgagtaattgagtggcctcagcctcagcctccgagagagagatcagcacagaacagaacatcacgtcttctcactgaccttccagatcccaccctcgccggcgatcgccatgttctccaccgtccgatctctctcccccttcctcgtctttgctttccttctcctatcccccgcgttcgcctccgaggcagatcacaagtatcaaacagaagaaccagttactctttgggtgaataaagttgggccatataataatccacaagaaacgtacaattactacagtcttcctttctgtcatccatctgaaaatgccgctcacaaatggggtggtcttggtgaagtcttgggtggaaatgaacttattgatagccagattgacataaagtttcaaaaaaatgtggatagggccaccatttgtcaacttgaacttgatgatcaaaaggttaaacaattcaaggatgcaattgagaatagttactggtttgaattcttcatggatgatctgcctttatggagctttgttggtgagttgcatcaggacaagaacagtgaaaatggcaagcatgtccttttcacgcataagcttattattgtcaaatacaataaagatcagataattcatgtgaatctcactcaagatagtccaaggccgctggaagcagggaaaaagttggacctgacatactctgtcaaatggattccaaccactgtcacctttgcacgtcgttttgatgtctatttggactaccctttctttgagcaccaaatacattggttctcgattttcaattcgttcatgatggttatattccttactggtttggtgtcaatgatattgatgcggactcttaggaatgactatgcaaaatacgctcgggaagacgatgatctggagactctggaaagggatgtcagtgaagagtctggctggaaacttgtgcatggggatgtttttcggcctcctcggagtctggttattctttcagctgttgttggcacaggagctcagctagctttgcttgttctcctcgtcatcttactggcaattgttggaatgttgtatgttgggagaggtgcaattgttacaactttcatagtgtgttatgcccttacctcattcatttctggttatgtaagtggtgggatgtattcacggaatgggggtaaaaactggataaagtcaatgattctcacagcatctctatttccatttatgtgctttggaattgggttcgtcttgaacaccattgctatattctatgggtctctagcagctattccttttggcacaatggtggttgtttttgtcatttgggctttcatctcttttcctctagcacttcttggcactgttgttggaagaaactggagtggtgctcctaataatccctgtcgtgtgaaaaccattcctcgtcctattcctgagaagaaatggtatttaaccccatctgttgtctcaatgatgggaggacttctgccctttggaagcatatttatcgaaatgtattttgtcttcacatccttctggaattacaaggtgtactatgtctatggctttatgcttcttgtttttctgattctcatcattgttactgtatgcgtgacgattgtggggacatacttcttgcttaatgctgagaactaccactggcaatggacttcattcttttctgctgcatcaacagctgtctacgtgtacttgtattcaatatattactactatgcgaagactaagatgtcaggtttcttccagaccagcttctattttgggtacactttgatgttttgccttggcttaggaattctctgtggagctgttggatatctgggctctaatttgtttgtgaggaggatctacagaaacatcaagtgcgactagtgtttctctgagaggaaatggtcctgatggagcttccgtgagtacattggtcgttattgaggcgatagattctgattggaagctacatggtcatggatggggatccagtaacctctacagattaaaatcacagggtttgaggatagggatgtattctttctctggacttgggaaagccctgagattttttttgttttccccggctgtaagtgaaagccttaattttagattgcagagattgttttataatctaagaaagttagcagatgtcgaactctcctgttactttattattttctttttcgaccttttacaaataggtgccccattactcttttaatctgtacggctttgggatggatgaaaagaggggaaagactttctgaaatgaacttttgcttctcggttatgtaacgacttgtgaattttgattccatctgtaccctgcatatataagtatcattgtctcaaaccacacattgtgaggtgataa

SEQ ID NO: 3920 - DNA, 2485 bp, Prunus mume
tttggtgagagaaaaaaataaaaaaaaatggagatgcgttccgaagtcgcaactctctctttctgaagactttgagtaattgagtggcctcagcctcagcctcagcctctgcctctgcctctgcctccgagagagagatcagaacagaacagaacatcacgtcttctcactgaccttccagatcccaccctcgccggcgatcgccatgttctccaccgtccgatctctctccccactcctcgtctttgctctccttctcctatcccccgcgttcgcctccgaggcagatcacaagtatcaaacagaagaaccagttactctttgggtgaataaagttgggccatataataatccacaagaaacatacaattactacagtcttcctttctgtcatccatctgaaaatgctgctcacaaatggggtggtcttggtgaagtcttgggtggaaatgaacttattgatagccagattgacataaagtttcaaaaaaatgtggatagggccaccatttgtcaacttgaacttgatgatcaaaaggttaaacaattcaaggatgcaattgagaatagttactggtttgaattcttcatggatgatctgcctttatggagctttgttggtgagttgcatcaggacaagaacagtgaaaatggcaagcatgtccttttcacgcataagaatattattgttaaatacaataaagatcagataattcatgtgaatctcactcaagatagtccaaggccgctggaagcagggaaaaagttggacctgacatactctgtcaaatggattccaaccactgtcacctttgcacgtcgttttgatgtctatttggactaccctttctttgagcaccaaatacattggttctcgattttcaattcgttcatgatggttatattccttactggtttggtgtcaatgatattgatgcggactcttaggaatgactatgcaaaatatgctcgggaagacgatgatctggagactctggaaagggatgtcagtgaagaatctggctggaaacttgtgcatggggatgtttttcggcctcctcggagtttggttattctttcagctgttgttggcacgggagctcagctagctttgcttgttctcctcgtcatcttactggcaattgttggaatgttgtatgttgggagaggtgcaattgttacaactttcatagtgtgttatgcccttacctcattcatttctggttatgtaagtggtgggatgtattcaaggaatgggggtaaaaactggataaagtcaatgattctcacagcatcactatttccatttatgtgctttggaattgggttcgtcttgaacaccattgctatattctatgggtctctagctgctattccttttggcacaatggtggttgtttttgtcatttgggctttcatctcttttcctctagcacttcttggcacagttgttggaagaaactggagtggtgctcctaataatccctgtcgtgtgaaaaccattcctcgtcctattcctgagaagaaatggtatttaaccccatctgttgtctcaatgatgggaggacttctgccctttggaagcatatttatcgaaatgtattttgtcttcacatccttctggaattacaaggtgtactatgtctatggctttatgcttcttgtttttctgattctcatcattgtgactgtatgcgtgacgattgtggggacatacttcttgctgaatgctgagaactaccactggcaatggacttcattcttttctgctgcatcaacagccgtctacgtgtacttgtattcaatatattactaccatgcgaagactaagatgtcaggtttcttccagaccagcttctattttgggtacactttgatgttttgcctcggcttaggaattctctgtggagctgttggatatctgggctctaatttgtttgtgaggaggatctacagaaacatcaagtgcgactagtgtttctcagagaggaaatggtcctgatggagcttccgtgaatacattggtcgttgttgaggcgatagattctgtttggaagctacatatggtcagggatggggatccagtaacctctacagattaaaatcacagggtttgaggatagggatgtattctttctctggacttgggaaagccctgagattttttttgttttccccggctgtaagtgaaagccttaattttagattgcagagattgttttataatctaagaaagttagcagatgttgaactctcctgttactttattattttctttttcgaccttttacaaataggtgccccattactctttcaatctgtacggctttgggatggatgaaaagaggggaaagactttctgaaatgaacttttgcttctcggttatgtaacgacttgtgaattttgattccatctgtaccctgcatatataagtatcaatatctcaaaccacacattgtgaggtgataattttgtgtttgttca

SEQ ID NO: 3921 - DNA, 2477 bp, Fragaria vesca
gcgactctgtgtttgtgaacaagagaagacttggttttgagcaattgagagagtagccccttcttcccccccaattcagatcccccaccgtcgccgccatgttctccaccgtcggatctctctcactcttcaccttcgccttcgccttcgccttcgccttcgccttcgcctgccttctcctctcccccgcctccgcctccgagccggatcacaagtatcaagcagaagaagcagttaccctttgggtaaacaaagttggcccttataacaatccacaagaaacctacaattactacagtctcccgttctgtcgtccatctgataatgctgctcacaaatggggtggtcttggtgaagtcttgggtggaaatgaacttattgatagccagattgacataaagtttggaaaaaatgtggatagggctaccatttgtcagcttgaacttgatgatcataaggttaaacaattcaaggatgcaattgagaatagttactggtttgagtttttcatggatgatctgcctttatggggctttgttggtgagttgcaccaggataagaacagtgaaaatggcaaacatgttcttttcacacacaaaaatattattatcaagtataataaagatcagataattcatgtcaatctcactcaagatagtccaaagccgctggaagcggggaagaaattggatctgacgtactctgtcaaatggattccaacccctatcacctttgcacgtcgctttgatgtatatttggactacccatttttcgagcaccaaatccattggttctccattttcaattcgttcatgatggttatattccttactggtttggtgtcaatgatattgatgcgcactcttcggaatgactatgcaaaatatgctcgggaagatgatgacctagagaccctggaaagagatgttagtgaagagtctggctggaaacttgtgcatggggatgtttttcgtcctcctcggagtttggttattctttcagctgtagttggtactggagctcagttggcgttacttgttctccttgtcattttactggcaattgttgggatgttgtatgtcgggagaggtgcaattgttacaactttcatagtgtgttacgctctcacatctttcatttctggttatgtaagtggtgggatgtattcacggcatgggggtaaaaactggataaagtcaatgattctcacagcatctttatttccatttatgtgctttggaattgggttcgtcttgaatacaattgccatattctatgggtctctagcagctattccattcggcactatggtggttgtctttgtcatttggggtttcatctcatttcctttagcgctccttggtacggttgttggaagaaactggagtggtgctcctaataatccttgtcgtgtcaaaaccattcctcgtccaattcctgagaaaaaatggtacttgacaccatctgtggtgtcgatgatgggagggcttttaccctttggaagcatattcattgaaatgtactttgtcttcacgtccttctggaattacaaggtgtactatgtctatggctttatgctgcttgtgtttctgattctcatcattgttactgtatgcgtgacgattgtggggacctacttcttgcttaatgctgagaattaccactggcaatggacttctttcttttctgctgcatcaacggctgtctatgtgtacttgtattcagtatattactactatgcaaagaccaagatgtcaggtttcttccagacaagcttctattttggatacactttgatgttttgccttggcttagggatcctctgtggtgctgttggatatttgggttcaaatttgtttgtgaggaggatctacagaaacatcaaatgcgactagaatttctgtaatgggaccagggatggagcttccctgtgtagaatggtcgtttgttgaggcaaaagattcatgtagaacggcatgtgataaggaatggggacttgataatgttaatggcagaaatcgcagggtgtgaggatggggatgtattttttctctggattaggggaaagccctgagatttttcctttttgttttccccggctgtaagtggaggccttgatttagattcgcagagattgttttataatcgaagaaagttaagttagcagatgtcattgaactcctgtcacttttattattttctttttttttttcactaccttttaccaaataggttgcccccgttactctttctatctccacgtctttgggatgaacgaaaggagggggaatgaactttgtgcgtctgagttatgtaacgacttgtgaattttgattctatcttatataccttgcatatatacgttcactgtcatcaggaaaatggatgcatggtatgctctatgtgaattgcttgctttgcaaaactgactgaatactttggaactcaatcttaaacttggaatatgtgtacataaa

SEQ ID NO: 3922 - DNA, 2551 bp, Triticum aestivum
ggagacgagaccaaccgcgcaggtaggctcggaagggcgacgcaaaccccccaactcgcgcccaccttccaccccagatctcgcggccgccgccgccgccgacgagatgctcctcctccgcggcctcctcctcgccgctctcctcgctgtcgcgcggcagcccctggcgtccgcctccgagtccgaccacaagtacaaaatttcagaaccagttaagctctgggtaaacaaggttggcccgtacaataatcctcaggaaacatacaactattacagccttccgttttgtcaaccagctgaaaaccctgcacataaatggggtggactcggagaggttctcggtggaaatgagctgattgatagtcagattgatatacagtttttgaaaaatgtggacaagggccccatttgcacaattgaacttgatgctaaaaaggttcagcaatttactgatgccattgaaagctcatactggtttgagcttttcatagatgatctgccattgtggggttttgttggggagactgacaaaaacaatgaaaacaagcactatctttacacacacaagaatattgttgttaaatacaacggtaacagggtaattcatgtcaatctcactcaagagtcacctaagcttcttgaagctggaagaaaattggacatgacatattcagttaagtgggtgcaaacaaatgtggcatttgcacggcgttttgaagtttacttggactacccattcttcgagcaccagattcattggttctccatcttcaattctttcatgatggtcattttcttaactggtttagtatcaatgatattgatgaggaccctgagaaatgattatgcaaaatatgctcgtgaagatgatgatcttgagtcacttgaaagggatgttagtgaggaatctggatggaagcttgttcatggagatgtatttcgacctccacgcaacctaatgtttctgtctgctgttgttggcattggcactcagatggcagctcttatcctgcttgttattgtacttgccattgttggtatgctttatgttggacgaggagctattatcacaacctttatcgtgtgctacgcgcttacatctttcatttctggatatgttagtggcggcctctactcaaggaatggcggcaaaaactggataaagtctatggtccttaccgcgtccctttttccattcttgtgcttttcaattggattagtgttgaacaccattgctatcttctaccattcattagcggctataccatttggtacaatggttgtcatatttgtcctctgggcttttatctctttcccactggtgctattgggaacagtagttggtagaaactggagtggtgctcccaataacccatgccgtgtgaagacaatcccacgtcctattcctgagaagaagtggtacctaacaccttctgttatctcattgatgggtgggcttcttcccttcggcagcattttcatcgagatgtacttcgtgttcacttcattctggaactacaaggtgtactatgtttatggcttcatgttgctagtctttgtcatcctcctaatcgtaacagtatgtgtcactattgtgggcacttatttcttgttgaatgctgagaactatcattggcaatggacatcgttcttctcggctgcatcaaccgccttgtatgtatatctatacgctatatactattatcatgtgaagacaaagatgtcaggctttttccagactagcttctacttcggctacacgttgatgttctgtctggggctaggcatactttgtggtgctatcggctatctggggtcaactctgtttgtcaggagaatctacagaaacatcaaatgcgactaaactgcttctccgattctgtaggctattagcacttagcagatcatgtgttgttgagtaacgcttctaagattctaattaacttttggaaactatacaggaggtagttctcccattgtttaccttggtacttacctttttggtctatatctacctccgtcatcaaactcgcactataaatgtatacctatattagttcggaattagtctcagcactgggatttctgtttccaccacatagctaaagggctggctatgtgaagaatacatacatggacaagatatgctcgcgatacgaaaatttctggaagaaaatgtgtgatgtgaagggtcgctcttgacgatatcgacctgcctgcgggtttctacgccctcttttagataaatgcgacggtgggttttcaatgaaaaaactttgaccagtatgacgtggatgatatggacgagcacctgtctctgagcaaaggtttactgacaatatacttggggaggcatgtacagggttaagataaccttttttcacctacagctactcgaaggggcccaaagataaggggaacccgacttcaaatatccctccgaggcggccatccataaacctaagcccaggataatgacccaattaaacccccacatgtgtttcctttagggaaagaactatgtccttttttatcaacaccgtgtccagga

SEQ ID NO: 3923 - DNA, 2359 bp, Hordeum vulgare
ggggaggcagctcctgctcgggcaggactgagacgagaccaaccgcgcaggcaggctcggaagggcgacgcaaaccccccaacccgcgtccaccctccactcagatctcgcggccgccgccgccgccgccgccgagatgctcctcctccgcggcctcctcctcgccgcgctcctcgccgtcgcgcgtccgcccctggcgtccgcctccgagtccgatcacaagtacaaaatttcagaaccagttaagctctgggtaaacaaggttggcccgtacaataatcctcaggaaacatacaactattacagccttccgttttgtcaaccagctgaaaaccctgcacataaatggggtggacttggagaggttctgggtggaaatgagctgattgatagtcagattgatatacagtttttgaaaaatgtggacaagggccccgtttgcacaattgaacttgatgctaaaaaggttcagcaatttactgatgccattgaaagctcatactggtttgagcttttcatagatgatctgccattgtggggttttgttggggagactgacaaaaacaatgaaaacaagcactatctttacacacacaagaatattgttgttaaatacaacggtaacagggtaattcatgtcaatctcacacaagagtcacctaagcttcttgaagctggaagaaaattggacatgacatattcagtgaagtgggtgcaaacaaatgtggcatttgcacgacgttttgaagtttacttggactacccgttcttcgaacaccagattcattggttctccatcttcaattctttcatgatggtcattttcttaactggtttagtatcgatgatattgatgaggaccctgagaaatgattatgcaaaatatgctcgtgaagatgatgatcttgagtcgcttgaaagggatgttagtgaggaatctggatggaagcttgttcatggagatgtatttcggcctccacgcaacctaatgtttctgtctgccgttgttggcattggcactcagatggcagctcttatcctgcttgttattgtacttgccattgttggtatgctttatgtaggacgaggagctattatcacaacctttatcgtgtgctacgcacttacatctttcatttctggatatgttagtggtggcctctactcaaggaatggtggcaaaaactggataaaatctatggtccttactgcgtccctttttccgttcttgtgcttttcaattggattagtgttgaacacgattgctatcttctaccattcattagcggctatcccatttggcacaatggttgtcatatttgtcctctgggcttttatctctttcccactggtgctattgggaacagtagttggtagaaactggagtggtgctcccaataacccatgccgtgtgaagacaatcccacgtcctattcctgagaagaagtggtacctaacaccttctgttatctcattgatgggcgggcttcttcccttcggcagcattttcatcgagatgtactttgtgtttacttcattctggaactacaaggtgtactatgtttatggcttcatgttgctagtctttgtcatcctcctaatcgtaacagtatgtgtcactattgtgggcacttatttcttgttgaatgctgagaactatcattggcaatggacatcgttcttctcggctgcatcaaccgccttgtatgtatatctatacgctatatactattatcacgtgaagacaaagatgtcgggctttttccagactagcttctacttcggctacacgttgatgttctgtcttgggctaggcatactttgtggtgctattggctatctggggtcaactttgtttgtcaggagaatctacagaaacatcaaatgcgactaaactgcttctccgattctgtaggctattagcacttagcagatcatgtgttgttgagtaacgcttctaagattctaattaacttttggaaactatacaggaggtggttctcccttcgtttacttaatactttgatttttggtctatatctacctccgtcatcaaactggtcccataaatgtatacctatattagttcaggaattagtctcaatactgggatttacatcttgcttatcattctatggcatcattgatgcagtgcagattcgggtggactagatgtgcccctaccgtgggttgcaacatcgagattctgttttagtatatgtaaaagcaaactactacgccttgggtgaactagatgtgcccctaccatgggtggcaaacagtctgaatgagaagcgtccgtctaacgagcgtttgcttgtctgttagccaaccaggtcagacgagataacctttagct

SEQ ID NO: 3924 - DNA, 2273 bp, Panicum virgatum
cggcagcagctgggctgggcgagtcttgccgtctcgggccaacccgaaccccaaggctcgcgaccgcgacactttcctgtctcctccgcctccctcctcagatctcgccgccggcggacatgctcccctcctccagcggcgcccgcgcccgcggtctcctgctcggcctcgccctcgccctcgcgtccctgctcgcccccgcctccgcctccgagtccgaccacaagtacaaagcggaggagccagttaagctctgggtgaataaagttggtccttataataatcctcaagaaacttacaactattacagccttccattttgtcaaccatctgagaaccccatacataaatggggtggtcttggagaggtcctgggtggaaatgagctgattgatagccagcttgagatgaagttcttaagaaatgaggagaagggcttcatttgtacacttgagctggattctaaaaaggttcagcagtttgctgatgccattgagaactcatattggtttgaatttttcatagacgatctgcctctttggggttttgttggggagactgacaagaacagtgaaaacaagcattatctatacacacacaagaacatccttgttaagtacaatgagaacaggataattcatgtaaatctcacccaagagtctcctaaacttcttgaagttggtaagaaattggatatgacatattcagtgaagtgggtagcaacagatgtgtcatttgcacgtcgttttgaagtgtacctggactatcctttctttgaacaccagattcactggttctccattttcaactcttttatgatggttattttcctaactggtttggtttcgatgatattgatgcggactttgagaaacgattatgccaaatatgctcgtgaagatgatgatctggagtccctggagagagatgttaacgaggaatcaggatggaagcttgtccatggtgacgtatttcggcctccccgaagtttgatgtttctttctgcacttgttggaattggcacccagctggcagctcttatcctacttgtgattgtgttggccatcgttggcatgttatacattgggcgaggtgctatcatcacaacatttattgtgtgctatgctcttacatcgttcatttctggatatgttagtgggggtctttactcgaggaatggtggcaaaaactggattaaagctatggtccttacagcatccctctttccgttgctgtgtttttcaattggcttcgcactgaacacaattgctatcttctaccgctcattagcagcaataccatttgggacgatggttgtcatgtttgtactttgggctttcatctcctttcccttggtgcttttggggactgttgttggtaggaactggagtggtgctcctaacaacccctgccgtgtaaagactattccacggcctattcctgagaagaagtggtaccttacaccttctgtcatctcgttgatgggtgggctgcttccctttggcagcatcttcattgagatgtactttgtgttcacatcattctggaactacaaggtgtattatgtctatggtttcatgttgctggtcttcatcatccttctaatagtcaccatctgcgtcactatcgtgggtacctatttcttgctgaatgctgagaactatcattggcagtggacttcgtttttctctgcagcatcaactgctttgtacgtgtacctatactccatctactactaccatgtgaagacaaagatgtcaggcttcttccagacaagtttctactttggctacacattgatgttctgccttggtctaggcattctttgcggtgctattgggtatttagggtcaaccctgtttgtaaggagaatctacagaaatatcaaatgtgattaaattcctgctactcactagcagcagagagatcatatgtattcagtgcggaagcaaggcctcaagatagattgatggtagatcctgaataggtttttgaaactacagaggacatgctccctttgttcactatcatacgcatttttgcttgcctgcttattcctgtggaatcgtcatcatattgtatacctatgtagttgaggattagtctaaagcaacggtttttattcttttctcttttttttagtatttttgtttggtaggatgtaatcagtgaatgttcatgcggcgcgagcacaattgttgggaattttccctcctatgcatcatatcatcccgttcaaagtttccaagttcaagttgaggagtgtttaattc

SEQ ID NO: 3925 - DNA, 2385 bp, Aristolochia fimbriata
tcgacccccgggtcccgaaactcccggccagtgagcgagaacagcacttccggcaaaaaggccttccttttcttgctttggtatcgcattcagaagtcaagatccgaggtcgcatcttcagcgacaatgctctccgcggtccgatcttcttccgcgatcttcttcttcctcttctctctcgtccgtcttacctctgcgtccgagtccgatcacaagtatcaagcagatgaccccatcacactatgggtaaacaaggtcgggccttacaataatcctcaagagacatataactactacagtttgccattttgtcaaccggctagcaatccaactcacaagtgggggggtttgggtgaagttcttggtggcaatgaactcatagacagtcaaattgacattaaataccaaaaaaatgttgaccggggtacaatatgtgagctagaactggatgcaccaaaagtgaagcatttcaaggatgcaattgagaatgcatattggtttgagttcttcattgatgatttgcctgcatggggttttgtcggtgaactgcatcctgataaaagcaatgaacataggcatttgctttacactcacaagaatattgtcattaagtacaacggtgatcagatcattcatgttaatcttacacaagaaagcccaaaacccttggaggctggaaaaacatttgaccttacatactcagttaaatgggtacctacaaatataacttttgctcgacgttttgatgtctacttggactatcctttctttgagcaccagattcattggttctccatctttaactccttcatgatggtcatttttctcactggacttgtatcaatgatattgatgcgaactcttagaaatgactatgcaaagtatgctagagaggatgatgacctggagactctggaaagggatgtgaatgaagaatctggatggaaactggttcatggagatgtattccgacctccacgcaatttagttttactatcagcagttgtaggtactggggctcagcttgcaactcttgttcttcttgtcatcctattggcaataattgggatgctatacattgggcgaggagcaattgtcacaactttcattgtttgttatgctcttacgtcattcatttcgggttatgtgagtggtggactttactctcgtcatggcggtaaaaactggatcaagtccatgatcctgactgcatctcttttcccattcatggtctttggaattggttttctattgaacactattgccatattctatggatctctagccgctattccttttggaacaatggtggtcgtgttcatcatctgggcatttatttcatttcctctggcccttcttgggactgttgttggcagaaactggagtggatctccaaataatccttgtcgtgtgaaaactattccccggccaatccctgagaagaaatggtacctcacaccatctgtagtttctcttatggggggcctgcttccctttgggagtattttcattgagatgtattttgtcttcacatccttctggaactacaaggtgtattacgtatatgggtttatgcttttggtctttctgattctcataatcgtcaccatatgtgtcacaattgttggtacttatttcttattgaatgctgagaactaccactggcaatggacttccttcttctctgctgcatcaaccgctgtctatgtgtatctctactccatttactactactatgtgaaaacaaagatgtctggattcttccagactagcttctattttggctacaccctaatgttttgccttggcttggggatcctctgtggtgctgttggctacctgggctctacactttttgtgagaaggatttacagaaacatcaaatgtgactaattgtggagcctctgctggagacattgagagtttggtggagtcgtgtggagaaagatgactggatcacctatttagtgactcaagagtagtgtatggcaagctggtgggttgcggcagggttttgtatctggtctctgaactttcggaggctttgcagaaatttttttgtggctcgaagtgaaagccttgttatttagggcagaggtagtgctaaggaccccatattcaactccacttgtttactgttatactatcaaagaggggaactgcttgagacatttgttgttgtcacaagttccttcaacaattggacacacttgtataactgttaaaatttttccttgtcttctttccattttgtcttcaatccagcatttaacacgaaccattctgttttccatggtttttgccctgctgcgaggggaaattttgaatgatattgtaccttatgggttcagacacgggtgttactgctgaatgagccatatgtga

SEQ ID NO: 3926 - DNA, 2244 bp, Solanum phureja
ctatttttgttaagattaagaaagttgtgaagcagctctactacaataggggctactcggacactctcttactctgtggaataaaaccaggccgaacgagtaacctgaaccgttgtatccatatctttgccggcgatacagatgctgccgaccgctcgatcactgtctcttgtcctgttcctggccgccttcatcatcgttccgcctgcgcttgcttccgagtccgatcacaagtatcaagcagatgatccggttaccctctgggtaaataaagttgggccatataataacccacaggaaacatacaactattacagccttccattctgtcatgcatctggtaatactcacaaatggggtggccttggtgaagttttaggtggaaatgagcttatcgatagtcagattgacctaaggtttcaaaaaaatgtggacaagggtagcatttgtgagcttgagcttgatgagacgaaggttaagcaattcaaggatgctattgaaaacaattactggtttgaattcttcattgatgacctgcctttatggggttttgttggtgagctacatactgacagaaacagtgataacaagcatgtgctttacacacataagaatattaatattaaatacaacaaggaccagatcattcatgttaatctctctcaggagagcccaaagcctttggaagctgggagaaccttggacatgacatattctgtcaaatgggaacctaccaatatcagttttgctcatcgttttgatgtatacttggactacccattttttgagcatcagatccattggttctccatatttaattccttcatgatggtcatcttccttactggtttggtgtctatgattttgatgcggacactgaggaatgattatgccaagtatgctcgggaagatgatgatctcgaaaccctggaaagagatgttagtgaagagtctggttggaaacttgttcatggggatgtgtttcggcctcctcattatctagcgctaatttcagctcttgttggtactggggcacaacttgcactgcttgttctccttgtcattctgttggcaattgtggggacattatatgttgggagaggagctattgtcacaactttcatagtgtgctatgctttgacatcattcatttcgggctatgttagtggtgcaatgtactcacggaatggtgggaaaagctggatcaaatcaatgattctaacagcgtcacttttcccatttttgtgctttgggattggctttattctgaacacaattgcaatattttatgggtctctagcagccattccctttggtacgatggtagttgtgtttgtcatctgggccttcatttccttccccctggctcttcttggtactgtttttgggagaaactggagtggcgctccaaacaatccatgccgtgtcaagaccatacctcggcctattcctgagaagaagtggtatctgacaccatctgtagtttccttgatgggaggattgctaccatttggaagcatatttattgagatgtattttgtcttcacctccttctggaattacaaggtatactatgtgtatggatttatgcttctggtgtttctgatcctcattattgttaccgtctgcgtgactattgtgggaacatatttcctactaaatgctgaaaattatcattggcagtggacttcgttttcctcagctgcctctaccgctgtctatgtatacctgtactcagtatattattattatgtgaagactaagatgtcagggttcttccagaccagcttctactttggctacacactgatgttttgtcttggcttagggattctctgcggagctgttggatttttgggctctaatctatttgtgaggaggatttatagaaacatcaaatgtgactgattttctttggaaggagagagttcaatgtccttattttctcggtcactggctatgaggtcaagaagagtatcaagtatcttcgtggggttattcagtcaactgatggtaggcgcctctgccaggaatcatcggagcctgaaagttttccttttttcgtttgggctgtaagagattttttcttttcttttgtacttacaattagaaagattagatagcttgaggtattcaaggctagcttttcagattgtcatttagcaattttggacgctctaaagtagtaatctttcatttttataaattattttactgcaaatgaatgagactcaggttagtttt

SEQ ID NO: 3927 - DNA, 2172 bp, Secale cereale
gggcgacgcaaaccccccaacccgcgcccaccctccacaccagatctcgcggccgctgttgccgccgccgccgacgacgagatgctcctcctccgtggcctcctcctcgccgcgctcctcgccgtcgcgcggccgcccctcggcgtccgcctccgacgtccgaccacaagtacaaaatttctagaaccagtaaagctctgggtaacaaggttggcccgtacaataatcctcaggaaacatacaactattacagcctcccgttttgtcaaccagctgaaaactacgcacataaatggggtggactcggagaggttcttggtggaaatgagctgattgatagtcagattgatatacagtttttgaaaaatgtggacaagggccccatttgcacaattgaacttgatcctaaaaaggttcagcaatttactgatgccattgaaagctcatactggtttgagcttttcatagatgatctgccattgtggggttttgttggggagactgacaaaaacaatgaaaacaagcactatctttacacacacaagaatattgttgttaaatacaacggtaacagggtaattcatgtcaatctcactcaagagtcacctaagcttcttgaagctggaagaaaattggacatgacatattcagtgaagtgggtgcaaacaaatgtggcatttgcacggcgttttgaagtttacttggactaccctttcttcgaacaccagattcattggttctccatcttcaattctttcatgatggtcattttcttgactggtttagtatcaatgatattgatgaggaccctgagaaatgattatgcaaaatatgctcgtgaagatgatgatcttgagtcacttgaaagggatgttagtgaggaatctggatggaagcttgttcatggagatgtatttcgacctccacgcaacctaatgtttctgtctgctgttgttggaattggcactcagatggcagctcttatcctgcttgttattgtacttgccattgttggtatgctttatgttggacgaggagctattatcacaacctttatcgtgtgctacgcgcttacatctttcatttctggatatgttagtggtggcctctactcaaggaatggcggcaaaaactggataaagtctatggtccttaccgcttccctttttccgttcttgtgcttttcaattggattagtgttgaacaccattgctatcttctaccattcattagcggctataccatttggcacaatggttgtcatatttgtcctctgggcttttatctctttcccactggtgctattgggaacagtagttggtagaaactggagtggtgctcccaataacccatgccgtgtgaagacaatcccacgtcctattcctgagaagaagtggtacctaacaccttctgttatctcattgatgggtgggcttcttcccttcggcagcattttcatcgagatgtactttgtgttcacttcattctggaattacaaggtgtactatgtttatggcttcatgttgctagtctttgtcatcctcctaatcgtaacagtatgtgtcactattgtgggcacttatttcttgttgaatgctgaaaattatcattggcaatggacgtcgttcttctcggctgcatcaaccgccttgtatgtatatctatatgctatatactattatcacgtgaagacaaagatgtcaggctttttccagactagcttctactttggctacacgttgatgttctgtctggggctaggcatactttgtggtgctattggctatctggggtcaactctgtttgtcaggagaatctacagaaacatcaaatgcgactaaactgcttctccgattctgtaggctattagcacttagcagatcatgtgttgttgagtaatgcttctaagattctaattaacttttggaaactatacaggaggtggttctcccttcgtttaccttaatatacttatatttttggtctatatctacccctgttatcaaactggccccataaatgtatacctatagtagttcaggaattagtctcagtactgggatttacatctagctttatctttttagggtggccctctggcttatgttcattgatgcagtgcagattctggtgaacatgtgcccctgccataagttgcagcattcagattcc

SEQ ID NO: 3928 - DNA, 1822 bp, Secale cereale
ctcgccgtcgcgcggccgcccctggcgtccgcctccgagtccgaccacaagtacaaaatttcagaaccagttaagctctgggtaaacaaggttggcccgtacaataatcctcaggaaacatacaactattacagcctcccgttttgtcaaccagctgaaaaccctgcacataaatggggtggactcggagaggttctcggtggaaatgagctgattgatagtcagattgatatacagtttttgaaaaatgtggacaagggccccgtttgcacaattgaacttgatcctaaaaaggttcagcaatttactgatgccattgaaagctcatactggtttgagcttttcatagatgatctgccattgtggggttttgttggggagactgacaaaaacaatgaaaacaagcactatctttacacacacaagaatattgttgttaaatacaacggtaacagggtaattcatgtcaatctcactcaagagtcacctaagcttcttgaagctggaagaaaattggacatgacatattcagtgaagtgggtgcaaacaaatgtggcatttgcacggcgttttgaagtttacttggactaccctttcttcgaacaccagattcattggttctccatcttcaattctttcatgatggtcattttcttgactggtttagtatcaatgatattgatgaggaccctgagaaatgattatgcaaaatatgctcgtgaagatgatgatcttgagtcacttgaaagggatgttagtgaggaatctggatggaagcttgttcatggagatgtatttcgacctccacgcaacctaatgtttctgtctgctgttgttggaattggcactcagatggcagctcttatcctgcttgttattgtacttgccattgttggtatgctttatgttggacgaggagctattatcacaacctttatcgtgtgctacgcgcttacatctttcatttctggatatgttagtggtggcctctactcaaggaatggcggcaaaaactggataaagtctatggtccttaccgcttctctttttccgttcttgtgcttttcaattggattagtgttgaacaccattgctatcttctaccattcattagcggctataccatttggcacaatggttgtcatatttgtcctctgggcttttatctctttcccactggtgctattgggaacagtagttggtagaaactggagtggtgctcccaataacccatgccgtgtgaagacaatcccacgtcctattcctgagaagaagtggtacctaacaccttctgttatctcattgatgggtgggcttcttcccttcggcagcattttcatcgagatgtactttgtgttcacttcattctggaattacaaggtgtactatgtttatggcttcatgttgctagtctttgtcatcctcctaatcgtaacagtatgtgtcactattgtgggcacttatttcttgttgaatgctgagaattatcattggcaatggacgtcgttcttctcggctgcatcaaccgccttgtatgtatatctatatgctatatactattatcacgtgaagacaaagatgtcaggctttttccagactagcttctactttggctacacgttgatgttctgtctggggctaggcatactttgtggtgctattggctatctggggtcaactctgtttgtcaggagaatctacagaaacatcaaatgcgactaaactgcttctccgattctgtaggctattagcacttagcagatcatgtgttgttgagtaatgcttctaagattctaattaactttgggaaactatacaggag

SEQ ID NO: 3929 - DNA, 2486 bp, Citrus sinensis
gagagtcaattgggtgtcgatttatactaaaataattaatttctctctttaaaggacgggccaaggctgataaggcacaaagtctcatttcaagttgaggggagtcagccagaggctgtttacagacaccttgatcttgaaatcaggaccgtccgatttcactcgctggtcgatcgcatcgtcatgtcctccgccgctcgatctctctcccttttcctcctcctgctcttcgtctccccttctctagcctccgagtcagatcacaagtatcaacaagatgaacctgttaccctatgggtaaataaggttggcccgtataacaatccacaagaaacttataactattacagtcttccattttgccatgcatctggcaatcctgcgcacaaatggggcggtcttggtgaggtcctgggtggaaatgaacttattgacagtcaaatagacataaagttccaaaggaatgttgacaaagcctccatctgttcattggatcttgatgaggcaaaggtcaaacaattcaaagatgcaattgagaacaattattggtttgaattcttcttggatgatctgcctttatggggctttgttggtgatctgcatcctgataagaacagtgataatgggaagcacgtcctctacacacacaagattataaattttaaatacaataaagatcagattattcatgttaatctcactcaagacggcccaaagcctctggaagttgggaggacactggacatgacatactcagtcaaatggactccaactaatgtcacttttgccgtcgttttgatgtatatttggactaccctttctttgagcaccagatccattggttctccattttcaattctttcatgatggttatcttcctcactggtttggtatcaatgatattgatgcggactcttagaaatgattatgccaagtatgcacgggaagatgatgatctagagactttggaaagagatgtgagtgaggaatctggttggaaacttgttcatggggatgttttccggcctcctcgtaatttggttgtcctttcagctgttgtaggcactggtgcacagcttgcattgctcgttctactcgttattctgatggcaattgtgggaactttgtatattgggagaggagccattgtgactactttcatagtatgttatgctcttacatctttcatttctggttatgtgagtggtgggatgtactcacgcaatgggggcaaaaactggataaagtctatgatcctcacagcatccctttttccatttatggtctttgggattgggttcttattgaacacaattgctatattctacggatctctagccgctattccctttggcacaatggtggttgtctttgtaatttgggctttcatttctttccctctggcacttcttggcacagttgttggaagaaattggagtggtgctccaaataacccatgccgagtgaagaccattcctcgcccaattcctgagaagaaatggtatctcacaccctctgtggtctcaatgatgggagggctgctaccttttggcagtatattcattgagatgtattttgtcttcacatccttttggaattacaaggtctactatgtgtatgggttcatgctgttggtttttgtgattctcatcattgtgactgtttgtgtcacaattgtgggaacatatttcctgctaaatgctgagaattatcactggcaatggacatcattcttctctgctgcctcaacggctgtctatgtgtatttgtactcaatatattactactatgtgaagactaagatgtcaggcttcttccagaccagcttctattttggctacactttgatgttttgtcttggtttaggaatcctctgtggagctgttggttatctcggctctaatttgtttgtgaggaggatttatagaaacatcaagtgtgactagaacgttaccaaggaaaaaccgacctgagtgtgcttacctgagaatttttggctgaggcaataaaatttagagaggaagccttgggtcagtatatgggggaccttccagtatctgcagatgaaaatcacagggatagaggatattatgaggagccctgaaatttttctaatattttccccggctgggagtgaaagcctaagccttaaggtagaagtcagagattgtttttataatatgggaagcttacataatattaggaacagcaatctttttatttttatttttatctttatttttatttttttcccattttcttctttcccttcacatatagttgccccgtgtaaggaccggtgtctaatttccccttgaatttgtcttgtttgcatatttctggagaatgaacttatgaggggaagggactcgaagaaatgaattttgtgttaaaaaaattatgtggatactgattgtttccatgattccatctataatttgcgtatgtgctcaatttttgtcccaatccactgagtatttgtggcg

SEQ ID NO: 3930 - DNA, 2314 bp, Aquilegia formosa
caattctcaaatcttgggaaacgagtgagagaagtcagggtgtctttctcgtctttctcttgttagctaaagaaagtaacgaagtcaagaaaagcttaagcaaacgagagagaaagaaagaaagagagagaggagagagagagatccgttcgtggcgcgatgctttccaccgttagattattctctatctctgtgttggttgttcttctcttcatcgttgtacctcaaaccttcgctgtcgattcagatcacaagtatcaacaagaagaagcagttaccctttgggtaaacaaggttggcccttataataatcctcaagaaacgtacaactactatagccttccattctgccagccgccaggcaatgctgcacacaagtggggtggacttggcgaggttcttggtggaaatgaacttattgatagccagattgaaataaagtttgggaaaaatgttgataagagttccatttgtgagcttgaattggatgctgcgaaggttaaacagttcaaggatgcaattgagaatacatattggtttgaatttttcattgacgatcttcctttatggggctttgtcggcgaacttcatcccgataaaaacaatgataacaagcatgtgctttacacacacaagactattaatgttaaataccatggagatcagatcattcatgttaatctcacccaagaaagccctaagcccttggaagtgggaaaaactttagagatgacttattcagtgagatgggtccctacaaacatcacatttgaaagacgttttgatgtgtatttggattatcctttcttcgagcaccagattcattggttttccattttcaattctttcatgatggtcattttcctcactgggttggtgtccatgatacttatgcgaactcttagaaatgactatgcaaagtatgcacgggaagatgatgacttggagaccttggagagggatgtgagtgaagagtctggctggaaacttgtccatggcgatgtatttcgacctccacgcaatttggttatactttcagctgttgttggaacaggtgctcagcttgcaatgctaattctacttgtcatcctattggcaatcattgggatgttgtacgtcgggcgaggagcgattgtcaccacttttattgtatgttatgctcttacatccttcatttccggctatgtgagtgggggtttgtactctcgcagtggcggtaaaaaatggataaagtcaatgatcctcacagcatcactgtttccgtttttgtgctttgggatcggttttgttctaaacacaattgctatattctatggatctctagcagctattccatttggcaccatggtggttgtgtttgtcatttgggctttcatctcttttcctttagcccttcttggtacagtggttggaagaaattggagtggtgctccaaacaatccttgccgtgtgaagaccattcctcgcccaatccctgagaagaaatggtatctaacaccctctgttgtttcactcatgggaggtctgcttccatttggtagcatttttattgagatgtacttcgttttcacctctttttggaattacaaggtgtactatgtatatggctttatgttgctggtcttcattatactcattattgttaccgtctgtgtcacaatagttgggacatatttcttgcttaatgccgagaattatcactggcaatggacttctttcttttctgctgcttcaactgctgtctatgtttatctctactcaatttattattactacatgaaaaccaagatgacagggttcttccagaccagtttctactttggatacactctgatgttttgtctcggtttaggaatcctctgcggagccgtcggttatctgggatctacgttatttgtgaggaggatttacagaaatattaagtgtgactaagccagggactgggccagtacaatatgggagtgatcatcagtcttgttttcatgacaaattgttttgaggatcgatgtttacgagggatatcagtggagttcaaggatgaggatgttctttttgctgtcctgtcaggatattgggaaggctttaaatttttccctggctataagtgaaagccttgtttacttaatttagagtagcagagattgtgttataagccagaaaacatcatattaactcatgttcatttagcctttttgattttctttttcttttatttttcacattggacacaaagggcaatccatttctcaccggttctcagccaatagagtctgtgtaatcacttttctacaatttatttcagtttattttcttg

SEQ ID NO: 3931 - DNA, 2277 bp, Aquilegia formosa
gaaacgagtgagagaagtcagggtgtctttctcgtctttctcttgttagctaaagaaagtaacgaagtcaagaaaagcttaagcaaacgagagagaaagaaagaaagaaagagagaggagagagagagatccgttcgtggcgcgatgctttccaccgttagattattctctatctctgtgttggttgttcttctcttcatcgttgtacctcaaaccttcgctgtcgattcagatcacaagtatcaacaagaagaagcagttaccctttgggtaaacaaggttggcccttataataatcctcaagaaacgtacaactactatagccttccattctgccagccgccaggcaatgctgcacacaagtggggtggacttggcgaggttcttggtggaaatgaacttattgatagccagattgaaataaagtttgggaaaaatgttgataagagttccatttgtgagcttgaattggatgctgcgaaggttaaacagttcaaggatgcaattgagaatacatattggtttgaatttttcattgacgatcttcctttatggggctttgtcggcgaacttcatcctgataaaaacaatgataacaagcatgtgctttacacacacaagactattaatgttaaataccatggagatcagatcattcatgttaatctcacccaagaaagccctaagcccttggaagtgggaaaaactttagagatgacttattcagtgagatgggtccctacaaacatcacgtttgaaagacgttttgatgtgtatttggattatcctttcttcgagcaccagattcattggttttccattttcaattctttcatgatggtcattttcctcactgggttggtgtccatgatacttatgcgaactcttagaaatgactatgcaaagtatgcacgggaagatgatgacttggagaccttggagagggatgtgagtgaagagtctggctggaaacttgtccatggcgatgtatttcgacctccacgcaatttggttatactttcagctgttgttggaacaggtgctcagcttgcaatgctaattctacttgtcatcctattggcaatcattgggatgttgtacgtcgggcgaggagcgattgtcaccacttttattgtatgttatgctcttacatccttcatttccggctatgtgagtgggggtttgtactctcgcagtggcggtaaaaaatggataaagtcaatgatcctcacagcatcactgtttccgtttttgtgctttgggatcggttttgttctaaacacaattgctatattctatggatctctagcagctattccatttggcaccatggtggttgtgtttgtcatttgggctttcatctcttttcctttagcccttcttggtacagtggttggaagaaattggagtggtgctccaaacaatccttgccgtgtgaagaccattcctcgcccaatccctgagaagaaatggtatctaacaccctctgttgtttcactcatgggaggtctgcttccatttggtagcatttttattgagatgtacttcgttttcacctctttttggaattacaaggtgtactatgtatatggctttatgttgctggtcttcattatactcattattgttaccgtctgtgtcacaatagttgggacatatttcttgcttaatgccgagaattatcactggcaatggacttctttcttttctgctgcttcaactgctgtctatgtttatctctactcaatttattattactacatgaaaaccaagatgacagggttcttccagaccagtttctactttggatacactctgatgttttgtctcggtttaggaatcctctgcggagccgtcggttatctgggatctacgttatttgtgaggaggatttacagaaatattaagtgtgactaagccagggactgggccagtacaatatgggagtgatcatcagtcttgttttcatgacaaattgttttgaggatcgatgtttacgagggatatcagtggagttcaaggatgaggatgttctttttgctgtcctgtcaggatattgggaaggctttaaatttttccctggctataagtgaaagccttgtttacttaatttagagtagcagagattgtgttataagccagaaaacatcatattaactcatgttcatttagcctttttgattttctttttcttttatttttcacattggacacaaagggcaatccatttctcaccggttctcagccaatagagtctgtgtaatcacttttctacaa

SEQ ID NO: 3932 - DNA, 2392 bp, Citrus clementina
gagagtcaattgggtgtcgatttatactaaaataattaatttctctctttaaaggacgggccaaggctgataaggcacaaagtctcatttcaagttgaggggagtcagccagaggctgtttacagacaccttgatcttgaaatcaggaccgtccgatttcactcgctggtcgatcgcatcgtcatgtcctccgccgctcgatctctcacccttttcctcctcctgctcttcgtctccccttctctagcctccgagtcagatcacaagtatcaacaagatgaacctgttaccctatgggtaaataaggttggcccgtataacaatccacaagaaacttataactattacagtcttccattttgccatgcatctggcaatcctgcgcacaaatggggcggtcttggtgaggtcctgggtggaaatgaacttattgacagtcaaatagacataaagttccaaaggaatgttgacaaagccaccatctgttcattggatcttgatgaggcaaaggtcaaacaattcaaagatgcaattgagaacaattattggtttgaattcttcttggatgatctgcctttatggggctttgttggtgatctgcatcctgataagaacagtgataatgggaagcacgtcctctacacacacaagattataagttttaaatacaataaagatcagattattcatgttaatctcactcaagacggcccaaagcctctggaagttgggaggacactggacatgacatactcagtcaaatggactccaactaatgtcacttttgcgcgtcgttttgatgtatatttggactaccctttctttgagcaccagatccattggttctccattttcaattctttcatgatggttatcttcctcactggtttggtatcaatgatattgatgcggactcttagaaatgattatgccaagtatgcacgggaagatgatgatctagagactttggaaagagatgtgagtgaggaatctggttggaaacttgttcatggggatgttttccggcctcctcataatttggttgtcctttcagctgttgtaggcactggtgcacagcttgcattgctcgttctactcgttattctgatggcaattgtgggaactttgtatattgggagaggagccattgtgactactttcatagtatgttatgctcttacatctttcatttctggttatgtgagtggtgggatgtactcacgcaatgggggcaaaaactggataaagtctatgatcctcacagcatccctttttccatttatggtctttgggattgggttcttattgaacacaattgctatattctacggatctctagctgctattccctttggcacaatggtggttgtctttgtaatttgggctttcatttctttccctctggcacttcttggcacagttgttggaagaaattggagtggtgctccaaataacccatgccgagtgaagaccattcctcgcccaattcctgagaagaaatggtatctcacaccctctgtggtctcaatgatgggagggctgctaccttttggcagtatattcattgagatgtattttgtcttcacatccttttggaattacaaggtctactatgtgtatgggttcatgctgttggtttttgtgattctcatcattgtgactgtttgtgtcacaattgtgggaacatatttcctgctaaatgctgagaattatcactggcaatggacatcattcttctctgctgcctcaacggctgtctatgtgtatttgtactcaatatattactactatgtgaagactaagatgtcaggcttcttccagactagcttctattttggctacactttgatgttttgtcttggtttaggaatcctctgtggagctgttggttatctcggctctaatttgtttgtgaggaggatttatagaaacatcaagtgtgactagaacgttaccaaggaaaaactgacctgagtgtgcttacctgagaatttttggctgaggcaataaaatttagagaggaagccttgggtcagtatatgggggaccttccagtatctgcagatgaaaatcacagggatagaggatattatgaggagccctgaaatttttctaatattttccccggctgggagtgaaagcctaagccttaagttagaagtcagagattgtttttataatatgggaagcttacaaaatattaggaacagcaatctttttatttttatttttatctttatttttatttttttccctttttcttctttcccttcacatatagttgccccgtgtaaggaccggtgtctaatttccccttgaatttgtcttgtttgcatatttctggagaatgaacttatgaggggaagggactcgaagaaatgaattttgtgtt

SEQ ID NO: 3933 - DNA, 2389 bp, Eucalyptus grandis
cgaacccactttcaagacccgactcccggcccccgctccatttaacactttaccccctcccgcagaagaagctcgggtacagacgaaggagagattacgagaaggacgacctccctcggtccgactctgacctcgattcagatccgactcccgccggcgaccgccatggttcccgccctccgatccctccctctcctcctcctcctcctctcctccgccgctctcgcctccgagtcagatcacaagtatcagccagacgaggcggtcaccctttgggttaataaagttggtccatacaacaacccccaggaaacatacaattattacagcctcccattttgccgtgctcctggcaatcctgcacataagtggggtggtcttggtgaggtccttggaggaaatgagctcatcgatagccagattgagataaagtttcaaaagaaagtggagaagggtgtcatttgtcaacttgagcttgatgaagcgaaagtcaaacaattcaaggatgctattgagaatagttactggtttgaattcttcattgatgatctgcctttatggggttttgttggtgaactgcacgctgataagaacagtgataccaaacacgtgctatacactcacaaaagcatcagcatcaaatacaacaaaaatcagattattcatgctggtctgacgccagagaatccaaaaccgttggaagttggaaagacgtacgatatgacttactctgtcaaatgggaagaaactactgtttcttttgcacgtcgttttgatatttatttggattacccattctttgagcatcagatccattggttttctatcttcaattcattcatgatggtgatattcctaactggcttggtgtcaatgattttgatgcggactcttagaaacgactatgcgaaatatgcaagggaagatgatgatctggagactctggaaagggacgtgagtgaagagtctggctggaaacttgtccatggcgatgtttttcggcctccacgtaatttagtactgctgtcagctttggttggcactggtggtcagctttctctacttgtgctccttgtcatattgttggcaattgttggaatgttatatgttgggagaggagcaattgttacgacttttatcctatgttatgccttcacctcatttatttctggctatgttagtggtggaatgtactcacgtcatggcggtaaaagttggatcaagtcgatgatcctcacggcatctttattcccatttatgtgctttggaattggcttcatcctcaataccattgctatattttatgggtctttggcagcaattccttttggtaccatggtagtggtttttgtgatctgggcattcatctcattccccctggctctccttggaacagttgtaggcagaaactggagtggggctcccaacaacccatgtcgtgtgaagactattcctcgtcccattcccgagaagaaatggtacttgacaccctctgtggtgtcgttgatgggaggattgttaccctttggcagcatatttattgagatgtactttgtcttcacttctttctggaattacaaggtgtactatgtttatggatttatgctgcttgttttcctaattctcatcattgttactgtttgtgtaacaatcgtgggaacatacttcctcttaaatgcggagaattatcattggcagtggacctcgtttttctctgctgcctcaacagctgtctatgtatacttgtactcaatctattactaccatgtgaagactaagatgtcagggttcttccagaccagtttctattttggatacaccttgatgttctgtcttggactgggaatactttgtggtgctgttggttatctgggctcaaatttgtttgtaaggaggatctacagaaacatcaaatgtgattagagcttcatcatgggaagtgggcgaaggtttttcccagtaccttttggttatggagatgacaataaaaattgagaggaagccagcctatctccttgcgaactatttagaatgtcaccagatggttatctcggaattcaaggatggggatgtacactttcttctgctgagcctggggagtcctaagaatttttttttcctttatattctagctgtaagatgaatagggtgcagggattgttctctctatcggaaactttttacaaataggtgccccagtggatatttaatttcttgagtctgctaacgttgtaatgctatttttgctgtctggaatatggacttcggcaggaaaggagttgatgaaaatgaattttgtggtcctgataaaacatgtgcttccgctattgtttacatggaatatgccagttttggccttggaatgcgtaatcgccctccagctggtgag

SEQ ID NO: 3934 - DNA, 2386 bp, Sorghum bicolor
cacgattctctcgacgaatccagctgcacccggcgaagaaaacgccctgccccggacccggaggagaggcgccagctgctgggctcgtgactcgtgagtctcgccgtctcgggccaacccggacgccgaaccccaaggctcgcgaccgcgacactcgtgtgcccctcctcctcctcctcagatctcgccgccggcggcatgctcccctcctccggcggcggccggtgccgcggccgccacctcctgctcggcttcggcctcgccgtcgctgccctgctcgcgctcgcctccgcctccgagtccgaccacaagtacaaaactgaagagccagttaagctttgggtgaataaagttggtccttacaataatcctcaagaaacttacaactattacagccttccattttgccaaccatctgagaaccctacacacaaatggggtggtcttggagaggtcctgggtggaaatgagctgattgatagtcagcttgaaattaagttcttaaaaaacgtggagaagggctccatttgtacacttgagctagatgctaaaaaggtccagcagtttgctgatgccattgaaagctcatattggttcgaattttttatagatgatctgcctctttggggttttgttggggagactgacaagaacagtgaaaacaaacattatctttacacacacaagaacatccttgtcaaatacaatgataacaggataattcatgtaaatctcacccaagagtctcctaagcttcttgaagatggtaagaaattggaaatgacatattcagtgaaatgggtagcaacagatgtgtcatttgcacgccgttttgaagtgtacctggactatcctttctttgaacaccagattcactggttctccattttcaactctttcatgatggttattttcctaactggtttggtttcgatgatattgatgcggactttgagaaatgattatgccaaatatgctcgtgaagatgatgatctagagtccctggagagagatgttaatgaggaatcaggatggaagcttgtccatggtgatgtatttcggcctccccgaagtttgatgtttctttctgcacttgttggtatcggcacccaattggcagctcttatcctacttgtgattgttttggccatcgttggaatgctatacattgggcgaggggctatcatcacaacctttattgtgtgctatgctcttacatcgtttatttctggatatgttagtggtggtctttactcaaggaatggtggcaaaaactggattaaagcgatggttcttacagcatccctctttccgttcttatgtttttcaattggctttgcactgaatacaattgctatcttctaccgctcattagcagcaattccatttggcacaatggttgtcatgtttgtactttgggctttcatctcctttcccttggtgcttttgggaactgttgttggtaggaactggagtggtgctcctaacaacccctgccgagtaaagacaattccacggcctatccctgagaagaagtggtaccttacaccttctgtcatctcattgatgggtggcctgcttccatttggtagcatctttattgagatgtacttcgtgttcacatcattctggaactataaggtgtattatgtctatggtttcatgttgctggtcttcgtcatccttctaatagtcaccatctgcgtcactattgtgggtacttatttcttgctgaacgcggagaactatcactggcaatggacgtcattttcctctgcagcatcaaccgctttgtatgtgtatctgtactccatctactactaccatgtgaaaacaaagatgtcaggcttcttccagacaagtttctactttggctacacattgatgttctgtcttggtctaggcatactttgtggtgctattgggtatctagggtcaaccctttttgtaaggagaatctacagaaatatcaaatgtgattaaatccctgctacttgctagcagcagaaagatcatatgtattgtcagtggaagcaaggcctcaaaaaatggattttaatggtagaccctgaataggtttttgaaactgccgaggacttgctccatttgttcgctgttatacgcatttttgtttgcctgcttattcctgtgaaatcgtccacataatgtatacctgtggtagttgaggattagtctgaagcacctgttttcatcattttcttttccttttgtttttatgacttcattcggtaggatgtaatcagtgaatgttcatgcggcgcgagcccaattaggacttaaaatcattctcgctatgaggatcgatgaggttgaacttatttgtcacctcaatcgtccaatacaacaatccgtacagcccgtctta

SEQ ID NO: 3935 - DNA, 2052 bp, Saccharum officinarum
cccaaggctcgcgcgaccgcgacactcgtgtgtcctcctgctcctccccagatctcgccgccggcggcatgctcccctcctccggcggcggccggggccgcggcggccacctcctgctaggcctcgccctcgccctcgctgccctgctcgcgctcgcctccgcctccgagtccgaccacaagtacaaaactgaagagccagttaagctttgggtgaataaagttggcccttacaataatcctcaagaaacttacaactattacagccttccattttgccaaccgtctgagaaccctacacacaaatggggtggtcttggagaggtcctgggtggaaatgagctgattgatagtcagcttgaaattaagttcttaaaaaacgtggagaagggcttcatttgtacacttgagctagatgctaaaaaggtccagcagtttgctgatgccattgaaagctcatattggttcgaattttttatagatgatctgcctctttggggttttgttggggagactgacaagaacagtgaaaacaagcattatctttacacacacaagaacatccttgtcaaatacaatgataacaggataattcatgtaaatctcacccaagagtctcctaagcttcttgaagatggtaagaaattggaaatgacatattcagtgaaatgggtagcaacagatgtatcatttgcacgccgttttgaagtgtacctggactatcctttctttgaacaccagattcactggttctccattttcaactctttcatgatggttattttcctaactggtttggtttcgatgatattgatgcggactttgagaaatgattatgccaaatatgctcgtgaagatgatgatctagagtccctggagagagatgttaatgaggaatcaggatggaagcttgtccatggtgatgtatttcggcctccccgaagtttgatgtttctttctgcacttgttggtatcggcacccaattggcagctcttatcctacttgtgattgttttggccatcgttggcatgctatacattgggcgaggggctatcatcacaaccttcattgtgtgctatgctcttacatcgtttatttctggatatgttagtggtggtctttactcaaggaatggtggcaaaaactggattaaagcgatggttcttacagcatccctctttccgttcttgtgtttttcaattggcttcgcactgaatacaattgctatcttctaccgctcattagcagcaataccatttggcacaatggttgtcatgtttgtactttgggctttcatctcctttcccttggtgcttttgggaactgtcgttggtaggaactggagtggtgctcctaacaacccctgccgtgtaaagactattccacggcctattcctgagaagaagtggtaccttacaccttctgtcatctcattgatgggtggcctgcttccctttggtagcatcttcattgagatgtacttcgtgttcacatcattctggaactataaggtgtattatgtctatggtttcatgttgttggtcttcgtcatccttctaatagtcaccatctgcgtcactattgtgggtacttatttcttgctgaatgctgagaactaccattggcaatggacgtcgttttcctctgcagcatcaaccgctttgtatgtgtatctgtactccatctactactaccatgtgaaaacgaagatgtcaggcttcttccagacaagtttctactttggctacacactgatgttctgtcttggtctaggcatactttgtggtgctattgggtatctagggtcaaccctttttgtaaggagaatctacagaaatatcaaatgtgattaaatccctgctacttactagcagcagaaatatcatatgtattgtcagtggaagcaaggcctcaaaaatggattttaatggtagaccctgaataggtttttgaaactgctgaggacttgctccctttgttcgctgttatacgcatttttgtttgcctgcttattcctgtgaaatcgtcctcataatatatacctgtggtagt

SEQ ID NO: 3936 - DNA, 2308 bp, Solanum lycopersicum
gtcgagaataaatcattatgatggacttcattttctttctggtgtatgtagtgcaatattttacttttctatttttgtcaagaaaaagaaagttgtgaagcagctctaccacaacaggggctactctcttactctggggaataaaaccaggccgaacgagtaatctgaaccgttgtatccgtatcttcgccgacgatacagatgctgccgaccgctccatcactctctcttgtcctgttcctggccgcctttattatctttccgcctgcgcttgcttccgagtccgatcacaagtatcaagcagatgatccggttaccctctgggtgaataaagttgggccatataataacccacaggaaacatacaactattacagccttccattctgtcatgcatctggtaatactcacaaatggggtggccttggtgaagttttaggtggaaatgagcttatcgatagtcagattgacctaaggtttcaaaaaaatgtggacaagggtagcatttgtgaacttgagcttgatgagatgaaggttaagcaattcaaggatgctattgaaaacaattactggtctgaattctttattgatgacctgcctttatggggttttgttggtgagctacataccgacagaatcagtgataacaagcatgtgctttacacacataagaatattaatattaaatacaacaaggaccagatcattcatgttaatctctctcaggagagcccaaagcctttggaagctggaagaacattggacatgacatattctgtcaaatgggaacctaccaatatcacttttgctcatcgttttgacgtatacttggactacccattttttgagcatcagatccattggttctccatatttaattccttcatgatggtcatcttccttactggtttggtgtctatgattttgatgaggacactgaggaatgattatgccaagtatgctcgggaagatgatgatctcgaaaccctggaaagagatgttagtgaagagtctggttggaaacttgttcatggggatgtgtttcgacctcctcattatctagcgctaatttcagctcttgttggtactggggcacaacttgcactgcttgttctcctagtcattctgtttgcaattgtggggacattatatattgggagaggagctattgtcacaactttcatagtatgctatgctttgacatcattcatttcaggctatgttagtggtgcaatgtactcacggaatggtgggaaaagctggatcaaatctatgattcttacagcgtcacttttaccctttttatgctttgggattggctttattctgaacacaattgcaatattttatgggtctctagcagccattccctttggtactatggtagttgtctttgtcatctgggccttcatttccttccccctggctcttcttggtactgtttttgggagaaactggagtggcgctccaaacaatccatgccgtgtcaagaccatacctcggcctattcccgaaaagaagtggtatctgacaccatctgtagtttccttgatgggaggattgctgccatttggaagcatatttattgagatgtattttgtcttcacctccttctggaattacaaggtatactatgtgtatggatttatgcttctggtgtttctgatcctcattattgttacggtctgcgtgactattgtgggaacatatttcctactaaatgctgaaaattatcattggcagtggacttcgttttcctcagctgcctctaccgctgtctatgtatacctgtactctgtatattattattatgtgaagactaagatgtcagggttctttcagaccagcttctactttggctatacactgatgttttgtcttggcttagggattctctgcggagctgttggatttttgggctctaacctatttgtgaggaggatttatagaaacatcaaatgtgactgattttctttggaaggatagagttcaatgtccttatttacgtggtcagtggctgtgaggtcaagaagagtatcaagtatcttcatggggttattcagtcaactgctggtaagcccctctgccaggaatcatcggagcctgaaagttttcctttgggctgtaagagatttttcttttcttttgtacttgtaattagaaagattagatagtttgaggcattcaaggctagcttttaagattgtcatttagcaattttggacgctccaaagtagtaatccttccattgttataaattattttgctgcaaaggaatgagacgcaggttagttttctcgttagtggg

SEQ ID NO: 3937 - DNA, 2466 bp, Triticum aestivum
ccgcagtgaaatcgcgaggcggcagctctctcgggccaacccgaccgaaggctcgcgaccgcctcctcttcatcctcagatctcgccggcggaatgctcccctcctcccgcggcggcggccgcagacgcttcgtcctcctcctctcgctcaccgccgtccttgccttcgcttctccgctccgcgcgtccgcctcagagtctgaccacaagtacaaagctggagattcagttaagctctgggtgaataaagttggaccttacaataatcctcaagaaacttacaattatcacagcctcccattttgtcaaccatctgagaaccctgggcataagtggggtggtcttggagaagtcctgggtgggaatgagttgattgatagtcagcttgacataaagttcttaagaaatgtggaaaggggatccatttgcacactggaactagatcccaagaagactcaacaatttgctgatgccattgaaagctcgtactggtttgaatttttcatagatgatctgcctctttggggttttgttggagagactgacaaaaacagtgaaaacaagcactatctttacacgcacaagaacattcttgtaaagtacaacgataacaggataattcatgttaatctcacccaagagtctcctaagctccttgacgctggtaagaagttggacatgacatattcagtgaagtgggtaccaacagatgtttcatttgcacgccgttttgaagtttacctggactatcctttctttgaacaccagattcactggttctccattttcaattctttcatgatggttatttttctcactggtttggtttcaatgatattgatgcgaacactgagaaatgattatgcaaaatatgctcgtgatgatgatgatctagagtcactggagagagatgttaatgaggaatctgggtggaaacttgtccatggtgatgtatttcgtcctcctagaagcttgacacttctttctgctcttgttggtatcggcacccagctggcagctcttatcctacttgtgattgtattggccatcgttggcatgttatatgttgggcgaggggctatcatcacaaccttcatcgtgtgctatgctcttacatcttttatttctggatatgttagtgctggtctgtactcgaggaatggcggtaaaaactggataaaggctatgatccttacagcatccctctttccattcttgcactttgcaattggctttgcactgaatacaattgcaatcttctatgggtcattagcggcaataccatttggtacaatggttgtcatgtttgtcctttgggctttcatatcttttccactggtgcttttgggaacggtcgttggtagaaactggagtggggctcctaacaatccctgccgagtaaagactattccacggcctattcccgagaggaagtggtaccttacaccttctgtcatctcattgatgggtgggctgcttccctttggcagcatcttcatcgagatgtactttgtgttcacatcattctggaactacaaggtgtattatgtttacggcttcatgttgctggtctttgtcattcttctaatagttacaatctgtgtcacaattgtcggtacttatttcttgctgaatgctgagaactatcattggcaatggacctcgtttttctccgctgcatcaacagcgctatatgtgtacctgtactccatctactactatcatgtgaagacaaagatgtccggctttttccagacaagtttctactttggctacacattgatgttttgtcttggtctgggaatactttgcggtgctattggctacctaggatcaactcttttcgtgaggagaatctacagaaacatcaaatgtgattaatttcctgctacacatgtggggtgggggtggagcagtatcagatcaaatcatatacgtggaagcgaggccttcggaattgattaatgctagttcctgattagggtttcagaactacgtcacgtttgcttattccatcacaccccttctttttgcatacttatttgttccctggagctgctctcatagtgtatacatctgtggtagctgagttcagtacaagtggatggtgcaggttcttatttttctttgtttcttgccttttttttgttgcattcctccttttcaaatgagaaagaaataggaagtgagtatccacgcggcaatgtctggacttcccctctgaatcgttacgtccaattcaaggatggcatgtactacgtgagatctgtgtatttatatacatatatcaacatttaatgcatgagagtatatgtgtgtcctcttatcatgttcgagaaaacggtgaaaatccttccgttgtagtgctttttacctgcggtatttaatacgtatgtgtaacttttgaggtaacttgtgtgacatttgattttccgccttgtgggattgtggtgccacggttgctgt

SEQ ID NO: 3938 - DNA, 2496 bp, Setaria italica
tgggctcgtgagtcttgccgtctcgcgggccaacccgaaccccaaggctcgcgaccgcgacactcccccgtctcctcctcccgctcgctcctcctcagatctcgccgccggcggacatgctcccctcctcccgcgccgcccgtggccgcggcctcggcctcggatgcctcctgctcggcctcgccctcactctcgcgtccctgctcgccctcgccgccgcctccgaggccgaccacaagtacaaagctgaagagccagttaagctctgggtgaataaagttggcccttacaacaaccctcaagaaacttacaactattacagccttccattttgtcaactatctgagaaccctatacataaatggggtggccttggagaggtcctgggtggaaatgagctgattgatagtcagcttgacataaagttcttaagaaatgaggagaagggcttcatttgtacacttgagctagattctaaaaaggttcagcagtttgctgatgctattgagaactcatattggtttgaattattcatagacgatctgcctctttggggttttgttggggagactgacaagaacagtgaaaacaagcattatctttacacccacaagaacatccttgttaaatacaatgagaacaggataattcatgtaaatctcacccaagagtctcctaagcttcttgaagctggtaagaagctggatatgacatattcagtgaagtgggtcgcaacagatgtgtcatttgcacgtcgttttgaagtgtacctggactatcctttctttgaacaccagattcactggttctccattttcaactcctttatgatggttattttcctaactggtttggtttcaatgatattgatgcggactttgagaaatgattatgctaaatatgctcgtgaagacgatgatctggagtccctggagagagatgttaatgatgaatcaggatggaagcttgtccatggtgatgtatttcggcctccccgaagtttgatgtttctttctgcacttgttggtattggcacccagctggcagctcttatcctacttgtgattgtgttggccatcgttggcatgttatacatcgggcgaggggctatcatcacaaccttcattgtgtgctatgctcttacatcgttcatttctggatatgttagcggtggtctttactcaaggaatggtggcaaaaactggattaaagctatggtccttacagcatccctctttccgttcctgtgtttttcaattggcttcgcactgaatacaattgctatcttctaccgctcattagcagcaataccattcggcacaatggttgtcatgtttgtactttgggctttcatctcctttcccttggtgcttttgggaactgtcgttggtaggaactggagtggtgctcctaacaacccctgccgagtaaagactattccacggcctattcctgagaagaagtggtaccttacaccttctgtcatctcgttgatgggtggactgcttccctttggcagcatcttcattgagatgtactttgtcttcacgtcattctggaactacaaggtgtattatgtctatggtttcatgttgctggtcttcgtcatccttctaatagtcaccatctgtgtcactattgtgggtacttatttcttgctgaatgccgagaactatcattggcaatggacttcgtttttctctgcagcatcaactgctctctacgtgtatctatactccatctactactaccatgtgaagacaaagatgtcaggcttcttccagacaagtttctactttggctacacattgatgttctgccttggtctaggcatactttgtggtgctattgggtatgtagggtcaactctctttgtaaggagaatctacagaaatatcaaatgtgattaaattcctgctactcactatcatacggaagcaaggcctcgaaaatggatcatatgtattgccagtgcggaagcaaggcctcgaaaatggattaatggtagatcctgaataggtttttgaaactacagaggacatgctccctttgttcactatcatacgcattttttgcttgcctgcttattcctgtggaatcgtcgtcataatgtatacctatgtagttgaggattagcctgaagcacctgtttttatccttttctttttctttttttttgtatttttattcggtaggatgtaatcagtgaatcttcatgcggcgcaagcacaattatcgggaattctccatcctatgcatcgtgcatcttcaagtttgaacgagtgaccacgggcagcaacttagattatcaacaaattgcaagtatacatgtataactgtctctgtctggccgcactttggagggacccgaggcctattacatgtatactcggtttgtagtcgtagttctggacatcacttgtgtcacccaacgcataaataactctggaatatgtagcaatatttccttttttttgttgagtgattatttgggta

SEQ ID NO: 3939 - DNA, 2507 bp, Oryza sativa
cgacggccgtccaagcccacccgagatccatcccgatccacccgactcctccccccacggctcgaccaaaccaaaagaaaatcaaccgcggcttggctcgtgatcagctcgtgagtcgacccgaccctcctcagatctcgccggcggcagcggcggcatgctgctccccacctccgcctccgcctgccgcggcagcggccgcgcgctcctcctcgccctcgccgccgccctcctcgccctcgccacgccgcgccccgcctccgcctccgagtcagaccacaagtacaaagttgaagaaccagttaagctctgggtgaacaaagtcggcccttacaataatccacaagaaacttacaactatcacagccttccattttgtcaaccatctgagaaccctgcgcataaatggggtggtcttggagaggtcctgggtggaaatgagctgattgatagtcagattgacataaagttcttaagaaatgaggagaggggctccatttgtacacttgagcttgattctaaaaaggttcagcagttctccgatgccattgataactcatactggttcgagtttttcatggatgatctgcctctttggggttttgttggggagacggacaaaaacaatgaaaacaagcgttatctctacacacacaagagcattcttgtcaaatacaatgataacaggatcattcatgttaatctcacccaagagtctcctaagcttcttgaagctggtaagaaattggacatgacatattcagtgaagtggttacaaacagatgtgacctttgcacgccgctttgaagtatacctggattatcctttctttgagcaccagattcattggttctccattttcaattctttcatgatggttattttcctcactggtttggtttcaatgatattgatgcggacattgagaaatgactatgcaaagtatgctcgtgaagatgatgatctggagtcactggagagagatgttaatgaggaatctggatggaagcttgttcatggtgatgtatttcgccctcctcgaagtttggcctttctttctgcagttgttggcatcggcactcagctggcagctcttatccttcttgttattgtattggccattgttggcatgctatatgttgggcgagggtctatcatcacaaccttcattgtgtgctatgctcttacatcttttatttctggctatgtcagtggtggcctctactcaaggaatggtggtaaaaactggataaaggctatgatccttacagcatccctatttccattcttgtgctttgcaattggctttgttctgaatacaattgctatcttctaccgatcattagcggcaataccattcggcacaatggttgtcatgttcgttctttgggccttcatttcttttccgctggtgcttctgggaactgttgttggtaggaactggagtggtgctcctaacaatccctgccgagtaaagactattccacggcctattccagagaagaagtggtaccttacaccttctgttatctcattgatgggtgggctgcttccctttggcagtatcttcattgagatgtactttgtgttcacgtcattctggaactacaaggtttattatgtctacggcttcatgctgctggtctttgtcatccttctaatagttacaatctgtgtcactattgtgggtacttatttcttgctgaatgctgagaactatcactggcaatggacttcatttctctctgctgcatcaactgcgttatatgtgtatctatattccatctactactatcatgtaaagacaaagatgtcaggttttttccagacgagtttctacttcggttacacattgatgttctgccttggtctaggcatactttgtggtgctattggctatctagggtcaactctttttgtgaggagaatctacagaaacatcaaatgtgattagatgatcgcagtttggaagacatagcagatcacatgttgtcactggaactgtggtagagaggccaagaagtggattaatgctagatgctgattaagttttttgagccacagaccgaaggggggccatgatctcctaacttaatataaatacattcatacgcctactctcttttttgactatgtcgccctgattatgcatacctgtggtagttgaggatttggttggttttttaatcagaagtaggatgtaacattgtaacatgtgaaatattcatgcggcactagatttcttctcttcgtatggattggaccgggggcttgtggattccaattcaaggctgtcattttaccacgagcacactgtggttatatgtattgcaacattgttatagccattaagctttatacatgggtttatctacatttaatctttggacacatgtttcgaggtacaaatttagtatatttctctttaatttatactgttattatgtgcaaacagttgatttaactaacctgaatattcgaatttacgcatgtccttcgtatggcag

SEQ ID NO: 3940 - DNA, 2447 bp, Malus domestica
ccgaactcgcaaactcgcaatctctctctctctctctctctctcgtgaagacttttgagagttgttgagtcgagtccgagtggcatcagccttcacctcctctgcctctgggagagatcagaatcatcacagcacaaagattacaccacctcctcgctgaccgtccagatcccaccctcgccggcgatcgccatgttctcctccgtccgatctctctccctctccctcctcttcgtcttcttcctccttgcccccgctttcgccgccgaggcagatcacaagtatcaaacagaagaatcagttaccctttgggtgaataaagttgggccctacaataatcctcaagaaacatacaattactacagtcttcctttctgtcatcaatctgaaaatgctgctcacaaatggggtggccttggtgaagtcctgggtggaaatgagttgattgatagccagattgaaataaaatttcaaaaaaatgtggacagggccaccatttgccaacttgaacttgacgatcaaaaggttaaacaattcaaggacgcaatcgagaataactactggtttgaatttttcatggatgatctccctttatggggctttgttggtgagttgcagcaggacaagaacagtggaaatggcaagcatgtcctttacactcataaaaatatcattgttaaatacaataatgatcagatcattcatgtgaatctcactcaagatagtccaaagccgttggaagtagggaagaaattggatctaacatactctgtcaaatggattgcaaccactgtcacctttgcacgtcgatttgatgtctatttggactaccccttctttgagcaccaaatacattggttctcgattttcaattcattcatgatggttatattccttactggtttggtctcaatgatattgatgcggactcttaggaacgactatgcaaagtatgctcgggaagacgacgatctggagactctggaaagagatgtcagtgaagagtctggctggaaacttgtgcatggggatgtttttcggccttctcggaatttggttattctatcagctcttgttggcacaggcgctcagctagcattgcttgttctcctcgtcatcttactggcaattgttgggatgttgtatgttgggagaggtgcaattgtaacaactttcatagtgtgttatgcccttacatctttcatttctggttatgtaagtggtgggatgtattcacggcatgggggtaaaaactggataaagtcaatgatactcacagcatccctatttccatttatgtgctttgggattgggtttgtcttgaacacaattgctattttctacgggtcactagcagctattccttttggcacaatggtggttgtttttgtcatttgggcattcatctcttttcctctagcacttcttggtacagttgttggaagaaactggagtggtgctcctaacaatccttgccgtgtgaaaaccattcctcgtcctattcctgagaagaaatggtatttaaccccatctgtagtctcaatgatgggaggacttctgccctttggaagcatatttattgaaatgtattttgtcttcacatccttctggaattacaaggtgtactatgtctatggctttatgctgcttgtttttctgattctcatcattgttaccgtatgcgtgacaattgtggggacgtacttcttgcttaatgctgagaactaccactggcaatggacttctttcttttctgctgcatcaacagctgtctacgtgtacttgtattcaatatattactactatgcaaagactaagatgtcgggtttcttccagaccagcttctattttgggtacactttgatgttctgccttggcttagggatcctctgcggagctgttggatatttgggttccaatttgtttgtgaggaggatctacagaaatatcaagtgcgactagagcatctccgcgaggaaatggacctgatggagctttcccgagtagattggccgttgttgaggtacgtggtcagggatggggatccggcaaccactagggaccgaaatcgcagggttgaggatagggaatgtattctttctctggacttgggaaagccctgagaggttttttgtttccccagctgtcagtgaaagcctaaattttagattgcagagattgttttataatctacagttagcggacgtcgaactcctgttgattttattatttttcgtccttttacaaataggtgcccgattactctctctctctgtatgtctttgggatggatggaaaggaagggaagggcttcccgaaacgaacctttgattccgagttatgtagcgacttttgtgaattttgattccatctgtaccttgcatatataagtatcattgtctgaaacctcactttgtgtctctacatctttgcatgatttgtttcga

SEQ ID NO: 3941 - DNA, 2275 bp, Zea mays
gatacgggattttaccttccaggcagctgctgggctcgtgacccacgccgtctcggaccaacccgagcgccgaaccccaaggctcgcgaccgcgacactcttgtgtcctcctgctctccagatctcgccgtcggcggcggcatgctcccctccaccgtcggcggccgcggccgctacctcatgctcggcatcgcccttgccctcgctgccctgctcgcgctcgcctccgcttccgagtccgaccacaagtacaaaactgaagagccagttaagctttgggtgaataaagttggcccttacaacaatcctcaagaaacttacaactactacagccttccattttgtcaaccgtctgagaaccctacacataaatggggtggtcttggagaggtcctgggtggaaatgagctgattgatagtcagcttgaaataaagttcttaaaaaacgtggagaagggcttcatttgtacacttgagctagatgctaaaaaggtccagcagtttgctgatgccattgaaagctcatattggtttgaattttttatagacgatctgcctctttggggttttgttggggagactgacaagaacagtgaaaacaagcattatctttacacgcacaagaacatccttgttaaatacaatgataacaggataattcatgtaaatctcacccaagagtctcctacgcttcttgaagatggtaagaaattggaaatgacatattcagtgaagtgggtagcgactgatgtgtcatttgcacgccgttttgaagtgtacctggactatcctttctttgaacaccagattcactggttctccattttcaactctttcatgatggttattttcctaactggtttggtttcgatgatattgatgcggactttgagaaacgattatgccaaatatgctcgtgaagatgatgatctagagtccctggagagagatgttaatgaggaatcaggatggaagcttgtccatggcgatgtatttcggcctccccaaagtttgatgtttctttctgcacttgttggtatcggtacccaattggcagctcttatcctacttgtgatcgttttggccatcgttggcatgctatacattgggcgaggggctatcatcacaaccttcattgtgtgctatgctcttacatcttttatttctggatatgttagtggtggtctttactcaaggaatggtggcaaaaactggattaaagcgatggttcttacagcgtccctgtttccgttcttgtgtttctcaattggcttcgcgctgaatacaattgctattttctaccgctcattagcagcaataccatttggaacaatggttgtcatgtttgtactttgggctttcatctcctttcccttggtgcttttgggaactgtcgttggtaggaactggagtggagctcctaacaatccctgccgagtaaagactattccacggcctattcctgagaagaagtggtaccttacaccttctgtcatctcattgatgggtggcctgcttcccttcggtagcatcttcattgagatgtactttgtgttcacatcattctggaactataaggtgtattatgtctatggcttcatgttgctggtctttgtcatccttcttatagtcaccatctgcgtcactattgtgggtacttatttcttgctgaacgccgagaactaccattggcaatggacgtcgttttcttctgcagcctcaaccgctctgtacgtgtatctgtactccatctactactaccatgtgaagacaaagatgtcaggcttcttccagacaagtttctatttcggctacacgctgatgttctgccttggcctaggcatactttgtggagctattggctatctagggtcaaccctttttgtaaggagaatctacaggaatatcaaatgtgattaaatccctgctgcttaagctagcaacagaaaaatcatatgtattgtcaggaggcatggcctaaaaaaatggattttaatggtagaccctgattttggaactgctgaggacttgctcccctttgttcgttgttatacgcatttttgtttgcctgcttattcctgcgagatcgtcctcgcaatgtatacctgtgatagtcgagcattagtctggagcacctgtgttcatcattctcttttttttttgtttctattactttattcggtaggatgtaatcagtgaatgttcgtgcggcgctctactaattaaggcaacaaggggtaggctccttcctctggtcttgttgttatgccttcct

SEQ ID NO: 3942 - DNA, 2369 bp, Zea mays
aggagccagctgctggctcgtgagtgtcggcgtgtcgggccacaacccgaacgctgaaccaaggctcgggaccgcgacactcgtgtgtccttctcctcagatctcgccggcggcggcatgctcccctcgtccggcagcggctggggccgcggccgcggccgccacctattgctcagcagggccctagctctcgctgcactgctcgcgctcgcctccgcctccgagtccgaccacaagtacaaaactgaagagccagttaagctttgggtgaataaagttggcccttacaataatcctcaagaaacctacaactattacagccttccattttgtcaaccgtctgagaaccccacacataaatggggtggtcttggagaggtccttggtggaaatgagctgattgatagtcagcttgaaataaagttcttaaaaaacgtggagaagggcttcatttgtacacttgagcttgatgctaaaaaggtccagcagtttgctgatgccattgaaagctcatattggttcgaattttttatagatgatctgcctctttggggttttgttggggagtctgacaagaacagtgaaaacaagcattacctttacacacacaagaacatccttgttaaatacaatgataacaggataattcatgtaaatctcacccaagagtctcctaagcttcttgaagatggcaagaaactggaaatgacatattcagtgaagtgggtagcaacagatgtgtcatttgcacgccgttttgaagtgtacctggactatcctttctttgaacaccagattcactggttctccattttcaactctttcatgatggttattttcctaactggtttggtttcgatgatattgatgcggactttgagaaatgattatgccaagtatgctcgtgaagatgatgatctagagtccctggagagagatgttaatgaggaatcaggatggaagcttgtccatggtgacgtatttcggcctccccgaagtttgatgtttctttctgcacttgttggtatcggcacccaattggcagctcttatcctacttgtgattgttttggccattgttggcatgctatacattgggcgaggggctatcatcacaaccttcattgtgtgctatgctcttacatcgtttatttctggatatgttagtggtggtctttactcaaggagcggtggcaaaaactggattaaagcgatggttcttacagcatccctctttccgttcttgtgtttttcaattggtttcgcactgaatacaattgctattttctaccgctcattagcagcaataccatttggcacaatggttgtcatgtttgtactttgggctttcatatcttttccgttggtgcttttgggaactgttgttggtagaaactggagtggtgctcctaacaacccctgccgagtaaagactattccacggcctattcctgagaagaagtggtaccttacaccttctgtcatctcattgatgggtggcctgcttccctttggcagtatcttcattgagatgtacttcgtgttcacatcattctggaactataaggtgtattatgtctatggtttcatgttgctggtcttcgtcatccttctaatagtcaccatctgcgtcaccattgtgggtacttatttcttgctgaacgccgagaactatcactggcaatggacgtcgttttcctctgcagcgtcaaccgctttgtatgtgtatctgtactccatctactactaccatgtgaagacaaagatgtcaggcttcttccagacaagtttctactttggttacacactgatgttctgccttggtctaggcatactttgtggtgctattgggtatctagggtcaaccctttttgtaaggagaatctacagaaatatcaaatgtgattaaatccctgctacttactagcagcagaaagaccatatgtattgtcagtggaagcaaggcctgaaaaaaatggattttgatggtagaccctgaataggtttttgaaactgctgatgacttgaccccgttgttcttatacgcacatttttgtttgcctgcttattcctgtgagatcgtcctcatagtgtatatctgtggtagttgaggattagcctgaaacacctgttttcatcattttttcttcattttaattacttcattcgttaggatgtaatcagtgaatattgatgcggcgcgagtcgaattaggactgttcggacaaatcactgcctatacgagtattgaggggtcacgattataacaccgaagctatgacgagcggccgcccgagcagaatgacaggataaggagaattgtataggatgtctctcgtgatgttaacgaaatattggttttggcatgtc

SEQ ID NO: 3943 - DNA, 2312 bp, Mimulus guttatus
gtcataagtcataaacccagatttaatttgcactctctctttctcgacttccattctcgtctcaaagtcctccgcagattcgaaaatctcagatggattcatatgacgacgtttaaacctgacaccaaatcgaaccctttccttgtccgaaaatcctttttcgagatctaaatctgttaccctcaattaggaataaacaccaatttcccttttttttttcttcaatttacaatcctcaggtttcttcattcagatccgacgaagcgatgttctcctccgtccgatccttctgcatcttcgtcttcttcttcgcgttcctcgtctcttcctcactcggcaagtatcaagacgatgaggcggtcactctatgggtgaataaggttggcccatataacaatccccaagagacctacaactattacagcctcccattttgccacctacctggcaacgctcctcacaagtggggtggtctcggtgaggttcttggagggaatgagctcattgatagccaaattgatataaaattcaagagagacgtggagaagtcttcaatttgtgatattgaattggatgcagtaaaggctaaacatttcaaggatgcaattgacaattcatactggtttgaattttttatggatgacctgccactgtggggttttattggtgaggttcttcctgatagaaaccgtgatcataagcatgtgctctttacacacaagaatcttgtcatcaactataatcaggaccagattattcatgtaaatcttacccaagaaaatcctaaggcacttgatgaggggcgaacattggatatgacttactctgtcaaatgggttccaactaacatcacgtttgcacgtcgttttgatgtttatctggattacccattttttgagcaccagatccactggttctctgtctttaattcgttcatgatggtaattttccttactggtttggtctctatgatattaatgcgcaccctccggaacgactatgcaaagtatgctagggaggatgatgatcttgagactctggaacgggatgtaagtgaagaatccggttggaagcttgtccatggtgatgtgtttcgtccccctcaaaatttggctctactaacagctgttgttggcactggcgctcaactatcgacacttgttctgctcgtcatcattctagcaattgttgggatgctgtacatagggagaggagcaattgtgactacctttatcgtatgctatgcttttacctcattcatagctggttatgtgagcggtggcatgtattcccgccatgggggtaagaagtggataaagtcaatgatcctcacagcatcacttttcccattcttgtgctttggcattggcttcgtcttgaacacagttgcaatattctatggttctctggctgccattccctttggtaccatggtggttgtttttgtgatatgggccttcatttcattccccttggctcttcttggtactgttgtcgggagaaactggagtggtgcaccaaacaatccttgccgagtgaagaccatccctcgtcctattccggagaagaaatggtatctaacaccatccattatatctctcatggggggattgcttccttttggaagcatttttatcgaaatgtactttgtcttcacttccttctggaattacaaggtgtactacgtgtacgggttcatgcttcttgtgtttgtaattctgataattgtgaccatttgtgtgacaattgtggggacgtatttcttgttgaatgctgagaactatcattggcagtggacatcattcttctcagcggcttcaactgctctatatgtgtacttgtattcgatatattactatcatgtgaagactaagatgtcaggcttcttccagaccagcttttattttggatacacgttgatgttctgtcttggattgggaatattgtgcggtgcggttggatatctggggtccaacttgtttgtgaggagaatttacaggaacatcaaatgtgactaaattgaagaatatatagagagagaatgcttgcttgggtttgattgttgcatgataagttaatatgccaatggggagatgagaaagaatagaaccctgctgcagcagcctctccggaaaaaaaacttttaatttttttttgtagcaaatgaaatgaatatgttacaagttggtggttggaacttggatagatatagacttttattttaccatccgaatctttgtagcttgtattatatctttgcctcttattaattacttacactctctgctttcattttgtttattttgttccaa

SEQ ID NO: 3944 - DNA, 2428 bp, Triticum aestivum
gtgaaatcgcgaggcggcagctctctcgggccaacccgaccgaaggctcgcgaccgcctcctcttcatcctcagatctcgccgccggcggaatgctcccctcctcccgcggcggcggccgcagacgcttcgtcctcctcctctcgctcaccgccgtcctcgccttcgcttctccgctccgcgcgttcgcctcagagtctgaccacaagtacaaagctggagattcagttaagctctgggtgaataaagttggaccttacaataatcctcaagaaacttacaattatcacagcctcccattttgtcaaccatctgagaaccctgggcataagtggggtggtcttggagaagtcctgggtgggaatgagttgattgatagtcagcttgacataaagttcttaagaaatgtggaaaggggatccatttgcacactggaactagatcccaagaagactcaacaatttgctgatgccattgaaagctcgtactggtttgaatttttcatagatgatctgcctctttggggttttgttggagagactgacaaaaacagtgaaaacaagcactatctttacacgcacaaaaacattcttgtaaagtacaacgataacaggataattcatgttaatctcacccaagagtctcctaagctccttgacgctggtaagaagttggacatgacatattcagtgaagtgggtaccaacagatgtttcatttgcacgccgttttgaagtttacctggactatcctttctttgaacaccagattcactggttctccattttcaattctttcatgatggttatttttctcactggtttggtttcaatgatattgatgcgaacactgagaaatgattatgcaaaatatgctcgtgatgatgatgatctagagtcactggagagagatgttaatgaggaatctgggtggaaacttgtccatggtgatgtatttcgtcctcctagaagcttgacacttctttctgctcttgttggtatcggcacccagctggcagctcttatcctacttgtgattgtattggccatcgttggcatgttatatgttgggcgaggggctatcatcacaaccttcatcgtgtgctatgctcttacatcttttatttctggatatgttagtgctggtctgtactcgaggaatggcggtaaaaactggataaaggctatgatccttacagcatccctctttccattcttgcactttgcaattggctttgcactgaatacaattgcaatcttctatgggtcattagcggcaataccatttggtacaatggttgtcatgtttgtcctttgggctttcatatcttttccactggtgcttttgggaacggtcgttggtagaaactggagtggggctcctaacaatccctgccgagtaaagactattccacggcctattcccgagaggaagtggtaccttacaccttctgtcatctcattgatgggtgggctgcttccctttggcagcatcttcatcgagatgtactttgtgttcacatcattctggaactacaaggtgtattatgtttacggcttcatgttgctggtctttgtcattcttctaatagttacaatctgtgtcacaattgtcggtacttatttcttgctgaatgctgagaactatcattggcaatggacctcgtttttctccgctgcatcaacagcgctatatgtgtacctgtactccatctactactatcatgtgaagacaaagatgtccggctttttccagacaagtttctactttggctacacattgatgttttgtcttggtctgggaatactttgcggtgctattggctacgtaggatcaactcttttcgtgaggagaatctacagaaacatcaaatgtgattaatttcctgctacacatgtggggtgggggtggagcagtatcagatcaaatcatatacgtggaagcgaggccttcgaaattgattaatgctagttcctgattagggtttcagaactacgtcacctttgcttattccatcacaccccttctttttgcatacttatttgttccctggagctgctctcatagtgtatacatctgtggtagctgaggagttcagtacaagtggctggtgcaggttcttattttatttgtttcttgccttttttttgttgcattcctccttttcaaatgagaaagaaataggaagtgagtatccatgcggcaatgtctggacttcccctctgaatcgttacgtccaattcaaggatggcatgtactacgtgagatctgtgtatttatatacatatatcaacatttaatgcatgagagtatgtgtgctgtctgtcatgttcgaaaaaatcggtgaaaatccttccgatgttgtagtgcttttgtatctgcggtatttaatatttgcaacttttgaggtgacttgtgtgacaaaaaaaa

SEQ ID NO: 3945 - DNA, 2218 bp, Solanum tuberosum
gtctgttgaaatcagatcatcatctatatagcccgttcacgactttgggtcggatcccccgtctcattctgccaatatctcacgcgccactcctatcgtcgccggcgattatgatgcggcccaccgtccgatcactaacattgctctccttcctcgccgccttgctcctcgtctcgccggcgcttgcttccgagtctgatcacaagtatcaatcagatgacccagttaccttatgggtaaataaagttgggccctacaataacccacaggaaacatacaactattacagccttccgttttgtcatgcatctggttctcacaaatggggtggccttggtgaagttttgggtggaaacgagcttattgatagtcagattgacataaagtttcaaaaaaacgttgacaagggtagcatttgtgagcttgagcttgatgaagcgaaggtcaagcaatttaaggatgctattgaaaacaattattggtttgaattcttcattgatgacctgccgatgtggggttttgttggtgagcaacatcctgacagaaacagtgataacaagcatgtactttacacacataagaacatacatatcaaatacaataaggaccagatcattcatgtcaatatctctcaagagggcccaaagcctttggaggctgggagaaccttggacatgacatattctgtcaaatgggagccaaccaatatcagttttgctcgtcgctttgaagtttacttggattacccattttttgagcatcagattcattggttctccatctttaattccttcatgatggtcatctttcttactggtctggtgtctatgatattgatgcggacgctaaggaatgattatgccaaatatgctcgggaagatgatgacctggagactctggaaagagatgtgagtgaagagtctggttggaaacttgttcatggagatgtgtttcggactccccttaacctagtgttactttctgctcttgttggtactggggcacaactggcattgcttgtcctccttgtcatactgttggcaattgtggggatgttgtatgttgggagaggatccattgttacgacttttattgtatgttatgctttgacatcattcatttcgggctatgttagtggtgcaatgtactcacggaatggtgggaaaagctggatcaagtcgatgattctgacagcatcactctttccatttatgtgctttggaattggcttcgttctgaacacaatcgccatattttatgggtctctagcagcaattccctttggcacaatggtggttgtcttcgtcatctgggcattcatttccttccccttggctcttctgggtacagttgttggaagaaactggagtggtgctccaaacaatccgtgtcgtgtcaagaccattcctcgccctatacctgtgaaaaagtggtacttgacaccatctgtaatctccttgatgggtggtctgctaccatttggcagcatatttatcgagatgtatttcgtcttcacatccttctggaattacaaggtttactatgtttacgggttcatgcttttggtgttcctgatactcattgttgttactgtctgtgtgaccattgtgggcacatatttcctgctaaatgctgagaattatcattggcagtggacttcatttttctcagcattctctacagctgtctatgtctacctgtactcagtatattactactatgtgaaaactaagatgtcagggttcttccagaccagcttctattttggatatacactgatgttttgtcttggcttaggaattctctgcggtgctgttggatttttgggctcacatctgttcgtgaggaggatctataggaacatcaaatgtgactgatgttttaacaaagaagattaggactgacactgctatatttgcttggtatctagcagtaaggtcaagaacaacctcaagaaccatgtatctttgtgggattcaatttggtttaatgatggtaggtacctctgcttgtattctagggagccctgaaaattttccaaattccttgggctgtaaaagaaatctcctattttcatttgtacttaaattagaatggagactttggaagattcaaggctagcatggtaagagtaacagctgtgatgtagttatatctccaatactatacgacgcagatgcaaaaaacattgctacttaatgttgtttattctttatgc

SEQ ID NO: 3946 - DNA, 2294 bp, Secale cereale
ggccaacccgaccgaaggctcgcgcccgcctcctcttcatcctcagatctcgccgccggcggaatgctcccctcctcccgcggcggcgaccgcagacgcctcgtcgtcctcctctcgctcaccgccgttctcgccttcgcttctccgctccgcgcgtccgcctcagagtctgaccacaagtacaaagctggagattcagttaagctctgggtgaataaagttggaccttacaataatcctcaagaaacctacaattatcacagcctcccattttgtcaaccatctgagaaccctgggcataagtggggtggtcttggagaagtcctgggtgggaacgagttgattgatagtcagcttgacataaagttcttaagaaatgtggaaaggggatccatttgcacactggaactagattcgaaaaagattcaacaatttgccgatgccattgagagctcctactggtttgaatttttcatagatgatctgcctctttggggttttgttggagagactgacaaaaacagtgaaaacaagcactatctttacacacacaagaacattcttgtaaagtacaacgataacaggataattcatgttaatctcacccaagagtctcctaagctccttgacgctggtaagaagttggacatgacatattcagtgaagtgggtaccaacagatgtttcatttgcacgccgttttgaagtttacctggactaccctttctttgaacaccagattcactggttctccattttcaattctttcatgatggttatttttctcactggtttggtttcaatgatattgatgcgaacactgagaaatgattatgcaaaatatgctcgcgatgatgatgatctagagtcactggagagagatgttaatgaggaatctgggtggaaacttgtccatggtgatgtatttcgtcctcctagaagcttgacacttctttctgctcttgttggtatcggcacccagctggcagctcttatcctacttgtgattgtattggccattgttggcatgttatatgttgggcgaggggctatcatcacaaccttcatcgtgtgctatgctcttacatcttttatttctggatatgttagtgctggtctttactcgaggaatggtggtaaaaactggataaaggctatgatccttacagcatccctctttccattcttgcactttgcaattggctttgccctgaatacaattgcaatcttctacgggtcattagcagcaataccatttggtacaatggttgtcatgtttgtcctttgggctttcatatcttttccgctggtgcttctgggaacggtcgttggtagaaactggagtggggctcctaacaatccctgccgagtaaagactattccacggcctattcccgagaggaagtggtaccttacaccttctgtcatctcattgatgggtgggcttcttccctttggcagcatcttcattgagatgtactttgtgttcacatcattctggaactacaaggtgtattatgtttacggcttcatgttgctggtctttgtcattcttctaatagttacaatctgtgtcacaattgtcggtacttatttcttgctgaatgctgagaactatcattggcaatggacttcgtttttctctgctgcatcaacagcgctatatgtgtacctgtactccatctactactatcatgtgaagacaaagatgtctggctttttccagacaagtttctactttggctacacattgatgttctgtcttggtctgggaatactttgcggtgctattggctatgtagggtcaactcttttcgtgaggagaatctacagaaacatcaaatgtgattaatttcctgctacacatgtggggttgagggtggagtggtatcagatcaaatcatatacgtggaagcgaagccttcgaaatggattaatgctagttcctgattagggtttcagaactacgtgccctttgcttattccatcacaccccttctttttgcatacttatttgttccctggagctgctctcatagtgtatacatatgtggtagctgaggagttcagtacaagtggctggtgcaggttcttacttttctttgttccttgccttttttttgttgcgttcctctttttcaaatcagaaataggaagtgagtatccatgcggcactgtctggactttcaaattcaaggatgtcatgtactacgtgagatctgtgtattcatatacatatatatcaacatttaatgcatgagagtctatgtgtgtcctctatcatatttgaaaaaa

SEQ ID NO: 3947 - DNA, 2237 bp, Solanum phureja
gtctgttgaaatcagatcatcatctatatagtccgttcacgactttgggtcggatcccccgtctcattctgccaatatctcacgcgccactcctatcgtcgccggcgattatgatgcggcccaccgtccgatcactaacattgctctccttcctcgccgccttgctcctcgtctcgccggcgcttgcttccgagtctgatcacaagtatcaatcagatgacccagttaccttatgggtaaataaagttgggccctacaataacccacaggaaacatacaactattacagccttccgttttgtcatgcatctggttctcacaaatggggtggccttggtgaagttttgggtggaaacgagcttattgatagtcagattgacataaagtttcaaaaaaacgttgacaagggtagcatttgtgagcttgagcttgatgaagcgaaggtcaagcaatttaaggatgctattgaaaacaattattggtttgaattcttcattgatgacctgccgatgtggggttttgttggtgagcaacatcctgacagaaacagtgataacaagcatgtactttacacacataagaacatacatatcaaatacaataaggaccagatcattcatgtcaatatctctcaagagggcccaaagcctttggaggctgggagaaccttggacatgacatattctgtcaaatgggagccaaccaatatcagttttgctcgtcgctttgaagtttacttggattacccattttttgagcatcagattcattggttctccatctttaattccttcatgatggtcatctttcttactggtctggtgtctatgatattgatgcggacgctaaggaatgattatgccaaatatgctcgggaagatgatgacctggagactctggaaagagatgtgagtgaagagtctggttggaaacttgttcatggagatgtgtttcggactccccttaacctagtgttactttctgctcttgttggtactggggcacaactggcattgcttgtcctccttgtcatactgttggcaattgtggggatgttgtatgttgggagaggatccattgttacgacttttattgtatgttatgctttgacatcattcatttcgggctatgttagtggtgcaatgtactcacggaatggtgggaaaagctggatcaagtcgatgattctgacagcatcactctttccatttatgtgctttggaattggcttcgttctgaacacaatcgccatattttatgggtctctagcagcaattccctttggcacaatggtggttgtcttcgtcatctgggcattcatttccttccccttggctcttctgggtacagttgttggaagaaactggagtggtgctccaaacaatccgtgtcgtgtcaagaccattcctcgccctatacctgtgaaaaagtggtacttgacaccatctgtaatctccttgatgggtggtctgctaccatttggcagcatatttatcgagatgtatttcgtcttcacatccttctggaattacaaggtttactatgtttacgggttcatgcttttggtgttcctgatactcattgttgttactgtctgtgtgaccattgtgggcacatatttcctgctaaatgctgagaattatcattggcagtggacttcatttttctcagcattctctacagctgtctatgtctacctgtactcagtatattactactatgtgaaaactaagatgtcagggttcttccagaccagcttctattttggatatacactgatgttttgtcttggcttaggaattctctgcggtgctgttggatttttgggctcacatctgttcgtgaggaggatctataggaacatcaaatgtgactgatgttttaacaaagaagattaggactgacactgctatatttgcttggtatctagcagtaaggtcaagaacaacctcaagaaccatgtatctttgtgggattcaatttggtttaatgatggtaggtacctctgcttgtattctagggagccctgaaaattttccaaattccttgggctgtaaaagaaatctcctattttcatttgtacttaaattagaatggagactttggaagattcaaggctagcatgttaagagtaacagctgtgatgtagttatatctccaatactatacgacgcagatgcaaaaaacattgctacttaatttttgtttattctttatgcccagacaagttgttgaac

SEQ ID NO: 3948 - DNA, 2362 bp, Nicotiana benthamiana
ctgctgcttccccctctccgggtctctatttgtcgaaaaatcagatcataatctacttatataaaatccgttcacgactttgggtcggatccctccgtctcttctgccattatctcgcgcgccaatccctaacgtagccggcgattatgatacggcccaccgtccgatcactaactctgttctccttcctcgccgctttcctcgtcgtctcgccggcgcttgcttccgagtctgatcacaagtatcaacaagatgacccagttactctgtgggtaaacaaagttgggccgtataataacccacaggaaacatacaactattacagccttccattctgtcatgcttctggttctcacaagtggggtggccttggtgaagttttgggtggaaacgagcttattgatagtcagattgacataaggtttcaaaaaaacgtggacaaaggtagcatttgtgagcttgaacttgatgaagcgaaggtcaagcaattcaaagatgctattgaaaacaattattggtttgaattcttcattgatgacctgccattgtggggttttgtaggagagcaacatcctgacagaaacagtgataataagcatgtactttacacacataagaacatccatattagatacaataaggaccagatcattcatgtcaatatttctcaagagggcccaaagcctttggaggctgggagaacattggacatgacatattctgtcaaatgggaaccaaccaatatcagttttgctcgtcgttttgaagtttacttggattacccattttttgaacatcagattcattggttctccatctttaactccttcatgatggtcatctttcttactggtctggtatctatgatattgatgcggacactgaggaatgattacgccaaatatgctagggaagatgatgacttggagacactggaaagagatgtgagtgaagagtctggttggaaacttgttcatggagatgtatttcggactcctcgtaccctagtgttactttctgctcttgttggtaccggggcacagttggcattgcttgttctccttgtcattctgttggcaattgtggggatgttgtatgttgggagaggagccattgttacgactttcatagtatgttatgctttgacatcattcatttcgggctatgtttgttgttcaatttacttacttattgcagggaaaagctggatcaagtctatgattctgaccgcttcactctttccatttttgtgctttggaattggtttcattctgaacacaattgccatattttatggttctctagcagccattccttttggcacaatggtagttgtcttcgttatctgggcattcatttccttccccctggctcttctgggtacagtcgttggaagaaactggagtggtgctccaaacaatccatgccgtgtcaagaccattcctcgccctatacctgtgaaaaagtggtacttgacgccatctgtaatctccttgatggggggtttgctaccatttggcagcatatttattgagatgtatttcgtcttcacatccttctggaattacaaggtgtactatgtttacgggtttatgcttttggtgttcctgattctcattgttgttacagtctgtgtgaccattgtgggcacatatttcctgttaaatgctgagaattatcattggcaatggacttcatttttctcagccgcctctacagctgtctatgtctacctatactcagtatattactactacgtgaagactaagatgtcagggttctttcagaccagtttctactttggatacacactgatgttttgtctcggcttaggaattctctgcggtgctgttggatttttgggctcacatctgtttgtgaggaggatctatagaaacatcaaatgcgactgatcttttgacgagtaggactgacactgctcctccatttgcttagtttctggcagtaaggtcgagaaaaacctcaagaaccacatatctttgtgggatttgatttggtttaatgatgatagttggtaggtacctctgcttgtattctggggagccctgaaaattttccccattccttgggctgtaaaagtaatctcctactttcatttgtacttaaattagaatgaagagacttcaaatgattcaaggctagcattgtaagagtttcagctgtcacgtagttattgtatatccattattactatacgactcggatgcactcaaagaactgctatttaattttttgttgattctcgtgcagttacaaatgagatccaagtcagtttttttccgtggtgaacaatttagtgaaaaccacttggatatacacattgcattatttacagcagaga

SEQ ID NO: 3949 - DNA, 2282 bp, Gossypium hirsutum
gtcaggtcagggacattgtgtttttccaatcgacctccggaccttcagatccgaccaacgttgcaccaccgccatgttatcctccgtccgctctttctctctttccgccttcattttcttcgtcttcttctcctctctcgccttcgcttccgagtcagatcataagtatcagccggatgatccaattaccctatgggtaaataaagttggaccatataacaatccacaagaaacttataactattacatccttccgttttgtcatccgggtgtcaatcctgcgcacaaatggggtggccttggtgaggtccttggtggaaatgaactgattgatagccagattgatataaagtttcaaaagaatgtggacaaaggtaccatttgccaactggaacttgatgaagctaaggtcaagcagttcaaggatgctatcgagaacaattattggtttgaattctttgtggatgatctgcctttgtggggctttgttggtgaactgcatcctgataagaacagtgataatggcaagcatgtcctctacacacataagaacattgttattaaatacaacaaggatcagattattcatgtcaacctcacccaggggagtcctaaacccttggaagcagggagagtattggacatgacatactcaatcaaatggcttccaactaatgtcacttttgctcgtcgctttgatgtttatttggactaccctttctttgagcaccaaattcattggttctctgttttcaattcattcatgatggttatctttctcactggtttggtctcaatgatcttgatgcgaactctgagaaatgactatgcaaagtatgctcgggaagatgatgatttggaaactttggaaagggatgtaagtgaagagtctggttggaaacttgtccatggtgatgttttccggcctccccgtggtttggttctgctttctgctgttgttggcaccggtgcacagctagcattgcttgttctccttgtcatcttattggcaattgtgggaactttgtatgtcgggagaggagcaattgtcactacttttatactctgttatgcttttacatcgttcatttctggttatgtgagtggtggaatgtactcgcgtaatgggggtaaaagttggataaagtcaatgatcctttcagcgtctctgttcccatttttgtgttttgggattggtttcatcttgaacacaattgctatattttatggatccctagctgctattccttttggtacaatggtggtggtttttgtaatttgggctttcatttcattccccctggctcttcttggtacagttgttgggagaaactggagtggtgctccaaataatccatgccgcgtgaagaccattcctcgcccaattccggagaagaaatggtatcttacaccctctgtggtctccttgatgggaggacttctgccgtttggcagcatatttattgaaatgtatttcgtcttcacatccttctggaattacaaggtttattatgtctatggatttatgctgctggtgttcctgattctcgtcattgtaactgtctgtgtgacaattgtggggacatatttcttgctgaacgctgagaactatcactggcagtggacatcatttttctctgctgcctcgacagcagtgtatgtgtatatgtactctgtatactactactatgtgaaaaccaagatgtcaggcttcttccagaccagtttctacttcggatacactttgatgttttgtcttggtttgggaatcctttgcggagctgttggttatcttggttctaatttgtttgtaaggaggatctacagaaacattaagtgtgactagaactttgctaatggatattagaaccagcagcgcttccacaagcattttcagttgtcgaggcaataaacatggagaggtagcttcttgtcaggtatgaggaaccaagcaaagcctcaagatgaaactggaagccctgagatttttgttttgcctttgattttactcgcctgtaattggaagccctgatttagaatatagaaaggtagctaaaatattaaacaactgtcatttgttatacttctgttatacttttctccttgatccctttgcatatagatgtgtccaatgtaagaatttatgttaaatttccgttggatttgttttgttctttctttcggggataaggaacttaaatcaaggaaatcgataaatgggtgtgtttctttcttttttttttaaataattatctgcattctgcaatttggcagttggcaca

SEQ ID NO: 3950 - DNA, 2478 bp, Gossypium hirsutum
ttaaaaaaaactaagggagagaactcagtcacgtagcatttcgaatcggcgtcgggaccattcagatccgatcaaccgtccgacgatcgcaatgtcgtccgccgtattctccgccgtccgatctttctctgttttcgtcttcgttttactcttcctctccctcgctttcgcttccgagtcagatcacaagtatcaacccgatgatccaattactctatgggtgaataaagttggtccgtacaataatccacaagaaacatataactactacagccttccgttttgtcaaccgggtactaatcctgctcacaaatggggtggtcttggtgaggtccttggtggaaatgaactgattgatagccaaatttatatgaagtttcaaaagaatgtggacagaggtaccatttgtcaattggaacttgatgaagcaaaggtcagacagttcaaggatgcaattgagaacagctactggtttgaattctttgtggatgatctgcctttatggggctttgttggcgagctgcatcctgataggaacagtgaaaatggcaagcatgtcctctacacacataagaatattgttattaaatacaataaggatcagattattcatgtcaatctcactcaggagagtccaaaacaactggaagcagggagaaccctggacatgacatattctgttaaatggcttccaactaatgtgacttttgctcgtcgctttgatatttacttagactatcctttctttgagcaccaaatccattggttctctgttttcaattcattcatgatggttatctttctcactggtttggtgtcaatgatcttgatgcgaactttgagaaatgactatgcgaagtatgctcgggaagatgatgatctggaaactttggaaagggatgtgagtgaagagtgtggttggaaactggtccatggtgatgtttttaggcctcctagcaatttggctttgctttctgctgttgttggcacaggtgctcagctagcgttgcttgttctccttgtcatcttattggcaattgtgggaactttgtatgttgggagaggagcaattgtcactacctttatactgtgttatgcttttacatcattcatttctggttatgtgagtggtggaatgtactcacgaaatgggggtaaaaattggataaagtcaatgatcctgacagcatctctgtttccatttttgtgctttgggattggattcctcctgaacacagttgctatattttatggatctctagcagctattcctttcggtacaatggtggttgttttgtaatttgggctttcatttccttccccttggcgcttcttggtacagttgttggaagaaactggagtggtgctccaaataatccatgccgtgtaaagaccattcctcgcccaattccagagaagaaatggtatcttacaccctctgtggtctctatgatgggaggacttcttccatttgggagcatattcattgaaatgtattttgtcttcacatccttctggaattacaaggtttattatgtctatggttttatgctgctggtcttcctgattctcatcattgtaaccatttgcgttacgattgtggggacatatttcttgctaaatgctgagaactatcactggcagtggacatcattcttctctgctgcctcaacagctatttacgtgtatttgtactccgtatactactactccgtgaaaaccaagatgtcaggcttcttccagaccagcttctacttcggatacactttgatgttttgtcttggtttgggaatcctctgtggagccattggttttctcggttcgaacttgttcgtaaggaggatctacagaaacatcaagtgtgattaaaccttttgttgtcagaaactagaaccatcggtgcttccatgagcttttcttttcttttttttctagttgtcgaggcaataaacatcgagaggaagctttaaggtatagagaccccatcaaagccttcaaacgaaatcacagggtttaacagtaggtatgtactctcggttccatggaccacggtaaaccccacgatttttgtttcgcctttttcccattggcatcataaacatagcttccctcagacttttcaataaccaggggatgtaagtcagtggtctgccacccagctgtgaatggagccagcatatcatgccccttaaacccattgccatcctttaaatctgaatcatctctctgcaaagatggctcagtactatataatcttgccagtaatgcacccttaagtgggtggtccatagaacttctgtacgcagcagcattttttatatatgaaccaagctgggttttgagagttgatcgaaggagctgttggcaccattttttttttccctttattatccaatgttaggacaaaaaacatgcagagaagcaaaaaggccaaaaaggataaagagtgctctgagaaagaaatgagcctcgacttgt

SEQ ID NO: 3951 - DNA, 2338 bp, Triticum aestivum
gctcgcgaccgcctcctcttcatcctcagatctcgccgccggcggaatgctcccctcctcccgcggcggcggccgcagacgcctcgtcctcctcctcgcactcaccgccgtcttcgccttcgcttctccgctccgcgcgtccgcctcagagtctgaccacaagtacaaagctggagattcagttaagctctgggtgaataaagttggaccttacaataatcctcaagaaacttacaattatcacagcctcccattttgtcaaccatctgagaaccctgggcataagtggggtggtcttggagaagtcctgggtgggaatgagttgattgatagtcagcttgacataaagttcttaagaaatgtggaaaggggatccatttgcacactggaactagattccaagaaggttcaacaatttgctgatgccattgaaagctcgtactggtttgaatttttcatagatgatctgcctctttggggatttgttggagagactgacaaaaacagtgaaaacaagcactatctttacacgcacaagaacattcttgtaaagtgcaatgataacaggataattcatgttaatctcacccaagagtctcctaagctccttgacgctggcaagaagttggacttgacatattcagtgaagtgggtaccaacagatgtttcatttgcacgccgttttgaagtttacctggactatcctttctttgaacaccagattcactggttctccattttcaattctttcatgatggttatttttctcactggtttggtttcaatgatattgatgcgaacactgagaaatgattatgcaaaatatgctcgtgatgatgatgatctagagtcactggagagagatgttaatgaggaatctgggtggaaacttgtccatggtgatgtatttcgtcctcctagaagcttgacacttctttctgctcttgtcggtatcggcacccagctggcagctcttatcctacttgtgattgtattggccatcgttggcatgttatatgttgggcgaggggctatcatcacaaccttcatcgtgtgctatgctcttacatcttttatttctggatatgttagtgctggtctgtactcgaggaatggcggtaaaaactggataaaggctatgatccttacagcatccctctttccattcttgcactttgcaattggctttgcactgaatacaattgcaatcttctatgggtcattagcggcaataccatttggtacaatggttgtcatgtttgtcctttgggctttcatatcttttccactggtgcttttgggaacggtcgttggtagaaactggagtggggctcctaacaatccctgccgagtaaagactattccacggcctattcccgagaggaagtggtaccttacaccttctgtcatctcattgatgggtgggctgcttccctttggcagcatcttcatcgagatgtactttgtgttcacatcattctggaactacaaggtgtattatgtttacggcttcatgttgctggtctttgtcattcttctaatagttacaatctgtgtcacaattgtcggtacttatttcttgctgaatgctgagaactatcattggcaatggacctcgtttttctcagctgcatcaacagcgctatatgtgtacctgtactccatctactactatcatgtgaagacaaagatgtccggctttttccagacaagtttctactttggctacacattgatgttctgtcttggtctgggaatactttgcggtgctattggctatgtagggtcaactcttttcgtgaggagaatctacagaaacatcaaatgtgattaatttcctgctacacatgtggggtgggggtggagcggtatcagatgaaatcatatacgtggaagcgaggccttctaaatggattaatgctagttcctgattagggtttcagaactacgtcccctttgcttattccatcacaccctttctttttgcatacttatttcttacctggagctgctctcatagtgtatacatctgtggtagctgaggagttcagtacaagtggctggtgaaggttcttatttttgtttgtttcttgccctttttttttggttgcattcctccttttcaaatgagaaagaaataggaagtgagtatccatgcggcactgtctggacttcccctctgaatcgttacgtccaattcaaggatggcatgtactacgcgagatctgtgtatttatatacatatatcaacatttaatgcatgagagtatgtgtgctgtctgtcatgttcgaaaaaatcggtgaaaatccttccgatgttgtagtgcttttgtatctg

SEQ ID NO: 3952 - DNA, 2105 bp, Triticum aestivum
ggcgtccgcctccgagtccgaccacaagtacaaaatttcagaaccagtcaagctctgggtaaacaaggttggcccgtacaataatcctcaggaaacatacaactattacagccttccgttttgtcaaccagctgaaaaccctgcacacaaatggggtggactcggagaagttctcggtggaaatgagctgattgatagtcagattgatatacagtttttgaaaaatgtggacaagggccccatttgcacaattgaacttgatgctaaaaaggttcagcaatttactgatgccattgaaagctcatactggtttgagcttttcatagatgatctgccattgtggggttttgttggggagactgacaaaaacaatgaaaacaagcactatctttacacacacaagaatattgttgttaaatacaacggtaacagggtaattcatgtcaatctcactcaagagtcacctaagcttcttgaagctggaagaaaattggacatgacatattcagtgaagtgggtgcaaacaaatgtggcatttgcacggcgttttgaagtttacttggactacccgttcttcgaacaccagattcattggttttccatcttcaattctttcatgatggtcattttcttaactggtttagtatcaatgatattgatgagaaccctgagaaatgattatgcaaaatatgctcgtgaagatgatgatcttgagtcacttgaaagggatgttagtgaggaatctggatggaagcttgttcatggagatgtatttcgacctccacgcaacctaatgtttctgtctgctgttgttggcattggcactcagatggcagctcttatcctgcttgttattgtacttgccattgttggtatgctttatgttggacgaggagctattatcacaacctttatcgtgtgctacgcgcttacatctttcatttctggatatgttagtggcggcctctactcaaggaacggcggcaaaaactggataaagtctatggtccttaccgcgtccctttttccattcttgtgcttttcaattggattagtgttgaacaccattgctatcttctaccattcattagcggctataccatttggtacaatggttgtcatatttgtcctctgggcttttatctctttcccactggtgctattgggaacagtagttggtcgaaactggagtggtgctcccaataacccatgccgtgtgaagacaatcccacgtcctattcctgagaagaagtggtacctaacaccttctgttatctcattgatgggtgggcttcttcccttcggcagcattttcatcgagatgtacttcgtattcacttcattctggaactacaaggtgtactatgtttatggcttcatgttgctagtctttgtcatcctcctaatcgtaacagtatgtgtcactattgtgggcacttatttcttgttgaatgctgagaactatcattggcaatggacatcgttcttctcggctgcatcaaccgccttgtatgtatatctatacgctatatactattatcatgtgaagacaaagatgtcaggctttttccagactagcttctacttcggctacacgttgatgttctgtctggggctaggcatactttgtggtgctatcggctatctggggtcaactttgtttgtcaggagaatctacagaaacatcaaatgcgactaaactgcttctccgattctgtaggctattagcacttagcagatcatgtgttgttgagtaacgcttctaagattctaattaacttttggaaactatacaggaggtggttctcccttcgtttaccttaatatacttttatttttggtctatatctaccccgtcatcaaaactggccccataaatgtatacctatattagttcaggaattagtctcagtactgggatttacatctacctttatctttttagggcggccctctagtttatgttcattgatgcagtgcagattcctctgaacctagatgtgcccctacaatgggttgcagcattcaggttccgttttatgtcatataaaagcaaactagtaatacactgatgttacattctgaatgagtagcgcccgttgaac

SEQ ID NO: 3953 - DNA, 2470 bp, Malus domestica
atgcgttccgaagtctatcttttgagaagactttggagagtaattgagtcgagtccgagtggcatcagcctcagcctctgcctcctctgcctctgggagagatcacaacacaaaacattacaccaccttctcacgctcaccgtccagatcccaccctcgccggcgatcgccatgttctcctccgtccgatctctctcacccctcctcctcttcgtcttcttcctcctcgctcccgccttcgcctccgagtcagatcacaagtataaaacagaagaatcagttaccctttgggtgaataaagttgggccctacaataatccacaagaaacatacaattactacagtcttcctttctgtcatcaatctgaaaatgctgctcacaaatggggtggccttggtgaagtcctgggtggaaatgagctgattgatagccagattgagataaagtttcaaaaaaatgtggacagggctaccatttgccaacttgaacttgacgatcaaaaggttaaacacttcaaggatgcaatcgagaataactactggtttgaatttttcatggatgatctgcctttatggggctttgttggtgagttgcacccggacaagaacagtgaaaatggcaagcatgtcctttacacgcataaaaatattattgttaaatacaataaagatcagatcattcatgtgaatctcactcaagatagtccaaagccgttggaagcagggaagaaattggacctaacttactctgtcaaatggattgcaaccactatcacatttgcacgtcgatttgatgtctatttggactaccctttttttgagcaccaaatacattggttctcgattttcaattcattcatgatggttattttccttactggtttggtgtcaatgatattgatgcggactcttaggaatgactatgcaaagtatgctcgggaagacgacgatctggagactctggaaagagatgtcagtgaagagtctgggtggaaacttgtgcatggggatgtttttcggccttctcgaaatttggttattctttcagccgttgttggcacgggcgctcagctagcattgcttgttcttctcgtcatcttactggcaattgttgggatgttgtatgttgggagaggtgcaattgttacaactttcatagtgtgttacgcccttacatctttcatttctggttatgtaagtggtgggatgtattcaagacatggtggtaaaaactggataaagtcaatgatactcacagcatctctatttccatttatgtgctttgggattgggttcatcttgaacacaattgctatattttacgggtcactggctgctattccttttggtacaatggtggttgtttttgtgatttgggcattcatctcttttcctctagcacttcttggtacagttgttggaagaaactggagtggtgctcctaacaatccttgtcgtgtgaaaaccattcctcgtcctattcctgagaagaaatggtatttaaccccatctgtagtctcaatgatgggaggacttctgccctttggaagcatatttatcgaaatgtattttgtcttcacatccttctggaattacaaggtgtattatgtctatggctttatgctgcttgtttttctgattctcatcattgttaccgtgtgcgtgacaattgtggggacatacttcttgcttaatgctgagaactaccactggcaatggacttctttcttttctgctgcatcaacagctgtctacgtgtacttgtattctatatattactactatgcaaagaccaagatgtcgggtttcttccagaccagcttctattttggatacactttgatgttttgccttggcttaggaatcctttgcggagctgttggatatctgggttctaatttgtttgtaaggaggatctacagaaacatcaagtgcgactagagcatctccgcgaggaaatggacctgatggagattctctgagtagattggccgttgttgaggtacgtggtcagggatggggatccagtaaccactagagactgaaatcacagggtttgaggacagggatgtattcttctctggactcggtaaagccctgagatttttttgttttccccggctgtaagtgaaagccttaattttagatgcagagattgttttataatctaagttagcggatgtcgaactcctgttatttcattattttcttttttttcgacctttcacaaataggtgccccgttactctccgtctccgaaaacgaacctttgattctgagttatgtaacgacttgtgaattttgattccatctgtaccttgcatatataagtatcattgtctgaaacggtgaaaccacacattgtgtctttacatctttgcacgatttatttcgagtatttcttgtaacttgtatgaatgacaattgattccgtaatattttgtcgtgtcgataaggaagattaaggatg

SEQ ID NO: 3954 - DNA, 2314 bp, Solanum lycopersicum
gctgctgcttctccttctcgagtctgttgaaaacagatcatcatctaatactctactatatagtccgttcacgactttgggtcggatcccccgtctcattctgccaatatctcacgagccactcctatcgtcgccggcgattatgatgcggtccaccgtcccatcactaacattgctctccttcctcgccgccttgctcctcgtctcgccggcgcttgcttccgagtccgatcacaagtatcaatcagatgacccagtaaccttatgggtaaataaagttgggccctacaataacccacaggaaacatacaactattacagccttccgttttgtcatgcatctggttctcacaaatggggtggccttggtgaagttttgggtggaaacgagcttattgatagtcagattgacataaagttccaaaaaaacgttgacaagggtagcatttgtgagcttgagcttgatgaagcgaaggtcaagcaatttaaggatgctatagaaaacaattattggtttgaattcttcattgatgatctaccgatgtggggttttgttggtgagcaacatcctgacagaaacagtgataataagcacgtactttacacacataagaacatacatatcaaatacaataaggaccagatcattcatgtcaatatctctcaagagggcccaaagcctttggaggctgggagaaccttggacatgacatattctgtcaaatgggagccaaccaatatcagttttgctcgtcgctttgaagtttacttggattacccattttttgagcatcagattcattggttttccatctttaattcattcatgatggtcatctttcttactggtctggtgtctatgatattgatgcggacgttaaggaatgattatgccaaatatgctcgggaagatgatgacctggagactctggaaagagatgtgagtgaagagtctggttggaaacttgttcatggagatgtgtttcggactccccttaacctagtgttactttctgctcttgttggtactggggcacaactggcattgcttgtcctccttgtcatactgttggcaattgtggggatgttgtatgttgggagaggatccattgttacaacttttattgtatgttatgctttgacatcattcatttcgggctatgttagtggtgcaatgtactcacggaatggtgggaaaagctggatcaagtcgatgattctgacagcatcgctctttccatttatgtgctttggaattggtttcgttctgaacacaatcgctatattttatgggtctctagcagcaattccctttggcacaatggtggttgtctttgtcatctgggcattcatttccttccccttggctcttctgggtacagttgttggaagaaactgcagtggtgctccaaacaatccgtgccgtgtcaagaccattcctcgccctatacctgtgaaaaagtggtacttgacaccatctgtaatctccttgatgggtggtctgctaccatttggcagcatatttatcgagatgtatttcgtcttcacatccttctggaattacaaggtgtactatgtttacgggttcatgcttttggtgttcctgatactcattgttgttaccgtctgtgtgaccattgtgggcacatatttcctgctaaatgctgagaattatcattggcagtggacttcatttttctcagcattctctacagctgtctacgtctacctgtactcagtatattactactatgtgaaaactaagatgtcagggttcttccagaccagcttctattttggatatacaatgatgttttgtctcggtttgggaattctctgcggtgctgttggatttttggggtcacatctgttcgtgaggaggatttataggaacatcaaatgtgactgatgttttaacaaagaagagtaggactgacactgctatatttgcttggtatctagcagtaaggtcaagaagaacctcaagaaccatgtattattgtgggattcaatttggtttaatgatggtaggtacctctgcttgtattctggggagccctgaaaattttccaaattccttgggctgtaaaagaaatctcctattttcatttgtacttaaattagaatggaaactttggatgattcaaggctagagttacagctctgatgtagttatatctccaatactatacgatgcacattgctacttaatttttgtttatttttttatgcaactacaaatgaggccctgttgaacaattcacgataacggttttgggatccacacattgcaagcagagagacggttcaccct

SEQ ID NO: 3955 - DNA, 2185 bp, Musa acuminata
cgaattcccgtgtgcggatagaggagagagatcgagaaggggcggaaggacctctttcgccctccgatctccgtagatccagccgcgaggatggtcctcaccgcccgatccctcgcccccctcctcctcatcctcctcgttgtagccgccgcatccccggcgtccgcctcggagtccgaccatacgtaccaaaacgatgaccatgttactctttgggtaaacaaggttgggccatataacaatcctcaagagacatacaattattatatccttccgttttgccaactaccagggaatgctgcccataagtggggtgggctcggggaggttctaggtggtaatcaacttgttgatagccagattgagataaagtttcgaaaaaatgttgataaggcttccatctgtgctattaatcttgatgctgctaaggtaaaacaattcaaagatgcagtagagagttcgtattggtttgaattcttcattgatgatttgcctctatggggtttcattggggagactgataagaccaatgaaaatcgacactatcttttcactcacaaggatatcgttgtaaagtacaatggtgatcagattattcatgtcaatctcacccaagaatctcctaaactcttggaagctggcaaaagcttagacatgacatactcagtgaaatggatagaaactgatgtaaaatttgctcgacgttttgatgtatacttggattatcctttctttgagcaccagattcactggttttcaattttcaattctttcatgatggttatattcctcactggtcttgtatcaatgattttgatgcgaactcttagaaacgattacgcaaaatatgctcgtgaagatgatgatttggagactctggaaagagatgcgagtgaagagtctggatggaagcttgttcatggtgatgtctttcgccccccgtgtaatctagttcttctttcagcagttgttggtactggtgctcagttggctatgcttgtcctcttggtcattttgttggcaataatcgggatgttgtatgttgggcgaggagctattgctactactttcattgtgtgctatgctcttacgtctttcatttcaggctatgtaagtggcggtctttattcacaaaatggtggtaaaagctggataaagtcgatgatccttgctgcatccttgttcccatttatgtgctttgggattggctttatacttaacacaattgctatcttttatggttcactagctgctattccatttggcactatggtagttgtgtttataatttgggccttcatctcatttccactagcacttcttggcactgttgttggtagaaactggagtggttctccaaacaatccttgccgtgtgaaaacaattcctcgtctgattcctgaaaagaaatggtatcttacaccgtccataatctcacttatgggcggcttgcttccttttggtagcatattcatcgagatgtattttgtcttcacatccttttggaattacaaggtgtactatgtctatggattcatgttgctggttttcctgatcctaatcatcgtcactatgtgtgtaacaattgttggcgcatacttcttgctcaatgctgagaactatcactggcagtggacttcattcttctctgccgcttcaacagctgtgtatgtgtatctctactctgtgtattactactacatgaagaccaagatgtcaggctttttccagaccagcttctattttggttacacattgatgttttgtttgggtttaggtatactatgtggtgctgtgggatatctcggctctaccatgtttgtgagaaggatatacagaaacatcaaatgtgattaggtccagaatcaggaggctctgtgcacatctaataatacatcaccaagagagaccaacctgttcggtgtaagatgtgagttgctgatcaaaattgatggccttctaaacatggatgactctgcttttgcttgcttcatatttttgcaacctatctgccctttgtttatttttctggatgtagagatggtcttcttatactaaatttagagatactgtcacgtctaaaatcttgtagcaatcataaaacttattagttatcttttgggttactcaggacttggaaccttgtgaccctttgaacaaatgaattcacagattaataatgctt

SEQ ID NO: 3956 - DNA, 1920 bp, Triticum aestivum
ggcgtccgcctccgagtccgaccacaagtacaaaatttcagaaccagttaagctctgggtaaacaaggttggcccgtacaacaatcctcaggaaacatacaactattacagccttccgttttgtctaccagctgaaaaccctgcacataaatggggtggacttggagaggttctgggtggaaatgagctgattgatagtcagattgatatacagtttttgaaaaatgtggacaagggccccgtttgcacaattgaacttgatgctaaaaaggttcagcaatttactgatgccattgaaagctcatactggtttgagcttttcatagatgatctgccgttgtggggttttgttggggagactgacaaaaacaatgaaaacaagcactatctttacacacacaagaatattgttgttaaatacaacggtaacagggtaattcatgtcaatctcactcaagagtcacctaagcttcttgaagctggaagaaaattggacatgacatattcagttaagtgggtgcaaacaaatgtggcatttgcacggcgttttgaagtttacttggactacccattcttcgagcaccagattcattggttctccatcttcaattctttcatgatggtcattttcttaactggtttagtatcaatgatattgatgaggaccctgagaaatgattatgcaaaatatgctcgtgaagatgatgatcttgagtcacttgaaagggatgttagtgaggaatctggatggaagcttgttcatggagatgtatttcgacctccacgcaacctaatgtttctgtctgctgttgttggcattggcactcagatggcagctcttatcctgcttgttattgtacttgccattgttggtatgctttatgttggacgaggagctattatcacaacctttatcgtgtgctacgcgcttacatctttcatttctggatatgttagtggcggcctctactcaaggaatggcggcaaaaactggataaagtctatggtccttaccgcgtccctttttccattcttgtgcttttcaatcgggctagtgttgaacaccattgctatcttctaccattcattagcggctataccatttggcacaatggttgtcatatttgtcctctgggcttttatctctttcccactggtgctattgggaacagtagttggtagaaactggagtggtgctcccaataacccatgccgtgtgaagacaatcccacgtcctattcctgagaagaagtggtacctaacaccttctgttatctcattgatgggtgggcttcttcccttcggcagcattttcatcgagatgtacttcgtgttcacttcattctggaactacaaggtgtactatgtttatggcttcatgttgctagtctttgtcatcctcctaatcgtaacagtatgtgtcactattgtgggcacttatttcttgttgaatgctgagaactatcattggcaatggacgtcgttcttctcggctgcatcaaccgccttgtatgtatatctatacgcaatatactattatcatgtgaagacaaagatgtcaggctttttccagacaagcttctacttcggctacacgttgatgttctgtctgggactaggcatactttgtggtgctattggctatctggggtcaactctgtttgtcaggagaatctacagaaacatcaaatgcgactaaactgcttctttggttctgtaggctattagcacttagcagatcatgtgttgttgagtaatgcttcgaagattctaattaacttttggaaactatacaggaggtagttctcccattgtttaccttggtacttacctttttggtctatatctacctccgtcatcaaactcgcactataaatgtatacctatattagttcggaattagtctcagcactgggattt

SEQ ID NO: 3957 - DNA, 2381 bp, Brachypodium distachyon
gaaatcacgaggcggcagctgggctcgtgagtctctctcgggccaaccccgacccaaggctcgcgaccgcctcctcctgctcagatctcgccgccggcagaaatgcgcccctcctctagctgcgggcgcggccgcctcctcctcctcctcgcgctcgccgccgttctcgccgtcgcttctccgccccgcgcgtccgcctcagagtctgaccacaagtacaaaactggagatccagttaagctctgggtgaataaagttggcccttacaataatcctcaagaaacctacaactatcacagccttccattttgtcagctgtctgagaatcctcctcataaatggggtggtcttggagaggtcttgggtggaaatgagctgattgatagtcagcttgacataaagttcttaagcgatgtggaaaagggctcaatttgtacacttgaactagattctaaaaagattcaacaatttgctgatgccattgaaaactcatattggtttgaatttttcatcgatgatctacctctttggggttttgttggagagactgacaagaacagtgaaaacaagcattatctttacacacacaagaacattcttgttaaatataatgataacaggataattcatgttaatctcacccaagagtctcctaagctccttgaagctggtaaaaagtttgatatgacatattcagtcaagtgggtagcaacagaagtctcatttgcacgccgttttgaagtttacctggactatcctttctttgagcaccagattcattggttctccattttcaattctttcatgatggttatttttctcacgggtttggtttcaatgatattgatgcgaacactcagaaatgattatgcaaaatatgctcgtgatgatgatgatctggagtcactggagagagatgttaatgaggaatctggatggaagcttgtccatggcgatgtatttcgtcctcctcgaagcttgacatttctttctgctcttgttggtatcggtactcagttggcagctcttatcctacttgtcattgtattggccattgttggcatgttatatgttgggcggggggctatcatcacaaccttcattgtgtgctatgctcttacatcttttatttcaggatatattagtgctggtctttactcaaggaatggtggcaaaaactggataaaagctatgatccttacagcatccctctttccattcttgcacttcgcaatcggttttgcactgaacacaattgctatcttctatggatcgttagcagcaataccattcggtacaatggttgtcatgtttgtcctttgggctttcatctcttttccccttgtgcttttgggcacggttgttggtaggaactggagtggggctcctaacaatccctgccgagtaaagactattccacgaccaatacctgagaggaagtggtaccttacaccttccgttatctcattgatgggtgggcttcttccctttggcagcatcttcattgagatgtactttgttttcacatcattctggaactacaaggtttattatgtctacggcttcatgttgctggtctttgtcattcttctaatagttaccatctgtgtcacaatcgtgggtacttatttcctgctgaacgctgagaactatcattggcaatggacttcgtttttctctgctgcatcaacagcactatatgtgtatctgtactccatctactactatcacgtgaagacaaagatgtctggctttttccagacaagtttctactttggctacacgttgatgttctgtctgggtctaggcatactatgtggtgctattggctatctaggatcaactctttttgtgaggagaatctacagaaacatcaaatgtgattaaattcacggtgcatacgggaggggtggcggtatcagatcatatgtggtgttattgctgtggaagcgagacctctgaactggattaatgccagttcctgactggggtttcagaaacaacgcagtaggccgtgctcccttggcttactcaattacaccccagttctcttgcctacttatttcttccctggagctgccctcgtaatgtatacttgtggtagctgacggatttagtacaagtgtctggtacatttaggttcttaattttttttgttacttttttttttctcttttcaaatcagaagtagggagtgagtatccatgtgttgcggcactgtctggattttcctgtccgaattgttgcatccaattcaaggatgtcagttaacagattatcgtctatcacgagcagatctttgtgtttatatatatctcaacatttatatatactcttcagtgggagcttaaacattggagtatctccagcagtaccgtccg

SEQ ID NO: 3958 - DNA, 2398 bp, Gossypium hirsutum
cattagaaaagagcgcgttacccgaaggtcaccaatcttagaaagaagacgagaaaacaagagagctggttcatgtaatttaaaacaaaaaaggaaaaaattctctcccaaatttatagttcgaattataaaaggggaagagaactcagcagcagtgtagtgttttgaatcgacctccggtttagcttcagatccgagcaccgtcatgtcatcttccgtagtctccactgttcgttcaaccttatctcttttcgttgtcgttttcatattcttttctccggttttcgcttctgagtcagatcacaagtatcaacctgatgatcctgttactctatgggtaaataaagttggtccatacaacaatccacaagaaacgtataactattacagccttcctttttgtcatccgggcaccaatccggctcacaaatggggtggtcttggtgaggtccttggtggaaatgaactgattgatagccaaattgatataaagttccaaaagaatgtggaaaaaagtaccatttgccaacttgaacttgatgaagcaaaggtcagggagttcaaggatgcaactgagaacagttattggtttgaattcttcatggatgacctgcctttatggggctttgttggtgagctgcatcctgataggaacagtgataatggcaagcatgtcctctacacacataagaatattattattaaatacaataaggatcagattattcatgtcaatctcactcaggagagtccaaaaccactggaagcagggagaatatttgacctgacttactctatcaaatggattccaactaatgtcacttttgctcgtcgctttgatgtctatttagactatcctttctttgagcaccaaatccactggttctctgtcttcaattcattcatgatggttatcttcctcactggtctggtgtccatgattttgatgcgaactctgagaaatgactatgcgaagtatgctcgggaagatgatgatctggaaactttggaaagggatgtgagtgaggagtctggttggaaacttgtccatggtgatgttttccggcctccttacaatttggttctgctttctgccgttgttggcacaggagctcagctagcattgcttgttctccttgtcatcttattggcaattgtgggaacgttgtatgtcgggagaggagcaattgtcactacttttatactgtgttatgcttttacatcattcatttctggttatgtgagtggtggcatgtactcacggaatgggggtaaaagttggataaagtcaatgatccttacagcgtgtctgttcccatttatgtgctttggcattggtttcatcttgaatacagtcgctattttctatggatctctagcagctattccttttggaacaatggtggttgttttcgtaatttgggctttcatttcattccccctggcccttcttggtacagttgttggaagaaactggagtggtgctccaaataatccttgccgtgtgaagaccattcctcgcccaattccggagaagaaatggtatttgaccccctctgtggtgtctttgatgggaggacttctgccatttggcagcatattcattgaaatgtattttatcttcacatccttctggaattacaaggtttattatgtatatggctttatgctgctggtcttcctgattctcatcattgtaactgtttgtgtgacaattgtggggacatatttcttgctaaatgctgagaattatcactggcagtggacatcgttcttctctgctgcctccacagctgtctatgtgtatttgtactccgtatactattaccacgttaaaaccaagatgtcaggcttctttcaaaccagcttctacttcggatacactttgatgttttgtcttggcttgggaattctctgcggagctgtaggttatcttggttccaatttattcgtacggaggatctatagaaacattaagtgtgactagaacattgctgtcggaaagtagaaccatcagcacttctgcgagaattctagttatcgaggcaataagtgctgagaggaagctcctgatcaggtacaggggaacccaacgaagcctatatattaaatcacggcgtttgacggtaacatgtattcttggtaccatggaacagggaaagccctgagattttgttttgcttctgttataattattattattattttattcctctggctgtaacttgaagccctggtttgttagatttcagatattgttttataattcagaaactagctaaagtataagacttgtgtcatttttacttgttatagatgtgtccttgacccctctgcttatagatgttgtcgtgtctgtaggaactgatacttaaattccatttggacttggactatt

SEQ ID NO: 3959 - DNA, 2559 bp, Populus trichocarpa
agaattaagaactcgcaaatctgagaaccctccttgcattacaatacaacactgtctctcactgtctctctttctataacgggaaaaatcagagcaactcgagagaattcatccgtccttgagaaaaagatttttgaaataaaaagagagagagatttggtttgatttgattgaccgaatcttgaccgtcagatccttccgtcaccggcgatcgccatgtcctccgccattcgatctcttcctctcatcgccttcatttccctcctcctcctctctcccgctctcgccttcgacgcagatcacaggtatggacaagaagaagcagttaagctttgggtaaacaaagtgggtccttataacaatccacaagagacatacaactattacagccttccattttgccatccatctagcaatgatgggacacacaaatggggtggccttggcgaggtccttggtggaaatgagcttattgatagccagattgacttaaagtttgcgaagaatgtggacaaagctgttatttgtcagcttgaacttgatgaagcaaaggtcaaacaattcaaggatgcaattgagaacagttattggttcgaattcttcattgatgatctgccattatggggttttgtgggtgaattgcgtcctgataagaacagtgataatggaaagcatctccttttcacgcataagagcatcactatcaaatataataaagatcagattattcatgtcaatctcacacaagagaatccaaagccccttgaagctgggacagtgttggagatgacatattctgtcaaatggtctttgactaatgtcagttttgcacgtcgctttgatgtttacttggactaccccttctttgagcatcagatccattggttttccatcttcaattcattcatgatggttatctttctcaccggtttagtgtcaatgattttgatgcggacacttagaaatgactatgcaaaatatgctcgggatgatgatgatctggtggagtctttggaaagagatgttagtgaggagactggctggaaacttgttcatggggatgttttccggccacctcgcagtttggttcttctctcagctgtcgttggaacaggtgctcagctagcaatgcttgtgcttcttgtcatcttgatggcaattgttggaacgttgtatgtcgggagaggagcaattgtcacgactttcatagtatgttatgctctcacatcatttattgctggttatgtgagtggggggatgtattctcgccatgggggtaaaagttggatcaagtcgatgattctcactgcctgtctatttccatttatgtgctttggcattgggttcatcctgaacacaattgctatattctatggatctttagctgcaattccctttggcaccatggtggttgtttttgtaatatgggctttcatctccttccctcttgcccttcttggcactgttgttggaagaaattggagtggtgctccgaacaatccatgtcgtgtgaaaaccattccccgaccaattcctgagaagaaatggtacctcacaccatctgtggtctcaatgatgggaggacttttgccctttggcagcatattcattgagatgtactttgtcttcacatccttctggaattacaaggtgtactatgtatacggctttatgctgcttgttttcctgattctcattattgtaacagtttgtgtaacaatagtggggacatatttcttgcttaatgctgagaactatcactggcagtggacttcattcttctctgctgcctcaacagctgtttatgtgtacttgtactcaatatattactactccatgaagactaagatgtcaggcttcttccagaccagcttctattttggatacactttgatgttctgtcttggattgggaattctctgtggagctgttggttatctaggctccaatttgtttgtgaggaggatctataagaacattaaatgcgactaggacttcaccgaggaaatttagacctgattgtgcttcatcagagcatgttcttattgttgagacaataatttcttagatgaagcctccgttcatgtatgggggacttaacaacgcaacagatgatggaacagggttttgggatggggtataaatttattctttctctggacaaagggaagccctgagatattttttggttttcttcccctgctgtaagtgatagtcgtaatttagaattgagagattgttttgtaatctgtgaagctagaaaaatatatcaaacgcctgtcgttttgctatacgttttgctatggaagtaggtgcgcagcacaaaggacgggtgcctattatcctttttttttttgttgaacttgtttttactgttcactgatattgggaagaatggtcatgtttaggttcaggaatgcatcttgctctgctgcaaaactctgctattttctgctgtttctgccaagtaatttgacattgaactttcttgtaactttgtgttcgacttgttcatgagaaacaaaatcctgacaaggccagttttcttgattcctaagc

SEQ ID NO: 3960 - DNA, 2162 bp, Zostera marina
agagtactgacggctgatcttagatacttactgatttgactcttgttacgaagcacgcaaccggtagtagcagatctcgccagacgagatgccctccaatgtccattccacggccatcttcctctctctcttccttctagtcttctcagcttcggcaggggagtccgatcacaagtatcaactagaagatccagttgtgctctgggtgaataaagttggtccatataataatccccaagaaacctacaactattacagccttccattttgtcagccacaagagaatcctgtacatagatggggtggtcttggggaggttctaggtggaaatgagctcattgacagtcagatcgaaataaaatatcagaagcctgttgataaggttaccatctgttccattgaccttgatgaagcaaaagtgacacagtttaaaaatgcaattgatagctcgtattggtttgagttttttatggatgatctgcctctttggggttttgttggtgagacccgaattgataaaagcaatgaaaataaacattttcttttcactcataaggatatcattattaaatataatggttttcagataattcatgtcaatctcacacaagatagtgcaaaacttttggaagttggaaagacattagatatgacatacagtgttaaatggataaagacaaacatcgaatttgcacatcgttttgatgtttatttagattatccattctttgaacaccagatccattggttttccatcttcaattcctttatgatggttattttcctcactggtctggtgtcaatgattctgatgcgaactcttagaaatgattatgcaaagtatgcccgtgaagatgatgaccttgaaactctggaaagagacgtgagtgaggaatcggggtggaagcttgttcatggagatgtcttccggcctcctcaaaatttgacagtcctgtcagctgtgatcggtacaggttctcagctggccatgcttgttcttatggtcattttattagcaatcattgggatgctttacattgggcgaggagcaattgtcacaaccttcattgtttgctatgctctcacttcatttattactggatatgtgagtggtggaatgtactcaaggaatggtggtaaaaactggattaagtccatgatcttctcagcatctctttttccatttatgtgttttggaataggcttcatactaaacaccattgcaattttctacggatcactggccgctatcccatttggaacaatggtggttgtttttataatttggggattcatatcattacccctagcatttcttggcactattgtagggagaaattggagtggttcgccaaataatccttgtcgtgtgaagacaattcctcgcccgatccctgaaaagaaatggcatctgacaccatctgcaatctccttaatgggaggccttcttccctttggcagcatattcatcgagatgtactttgttttcacatccttttggaattacaaggtttactatgtgtatggttttatgctgttagtttttatcatccttataattgtaaccgtctgcgtcaccattgtgggcacatatttcttgctgaatgctgagaactaccattggcaatggacctcatttttctctgctgcttcaaccgcgggatatgtttatttgtattctatatattactaccattcgaagactaagatgtctggatttttccagactagtttttactttggctacaccctgatgttctgcttgggcttgggtatcctctgcggtgctgtgggatatctagggtctacactgtttgtgagaagaatctacagaaacataaagtgcgactagtaagagccagcatttgtaattaacttttgggaagcattacatacaatttttcatatattagagtttgtaatatttacccttttattgtgagattataaccacagtcattgccaatttagcattttagctcttagcgtttagtatttatctataggaatcaggaggatgcgttgatgaataaactaatttactctaaagttagaaagttcctataataagcctgagccaaaatgcgcctggttaatctcatccgttcgttttttaaattttgatagattgaatgtcagccgttcagtgatgtaatgagttg

SEQ ID NO: 3961 - DNA, 2448 bp, Glycine max
gcaaggttggttggattgaacgtaaaaaaaataaaaaaaaaaatattagtaatcagtggcacacagaaaaaagagagagagtctcaatccttcaagggcaagtcctcctcctcgtcctcgtcgtgtttctctctgttctgattcgagatccgccatgtccatgctcttcagattctctctcctcctccctctcttcctctctacggcctttgcttccgagtcagatcataggtatcaacaagatgacccagttatcctttgggtgaacaaagttggtccttataacaatccacaagaaacgtacaattattacagcctaccattttgccgttcacctggtaatcctgcacacaaatggggtggtcttggtgaggtcctgggtggcaatgaactcattgatagccaacttgagataaagttcctaggaaatgtggagaagaccaccttttgccgtatagaacttgatgaggcaaaggttaaacagttcaaggatgcaatagagaataattactggtttgaatttttcatggatgaccttccattgtgggggtatgttggcgagttacatcctgataagaacggtgataatggcaagcatgtactttacacacacaagaacataaatgttcaatacaataaagatcagatcattcatgttaatctaacttatgacaacccaaggcctctggaagtaggaaaatctttggacatgacatattctgtcaaatggtctcctacgaatgtcacttttggacgccgatttgatgtatacctggactatccgttctttgagcatcagattcactggttctccatttttaattcttttatgatggtcatcttccttactggattggtgtcaatgatattaatgcgaacattgagaaatgactatgcaaagtatgcccgggaagatgatgatttggaaactctggaaagagatgttagtgaagaatctggctggaaacttgtgcatggtgatgtttttcggcctcctcgcagtttggttattctttcagctgttgttggtacaggtgctcagcttgcattgctggttcttcttgtcatcttgttggctattattgggatgctgtatgttggacgaggagccatagtcacaaccttcattgtttgctatgctctcacatctttcatttctggttatgtgagtgggggaatgtactcacgtaatgggggtaaaaattggattaaatccatgatccttacagcatcactgttcccattcatgtgctttggaattggttttattttaaacacaattgctatattctatggatctctagctgcaatcccctttggtactatggttgttgtctttgttatatgggcttttatctctttccctctagcacttcttggcacagttgttggaagaaactggagtggtgctccaaataatccatgccgtgtgaagaccattcctcgtcccattcctgagaagaaatggtacctcacaccatctgtagtttcgctgatgggaggactgcttccctttggcagcatattcatcgagatgtattttgtattcacttccttctggaattacaaggtgtactatgtctatggcttcatgctactggtttttctgattcttaccattgttactgtttgtgtgacaattgtggggacatactttttgttaaatgctgagaactaccactggcaatggacttctttcttttcagctgcctcaacagctgtttacgtgtatttgtactcagtatactactactatgtgaagacgaagatgtcaggcttcttccaaaccagcttctattttggatacactttgatgttttgtcttgggctgggaattctgtgtggagctgtgggttatcttggttcgaatttgtttgtgaggaggatctacagaaacatcaagtgtgactaaggcttttgtaggagtctgagaccagagcacttccatatgtttgttgctggagacaataaatttcttagaggaagcctctggtcatgtgtggggaccaaacaatgtttgcaggtagtaagtatcacagggttgaggatggatggggatgcattttttctctatgtctaggggatgtattcttttctctatactagggaggccctgaggttttttccctgactgtttgaaagcctagattagaatgcagggattgatctttataatttagatagttagcaaaatatcagactcgttgcttttttttttttttttatataaataggtgccctattgacggactgatgtctgattcccctacacggtttagctattgtacgtagaggggatgaagtctcggaaatgaattttgtgcttctgaattttgtatcaaatctgaatatcctctcttaactacttcctgcacatctctccctctttgagttttaaatcattgatgtgctttctttttgcttttcattttcgccttataacgtttt

SEQ ID NO: 3962 - DNA, 2358 bp, Castanea mollissima
aaaaaataaatagaagaaaatcaaatcaaacggaaagtcttttgagtttgaggagcgatcccttttaggaaagaaagaatctggaccgtcccagatccgtctctctccggccatcatccatgtcctccaccgtccgatctctctctttcctttccttcctcttcctctccctcttcctttctctctcctccgtatcgctcgcctccgactcagatcacaagtatcaaccagatgacccagttaccctttgggtaaataaagttggtccctataataatccacaagaaacttacaattattacagccttccgttttgtcgtccagaaggcaatgctggtcacaaatggggtggtctgggtgaggtcctcggtggaaatgaacttatagatagccagatcgatataaagtttgataaaaatgtggaaaaggctgtcatttgtcaactaaaacttgatgaggcaacggttaaacatttcaaggatgcaattgagaacaattactggtttgaattctttgtggatgatctgcctttatggggttttgttggtgcgttgcatccagataagaacagtgataatggcaagcatgttcttttcacgcataagaagattgttgtccaattcaacaaagatcagattattcatgtgaatctcactcaagagggcccaaagccattgacagttgggaaaacattagacatgacatattctgtcaaatggatgccaactaatgtcacttttgcacgtcgctttgatgtctatctggattatcctttctttgagcatcagatccattggttctccatttttaattcatttatgatggttatcttcctcactggtttggtgtcaatgatattaatgcgaactcttaggaatgactatgcaaaatatgctcgggaagatgatgatctggagactctggagagagatgttagtgaagagtctgggtggaaacttgtgcatggtgatgtttttcggcctcctcgcaatttggttcttctttcagctgttgttggtacaggtgctcagcttgcgttgcttgttctcctcgtcatcttattggcaattgttggaatgttgtatattgggagaggagcgattatcaccaccttcattgtatgttatgcccttacatcattcatttctggttatgtgagtggtgggatgtactcgcgccatggggggaaaaattggataaagtccatgatcctcacagcatctctatttccatttatgtgctttggtattgggttcatcttgaacacagttgctatcttctatggttctctggcggccattccctttggcactatggttgttgtctttgtcatatgggccttcatctctttccctctggcacttcttggtacggttgttggaagaaattggagtggtgctccaaacaatccttgtcgtgtgaagaccattcctcgtccaattcctgagaagaaatggtatctcacaccatctgtggtctcaattatgggtggattgctaccctttggcagcatattcattgagatgtattttgtctttacatccttctggaattacaaggtgtactacgtgtacggatttatgctgctggttttcgtgattctcattattgtcactgtttgtgtgaccatcgtggggacgtacttcttgctgaatgctgagaactatcattggcagtggacttctttcttctctgctgcctcgacagctgtctacgtgtacctgtattcgatatactactattatgtgaagaccaagatgtctggcttctttcagaccagcttctattttggatacactatgatgttttgtcttggtttaggaatcctctgtggagctgtgggttacctgggctctaatttgtttgtgaggaggatctacagaaacatcaagtgcgactaggattcttctgagaagaaagagactgcatgccacttcctggagcactttggttaggacacaataaattttgagaggaagcttgtggtcatgtacgagggacagcattttctacagattcaaatcacagggtttgaggatggggatgtattcttcttctttctctagactaggggatgccctgagattttttgtgttttccccggctgtaagtgaaaggccttaatttaggaatcagaaattgtttctatagtatggaaaatttagcaaaatatcggactcttgtcatttattattttcttctttgtccctttacaaataggttccctgtgtaaggattgatgcctaatttcctctgttctttttatttagttctgtacctgcacatctttgggacaaagaacctgtgagggaaaatacctttttagtaatgaattttgtgcttctgaatatgtaaaaa

SEQ ID NO: 3963 - DNA, 2174 bp, Euonymus alatus
gggtttctttattttgacgaaatttagtaacatatctagaaagcaaagctcagtgtcttctctccttgcaattacaaggtccgggccaattcgcagctcggcgaatccagaggaggagagaccctaaagcctgaattgatctttcttcgtgaaatctggaccgttagattggtgatcgccatgtcctccgctggccgattcgtctctctcttcgccctcattttcgtcttcctctttcccgctgcgtttgcctccgagtccgatcacaagtatcaactagatgatccagttgcactttgggtgaacaaagttggcccttataataatcctcaagagacgtataactattacagccttccattttgccgtccagctggtgatcctgctcataaatggggtggcctcggtgaggtccttggtggaaatgaacttatagacagcctgatcgacataaagtttggaaagaatgttgataaaagtctgatttgtcaacttgatcttactgcggagaaagtcaaacagttcaaggatgcaattgagaacagttattggtttgaatttttcatggatgaccttccattatggggctttgtcggtgagttacatcctgataagaacagcgataaccgcaagcatgttctttacacacacaagagcattacagttaaatacaataacgaccagatcattcatgttaatctctctcaagaaaccccaaagcccttggaagacgggagaactttggacatgacatactctgttaagtggattccaactaatatcacttttggacgccgttttgatgtttaccttgactatcctttctttgaacaccagatccactggttctccattttcaattctttcatgatggttatcttcctgactggtttagtgtcaatgatattgatgcggactctgaggaatgactatgcaaaatatgcgcgggaagatgatgatttagagactctggaaagggatgtgagtgaagagtctgggtggaaactggttcatggagatgttttccggcctcctcggaacttggttcttctttccgctgttgtggggactggtgctcagctagctttacttgtcctcctcgtcatcttactggcaattgtgggaacgttgtatgtcgggagaggggcaattgttaccactttcatagtgtgttatgctcttacatcattcatttctggttacgttagtggtggaatgtactcacgccatggtggtaaaagttggataaagtcaatgattctcacagcatctctatttccatttatgtgctttggtattggattcattttgaacacagttgcgatattttatgggtccctggctgctattccctttggcacaatggtggtggtttttgtgatttgggctttcatttcttttcccctagcgcttcttggtactgttgtgggcagaaactggagcggtgctcctaacaatccatgccgtgtgaagaccatacctcgtccgattcctgagaagaagtggtacctcactccgtcagtggtctcaatgatgggtggactgctaccatttggaagtatattcattgagatgtattttgtatttacatccttctggaattataaggtttactacgtctatggctttatgctactggttttccttattctcatcattgtaactgtatgtgtaacaattgtggggacatatttcttgctcaatgctgagaattatcactggcagtggacatcattcttctctgcagcttcaacagctgtctatgtgtacttgtactcgatatattactactacgtgaagacaaaaatgtttggcttcttccagaccagcttctactttggatacactttgatgttttgtcttggtttaggaatcctttgtggtgctgtcggttatttgggatccaacctgttcgtgagacgaatttacagaaacatcaagtgtgattaaaggctcttgggaagaaaagactgggtggtgcttccctgagctagctagtacatatgtggaaacaattaatcttaggaggaaccacgaagggagcccgtggtcgtgcatggagtaaccagcaatctttgcagatgcaaaatacagggtcttataggggggggaatgcaatgttctcttattggagtggggggaaatgacggagattttttctatttgtttcttta

SEQ ID NO: 3964 - DNA, 2390 bp, Cajanus cajan
aaaaaatagtaatgagttgcaaagagagaaagagagagagtcagaatcgttcaagttgaagttcaagttgaagggtcgtgtgttctctttctcttaagaattcagatccgccatgtccatcttctccagattctctctcctcttcctcttcctcctctctccggccttcgcctccgagtcggatcacaggtatcaacaagacgagcaggttatcctttgggtaaacaaagttggtccttataacaatccacaagaaacatacaattattacagcctaccgttttgccgtccacctggtaatgctgcacacaaatggggtggtctcggtgaggtcctaggtggcaatgaactcattgatagccaacttgatataaaattcctagcaaatgtggaaaagaccacctattgccgtgtggaacttgatgaagcaaaggttaagcagttcaaggatgcaattgagaataattactggcttgaattcttcatggatgaccttccattgtgggggtatgttggcgagctacatcctgataagaacagtgataatggcaagcatgtcctttacacacacaagaacattaatgttaaatacaataaagatcagatcattcatgttaatctaactcatgacaacccaaagcctctggaagtaggaagacctttggacatgacatattctgtcaaatggacccctactaatgtcacttttgcacgccggtttgatgtatacctggactatccgttctttgagcatcagattcattggttctccatttttaattcttttatgatggtcatcttccttactggattggtgtcaatgatcttaatgcgaactttgagaaatgactatgcaaagtatgctcgggaggatgatgacttggaaactctggaaagagatgttagtgaagaatctggctggaaacttgtgcatggtgatgtttttcggcctcctcgcagtttggttgttctttcagctgttgttggtacaggtgctcaacttgcattgctggttcttcttgtcatcttgttggctattgttggaatgttgtatgttggacgtggagccattgtcacaaccttcattgtatgctatgctctcacgtctttcatttctggttatgtgagtggagggatgtactcacgcaatgggggtaaaaattggattaaatccatgatccttacagcatcactgtttccattcatgtgctttggaattggatttatcttaaacacaattgctatattctatggatctctggctgcaatcccctttggtactatagttgttgtttttgttatttgggcttttatcgctttccctctagcacttcttggcacagttgttggaagaaactggagtggtgctccaaataatccatgtcgtgtgaagaccatccctcgtcccattcctgagaagaagtggtacctcacaccatctgtagtttctctgatgggaggactgcttccctttggcagcatattcattgagatgtattttgtattcacttccttctggaattacaaggtgtactatgtctatggcttcatgctactggtttttctgattcttatcatcgttactgtttgtgtaacaattgtggggacctactttttgttaaatgctgagaactaccactggcaatggacttctttcttttcagctgcctcaacagctgtttatgtgtatttgtactcagtatattactactatgtgaagacgaagatgtcaggtttcttccaaaccagcttctattttggatacactttgatgttctgtcttggactgggaattctctgcggagctgtgggttatctcggttcgaatttgtttgtgaggaggatctacagaaacatcaagtgtgactaaggcttttctaggagtctgagaccaaagcacttccatatgtttgttggtggagacaataaatttgttagaggaaggctctggtcatgtgtggggaccaaagaatgtttacaggtagtatcacagggttgaggatggggatgtattttttttctctatattaggggatgtattcattctctatgctaggaaagccctgagattttttccctgactgtggttgaaagccttgatttagaatgcagggattggtctttataatttagatagctagcaaaatatgagactcgttgctactacttttttcatcctttttataaataggtgcccgattgacggactgatgtctgattcccctacacggtttagctattgtacgtagaggggatgaagtctcggaaatgaattttgtgcttctgaattttgtatcaaatatcaatatcctttctaactactccctattccctgcacatctctccatgtttcagtttttaatcattgacgtgttatttttcgtttttgc

SEQ ID NO: 3965 - DNA, 1975 bp, Ambrosia trifida
cttcttctccgatcaatctcagccgttagatccaatctcgccggcgaccgccatgtcgtccgccgtccgatctctcctcttcatcgcctcatttcttattatctccaatcttgtcttcgcttctgaatatgatcacaagtatcagtcagatgaaccaattaccctttggtgaataaagtcgggccttacaataatccacaagaaacatataactattacagccttccgttttgtcgtccatctggtaaccctggtcataagtggggtggactgggtgaggtattaggtggaaatgagcttattgatagccaaattgacatcaaatttcaaaagaatgtggacaagactacaatttgtgagcttgaattagatgaatcaaaggttaagcagtttaaggaggctatagagaataactattggtttgaatttttcatggatgatctgccactgtggggttatgttggggagctacatactgataggaatagcgatagcaagcatatgctattcacccataagaatattactatacagtacaacaaagatcagatcattcatgttaatctcactcaagagaacccaaaaccactcgaagctgggaaaacactggacatgacttactcggtcaagtggactgaaactaatattagttttgcacatcgctttgatgtttacctggattaccatttctttgagcatcagattcactggttttccatattcaattcgtttatgatggttatcttccttactgggttggtttcaatgattctgatgcggactcttagaaatgactatgccaagtatgctagggaagatgatgatctggaaagtctggaaagagatgtaagtgaagaatctggttggaagcttgttcatggggatgtcttccggccacctcgtcatttggttatattgtcggccgttgttggaacaggtgctcaattggcactgctgattcttcttgtcatcttgtttgcaattgttgcaacgttgtacattgggagaggagcaattgtcactactttcatcgtttgttatgccctcacctcatttgtatctgggtacgtgagcggtggcatgtattcccgccatggtgggaaaaactggataaagtcaatgatcctgactgcatctcttttcccatttttgtgctttggaatcggctttgttttgaacacaattgctatattttatggatctttggctgcaattccatttggcacaatggtggttgtttttgtcatctgggctttcatctctttccctcttgctcttcttggtactgttgttggaaggaactggagcggggctccaaacaatccttgtcgtgtgaagactattccacgccctattcctgaaaagaaatggtatctcacaccatctgtggtctcaataatgggaggactgctaccttttggcagtatttttattgaaatgtacttcgtcttcacatccttctggaattacaaggtgtactatgtttatggattcatgctacttgttttcttgattcttatcatcgtgaccgtttgcgtgacaattgtgggaacatattttctgcttaatgccgaaaattaccactggcaatggacttcattcttctctgcagcctccacagctatttatgtctacttgtactcgatatattactattctgtcaagaccaagatgtcgggcttcctccaaactagcttttactttggatacacagccatgttctgccttggcttagggattctctgtggagctgtcgggtatttgggttctaatctctttgtgagacggatttaccggaacatcaaagtgtgattaaggcgcaaagcggccccacgtggcctcccaggttttgtagcttgttttgttgataccaaatgaaagatttaaatggggagttgaggggcttgttattatttgtaacttttgaggaatatgtagaagaaaggtttagagaaatgcaagactgttaatgtaa

SEQ ID NO: 3966 - DNA, 2496 bp, Phaseolus coccineus
ggtcggttagaatgaaggtaaaaattaatattagtaatgaatcagtggcacagagagaaaaagagagagtctcaatccttcaagggcaagtcctcgtcgtgtttctcttctctctcttctcttctcctctgagatcccccatggccgtcttcttcagattctcccttctcctcctcctccctctcttcctctctccggctttcgcttccgactcagatcacaggtatcaaccggaggagaaagttatgctttgggtgaacaaagttggtccttacaacaatccacaagaaacgtacaattattacagtctacccttttgccgtccacctggtcatcctgcacacaaatggggtggtcttggtgaggtcctgggtggcaatgaactcattgatagccaacttgagataaagttcctaggaaatgtggaaaagaccaccttttgtcgtctgcagcttaacgaagcaaacgttaaacagttcaaggatgcaatagagaataattactggtttgaattcttcatggatgatcttccattgtgggggtatgttggggagctacatcctgataagaacagtgataatggcaagcatgtactttatgctcacaagaacatcaatattcaatacaataaagaccagatcattcatgttaatctaactcatgacaacccaaggcctctggaagtaggaaaaactttggacttgacatattctgtgaaatggactcctacgaatgtcacttttgcacgccgatttgatgtatacttggactatccattctttgagcatcagattcactggttctctatttttaattcttttatgatggtcatcttccttactggattggtgtcaatgatattaatgcgaactttgagaaatgactatgcaaagtatgctcgggaagatgatgatttggaaactttggaaagagatgttagtgaagaatctgggtggaaactcgtgcatggtgatgtttttaggcctcctcgcagtttggtcattctttcagctgttgttggtacaggcgcccagcttgcattgctggttttcctcgtcatcttgttggctattattgggatgttgtatgttggacgaggagccatcgtcactaccttcattgtatgctatgctctcacatctttcatttctggttatgtgagtggggggatgtactcacgaaatgggggtaaaagttggattaagtccatgatccttacagcatcactgttcccattcatgtgctttggaattggttttattttaaacacagttgctatattctatggatcactagctgcaatcccctttggtactatggttgttgtctttgttatatgggcctttatctctttccctctagcacttcttggtacagttgttggaagaaactggagtggtgctccaaataatccatgtcgtgtgaagaccattcctcgtcccattcctgagaaaaagtggtacctcacaccatctgtagtttctctgatgggaggactgcttccctttggcagcatattcatcgagatgtattttgtattcacttccttctggaattacaaggtgtactatgtatatggtttcatgctactggtttttctgattcttatcattgttactgtttgtgtgacaattgtggggacatactttttgttaaacgctgagaactaccactggcaatggacctctttcttttcagctgcctcaacagctgtttacgtgtatttgtactcagtatactactactttgtgaagacgaagatgtcaggcttcttccaaaccagcttttattttggatacactttgatgttttgtcttggactgggaattctctgtggagctgtaggttatcttggttcgaatttatttgtgaggaggatctacagaaacatcaagtgtgactaagggtcctagaagtctgagaccagagcacttccacatgtttgttgctagacacaataaatttcttcgaggaggtctctggtcatgtgtggggaccaagcagtgtttacaggtagtaagtatcacagggttgaggatgggatgtattctttctctatattaggggatgtattctttctctatggtagggaagccctgagatttttttccctgactgtgattgaaagccttgattagtagaatgcagggattggtctttataatttagatagttagcaaaatatcagactcgttgctactttttttcgtccttctataaataggtgccatattgacggactgatgtcggattcccctacacggtttagctattgtacgtagaggggatgaagtcacggaaatgaattttgtgcttctgaattttgtatcaaatctgaatatcctttctaactatttcctgcctccacatttctccttctttggcttttaaatcattgacgttttccccctctccaatccaatgcttgttaggctgcatacatttctgcctctatcaccatgttaaccatgaataaatgagatcaacattctgttc

SEQ ID NO: 3967 - DNA, 2379 bp, Hordeum vulgare
gcagctctctcgggccaaacccgaccgaaggctcgcgaccgcctcctcttcatcctcagatctctccggcggcggaatgctcccctccccccgcggcagcggccgcagaagcctcgtcctcgtcctctcgctcaccgccgtcctcgccttcgcttctccgcaccgcgcgtccgcctcagagtccgaccacaagtacaaatctggagattcagttaagctctgggtgaataaagttggaccttacaataatcctcaagaaacttacaactatcacagcctcccattttgtcagccatctgagaaccctgggcacaagtggggtggtcttggagaagtcctgggtgggaacgagttgattgatagtcagcttgacataaagttcttaaaaaatgtggaaagggggtccatttgcacactggaactagattccaaaaagattcaacaatttgctgatgccattgaaagctcgtactggtttgaatttttcatagatgatctgcctctttggggtttcgttggagagactgacaaaaacagtgaaaacaagcactatctttacacacacaagaatattcttgtaaagtacaacgataacaggataattcatgttaatctcacccaagagtctccgaagcttcttgaagctggcaagaagttggaactgacatattcagtgaagtgggtaccaacagatgtttcatttgcacgccgttttgaagtttacctggactatcctttctttgaacaccagattcactggttctccattttcaattctttcatgatggttatttttctcactggtttggtttcaatgatattgatgcgaacactgagaaatgattatgcaaaatatgctcgcgatgatgatgatctagagtcactggagagagatgttaatgaggaatctgggtggaaacttgtccatggtgatgtatttcgtcctcctagaagcttgacacttctttctgctcttgttggtatcggcacccagctggcagctcttatcctacttgtgattgtattggccatcgttggcatgttatatgttgggcgaggggctatcatcacaaccttcatcgtgtgctatgctcttacatcttttatttctggatatgttagtgctggtctttactcgaggaatggcggtaaaaactggataaaggctatgatccttacagcatccctctttccattcttgcactttgccattggctttgcgctgaatacaattgcaatcttctacgggtcattagcagcaataccatttggtacaatggttgtcatgtttgtcctttgggctttcatatcttttccgctggtacttttgggaacggtcgttggtagaaactggagtggggctcctaacaatccctgccgagtaaagactattccacggcctattcctgagaggaagtggtaccttacaccttctgtcatctcattgatgggcgggcttcttccctttggcagcatcttcatcgagatgtactttgtgttcacctcattctggaactacaaggtgtattatgtttacggcttcatgttgctggtctttgtcattcttctaatagttacaatctgtgtcacaattgttggtacttatttcttgctgaatgctgagaactatcattggcaatggacttcgtttttctctgccgcatcaacagcgctatatgtgtatctgtactccatctactactatcatgtgaagacaaagatgtccggctttttccagacaagtttctactttggctacacattgatgttctgtcttggtctgggcatactttgcggtgctattggctatgtagggtcaactctttttgtgaggagaatctacagaaacatcaaatgtgattaatttcctgctacatatgtggggtgggggcggagcagtatcagaagaaatcatatacgtgccattgctttggaagtgaggccttcgaaatggattaatgctagttcctgattagggtttcagaactacgccccgttcgcttattccatcacaccccttctttttgcatacttatttgttccctggagctgctctcatagtgtatacatctgtggtagcttaggagttcagtacaagtgcctggtgcaggttcttatttttctttgtttcttttgttgcattcctccttttcaaatcagaaataggaagtgagtatccatgcggcactgtctggacttcccctctgaattgttgcgtccaattcaaggatatcatgtactacgtgagatctgtgtatttatatatatcaacatttaatgcatgagagtatgtgtgtcctctatcatgttgggaaaattctgtgaaaatcctttcgatgtagcggtgcttttgtaactgtgatgtctatttatttgtaa

SEQ ID NO: 3968 - DNA, 2337 bp, Humulus lupulus
aaacgttgggaagtcgcaagactccttttctcgctcttaaaagcaagctaagatatattaatactcagacaagacagaaatctgagtacagagccggagcctcttatcgatctctgaccgtccagatcccactgtcgccggcgatcgccatgttctccgccgttcgatctctccctctcttcacttttgcttatctttttcttcttcttcttctctcgccggtattcgcttccgagtcagatcacaagtataaaaaagaggatgcagttacactttgggtaaataaagttggtccttacaacaacccgcaagaaacatacaactattatagccttcctttttgtcatccggctggaagttctgctactcacaaatggggtggtcttggtgaggtcttgggaggaaatgaactcattgagagcgggattgagataaagttccaacaaaatgtggagaagactgtcatttgtacacttcaactcaatgaagcaaaggttaaacatttcaaggatgcaattgagaatagctattggtttgaattctttatggacgatctaccattatggggctttgttggtgagttgcatccggataagaacagtgataatggcaagcatgtgctgtacacacacaagaatattaatgttcagtataataatgatcagataatacatgtgaacctttctcaagagagtccaaagcctttggaagttggccgaacattggacctgacgtattctgtcaaatggactccaaccaatgtcacctttgcacgtcggtttgatgtttatttggactacccgttttttgagcatcagatccattggttctcaatattcaattcattcatgatggttatattcctcactggattggtttcaatgatattaatgagaactttgaggaatgactacgcgaaatatgcacgagaagacgatgatcttgaaactttggaaagagatgtaagcgaagagtctggctggaaacttgttcatggggatgttttccggcctcccaggaacttagtgattctttccgctgtcgtaggaacaggtgcccagttagcattgcttgttctccttgtcatcttgttggcaattgtgggaatgctatatgttgggagaggagcaattgttacaacgttcatagtatgctatgctcttacgtcattcatttctggttatgtaagtggtgggatgtattcgcgacatggtggtaaaagctggataaagtcgatgattctgacagcatccctatttccatttatgtgctttgggattggatttatcttgaacacaattgccattttctatgggtctttagcagctatcccatttggcacaatggtggttgtcttcgtcatttgggctttcatctcttttcctttggcacttcttggtacagttgttggaagaaattggagtggtgcccctaacaatccttgtagagttaagaccattcctcgacctattcctgagaagaagtggtacttgacaccatccgtagtctcattgatgggaggacttctaccctttggcagcatatttattgagatgtactttgtcttcacatcattctggaattacaaggtgtactatgtttatggttttatgctgcttgtttttctaattctcgttattgtcactgtttgtgtgacaattgtgggtacatatttcttgctgaacgctgagaactatcactggcaatggacttctttcttttcggctgcttcaacagccgtgtatgtgtacttgtattcaatctattactactacgtaaagacgaagatgtctggtttcttccagaccagcttctattttggatacactatgatgttttgtcttggactgggaatcctctgcggggctgttggttatctcggctcgaatttgtttgtgaggaggatctacaggaacatcaagtgtgattaagatttctcgaagaggaacaacctgatagagcttcctgaattgcattgttgataaaatgcagttggagaggacaattattggtcatatatgaagaagccacaatatattcaggttgaaatgatggtgttattaggatgaggatgtattcttctttctctggttttggggaagccttgagattttcctctttttttgtcttttttacttttactctacgtttccgtttcccgtcgtagtagtagaacgtacttaattagatgatgagtattattactatacttacttaaagtaaattagactaaattagtactgtctattactttattttacttttactttcgtttacgtttacctttttactatagtaggctcctccagtagtagacacactgctattgtgtctctc

SEQ ID NO: 3969 - DNA, 2444 bp, Quercus alba
acactcaaacaaaccccactctaaaaaggaaggggggtatagtacataggaaggaaagaaaatttttacaaaaaaataaataggaaatcaaagctataacggaaagtctttgagcttgagcgacccttttagtaaaggaagaatctggaccgtcccagatccgtctctctccggccatcacccatgtcctccaccgtccgatctctctctttcctttccttcctcttcttcttcctttccctctcctccgtatcactcgcctccgactcagatcacaagtatcaacaagatgacccagttaccctttgggtaaataaagttggtccctataataatccacaagaaacatacaattattacagccttccgttttgtcgtccaaaaggcaatgctgctcacaaatggggtggtctgggtgaggtcctcggtggaaatgaacttatagatagccagatcgatataaagtttgataaaaatgtggataaggctgtcatttgtcaactggaacttgatgaggcaacagttaaacatttcaaggatgcaattgagaacaattactggtttgaattctttgtggatgatctgcctttatggggttttgttggtgcgttgcatccagataagaacagtgataatggcaagcatgttcttttcacgcataagaaaattgttgtccaattcaacaaagatcagattattcatgtgaatctcactcaagagggcccaaagcctttgacagttggaaaaacattagacatgacatattctgtcaaatggatgccaactaatgtcacttttgcacgtcgttttgatgtttatctggattatcctttctttgagcatcagatccattggttctccatttttaattcatttatgatggttatcttcctcactggtttggtgtcaatgatattaatgcgaactcttaggaatgactatgcaaaatatgctcgggaagatgatgatctggagactctggagagagatgttagtgaagagtctggttggaaacttgtgcatggtgatgtttttcggcctcctcgcaatttggttcttctttcggctgttgttggtacaggtgctcagcttgcgttgcttgttctcctcgtcatcttattggcaattgttggaatgttgtatattgggagaggagcgattatcacaactttcattgtatgttatgctcttacatcgttcatttctggttatgtgagtggtgggatgtactcgcgccatggggggaaaaattggataaagtccatgatcctcacagcatctctatttccatttatgtgctttggtattgggttcatcttgaacacagttgctatcttctacggttctctagcggccattccctttggcactatggttgttgtctttgtcatatgggccttcatctctttccctctggcacttcttggtacagttgttggaagaaattggagtggtgctccaaacaatccttgtcgtgtgaagaccattcctcgtccaattcctgagaagaaatggtatctcacaccatctgtggtctcaattatgggtggattgctaccctttggcagcatattcattgagatgtattttgtctttacatccttctggaattacaaggtgtactatgtgtacggatttatgctgctggtttttgtgattctcattattgtcactgtttgtgtgaccattgtgggtacgtacttcttgctgaatgctgagaactatcattggcagtggacttctttcttctctgctgcctcaacagctgtctacgtgtacctttattcgatatactactattatgtgaagaccaagatgtctggcttctttcagaccagcttctattttggatacactttgatgttttgtctcggtttaggaatcctctgtggagctgtgggttacctgggctctaatttgtttgtgaggaggatctacagaaacatcaagtgcgactaggattcttctgagaagaaagagactgcatgccacttccctgagcacttcagttaggacacaataaattttgagaggaagcttgtggtcatgtacgagggacagcattttctacagattcaaatcacagggtttgaggatggggatgtattcttcttctttctctagactaggggatgccctgagattttttgtgttttccccagctgtaagtgaaaggccttaatttaggaatcagaaattgtttctatagtatggaaatttagcaaaatatcggactcttgtcatttattattttcttctttgtccctttacaaataggttccctgtgtaaggattgatgcctaatttcttctgttctttttatttagttctgtacctgcacatctttgggacaaagaacttgtgagggaaaatacttttttagtaatgaattttgtgattctgaatatgtaagaatttacagattttgtttctatacctgcata

SEQ ID NO: 3970 - DNA, 2250 bp, Chelidonium majus
gaagataaattaaaatgcacacaatcccttcttttcgcaaatctataattattattataagtttagtgtaaaatctcaggctctttctctttctctctcttctttctctctctaaacgctttttttctcacagtctatagatccggccgaacgcggacgtaatggtttccaccgttttcttcttcgccttctctctctgcattctcttcgtcgtccatcctacttttgcttctgagtcagatcacaagtatcaaccagaagatccagttacgctttgggtaaacaaggttggcccttataataatccacaagaaacatacaactactacagccttcccttttgtcagtcacctggcaatgcagctcacaagtggggtggtctgggggaggttcttggtggaaatgaactcattgatagccagatagacataaagtttcagaaaaatgtggacaagagttccatttgtgagattaatctggatgccgcgaaggttaagcattttaaagatgcaattgagaattcctattggtttgaattcttcatggatgatctgcctttatggggctttgttggtggaccacattctgataaaaacagcgataacaacaaacacctgctttatacacataaaaatattgttgttaaatacaatggagagcagattattcatgttaatctcacccaagaaagtcctagacccttggaagtgggaaaggtgttagacatgacatattcgatacagtggattccaacaaatatcacttttgcacggtcgttttgatgtttacttggtattaccctttctttgagcaccagattcattggttctcgattttcaattcttccatgatggttatcttcctcactggtttggtatcaatgattttaatgagaactctacgaaacgactatgcaaaatatgctcgggaagatgatgatctcgagaccttggaaagagacgtgagtgaggagtctggttggaaacttgtccatggggatgtttttcgccctccccgcaatttggttatactttcagcagttgttgggacaggtgctcagcttgcgatgcttgttctccttgtcatcctattggcaatcattgggatgttatacgttggccgaggagcgattgtcactacttttatagtatgctatgctcttacatcattcatttcgggttatgttagtggtggtctgtattcacggcatgggggtaaaagctggattaagtcgatgatcctcacagcatcactctttccattcttgtgctttgggatcgggttcattctaaatacaattgctatattttacggatctctggctgcaattccttttggaaccatggtggttgtgtttgtcatttgggctttcatttctttccctctggcacttcttggtacagtcgttggaagaaactggagtggtgctccaaacaatccctgtcgtgtgaagaccattcctcgtccaatccccgagaagaaatggtatctcacgccgtctattgtctcactgatgggagggctgctcccctttggcagcatattcatcgaaatgtattttgtcttcacatcattttggaactacaaggtgtattatgtctatggcttcatgttgctggttttcgtaattctagttattgttactgtctgtgttacaattgtgggaacatatttcttgctcaatgctgagaactatcattggcaatggacttcattcttcgctgctgcttcaacgtctgtctatgtgtacctgtactccatatactactattacgtgaagaccaagatgtcaggattcttccagactagcttctattttggatacactatgatgttctgtcttggtttaggaatcctttgtggtgctgttggttacttgggatcaactttattcgtgaggcggatttacagaaacatcaaatgtgactagtaagggggtgagccaaattactttcagtcccatcattgagatagaagtatattagaaaaagcctagttacccgatggtctgacagatggaacccacagagtttgatggggtattctcgtctctggacgtgggaaggttctatttttttcccggctgtaagtgtaagccttcatgacctaatttagagtacagagactgtgttataatctaggaagtaagcatattatactctcatattaccttttttcttttgttcttttcatcccaagcatgggaatttgtttctcatattgactcgacaaatggatacccattgtaat

SEQ ID NO: 3971 - DNA, 2396 bp, Euonymus alatus
gaaagcaaaactcagtgtcttctctccttgcaattacaaggtccgggccaattcgcagctcggcgaatccagaggaggagagacctaaagcctgaattgatctttcttcttgaaatctggaccgttagattggtgatcgccatgtcctccgctggccgattcgtctctctcttcgccctcattttcctcttcctctttcccgctgcgtttgcctccgagtccgatcacaagtatcaagtagatgatccagttacactttgggtgaacaaagttggcccttataataatcctcaagagacgtataactattacagccttccattttgccgtccagctggtgatcctgctcataaatggggtggcctcggtgaggtcctcggtggaaatgaacttatagacagcctgatcgacataaagttcggaaagaatgttgataaaagtctgatttgtcaacttgatcttactgcggagaaagtcaaacagttcaaggatgcaattgagagcagttattggtttgaatttttcatggatgaccttccattatggggctttgtcggtgagttacatcctgataagaacagcgataaccgcaagcatgttctttacacacacaagagcgttacggttaaatacaataacgaccagatcattcatgttaatctctctcaagaaaccccaaagcccttggaagacgggagaactttggacatgacatactctgttaagtggattccaactaatatcacttttggacgccgttttgatgtttaccttgactatcctttctttgaacaccagatccactggttctccattttcaattctttcatgatggttatcttcctcactggtttagtgtcaatgatattgatgcggactctgaggaatgactatgcaaaatatgcgcgggaagatgatgatttagagactctggaaagggatgtgagtgaagagtctgggtggaaactggttcatggagatgttttccggcctcctcggaacttggttcttctttccgctgttgtggggaatggtgctcagctagctttacttgtcctcctcgtcatcttactggcaattgtgggaacgttgtatgtcgggagaggggcaattgttaccactttcatagtgtgttatgctcttacatcattcatttctggttatgttagtggtggaatgtactcacgccatggtggtaaaagttggataaagtcaatgattctcacagcatctctatttccatttatgtgctttggtattggattcattttgaacacagttgcgatattttatgggtccctggctgctattccctttggcacaatggtggtggtttttgtgatttgggctttcatttctttcccgctggcgcttcttggtactgttgtgggcagaaactggagtggtgctcctaacaatccatgccgtgtgaagaccatacctcgtccgattcctgagaagaagtggtacctcaccccttcagttgtctcaatgatgggtggactgctaccatttggaagtatattcattgagatgtattttgtcttcacatccttctggaattataaggtttattatgtgtatggctttatgctactggttttcctgattctcatcattgtaagtgtttgtgtgacaatcgtggggacatatttcttgctcaatgctgagaattatcactggcagtggacatcattcttctctgcagcctcgacagctgtctatgtgtacttctactcggtatattactactatgtgaagacaaaaatgtcgggctttttccagaccagcttctactttggatacactctgatgttttgtcttggtttaggaatcctttgtggtgctgtcggttatctgggctccaacctatttgtgagacgtatctacagaaacatcaagtgtgattaaaggctcgtgggagaaaaagacctgaaagtgcttccctgagctagttattattacatacgtggaaacatttaatctcaggagggagaccattgtcgtgcatgaagtgcccagcaatgttttgcagatgctaaacacagggtcgtagaagggggatgtattgttctctcatgggatttgggggaatccctgagattttttctttgtttctgcaaccttttccccatccattactgaaagccttaatttagatttgagatgtgtgttttctttttattatctgagaagctagctagtgagacaacagagaccgttacttctgcaaatttttgatatttaatctttttaacaaataggtgtcctatgtaaagtgtaggtgctcaatatccccttctctagattttgtttttgctcctaggaagttgttgaaaagtaaaattttcctggtccgaatccggtccagaagatactatttctatgaatccatc

SEQ ID NO: 3972 - DNA, 2296 bp, Papaver somniferum
aaatcaagcaaaattctattacattctttaacaggtaacaccaaacacaggaaaaacaaaaaagaaagaagaagaagaagactgaagagaagaaagctttgagaaattatctttttctctctgttttctgtcaccgtgtaacattatcgttaaggagctgaaaataataaagttagggtttttgtagatccgcgatgcatcgatttttctatctattctttctttccccttttctgttacacttcatttctcctaatctcgcttctgaatctgatcacaagtattcacaagatgaatcagtaacgctatgggtaaacaaggttggtccatacaataatcctcaagaaacgtataattactacagccttccgttttgtcaattatctggtggtaatggcaatgctgctcacaagtggggaggacttggtgaggttttgggtggaaatgagctcattgatagccagattgacattaagtaccgaaaaaatgttgataagagcacaatttgtgagcttgaactggatgctgcaaaggttaaacagttcaaggatgcaattgagaacacttattggtttgaattttttatagatgacttgcctttatggggctatgttggtgaactgcaccctgacaaaaacaatgataacactaagcatgtgctttacacacacaagagtattacctttagatacaatgaagatcagattattcatgtcaatctcactcaagaggaccctaaacccttagaagcaggaaaaaccttagacatgacatactcagtcaaatggatcccaacaaatatcaccttcgggcggcgttttgatgtttacctcgactaccccttctttgagcatcagattcattggttttctatcttcaattctttcatgatggttatctttctcactggtttggtctcgatgatacttatgcgaactcttagaaatgactacgcaaaatatgctcgggaggatgatgatcttgagactctggaaagggatgcgagtgaagagtctggatggaaacttgtccatggagatgtcttccgttcaccccgcaatctggtcttactttcagcagttgttggtactggtgctcaacttgcgatgcttgtgctgcttgtcattctgttagcaatcattgggatgttgtacatcgggcgaggagcgattgtcaccacattcattgtatgttatgctcttacatcgttcatttctggctatgtgagtggagggttgtactccaggagtggtggtaaaagctggataaaatcaatgatccttacggcctcactttttccatttatgtgctttgggattggctttgcactgaatacaattgccatattctacggatctctagccgctattccttttggaacgatggtagttgtttttgtcatctgggccttcatttccttccctctagcacttcttggtactgttgttggaagaaactggagtggtgctccaaacaatccttgtcgtgtaaagaccattcctcgtccaatccctgagaagaaatggtatctcacaccgtcggttgtctcactaatgggaggtcttcttccctttggcagcatatttattgagatgtattttgtcttcacatccttctggaattacaaggtgtactatgtctatggatttatgttactggttttcctaattctggttatcgttactgtctgtgttacaattgtcggtacatatttcttgctgaatgctgaaaactaccactggcaatggacttcattcttctctgctgcatcaactgccatctacgtgtacctctactctatttactactactatgtgaaaactaggatgtccggcttcttccaaactagcttctattttggatacactgcgatgttttgtctcggtttaggaattctatgtggagccgttggttatctgggatctactttatttgtgagaaggatatacagaaacatcaagtgtgactaaactgaataaagtatcaaatactgctgctaaatatggtgagtgcatgcagcaattttgttgtcaaaacaaaaagccctttgcgaaattgcctggttgccgtaccttggcaaactcccctgaagatttacaggattataatccctatagcagggatctcaagatgaggaaatttttcttcttttttttttttatctctggactctgggaggaggctttagttttccgacttgtaagtgaaagccttctttttacacataattttagagggttcagagatctgtgtcataattcagaacatctcactgttactctcacaaccacttccc

SEQ ID NO: 3973 - DNA, 4520 bp, Papaver somniferum
ataatgtgagaataaacatgagaatgttgtataaatcaaaagcgattcagacaaatagagacttcagtttgtctaaaaaggaaagactttctgagccccacaatagtcgatacctacaacgtggtggactcaataccttggaaacatgtagagttacaaaatggaagaagcccccattgatagatactctcaacttattacacaaacaaaaaacataaaagttgagaaagagagctacaaaatgccaaacacaactgatggttggctagaaaccaatgtttttgaaatgcaatctaaggaacaggatagtcaccctacacctacatcattaaagccctaactatcttcaaacctaggaatgttctcagggccagaaataaaaaagacaagaaaagaaggaaaacataagctgaggaaaataacttctccaaattatactaaagcaaaaagatatatgataggaggtccagaaaatagcagcagaagcctttcattaccctcccaatataaaactgtcatctgatttacttcacgacgtcaatacttaagacttcacaacacagatcttaatgactgaggctcccccaatacgatggagtgccacaattgcatccccaggtttgcacaaattcctcttaatagcagacttgagggcagcttccagaatcacctcagttgattcggtgtctgtggccttggctgaaccttcggcaagtaagggaattagtcctctgtagcacagactctgtcttgctggagtttcatcactgcaggtccagttgaaggagtcagttgtcagaactgggaccactacgttaaggattggtactgctggcctgtacttagccaccaacttcgctgtagttccaccacgagtcatcacaacaataagggtggctctagccttgttagctgttcggacagcagaagaggcaagactttccaacgggctcattggaagtggggtggacctaatcatctccttgaagatggcattataatcaagggaagattcagcttcaatgcatatcctggccatgatcttcactgcaagctctgggtaggccccagctgcactctcaccactgagcatgacacagtcggtaccgtctagaacagcattggcaacatcagtggcttcagccctggtgggtcttggggacttgatcatcgactcaagcatctgggtggcagtaaccacaggcttccctacaaggttgcacttgtagatcatcatcttctgtgcaagaaagatcttctccactggaatctccattccaagatcacctctagcaaccataaaagaatctgtctcgcgaaggatctcatcgaagttgaccactccttcctgattctcaacctttgacatcagctgaatgctttttgaatgtggtccaagaagcgttcggacattgacaagatctgagcccttgcgcacaaacgatagagcaatcatatctatcttgttaggaacaccccattgcatgatgtcctctttgtccttctctgtgagagttgggagatcaaccacaataccagggagatttacattctttctctctcctaggacagcagtgttctcacatcgacatctcacagttcctgcacctacgtcacaagacaacacagtaagtgtgatggttccatcggcacacaagatggtatttccaggcttcacgtcttctggaagctttttgtaactcatagtaattgtctttccatcccctttcaagtcgtagtctgtggagattgtaacttcctggccctctttaagttgaacaggtttttcatccacaaggaatccagttcggatctcaggtcccttagtatcgagcataacagcacacatgatctcagttttctgcatagcaattttaagattatccaaagtctcttgatgatatgaatgactcccatgtgagaaattgaatctagcaacattcattccagctttcaatagctttgaaatcatttcaacagatctagaagctggtccaagtgtacaaacaatctttgtctttggaattctaccatcatttggtaattcctttaagatcccttcaatatcaatattcgccattaattgaatctacacttccaaaaaccctttatagaatatgctgatgagatccaagtcttgatcagaaagaaataagaggagaggagaaagctttgagaattatctttttctctctgtttctgtcaccgtgtaacattatcgttaaggagctagaaataataaagttagggttttgtagatccgcgatgcatcgatttttctatctattctttctttccccttttctgttacacttcatttctcctaatctcgcttctgaatctgatcacaagtattcacaagatgaatcagtaacgctatgggtaaacaaggttggtccgtacaataatcctcaagaaacgtataattactacagccttccgttttgtcaattatctggtggtaatggcaatgctgctcacaagtggggaggacttggtgaggttttgggtggaaatgagctcattgatagccagattgacattaagtatcgaaaaaatgttgataagagcacaatttgtgagcttgaactggatgctgcaaaggttaaacagttcaaggatgcaattgagaacacatattggtttgaattctttatagatgacttgcctttatggggctatgttggtgaactgcaccctgacaaaaacaatgataacactaagcatgtgctttacacgcacaagagtattacctttagatacaatgaagatcagattattcatgtcaatctgactcaagagaaccctaaacccttagaagcaggaaaaaccttagacatgacatactcagtcaaatggatcccaacaaatatcaccttcgggcggcgtttttatgtttacctcgactaccccttctttgagcatcagattcattggttttctattttcaattctttcatgatggttatctttctcactggtttggtctcgatgatactcatgcgaactcttagaaatgactacgcaaaatatgctcgggaggatgatgatcttgagactctggaaagggatgtgagtgaagagtctggatggaaacttgtccatggagatgtcttccgttcaccccgcaatctggtcttactttcagcagttgttggtactggtgctcaacttgcgatgcttgtgctgcttgtcattctgttagcaatcattgggatgttgtacatcgggcgaggagcgattgtcaccacattcattgtatgttatgctcttacatcgttcatttctggctatgtgagtggagggttgtattccagaagtggtggtaaaagctggataaaatcaatgatccttacggcctcactttttccatttatgtgctttgggattggctttgcactgaatacaattgccatattctacggatctctagccgctattccttttggaacaatggtagttgtttttgtcatctgggccttcatctccttccctctagcacttcttggtactgttgttggaagaaactggagtggtgctccaaacaatccttgtcgtgtaaagaccattccccgtccaatccctgagaagaaatggtatctcacaccgtcggttgtctcactaatggggggtcttcttccctttggcagcatatttattgagatgtattttgtcttcacatccttctggaattacaaggtgtactatgtctatggatttatgttactggttttcctaattctggttatcgttactgtctgtgttacaattgtcggtacatatttcttgctgaatgctgaaaactaccactggcaatggacttcattcttctctgctgcatcgactgccatctatgtgtacctctactctatttactactactacgtgaaaactaggatgtccggcttcttccaaactagcttctattttggatacactgcaatgttttgtctcggtttaggaattctatgcggagccgttggttatctgggatctactttatttgtgagaaggatatacagaaacatcaagtgtgactaaactgaataaagtgtcaaatactgctgctaaacatggtgagtgcatgcagcaattttgttgtcaaaacaaaaagccctttgagaaattgcctggttgccataccttggcaaactcccctgaagattacaggattataatccctatagcagggatctcaagaatgaggaaatttttcttctttttgttttatctctggactctgggaggaggctttagttttccgacttgtaagtgaaagccttctttttacacataattttagagggttcagagatctgtgtcataattcagaacatctcactgttcctctcacaaccacttctctttcattttctttttcttaggttttttatatttgttactcttaattatatgcccttaattgacagttctttctctccaaaattataggttgtactttatgtaattgactactgtgccgtctgtgcacttttttatcttttctttctttccgctgt

SEQ ID NO: 3974 - DNA, 2361 bp, Glycine max
acagaaaagaaaagagagagagtctcaatccttcaagggcaagtcctcgtcttcgtcgtgtttctcttctctgttctgattcgagatctgccagccatgttcgtgctcttcagattctctctcctccctctcttcctctctctggtcttcgcttccgagtcagatcacaggtatcaacaagatgacccagttaccctttgggtgaacaaagttggtccttataacaatccacaagaaacgtacaattattacagcctaccattttgccgtccacctggtaatactgcacacaaatggggtggtcttggtgaggtcctgggtggcaatgagctcattgatagccaacttgagataaagttcctaggaaatgtggagaagaccatattttgccgtatagaacttgatgaagcaaaggttaaacagttcaaggatgcaatagagaataattactggtttgaattttttatggatgatcttccattgtgggggtatgttggcgagttacatcccgataagaatggtgataatggcaagcatgtactttacacacacaagaacatcaatgttcaatacaataaagatcagatcattcatgttaatctaactaatgacaacccaaggcctctggaagtaggaaaacctttggacatgacatattctgtcaaatggtctcctacgaatgtcacttttggacgccgatttgatgtatacctggactatccgttctttgagcatcagattcactggttctccatttttaattcttttatgatggtcatcttccttactggattggtgtcaatgatattaatgcgaacgttgagaaatgactatgcaaagtatgctcgggaagatgatgatttggaaactctggaaagagatgttagtgaagaatctggctggaaacttgtgcatggtgatgtttttcggcctcctcgcagtttggttattctttcagctattgttggtacaggtgctcagcttgcattgctggttcttcttgtcatcttgttggctattgttgggatgttgtatgttggacgaggagccatagtcacaaccttcattgtttgctatgctctcacatctttcatttctggttatgtgagtggggggatgtactcacgtaatgggggtaaaaattggattaaatccatgatccttacagcatcactgttccctttcatgtgctttggaattggttttattttaaacactattgctatattctatggatctctagctgctattccctttggtacaatggttgtcgtctttgttatatgggcttttatctctttccctctagcacttcttggcacagttgttggaagaaactggagtggtgctccaaataatccatgccgtgtgaagaccattcctcgtcccattcctgagaaaaagtggtacctcacaccatctgtagtttctctgatgggaggactgcttccctttggcagcatattcatcgagatgtattttgtattcacttccttctggaattacaaggtgtactatgtctatggcttcatgctactggtttttctgattcttatcattgttactgtttgtgtgacaattgtggggacatactttttgttaaatgctgagaactaccactggcaatggacttctttcttttcagctgcctcaacagctgtttacgtgtatttgtattcagtatactactactatgtgaagacgaagatgtcaggcttcttccaaaccagcttctattttggatacactttgatgttttgtcttggactgggaattctgtgtggagctgtgggttatcttggttcgaatttgtttgtgaggaggatctacagaaacatcaagtgtgactaaggcttttgtaggagtctgagaccagagcacttccatatgtttgttgctggagacaataaatttcttagaggaagcctctggtcatgtgtggggaccaaacaatgtttacaggtagtaagtatcacagggttgaggatgaggatgtattttttctctatattagttgatgtattctttctctatactagggaggccctgagattttttccctgactgtgtttgaaagccttgatttagaatgcagggattggtctttataattagatagtcagcaaaatgtcagactcgttgctactttttcatcctttttttttataatataaataggtgccctattgacggaatgatgtctgattcccctacgcggtttagctattgtacgtaaaggggatgaagtctcggaaatgaattttgtgattctgaattttgtatcaaatctgaatatcctttctaactacttcctgctcatctctcctgagttttaaatcattaacgtgttttctttttgct

SEQ ID NO: 3975 - DNA, 2431 bp, Glycine max
agaaaattgcaaggttggttggattgaacgtaaaaaagaaatagtattagtaatcagtggcacacagaaaagaaaagagagagagtctcaatccttcaagggcaagtcctcgtcttcgtcgtgtttctcttctctgttctgattcgagatctgccagccatgttcgtgctcttcagattctctctcctccctctcttcctctctctggtcttcgcttccgagtcagatcacaggtatcaacaagatgacccagttaccctttgggtgaacaaagttggtccttataacaatccacaagaaacgtacaattattacagcctaccattttgccgtccacctggtaatactgcacacaaatggggtggtcttggtgaggtcctgggtggcaatgagctcattgatagccaacttgagataaagttcctaggaaatgtggagaagaccatattttgccgtatagaacttgatgaagcaaaggttaaacagttcaaggatgcaatagagaataattactggtttgaattttttatggatgatcttccattgtgggggtatgttggcgagttacatcccgataagaatggtgataatggcaagcatgtactttacacacacaagaacatcaatgttcaatacaataaagatcagatcattcatgttaatctaactaatgacaacccaaggcctctggaagtaggaaaacctttggacatgacatattctgtcaaatggtctcctacgaatgtcacttttggacgccgatttgatgtatacctggactatccgttctttgagcatcagattcactggttctccatttttaattcttttatgatggtcatcttccttactggattggtgtcaatgatattaatgcgaacgttgagaaatgactatgcaaagtatgctcgggaagatgatgatttggaaactctggaaagagatgttagtgaagaatctggctggaaacttgtgcatggtgatgtttttcggcctcctcgcagtttggttattctttcagctattgttggtacaggtgctcagcttgcattgctggttcttcttgtcatcttgttggctattgttgggatgttgtatgttggacgaggagccatagtcacaaccttcattgtttgctatgctctcacatctttcatttctggttatgtgagtggggggatgtactcacgtaatgggggtaaaaattggattaaatccatgatccttacagcatcactgttccctttcatgtgctttggaattggttttattttaaacactattgctatattctatggatctctagctgctattccctttggtacaatggttgtcgtctttgttatatgggcttttatctctttccctctagcacttcttggcacagttgttggaagaaactggagtggtgctccaaataatccatgccgtgtgaagaccattcctcgtcccattcctgagaaaaagtggtacctcacaccatctgtagtttctctgatgggaggactgcttccctttggcagcatattcatcgagatgtattttgtattcacttccttctggaattacaaggtgtactatgtctatggcttcatgctactggtttttctgattcttatcattgttactgtttgtgtgacaattgtggggacatactttttgttaaatgctgagaactaccactggcaatggacttctttcttttcagctgcctcaacagctgtttacgtgtatttgtattcagtatactactactatgtgaagacgaagatgtcaggcttcttccaaaccagcttctattttggatacactttgatgttttgtcttggactgggaattctgtgtggagctgtgggttatcttggttcgaatttgtttgtgaggaggatctacagaaacatcaagtgtgactaaggcttttgtaggagtctgagaccagagcacttccatatgtttgttgctggagacaataaatttcttagaggaagcctctggtcatgtgtggggaccaaacaatgtttacaggtagtaagtatcacagggttgaggatgaggatgtattttttctctatattagttgatgtattctttctctatactagggaggccctgagattttttccctgactgtgtttgaaagccttgatttagaatgcagggattggtctttataattagatagtcagcaaaatgtcagactcgttgctactttttcatcctttttttttataatataaataggtgccctattgacggaatgatgtctgattcccctacgcggtttagctattgtacgtaaaggggatgaagtctcggaaatgaattttgtgattctgaattttgtatcaaatctgaatatcctttctaactacttcctgctcatctctcctgagttttaaatcattaacgtgttttctttttgctcttcagt

SEQ ID NO: 3976 - DNA, 1895 bp, Panicum virgatum
ttggcagctcggatcccctatttcaaaaaggactgcgaactgagacccgtatagcgtgaggcatgcgaactgactcctaaatatcgaaatttctcctgtatgatgcagctcgtgctcgttcgggactgagacacacccgaacgtccgcggccgcctccctccgcccagatctcgccgccgacgagatgctcagccgcggcgtgctactcctggcggccatcctcctcgccgttgcgcgccttccccacgcgtatgcatccgaggccgaccacaagtacaaagcagaagaaccggttaagctatgggtaaacaaagttggaccatacaataaccctcaagaaacatacaactattacagcctcccgttttgtcaaccatctgaaaaccccacacataaatggggtggactgggagaggtcctcggtggaaatgagctgatcgatagtcagattgatataaaattcttaaaaaatgtggacaagggccccatttgcataattgaacttgatgctcaaaaggttcagcaattttctgatgccattgagagctcatactggtttgagcttttcatagatgatctgccattgtggggtttcgttggggaaactgacaaaaacaatgagaacaagcactacctttacactcacaagaacattgttgtcaaatacaatggtaacaggataattcatgtcaatctcacgcaagagtcacctaagcttcttgaagctggtaaaaagttggatatgacatattcagtaaagtgggtgcaaacaaatgtggcatttgcacggcgttttgaagtttacttggactacccattctttgaacatcagattcattggttctccatcttcaattcattcatgatggttattttcttgactggtttagtgtcaatgatattgatgaggacactaagaaatgattatgcaaaatatgctcgtgaagatgatgacctggaatcccttgagcgagatgttaatgaggaatctggatggaagcttgtccatggagatgtatttcggcctcctcgtggcctggtgtttctttctgcccttgttggtattggcactcagctggcagctcttatcctgcttgtgattgtgttggccatagttggcatgttatatgttggacgaggagctatcatcacaacctttattgtgtgctatgctcttacatcctttatctctggatatgttagtggtggcctatattcaaggaatggtggcaaaaactggataaagtccatgatccttacggcatccctttttccattcttgtgcttctcaattggattagtgttaaacaccattgctatcttctatcgatcattagcagctataccatttggtacaatggttgtcatatttgttctttgggctttcatctccttcccattggtgctattgggaactgtagttggtagaaactggattggtgctcccaacaacccatgccgagtgaaaacgattccacgtcctattcctgaaaagaagtggtatcttacaccttcagttatttcattgatgggtgggcttctccccttcggcagcatcttcattgagatgtactttgtgttcacttccttctggaactacaaggtgtactatgtgtatggcttcatgctgctggtgtttgtcatccttataatagtcaccatatgtgtcactattgtcggtacttatttcttgttgaatgctgagaactatcactggcaatggacatcattcttctctgctgcttctaccgccttgtatgtatatttatactccatatactattatcatgtgaagacaaagatgtcaggcttcttccagacaagcttctactttggttacaccctgatgttctgtcttggattgggaatactttgcggtgagctttgaaactta

SEQ ID NO: 3977 - DNA, 2317 bp, Citrullus lanatus
atgcagagaatcggagtttttaaaagcatcgccttgaaaaaacgaagaaatccgggtagtggaaaaaggaggccatctagaccgcccaattcagttcgaccttcgccggtgatcaccatgtcctccaccgtacgatccacctccgtcaccttcttcttcgcctccctcctcatttcctcactctccacagtcttcgcctccgagtctgatcacaagtatcaagcagacgagtcagtaactctatgggtgaataaagttggtccgtacaacaatccacaagaaacatacaattattacagccttccattttgtcatccatccggccagtctggtcacaaatggggtggtcttggtgaggtccttggaggaaacgaacttattgacagtcaaattgagattaagttccaaaaaaatgtggagaggactactatttgtcaactggagcttgatgaacaaaaggtcaagcagtttaaggatgcaattgagaatggttactggtttgagttcttcatggatgatttgcctctgtggggctttgttggtgagttgcatcctgacaagaatagcaataatattaagcatgtgctttacacgcataagaatatcatcatcaaatataataaagatcagattattcatgtgaatctcacccaagaaaacttaaagccgttggaagttggaaagacattggacttgacatatgctgtgaagtggattcctactaatgtcactttcgctcgacgatttgatatttatttggactacccattctttgagcatcagattcattggttctctattttcaattcgttcatgatggttattttcctcactggtttggtctctatgatattgatgcggactcttagaaatgactatgctaaatatgcacgtgaagatgatgatctggaaactctggagcgagatgttagtgaagagtctggttggaaacttgtgcatggggatgttttccggcctcctcgtaacttagtaattctttcagctgttgttggtacaggtgcccagctcgcattgcttgttctccttgtcatcctattggcaattgttggaatgttgtatgttgggagaggagcaattgtcacaactttcatagtatgctatgctcttacgtcatccatttctggttatgttagtgctgggatgtactcacgcaatgggggtaaaaactggataaaatcaatgatcttcacagcatctctatttccatttttgtgctttggaattgggttcatcttgaacactattgctatattctatgggtctctagcagccattccttttggtacgatggttgtggtctttgttatttgggctttcatttcttttcctttggctcttcttggtacggttattggacgaaactggagtggtgcccctaacaatccatgccgtgtgaagactattcctcgtcctatccctgagaagaaatggtacctcacaccatcggtagtttccatgatgggaggattgctgccttttggtagtattttcatagagatgtattttgtctttacatccttctggaactacaaggtgtactacgtatatggattcatgctgctggtttttctaattctcatcattgttactgtctgcgtgaccattgtgggaacttacttcttgcttaatgccgagaactatcactggcagtggacttcatttttctctgctgcttcaactgctgtctatgtgtatttctactctatatactactattatgtgaagacaaaaatgtccggctttttccaaaccagcttctattttggatacacattgatgttctgccttgggttgggaattctttgcggggctgttggttatctgggctccaatttgtttgtacggaggatctacagaaacatcaaatgtgattaggggtattttgtggaagcgaaagacctacgctaccttgaagcattttgatagtggaggcaataacttcgagaagcccttgatacatgggaggcctagcaacgcagtaatacctgtagaaattaaaaagattttgagatggggacatgcttttagccctgagatgttttctttttggtaattgatgcgttttacccaagctgtaattgaatatcttgatttagaatttgagagattgcttttcataatgtagaaaagttgaccaaattgttagacccatgtcatttttataatatttttttgtcttcacacatcagaaaagatatgaccagggtctatttctatattatggtttttttttatcatacaaaggcctatttctgaaaattttgtgacttgaatgaaaaagatggagaaaatagaa

SEQ ID NO: 3978 - DNA, 2362 bp, Eschscholzia californica
catactctctctctctctactcgcttgtaaagaaggaaaaggtagtcaatacaagataccaacaaaaaaagaaagattcataaaagttttagtagagagaaagtaagaaagcttctgaaaagaaaacaatctctcttcgtcttcatcatcatcatcatcttcttagagagagagagtagagatcgaaccacaatgttctccaccgttcaatattgttatctattcgttctatcttcactcttattcttcttcgtttccccaaacttggcttctgagtctgatcacaagtatcgactagaagatccagttacgctctgggtaaacaaggttggtccatacaataatcctcagaaacatataactactacatccttccattttgccagccttctggtagtgcagctcacaagtggggaggacttggtgaggttttgggtggaaatgagctcattgatagccaaattgagataaagtttggaaaaaatgtggacaagaactcaatatgtgaacttcaactggatgctgctaaggttcaacagttcaaggatgcaattgagaatacatattggttcgaattcttcatagatgaccttcctctatggggttatgttggtgaactacatcctgggaggaatgatgaaaatcacaagcattttctttacacgcataaaaatattcttgtgaaatacaatgaagaccagataattcatgttaatctcactcaagagaaccctaaactcgtagaagcagggaaaacatttgacatgacatattcagtcaaatgggttccgacgaatattactttcggacgacgatttgatgtttacttggactaccccttctttgagcatcagattcattggttttctatcttcaattctttcatgatggttatcttcctcaccggcttggtatctatgatactaatgcggactctcagaaatgactatgcaaaatatgctcgggaagatgatgatcttgagactctggaaagagatgtaagtgaagaatctggctggaaacttgtccatggagatgtcttccgatctccccgcaatctggttatactttcagcagttgttggaacaggtgctcagcttgcaatgcttgtgttcctcgtcatcatattagcaatcattggaatgttgtacatcgggagaggagcaattgtcacaacatttatcgtgtgttatgctcttacatcattcatttcgggttatgtgagcggtgggttgtattcacgtagcggtggtaagagttggataaagtccatgatcctgacggcatcactttttccattcatgtgctttggaattggctttattttgaacacagtcgctatattctacggatctcttgcagctattccatttggcacaatggttgttgtttttgttatatgggcttttatttccttccctctagctcttcttggtacagtggttggaagaaactggagtggtgccccaaataatccatgtcgtgtaaagaccattcctcgtcccatccctgaaaagaaatggtatctcacaccatctgttgtctcattgatgggtggtctgcttccctttggcagcatatttattgagatgtattttgtcttcacatccttctggaattacaaggtatactatgtatatggatttatgttgctggtttttgtgattctcgttatcgttactgtatgtgtcacaatcgtcggaacatatttcttgttgaatgcggagaactaccactggcaatggacttcattcttctctgctgcttcaactgcaatctatgtctacctctactcaatttactactactatgtgaagaccaagatgtcaggctttttccagaccagcttctattttggatacactctgatgttctgtctcggtttgggtatcctctgcggtgccgttggttatcttggttcaactttgttcgtaagaaggatttacagaaacatcaaatgtgactaacaaggaggatgaactatttccaggaatgctttcagcagttttgttgccgtaacaaattgttttgagcagcctacctggttgcccgacaaagaactctgccgatgattacaaaatccatccatccatccggggttgaaaagatgagtaatttttttgctttcgtttatgtaattctgaatgtaggaagccttgatataattttgcttgacttgtataagtgaaaacctttttgtcgtataatttagagtttagagattgttctgtattaacttcgatcacttatattagattctaattttctttctcatacctcaattctgggcttgtcttataaaagtcaagcaaaattatatgaaggcttcctacattcagaattacataaacgaaagcaaaaa

SEQ ID NO: 3979 - DNA, 2394 bp, Manihot esculenta
gagttcagagtctaaacacgagctcgttgctctctctctctctatctgattatagggaaagggcaaatctcagctggtcgagaattccataaattcgccaataactcgaacagagacctctgattgacctcaagctagacctcagatcccgctgtcgccggtgatggccatgtccgcctcctccacatcggtccgatcctcaatcttccctcatttcgccttcatttctctcatcctcctcctctctcctgttctcgcctccgaggcggatcacaagtatcaatcagatgacccagttactctttgggtgaataaagttggtccttataataatccacaagaaacatataactattacagccttccattttgccatccatctggcagtgctgggcacaaatggggtggccttggtgaggtcctgggtggcaatgaacttatcgatagcaagattgacataaagttcctgaggaatgtggataaaggcaccatttgttcacttgaactggatgaagcaaaagtcaaacaatttaaggaagcaattgagaacaactactggtttgaattcttcatggatgatctgccattgtggggctttgttggtgagttgcatcctgacaagaacagtgataatggaaagcatgtactctacacacacaagagcatcaatgtcaaatataataaagatcagattatccatgtcaatcttacgcaggatgggcccaagcccttagaagttggtagaatatatgacatgacatattcagtcagatggatttcaactaatatcacttttgcacgtcgttttgatgtgtatttggactaccctttctttgagcaccagatccattggttctccattttcaattcattcatgatggttatttttctcactggtttggtgtcaatgatattgatgcggactcttagaaatgactatgccaaatatgcccgggaagatgatgatcttgagtctctggaaagagatgttagtgaggagtctggttggaagcttgttcatggtgatgttttccgttcacctcgcaatttagttgttctttcagctgttgttgggactggtgctcagctggcattgcttgtgcttcttgtcatcttgttggccattggtggaacactatatgttgggaggggggcaatcgttacaactttcattgtatgttatgcgctcacatccttcatttctggttatgtcagtggggggatgtattctcgccatggtggtaaaacttggataaagtcaatgatccttacagcttctctgtttccatttatgtgtttcgggatcgggttcctcttgaacacaattgctatattctatgggtccttagcagctattccttttggcactatggtggtggttttcgtaatttgggctttcatttccttccccctggcacttcttggcacagtggttggaaggaattggagtggtgctccaaacaatccatgccgtgtgaagaccattcctcgtccaatccctgagaagaaatggtatcttacaccatctgttgtttcactgatgggaggactactaccctttggcagcatattcattgagatgtattttgtcttcacatccttctggaattacaaggtgtactatgtgtatggctttatgctacttgttttcctgatactaattattgtcactgtttgtgtgacaattgttgggacatatttcttgctcaatgctgagaactatcactggcagtggacatcatttttctctgctgcctcaacagctgtttatgtctacttgtactcaatatattactactgcgtgaagactaagatgtcaggcttcttccaaacgagcttctattttggatacactttgatgttctgtcttggtttaggaatcctttgtggagctgttggttatttgggctcaaatttgtttgtgaggaggatctacagaaacatcaagtgtgactaaaatttcatgtaggagaaagaggcccggtagctcctctagcgcattcttgatgagaataaattttgaggaagcctctggtcatgtggtggggatcagtgaagcttacgaacggatgaaaatgttttacggcaggacgcattcttctttctctggactagggggaggccctgagattgtttttgtctttttttccccagctgtaagtgaaatccttaatttagaattcagaggttgttcttataatctgtgaagttagcaaaatatgttaaacggctgttatttttttttttcactttttacaaataggtgccctatgtaagaactgattcctaatcctctttcttgaaatggttttggtatctgctcacctttggaagtagagataacttttcaagggcaagtttgaagaaatgaattttgtgcttagatttgtgtgc

SEQ ID NO: 3980 - DNA, 1927 bp, Valeriana officinalis
aggaagaggggcgaggtctcttctttctcacaatcacattgcgttttccggtgaagacctcaaatccaaccaaacccaccctcttttcatcgccggcgatccgatgtggcccaccgtcagatcgtcatctcttttcgccgttatccttcttctcatcgtctcgcctgtgttctcatccgactcggatcacaagtatcaacctgacgattcagtaactctttgggtaaacaaagttggaccttataataatccacaagaaacatacaactattacagtcttccattttgccattcaaccggcaacgctgctcataaatggggtggccttggtgaggttttgggtggaaatgaacttatcgatagccagatagacatcaaataccaaaaaaatgtggagaggagtagtatttgtgaactcgaacttgatgaagctaaggtgaaacaatttaaggacgctatagaaaatagctattggtttgaattctttatggacgatctgccattatggggttttgtcggtgagcagcatgctgataggaacagtgataacaaactcgttttgtatactcataaaagtgtagttgtgaagtacaataaagatcagattattcacgtcaatctcactcaagaaagcccaaaaccgttagaagttgggagaatattagatatgacatattctatcaaatggattccaactaatatcacttttgctcgtcgttttgatgtttatctggactaccccttttttgagcatcagatacattggttctctattttcaattcatttatgatggttatcttcctgacgggtttggtatcgatgatactgatgcgaactcttagaaatgactatgccaaatatgctcgagaagatgatgatctagaaacgctggaaagagatgtgagtgaagagtctggttggaaacttgttcatggtgatgtttttcggtctccgcgtaatttagtattactttcggctgttgtgggtatgggtgctcagcttgctctgctcgttcttcttgtcattttgtgtgctatcatcggcatgttgtatatcgggagaggagccattgtcacaacttttatagtatgttataccctcacatccttcatctcgggttacgtgagtggcggcatgtactcacgcaatgggggtaaacactggataaagtcaatgattctgacggcttctcttttcccattcttatgctttggaatcggcttcattctaaacacaattgctatattctacggatctctagcagcaatcccattcggaacaatggtggtagtttttgtaatttggggttttatttcgttccctttaggtcttctcggtacagttgtaggacgaaattggagtggggcccctaacaatccctgccgtgtgaagacgattcctcgccctattcctgagaaaaaatggtacctcacaccgtcagtcgtttccatgatgggaggattattaccatttggcagcattttcattgagatgtatttcgtcttcacttctttctggaactacaaggtgtactatgtttacggattcatgcttctggttttcttgatcttgactatcgtaacagtttgcgtgacaattgttggaacgtatttcttgctaaacgcggaaaattatcactggcaatggacttcgtttttctcagcagcctcaaccgccgtctacgtctacctatactccatatattattattatgtaaagaccaagatgtcgggtttcttccaaaccagtttctactttggatacacacttatgttttgtctgggcttaggaatcctgtgcggggctgttggttatttgggttcaaatttgttcgtgagaaggatctacagaaacatcaagtgcgactaaacattttggtttttgaggagatggcgaaatatgtgggggtttaatgacggaatgtaa

SEQ ID NO: 3981 - DNA, 2253 bp, Amorphophallus konjac
ccggcctccgcacccgccagatccggccgcgatgtcgcgcctcgccgggcgatcgcttcccttcctcgcctccctgctgtcgctcctcctagccgcggcctcggctgccgagtccgatcacaagtatcaaacggatgaccctgttagactgtgggtaaacaaggttggaccatataataatcctcaagaaacatataactattacagcctccccttctgccagccagctggggacccttctcataggtggggtgggctcggggaagttcttggtggaaatgaacttatcgacagccagattgaaataaagtatcaaaaaatgttgacaagggctccatttgtgctcttgaacttgatgatgtgaaagtgaggcagttcaaggatgcaattgagaactcatattggcttgaattcttcatggacgatttgcctttatggggctttgttggcgagatgcgttctgacagaaacaatgaaaataaacattaccttttcactcacaaggatattgttgttaaatataatggcgatcagatcatccatgtaaatctcactcaagaaggccctaagcttttagaagttgggagaacattagacatgacatattctgtcaagtggatcaaaacaaacataacatttgcaaagcgatttgatgtttacctggactatcctttctttgagcatcagattcattggttctccattttcaattcttttatgatggttctctttctcactggtttggtatcaatgatactgatgcgaactttgagaaatgactatgccaagtatgctcgtgaagatgatgaccttgagactctggaaagggatgtgactgaagagtctggatggaagcttgtccatggtgatgtctttcgacctcctcgcaatttggttcttctttcagctgttgttggtacaggtgcccagctgacaatgcttgttcttcttgtcatcctgttggcaatcatcgggatgttatatgttgggcgaggagcaattgtcacaactttcattgtgtgttatgctcttacttcattcatctcaggctatgttagtggtggtctttattcacgtagtggaggtaaaaactggataaagtcaatgaccctggcagcgtcactcttcccattcatgtgcttcggcattgggttcatattgaacaccattgctatcttctatggatctcttgcggctatcccatttggaacaatggtggttgtgtttgtaatatgggctttcatctcattccctctgacacttcttggcacggtggtgggcagaaactggagtgggtctccaaacaatccttgccgtgtgaagactattcctcgtcccattcccaagaagaaatggtacctaacaccatctatcgtgtcactcatgggtggactgcttccctttggcagcattttcattgagatgtactttgtcttcacttcattttggaattacaaggtgtattatgtttatgggttcatgctactggttttcgtcatcctcataattgtcactgtctgtgtgacaattgtgggtacttatttcctgttgaatgctgagaactaccactggcaatggacttcctttttctctgctgcctccacggctgtctatgtgtacctctactccatatactattaccacgtgaagaccaagatgtcgggtttcttccagatcagtttctactttggctatactttaatgttttgccttggtttgggaatactttgtggtgctgtgggctaccttggttcttctttgtttgttagaaggatatataggaacatcaaatgtgactaggaagtcagtgactgttcatacctgcaggcgatgagacaccgtcggagtggaaggccacggttgcaatgcagatttgtctaccataatatgatcacctcatcaacgctcatgttattcccttgttctactattcaggggccgttttaacctcttggagtatggactattcggaggtttttgcaagttcttcggctgtagttaaaagctttctcatttgttgttgcggggtagtatcatatttgatgaaaagaataacaaacgtgtgctagctaatttttttttggagggttaactgcagtgactcaagaagccgcagtgacccaatggagatggatacacatactaattgatgtaggctcccctccccaaagaagacattttgtccatttcaaattttatccatggctgtttcattttgtttattcgctaaccatgcagagtttatttctctag

SEQ ID NO: 3982 - DNA, 2398 bp, Gossypium raimondii
tcatagtccattacaggccagaggaaaaatagctgctgcggttcttgcttgcaacttgcaagttttaaaaataaaaactccaagacttgggagaactcaggtcaggtcagggacattgtgtttttccaatcgacctccggaccttcagatccgaccaacgttgcaccaccgccatgttatcctccgtccgctctttctctctttccgccttcattttcttcgtcttcttctcctctctcgccttcgcttccgagtcagatcataagtatcagccggatgatccaattaccctatgggtaaataaagttggaccatataacaatccacaagaaacttataactattacatccttccgttttgtcatccgggtgtcaatcctgcgcacaaatggggtggccttggtgaggtccttggtggaaatgaactgattgatagccagattgatataaagtttcaaaagaatgtggacaaaggtaccatttgccaactggaacttgatgaagctaaggtcaagcagttcaaggatgctatcgagaacaattattggtttgaattctttgtgggctttgtcggtgagctgcatcctgataagaacagtgataatggcaagcatgtcctctacacacataagaacattgttattaaatacaacaaggatcagattattcatgtcaatctcacccaggggagtcctaaacccttggaagcagggagagtattggacatgacatactcaatcaaatggcttccaactaatgtcacttttgctcgtcgctttgatgtttatttggactaccctttctttgagcaccaaattcattggttctctgttttcaattcattcatgatggttatctttctcactggtttggtctcaatgatcttgatgcgaactctgagaaatgactatgcaaagtatgcccgggaagatgatgatttggaaactttggaaagggatgtaagtgaagagtctggttggaaacttgtccatggtgatgttttccggcctccccgtggtttggttctgctttctgctgttgttggcaccggtgcacagctagcattgcttgttctccttgtcatcttattggcaattgtgggaactttgtatgtcgggagaggagcaattgtcactacttttatactctgttatgcttttacatcgttcatttctggttatgtgagtggtggaatgtactcgcgtaatgggggtaaaagttggataaagtcaatgatcctttcagcgtctctgttcccatttttgtgttttgggattggtttcatcttgaacacaattgctatattttatggatccctagctgctattccttttggtacaatggtggtggttttcgtaatttgggctttcatttcattccccctggctcttcttggtacagttgttgggagaaactggagtggtgctccaaataatccatgccgtgtgaagaccattcctcgcccaattccggagaagaaatggtatcttacaccctctgtggtctccttgatgggaggacttctgccgtttggcagcatatttattgaaatgtatttcgtcttcacatccttctggaattacaaggtttattatgtctatggatttatgctgctggtgttcctgattctcgtcattgtaactgtctgtgtgacaattgtggggacatatttcttgctgaacgctgagaactatcactggcagtggacatcatttttctctgctgcctcgacagcagtgtatgtgtatatgtactctgtatactactactatgtgaaaaccaagatgtcaggcttcttccagaccagtttctacttcggatacactttgatgttttgtcttggtttgggaatcctttgcggagctgttggttatcttggttctaatttgtttgtaaggaggatctacagaaacattaagtgtgactagaactttgctaatggatattagaaccagcagcgcttccacaagcattttcagttgtcgaggcaataaacatggagaggtagcttcttgtcaggtatgaggaaccaagcaaagcctcaagatgaaactggaagccctgagatttttgttttgccttcgattttactcgcctgtaattggaagccctgatttagaatatagaaaggtagctaaaatattaaacaactgtcatttgttatacttctgttatacttttgtccttgatccctttgcatatagatgtgtccaatgtaagaatttatgttaaatttccgttggatttgttttgttctttctttcggggataaggaacttaaatcaaggaaatcgataaatgggtgtgtttcttttttttttttttttaaataattatctgcattctgcaatttggcagttggcacatgtttgatgtttctaatttccccctatttttg

SEQ ID NO: 3983 - DNA, 2101 bp, Helianthus annuus
ctctctctcacggatccaaatcaagccctatttgccgtaataaaactcccctttttttctccgatcaatcgccgttagatccaatttcattcgccggcgaccgccatgtgtcccgccgtccgatctcctctcctcttcatcgcttcatttctcctcatctcatcctcggtcttcgcttcagagtatgatcacaagtatcagtcagatgagccaattaccctgtgggtgaataaagtcgggccttacaataatccacaagaaacatacaactactacagccttccattctgtcgtccatctggtaaccctggccacaagtggggtggtctgggtgaggtattgggtggaaacgagcttatcgatagccaaattgacattaaatttcaaaagaatgtggacaagacttcaatttgtgagcttgatctagatgaatcaaaggttaagcaatttaaggaggctatcgagaataactattggtttgaatttttcatggatgatctgccattgtggggctatgttggggaactacatactgatagaaatagcgatagcaagcatatgctatttacccataagaatattactatacagtacaacaaagatcagatcattcatgttaatctcactcaagagaacccaagaccactggaagctgggaaaacactcgacatgacttactcagtcaagtggaccgaaactaatattagctttgcacaccgctttgatgtttacctggattaccatttctttgagcatcagattcattggttttcgatattcaattcgtttatgatggttatcttccttaccggattagtttcaatgattctgatgcggactcttagaaacgactatgccaagtacgctagggaagatgatgatctggaaagtctggaaagagatgtaagtgaagaatctggttggaagcttgtacatggggacgtcttccgaccgcctcgtcatttggttttattgtcagctgttgttggaacgggtgctcaattggcgctgctgattcttcttgtcatcttgtttgcaattgttgcaacgttgtacattgggagaggagcaattgtcactactttcatcgtttgttacgcgctcacctcatttgtatctgggtacgtgagcggtggcatgtattcccgccatggtgggaaaaactggataaagtcgatgatcctgaccgcatctcttttcccatttttatgctttggaatcggcttcgttctcaacacagttgctatattttacggatctctagctgcaattccgtttggcacaatggtggttgtttttgtcatctgggctttcatatctttccctcttgctcttctcggtacggttgttggacggaactggagcggggcccctaacaacccgtgtcgcgtgaagactattcctcgccctattcccgaaaagaagtggtatctcacaccgtcggtagtctcaataatgggcggactgctacctttcggcagtattttcattgagatgtacttcgtcttcacatcgttctggaattacaaggtgtactatgtttacggatttatgctacttgttttcctgattcttatcatcgtgaccgtttgcgtgacgattgtgggaacgtattttctgcttaacgcggagaattaccactggcaatggacttcattcttctctgcagcctcgacggctatttatgtctacttgtattcgatatattactactcggttaagaccaagatgtcgggcttcttccaaaccagcttttatttcggatacaccgccatgttctgcctcggtttaggaattctctgcggggctgtcgggtatttgggttctaatctctttgtgagacggatttaccggaacatcaagtgtgattaaggctcataacggccccactgtggcctccgaggttttgtagcttgttttgttgataccaaatgaaagatttaaaaggagggttgaggggcttgttattatttgtaacttttgaggaatatgtagaagaaaggtttagagaaatgcaagactgttaatgtagcaggttcttaagaaaaaacttgttatatacatcttctattgtattcttattcatcagtcatttcagaaa

SEQ ID NO: 3984 - DNA, 2239 bp, Manihot esculenta
catctttcccccctgttttcttgtttgtacagttctatatattttgtgtaagactctgttttatacgtttttcaatatcacttaatagttatattatttttcttctaatacttttatcttacatttttttacagtatcaaccagatgacccagttactctttgggtaaataaggttggcccctataataatccgcaagaaacgtataactactacagccttccattttgccatccatctggcactgctgcgcacaaatggggtggccttggtgaggtcctaggaggaaatgaacttattgatagcaagattgacttaaagttccagaagaacgtcgataaaaggactatttgttcacttgaacttgatgaagcaaaagtcaggcaatttaaggatgcaattgagaacaactactggtttgaattcttcatggatgacctgccattatgggggtttgttggtgagttgcatcctgacaagaacagtgataatgggaagcatgtcctttacacacataagagcatctttgtcaaatataataaagatcagattattcatgtcaatcttacacaagaaggtccgaagcccttagaagctggtagaatactggacatgacatattctatcaaatggattccaactaatatcacttttgcacgacgttttgatgtgtatttggactaccctttctttgagcaccagattcattggttctcgattttcaattcattcatgatggttatctttctcactggtttggtgtcaatgatattgatgcggacgcttagaaatgactatgccaaatatgcacgggaggatgatgatctcgattctttggaaagagatgttagtgaggagtccggttggaagcttgttcatggggatgttttccgtccacctcgctatttagtagttctttcagctgttgttgggactggtgctcagctagcactacttgtgcttcttgtcatcttgttggcaattgttgggacactatatattgggaggggagcaattgtcacaactttcattgtatgctatgctctcacatccttcatttctggttatgtgagtggggggatgtattctcgccatggtggtaaaaattggataaaatcaatgatcctcacagcttctctgtttccattcatgtgttttgggattgggttcatcttaaatacaattgctatattttacgggtctttagcggctattccctttggcaccatggtggtggtttttataatttgggccttcatttccttccctctggcacttctgggcacagttgttggaagaaattggagtggtgctccaaacaatccatgccgtgtgaagaccattcctcgtccaatccctgagaagaaatggtacctcacaccatctgttgtttcacttatgggaggactactaccctttggaagcatattcattgagatgtattttgtcttcacatccttctggaattacaaggtgtactatgtatatggctttatgctcctggttttcttgatactcattattgtcactatttgtgtaacaattgtggggacatatttcttgctcaatgctgagaactatcactggcagtggacatcgtttttctctgctgcctcaacagctgtttatgtgtacttgtactcaatatattactactacgtgaagacgaagatgtttggcttcttccaaacaagcttttattttggatacactttgatgttctgtctgggtttaggaatcctctgcggagctgttggttatttgggctcaaatttgtttgtgaggaggatctacagaaacatcaagtgtgactaaaatttcactgaggaagagagctgggagcttctgtagcacaatattgttgagaaaataaaatttgaggaagcttctcggcatgtggtgggatctgtcaagcttaaaaatggatcaaaatgttagattacggggatgtattcttctttctctggactaggggaagccctgagattgtttttggttttttccccggctgtaagtgaaattcttaatttagaactaagagattgttataatcagtgaagttagcaaaatataccaaacgtctgccatttttttcctctcatgttttacaaattggtgcccgatgtaagaactgatgtctatttttttttctttaatttgttttgttatctactcatctttccaagtagaaaacttttcgggggcaagtttgaagaaatgaatcgtgtgcttcagattta

SEQ ID NO: 3985 - DNA, 2662 bp, Panicum virgatum
tatgcttctttgatgcagtacaaagcggaggagccagttaagctctgggtgaataaagttggtccttacaacaatcctcaagaaacttacaattattacagtcttccattttgtcaaccatctgagaaccccatacataaatggggtggtcttggagaggtcctgggtggaaatgagctgattgatagccagcttgagatgaagttcttaagaaatgaggagaagggcttcatttgtacacttgagctagattctaaaaaggttcagcagtttgctgatgccattgagaactcatattggtttgaatttttcatagacgatctgcctctttggggttttgttggggagactgacaagaacagtgaaaacaagcattatctatacacacacaagaacatccttgttaagtacaatgagaacaggataattcatgtaaatctcacccaagagtctcctaagcttcttgaagctggtaagaaattggatatgacatattcagtgaagtggatagcaacagatgtgtcatttgcacgtcgtttcgaagtgtacctggactatcctttctttgaacaccagattcattggttctccatcttcaactcttttatgatggttattttcctaactggtttggtttcgatgatattgatgcggactttgagaaatgattatgccaaatatgctcgtgaagacgatgatctggagtccctggagagagatgttaacgaggaatcaggatggaagcttgtccatggtgatgtatttcggcctccccaaagtttgatgtttctttctgcacttgttggaattggcacccagctagcagctcttatcttacttgtgattgtgttggccatcgttggcatgttatacattgggcgaggtgctatcatcacaacgttcattgtgtgctatgctcttacatcgttcatttctggatatgttagtggaggtctttactcgaggaatggtggcaaaaactggattaaggctatggtccttacagcatccctctttccgttcctgtgtttttcaattggctttgcactgaacacaattgctatcttctaccgctcattagcagcaataccattcggcacgatggttgtcatgtttgtactttgggctttcatctcctttcccttggtgcttttggggaccgttgttggtaggaactggagtggtgctcctaacaacccctgccgtgtaaagactattccacggcctattcctgagaagaagtggtaccttacaccttctgtcatctcgttgatgggtgggctgcttccttttggtagcattttcattgagatgtactttgtgttcacatcattctggaactacaaggtgtattatgtctatggtttcatgttgctggtcttcgtcatccttctaatagtcaccatctgcgtcactattgtgggtacctatttcttgctgaatgctgagaactataattggcagtggacttcgtttttctctgcagcatcaactgctttgtacgtgtacctatactccatctactactaccatgtgaagacaaagatgtcaggcttcttccagacaagtttctactttggctacacattgatgttctgccttggtctaggcattctttgtggtgctattgggtatgtagggtcaaccctgtttgtaaggagaatctacagaaatatcaaatgtgattaaattcctgctactcactagcagcagagagatcatatgtattgtcagtgcggaagcaaggcctcaaaatggattaatggtagatcctgaataggtttttgaaactacagaggacatgctccctttgttcactattatacgcattttttgcttgcctgcttattcctgtggaatcatcgtcataatgtatacctatgtagttgaggattagcctaaagcaccggtttttattctttttctttttgtatttttgtttggtagaatgtaatcagtgaatgttcatgcggcgcgagcacaattgtcgggaattttttccctcctatgctttatgcatcataccatcccgttcaaagttaaagttgaggagtgcttaccgcctgagcagtctgaacttgtattccactcgttaggttttggaaaatgcctttgcgaccatcatcactccctactaagtggtatggtgtttgacacccatctggtcatatgctgctagcatcgggaacgttgtgatttcgcggtctgtttgtttcagtattgtctggcggcaatccagcacggtacatccaagttcgtctagtttgatgactagctaaagtgtgtgctcggtttgtagttgtactagaaattgctttattgcaacttttctttttgtggagtgatttgaagaatttgtgagaaatgatatatggcctctgcttggttggagttggaggtaccaggctctagctaggcgggctgggcgaacaggcttggtgtggtatcagggttgggctgaacaagtcgaggaaggcttaagtatcaaaaaaaaaaaaagtcgaggaaggcttcatcacatgacataaggcctgacacccccaacatttcgaaccgcgtcccgcatgcagctaactgatgtgaacgcagagatccctgtgaaaaagaaacgatgaaacgtcggtacacaagcatacacaatgcgtcggcgtgttgtcatccg

SEQ ID NO: 3986 - DNA, 2190 bp, Amsonia hubrichtii
tcttcctctctctctttccctctgtatctcgctttcactcgacttttatcaccgtaagatccaaaccaacgccggcgatctcttccccgagatgcggctcaccgtccgatccttcgctctcctctctcttctcgccacctttttcctcgcttcgccggcgtttgcctccgagtacgatcataagtatcaagaggaagacaaggttaccctttgggtaaacaaagtagggccttacaataatccccaggagacatacaattattacagccttccattttgtaagccagagggcgttgctgctcacaaatggggtggtcttggtgaagtccttggtggaaatgagcttatcgatagtcttattgacataaaattcaaaaaaaaagtggagaagactaccttttgtgagcttgaacttgatgaaacaaaggttaagcaatttaagaatgcaatcgaaaacagttattggttcgaattcttcatggatgatctgcctttgtggggttttgttggggagtttcattctgacagaaatagtgataacaagcatgtgctttatacccataagagtattgatgtcaaatacaataaagatcagatcattcatgttaatctctctcaagagagtccgaaaccattggaaattggacgaacattggatatgacatattctgtcaaatggatgcctacaaatgtcacttttgcgcatcgctttgatgtctacctggattaccccttttttgaacatcagattcattggttctccatttttaattccttcatgatggttatctttcttactggattggtctcgatgatactcatgcgaactctgagaaatgattatgctaaatatgctcgggaagatgatgatcttgaaaccctggaaagagatgttagtgaagagtctggttggaagctcgtgcatggagacgtatttcggcctcctcgcaatttagtattactttctgctcttgttggcactggtgctcaactagcagtactggttcttgttgtcatcttatctgcaattgtgggaatgttatatgttgggagaggaacaattggcactgctttcattgtttgctatgtcttgacatcaattgtttcgggctatgtcagtggtggaatgtactcgcgcaatggtggtaaaaactggataaaatcgatgatccttacagcaacccttttcccatttatgtgctttgggatcggttttatgctcaacaccattgcaatattttatgggtctctggcagccattccttttggaacaatggttgttgttcttgtcatctggactttcatctccttccctctagcacttgttggtacagtcgttggaaggaactggagtggtgctccaaacaatccttgccgggtgaaaacaattcccaggccaattcccgagaagaagtggtacttgacaccatctgtagtttccttgatgggaggcttgttgccgttcggaagtatattcattgaaatgtattttgttttcacctccttttggaactacaaggtttactatgtctatggttttatgctgctggttttccttattctcatcattgttacagtgtgtgtgacaattgttgggacatatttcctgcttaatgctgagaattatcactggcaatggacctctttcttctcagctgcctccacagctgtatatgtgtacttgtattctgtgtactactaccatgtgaagacaaagatgtcaggtttcttccagacaagcttctattttggttatacactgatgttctgcattggcttaggaattctctgcggggctgttggttatttaggctctaatctcttcgtgaggaggatctaccgaaatatcaaatgtgattagttgtgttcaagggacgtgaaactttgcttctgggaactattcacttggcaagaaatgaagaagcaagaaatcatttttttgtccccgacaatgtttcatgaagggattgacagggttggaggatggtttgtaacacagtattgcggggaagctctgaaaattttccctgttccccaggctgtagaaaaaaagaccatttttactttactagaatgcagagactggttggataatttggaaaagctagaaggatgttggcattacctctgtcttgtagttattggtctcctcatccctctatatattagatgccctttactagctcagtc

SEQ ID NO: 3987 - DNA, 2113 bp, Flaveria ramosissima
aagtctaataatatcgagaaaaacagctaacctctctcggatccaaagccatacctattccccccttttcctccgatcaatcgcccttagatccagattcactcgccggcgaccgccatgtggcccaatctccgatcatcacatcatcttactgctctcatcttcatcgcttcatatctcctcatctcatcgccggtgttcgcttcggagtacgatcacaagtatcaatcagatgagccggttaccctttgggtgaataaagttgggccttacaataatccacaagaaacatataactattatagccttccattttgtcgtcaatctggtaatcctagtcataaatggggtggccttggcgaggtattgggtggaaatgagcttattgatagccaaattgacatcaaatttcaaaagaatgtggacaaggctacaatttgtgagcttgaacttgatgaatcaaaggtcaagcagtttaaggaggccattgagaatggctattggtttgaatttttcatggacgatctgccattgtggggttatgttggggagctacgtactgataggaatagtgatagcaagcatatgctgttcacccataagaatattactatacagtacaacaaagatcagatcattcatgttaatctgacacaagagaacccaaaaccactggaagctgggaaaacactagaaatgacttactcggtcaagtggactgaaactaatactaattttgcacaccgttttgatgtttacctggattaccatttcttcgagcatcagattcattggttttccatattcaattcgtttatgatggttatcttcctcactgggttggtttcaatgattctgatgcggactcttagaaatgattatgccaagtatgctagggaagatgatgatcttgaaagtctggaaagagacgtgagtgaagaatctggttggaagcttgtccatggggatgtcttccgcccccctcgtaatttggttttattgtcggcagttgttggaacgggtgctcaattggcgttgctgattcttcttgtcatcttgtttgcaattgttgcaacgttatacgttgggagaggagcaattgtcactactttcatcgtttgttatgccctcacatcatttgtatctgggtatgtgagcggtggcatgtattctcgccatggtgggaaaaactggataaagtcaatgatcctgacggcatctcttttcccatttttgtgctttggaattggcttcattctgaacactattgctatattttatgggtctctagctgcaattccatttggcacaatggtggttgtttttgtcatctgggctttcatttctttccctcttactctccttggtaccgttgttggaaggaactggagtggggccccgaacaacccttgccgtgtgaagactattcctcgcccaattcctgaaaagaagtggtatctcacaccatctgtagtctcaataatgggagggttgctaccttttggcagtattttcattgaaatgtactttgtcttcacatccttctggaattacaaggtgtactatgtttatggatttatgctacttgttttcctaattcttgtaattgtgactgtgtgcgtgacaattgtgggaacatattttctgctaaatgccgagaactaccactggcaatggacttcattcttctctgcagcctctacagctatttatgtctacctgtattcaatatattactactatgtcaagactaagatgtccggcttcttccaaaccagcttttactttggatacacagccatgttctgccttggtttaggaattctctgtggagctgttggatatttgggttctaatctctttgtgagacggatttaccgtaacatcaagtgtgattaaggctctaaagcgaaacatcaagtgggctctaatcctccgcggttttgtagtttattttgttgataccgaaggaagattcaaatgatgggggttgagggacttgttattatttgtaacctgtgaggaatattggggtctttcttccctccattgataggaggaatgtagaagaaaggtttagagcacatgcaagagattgttttttattatgaac

SEQ ID NO: 3988 - DNA, 2548 bp, Populus trichocarpa
gcaaatctgagaaccctccttgcattacaatacaacactgtctctcactgtctctctttctataacgggaaaaatcagagcaactcgagagaattcatccgtccttgagaaaaagatttttgaaataaaaagagagagagatttggtttgatttgattgaccgaatcttgaccgtcagatccttccgtcaccggcgatcgccatgtcctccgccattcgatctcttcctctcatcgccttcatttccctcctcctcctctctcccgctctcgccttcgacgcagatcacaggtatggacaagaagaagcagttaagctttgggtaaacaaagtgggtccttataacaatccacaagagacatacaactattacagccttccattttgccatccatctagcaatgatgggacacacaaatggggtggccttggcgaggtccttggtggaaatgagcttattgatagccagattgacttaaagtttgcgaagaatgtggacaaagctgttatttgtcagcttgaacttgatgaagcaaaggtcaaacaattcaaggatgcaattgagaacagttattggttcgaattcttcattgatgatctgccattatggggttttgtgggtgaattgcgtcctgataagaacagtgataatggaaagcatctccttttcacgcataagagcatcactatcaaatataataaagatcagcatcttcgcttgcagattattcatgtcaatctcacacaagagaatccaaagccccttgaagctgggacagtgttggagatgacatattctgtcaaatggtctttgactaatgtcagttttgcacgtcgctttgatgtttacttggactaccccttctttgagcatcagatccattggttttccatcttcaattcattcatgatggttatctttctcaccggtttagtgtcaatgattttgatgcggacacttagaaatgactatgcaaaatatgctcgggatgatgatgatctggtggagtctttggaaagagatgttagtgaggagactggttggaaacttgttcatggggatgttttccggccacctcgcagtttggttgttctctcagctgtcgttggaacaggtgctcagctagcgatgcttgtgcttcttgtcatcttgatggcaattgttggaacgttgtatgtcgggagaggagcaattgtcacgactttcatagtatgttatgctctcacatcatttattgctggttatgtgagcggggggatgtattctcgccatggaggtaaaagttggatcaagtcgatgattctcactgcctgtctatttccatgcatgtgctttggcattgggttcatcctgaacacaattgctatattctatggatctttagctgcaattccctttggcaccatggtggttgtttttgtaatatgggctttcatctccttccctctggcccttcttggcactgttgttggaagaaattggagtggtgctccaaacaatccatgtcgtgtgaaaaccattccccgtccaattcctgagaagaaatggtacctcacaccatctgtggtctcaatgatgggaggacttttgccctttggcagcatattcattgagatgtactttgtcttcacatccttctggaattacaaggtgtactatgtatacggctttatgctgcttgttttcctgattctcattattgtaacagtttgtgtaacaatagtggggacatatttcttgcttaatgcggagaactatcactggcagtggacttcattcttctctgctgcctcaacagctgtttatgtgtacttgtactcaatatattactactccgtgaagactaagatgtcaggcttcttccagaccagcttctattttggatacactttgatgttctgtcttggattgggaattctctgtggagctgttggttatctaggctccaatttgtttgtgaggaggatctataagaacattaaatgcgactaggacttcaccgacaaaatttagacctgattgtgcttcatcagagcatgttcttattgttgagacaataatttcttagatgaagcctccgttcatgtatgggggacttaacaacgcaacagatgatggaacagggttttgggatcgggtataaatttattctttctctggacaaagggaagccctgagatattttttggttttcttcccctgctgtaagtgatagtcgtaatttagaattgagatattgttttgtaatctgtgaagctagaaaaatatatcaaacacctgtcgttttgctatacgttttgctatggaagtaggtgcgcagcacaaaggacggatgcctattatcctttttttatttttgttgaatttgtttttactgttcactgatcttgggaagaacggtcatgtttaggttcaggaatgcatcttgctctgctgcaaaactctgctattttctgctgtttctgccaagtaatttgacattgaactttcttgtaactttgtgttcgacttgttcatgagaaacaaaatcctgacaaggccagtttt

SEQ ID NO: 3989 - DNA, 2118 bp, Cucumis melo
aaggaaggccatctcgaccgcccaattcagttcgaccttcgccggtgatcaccatgtcctccaccctacgatccacctccgttaccttcttcttcttctcttccctcctcatttcctcactctctatagtcctcgcttccgagtctgatcacaagtatcaacaagatgagttagtaactctatgggtgaataaagttggtccgtacaacaatccacaagaaacttacaattattacagccttccattttgtcatccatctggtcattctgctcacaagtggggtggtcttggcgaggtccttggaggaaacgaacttattgacagccaaattgagattaagttccaaaaaaatgtggagaggaccactatttgtcaactggagcttgatgaatcaaaggtcaagcagtttaaggatgcaattgagaatggctactggtttgagttcttcatggatgatttgcctctgtggggctttgttggtgagttgcatcctgacaagaatagcaataacgttaagcatgttctttacacacataagaacatcatcatcaaatataataaagaccagattattcacgtgaatctcactcaagaaaacttaaaaccattggaagttgggaagacattggacttgacatatgctgtgaagtggatttcgactaatgtcactttcgctcgacggtttgatatttatttggactacccattctttgagcatcagattcattggttctccattttcaattcattcatgatggtcattttcctcactggtttggtctctatgatattgatgaggactcttagaaatgactatgctaaatatgcacgtgaagatgatgatctagaaaccctggagcgagatgttagtgaagagtctggctggaaacttgtgcatggggatgttttccggcctcctcgtaacttagtaattctttcagctgttgttggtacaggtgctcagcttgcattgcttgttctgcttgtcatcctattggcaattgttggaatgttgtatgttgggagaggagcaattgtcacaactttcattgtatgctatgctcttacgtcatccatttctggttatgttagtgctgggatgtactcacgcaatgggggtaaaaactggataaaatcaatgatcttcacagcatctctatttccatttttgtgctttggaattggattcatcttgaacactattgctatattctatgggtctctagcagccattccttttggtacgatggttgtggtctttgtcatttgggctttcatttcttttcctttggctcttcttggtacggtaattggacgtaactggagtggtgctcctaacaatccatgtcgtgtgaagaccattcctcgtcctatccctgagaagaaatggtacctcacaccatctgttgtctccatgatgggaggattgctgccttttggcagtattttcatagagatgtattttgtctttacatccttctggaactacaaggtgtactacgtatatggattcatgctgctggtttttctaattctcatcatagttactgtctgcgtgaccattgtgggaacatatttcttgcttaatgccgagaactatcactggcagtggacttcatttttctctgctgcttcaactgctgtctatgtctacttctactcaatatactactattatgtgaagaccaagatgtcaggctttttccaaaccagcttctattttggatacactttgatgttctgccttgggttgggaattctttgcggagctgttggttacctgggttccaatttgtttgtacggaggatctacaggaacatcaaatgtgattaggggtatttttggaagcagaagacctacgctaccttgaagcattttcatagtggaggcaataacttcgagaagcccttgacacatgggaggcctagcagcgcagtaatacctgtagaaattaaaagattttgagatggggacatgttcttagctctgagatattttctttttggtaattgatgcgttttgcccaagctgtaattgaatatcttgatttagagtttgagagattgcttttcgtaatgtagaaaagttgaccaaattgttagacccgtgtcatttt

SEQ ID NO: 3990 - DNA, 2197 bp, Flaveria ramosissima
cggatccaaagccatacctattcgccccttttcctccgatcaatcgccgttagatccagattcactcgccggcgaccgacatgtggcccaatctccgatcaccacatcatctcactgctctcatcttcatcgcttcatttctcctcatctcatcgccggtgtccgcttcggagtacgatcacaagtatcaatccgatgagccggttaccctttgggtgaataaagtcgggccttacaataatccacaagaaacatataactattatagccttccattctgtcgtcaatctggtaatcctagtcataaatggggtggccttggcgaggtattgggtggaaatgagcttattgatagccaaattgacatcaaatttcaaaagaatgtggacaaggctacaatttgtgagcttgaacttgatgaatcaaaggttaagcagtttaaggaggccattgagaataactattggtttgaatttttcatggacgatcttccattgtggggttatgttggggacctacgttctgataggaacagtgatagcaaacatatgctgttcacccataagaatattactatacagtacaacaaagatcagatcattcatgttaatctgacacaagagaacccaaaaccactggaagttgggaaatcactagaaatgacttactcggtcaagtggactgaaactaatactaattttgcacaccgttttgatgtttacctggattaccatttctttgagcatcagattcattggttttccatattcaattcgtttatgatggttatcttcctcactgggttggtttcaatgattctgatgcggactcttagaaatgattatgccaagtatgctagggaagatgatgatctcgaaagtctggaaagagatgtgagtgaagaatctggttggaagcttgtccatggggatgtcttccgccccctcgtaatttggttttattgtcagcagttgttggaacgggtgctcaattggcgttgctgattcttcttgtcatcttgtttgcaattgtcgcaacgttatacgttgggagaggagcaattgtcactactttcatcgtttgttatgccctcacatcatttgtatctgggtatgtgagcggtggcatgtattctcgccatggtgggaaaaactggataaagtcaatgatcctgacggcatctcttttcccatttttgtgctttggaattggcttcattctgaacactattgctatattttatgggtctctagctgcaattccatttggcacaatggtggttgtttttgtcatctgggctttcatttctttccctcttactctccttggtactgttgtcggaaggaactggagtggggccccgaacaacccttgccgtgtgaagactattcctcgcccaattcctgaaaaaaagtggtatctcacaccatctgtggtctcaataatgggagggttgctaccttttggcagtattttcattgaaatgtactttgtcttcacatccttctggaattacaaggtgtactatgtttatggatttatgctacttgttttcctaattcttgtaattgtgactgtgtgcgtgacaattgtgggaacatattttctgctaaatgccgagaactaccactggcaatggacttcattcttctctgcagcctctacagctatttatgtctacttgtattcaatatattactactatgtcaagactaagatgtccggcttcttccaaaccagcttttactttggatacacagccatgttctgccttggtttaggaattctctgtggtgctgttggatatttgggttctaatctctttgtgagacggatttatcgaaacatcaagtgtgattaaggctcttaagcaaaagatcaagtgggctctaatcctccgcggttttgtagtttattttgttgataccgaaggaagattcaaatgatggggttgagggacttgttattatttgtaacctgtgaggaatattggggtctttcttccctccattgataggaggaatgtagaagaaaggtttagagcacatgcaagaaattgttttttattatgaacaaaaaggggggtgggtggttgggtgtgtacaagactgttaatgtagcaagctcttaagaaaaaacttgttatatacatcttctattgtattcttatcatttttagacgggttagcgggttaag

SEQ ID NO: 3991 - DNA, 1914 bp, Ambrosia trifida
aatcatacttagatccaaacccaatcaccggcaaccatcatgtgggccgccgtcctcttctccgctttcttcctccttatctcctcacctgtcttagcttctgagtatgatcacaagtatcaaaccgatgaagcaattaacctttgggtgaataaggttgggccttacaataatccacaggaaacatataactactacagcctccgttttgtcgtaaacctggtaaccctgggcataagtggggtggcctgggtgaagtattgggcggaaatgaacttattgatagtcaatatgacgtcaagtttcaaaagaatgtggagaaggttacaatttgtaagcttgaacttgatgaatcgaaggttaagcagtttaaagacgccattgagaataattattggtttgaatttttcatggatgatctgccattctggggttttgttggggagatacataccgataagaatagcgatagcaagcatatgctattcacccataagaatattactatacactacaacaaagatcagatcattcatgttaatctcactcaagagaacccgaaaccactggaagctgggaaaacactagacatgacttactctgtcacgtggactgaaactaatatcaattttgcacaccgttttgatatttacttggattaccatttttttgagcatcagatacattggttttctatctttaactcgtttatgatggttatcttcctcactgggttggtttcaatgattttgatgcggactcttagaaatgattatgctaagtatgcgcgggaagatgatgatctagacagtctggaaagagatgtaagtgaagaatctggttggaagcttgtgcacggggatgtcttccgatcacctcgtagtttggctttattgtcggcagtggttggaacgggtgctcagctggcgctgctgattcttcttgttattttgtttgcaatcgttgcaacattgtacattgggagaggagcaattgtcactacattcatcgtctgctatgccttgacatcatttgtctctgggtatgtgagtggtgggatgtattcacgccatggtgggaaaaactggataaagtcgatgatcctaaccgcatcccttttcccatttttatgcttcggaatcggctttgttctgaacacgattgccatcttttacgggtctctagcagcaattccatttggaacaatggtgattgtttttgtcatatgggctttcatctctttccctcttgctcttctcggtacggttgttggaaggaactggagtggtgccccaaacaacccttgtcgtgtgaagactatccctcgccctattcctgacaagaagtggtatctcacaccgtctgtagtctccataatgggaggactgctaccttttggcagtattttcatcgaaatgtactttgttttcacatccttttggaattacaaggtgtactatgtttatgggttcatgctacttgtttttctgattctcatcatcgtgaccgtgtgcgtgacgattgtgggaacatatttcctgctaaatgctgagaattaccactggcaatggacttccttcttctctgcagcctctactgctatttacgtctacttgtattcaatatattactaccatgtcaagaccaagatgtcgggctttttccaaaccagcttctacttcggatacactgccatgttctgctttggtttaggaattctatgtggcgctgtcgggtatttgggctctaatctctttgtcagacggatttatcgaaacatcaaatgtgattaaggaaggcttttaaagaccagcgcaccacaatggcctttcaggttttgtagtttattttgtcgataccatatgaagacttgcagccgatttaaaagggggttacgcagaattgttttttttt

SEQ ID NO: 3992 - DNA, 2624 bp, Triticum aestivum
agtacaaaatttcagaaccagttaagctctgggtaaacaaggttggcccgtacaataatcctcaggaaacatacaactattacagccttccgttttgtcaaccagctgaaaaccctgcacataaatggggtggactcggagaggttctcggtggaaatgagctgattgatagtcagattgatatacagtttttgaaaaatgtggacaagggccccatttgcacaatagaacttgatgctaagaaggttcagcaatttactgatgccattgaaagctcatactggtttgagcttttcatagatgatctgccattgtggggttttgttggggagaccgacaaaaacaatgaaaacaagcactatctttacacacacaagaatattgttgttaaatacaacggtaacagggtaattcatgtcaatctcactcaagagtcacctaagcttcttgaagctggaagaaaattggacatgacatattcagtgaagtgggtgcaaacaaatgtggcatttgcacggcgttttgaagtttacttggactacccgttcttcgaacaccagattcattggttctccatcttcaattctttcatgatggtcattttcttaactggtttagtatcaatgatattgatgagaaccctgagaaatgattatgcaaaatatgctcgtgaagatgatgatcttgagtcacttgaaagggatgttagtgaggaatctggatggaagcttgttcatggagatgtatttcgacctccacgcaacctaatgtttctgtctgctgttgttggcattggcactcagatggcagctcttatcctgcttgttattgtacttgccattgttggtatgctttatgttggacgaggagctattatcacaacctttatcgtgtgctacgcgcttacatctttcatttctggatatgttagtggcggcctctactcaaggaatggcggcaaaaactggataaagtctatggtccttaccgcgtccctttttccattcttgtgcttttcaattggattagtgttgaacaccattgctatcttctaccattcattagcggctataccatttggtacaatggttgtcatatttgtcctttgggcttttatctctttcccactggtgctattgggaacagtagttggtagaaactggagtggtgctcccaataacccatgccgtgtgaagacaatcccacgtcctattcctgagaagaagtggtacctaacaccttctgttatctcattgatgggtgggcttcttcccttcggcagcattttcatcgagatgtacttcgtgttcacttcattctggaactacaaggtgtactatgtttatggcttcatgttgctagtctttgtcatcctcctaatcgtaacagtatgtgtcactattgtgggcacttatttcttgttgaatgccgagaactatcattggcaatggacatcgttcttctcggctgcatcaaccgccttgtatgtatatctatacgctatatactattatcacgtgaagacaaagatgtcaggctttttccagactagcttctacttcggctacacgttgatgttctgtctggggctaggcatactttgtggtgctatcggctatctggggtcaactctgtttgtcaggagaatctacagaaacatcaaatgcgactaaactactactccgattctgtaggctattagcacttagcagatcatgtgttgttgagtaacgcttctaagattctaattaacttttggaaactatacaggaggtggttctcccttcgtttaccttaatatacttttattttggtctatatctacccccgtcatcaaaactggccccataaatgtatacctatattagttcaggaattagtctcagtactgggatttacatctacctttatctttttagggcggccctctagtttatgttcattgatgcagtgcagattccgctgaacctagatgtgcccctacaatgggttgcagcattcagattccgttttatgtcgtatataaaagcaaactagtaatacgctaatgctacagtctgaatgagtagcccccgttgaactgtaagccaaccagtttgagatgtgccccttcgtttgctggttttcatttgcgatcgagcagaactgttagccaaccaggtcaaacgagataacctttagcttgctgacggcactatatttgttactcctatttcagttagctgtgactgcactctgcagtgaccatgtgctgaattgtttttgtaataccaataaatgtttgtgttattttcgtaagtgtacattttattcaaggactacgatgacagagggaaacttgtgtaacattggatcccacatggatcctagacgcgaggatgatatgggtggtatagttttgttccttgaaaacctaacatctcgccagaggcaactagggtttcaaggggatatttcggtgcacgtgctggccagtgaaaaagaatcagctgcacaagacaagcgtgaggaacacaatgtgagaaagaatacagacgagttctcgtgacgccatttctcgggaggttgttgttggcgccggtgatggtggaccaagcttaattacctatttagggaattgtaag

SEQ ID NO: 3993 - DNA, 2491 bp, Hordeum vulgare
tatgtttcttacatgcagtacaaatctggagattcagttaagctctgggtgaataaagttggaccttacaataatcctcaagaaacttacaactatcacagcctcccattttgtcagccatctgagaaccctgggcacaagtggggtggtcttggagaagtcctgggtgggaacgagttgattgatagtcagcttgacataaagttcttaaaaaatgtggaaagggggtccatttgcacactggaactagattccaaaaagattcaacaatttgctgatgccattgaaagctcgtactggtttgaatttttcatagatgatctgcctctttggggtttcgttggagagactgacaaaaacagtgaaaacaagcactatctttacacacacaagaatattcttgtaaagtacaacgataacaggataattcatgttaatctcacccaagagtctccgaagcttcttgaagctggcaagaagttggaactgacatattcagtgaagtgggtaccaacagatgtttcatttgcacgccgttttgaagtttacctggactatcctttctttgaacaccagattcactggttctccattttcaattctttcatgatggttatttttctcactggtttggtttcaatgatattgatgcgaacactgagaaatgattatgcaaaatatgctcgcgatgatgatgatctagagtcactggagagagatgttaatgaggaatctgggtggaaacttgtccatggtgatgtatttcgtcctcctagaagcttgacacttctttctgctcttgttggtatcggcacccagctggcagctcttatcctacttgtgattgtattggccatcgttggcatgttatatgttgggcgaggggctatcatcacaaccttcatcgtgtgctatgctcttacatcttttatttctggatatgttagtgctggtctttactcgaggaatggcggtaaaaactggataaaggctatgatccttacagcatccctctttccattcttgcactttgccattggctttgcgctgaatacaattgcaatcttctacgggtcattagcagcaataccatttggtacaatggttgtcatgtttgtcctttgggctttcatatcttttccgctggtacttttgggaacggtcgttggtagaaactggagtggggctcctaacaatccctgccgagtaaagactattccacggcctattcctgagaggaagtggtaccttacaccttctgtcatctcattgatgggcgggcttcttccctttggcagcatcttcatcgagatgtactttgtgttcacctcattctggaactacaaggtgtattatgtttacggcttcatgttgctggtctttgtcattcttctaatagttacaatctgtgtcacaattgttggtacttatttcttgctgaatgctgagaactatcattggcaatggacttcgtttttctctgccgcatcaacagcgctatatgtgtatctgtactccatctactactatcatgtgaagacaaagatgtccggctttttccagacaagtttctactttggctacacattgatgttctgtcttggtctgggcatactttgcggtgctattggctatgtagggtcaactctttttgtgaggagaatctacagaaacatcaaatgtgattaatttcctgctacatatgtggggtgggggcggagcagtatcagaagaaatcatatacgtgccattgctttggaagtgaggccttcaaaatggattaatgctagttcctgattagggtttcagaactacgccccgttcgcttattccatcacaccccttctttttgcatacttatttgttccctggagctgctctcatagtgtatacatctgtggtagcttaggagttcagtacaagtgcctggtgcaggttcttatttttctttgtttcttttgttgcattcctccttttcaaatcagaaataggaagtgagtatccatgcggcactgtctggacttcccctctgaattgttgcgtccaattcaaggatatcatgtactacgtgagatctgtgtatttatatatatcaacatttaatgcatgagagtatgtgtgtcctctatcatgttgggaaaattctgtgaaaatcctttcgatgtagcggtgcttttgtaactgtgatgtctatttatttgtaacttttgaggtaacttgagtgacatttgattttccaccttgtgggggtttctatgatgagaaacatgtttaagcatgaatcactttttggaggttaaagcaactggggcatttcgcccactacagcttattacagcaacacaaagttggaaccgtcttgctcccagatcacctggtgggatcttcacaaccattgccaagcgtggcaaagccatgcacagccctctcctgcatcacgtttacatagacaggcggcgccgttgcagcttaagtccttgatgacatgcgc

SEQ ID NO: 3994 - DNA, 2248 bp, Arabidopsis lyrata
tattacccaaaatctctacaaagtgaaacactgagctgaggatctcgctctctcctcgattggtatctctccctccgtcattcctcagatctgatcgtccgccggttttcacgatgccgtcttcctcctccgccgtcgtcgtgtttcttcttctcgtttcccttctcactcctacgttcgcatccgattcagatcacaagtatcaagccgatgagcaggttaccctgtgggtgaacaaagttggcccatataacaatccacaagaaacatacaactattacagtcttccattttgccgcccatctggaaacaatgttcacaaatggggtggtcttggtgaagttcttggtggaaatgagctgattgacagtgagattgcgataaagttcttgaagaatgtcgatagaaatgtcatctgtccgcttgaactcgatgaagctaaggtcaagcatttcaaagatgcaattgaatctagctactggtttgaattttttatggatgatctacctttgtggggctttgtgggtgagctgcatcctgacaaaaatagtgaaaacggcaagcatgtcctctacacacataagaacattgttgtcaaatacaacaaagaccagatcattcatgttaatctcactcaagacaacccaaggccattggaagcagggaaaaaaatggacctgacgtattctgtgcaatggattccaacaaatgtcacatttgctcgccgctttgacgtctatcttgattatccgttctttgaacaccagatccactggttctccatctttaactcgttcatgatggttattttcctcactggtttggtctcaatgatattgatgaggactctcagaaatgattatgcaaagtatgctcgagaagatgatgatcttgagagcttggaacgggatgtaagtgaagaatctggttggaaacttgtacatggagatgtgttcaggccagcaagtagtctagttctactctcagctgtagttggcacaggtgcacagttggcgttactggttcttcttgtcatattaatggccatcgtgggaactctctacgttgggagaggagcaatcgtcacaactttcatagtttgctatgctctgacttcctttgtctctggttacgtgagcggtggaatgtactcaagaagcgggggtaaacattggatcaagtgcatggtcctcacggcttctctctttccctttttgtgcttcggaattggctttctcctaaacacaattgccatattctatggatctcttgcggctattccttttgggacaatggtggttgtgtttgtaatttgggggttcatttccttccccttagccctcctcggaacggttgttggaagaaactggagcggtgctcctaacaatccatgccgtgtgaagaccattccacgtccaatccctgagaaaaaatggtacttgactccatcagttgtctccctgatggggggtttactaccctttggaagcatcttcattgagatgtactttgtcttcacatccttctggaattacaaggtctactatgtgtatggattcatgttactggtttttgtgattctcgtcatagtgacggtgtgtgtgacaattgtgggtacatacttcctgctgaatgcagagaactatcactggcaatggacttcatttttctctgctgcttcgacggctgtctatgtctacttatactccatctattactattacgtaaagaccaagatgtccggattcttccagacaagcttctactttggatacaccatgatgttctgtctcggccttggaatcctttgcggagctgttggatacttgggatcaaatctgtttgtaaggaggatctacagaaacatcaagtgcgactagaagaggtaaacgggaaaaaaagagagaaaacaaatccaattagaagaaagcttcttatgaggttatatattatattgaaggaacataatatattcttcaatgggggctttttgtctcttcatcttcttttttcttcttcttttttttttttctttcccattttggtaagtgaattgttctctttagattagaatcgagtgggtgtactatactactactacctgtaatctttttccctatctttttttggttcatatttacttcaccctcacctagatcattgaatatgttgtcctctaggagcaattggatgaattattgtcatgtgttgggacttgggagacgttaactctcgttcatggtgttaa

SEQ ID NO: 3995 - DNA, 2258 bp, Arabidopsis thaliana
atcgttgtttttgtattacccaaaatctctacaaagtgaaaacactgagctgaggatctcgctctctctcgattggtatctctcgctccgtccttcctcagatctgatcgtccgccggttttcacgatgccgtcttcctcctccgccgccgtcctcgtgttccttcttctcgtttcccttctcactcctacgttcgcatccgattcagatcacaagtatcaagccgaggagcaggtcaccctatgggtaaacaaagttggcccatataacaatccacaagaaacatacaactattacagtcttccattttgccgcccatctggaaacaatgttcacaaatggggtggtcttggtgaagttctaggtggaaatgagctgattgacagtgagattgcgataaaattcatgaagaatgtcgagagaagtgtcatctgtccgcttgaactcgatgaagctaaggtcaagcattttaaagatgccattgaatctagctactggttcgaattttttatggatgatctacctttgtggggctttgtgggtgagctgcatcctgacaaaaatagtgaaaacggcaagcatgttctttacacacataagaacattgttgtcaaatacaacaaagaccagatcattcatgttaatctcactcaagacaacccaaggccattggaagcagggaaaaaaatggacctgacgtattctgtgcaatggattccaacaaatgtcacatttgctcgccgctttgacgtatatctggattatccgttctttgaacaccagatccactggttctccatctttaactcgttcatgatggttattttcctcaccggtttggtctcaatgatattgatgaggactctcagaaatgattatgcgaagtatgctagagaagatgatgatcttgagagcttggaacgggatgtaagtgaagaatctggttggaaacttgtgcatggagatgtgttcaggccagcaagtagtctagttctgctctcagcggtagttggtacaggtgcacagttggcgttgctggttcttcttgtcatattaatggccatcgtgggaactctctacgttgggagaggagcaatcgtcacaactttcatagtgtgctatgctctgacttcttttgtctctggttatgtgagcggtggaatgtactcaagaagcgggggtaaacattggatcaagtgcatggtcctcacggcttctctcttcccctttttgtgcttcggaattggctttctcctaaacacaattgccatattctatggatctcttgcggctattccttttgggacaatggtggttgtgtttgtaatttgggggttcatttccttccccttagccctcctcggaacggttgttggaagaaattggagcggtgctcctaacaatccatgccgtgtgaagactattccacgtccaatccctgagaaaaaatggtacttgactccatcagtcgtctccctgatggggggtttgctaccctttggaagcatcttcattgagatgtactttgtcttcacatccttctggaattacaaggtctactatgtgtatggattcatgttactggtttttgtgattctcgtcatagtgacggtgtgtgtgacaatcgtgggtacatatttcctgctgaatgcagagaactatcactggcagtggacttcatttttctctgctgcttcgacggctgtctatgtgtacttatactccatctattactactacgtaaagaccaagatgtccggattcttccagacaagcttctactttggatacaccatgatgttctgtcttggccttggaatcctttgcggagctgttggctacctgggatcaaatctgtttgtaaggaggatctacagaaacatcaagtgcgactagaagaggtaaacggaaaaaaagagaaaacaaatccaattagaaggaagctcttacgaggttatatattatattgaaggaacataatatattcttcaatgggggctttttgtctcttcatcttcttctttttttttttttttttttcttcccattttggtaagtgaattgttctctttagattagaatcgagtgggtgtactatactactactacctgtaatctttttccctatctttttttggtcgtatttacttcacttcacttagatcattgaatatggtgtcatctaggagcaattggatcatttaattattgtcatgtgttgggccttgggagtcgttaactctcgttcatggtgttaa

SEQ ID NO: 3996 - DNA, 2181 bp, Cucumis sativus
atcgccttgaatgaacgaagaaatccaggtagtggtaaaaggaggccatctcgaccgcccaattcagttcgaccttcgccggtgatcaccatgtcctccaccctacgatcctcctccgtcaccttcttcttcttctcttcccttctcatttcctcactctccatagtcctcgcttccgagtctgatcacaagtatctacaagatgagtcagtaactctatgggtgaataaagttggtccgtacaacaatccacaagaaacatacaattattacagccttccattttgtcatccatctggtcattctgctcacaaatggggtggtcttggcgaggtccttggaggaaacgaacttattgacagccaaattgagattaagttccaaaaaaatgtggagaggaccactatttgtcaactggagcttgatgaatcaaaggtcaagcagtttaaggatgcaattgagaatggctactggtttgagttctttatggatgatttgcctctgtggggctttgttggtgagttgcatcctgacaagaatagcaataacgtgaagcatgtcctttacacgcataagaacatcatcatcaaatataataaagaccagattattcacgtgaatctcacccaagaaaacttaaaaccgttagaggttgggaagacactggacttgacatatgctgtgaagtggatttcgactaatgtcactttcgctcgacgatttgatatttatttggactacccattctttgagcatcagattcattggttctccattttcaattcattcatgatggtcattttcctcactggtttggtctctatgatattgatgaggactcttagaaatgactatgctaaatatgcacgtgaagatgatgatctggaaaccctggagcgagacgttagtgaagagtctggctggaaacttgtgcatggggatgttttccggcctcctcgtaacttagtaattctttcagctgttgttggtacaggtgctcagcttgcattgcttgttctgcttgtcatcctattggcaattgttggaatgttgtatgttgggagaggagcaattgtcacaactttcattgtatgctatgctcttacgtcatccatttctggttatgttagtgctgggatgtactcacgcaatgggggtaaaaactggataaaatcaatgatcttcacagcatctctatttccatttttgtgctttggaattggattcatcttgaacactattgctatattctatgggtctctagcagccattccttttggtacgatggttgtggtctttgtcatttgggctttcatttcttttcctttggctcttcttggtacggtaattggacgtaattggagtggtgcccctaacaatccatgtcgtgtgaagactattcctcgtcctatccctgagaagaaatggtacctcacaccatctgttgtatccatgatgggaggattgctgccttttggcagtattttcatagagatgtattttgtctttacatccttctggaactacaaggtgtactacgtatatggattcatgctgctggtttttctaattctcatcatagttactgtctgcgtgaccattgtgggaacatatttcttgcttaatgccgagaactatcactggcagtggacttcatttttctctgctgcttcaactgctgtctatgtctacttctactcgatatactactattatgtgaagaccaagatgtccggctttttccaaaccagcttctattttggatacactttgatgttctgccttgggttgggaattctttgtggagctgttggttacttgggttccaatttgttcgtacggaggatctacaggaacatcaaatgtgattaggggtatttttggaagcagaagacctacgctaccttgaagcattttcatagtggaggcaataacttcgagaagcccttgacacatgggaggcctagcaacgcagtaatacctgtagaaattaaaagattttgagatggggacatgttcttagccctgagatattttctttttggtaattgatgcgttttgcccaagctgtaattgaatatcttgatttagagtttgagagattgcttttcataatgtagaaaagttgaccaaattgttagacccatgtcatttttataatatttttttttttgtcttcac

SEQ ID NO: 3997 - DNA, 2103 bp, Tripterygium wilfordii
gaattgactttattcgtggaatctggaccattagatcggcgatcgccatgtcctacgccggccgattcctctctctcttcgccttcattgttctcttcctctctgccgctgcgtttgcctccgagtccgatcacaagtatgaagtggatgatccagttacattttgggtgaacaaagttggtccttataataatcctcaagagacatataactattatagccttccattttgccgtccggctggtgatcctgctcacaaatggggtggccttggtgaggtcctcggtggaaacgaacttatagacagccgggtatccataaagttccgaaagaatgttgataaaagtctgatttgtcaacttcctcttactgcggaaaaggtcaaacaattcaaggatgcaattgagaacagttattggcttgaatttttcatggatgacctgccattatggggctttgtcggcgaattacatcctgataagaacagcgataacaacaagcatgttctttacacacataaaagcattactgttaaatacaacaacgaccagatcattcatgttaatctctctcaagaagaccccaaagcccttggaagacgggacaactttggacatgacatactctgttaagtgggttccaactaatattacttttggtcgtcgtttcgatgtttaccttgactatcctttctttgaacaccagatccactggttctccatttttaattctttcatgatggttatcttcctcactggtttagtgtcaatgatattgatgcggactctgaggaatgactatgcaaaatatgcgcgggaagatgatgatttagagactctggaaagggatgtgagtgaagagtctgggtggaaactggttcatggagacgttttccggcctccacggaacttggttcttctttcagctgttgtggggaccggtgctcagctagctttacttgtcctcctagtcatcttactggcgattgtggcaatgttgtatgttgggagaggagcaattgttaccactttcatagtgtgttatgctcttacatcattcatttctggttatgttagtggtggaatgtactcacgccatggtggtaaaagttggataaagtcgatgattctcacagcatctctatttccatttatgtgctttgggattggattcattttgaacacgattgcgatattttatgggtccctggctgctattccctttggcacaatggtggtggtttttgtgatttgggctttcatttctttcccgctggcgcttcttggtactgttgtgggcagaaactggagtggtgctcccaataatccatgccgtgtgaagaccatcccacgaccaattcctgagaagaagtggtatctcaccccttcagtggtctcaatgatgggtggactgctaccatttggaagtatattcattgagatgtattttgtcttcacatccttctggaattataaggtttactacgtgtatggctttatgctactggttttcctgattctcatcatcgtaagtgtttgtgtgacaatcgtggggacatatttcttgctcaatgctgagaattatcactggcagtggacatcattcttctctgcagcgtcgacagctgtctatgtgtacttctactcgatatattactaccacgtgaagacaaaaatgtcgggcttcttccagaccagcttctactttggatacactttgatgttttgtcttggtttaggaatcctttgtggtgctgtcggttatctgggatccaacctgttcgtgagacgaatctacagaaacatcaagtgtgattagaggctcttgggaggaaaaagacctgatggtgcttccctgaactagttattacatacgttgaaacaattaatcataggagggacgccattgtcatggatggagtacccagcaatgttttgaagaggcgaaacacgggtcttagaaggggggatccattgttctctcatgggagttggggaaaatccctgagattttttctctcctctacctttttccccacccatactgaaagcctgaatttagatttgaggtgtatttttattatctgagaagctagcaagtgag

SEQ ID NO: 3998 - DNA, 2973 bp, Ricinus communis
ccaccatgtaaattaaaattacttcctttcaattttcatttctttatttgaacgaaatcaaagtctgtgtaatctacgtaccgctccaacgagccccaaatctgaaaacgccattagctctcgtcactctctttctgtctctctctgtctttctttgataaaaagagaaagaggcaaatcagagctgataaaaacttaacccgaaacgtatccatacgtaagcactaaatagacctctgcttgactcgaatcttgacccgccagatcccgctttcgccggcgatcgccatgtcctcctcctccgcctttgcctccatcaccacggtccgaatccgatcacccgccatttccttattcgcgttcatttctcttattctcctcctctctcccgtcctcgcttccgagtcggatcacaagtaccaacaagatgagtcggttactctttgggtgaataagattgggccttataataatccacaagaaacgtacaattattacagccttccattttgccatccatctggcagtgctgggcacaaatggggtggccttggtgaggtcttgggaggaaatgaacttattgatagcaagattgacataaagttccagaagaatgtggaaagaggtaccatttgttcacttgagcttgacgaagcaagagtcaaaattttcaaggatgcaattgagaacaactattggtttgaattcttcatggatgacctgccactgtggggttttgttggtgagttgcgtcctgacaagaacagtgataacggcaagcatgttctttacacacacaagagcattactgttagatataataaagatcagattattcatgtcaatcttacacaagacaatccaaagcccttagaaactggaaggatagtggacatgacatattctgtcaaatggcttccaacaaatatcacttttgcacgtcgttttgatgtgtatttggaccaccctttctttgagcaccagattcattggttctccattttcaattccttcatgatggttatcttcctcaccggtttggtgtcgatgatattgatgaggactcttagaaatgactatgccaagtacgcacgggaagatgatgatcttgagacactggaaagagatgttagcgaggagtctggttggaaacttgtgcatggtgatgtttttcgtccacctcgcaatcttgttgttctttcagctgttgttggcacaggtgctcagctagcactgcttgtgcttcttgtcatcttgttggcaattgttgggacactttatgttgggaggggttcaattgttacaactttcattgtatgttatgctctcacatcgttcatttctggttatgtgagcgggggaatgtattcccgccatggtggtaaaagttggataaagtcaatgatccttacagcttctctatttccatttatgtgctttgggattgggttcatcttgaacacaattgctattttctatgggtctttagcagctattccctttggcaccatggtggtggtttttgtaatttgggctttcatttcattccctctggcacttcttggcacagttgttggaagaaattggagtggcgctccaaacaatccatgccgtgtgaagaccattcctcgtccaattcctgagaagaaatggtacctcacaccatctgtggtctcactgatgggagggctactaccttttggcagcatattcattgagatgtattttgtctttacatccttctggaattacaaggtctactatgtatacggcttcatgttacttgtttttctgattctcattattgtcactgtgtgtgtgacaatcgtcgggacatatttcttgctcaatgctgagaactatcactggcagtggacatcatttttctctgctgcgtcaacagctgtttatgtgtacttgtactcaatatattactattacgtgaagactaagatgtcgggcttcttccagacaagcttctactttggatacactttgatgttctgtcttggtttaggaatcctttgcggagctgttggttatttgggttccaatttgtttgtgaggaggatctacagaaacatcaagtgtgactaaactgaattgaggagaaagacctgggagcttctctgggcatacattcttcttgagataataaattttgaggaagcctctggttatctaggatgggacggccatcttacagatgcattaaaatgtttgacgatgggggagtattcttctttctctggactaggggaagccctgagattgtttttggtttttttccccggctgtaacccgcctgtcactttttcctttttcatgttttacaaataggttccctatgtaagaactgatccctaattgccccatttcctgaatttgttttgttatttgcacatctttggaagcagaaactatccagggggcaaaagcttgaagaaatgaattttgtgcttcagaattatgtgcatacactagttgttgaaacgcctacttttgtatcgtcaatgtaatttccttttctttaagcggaatgaaatcttgacaggttttttggtcgacttgatttttatttttttttttgtttcttttttgggcgaagttcgaaatgattcaaatggctgctattgcggcctggaaatgagattctttaaaagtttacttaaagaggaatacaagaggggaattacccatggaatgtcgagtccatgcaaaatctggggacagtttcattttgtttgcacacgaaatttccaaactgaagatttttattttacattttagcaattgccctatcttcctaaatgtggtcaaggttatgtcccaattggacagttgggttaatttttggatttgtgggtttccatgtggagcatcagtggctcttcatttaacaaaggaagaccgatttattattgcaaatatacaagccaggaaattataaatatataatcaccagaagaacct

SEQ ID NO: 3999 - DNA, 2024 bp, Phalaenopsis aphrodite
tctcttcccggtcaccgtcacgccgcgcttaagtaaatcttgcttaccatcgtagatctgccgacgccatggtcgtcacagcgagatctctaacccatttagccgccggaatcgccatcgttatccttaccgcctggccggcgtcggcgtcggagtccgaccacaagtatcaacctgatgatcctgttacactatgggtaaacaaagttggtccttataacaacccgcaagaaacatataactattatagccttccattttgccagcctagagagaaccctcctcataagtggggtgggctgggagaagttttgggtggaaatgaactgattgatagccagattgaattaaagttccagaaaaatattgaaaaagggtccatttgttctcttgaactcgatgatgttaaggtgaatatttttaaggatgcaatagagacttcgtattggtttgaatttttcatagatgacttgcctctatgggcatttgtgggagagactggaaaaactgatgagaacaagcattatcttttcacacacaagaatatccttgtgagatacaatggagaccagattattcatgttaatatcacccaagaaatccctaaactattggaacctggaaagacattggagctgacatattcagtcaaatggatagcaacgaatgtaacatttgctcatcgttttgatgtatacttggattaccctttctttgaacaccagatccactggttctctattttcaactcctttatgatggttattttcctcactggcctggtttctatgatactcatgcggactcttagaaatgattacgccaaatatgcacgtgaagatgatgatttggagactctggaaagagatgtgagcgaggagtctggttggaagcttattcatggtgatgttttcaggcctgtccgcaatttggctcttctttcagctgtagttggtactggtgcccagctggcgttgcttgttctcctagtcattttactggcaataattgggatgctttatgttgggcggggatctattcaaactacttttatattatgctatgctttcacttcatttatttcgggctatgtcagtggtggactttattcgcggaatggcggtaaaagctggattaaaacaatgattctcacagcgtccctcttcccatttttgtgctttggaattggttttgtcctcaacacaattgccatattctatcgatcacttgcggccatcccttttggaacaatggtggttgtttttgtaatttgggcctttatctcatttcctctcacacttctcgggacggtggtgggtaggaactggagtggcgttcctagcaacccctgccgtgtgaagaccatacctcgtcctatccccgagaaaaagtggtatctcacacccttcattgtctcgctcatgggcggcttacttcctttcggcagcatcttcattgaaatgtattttgtattcacatccttctggaactacaaggtttactatgtctatggattcatgttactggtattcttaattctcaacattgtagctgtctgtgtcacaatcgtcggcacatatttccttctcaatgctgaaaactatcattggcagtggacctcattcttctctgctgcttccacagctgcttatgtctatctttactccatatattacttctatgtgaagaccaaaatgtcaggtttcttccagaccagcttctactttggctacaccctcatgttttgtctcggactcggaatactctgcggtgctgtgggttttcttggttcatccttatttgttcgaagaatttatagaaacatcaaatgtgattagctcggacgaagttttggttgtttcgcgacagattttcgtcttcaagctgtgaaggaaaatattttgagagtgaaagataaagtttagattttccatggttggctgattttcatctaataaccctttaaatttatttgagatgtaattttaggtgatatggaattttgaatttttcttattgtaatt

SEQ ID NO: 4000 - DNA, 2257 bp, Olea europaea
gttctcagtcaacccgaccggttttctatatcggactcggatatcttcgccgattgccgttccgatgcggtccaccgttcgactctcctttcttttactcgcctccttctccctcctctctctggcgttcgcctccgagtccgatcacaagtatcaaccagatgatcctgtcaccctttgggtgaataaagtagggccatacaataatccacaagaaacttacaattattatagccttccattttgtcgcccatcgggtaatgctgctcacaaatggggtggtcttggtgaggtattgggtggaaatgagctcattgatagcttgattgacataaaattccgaaaaccggtggacaaaaccactatttgtgagctcgaacttgatgaagcaaaggtcaaacaattcaaggatgctattgagaatagttattggtttgaatttttcattgatgatctacctttatggggttttgtgggtgagctgcactctgacaagaataatgataataagcatgtgctctacacacataagagtataactgtgaattacaacaaagatcaaatcattcatgtcaatcttactcaagggggtgcaaaaccattggaagttggaaaaacagtggacatgacttactcggtgaaatggattccgacaaaaacttctttcgctcgtcgttttgatgtttacctggactacccattttttgaacatcagatacactggttctctattttcaattccttcatgatggttatattccttaccggtctggtatcaatgatattgatgcgaactctgcgaaatgattatgcaaagtatgctcgtgaggatgatgatttggaaacactggaaagagatgtcaatgaagagtctggttggaaacttgttcatggagatgtatttaggactccccgcggtttagttttactctctgctcttgttggcactggcgcacagctagccttgctggtactcattgttgtcttatttgcaattgtcggaatgttgtacatcgggagaggtgcaattgtcactactttcattatatgttatgcttttacatcattcatctcgggctatgtcagtggtggaatgtactcacgccatggtggcaaaaattggatcaaatcaatgattttcacagcttcattttttccttttctgtgctttggaattggtttcgtgctgaacactattgcaatattctatgggtctctagcagccattccctttggcacgatggtgattgtcttcgtcatctgggcctttatttctttccccctggcacttcttggtacggttgttggaagaaactggagtggtgctccaaacaatccatgccgagtgaagaccattccacgaccaattcctgagaagaagtggtacttgacaccatctgtagtttctgtgatgggaggattgcttccctttggcagcatattcattgaaatgtactttgttttcacttccttctggaattacaaggtttactacgtatatggctttatgcttctggttttcgtgattcttattattgttacggtctgcgtgacgatagtcggaacctatttcctgctaaatgccgagaattatcattggcagtggacttctttcttctcggcagcatcaacagctatctatgtgtacttgtactctatatattactattatgtgaagacaaagatgtcgggattcttccagatgagcttttactttggctataccctaatgttttgtcttggattaggaattctttgcggtgctgttggttacttgggttctaatctgtttgtaaggaggatatatagaaacatcaaaatcgactagtttatgagccgggagagagaaatctttgttctcatcgtcagggtgatatcgagagaagcctgcagtacctccttcagatatctggtaatgtccatgtttaatatgcaagatttgaggatgatctgtaattcgggatcgtgggaggccctaaaaaatttccccgttcttcgggttgtaaaaccaagtataattacataaatttagagtgattgttttcatgactgaaaagaggacggatgatactagttttttatttagttatttctctaatctttccggacaatggattctctttaccggtactgcatgtttgcatatcttttgcgaataggtgttcttgggagagcgactattactggaatggggaaatgagttttgtcttatgacagtcatctctatagagcattatattttaagtaatactattta

SEQ ID NO: 4001 - DNA, 2434 bp, Distylium racemosum
tttgaatccgatcccatcgttggaagctcgtggctctgtgccaccacagacagggcagaacaagggaaaagtgggtggagagatccggaccttgttggatccaaatctaacgtaaggcgaaaaaaaatggggcacttcaacaaaaagcagcaaaaaccctggttattcctatgcttagtcctctgtctcctccaggcattccacacaaatctggcttcagaatacgatcataagtatcgagcaggtgactccgttacgctatgggtgaacaaagttggcccttacaataaccctcaagaaacatataattactacagtcttcctttttgccaaccaaagaaaaaccctgtacacaagtggggtgggcttggcgaggttttgggaggaaatgaactcatcgacagccagattgatataaaatttggaaaacccgtcgagagaggcacaatatgtgaacttgagcttgatgatgcaaaagtgaagcagtacaaggatgctatcgagaatacctattggtttgaattcttcatggatgatttgccactatggggttttgttggtgaacaacaccctcacaagagtgatgaccagaagtatttgttatacactcacaagaatatcattgtgaaattcaataatgaccagataattcatgtcaacctaactcaggaaaatcctacgcctcttgttgctgggaagacgctagagtttacgtattcagtcaagtgggttgagacaaatgtaacttttgctagacgatttgatgtatatctggactatcccttttttgaacaccagatccattggttctccatcttcaattcatttatgatggttatttttcttacgggattggtctcaatgatattgatgcggactctaagaaacgactatgcaaagtatgcacgagaagatgatgatttagaaagtctggagagggatgtcagtgaagaatcaggttggaagcttgttcatggagatgtttccgtacacctcgaaacttggtcataatgtcagcattagtaggcacaggtgcacaactggccacgcttgtgctacttgttatcttgctggcaatcatcggcatgttatacattgggcgtggagcaattgtcacaactttcatagtctgctatgctcttacttcatttatatccggttatgtgagtggaggcttgtactcacgcaacgatggcaagcactggataaagtctatggctctcacagcatccctttttcccttcatgtgttttggtattggattcatactgaacaccatagctatattctatggttctctggctgctattccttttggcacaatggtggtggttttcataatgtgggcatttatttctttccctctagcacttcttggaacagttgttggaagaaattggagtggggctccaaataatccttgtcgcgtgaagaccattcctcggccaattccagaaaagaagtggtatctgacaccaactgtagtatcactaatgggtggtctgcttccatttggaagtatttttatcgaaatgtattttgttttcacctcattctggaactacaaggtatactatgtttatggcttcatgttgctggtgtttttgattctcattattgtgacagtatgtgtcacaattgtgggaacatacttcttgctgaatgctgaaaactatcactggcaatggacatcgttcttctctgctgcatcaacggctgcatatgtgtatctttattccatatactactactatatgaagacaaaaatgtctgggtttttccagacgagcttctattttgggtatactcttatgttctgccttggtctaggcatcctttgtggggcagttggttacttgggatcgactttgtttgtaagaagaatttatcgaaatatcaaatgtgattgaggacaaggaaaatttgtagagtagaagcaaagcaaagcatatttgacgcctgaatctgttaatggtcctgtgctgaggacttctttccccaaggataaaggttcacagttttataggataactttttggtttctgatcttttcatttgatactattcttgggcgcagaatgctttttgtaatattgaacaacgaagatgtgcaaattgtagatcactttactgctacatgtagcatctctctattcattgaaaaggtaaatgcccatcttcaagatgacaacaatgaaagaacactcttttagtagggccatttttgataagcatgatgattatttttgcccatagagatgtttttcaaccaaaggatggctttcaaatgcgggcctttatctagttaagagttggagagtgcaattgttattaccatcttaagagactattggattgatgttacactgataacttagattgagttattcatctataagtataaattacttaagtaattgagtttacaaaaaaa

SEQ ID NO: 4002 - DNA, 2983 bp, Gossypium raimondii
agagcatatgtgtcaaacattcattaggaaacatgatggtgtttggtatgggtactaaattgaacagtgaaatcaaatttaggtatcaaattagaactaaaattttcagttaccaaaatgaatattaaagtcaagtttaggttccaaattgtatattaacccttattaacaagggatcaaaatcattattatcttagaacgtcacttaaatttcatccaaaaaaaaaaaaatcattagaaaagagcgcgttacccgaaggtcaccaatcttagaaagaagacgagaaaacaagagagctggttcaaatttaaaaaaaaaaaggaaaaaattctctcccaaatttatagttcgaattataaaaggggaagagaactcagcagcagtgtagtgttttgaatcgacctccggtttagcttcagatccgagcaccgtcatgtcatcttccgtagtctccactgttcgttcaaccttatctcttttcgttgtcgttttcatattcttttctccggttttcgcttctgagtcagatcacaagtatcaacctgatgatcctgttactctatgggtaaataaagttggtccatacaacaatccacaagaaacgtataactattacagccttcctttttgtcatctgggcaccaatccggctcacaaatggggtggtcttggtgaggtccttggtggaaatgaactgattgatagccaaattgatataaagttccaaaagaatgtggaaaaaagtaccatttgccaacttgaacttgatgaagcaaaggtcagggagttcaaggatgcaattgagaacagttattggtttgaattcttcatggagtttaatgttaactttttaggctttgttggtgagctgcatcctgataggaacagtgataatggcaagcatgtcctctacacacataagaatattattattaaatacaataaggatcagattattcatgtcaatctcactcaggagagtccaaaaccactggaagcagggagaatatttgacctgacttactctatcaaatggattccaactaatgtcacttttgctcgtcgctttgatgtctatttagactatcctttctttgagcaccaaatccactggttctctgtcttcaattcattcatgatggttatcttcctcactggtctggtgtccatgattttgatgcgaactctgagaaatgactatgcgaagtatgctcgggaagatgatgatctggaaactttggaaagggatgtgagtgaggagtctggttggaaacttgtccatggtgatgttttccggcctccttacaatttggttctgctttctgccgttgttggcacaggagctcagctagcattgcttgttctccttgtcatcttattggcaattgtgggaacgttgtatgtcgggagaggagcaattgtcactacttttatactgtgttatgcttttacatcattcatttctggttatgtgagtggtggcatgtactcacggaatgggggtaaaagttggataaagtcaatgatccttacagcgtgtctgttcccatttatgtgctttggcattggtttcatcttgaatacagtcgctattttctatggatctctagcagctattccttttggaacaatggtggttgttttcgtaatttgggctttcatttcattccccctggcccttcttggtacagttgttggaagaaactggagtggtgctccaaataatccttgccgtgtgaagaccattcctcgcccaattccggagaagaaatggtatttgaccccctctgtggtgtctttgatgggaggacttctgccatttggcagcatattcattgaaatgtattttatcttcacatccttctggaattacaaggtttattatgtgtatggctttatgctgctggtcttcctgattctcatcattgtaactgtttgtgtgacaattgtggggacatatttcttgctaaatgctgagaattatcactggcagtggacatcgttcttctctgctgcctccacagctgtctatgtgtatttgtactccgtatactattaccacgttaaaaccaagatgtcaggcttctttcaaaccagcttctacttcggatacactttgatgttttgtcttggcttgggaattctctgcggagctgtaggttatcttggttccaatttattcgtacggaggatctatagaaacattaagtgtgactagaacattgctgtcggaaagtagaaccatcagcacttctgcgagaattctagttatcgaggcaataagtgctgagaggaagctcctgatcaggtacaggggaacccaacgaagcctatatattaaatcacggcgtttgacggtaacatgtattcttggtaccatggaacagggaaagccctgagattttgttttgcttctgttataattattattattattttattcctctggctgtaacttgaagccctggtttgttagatttcagatattgttttataattcagaaactagctaaagtataagacttgtgtcatttttacttgttatagatgtgtccttgacccctctgcttatagatgttgtcgtgtctgtaggaactgatacttaaattccatttggacttggactattactttttttccctctgatatataggaaccttttaaagtaattcagtaaatgaatggtgtttcttttcttggaaaatgtttcttatatttttccaggactaatatagaggaatcagaagggttctgtatactaggtagactgagtgaaaacggcattaaatagcgaaaataattacatggcctgtactgtaatagcaaaggagttagtaaaatcttttccgatgcaatgttaacgaaatatggatgttatgatatgaaagctgtggttggcataattatttaactttttttttttttttatggtttccaaatctgtaatatttgcttcgttatttttccttgctcaaaaagaaa

SEQ ID NO: 4003 - DNA, 2446 bp, Sequoia sempervirens
ttttgttaaatgaaataattttatctgtgttgagcaggcaagtaaatcttaaacttggacaaaagagatccaggcgaagcttaagcaggttgcgttggatccaaacccagggttaacaaaatgggtagggagctctggttattatgctcggtactatatctgttcacgacagcgtttgcttcggaatacgaccacaagtatggagcaggagatcctgtcaccttatgggtgaacaaagttggcccttacaacaatcctcaagaaacatacaactactatagtcttcctttttgtcatccagggaaaaatgctgtacacaaatggggtgggcttggcgaagttctgggaggaaatgagctcattgacagccaaattgaaataaaatatcgaaaaactgtcgagagaggcacaatttgtgaacttgaacttgatgctgcaaaagtgaagcagtttaaggatgctattgagaatacctactggtttgaattctttatggatgatttgcctctgtggggttttgttggtgaacagaatgcacagaagcgtgatgaccagaagtatttgttatacacacacaagaatatcattgtgaaaaccaataaggatcagataattcatgtcaaccttactcaggaaaatcctactccacttactgctggaaagccattggagcttacttattcagtaaagtgggttgagacaaatataacctttgctaggcgttttgatgtatatttagactatcctttctttgaacaccagatccattggttttccatcttcaattcattcatgatggttatttttctcactggtttagtatcgatgatcttgatgcgaactctgagaaatgactatgcaaagtatgctcgagaggatgatgatttagaaagtctggagagggatgttagtgaagagtcaggttggaagcttgtccatggagatgtttttagaacacctagaagcttggtcatgctgtctgcattagtggggacaggagcacaacttgctacgcttgtgcttcttgtcatcttactggcaatcattggcatgctatacattgggcgtggagcaattgtcacaactttcattgtgtgctatgcgcttacttcatttatatctggttatgtgagtggaggcttgtattcacgtaatgatggcaagcactggataaagtcaatggttctcacagcatctctttttccattcatgtgctttagtattggctttattttgaacacggttgctatattctatggttctcttgctgccattccttttggcactatggtggttgtttttataatgtgggcatttatttcttttcctttagcacttcttggaacagttgttggaagaaattggagtggggctccaaacaatccttgccgtgtgaagacaattcctcgtccaattccagaaaaaaagtggtatctgacacctgcagtggtatcattgatgggtggtctgcttccatttggaagtatttttatcgaaatgtattttgttttcacctcgttttggaattacaaggtttactatgtttatggcttcatgctgctggtatttttgattctcattattgtgacaatctgtgtcacgattgtgggaacatacttcttgcttaatgccgaaaactatcactggcaatggacatccttcttctcagctgcttcaacagctgcctatgtgtatctctattccatatactactattatatgaagacaaagatgtctgggtttttccagaccagtttctattttgggtacacattaatgttctgccttggtttgggcatcctttgtggagctgttggctacttgggatcaacaatgtttgtaagacggatttatcgaaatatcaaatgtgattgagggaaaggaaagaaaaatctttagatcagaaacagagcaaaggatatttgatgcctgaagctttcgaagtggtcctgtgcttaggacttgcttatttccaggaaagaggttcactatttgtttttgtagcggttcattcgaaagaatccctggttgtagcaatgctttttgtattattgaactctaagcatgagaaaattgaagatcacttttctactatatctgaaatcctcaagaaggagaaaattagagaacacattttatcaggtcgattattgattaagcaagatgattatttttgtcaacagatgttaatgaaaggatggcttttatgatgcgggccttgtcaacagtggcagagtgtaggcattttcatcatctttagagagtattgaattgatatcgttcagacaacttgaatttagttttactttcctagggacataagtactggggtttcgtcttaaattaatgactcaagctgttgcaattagggtttttgcaggaaatgtgatttgtcagagaacatgatatgctctcttgttctgcacttgtcatattaatactttct

SEQ ID NO: 4004 - DNA, 2365 bp, Glycine max
aaaaagagagagagtctcaatccttcaagggcaagtcctcctcctcgtcctcgtcgtgtttctctctgttctgattcgagatccgccatgtccatgctcttcagattctctctcctcctccctctcttcctctctacggcctttgcttccgagtcagatcataggtatcaacaagatgacccagttatcctttgggtgaacaaagttggtccttataacaatccacaagaaacgtacaattattacagcctaccattttgccgttcacctggtaatcctgcacacaaatggggtggtcttggtgaggtcctgggtggcaatgaactcattgatagccaacttgagataaagttcctaggaaatgtggagaagaccaccttttgccgtatagaacttgatgaggcaaaggttaaacagttcaaggatgcaatagagaataattactggtttgaatttttcatggatgaccttccattgtgggggtatgttggcgagttacatcctgataagaacggtgataatggcaagcatgtactttacacacacaagaacataaatgttcaatacaataaagatcaggttaggtccatttcattgcagatcattcatgttaatctaacttatgacaacccaaggcctctggaagtaggaaaatctttggacatgacatattctgtcaaatggtctcctacgaatgtcacttttggacgccgatttgatgtatacctggactatccgttctttgagcatcagattcactggttctccatttttaattcttttatgatggtcatcttccttactggattggtgtcaatgatattaatgcgaacattgagaaatgactatgcaaagtatgcccgggaagatgatgatttggaaactctggaaagagatgttagtgaagaatctggctggaaacttgtgcatggtgatgtttttcggcctcctcgcagtttggttattctttcagctgttgttggtacaggtgctcagcttgcattgctggttcttcttgtcatcttgttggctattattgggatgctgtatgttggacgaggagccatagtcacaaccttcattgtttgctatgctctcacatctttcatttctggttatgtgagtgggggaatgtactcacgtaatgggggtaaaaattggattaaatccatgatccttacagcatcactgttcccattcatgtgctttggaattggttttattttaaacacaattgctatattctatggatctctagctgcaatcccctttggtactatggttgttgtctttgttatatgggcttttatctctttccctctagcacttcttggcacagttgttggaagaaactggagtggtgctccaaataatccatgccgtgtgaagaccattcctcgtcccattcctgagaagaaatggtacctcacaccatctgtagtttcgctgatgggaggactgcttccctttggcagcatattcatcgagatgtattttgtattcacttccttctggaattacaaggtgtactatgtctatggcttcatgctactggtttttctgattcttaccattgttactgtttgtgtgacaattgtggggacatactttttgttaaatgctgagaactaccactggcaatggacttctttcttttcagctgcctcaacagctgtttacgtgtatttgtactcagtatactactactatgtgaagacgaagatgtcaggcttcttccaaaccagcttctattttggatacactttgatgttttgtcttgggctgggaattctgtgtggagctgtgggttatcttggttcgaatttgtttgtgaggaggatctacagaaacatcaagtgtgactaaggcttttgtaggagtctgagaccagagcacttccatatgtttgttgctggagacaataaatttcttagaggaagcctctggtcatgtgtggggaccaaacaatgtttgcaggtagtaagtatcacagggttgaggatggatggggatgcattttttctctatgtctaggggatgtattcttttctctatactagggaggccctgaggttttttccctgactgtttgaaagcctagattagaatgcagggattgatctttataatttagatagttagcaaaatatcagactcgttgcttttttttttttttttatataaataggtgccctattgacggactgatgtctgattcccctacacggtttagctattgtacgtagaggggatgaagtctcggaaatgaattttgtgcttctgaattttgtatcaaatctgaatatcctctcttaactacttcctgcacatctctccctctttgagttttaaatcattgatgtgc

SEQ ID NO: 4005 - DNA, 2345 bp, Helianthus annuus
actgtgtgaattgtaatttgcaagtaaattatataacacacgaactacaaaactatcaagacttgaaaccctcacgcagatcgaacacacattcatcttcacattcgcaaccgcaatcgccggcgatcccgatgcggccctccgtcagatcctccgccgttgcagcactcttcgtcaccgttctcctctttgcatcgccggtgttcggttccgattatgatcacaagtatcaatcagatgaaaaagtcaccctttgggtgaataaagttgggccttacaataatcctcaagaaacatacaatttctacagtcttccgttttgtcgtaaagatgatcatgctcaagctgcacacaagtggggcggtctgggtgaagtattgggtggaaatgagcttattgacagccaaatggacgtcaagtttcaaaagaatgtggataaaacgactgtttgcgagctggaacttgatgattcaaaagccatgcagtttaaacaggctattgagaataactactggtttgaattattcatggatgacctgccactgtggggttttgtgggtgagttacactctgataagaacagcgatagcaagcatatgctattcacacatatgaatatcaccatacaatacaacaaagaccagatcattcacgttaatctaactcaagaaaacccaaaacctttggaagctggtaaaacactggacatgacatattcagtaaagtggactgaaactaatgtcacatttgctcgccgttttgatgtttacctggattaccatttttttgagcatcagattcattggttctccatattcaattcttttatgatggttatctttctgaccgggttggtctcaatgatactgatgcggactcttagaaatgactacgcaaaatacgccagagaagacgatgatctcgaaaccctggaaagagatgtcaatgaagaatctggttggaaacttgttcatggagatgttttccggccacctcgtaatttggttttgctgtctgcggttgttgggacaggtgcccaattggcactattgattcttctcgtcatcgtgtttgcgattattggaatgctgtatgtcggacgaggatcaattgtaacaacatttatagtttgctatgctctcacttcttttgtttctggctatgtgagtggtgggatgtactcacgcaatggcgggaaaacttggataaagtcaatgatcctgactgcatcactttttccatttttgtgctttggaatcggtttcatactcaacactatcgcaatattctacggatctctagcagcaattccatttggcacaatggtggtagttttcgtcatttgggcttttatttccttccctcttgctcttcttggcacagttgttggaagaaactggagtggggcccccaacaacccgtgtcgtgtgaaaactattccgcgcccgattcctgtgaagaagtggtatctcacaccgtctgtagtttcactcatgggaggactgcttccttttggcagcattttcattgagatgtacttcgttttcacttccttttggaattacaaggtgtactatgtgtacgggtttatgctacttgtatttctgattcttataattgtgactgtgtgtgtgacaattgtggggacatatttcttgctaaatgctgagaattactattggcaatggacttcattcttctctgcggcgtctacagctatttacgtctacttgtattccgtatattactactatgtcaagacgaagatgtctggcttcttccaaaccagcttctactttggatacactgctatgttctgccttggattaggaattctatgtggagctgttggtcacctgggctcaaacctgttcgtcagaaggatctacaggaacatcaagtgcgactaagtcacattcacaggaaaaacaccgcccacagtggaccccgatctttgtagtaaacagcgaataccgattggaagcttgcatcaggtatgtgaacccgaaggcccgggcagtgataatttagtagtatacctaactcctgagattgagggaggtttgataagtttttgttccttccttttcatggagtgtagaaaaaacttagatgagaaatttaaattcagaggttgttttatgatccagaaaaaaagggctactttggttccacatatgttttttttttgtttttgtcttctgtagtgtggattttgcttcgagtttgcggttgtctttgaacaagtggtggggagggggtacatttatgtgcttgtgagcttttgtgcaaaacagatgatgtttattatatatacttgttctattcatttagtccaatttggc

SEQ ID NO: 4006 - DNA, 2387 bp, Eutrema halophilum
gaatctctggtcacgctttcgcttcgatcgctcgcatccgaggaaaataattaaagagctcataaatttgtaacatcatataacatttatgccacctgaatcgtatctctgagacgagtcattggtctaacacttctcaatcaccgtcggtctctgtcgtctccctcagatctgattcttcgccggattccgacatgccgtcttcctccaccgtccaatctcttttctccgtcgtcgcttgcgtcttccttcttctctctccggctttggcctctgagtcagatcacaagtatcaagctgatgagcaggttactctgtgggtgaacaaagttggcccttataataatccacaagaaacatataactattacagcctcccgttttgccgcaaaactgagaacagcgttcacaaatggggtggtcttggtgaggttcttgggggaaatgagctcatcgacagccagatagacataaaattcttgaaaaatgttgacagaagcgtgatctgtcaattggaacttgatgaacctaaggtcaagcatttcaaagatgccatcgagaatagttactggtttgaattatttatggatgatctgcctttgtgggggtttgtgggcgaactgccacctggtaaaaatagtgaaaacggcaagcatgttctttacactcataagaatattattatcaaatacaacaaagaccagattattcatgtaaatcttacacaagacaacccaaggccgttagaagcagggagaacggtggacttgacgtattctgtgaattggattccaaccaatgtcacatttgctcgtcgttttgatgtttatctagactatccattcttcgagcaccagatccattggttctccatctttaactcgttcatgatggttatcttccttactggtttggtctcaatgatattaatgaggactctcagaaacgattatgcgaaatatgctcgggaagacgacgacctggagagcctggaacgggatgtaagtgaagaatctggatggaaactcgtacacggagatgtgttccgaccaccacgtagtctggttcttctctcggctgttgttggtacaggtgcacagttggctttacttgttcttcttgtcatattaatggcaatcatcggtacactttatgttgggagaggcgcaattgttacaactttcattgtttgctacgctctgacgtcatttatctctggttatgtgagtggtggaatgtactcaagaagtgggggtaaacattggatcaagtgcatgatcctcacagcttctctcttcccattcttgtgcttcgggatcggattcctcctaaacacaatcgccatattctacggatctcttgcggctattcccttcggaacaatggtggtggttttcgtaatctggggtttcatttcgttccctctcgctctcctcgggacagtcgtcggtagaaactggagtggtgctccaaacaatccatgccgtgtgaagacaatcccacgtccaatccctgagaaaaagtggtacttgactccatctgtagtctctcttatgggaggtctcttaccctttggcagcatcttcattgaaatgtacttcgttttcacatcgttctggaattacaaggtatactatgtatacgggttcatgcttcttgtatttttgatacttgttgtggtgaccgtttgtgtgacgatcgtggggacgtatttcttgttgaatgcggagaactatcactggcaatggacatcgttcttctctgctgcttcgaccgctgtttatgtctacttatactcgatctattactactacgtaaagaccaagatgtttgggtttttccagaccagcttctactttggatacaccttgatgttctgtctcggcctcggaatcctttgtggagctgttgggttcttaggatcaaatctgtttgttagaaggatctacagaaacatcaagtgcgactagagagaaaattaccaaaccaaaaaaaaaaagcggtaaagttggatcgtagaggcagttaagtctgttagagagaaagcctcttacgggtttagatttataaacaagggaaagtggggaatcattgtggaggagaaggttgtatgggtgattcaaaatccaacttatatcatattcttcttgatatctttttttttttttttgcttgggggagttctttttgttttcattcttcttcttctttttttttttgtttaatctccccccttttggtaaagtggaatctgctctatttaatttaggattcagagatattgttggttcagaaacttaatttctaatttggtcttttttccattatctcaaatcttgtaattcatacattttcatcttagaaataaaaaatatcacttggttgac

SEQ ID NO: 4007 - DNA, 2579 bp, Populus trichocarpa
gtcgcaaatattaaatcccgagctccttgccttacattcctgtctcttcactcccccccgctttctctctacctgaaaggaaaaaaaaagaaaaagaaaaattcagagctaagcgagagaattcatctgtttttgaaaaaagatttacgagaaaaaatcgatctgattcgacttgactgatcgaatctggaccatcagatcccaccgtcaccctcgatcgccatgtcctcagcaaccactgctcgatcccttcctctcctcgccttcatttccctccttatcctctctcccgctctcgccttcgacgcagatcacaggtatggacaagaggaacccgttaaactatgggtaaataaagtgggtccttataacaatccacaagagacatacaattattacagccttccattttgccatccatctggtgatgttgctacacacaaatggggtggcctcggtgaggtccttggtggcaatgagcttattgatagccagattgacataaagtttgggaagaatgtggacaaaggtgtcatttgtcagcttgagcttgatgaagcaaaggtcaaacaattcaaggatgcaattgagaacaattattggcttgaattctttgtggatgatctgccattatgggggtttgttggtgaattgcgtcctgataagaatggtgaaaatggcaagcatttccttttcacgcacaagagcattactatccaatataataaagatcagattattcacgtcaatctcacacaagaaaatgcaaagccccttgaatctgggagaattttggacttgacatactctgtcaaatggagtttgactaatgtcagttttgcacgtcgctttgatgtttatttggactaccccttctttgagcatcagatccattggttttccatcttcaattcattcatgatggttatctttctcaccggtttagtgtcaatgattttgatgcggactcttagaaatgactatgcaaaatatgctcgggaagatgatgaccttgtggaatctctggaaagagatgttagtgaggagactggttggaaacttgttcatggagatgttttccggccacctcgcagtatggttcttctctcagctgttgttggaacaggtgctcagctagcgttgcttgtgcttcttgtcatcttgatggcaattgttggaacgttgtatgtcgggagaggagctattgtcacgacattcataacatgttatgctctcacatcattcattgctggttatgtgagtggagggatgtactctcgccatggaggcaaaaattggatcaagtcgatgattctcaccgcttgtctctttccatttatgtgctttgggattgggttcatcctgaacacaattgccattttctatgggtctttagcagccattccctttggcaccattgtggtagtttttgtaatatgggcttttatttccttccctctggctcttcttggcactgttgttggaagaaattggagtggtgctccaaacaatccatgtcgtgtgaaaaccattccccgtccaattcctgagaagaaatggtacctcacaccatctgtggtttcgatgatgggaggacttttgccctttggcagcatattcattgagatgtactttgtcttcacatccttctggaattacaaggtctactatgtgtacgggtttatgctgcttgttttcctgattctcattattgtaacagtttgcgtgacaattgtgggaacatatttcttgcttaatgctgagaactatcactggcagtggacttcattcttctctgctgcctcaacagctgtttatgtgtacttgtactcaatatattacttctatgtgaagactaagatgtcgggcttcttccagacaagcttctattttggatacactttgatgttctgtcttggattgggaattctctgtggagctgttggttatttaggctcaaatttgtttgtgaggaggatctataagaacataaaatgcgactagaacttcagcgaggaaatgtagacctcaaagtgcttcctcagagcttgttcttattgttgagacaatgatttttgagatgaagcctctggtcatgtatggggaactcaacaatgcacagatataacagggttttgggatgggggatatattcttcgttctctggaaaaaaggaagccttgagatgttttttggttatcttccccggctgtaagtgaaggtcttaatttagaattaagagattgtttttgtaatctgtgaagctagaaaaatatatcaaacacctttcattttgttatacgctttctcatggaagtaggtacactacacgaaggactgatacctattttcctttttttttttgttgaatttgttcttattatttactgatcttgggaagaatcgtcatgttcaggttctggaaattctttctgcgctgcttaaaaactatctatgctatttttgtagttctctggaaacttttattgaacagtaccacacatctcggcagggccagttttctggtttcctctaaacatgaattgagccctttgaatgcgcattcataattttcgaaa

SEQ ID NO: 4008 - DNA, 1980 bp, Brassica napus
aaattgaaatcagagtcatcgagcatagtcattgttccaacgcattcccaccacctcagatctgatcgtccgccgggtttcacgatgccgtcctccaccggcgccgtattgcttctcctcgtctctcttctagcaattgctctcgcctccgattctgatcacaagtatcaagctgatgagcaggttaccctgtgggtgaacaaagttgggccatataacaatccacaagaaacatacaactacttcagccttcccttttgccgtccctctcagaacgatgttcacaaatggggtggtctcggtgaagttcttggtggaaatgagcttattgacagcgagatccctataaagttcttgaaaaatgttgatagaaatgttatctgtaagcttgaactcgatgaagctaaggtcaagcactttaaagatgccatcgaatctagctactggtttgaattctttatggatgatctgcctttatggggcttcgtgggtgagctgcattctgacaaaaatggtgaaaacgccaaacacgtcctctacacacataagaacattgttgtcaaatacaacaaagaccagatcatacatgttaatcttactcaagacaacccaaggccattggaagcagggaggacagtggatctgacgtattctgtgcaatggattccaacagatatcacgtttcctcgccgttttgatgtatatctggattatccgttctttgagcaccagatccattggttctccatctttaactcgttcatgatggttatttttctcactggtttggtctcaatgatattgatgaggactctcagaaatgattatgcgaagtatgctcgtgaagatgatgatctcgagagcttggaacgggatgtaaatgaagaatctggttggaaacttgtgcatggggatgtgttcagaccaccatggagtctagttcttctctcagctgttgttggcacaggtgcacagttggcgttgcttgtccttcttgtcatattaatggccattgtggggactctctatgttgggagaggagcaatcgtcactacattcatagtttgctatgctctaacttcctttatctctggttatgtgagtggtgggatgtactcaagaagcgggggtaaacattggatcaagtgcatggtcctcacggcttctctcttcccctttttgtgctttggaatcggctttctcctaaacacgattgccatattctatggatcccttgcggctattcctttcgggacaatggtggttgtgtttgtaatttgggtttcatttccttccccttagccctcctcgggacagtcgttggaagaaactggagcggtgctcctaacaatccatgccgtgtgaagaccattccacgtccaatccctgagaagaaatggtacttaactccatcggttgtctcccttatgggagggttgctaccattcggaagcatcttcatcgagatgtacttcgtcttcacatccttctggaattacaaggtgtactacgtgtatggattcatgctgctggtatttgtgattctggtcatagtgacggtctgtgtgacaattgtgggaacctatttcctgctgaacgcagaaaactatcactggcaatggacttcgtttttttcagctgcttcaacggctgtctacgtctacttatactccatctattattactacgtaaagaccaagatgtcaggattcttccagacaagcttctactttggatacaccatgatgttctgtcttggcctcggcatcctttgcggagctgttggattcttgggatcaaacctgtttgtaaggagaatctatagaaacatcaagtgcgactagatggtttatcgaaaaggaagaaaaaacatccaatgtagaagaaatcttcttatggggattatatattatataaatacagacagtagagagggaaattaagatggaggaagggcttatgtcttttttttctcccttt

SEQ ID NO: 4009 - DNA, 2346 bp, Amborella trichopoda
acgatgtgtaatgtacagtatcaagaagatgagcctgttatgctctgggtgaacaaggtgggaccttataacaatcctcaggagacatataattattacagccttccattttgccaaccagctggtaatcctgctcataagtggggaggtcttggtgaggttcttggtggaaatgagctcattgacagtcaaatagaaataaagtttaaaagaaatgttgacaagcgctccatttgtgagcttgagctggatgatgcgaaggcaaagctgttcaaggatgcaattgagaacgcttactggtttgaattctttatgggctatgttggtgatattcgttctgacaaagtcaatgacaataagcatgttcttttcacacataaaaatattgttgtcgaatacaatggagatcagattattcatgtaaatcttacccaagaaaatcctaaaactcttgaggctgggaagtcattggaccttacttattctgtcaaatggatttctacaaatgtaacatttgcacggaggtttgatgtttacttggactaccctttctttgagcaccagatccattggttctccattttcaattcctttatgatggttattttcctcactgggttggtgtcaatgatattgatgcgaactctcagaaatgactatgccaaatatgctagagaagatgacgatctggagactctggaaagagatgtaagtgaggagtcgggctggaaacttgtacacggtgatgttttccgtcccccacgcaacttggttatactatcagcagttgttgggacaggtgcacagctagcaatgcttgttcttctggtgatcttgctggccatagttggaatgctgtacataggacgcggagcaattgtgacaacttttattgtatgttacgccctcacttcattcatttcgggccatgtaagtggaggactctattcacgcaatggaggtaaaaattggataaagtcgatgatccttactgcctcacttttcccatttatgtgctttggcatcggcttcatactaaacacaattgctatattttatggatctttggctgctatcccctttggaacaatggttgttgtattcataatctgggcctttatttcattccctctcgcacttcttggcacggtggttggaaggaactggagtggagctcctaacaacccttgtcgggtcaagaccattcctcgccccattccggagaagaagtggtatctcaccccatctgttgtgtcactgatgggtggcctccttccttttggcagcatattcatcgagatgtattttgtgtttacatcattctggaactataaggtttactatgtctatggttttatgcttctcgtcttcctaattctcataatcgtcacggtgtgtgtgacaattgtgggaacatacttcttgctgaatgccgagaactaccactggcaatggacctcatttttctctgctgcatcaacagctgtctatgtatacctgtactccatttactactactatgtgaagaccaagatgtcggggttctttcagaccggtttctattttggctacactctgatgttttgccttggtttaggcattctatgtggtgctgttggttatttgggctcaactctttttgttaggaggatttataggaacatcaaatgtgactaagccaaggggttgtggacgttcctcaactatgtgttgatggggttcgtggggtggctgttatgagttaacatatggttgcagacagaatcgatggtgtaccagggatcacagtggataggattctgtccctggcctcagtctggtgaatgggggcttcaggggcttgcaatttttggcctgtaagcgaatgccatttacttattgctttgccagtcttatatggagaaaatggactctcccctgtttctttaggatagtaatggattgtgcgggatttttttcttgatcccttgacaaatggcagtaacgtattatgattctctcttaaaaacttaccactacttgttttatttttttattttttttttctttcggtaatttattggggaagaccggttcctacctattttttcaattagttttaagagtcatcttgaaggtgttagtggggtggtgtcagtcggaatggaaactacaacgtgctgacttgagtgtgggtttactagatcccagccccttttccataaccggatcattttgatgttcttttgctgttaaaggtcgcttaattgtggaggtagttaaaatttcggattctgtaacacaacatccatatcggctctgaaactggaccggggcagtcaaatgaatgctttgaaatttgcccca

SEQ ID NO: 4010 - DNA, 2147 bp, Phalaenopsis aphrodite
ggcttgcgcgtctctctctttctttcgctctaccgcgcattggtagaaggcctggaagctggagctgaatccatcgtttttggactcttagatctgcgggcgccatgttcgtccgtctgagatcttcaaatctccttgctgctgtcctcgttatcgtcctccttgtcgctgcaccggcgtcggcctcggagtctgatcataagtatcaacccaatgaccctgtcacactctgggtaaacaaggttggcccgtataataaccctcaagaaacatacaactattatagccttccattttgccagcctggagagaaaccttcacataagtggggtggtcttggcgaggttttgggtggaaatgagcttattgacagccagattgagttaaaataccagaaaaacgtagaaaaaagttttatctgttctattgaacttgatgatgccaaggtgaagcaattttctgatgcaatagatgcttcatactggtttgaatttttcatagatgatttaccactgtgggcctttgttggagagactggcaaaacggatgagagcaaacattatctcttcactcataaaaatatcattgtgagatacaataaagaccagattattcatgtcaatatcacccaagaaaaccctaagttgttggaacctggaaagaaattagacatgacattttcagtcacttggacaacaacaaatataacatttgctcgtcgttttgatgtatacttggactatcctttctttgagcaccagatccactggttctccatcttcaattcatttatgatggttattttcctcactggcttggtttctatgatacttatgaggacacttagaaatgattacgcaaaatatgctcgtgaagatgacgatctggagactctggagagagatgtgagtgaagagtctggttggaagcttgttcatggagatgtattccggcctcctcgcaatttggttcttctttcagctcttgttggtacgggtgctcagctggcgctgcttattctcctcgtcattttactggctatagttgggatgttgtatgttgggcgaggagctattcacacaacttttatattgtgctacgctttcacctcatttatttcgggttacgtcaacggtggtctttattcccggagtggtggtaaaagttggattaagtcaatgattcttacagcttctcttttcccatttttgtgctttggaattggttttgcactcaacaccgttgccatattttatcgctcactagcggctattcccttcggaacaatggtggtgatttttgtaatttgggcctttatctcatttcccctcacacttctaggcactgtggtgggcagaaactggagtggtgcccctagcaatccatgccgagtgaagaccattcctcgccctatcccagagaaaaagtggtatctcacaccttccattatctctctaatgggaggtcttcttcctttcggcagtatcttcattgagatgtattttgtattcacatctttctggaattacaaggtttactatgtgtacggattcatgctactggttttccttattcttattattgtaacagtctgtgttaccattgtgggcacatatttccttctaaatgcggagaactaccattggcaatggacctccttcttctctgctgcttctactgctgcgtatgtctatctttactccatttactactactctgtgaagaccaagatgacaggtttcttccagaccagcttctattttggctacaccctcatgttctgtctgggaattggaattctgtgtggcgccgtgggttatcttggttcatctctgttcgtgagaagaatttacagaaacatcaaatgcgactagctgtagatgaagtcggaggcattgataagccttttttttccctgcggcgcagaagatcaaatattcattgctctctaaagttccaatttttggagattacttgaggggtttggtctcatactggtcgaatttgtaagcttttcgttttcactgcttgtttagaacagagtaaatgagttaattatttttgtattgcagactaactctctgttttgatgggacatgtggacccaaaaacagttcatcatctccagattgctatacatggtttct

SEQ ID NO: 4011 - DNA, 2270 bp, Brassica rapa
gaggatctctgccgaacaaataacagtactgcgctctctttctcttcttccttggtcactcgctctcttgatcgctccttgccgagaaacgagagcggggagctaacacttatctctcaacatccgccaaattgaaatcagagtcatcgagcatagtcattgttccaacgcattcccaccacctcagatctgatcgtccgccgggtttcacgatgccgtcctccaccggcgccgtattgcttctcctcgtctctcttctagcaattgctctcgcctccgattctgatcacaagtatcaagctgatgagcaggttaccctgtgggtgaacaaagttgggccatataacaatccacaagaaacatacaactacttcagccttcccttttgccgtccctctcagaacgatgttcacaaatggggtggtctcggtgaagttcttggtggaaatgagcttattgacagcgagatccctataaagttcttgaaaaatgttgatagaaatgttatctgtaagcttgaactcgatgaagctaaggtcaagcactttaaagatgccatcgaatctagctactggtttgaattctttatggatgatctgcctttatggggcttcgtgggtgagctgcattctgacaaaaatggtgaaaacgccaaacacgtcctctacacacataagaacattgttgtcaaatacaacaaagaccagatcatacatgttaatcttactcaagacaacccaaggccattggaagcagggaggacagtggatctgacgtattctgtgcaatggattccaacagatatcacgtttcctcgccgttttgatgtatatctggattatccgttctttgagcaccagatccattggttctccatctttaactcgttcatgatggttatttttctcactggtttggtctcaatgatattgatgaggactctcagaaatgattatgcgaagtatgctcgtgaagatgatgatctcgagagcttggaacgggatgtaaatgaagaatctggttggaaacttgtgcatggggatgtgttcagaccaccatggagtctagttcttctctcagctgttgttggcacaggtgcacagttggcgttgcttgtccttcttgtcatattaatggccattgtggggactctctatgttgggagaggagcaatcgtcactacattcatagtttgctatgctctaacttcctttatctctggttatgtgagtggtgggatgtactcaagaagcgggggtaaacattggatcaagtgcatggtcctcacggcttctctcttcccctttttgtgctttggaatcggctttctcctaaacacgattgccatattctatggatcccttgcggctattcctttcgggacaatggtggttgtgtttgtaatttggggtttcatttccttccccttagccctcctcgggacagtcgttggaagaaactggagcggtgctcctaacaatccatgccgtgtgaagaccattccacgtccaatccctgagaagaaatggtacttaactccatcggttgtctcccttatgggagggttgctaccattctgaagcatcttcatcgagatgtacttcgtcttcacatccttctggaattacaaggtgtactacgtgtatggattcatgctgctggtatttgtgattctggtcatagtgacggtctgtgtgacaattgtgggaacctatttcctgctgaacgcagaaaactatcactggcaatggacttcgtttttttcagctgcttcaacggctgtctacgtctacttatactccatctattattactacgtaaagaccaagatgtcaggattcttccagacaagcttctactttggatacaccatgatgttctgtcttggcctcggcatcctttgcggagctgttggattcttgggatcaaacctgtttgtaaggagaatctatagaaacatcaagtgcgactagatggtttatcgaaaaggaagaaaaaacatccaatgtagaagaaatcttcttatggggattatatattatataaatacagacagtagagaggaaaattaagatggagggagatgtcttgttattttctccctttttgttaagtgaacagtttgttctctttagattagaaacaagtgggtgtaatatactactactacctgtaatcttctttttccttattccttttcgtgtttacttcactatcaactacatcattgaatatagatagtgtcctttagaggaggcaattggatataa

SEQ ID NO: 4012 - DNA, 2218 bp, Brassica napus
ggatcaacagcaatactgtgtgctgctgctctcttctatttagtttggtctctcgctcgctccctcgatcgcttgctgccgagaaacgagagagagagagagagagctgctaacactgtattctcgataatgcaatttgcgccaatttgaatcagatcatcgaccctactcattgctctatctaacgcattcttcgtcagatctgatcgtccgccgcatttcgcgatgccgtcttcctcctcctcagccaccgccgctgtcttccttcttctcgtttctcttctcgcaacctctctcgcctctgattcagatcacaagtatcaagctgatgagcaggttacactgtgggtgaacaaagtcgggccgtacaacaatccacaagaaacgtacaactactacagccttcccttttgccgcccctctctaaacgatgttcacaagtggggtggtcttggtgaagttcttggtggcaacgagctcattgacagcgagatccctatcaaattcttgaaaaatgttgacagaaacgttatctgtaagcttgaactcgacgaacctaaagtcgagcattttaaagatgccatcgaatctagctactggtttgagttctttatggatgatctgcctttgtggggattcgttggtgagctgcaatctgacaaaaatggtgaaaacggcaaacatgtcctctacacgcataagaacattatcgtcaaatacaacaaagaccagattattcatgttaatctcactcaagacaacccaaggccattggaagcagggaggactgtggatctgacgtattctgttcaatggattccaaccgatgtcacatttgcccgccgttttgatgtgtatttggattatccattcttcgagcaccagatccattggttctccatctttaactcgttcatgatggttatttttctcactggtctggtctcaatgatattgatgagaactctcagaaatgattacgcgaagtatgctcgtgaagatgatgatctcgagagcttggaacgggatgtaaatgaagaatccggctggaaacttgtgcatggggatgtgttcagaccaccatttagtttagttcttctctcagctgttgtcggcacaggtgcacagttggcgttgcttattcttcttgtcatattgatggccatcgtagggactctatatgttgggagaggagcaattgtcacaactttcatagtttgctatgctctgacttcctttgtctctggttacgtgagtggtggaatgtactcaagaagcgggggtaagcactggatcaagtgcatggtcctcacggcttctctattcccctttttgtgctttgggatcggctttatcctaaacacaattgccatattctatggatcccttgcggctattcctttcgggacaatggtggttgtgtttgtaatttgggtttcatttcttccccttagccctcctcgggacagtcgtgggaagaaactggagtggtgctccaaacaatccatgccgtgtaaagactattccacgtccgatccctgagaaaaaatggtacttgactccatcggttgtctccctgatgggaggtctgctaccatttggaagcatcttcattgagatgtacttcgtcttcacatccttctggaattacaaggtgtactacgtgtatggattcatgctgctggttttcgtgattctggtgatagtgacggtctgtgtgacaatagtgggaacttatttccttctgaacgctgagaattatcactggcaatggacttcgtttttctctgctgcgtcaacggctgtctatgtctacctatactccatctattactactacgtgaagacgaagatgtccggattcttccagacaagcttctactttgggtacaccatgatgttctgtcttggccttggaatcctttgcggagcggttggattcttgggatcaaacctgtttgtaaggagaatctacagaaacatcaaatgcgactagagatatcaatagaggtaaaaaaacaccgagttgagaaggaagcttgttatggtggacatacattatatataaacgccagtagagagggagaatatataagtattcttcaatggggtctttgtgtttttttggtaagtgaactgtttttcctctttagattagaatttgagtgggtgtaatatacagcaactactactacctgtaattttttcccttgttcct

SEQ ID NO: 4013 - DNA, 2006 bp, Cicer arietinum
attttatgttttatttggatcgaacgtagcgtagaagtgttaaaatatataatataaaataaacaaaaaaatgcaaggtttgtgtattgctgagaaagtaatgaaataattggcagagagatagagtctcaattcttcaaggttaagtcctctctctctctctctctctcttcaaggttggagatccaccaccaccactaccaccaccgccaccaccatgttctttagattctctctccttctgcttcttctcatttctccggttttcgcttccgagtcagatcacaagtatcaacaagatgacccagttaccctttgggtgaacaaagtaggtccatataataatccacaagaaacatacaactattacagcctcccattttgccgtctacctggtaatgctgcacacaagtggggtggtctaggtgaggtcctaggtggcaatgaacttattgatagccaaattgagataaagttcctagggaatgtggagcggaccactttttgccgtttgcctcttgatgatgcaaaggttaaacagttcaaggatgcaatagaaaataattactggtttgaattcttcatggatgaccttccattgtgggggtatgttggggagctacatcctgataagaacagtgatagtggcaaacatgtcctttacacacacaagaacatcattgttaaatacaataaagaccagatcattcatgtgaatcttactcatgatgacccaaaacctttggaagcaggaagatctctggacatgacatattctgtcaaatggattcccactaatgtcacttttagacaccggtttgatgtatatctggattatccattctttgagcatcagattcactggttctccatttttaactcttttatgatggtcatattcctaactgggttggtgtctatgatattgatgcgaactttgagaaatgactatgcaaagtatgctcgggaagacgatgatttggaaactctggaaagagatgttagtgaagaatctggctggaaacttgtacatggtgatgtttttcggcctcctcgcaatttggctcttctttcagctgttgttggtacgggtgctcagcttgcattgttgattcttcttgtcatcttgctggctattgttggaatgttgtatgttgggcgaggagcaattgtcacaaccttcattgtctgttatgctcttacatcgttcatttctggttatgtgagtgggggaatgtactcacgaaatgggggtaaaagctggattaagtccatgatccttacagcttctttgttcccattcatgtgcttcggaattggatttgtcttgaatactattgctatattctatgggtctctagcagctattccatttggcacaatggtggttgtatttgttatttgggctttcatctctttccctctagcacttcttggtacagttgttggaagaaactggagtggtgctccaaataatccctgtcgtgttaagaccattcctcgtcccattcctgagaagaagtggtatctcacaccctctgtagtttctctgatgggaggactgcttccttttggcagcatattcattgagatgtattttgtatttacatccttctggaattacaaggtgtactatgtctatggcttcatgctactggtttttttgattctcattgtcgttaccgtatgtgtgacaattgtggggacatactttttgttaaatgctgagaactacaactggcagtggacttcttttctttcagctgcctcaacaggtgtttatgtatatttgtactcgatatactactactatgtgaagacaaagatgtcaggcttcttccaaactagcttctattttggatacactatgatgttttgtcttggactgggaattctctgtggagctgtgggtcatcttggttcaaatttgtttgtgaggaggatctaccggaatatcaagtgtgactaaggcttctctatgtgttgagaccagagcaattccgtat

SEQ ID NO: 4014 - DNA, 2169 bp, Flaveria ramosissima
ttaaaatgcacgaagtagaaaaccaataagaaaacgagtggaaccctcgcacagatcgaccacaaaatcatctgatcaatcgccgttaacatccaattcctccgccggcgatcccgatgccgccgtcctccgccgcagcactcttcgccaccgtcctcctcctcctcctcctcatctcatcgccggtgctcgcctccgattacgatcacaagtatcaatcagatgaaaaagtcaccctttgggtgaataaagttggaccttacaataatccacaagaaacatacaatttttacagtcttccattttgtcgtcacgacggtcatgctcaagctgcacacaagtggggcggtctgggtgaagtattaggtggaaatgagcttattgacagccaaatggatgtcaagtttcaaaaaaatgtggaaaaaactactgtttgcgagctggaacttgacgaatcgaaagccatgcagtttaaacaggccattgagaataactactggtttgaattattcatggatgatctgccactgtggggttttgtgggcgacctacactctgataagaacagcgatagcaagcatatgctattcacacatatgaatatcactatacaatacaacaaggatcagatcattcatgttaatctcactcaagaaaacccaaaacctttggaagttggtaaaacgctggacatgacatattcagtaaagtggactgaaactaaggtcacatttgctcgacgttttgatgtttacctggattaccattttttcgagcatcagattcattggttctccatattcaattcatttatgatggttatctttctaactgggttggtctccatgatactgatgcggactcttagaaatgactatgccaaatatgccagagaagatgatgatctagaaactttggaaagagatgtcaatgaagaatctggttggaaacttgtacatggggatgttttccggccaccgcgtaatttggttttgctgtcagcggttgttgggacaggtgcccaattggcattattgattcttctcgtcatcatgtttgcgattattggaatgttgtatgttggacgaggatcaattgtaacaacattcattgtctgctacgctctcacttcttttgtttctggctatgtgagtggtgggatgtactcacggaatggcgggaaaacatggataaagtcaatgatcctgaccgcatccctttttccatttttgtgctttggaattggtttcatactcaacactattgccatattctatggatctctagcagcaattccatttggtacaatggtggttgtttttgtcatttgggcttttatttctttccctcttgctcttcttggtactgttgttggaaggaactggagtggggcacctaacaatccgtgtcgtgtgaagactattcctcgcccaattcccaagaaaaagtggtatctcacaccatctgtcgtttcactcatgggaggactgctaccttttggcagcattttcattgagatgtactttgttttcacttccttttggaattataaggtgtattatgtgtacgggtttatgcttcttgtatttctgatcctcataatagtgactgtgtgtgtgacaattgttgggacatatttcttgctaaacgctgagaattattattggcaatggacttcattcttctctgcggcttctacagctatctatgtgtacttgtattcagtatattactactatgtcaagactaagatgtctggcttcttccaaaccagtttctactttggatacaccgctatgttctgtcttgggttaggaattctatgtggagctgttggtcacctgggctcaaatttgttcgtgagaaggatctatcggaacatcaagtgcgactaagtcactttcataggaagaacagcacccacagtggaccccgacctttgtagttaacagcgaataccaattggaagccttgtatcaggtacgtaaacccgggtcttcacaaggtccggtcagtgattaattagtagtatacctaactcctgatgattaagggaggtttgattaattttttccttcctattcatggagtttagaaaaaagttagatgtgcaatttgaattcagagattgttttattatccagaagaacgaggttactttggttccac

SEQ ID NO: 4015 - DNA, 2335 bp, Plantago ovata
acaaaacccacaatctgctgcattcttcttctctctctggactgtagtctgtaaaacaatctccgatcgagaaccaaaatcgagtgggttacaatacatctccaatggagacgtgaaacctgacagcaaatcaagctcaacgccaatctaattttcctgagatctaaatctagagataacgaagaggagctgctgttccgttccaatctcgcgagtatacccttcattcagatccgacggacttacagcggcgatgcgctccgccgttagatcgcgctgcgttttcattgtcttcttcctctcacttgtctcttccactatcggcaagtatcaggctggcgagcctgtgacactatgggtgaacaaggttggtccatataacaatccccaagaaacatacaactattacgctctcccattctgccacccacgtggtgatgcgccacacaagtggggtggactgggtgaggttctaggaggaaatgagcttatcgacagccaaatcgagataaagtttcagaaggatgtcgagagaactacaatttgtgaaattgaattggacggagcaaaggttgaacagttcaagcatgcaattgaccattcatattggtttgaattttttatggatgatttgccactatggggtttcgttggagaagttcttcccgaccgaacccgtgataataagcatgccctctggacacacaagaatcttgttataaactacaatggcgaccagattattcatgtcaatctcactcaagagaacctcaagccacttgaagaggggcgagtgttggatatgacttactcagtcaaatggctaccgactaatattacatttgcccgccgttttgatgtgtatctggactaccctttttttgagcatcagattcactggttttctgtgtttaactctttcatgatggtgattttcctcactggtttagtctctatgatactaatgcgcactctccgcaatgactatgctaaatatgctcgagaagatgatgatttggagactctggaacgggacgttaatgaagagtctggctggaaacttgtgcacggtgatgtgtttcgccctccccaaagtctggctctacttacagctgttgttggaactggggcacagctatccacacttgttcttcttgtcatcattttagcaattgttgggatgctgtatattgggcgaggtgcaattgtgacaacatttattatatgctatgcttttacctcgttcatcgctggttatgtgagtggcggcatgtattcccgctatggcggtaaaaattggataaagtcaatgatcctcaccgcatcactttttccttttatgtgctttggtattgggttcgtcctgaatacagtagctatcttttacggatccctggctgccattccctttggcacaatggttgttgtatttgtcatatggggttttatatcattccccctggcacttctcggaactgttgttggaagaaattggagtggtgccccaaacaatccttgccgggtgaagacaatccctcgtccgattcctgagaagaaatggtatctcacgccgtccgtgatctctctcatgggagggctgcttccttttggaagcatattcattgagatgtattttgttttcacttccttctggaattacaaggtttactatgtgtatggcttcatgcttcttgtctttatgattctgatcattgtcaccatctgcgtgacgattgttggaacatacttcttgctgaatgccgagaactatcattggcagtggacttccttctactcagctgcctcaactgctctttatgtgtttctgtattcgatatactactattatgtcaagactaagatgtcaggcttcttccagaccagcttttatttcggatacactttgatgttctgtcttggcttgggaatactatgtggtgctgttggatatctgggctccaacttgtttgtcaggagaatatacagaaacatcaaatgtgactgattctactattatacaacatatttcttgagtctgctactctgcttgtcttgataagttaattctcatgggagccgaggggaaaccatcagcctccaaactgggatggatgtcacaggttttggatatggccactaaattgaaaactcaaattttgccttactcccatttacatcgaggaaatactgctttgtaaattttgctgcttagacagttcactttactctcttttgttatatagacgttgagaatagttgattttttcttctgaattgaacaaagtttttgaagattaaccgtggaatttattgagattctgaagagattcgatta

SEQ ID NO: 4016 - DNA, 2317 bp, Solanum lycopersicum
gaaacgacaatacctcagatttggttgctttgtcgagtcttagagctctcaaattgctctgaaacttgagatctaaagaagacaaagagaagagagtaaaagagaagagagctcataaaatctgaaacacaagtacaacaaacccatacatacgttttctagaatcgatttttcattttcagatccgtttagcaatgctctctactgctcgatctctcgtcattttcgttatcttctctctattccttgcatacccatctcttgcaaagtatcaagcggatgaacctgtcactctttgggtaaataaggttggaccctataataatccacaagagacgtacaactattacagccttccgttctgtcatcctggtgatggtggtcacaagtggggtggccttggcgaggttcttggtgggaatgaacttattgatagccgaattgacataaagttcaaaagagatgtggagaaaagcacaatctgcgaacttgtattggatgcagcaaaagtggcacaatttaaggatgctatcgaaagttcatattggtttgaatttttcatggacgatttgccattatggggtttcgtgggcgaagtgcttcctgatagaaaccgagacaacaagcatgtgctctacacacacaagaattttcttattcaatacaataaagaccagatcattcatgtcaacctaactcaagagaacccaaagccactggaggaaggaagactcttaggcatgacatactctgtaaaatgggttccgacaaatattacttatgaacggcggtttgatgtatacttggattaccccttttttgaacaccagatccactggttctcggtgttcaattctttcatgatggttattttcctcactggcttagtgtctatgattttgatgcgcactcttcgtaatgattatgctaaatatgctcgtgaagatgatgatctggagagtctggagagggatgtgaatgaagagtctggttggaaacttgtccatggtgatgttttccgacctccacaaaatttggcccttctttcagctgttgttggcactggtgctcagcttacaacacttgttctccttgtgatcatatttgctattattggaatgttatacatagggagaggagctattactacaacctttattgtatgttatgctcttacatccttcattgccggatatgtgagtggtggcctgtactctcgtaatggtggtaaaaagtggataaagtcaatgatactaacggcatcacttttcccctttatgtgctttggcattgggttcattctaaacacgattgctatattttatggatctttagctgctattccctttggcacaatggtggtggtttttgttatttgggcttttatttcattccctctggcacttcttggtactgttgtaggaagaaactggagtggtacgccaaacaatccttgccgtgttaagaccataccccgccctatccctgagaagaaatggtacctcacaacatctgtaatttctctaatgggaggtcttcttccctttgggagcatttttattgagatgtattttgtcttcacttccttctggaactacaaggtttactatgtctatggttttatgcttcttgtatttattattctcatcatcgtcaccgtttgtgtgacaattgtgggcacgtatttcttgctgaatgccgagaactaccattggcgatggacttcattcttttctgctgcctcaacagctctttatgtttatctttacgccatatattactatcacgtaaagactaagatgtccggtttcttccagaccagcttttactttggctacactatgatgttctgccttggcctcggcatcctctgtggtgctgtaggatatcttggctctaacttgtttgttagaaggatttacagaaatatcaagtgtgattaagtgctcaaacaaagcatatgaaacaatgcaccacagttttgcatgatccattctacctgtcacttgtggatttccagataataccacagcaatcgggttacctaatgtgaatgaagattatttttacaagagatcgaaggaagaaaattagttatttccaatttttctgatttagaatgtgtggaaatgtttagtaaagttgtatgggagaaacaatggaatattgtgcaacttttgtagtgcatacatatattacttgcatatacatttgttttattacttcaaaggccataatctgcattgtattttggaatatgttgagaatcatttttttaaatcaagtgacagtacttggaaatattgccgccttcatg

SEQ ID NO: 4017 - DNA, 2109 bp, Zostera marina
aagctacgcagccgtattagtagatctcggcagacgagatgctccccaatctcccgtcgacgaccatcctcctcctctcgctctttcttctcgtcttatcagcttcggcaggggagtccgatcacaagtatcaaccagaagattcagttgtgctctgggtgaataaagttggtccatataataatccccaagaaacctacaactatcacagccttccattttgtcagccacaagagaatcctgttcatagatggggtggtcttggggaggttttgggtggaaatgaactcattgacagtcagatcgaaataaaatatcagaaacccgttgataaggttaccatctgttccattgaccttgatgaaacaaaggtgacacagttcaaaaaatgcaattgatagctcgtattggtttgaattatttatggatgatctgcctctttggggctttgttggtgagactcgaactgataaaagcaatgaaaataaatattttcttttcactcataaagatattgttattaagtataatggttttcagataattcatgtaaatctcacacaagatggcgcaaagcttttggaagttggaaagacggtagacatgacttacagtgttaaatggataaagacaaacatagaatttgcacatcgttttgatgtttatttagattatccattctttgaacaccagattcattggttctccatctttaattcctttatgatggttattttcctcaccggtctggtgtcaatgattctgatgagaactcttagaaatgattatgcaaagtatgcccgtgaagatgatgacattgaaactctggaaagagacgtgagtgaggaatcggggtggaagcttgtccatggagatgtcttccggcctcctctaaatttaattgtcctgtcagctgtggtcggtacaggtgctcagtttgccatgcttgttcttatggtcattttattggcaatcattgggatgctttacattgggcgtggatcaattgtcacaaccttcattgtttgctatgctcttacttcatccatatctggatatgtgagtggtggaatgtactcaaggaatggtggtaaaaactggattaagtccatgatcttctcagcatctcttttcccattcatgtgctttggaataggcttcatactaaacaccattgctattttttacggatcactggctgctatcccatttggaacaatgatggttgtttttataatttggggattcatatcattacccctttcttttcttggcactcttgtagggagaaattggagtggttatccaaataatccttgtcgtgtgaagacaattcctcgcccaattcctgaaaagaaatggtacctgacgccatctgtaatctccttgatgggaggtctccttccctttggcagcatattcattgagatgtattttgtcttcacatccttttggaattacaaggtgtactatgtttatggttttatgctgctggtttttatcatccttataattgtaaccgtctgtgtcacaattgtgggcacatatttcttgcttaatgctgagaactaccattggcaatggacctcatttttctctgctgcttcaaccgcgggatatgtttatttgtattctatatattactaccattcgaagactaagatgtctggatttttccagactagtttttactttggctacaccctgatgttctgcttgggcttgggtatcctctgcggtgctgtgggatatcttggatctactctgtttgtgaggagaatctacagaaacataaagtgcgactagtaagaagagccagccagtcggccggcaatgtaattaactgttgggaagcatttcatgcaattttccatatgatagtgtttgtaatatttacccttttattgtgagattatgactacaatacagtcattgccaagttagcagttagcttggcaagtcttgatgatgaacaagaatatactatttagttatatagtaacaaaaatattcaggtgcgatttaccattaaacagtcgagaatttttacatttaattattatttttctattatgtatttcgacaatgaataataaatactattttttg

SEQ ID NO: 4018 - DNA, 1919 bp, Ambrosia trifida
ctgaatatgatcacaagtatcagtcagatgaatcattaccctttggttgataaatcgggccctacaataatccacaagaaacatataactattatagcttccgttttgtcatccatctggtaaccctggtcataagtggggtggactgggtgaggtattaggtggaaatgagcttattgatagtcaaattgacatcaaatttcaaaagaatgtggacaagactacaatttgtgagcttgaattagatgaatcaaaggttaagcagtttaaggaggccatagagaataactattggtttgagtttttcatggatgatctgccattgtggggttatgttggggagctacatactgataggaatagcgatagcaagcatatgctattcacccataagaatattacaattcagtacaacaaagatcagatcattcatgttaatcttactcaagagaacccaaaaccacttgaagctgggaaaacactggacatgacttactcggtcaagtggactgaaactaatattggttttgcacaccgctttgatgtttacctggattaccatttctttgagcatcagattcattggttttctatattcaattcgtttatgatggttatcttcctaactgggttggtttcaatgattctgatgcggactcttagaaatgactatgccaagtatgctagggaagatgatgatctggaaagtctggaaagagatgtcagtgaagaatctggttggaagcttgtacatggggatgtcttccgaccgcctcgtcatttggttatattgtcagccgttgttggaacaggtgctcaattggcactgctgattcttcttgtcatcttgtttgcaattgttgcaacgttgtacattgggagaggagcaattgtcactactttcattgtttgttacgccctcacctcatttgtatctgggtatgtgagcggtggcatgtattctcgccatggtgggaaaaactggataaagtcaatgatcctgactgcatctcttttcccgtttttgtgctttggaattggcttcgttttgaacacaattgctatattttatgggtctttggctgcaattccatttggcacaatggtggtggtttttgtcatatgggctttcatctctttccctcttgctcttcttggtactgttgttggaaggaactggagcggggctccaaacaatccttgtcgtgtgaagactattccgcgccctattcctgaaaagaaatggtatctcacaccatctgtggtctcaataatgggaggactgctaccgtttggcagtatttttattgaaatgtacttcgtcttcacatccttctggaattacaaggtgtactatgtttatggatttatgctgcttgttttcttgattcttatcatcgtgaccgtttgcgtgacaattgtgggaacatattttctgcttaatgccgaaaattaccactggcaatggacttcattcttctctgcagcctccacagctatttatgtctacttgtactcgatatattactattctgtcaagaccaagatgtcaggcttcttccaaactagcttttactttggatacacagccatgttctgccttggcttaggaattctctgtggagctgtcgggtatttgggctctaatctcttcgtgagacggatttaccggaacatcaagtgtgattaaggcgcaaaacggccccaccgtggcctcccaggttttgtagcttgttttgttgataccaaatgaaagatttaaatggggagttgaggggcttgttattatttgtaacttttgaggaatatgtagaagaaaggtttagagaaatgcaagactgttaatgtagcaggttgttaagaaaaaacttgttatatacatcttctattgtattcttattcatcagtcattccagaaa

SEQ ID NO: 4019 - DNA, 2103 bp, Zostera marina
gtagatctcggcagacgagatgctccccaatctcccgtcgacgaccatcctcctcctctcgctctttcttctcgtcttatcagcttcggcaggggagtccgatcacaagtatcaaccagaagattcagttgtgctctgggtgaataaagttggtccatataataatccccaagaaacctacaactatcacagccttccattttgtcagccacaagagaatcctgttcatagatggggtggtcttggggaggttttgggtggaaatgaactcattgacagtcagatcgaaataaaatatcagaaacccgttgataaggttaccatctgttccattgaccttgatgaaacaaaggtgacacagttcaaaaatggcaattgatagctcgtattggtttgaattatttatggatgatctgcctctttggggctttgttggtgagactcgaactgataaaagcaatgaaaataaatattttcttttcactcataaagatattgttattaagtataatggttttcagataattcatgtaaatctcacacaagatggcgcaaagcttttggaagttggaaagacggtagacatgacttacagtgttaaatggataaagacaaacatagaatttgcacatcgttttgatgtttatttagattatccattctttgaacaccagattcattggttctccatctttaattcctttatgatggttattttcctcaccggtctggtgtcaatgattctgatgagaactcttagaaatgattatgcaaagtatgcccgtgaagatgatgacattgaaactctggaaagagacgtgagtgaggaatcggggtggaagcttgtccatggagatgtcttccggcctcctctaaatttaattgtcctgtcagctgtggtcggtacaggtgctcagtttgccatgcttgttcttatggtcattttattggcaatcattgggatgctttacattgggcgtggatcaattgtcacaaccttcattgtttgctatgctcttacttcatccatatctggatatgtgagtggtggaatgtactcaaggaatggtggtaaaaactggattaagtccatgatcttctcagcatctcttttcccattcatgtgctttggaataggcttcatactaaacaccattgctattttttacggatcactggctgctatcccatttggaacaatgatggttgtttttataatttggggattcatatcattacccctttcttttcttggcactcttgtagggagaaattggagtggttatccaaataatccttgtcgtgtgaagacaattcctcgcccaattcctgaaaagaaatggtacctgacgccatctgtaatctccttgatgggaggtctccttccctttggcagcatattcattgagatgtattttgtcttcacatccttttggaattacaaggtgtactatgtttatggttttatgctgctggtttttatcatccttataattgtaaccgtctgtgtcacaattgtgggcacatatttcttgcttaatgctgagaactaccattggcaatggacctcatttttctctgctgcttcaaccgcgggatatgtttatttgtattctatatattactaccattcgaagactaagatgtctggatttttccagactagtttttactttggctacaccctgatgttctgcttgggcttgggtatcctctgcggtgctgtgggatatcttggatctactctgtttgtgaggagaatctacagaaacataaagtgcgactagtaagaagagccagccagtcggccggcaatgtaattaactgttgggaagcatttcatgcaattttccatatgatagtgtttgtaatatttacccttttattgtgagattatgactacaatacagtcattgccaagttagcagttagcttggcaagtcttgatgatgaacaagaatatactatttagttatatagtaacaaaaatattcaggtgcgatttaccattaaacagtcgagaatttttacatttaattattatttttctattatgtatttcgacaatgaataataaatacatttttttggttttgagagatt

SEQ ID NO: 4020 - DNA, 2450 bp, Abies balsamea
acttcttccataattttcatctcgcctgggagctcgcagcgagagtctctgcatcagaggcaagacgagatccaggcttcccgtaaacagtctgggttagatctaactatactattaagaagatggggtacaaggaaggcgtctggttacgcttgaccctctacatggtcgcggcattgggtgcagtgtttgcttccgagtatgatcataagtatcgagcaagtgaccctgttaccctatgggtgaacaaagttggcccttacaataatcctcaagaaacatataactactatagtcttccgttctgccatccaggtaaaaaccctacacataagtggggtgggcttggtgaggttctgggaggaaatgagctcatagatagccaagttgacatcaaatttggaaaaactattgagaaaagcccgatatgtgaaattgagctggatgctacaaaagtgaaacagttcaaggaagctattgaaaatacctactggtttgaattcttcatggacgatctacctctctgggcatttgttggtgaaatgcatcaagacaagagtgatgatcagaagcatttgctatacacgcacaagaatattattgtgaagatcaataatgatcaaataattcatgtcaatctcactcaggagaatccaaaaccgctcgttgctgggaagacactagaacttacctattcagtcaattgggttcccaccaatataacctttgccaggcgctttgatgtctatttagattatcctttctttgagcaccagatccattggttctccatcttcaattcatttatgatggttatttttctcacgggtttagtctcaatgatcttgatgcggactctgagaaatgactatgcaaaatatgcccgagaagaagatgatttagaaagcctggagagggatgttagtgaagagtcaggttggaagcttgttcatggagatgttttccgaacaccacgaagcttagtcttgctgtcagctttagtgggcacgggtgcacaacttgctatgcttgtgcttctagtgatcttgctggcaattgttggcatgttatatattgggcgtggagcaattgtcacaactttcattgtctgctacgcccttacttcatttatatccggctatgtgagcggaggattgtattctcgtaatgatggcaagcactggataaagtcaatggttcttacagcatcacttttcccatttatgtgctttggcattggatttgtactgaacatcattgctatattctatggtactctggcagctattccttttggtactatggtggtggtgtttataatctgggcatttatttctttccctctagcactacttggaacagttgttggaaggaattggagtggggctccaaataatccctgccgtgtgaagaccattcctcgcccaattccagaaaagaagtggtacctgacaccaacagtggtgtcactgatgggtggcctgcttccctttgggagtattttcattgaaatgtattttgttttcacctcattttggaactacaaggtatattatgtatacggcttcatgttgctggtatttttgattctcgttattgtgaccatctgcgttactattgttggaacatacttcttgcttaatgctgaaaactatcactggcaatggacatcattcttctcagctgcatcaacagctgcctatgtgtatctttattccatatactattaccacatgaagacaaagatgtctggatttttccagaccagtttctattttggctatactctgatgttctgccttggcttaggcatcctttgtggggctgttggttacttgggctctacattgtttgtaagaagaatttatcggaatatcaagtgtgattgatgacaagtagatcagaaacaaaatgaatcatatttaatgcctgagctattgcagggcctgttttaggcgcctgtttcttcccagggaaaggttcatagttccatatattcactgtttatccttgagccatttgttctatgctattcctgggtgtagcatgcattttgtattactgaacattgaagttagttcacttgtaggaaaatcattacagtgactgcaagtcttgcatctctattcattcaaaatggcacaagtccacataacacacttttagaagggcgtttttgatttgcaagatgactacttttgcttgcagatgctattcattgggaggatggcttttagaaccgggcccttatctagtagagtggcagagtgtagctattttcaacaccttttaagagatcggaattggatttttatgcagattaacttagattgagtcattctgctttagtacctttgtagtgggctttgcagatccattactgtcatgcttttatgaccctgaaattaacagttgaatctagccaaaatatggtggttccaggatataac

SEQ ID NO: 4021 - DNA, 2042 bp, Flaveria ramosissima
cccttttctgatcaatcgccgttagatcgaaatccgttcgtcggcgaccgccatgtggcccgccgtccgacgccccctactcctcatctcctatcttcttcaccgctttctttctccttatctcctcatcggtgttcgcttccgactatgatcacaagtatcaacaagatgacccaattaatctttgggtgaataaagttgggccttacaataatccacaggaaacatacaactactacagccttccgttttgtcgtaaacctggtaaccctgggcataagtggggtggcctgggtgaagtattgggtggaaatgaacttattgatagtcaatttggcatcaagtttcaaaagaatgtggagaaggctacaatttgtgagcttgaacttgatgaatcaaaggtcaagcagtttaaggaggccattgagaataactattggtttgaatttttcacggatgatctgccactctggggttttgtcggggagctacatactgataggaacaacgataccaagcatatgctattcactcataagaatattactatacagtacaacaaagatcagataattcatgttaatctcactcaagagaacccaaaaccactggaagctgggaaaacactagacatgacttactcggtcatgtggactgagactaataccacttttgcacgtcgttttgatgtttacttggattaccatttctttgagcatcagattcattggttttccatttttaactcgtttatgatggttatcttcctcactgggttggtttcaatgatattgatgcggactcttagaaatgattatgccaagtatgcccgggaagatgatgatctcgatagtctggaaagagatgtaagtgaagaatctggttggaagcttgtgcatggggatgtcttccgaccacctcgtaatttggttttattgtcggcagtggttggaacgggtgctcaattggcgctgctgattcttcttgtcattttgtttgcaattgttgcaacgttgtacattgggagaggagcgattgtcactacgttcatcgtctgttatgccctgacatcatttctctctggttatgtgagtggtggcatgtattcacgtcatggtgggaaaaactggattaagtcaatgatcctgactgcgtctcttttcccatttttgtgctttggaattggcttcgttctgaacacgattgctatattttacgggtccctggcagcaattccatttggcacattggtggttgtttttgtaatctgggctttcatctctttccctcttgctcttcttggtacagttgttggaaggaactggagtggtgccccaaacaacccttgtcgtgtaaagaccattcctcgccctattcctgaaaagaagtggtatctcacaccatctgtagtctccataatgggaggactgctacctttggcagtatttttatcgaaatgtactttgtcttcacatccttttggaattacaaggtgtactatgtttatgggttcatgctacttgtttttctgattctcatcattgtgactgtatgcgtgacaattgtgggaacatatttcctgctaaatgctgagaattaccactggcaatggacttccttcttctctgcagcctctacagctatttatgtgtacttgtattcaatatattactaccatgtgaagactaagatgtcgggctttttccaaaccagcttttacttcggatacacggccatgttctgccttggtttaggaattctttgtggagctgtcgggtatttgggctctaatctctttgtgagacggatttatcgaaatatcaagtgtgattaaggaaggcttttagcagaaaagaaacccccacagttgctcgccgttttgtagtttattttgtcaacacagaatgaagatttgcagcagatttaaatggggcgttcggcaactggttaatttgtaaactttatagattggaacctttcttttttcaatgcaaggaaggaggaatgtagaagaaaagcttagaaaaatgtttgttgtgaag

SEQ ID NO: 4022 - DNA, 2160 bp, Phalaenopsis aphrodite
cgctcccaccgactttattttacccgtcaaaccttagaccacgaagcgaacccgtcggttttcctaatccactagggtctcgggggcttgcgggtctctctctttctttcgctctaccgcgcattggtagaaggcctggaagctggagctgaatccatcgtttttggactcttagatctgcgggcgccatgttcgtccgtctgagatcttcaaatctccttgctgctgtcctcgttatcgtcctacttgtcgctgcaccggtgtcggcctcggagtccgatcataagtatcaacccaatgaccctgtcacactctgggtaaacaaggttggcccgtataataaccctcaagaaacatacaactattatagccttccattttgccagcctggagagaaaccttcacataagtggggtggtcttggcgaggttttgggtggaaatgagcttattgacagccagattgagttaaaataccagaaaaacgttgaaaaaagttttatctgttctattgaacttgatgatgccaaggtgaagcaattttctgatgcaatagatgcttcatactggtttgaatttttcatagatgatttaccactgtgggcctttgttggagagactggcaaaacggatgagagcaaacattatctcttcactcataaaaatatcattgtgagatataataaagaccagattattcatgtcaatatcacccaagaaaaccctaagttgttggaacctggaaagaaattagacatgacattttcagtcacttggacaacaacaaatataacatttgctcgtcgttttgatgtatacttggactatcctttctttgagcaccagatccactggttctccatcttcaattcatttatgatggttattttcctcactggcttggtttctatgatacttatgaggacacttagaaatgattacgcaaaatatgctcgtgaagatgacgatctggagactctggagagagatgtgagtgaagagtctggttggaagcttgttcatggagatgtattccggcctcctcgcaatttggttcttctttcagctcttgttggtacgggtgctcagctggcgctgcttattctcctcgtcattttactggctatagttgggatgttgtatgttgggcgaggagctattcacacaacttttatattgtgctacgctttcacctcatttatttcgggttacgtcaacggtggtctttattcccggagcggtggtaaaagttggattaagtcaatgattcttacagcatctcttttcccatttttgtgctttggaattggttttgcactcaacaccgttgccatattttatcgctcactagcggctattcccttcggaacaatggtggtgatttttgtaatttgggcctttatctcatttcccctcacacttctaggcactgtggtgggcaggaactggagtggtgcccctagcaatccatgccgagtgaagaccattcctcgccctatcccagagaaaaagtggtatctcacaccttccattatctctctaatgggaggtcttcttcctttcggcagtatcttcattgagatgtattttgtattcacatctttctggaattacaaggtttactatgtgtacggattcatgctactggttttccttattcttattattgtaacagtctgtgttaccattgtgggcacatatttccttctaaatgcggagaactaccattggcaatggacctccttcttctctgctgcttctactgctgcgtatgtctatctttactccatttactactactctgtgaagaccaagatgacaggtttcttccagaccagcttctattttggctacaccctcatgttctgtctgggaattggaattctgtgtggcgccgtgggttatcttggttcatctctgttcgtgagaagaatttatagaaacatcaaatgcgactagctgtagatcaagtcggaggcattgataagccttttttttccctgcggcgcagaagatcaagtattcatgctctctaaagttccaatttttggagattacttgaggggtttggtctcatattggtcgaatttgtaagcttttcgttttcactgcttgtttagaacagagtaaatgagttaattaattttgtattgcagactaa

SEQ ID NO: 4023 - DNA, 2482 bp, Populus trichocarpa
agctccttgccttacattcctgtctcttcactcccccccgctttctctctacctgaaaggaaaaaaaaagaaaaagaaaaattcagagctaagcgagagaattcatctgtttttgaaaaaagatttacgagaaaaaatcgatctgattcgacttgactgatcgaatctggaccatcagatcccaccgtcaccctcgatcgccatgtcctcagcaaccactgctcgatcccttcctctcctcgccttcatttccctccttatcctctctcccgctctcgccttcgacgcagatcacaggtatggacaagaggaacccgttaaactatgggtaaataaagtgggtccttataacaatccacaagagacatacaattattacagccttccattttgccatccatctggtgatgttgctacacacaaatggggtggcctcggtgaggtccttggtggcaatgagcttattgatagccagattgacataaagtttgggaagaatgtggacaaaggtgtcacttgtcagcttgagcttgatgaagcaaaggtcaaacaattcaaggatgcaattgagaacaattattggcttgaattctttgtggatgatctgccattatgggggtttgttggtgaattgcgtcctgataagaatggtgaaaatggcaagcatttccttttcacgcacaagagcattactatccaatataataaagatcagattattcacgtcaatctcacacaagaaaatgcaaagccccttgaatctgggagaattttggacttgacatactctgtcaaatggagtttgactaatgtcagttttgcacgtcgctttgatgtttatttggactaccccttctttgagcatcagatccattggttttccatcttcaattcattcatgatggttatctttctcaccggtttagtgtcaatgattttgatgcggactcttagaaatgactatgcaaaatatgctcgggaagatgatgaccttgtggaatctctggaaagagatgttagtgaggagactggttggaaacttgttcatggagatgttttccggccacctcgcagtatggttcttctctcagctgttgttggaacaggtgctcagctagcgttgcttgtgcttcttgtcatcttgatggcaattgttggaacgttgtatgtcgggagaggagctattgtcacgacattcataacatgctatgctctcacatcattcattgctggttatgtgagtggagggatgtactctcgccatggaggcaaaaattggatcaagtcgatgattctcaccgcttgtctctttccatttatgtgctttggggttgggttcatcctgaacacaattgccattttctatggatctttagcagccattccctttggcaccattgtggtagtttttgtaatatgggcttttatttccttccctctggctcttcttggcactgttgttggaagaaattggagtggtgctccaaacaatccatgtcgtgtgaaaaccattccccgtccaattcctgagaagaaatggtacctcacaccatctgtggtttcgatgatgggaggacttttgccctttggcagcatattcattgagatgtactttgtcttcacatccttctggaattacaaggtctactatgtgtacgggtttatgctgcttgttttcctgattctcattattgtaacagtttgcgtgacaattgtgggaacatatttcttgcttaatgctgagaactatcactggcagtggacttcattcttctctgctgcctcaacagctgtttatgtgtacttgtactcaatatattacttctatgtgaagactaagatgtcgggcttcttccagacaagcttctattttggatacactttgatgttctgtcttggattgggaattctctgtggagctgttggttatttaggctcaaatttgtttgtgaggaggatctacaagaacataaaatgcgactagaacttcagcgaggaaatgtagacctcaaagtgcttcctcagagcttgttcttattgttgagacaatgatttttgagatgaagcctctggtcatgtatggggaactcaacaatgcacagatataacagggttttgggatgggggatatattcttcgttctctggaaaaaaggaagccttgagatgttttttggttatcttccccggctgtaagtgaaggtcttaatttagaattaagagattgtttttgtaatctgtgaagctagaaaaatatatcaaacgcctttcattttgttatacgctttctcatggaagtaggtacactacacgaaggactgatacctattttcctttttttttttgttgaatttgttcttattatttactgatcttgggaagaatcgtcatgttcaggttctggaaattctttctgcgctgcttataaactatctatgctatttttgcagttctctggaaacttttattgaacagtaccacac

SEQ ID NO: 4024 - DNA, 2346 bp, Glycine max
gtgtagtggtaacgtaaccttactttctctttcgtcgtccacaacgtaaattaccattatagtccgttcgtgcttcctctgttgttgtgttgttctgttgtctcttctctctctctctctctctctctctctctcatcactgccatgttcttcgaatcccgatccctcctcttcccgctccttttctctctcttccttgcttccgccttcgcttcagagtcagatcacaagtatcaacatgatgaacaagttaacctttgggtgaacaaagttggtccttataacaatccacaagaaacatacaactattacagcctcccattttgtcatccatctagtagtgctagtgctgcacacaaatggggtggtcttggtgaggtcctgggtggcaatgagctcatcgatagccaacttgaaattaagttccaaagaaatgtggataagactgtcttttgccagatagatctcgatgaagcaaaggtgaaacagttcaaggatgcaatagagaataattactggtttgaattcttcatggatgatctacctttgtggggatatgttggtgagttacatcctgataagaacagtgataatggcaagcatgtcatttacacacacaaaaacattattgttaaatacaacaatgatcagattattcatgttaatctcactcaggatatcccaaagcctttggaagtaggaaaacatttggacatgacatattctgtcaaatgggattctaccaatgtcactttcgggcgtcgctttgatgtctacctggaccatcctttctttgagcatcagattcattggttctccatttttaactctttcatgatggtcatcttccttactggtttggtgtcaatgatattgatgcgaactctgagaaatgactatgcaaagtatgctcgggaagatgatgatttggaaagtctggagagagatgttagtgaagaatctggctggaaacttgtgcatggtgatgtttttcggcctcctcgcaacttagttattctttcagctgttgttggcactggtgctcaacttgcgttgctggttcttcttgtcgtcttgttggctattgttgggatgttgtatgttgggcgaggagccattgtcactactttcattgtgtgttatgctctcacatctttcatttctggttatgtgagtggggggatgtactcacgaaatgggggtaaacactggattaaatccatgatccttacagcttctctgttcccattcatgtgctttggaattggatttatattaaacacaatcgctatattctatgggtctctagcagcaattccatttggcacaatggtggttgtatttgtcatttgggctttcatctctttccccctagcacttcttggcacagttgttggaagaaactggagtggtgctctgaataatccctgtcgtgtaaagactattcctcgtcccattcctgaaaagaagtggtaccttacaccctctgtggtttctctgatgggaggactgctaccctttggcagcatattcattgaaatgtattttgtattcacttccttctggaattacaaggtgtactatgtgtatggctttatgctgctagtctttctgattcttatcatcgttaccgtttgtgtgacaattgtggggacatactttttgttaaatgctgagaactaccactggcaatggacttctttcttttcagctgcctcaacagctgtttatgtgtatttgtactcaatatactacttctatgtgaagacgaagatgtcaggcttcttccagaccagcttttattttggatacactttgatgttttctcttggactaggaattctatgtggagctgtgggttttcttggttcaaatttgttcgtgaggaggatctacagaaacatcaagtgcgattaaggttttctgagtcagacctgagcacttccataggtttgttgctgaagacaataaatttttggaggaagcctctggtcatgtgtggggaacctaacaatgtttacaggtagaatccacagggttttgagaatgaggatgtattatttttctatattggggaagccctgagattctttccccggctgtaattgattgtcttcataattttagataagtagtacaatattcaactcttgtggttactgtttcatccccttataaaataggggtcccttgaaggactgatgtctaattccccaacatgggtttcaactattcaatatatgtaaagaggggatgaagtctcggaaatgaattttgtatgaacatctgaatatcattcttatctgcttccttaacttttaaatgataaataatgtttgtagtgtc

SEQ ID NO: 4025 - DNA, 2472 bp, Glycine max
acttcaccgtcgtagtcacagaacactgtttcactgtattaccccaaaaaccgtaatgaaatgaaagaaatttacactcatcagcattattcatttcatttcagtgtagtggtaacgtaaccttactttctctttcgtcgtccacaacgtaaattaccattatagtccgttcgtgcttcctctgttgttgtgttgttctgttgtctcttctctctctctctctctctctctctctctcatcactgccatgttcttcgaatcccgatccctcctcttcccgctccttttctctctcttccttgcttccgccttcgcttcagagtcagatcacaagtatcaacatgatgaacaagttaacctttgggtgaacaaagttggtccttataacaatccacaagaaacatacaactattacagcctcccattttgtcatccatctagtagtgctagtgctgcacacaaatggggtggtcttggtgaggtcctgggtggcaatgagctcatcgatagccaacttgaaattaagttccaaagaaatgtggataagactgtcttttgccagatagatctcgatgaagcaaaggtgaaacagttcaaggatgcaatagagaataattactggtttgaattcttcatggatgatctacctttgtggggatatgttggtgagttacatcctgataagaacagtgataatggcaagcatgtcatttacacacacaaaaacattattgttaaatacaacaatgatcagattattcatgttaatctcactcaggatatcccaaagcctttggaagtaggaaaacatttggacatgacatattctgtcaaatgggattctaccaatgtcactttcgggcgtcgctttgatgtctacctggaccatcctttctttgagcatcagattcattggttctccatttttaactctttcatgatggtcatcttccttactggtttggtgtcaatgatattgatgcgaactctgagaaatgactatgcaaagtatgctcgggaagatgatgatttggaaagtctggagagagatgttagtgaagaatctggctggaaacttgtgcatggtgatgtttttcggcctcctcgcaacttagttattctttcagctgttgttggcactggtgctcaacttgcgttgctggttcttcttgtcgtcttgttggctattgttgggatgttgtatgttgggcgaggagccattgtcactactttcattgtgtgttatgctctcacatctttcatttctggttatgtgagtggggggatgtactcacgaaatgggggtaaacactggattaaatccatgatccttacagcttctctgttcccattcatgtgctttggaattggatttatattaaacacaatcgctatattctatgggtctctagcagcaattccatttggcacaatggtggttgtatttgtcatttgggctttcatctctttccccctagcacttcttggcacagttgttggaagaaactggagtggtgctctgaataatccctgtcgtgtaaagactattcctcgtcccattcctgaaaagaagtggtaccttacaccctctgtggtttctctgatgggaggactgctaccctttggcagcatattcattgaaatgtattttgtattcacttccttctggaattacaaggtgtactatgtgtatggctttatgctgctagtctttctgattcttatcatcgttaccgtttgtgtgacaattgtggggacatactttttgttaaatgctgagaactaccactggcaatggacttctttcttttcagctgcctcaacagctgtttatgtgtatttgtactcaatatactacttctatgtgaagacgaagatgtcaggcttcttccagaccagcttttattttggatacactttgatgttttctcttggactaggaattctatgtggagctgtgggttttcttggttcaaatttgttcgtgaggaggatctacagaaacatcaagtgcgattaaggttttctgagtcagacctgagcacttccataggtttgttgctgaagacaataaatttttggaggaagcctctggtcatgtgtggggaacctaacaatgtttacaggtagaatccacagggttttgagaatgaggatgtattatttttctatattggggaagccctgagattctttccccggctgtaattgattgtcttcataattttagataagtagtacaatattcaactcttgtggttactgtttcatccccttataaaataggggtcccttgaaggactgatgtctaattccccaacatgggtttcaactattcaatatatgtaaagaggggatgaagtctcggaaatgaattttgtatgaacatctgaatatcattcttatctgcttccttaacttttaaatgataaataatgtttgtagtgtcttcaccgtttagtttattatttt

SEQ ID NO: 4026 - DNA, 2321 bp, Eutrema parvulum
atctctgccgaaccacaacaacactgtgctctcttctcttacgttggtctctcgctctctcgatcgctcgctgccgagaaacgagagagctgactattctcaacatgcaatatacgccataattgaattagatcatcgagcctggtcattgctctaacgcatttccaccaccgtctccgtcttcctcagatctgatcgcccgccggatttcacgatgccgtcttcctcccccgtcgccgtgttccttcttcttgtttctcttctcgcaactgctcttgcctccgattcagatcacaagtatcaagctgatgagcaggttaccctgtgggtcaacaaagttggcccatataacaatccacaagaaacatacaactattacagtcttccgttttgccgcccctctcaaaatgatgttcacaaatggggtggtcttggtgaagttcttggtggaaatgagctgattgacagcgagatcccaataaagttcttgaaaaatgttgaaagaaatgttatctgtcagcttgagctcgatgatgctaaggtcaagcattttaaagatgccatcgaatccagctactggtttgagttctttatggatgatctgcctttgtggggcttcgtgggtgagctgcatcctgacaaaaatagtgaaagcggcaaacatgtcctctacacacataagaacattattgtcaaatacaacaaagaccagatcattcatgttaatctcactcaagacaacccaaggccactggaagcagggaggacagtagatctgacgtattctgtgcaatggattccaacaaatatcacatttgcccgccgttttgatgtatatctggattatccgtttttttgagcaccagatccattggttctctatctttaactcgttcatgatggttatttttctcactggtctggtctcaatgatattgatgaggactctcagaaatgattatgcaaagtatgctcgtgaagatgatgatctcgagagcttggaacgggatgtaagtgaagaatctggttggaaacttgtgcatggggatgtgttcagaccaccatatagtctagttcttctctcagctgttgttggcacaggtgcacaattggcgttgcttgttcttcttgtcatattaatggcgatcgtggggactctatatgttgggagaggagcaatcgtcacaactttcatagtttgctatgctctgacttccttcgtctctggttacgtgagtggtggaatgtactcaagaagcgggggtaaacattggatcaagtgcatggtcctcacggcatctctcttcccctttttgtgctttggaattggctttctcctaaacacaattgccatattctatggatcccttgcagctattcctttcgggactatggtggttgtgtttgtaatttggggtttcatttccttccccttagccctcctcgggacagtcgttggaagaaactggagcggtgctccaaacaatccatgccgtgtgaagaccattccacgcccaatccctgagaagaaatggtacttaactccatcagttgtttccctgatgggaggtttgctaccatttggaagcatcttcatcgagatgtactttgtcttcacatccttctggaattacaaggtttactatgtgtacgggttcatgctgctggtttttgtgattctggtcatagtgacggtctgtgtgaccattgtgggaacttatttcctgctgaatgcagagaactatcactggcaatggacttcgtttttctctgctgcttcaacggctgtctatgtctacttgtactccatctattactactacgtcaagaccaagatgtccggattcttccagacaagcttctactttggatataccatgatgttctgtcttggccttggaatcctttgcggagctgttggattcttgggatcaaatctgtttgtaaggaggatctacagaaacatcaagtgcgactagacgaattatctaaaaagaggaaaaaacacatcgaatatagaaggaagcttctcatgggggtttatatattacagcagcacagtagagagggaaactgagagggaggaagctggagcatatatatatattcttcaatgggggctttttgtctttttcgtcttatttttctccctttttggtaagtgaactgttctctttagattagaattgagttggtgtaatatactactattactactactactacctgtaatattttttttctattcctttttgtgtttacttcacttcccttatatcattgaatgttaggagcaattggatatatataacctacctatc

SEQ ID NO: 4027 - DNA, 1920 bp, Vinca minor
cagagatgcgtcttaccgtccgatcaccccttttcctctctcttcttatcgccgccgcctttttcctatcatcgccggcgattgcctccgagtacgatcacaagtatcaagatggagacaaggttaccctttgggtgaacaaagtagggccgtacaataatccacaggagacatacaattattacagccttccgtttgtaggccagatggcattgctgctcacaagtggggtggtcttggtgaagtccttggtggaaatgaacttattgatagtctcattgatataaaattcaaaaagaatgtggagaagactaccttttgtgagattgaacttgatgaagcgaaggttaaacaatttaagaatgcaattgaaaacagttattggttcgaatttttcatggacgatctacctttgtggggttttgtcggggagcttcatcctgacagaaacagtgagaacaagcacgtactatacacccataagagtattgatgtcaaatacaataaggatcagattattcatgtgaatctatctcaagagagtccaaaaccattggaagttggaagaacgttggatatgacatattctgttaaatttacacctacaaatgtcacttttgcacatcgatttgatgtctacctggattaccccttctttgaacatcagattcattggttctccatctttaattccttcatgatggttatctttcttactggattggtctcaatgatactcatgcgaactttgagaaatgattatgctaaatatgctcgggaagacgatgatctggaaaccctggaaagagacgttagtgaagaatctggctggaagcttgtacatggtgacgtctttcgtcctcctcgcaatttggcgttgcttgccgctcttgttggaactggttcacaactagcagttctggttcttgttgtcatcttatgtgcaattgtgggaatgttatatgttgggagaggaacaattggtactgctttcattgtttgctatgtcttgacatcaattgtttcgggctatgtcagtggtggaatgtactcacgcaatggtggtaaaaactggatcaaatcaatgatccttacagcaacccttttcccattcttatgctttgggatcggtttaatcctcaacacgattgcaatattttatgggtctctggcagccattccattcggaacaatggttgttgttcttgtcatctggtctttcatctccttcccactggcacttgttggtactgtgatcggaaggaactggagtggtgctccaaataatccctgcagagtgaaaaccattcccaggccaattcccgagaagaagtggtacttgacaccatctgtagtttccttgatgggaggcttgttaccgttcggcagtatattcatcgaaatgtattttgttttcacctccttttggaactacaaggtttactacgtctacgggtttatgctactggtcttccttattctcatcattgttacagtctgtgtgacaattgttggaacgtatttcctgcttaatgctgagaattatcactggcaatggacctctttcttctctgctgcatcaacagctgtatatgtgtatttgtattctgtgtattactactatgtgaagaccaagatgtcgggtttctttcagacaagcttctattttgggtatacagcaatgttctgcattggtttaggaattctctgcggtgctgttggttatttaggctcgaatcttttcgtgagaaggatctaccgaaatatcaaatgtgattagttcgtgttcaagggaggatgaaatgttgcttctgccagctcattacgtagcaatgcttgagaaagcaagaaatcattttttgcccccgattatgttcacagaggcattggcagggttggaggatggtttgcgacacagta

SEQ ID NO: 4028 - DNA, 1981 bp, Arnica chamissonis
tatcaatcagatgacccaattcacctttgggtgaataaagttgggccttacaataatccacaagaaacatataactactacagccttccattctgtcgtcaacctggtaaccctggtcataagtggggtggcctgggtgaggtattgggtggaaatgagcttattgatagccaaattgacatcaagtttcaaaagaatgtggacaagactaccatttgtgagcttgaacttgatgactcaaaggttaagcagtttaaggaggctattgagaataactattggtttgaatttttcatggacgatctgccattgtggggttatgttggggagctacatactgataggaacagcgatagcaagcatatgctgttcacccataagaatattactatacagtacaacaaagatcagatcattcatgttaatctcactcaagagaacccaaaaccactggaagctgggaaaacactagacatgacttactcggtgaagtggactgaaactaatatcacttttgcacaccgtttcgatgtttacctggattaccatttctttgagcatcagattcattggttttccatattcaattcgtttatgatggttatcttcctcactgggttggtttcaatgattctgatgcggactcttagaaatgattatgccaagtatgctagggaagatgatgatctggaaagtctggaaagagatgtaagtgaagaatctggttggaagcttgtacatggggatgtctttcgcccacctcgtagtttggttttattgtcggcagttgttggaacgggcgctcaattggcgctgctgattcttcttgtcatcttgtttgcaattgttgcaacgttgtatattgggagaggagcaattgtcactactttcatcgtttgttatgccctaacatcatttgtgtctgggtatgtgagcggcggcatgtattcccgccatggtgggaaacattggataaagtcgatgatcctgacagcatctcttttcccatttttgtgctttggaattggctttgttttgaacacgattgctatattttatgggtctctagctgcaattccatttggtacattggtggttgtttttgtcatctgggctttcatctcttttcctcttgctcttcttggtacggttgttggaaggaactggagtggggccccaaacaacccttgccgtgtgaagactattcctcgtcctattcctgaaaagaagtggtatctcacaccatctgtagtctcaataatgggaggactgctacctttcggcagtattttcattgaaatgtactttgtcttcacatccttctggaactacaaggtgtactatgtttatggattcatgctacttgttttcctgattcttatcatcgttaccgtgtgcgtaacaattgtgggaacatattttctgctaaatgccgagaattaccactggcaatggacttcattcttctctgcagcctctacagctatttatgtctacttgtattcgatatattactactacgtcaagactaagatgtcaggcttcttccaaaccagcttttactttggatacacagccatgttctgccttggtttaggaattctctgtggagctgtcgggtatttgggctctaatctgtttgtgagacggatttaccgaaacatcaagtgtgattaagactcttaacggaaggagaacgccacaccgttgcctcccaggttttgtagtttattttgttgataccaactgaagatttaaatggggggttgagggacttgttattatttgtaactttcgagggatattggggtctttcttttcttcatggaaaggaggaggaatgtagaagaaaggtttagagaacatgcaagagattgttttttattatgaagaaaaatggggtgggtgggtgtttacaaaactgttaatgtagcaggctcttaaggaaaaaccttgttatatacatcttctattgtattct

SEQ ID NO: 4029 - DNA, 2312 bp, Artemisia annua
atatcgcgagaatgaaataaactacacacacaaaggtacagcagtagtgcgtgtaatgttcacctaaaaataaaaacaatataaaaacagagtgaaatcaaaagaccgtaataatcggcattagatccaaatccaatctgcggcgatccgatgtcctccgctctcacctccgccgtattcctcctcgtcctcctcattttgtcgccggtgtttgcttctgactatgatcacaagtatcaaccagatgacaatgttgatctttgggtgaataaagttgggccttataacaatccacaagaaacatataactattacattcttccgttttgtcgtccacctggccatgcggggcacaaatggggtggtctcggtgaagtattgggtggaaatgaattaattgatagtcaaatcgatgtcaagtttcaaaagaatgtagaaaagacaactatatgtgaactcgaactcgatgaacagaaggttttgcagtttaagcaagctattgaggataactactggttcgaatttttcatggatgatttgccactgtggggttttgttggagagctacattctgataggaatagtgatagcaagcatacgctattcacacataaaaatatcactataaaatacaacaaagatcagattattcatgttaatctgactcaagagaacccaaaaccattggaagttgggaaaaaattggacatgacatattcagtcgagtggagtgaaactaacatcacatttggtcgccgttttgatgtttacctggattaccacttttttgagcatcagattcattggttctccatattcaattcatttatgatggttatctttcttactgggctggtctcgatgatactaatgcgcactcttagaaatgactatgccaaatatgctagggaagatgatgatcttgaaacactggaaagagatgtaaatgaagaatctggttggaaattggttcatggggatgttttccgcccacctcgcaatatggttttgctgtcagcagttgtcgggacaggtgcccaaatggcactattgatacttcttgtcatcttgcttgcaatcgttgggatgttgtatgtcgggagaggagctattgtcacaacatttatagtttgttatgctctcacctctttcgtttctggctatgtaagtggtgggatgtattcacgcaatggtgggaaaaattggataaagtcgatgatcctcacagcttcactttttccatttttgtgctttgggattggtttctttctgaataccattgctatattttatggatctctagctgctattccattcggcacaatggtggttgtttttgtcatatgggcttttatttctttccctctggctcttcttggtacggttgtgggaaggaactggagtggggctccaaacaacccttgtcgtgtgaagactattccccgcccaatccctgaaaagaagtggtatctgacaccatctgtagtctcaataatgggagggctgctaccttttggcagtattttcatcgagatgtactttgtattcacatccttctggaattacaaggtatactacgtctatggctttatgctactcgtttttctcattctcattattgttactgtttgcgttacaattgtgggaacatatttcttgctaaacgcggagaattactactggcaatggacatcattcttctcagcagcctctacagctatctacgtgtatttgtactcaatatattactactatgtgaagactaaaatgtctggcttcttccaaacgagcttctactttggatatacagccatgttctgccttggcttaggaattctgtgcggtgcggttggtcatttgggttctaacttatttgttagaaggatctaccgaaacatcaaatgcgactagtatgtctttattaagaagaacaacacatacagttgattcgcggtgcatttgtagtttattgccacaccaagtggaagcctattaatgaaagataaaacctgggtgattcacaaggtcggggccgcagttaatatatgtaactcttgaggaatgggggaagcttgttaattattttccttcttttcatggaatgtagaagaaattaaaggcaccttaatttagagaaatgcagatattgttttgttatcgagataacgttattaacataggaacaatgaagtttaatgggggatcaaaaccccatgtttggtttcttcctcagtgtgtaccctttttagagttttattgatgtacttgtgctgtcaaaattatagaatcattgttggtggtgcgggataacc

SEQ ID NO: 4030 - DNA, 2320 bp, Brassica napus
cttcatcttcgtttctctctccgagaaacgagagagctgacactgtactgccgcgatgcagtgtacaccaatttgaatcagatcatcgagtcttaacgcatttcaaccaccgtctcattccttcttcctcagatccgatcatccgccggatttcgcaatgccgtcttcctccgccgtattcgttcttctcgtttgccttctcgcaactgctctcgcctccgattcagatcacaagtatcaagcggatgagaaagttaccctgtgggtgaacaaagtcggcccatataacaacccacaagaaacatacaactactacagcctcccgttctgccgcccctctcaaaatgatgttcacaaatggggtggtcttggtgaagttctcggtggaaatgagcttattgacagcgagataccgataaagttcctgaaaaatgttgacagaaatgttatctgtcaccttgaactggatgaagctaaggtgaatcacttcaaagacgccatcgaatctagctactggtttgagttctttatggatgacctgcctttgtggggcttcgtgggtgagctgcatcctgacaaaaatagtgaagacggcaaacaagtactctacacacataagaacattattgtcaaatacaacaaagaccagatcattcatgttaatctcacacaagacaacccaacgccactggaagcagggaggacagtggatctgacgtattctgtgcaatggattccaacagatgtcacatttgcccgacgttttgatgtatatctggattatccgttctttgagcaccagatccattggttctccatctttaactcgttcatgatggttatttttctcaccggtttggtctcaatgatattgatgaggaccctcagaaatgattatgcgaagtatgctcgtgaagatgatgatctcgagagcttggaacgggatgtaaatgaagaatctggttggaaacttgtgcatggagatgtattcagaccaccatggagtctagttcttctctcagctgttgttggcacaggtgcacagttggcgctgcttgttcttcttgtcatattaatggccatcgttgggactctatatgttgggagaggagccatcgtcacaactttcattgtttgctatgctctgacttcctttgtgtctggttatgtgagtggtggaatgtactcaagaagcgggggtaaacattggatcaagtgcatggttctcacggcttctctcttcccctttttgtgctttggaatcggctttctcctaaacacaattgccatattctatggatcccttgcggccattcctttcggaacaatggtggttatgttcgtaatttggggcttcatttccttccccttagccctcctcgggacagttgttggaagaaactggagtggtgctccaaacaacccatgccgtgtaaagaccattccgcgcccaatccctgagaaaaaatggtacttaactccatcggttgtctctctgatgggaggtttgctaccatttggaagcatcttcatcgagatgtactttgtcttcacatccttctggaattacaaggtgtactatgtgtatggattcatgctactggttttcgtgattctggtgatagtgacggtttgtgtgacaattgtgggaacttatttcctgctgaacgcagagaattatcactggcaatggacttcgtttttctcagctgcttcaacggctgtctatgtctacttatactccatctattactactacgtaaagaccaagatgtctggattcttccagacaagcttctactttggatacacaatgatgttctgtcttggccttggaatcctttgcggagctgttggattcttgggatcaaatctgtttgtaaggagaatctacagaaacatcaagtgcgactagacgaatgatcgaaaaggagaaaaacccatccagttcagaaggaaccttcttatgggggattatatattatataaacacagtagagggacgaaggtgaagcatatatgttctccaatgagggcttctgtcccttttgttggtattgtctcgtctccctttttggtaagtgccctgttctctttagattagaacttagtggatgtaatatactattactacttgtgtttagttcacgtcaattagatcacattgaatgtcatttaggagcaattggatataaccaagttttttgtaattgattgcttgctacgtttttattctatccgagaataagatagtatacatccaagaaactgtgtggtcgtgttgagaagataattgcatcggtagagattaaagattacg

SEQ ID NO: 4031 - DNA, 2345 bp, Eutrema halophilum
gaggatctcagccgaacaacatcactgtgctctcttctcttcgttggtctctcgctctctcgatcactcgctgccgagaaacgagagagctcatattgtattgtcaaagatgcaatatacgccaaattgatccagatcatcgagtatagtcattgtcctaacgcatttccactaccttctccgtcttcctcagatctgatcgtccgccggttttcgccatgtcgtcttcctccgccgtcgtattccttcttctcgtttcccttctagcatctgctctcggctccgattcagatcacaagtatcaagctgatgagcaggttaccctgtgggtgaacaaagttggcccatataacaatccacaagaaacatacaactattacagtcttccattttgccgcccttctaaaaatgatgttcacaaatggggtggtcttggcgaagttcttggtggaaatgagctgattgatagcgagatcgcgataaagttcttgaagaatgttgacagaaatgttatctgtcagcttgaactcgatgaagctaaggtcaagcattttaaagatgccatcgaatctagctactggtttgagttctttatggatgatctgcctttgtggggcttcgtgggtgagctgcatcctgacaaaaatagtgaaaacggaaagcatgtcctctacacacataagaacattattgttaaatacaacaaagatcagatcattcatgttaatctcactcaagacaacccaaggccactggaagcagggagaacagtcgatctgacatattctgtgcaatggattccaactaatgtcacatttgctcgccgttttgacgtatatctggattatccattctttgagcaccagatccattggttctccatcttcaactcgttcatgatggttatctttctcactggattggtctcaatgattttgatgaggactctcagaaatgattatgcgaaatatgctcgtgaagatgatgatctcgagagcttggaacgggatgtaagtgaagaatctggttggaaacttgtgcatggggatgtattcagaccaccttacagtctggttcttctctcagctgttgttggcacaggtgcacagttggcgttgcttgttcttcttgtcatattgatggccatcgtggggactctctatgttgggagaggagcaatcgtcacaactttcatagtttgctatgctctgacttcctttgtctctggttacgtgagtggtggaatgtactcgagaagcgggggtaaacattggatcaagtgcatggtcctcacggcttctctcttcccctttttgtgctttggaattggctttctcctaaacacaattgccatattctatggatcccttgcggctattccgttcgggacaatggtggttgtgtttgtaatctggggtttcatttccttccccttagcactcctcgggacagtcgttggaagaaactggagcggtgctccaaacaatccatgccgtgtgaagaccattcctcgtccaatccctgagaagaaatggtacttaactccatcagttgtctccctgatgggaggtttgctaccatttggaagcatcttcatcgagatgtactttgtcttcacatccttctggaattacaaggtttactatgtgtacgggttcatgctgctggtttttgtgattctggtaatagtgacggtgtgtgtgacaattgtgggaacttatttcctgctgaatgcagagaactatcactggcaatggacttcgtttttctctgctgcttcaacggccgtctatgtctacttatactccatctattactactacgtaaagaccaagatgtctggattcttccagacaagcttctactttggatacaccatgatgttctgtcttggacttggaatcctttgcggagctgttggattcttgggatcaaatctgtttgtaaggaggatctacagaaacatcaagtgcgactagaggagtggtagacgaattgttgaaaaaagaggaaacaaaacatccaattagaaggaagcttcttatggggttatatattatataaacacagtagagagggagagaaattgagagggaggaggatggagcatatatatattaaatggggggctctatatgtatcttcatcgtctttgtcttattatcttctcttttttggtaagtgaattgttctcattagattagaattgagtcggtgtactatactactactactaccacctgtaatcattttcccttttgattttttgttcttgttttcacttcactttagatccttgaatatggtgtccttaaggagcatttggatagaatccacctattttt

SEQ ID NO: 4032 - DNA, 2327 bp, Phaseolus coccineus
ttattttctggtttctgaacaacgtaaattacaattatagtccgtgtttggctttctgctctgctctgttctcttcttctgttctcttcttccattgtcttctctcttctcttctctcttctcttctgtccccgccatgttcttccaatcccgatccctcctcttcccgctcctcatatctctcttcctgtcttccgcattcgcttcggagtcagatcacaagtatcaccgtgatgaaccagttaccctttgggtgaacaaattgggtccttataacaatccacaagaaacgtacaactattacagcctcccattttgtcatccattgagtaatgctagtgctggacacaaatggggtggtcttggtgaggtcctgggtggcaatgaactcattgatagccaaattgacataaagttccaaaaaaatgtggataagactgttttttgccggatagatctcagtgaagcaaaggtgaaacagttcaaggatgcaatagagaataattactggtttgaattcttcatggatgatctacctttgtggggatatgttggcgagctacatcctgataagaatggtgatggcaaacatgtcctttacacccacaaaaacattaatgttaaatacaacaatgatcagattattcacgtcaatctcactcaggatatcccaaagcctttggaagtaggaaaacatttggacatgacatattctgtgaaatgggattctaccaatgtcacttttgggcaccgctttgatgtctacctggaccatcctttctttgaacatcagattcattggttctccatttttaactctttcatgatggttatcttccttactggattggtgtcaatgatattgatgcgaactctgagaaatgactatgcaaaatatgctcgggaagatgatgatttggaaaccctggagagagatgttagtgaagaatctggctggaaacttgtgcatggtgatgtttttcggcctcctcgctacttagttattctttcagctgttgttggcacaggtgctcagctagcattgctggttcttcttgtcgtcttgttggctattattgggatgttgtatgttgggcgaggagcaatagtcactaccttcattgtgtgttatgctcttacatcttttatttctggttatgtgagtgggggaatgtactcaagaaatggcggtaaaaactggattaaatccatgatccttacagcttctctgttcccattcatgtgctttggaattggatttatcttaaacaccattgctatattctatgggtctctagcagcaattccctttggcacaatagtggttgtatttgtcatttgggctttcatctctttccctctagcacttcttggcacagttgttggaagaaactggagtggtgctctgaataatccctgtcgtgtaaagactattcctcgtcccattcctgaaaagaagtggtacctcacaccctctgtggtttctctgatgggaggactgctaccctttggaagcatttttattgaaatgtattttgtattcacttctttctggaattacaaggtgtactacgtgtatggctttatgctgctagtctttctaattcttatcatcgttacagtttgtgtgacaattgtggggacatactttttgttaaatgctgagaactaccactggcaatggacttctttcttttcagctgcctcaacatctgtttatgtgtatttgtactcaatatactactactatatgaagacgaagatgtcaggcttcttccagaccagcttctattttggttacactctgatgttttctcttggactaggaattctatgcggagctgtgggttttcttggttcaaatttatttgtcaggaggatctacagaaatatcaagtgcgattaaggtattctgggtcagacctgagcacttccataggcttatttctgaagacaataaatttttggaggaagtctctggtaatgtgtggggaacctaacaatgtttactggtagaatcacaatgagggtgtattcttttctatattggggaaaccctgagatttttttccccggctgtaattgattgtctttaaaatttagataattagtacaatatccaactctagtgattactgtttcatccccttataaagtagggacccattgaatgactgatttctaattccccaacatggtttcaattcaactattcgacatatgtaaagaggggatgaagtcttggaaatgaattttggtgcgtctgaattttgtatgaaagatctgcctccttcacatccattttaaatgttaatgtttgtattatc

SEQ ID NO: 4033 - DNA, 1828 bp, Zostera marina
ccaccctcctctctctcttccttctcgttttatcagcttcggcaggggaatccgaccacaagtatcaaccagaagatttagttgtgctctgggtgaataaagttggtccatataataatccccaagaaacctacaactatcacagccttccattttgtcagccacaagagaatcctgttcatagatggggtggtcttggggaggttttgggtggaaatgaactcattgacagtcagatcgaaataaaatatcagaaacccgttgataaggttaccatctgttcgattgaccttgatgaaacaaaggtgacacagttcaaaaatgcaattgatagctcgtattggtttgaattatttatggatgatctgccactttggggctttgttggagaggctcgaactgataaaagcaatgaaaataaacattttcttttcactcataaagatatcattattaaatataacggttttcagataattcatgtaaatctcacacaagatggcgcaaagcttttagaagttggaaagacattagacatgacttacagtgttaaatggataaagacaaacatagaatttgcacgtcgttttgatgtttatttagattatccattctttgaacaccagattcattggttttccatcttcaattcctttatgatggttattttcctcactggtctggtgtcaatgattctgatgagaactcttagaaatgattatgcaaagtatgcccgtgaggatgacgaccttgaaactctggaaagagacgtgagtgaggaatcggggtggaagcttgtccatggagatgtcttccgacctcctctaaatttgatcgtcctatcagctgtggtcggcacaggtgctcagtttgccatgcttgttcttatggtcattttattggcaatcattgggatgctttacattgggcgtggatcaattgtcacaaccttcattgtttgctatgctcttacttcatccatatctggatatgtgagtggtggaatgtactcaaggaatggtggtaaaaactggattaagtccatgatcttctcagcatctcttttcccattcatgtgctttggaataggcttcattctaaacaccattgctattttctatggatcactggctgctatcccatttggaacaatgatggttgtttttataatttggggattcatatcattaccccttgcttttcttggcactcttgttgggagaaattggagtggttatccaaatattccttgtcgtgtgaagacaattcctcgtctgatccccgaaaagaaatggtacctgacgccatctgtaatctccttgatgggaggtctccttccctttggcagcatattcattgagatgtactttgtcttcacatccttttggaattacaaggtgtactatgtttatggttttatgctgctggtttttatcatccttataattgtaaccgtctgtgtcaccattgtgggcacatatttcttgctgaatgctgagaactaccattggcaatggacctcatttttctctgctgcttcaaccgcgggatatgtttatctgtattctatatattactaccattcgaagactaagatgtctggatttttccagactagtttttactttggctacaccctgatgttctgcttgggcttgggtatcctctgcggtgctgtgggatatctagggtctacaatgtttgtgaggagaatctacagaaacataaagtgtgactagtaagaagagttcggctagcaatgtaaaattaaattaaatgttgggaaacattacataaatttttccatatgatagtgtttgtactataa

SEQ ID NO: 4034 - DNA, 2308 bp, Brassica rapa
cgaacaaaacatcaacagcaatactgtgtgctgctgctctcttctatttagtttggtctctcgctcgctccctcgatcgcttgctgccgagaaacgagagagagagagagagagctgctaacactgtattctcgataatgcaatttgcgccaatttgaatcagatcatcgaccctactcattgctctatctaacgcattcttcgtcagatctgatcgtccgccgcatttcgcgatgccgtcttcctcctcctcagccaccgccgctgtcttccttcttctcgtttctcttctcgcaacctctctcgcctctgattcagatcacaagtatcaagctgatgagcaggttacactgtgggtgaacaaagttgggccgtacaacaatccacaagaaacgtacaactactacagccttcccttttgccgcccctctctaaacgatgttcacaaatggggtggtcttggtgaagttcttggtggcaacgagctcattgacagcgagatccctatcaaattcttgaaaaatgttgacaggaacgtgatctgtaagcttgaactcgacgaacttaaagtcgagcattttaaagatgccatcgagtctagctactggtttgagttctttatggatgatctgcctttgtggggattcgttggtgagctgcaatctgacaaaaatggtgaaaacggcaaacatgtcctctacacgcataagaacattatcgtcaaatacaacaaagaccagattattcatgttaatctcactcaagacaacccaaggccattggaagcagggaggacagtggatctgacgtattctgttcaatggattccaaccgatgtcacatttgcccgccgttttgatgtgtatttggattatccattcttcgagcaccagatccattggttctccatctttaactcgtgcatgatggttatttttctcaccggtcttgtctcaatgatattgatgagaactctcagaaatgattacgcgaagtatgctcgtgaagatgatgatctcgagagcttggaacgggatgtaaatgaagaatccggctggaaacttgtgcatggggatgtgttcagaccaccatttagtttagttcttctctcagctgttgtcggcacaggtgcacagttggcgttgcttattcttcttgtcatattgatggccatcgtagggactctatatgttgggagaggagcaattgtcacaactttcatagtttgctatgctctgacttcctttgtctctggttacgtgagtggtggaatgtactcaagaagcgggggtaagcactggatcaagtgcatggtcctcacggcttctctattcccctttttgtgctttgggatcggctttatcctaaacacaattgccatattctatggatcccttgcggctattcctttcgggacaatggtggttgtgtttgtaatttggggtttcatttccttccccttagccctcctcgggacagtcgtgggaagaaactggagtggtgctccaaacaatccatgccgtgtaaagactattccacgtccgatccctgagaaaaaatggtacttgactccatcggttgtctccctgatgggaggtctgctaccatttggaagcatcttcattgagatgtacttcgtcttcacatccttctggaattacaaggtgtactacgtgtatggattcatgctgctggttttcgtgattctggtgatagtgacggtctgtgtgacaatagtgggaacttatttccttctgaacgctgagaattatcactggcaatggacttcgtttttctctgctgcgtcaacggctgtctatgtctacctatactccatctattactactacgtgaagacgaagatgtccggattcttccaaacaagcttctactttgggtacaccatgatgttctgtcttggccttggaatcctttgcggagcggttggattcttgggatcaaacctgtttgtaaggagaatctacagaaacatcaaatgcgactagagatatcaatagaggtaaaaaacaccgagttgagaaggaagcttgttatggtggacatacattatatataaacgccagtagagagggggaatatataagtattcttcaatggggtctttgtgtttttttggtaagtgaattgtttttcctctttagattagaatttgagtgggtgtaatatacagcaactactactactacctgtaattttttcccttgttccttataacttcacttcacttggaacattgaatgtgtcctcaaggagcaattggacaagtctagaatcatcccaagcccaa

SEQ ID NO: 4035 - DNA, 2426 bp, Phaseolus coccineus
gtcgttattcatttcatttcattcaattaagcgtggtttgcactgtaattgtaaccttattttctggtttctgaacaacgtaaattacaattatagtccgtgtttggctttctgctctgctctgttctcttcttctgttctcttcttccattgtcttctctcttctcttctctcttctcttctgtccccgccatgttcttccaatcccgatccctcctcttcccgctcctcatatctctcttcctgtcttccgcattcgcttcggagtcagatcacaagtatcaccgtgatgaaccagttaccctttgggtgaacaaattgggtccttataacaatccacaagaaacgtacaactattacagcctcccattttgtcatccattgagtaatgctagtgctggacacaaatggggtggtcttggtgaggtcctgggtggcaatgaactcattgatagccaaattgacataaagttccaaaaaaatgtggataagactgttttttgccggatagatctcagtgaagcaaaggtgaaacagttcaaggatgcaatagagaataattactggtttgaattcttcatggatgatctacctttgtggggatatgttggcgagctacatcctgataagaatggtgatggcaaacatgtcctttacacccacaaaaacattaatgttaaatacaacaatgatcagattattcacgtcaatctcactcaggatatcccaaagcctttggaagtaggaaaacatttggacatgacatattctgtgaaatgggattctaccaatgtcacttttgggcaccgctttgatgtctacctggaccatcctttctttgaacatcagattcattggttctccatttttaactctttcatgatggttatcttccttactggattggtgtcaatgatattgatgcgaactctgagaaatgactatgcaaaatatgctcgggaagatgatgatttggaaaccctggagagagatgttagtgaagaatctggctggaaacttgtgcatggtgatgtttttcggcctcctcgctacttagttattctttcagctgttgttggcacaggtgctcagctagcattgctggttcttcttgtcgtcttgttggctattattgggatgttgtatgttgggcgaggagcaatagtcactaccttcattgtgtgttatgctcttacatcttttatttctggttatgtgagtgggggaatgtactcaagaaatggcggtaaaaactggattaaatccatgatccttacagcttctctgttcccattcatgtgctttggaattggatttatcttaaacaccattgctatattctatgggtctctagcagcaattccctttggcacaatagtggttgtatttgtcatttgggctttcatctctttccctctagcacttcttggcacagttgttggaagaaactggagtggtgctctgaataatccctgtcgtgtaaagactattcctcgtcccattcctgaaaagaagtggtacctcacaccctctgtggtttctctgatgggaggactgctaccctttggaagcatttttattgaaatgtattttgtattcacttctttctggaattacaaggtgtactacgtgtatggctttatgctgctagtctttctaattcttatcatcgttacagtttgtgtgacaattgtggggacatactttttgttaaatgctgagaactaccactggcaatggacttctttcttttcagctgcctcaacatctgtttatgtgtatttgtactcaatatactactactatatgaagacgaagatgtcaggcttcttccagaccagcttctattttggttacactctgatgttttctcttggactaggaattctatgcggagctgtgggttttcttggttcaaatttatttgtcaggaggatctacagaaatatcaagtgcgattaaggtattctgggtcagacctgagcacttccataggcttatttctgaagacaataaatttttggaggaagtctctggtaatgtgtggggaacctaacaatgtttactggtagaatcacaatgagggtgtattcttttctatattggggaaaccctgagatttttttccccggctgtaattgattgtctttaaaatttagataattagtacaatatccaactctagtgattactgtttcatccccttataaagtagggacccattgaatgactgatttctaattccccaacatggtttcaattcaactattcgacatatgtaaagaggggatgaagtcttggaaatgaattttggtgcgtctgaattttgtatgaaagatctgcctccttcacatccattttaaatgttaatgtttgtattatctttattttccttttgttttgttttctgtctgtgtaaatatttt

SEQ ID NO: 4036 - DNA, 2265 bp, Brassica napus
gaaatgtgctgctgctctcttctatttggtttggtctctctcgctctctcgatcaatcgctgccgagaaacgagagcgagctgctatcactaacatgcaatttgcgccaatttgaatcagatcgtcgagcctactcattgctctatctaacgcattcccatcaccgtctccgtcatcatcagatctgatcgtccgccgggtttcgcgatgccgtcttccaacaccgccgccgtattccttcttctcgtttctcttctcgcaacctctctcgcctctgattcagatcacaagtatcaagctgatgagcaggttacactgtgggtgaacaaagttgggccatacaacaatccacaagaaacatacaactactacagccttcccttttgccgcccctctcaaaacgatgttcacaaatggggcggtcttggtgaagttcttggtggcaacgagctcattgacagcgagatccctatcaaattcttgaaaaatgttgacaggaacgtgatctgtaagcttgaactcgaccaacctaaagtcgagcattttaaagatgccatcgagtctagctactggtttgagttctttatggatgatctgcctttgtggggattcgttggtgagctgcaatctgacaaaaatggtgaaaacggcaaacatgtcctctacacgcataaaaacatcattgtcaaatacaacaaagaccagatcattcatgttaatctcactcaagacaacccaaggccactggaagcagggaggacagtggatctgacgtattctgttcaatggattccaaccgatgtcacatttgcccgccgttttgatgtgtatttggattatccgttcttcgagcaccagatccattggttctccatctttaactcgttcatgatggttatttttctcaccggtcttgtctcaatgatattgatgagaactctcagaaatgattacgcgaagtatgctcgtgaagatgacgatctcgagagcttggaacgggatgtaaatgaagaatctggctggaagcttgtgcatggggatgtgttcagaccaccatttagtttagttcttctctcagctgttgttggcacaggtgcacagttggcgttgcttattcttcttgtcatattaatggccatcgtagggactctatatgttgggagaggagcaattgtcacaactttcatagtttgctatgctctgacatcctttgtctctggttacgtgagtggtggaatgtactcaagaagcgggggtaagcactggatcaagtgcatggtcctcacggcttctctattcccctttttgtgctttgggatcggctttatcctaaacacaattgccatattctacggatcccttgcggctattcctttcgggacaatggtggttgtgtttgtgatttggggtttcatttccttcccattagccctcctcgggacagtcgttgggagaaactggagtggtgctccaaacaatccatgccgtgtaaagactattcctcgtccaatccctgagaaaaaatggtacttgactccatcggttgtctctctgatgggcggcttgttgccatttggaagcatcttcatcgagatgtactttgtcttcacatccttctggaactacaaggtgtactacgtgtatggattcatgctgctggtttttgtgatactggtcatagtgacggtctgtgtgacaatagtgggaacttacttcctgctgaacgctgagaattatcactggcaatggacttcgtttttctctgctgcatcaacggcggtctatgtctacctatactccatctattactactacgtgaagacgaagatgtccggattcttccagacaagcttctactttgggtacaccatgatgttctgtcttggccttggaatcctttgcggagcggttggattcttgggatcaaacctgtttgtaaggagaatctacagaaacatcaaatgcgactagaggagatatcaataaagaggtaaaaaccatcgagttgagaaggaaacttgttatggtggacatacattatatataaacgccagtagagagggagaatatataagtattcttcaatggggtctttgcgttttttttggtaagtgaactgtttttctctttagattagaatttgagtgggtgtaatatacaacaactactactacctgtaattttttcccctgttccttataactttactttcacttggaacattgaatgtgtgtccttaaggagcaattggacaagtctagaatc

SEQ ID NO: 4037 - DNA, 2918 bp, Vitis vinifera
attgcagtaaacctcaaattttccatttatcagacaaatcccaaataccaaaatacaaaaagcacaaaatctccatcatcaatctccatctacacaaaaaaaagaaaaataaataaaaataaaaataaaagaaaattctaagaagtcaagagaggagttctactatcaaaaatcacaacatccacatgatttgccaaatcttcctcatcgccgcattcatacacagatccaaccagcccaatctgatcttccaggtaccgctgcagcagccccacctccccctccccctccccctcctcctccgcccctgctccgccctcctcgcagcggcgcagcctccctccgctgccttcggaggatcgcttggggctgccgccgccgcggcggcagaggcggatacaaagctccgcagcgcagaggaggggaaaagtcgcacagaggaaggggaggatgatgggagagcagaggaggagcacgaggcaacggctccggcgggggcggagccaggcgatcagcatggcggaggtgggcggcatacggtggtggtagactacatttgccttttgcctcaagctgagtgggggagaaaagaggcatattattttataatggagtgtccatgtgactttatgaatcgatccgcccaccgttgccccccagcagccatggtctccaccttcagatcctccttcctcctcctcctcctcgtctctctcttcgctctactggccttcgcctctgagtccgatcacaagtatcagacagatgagcaggtgactctgtgggtaaacaaagttggtccttacaataatccacaagaaacctacaactacttcagccttccattttgtcaccctcctggcaatgcaggtcacaagtggggtggccttggtgaagttctgggtggaaatgagctcattgatagccaaattgatatgaagtttaaaaaaaatgtggaaaggactactatttgtataattgaactggatgcagcaaaagttaagcagttcagagatgccattgggaagtcatattggtttgagttcttcattgatgatttgcctttatggggttttattggtgaggtgcattctgataaaaagaatgataagatccagcatctactttatacgaacaaaaatatttttgttagatataatggagatcagattattcatgttaatctcactcaagacagtcctaaaccattggaagaagggaaagccttggacatgacatattctgttcaatggattccaacagatgttgcattttcacggcgttttgatatttacctggaccaccctttctttgagcaccagatccattggttctcaatcttcaattcattcatgatggttattttcctcactggattggtgtctatgatattaatgcgaactcttcgaaatgattatgccaaatatgctcgggaagatgatgatttggagactctggaaagggatgtaagtgaagagtctggctggaaacttgtccatggggatgtttttcggtctcctcgcaatatggttttattttcagctgttgttggcactggtgctcagctggccatgcttgttctccttgtcatcattttggcaattattgggatgttgtatatagggagaggagcaattgtcacgacttttatagtgtgttatgctcttacatcattcatttcgggttatgtgagtggtggaatgtactcccgcaatggtggtaaaagctggataaagtcaatgatactcactgcatcacttttcccgtttatgtgctttgggattggtttcatcttgaacacaattgctatattctatggatctctagctgcaattccctttggtacaatggtagttgtttttgtcatttgggctttcatctccttccctctggcacttcttggtactgtagttggaagaaactggagtggtgctccaaacaatccctgccgcgtaaagaccattcctcgtccaattccagagaagaaatggtatctcacaccatctgtagtctctctcatgggaggactgcttccttttgggagtattttcattgagatgtattttgtcttcacatccttctggaattataaggtatattatgtatatggctttatgttgcttgttttcatgattcttatgattgttacagtctgtgtaacaattgtggggacatatttcttgttgaatgctgagaactatcactggcaatggacttcattcttctctgctgcttccactgccttctatgtgtatttctactctatatattactattatatgaagaccaagatgtcaggcttcttccaaaccagcttttattttggttacactctcatgttatgccttggtttggggatactgtgtggagctgttgggtttttgggctccaatttgttcgtaaggaggatctaccgaaacatcaaatgtgactagtgatttgtccaaaggccattttgataggataatgcttgctggggtctgaattttggtgacaaaaacttcttgagaggaaagcaagagatcagataatggactccagaaagcggccttttatgacatttgataccacaaccactgcacatcacagatttgagagatgtgtattctttttgttcttttgttgttttcttttctcccttttttctcagaacatggtgcctttcggatttgtattggattccagagatcatgttcataatccaccaagcaactcgccatacgtttttctcttccattgttttgtactactcattaggcaatgacctcttttgaactctctctctctctctctctctcattttatatatgtaatcaaattggtgttatcacgtcaccctgtgtgtggatgcctctatgtgtaatgcaaggccaacttaaaaaggatccatatccatatctggtaataaatcaaataat

SEQ ID NO: 4038 - DNA, 2307 bp, Medicago truncatula
gtttagaggaaataataaagtgataatagatagatattagatagagtctcaattcttcaaggttaagtcctctttcgctcgttttcgtttctctctcgtcaaggttagagattgagatccacgatgctcttcagattctcgctcctcctccttctactcctctctccggccttcgcttccgagtcagatcacaagtaccaaccagatgacccagttaccctttgggtcaacaaagtaggtccgtacaataatcctcaagaaacatataattattacagcctgccattttgccgtccacctggtaatactgctcacaaatggggcggtctaggtgaggtccttggtggcaacgaacttattgatagccaaattgagataaaattcttagggaatgtggaaaggaccactttttgccgtttgaatcttgatgaggcaaaggttaaacagttcaaggatgcaattgaaaataattactggtttgaattcttcatggatgatcttccgttgtgggggtatgttggggagttacatcctgacaagaacagtgacagtggcaagcatgtcctttacacacacaagaacatcattgttaagtacaatacagatcagatcattcatgtgaatctcactcatgatgacccgaaacctttggaagcaggaagatcgttggacatgacatattctgttaaatggattgccactaatgtcacttttagacaccggtttgatgtatatctggactatccattctttgagcatcagattcattggttctctatttttaactcttttatgatggtcatattcctaactggattggtgtctatgatattgatgcgaactttgagaaatgactatgcaaagtatgctcgggaagatgatgatttggaaactctggaaagagacgtcagtgaagaatctggctggaaacttgtgcatggtgatgtttttcggcctcctcgcagtttggctcttctttcagctgttgttggtacgggtgctcagcttgcgttgttgattcttcttgtcatcttgttagctattgttgggatgttgtatgttgaccgaggagccattgtcacaacattcattgtttgttatgctctcacgtcagtcatttctggttatgtaagtggggggatgtactcacgtaatgggggtaaaagttggattaaatccatgatccttacagcatcacttttcccattcctgtgctttggaattggattcatcttaaacaccgtggctatattttatggatctctagcagcaatcccctttggtacaatggtggttgtctttgttatttgggctttcatctctttccctcttgcacttcttggcacagttgttggaagaaactggagcggtgctccaaacaatccatgtcgtgttaagaccattcctcgtcccattcctgagaagaagtggtacctcacaccctctgtagtttctctgatgggtggactgcttccctttggcagcatattcattgagatgtattttgtatttacttccttctggaattacaaggtgtactatgtctatggcttcatgctactggtttttctgattctcattgttgttacagtatgtgtgacaattgtggggacatactttttgttaaatgctgagaactacaactggcaatggacttcttttctttcagctgcatcaacaggtgtttatgtatatttgtactcgatatactactactatgtgaagacaaagatgtcaggcttcttccaaactagcttctattttggatacactgcgatgttttgtcttggactgggaattctctgtggagctgtgggtcatcttggttcgaatttgtttgtgaggaggatctaccgcaatatcaagtgtgactaaggcttagacgaagcctctggtcattcggggaccaagcaatgtttatagggtagtatgacggggttttgaggatgggaatgtattctttctcgataatagggaaaccctgagatttttttccctggctgtaattgaaagctttgatttagaatgcagggattgatctttattatcataattcagatagtagctagcaaaatatcagactcatgtggtttcttttttaagtccttttattacaaaataggtgtcagattgacgaactgatgtctgattcccatacgcgctttatctattgtacgtagaggggatgaagtctcggaaatgaattttgtatcaactccgttctgagtacttcctccacataccttcatggtttaatctaaattttaaatcattacgattattcatttttgccttctattgtttttg

SEQ ID NO: 4039 - DNA, 2363 bp, Cajanus cajan
gaattgaaggcatcgtgtttggttgctctgtagtcgtaacgtgaattaccattatagtctgcgctttctctctcctcgtcttccttcttccatctccgccatgtcccgatccctcgtcttcccgctcctactttctctcttcctctcttcggccctcgcttcagagtcagatcacaagtatcaacgtgatgaagcagttaccctttgggtgaacaaagttggcccttataacaatccacaagaaacatacaactattacagcctcccattttgtcatccatctagtagtgctagtgccgcacacaaatggggtggtcttggtgaggtcctgggtggcaatgaactcattgatagccaaattgagataaagttccaaagaaatgtggagaagactgtcttttgccagatagatctcgatgatgcaaaagtgaaacagttcaaggatgcaattgagaataattactggcttgaattcttcatggatgatctacctttgtgggggtatgttggtgagctacatcctgataagaacagtgataatggcaagcatgttctttacacacacaaaaacattattgttaaatacaacaatgatcagattattcatgtcaatctcactcaggatatcccaaagcctttggaagttggaaaacctttggacatgacatattctgtcaaatggatttccaccaatgtcacttttgggcgtcgctttgatgtctacctcgaccatcctttctttgagcatcagattcattggttctccgtttttaactctttcatgatggtcatcttccttactggattggtgtcaatgatattgatgcgaactctgagaaatgactatgcaaaatatgctcgggaagatgatgatttggaaagtctggagagagatgtaagtgaagaatctggctggaaacttgtgcatggtgatgttttccggcctcctcgctacttggttattctttcagctgttgttggcacaggtgctcagctagcaatgctggttcttctggtcatcttgtcagctattgttgggatgttgtatgttgggcgaggagcaattgtcactaacttcattgtgtgctatgctctcacatctttcatttctggttatgtaagtgggggaatgtactcacgaaatgggggtaaaaactggattaaatccatgatccttacagcttctctgttcccattcatgtgctttggaattggatttatcttaaacacaattgctatattctatggatctctagcagcaattccatttggcacaattgtggttgtgtttgtcatttgggctttcatctctttccctctagcacttcttggcacagttgttggaagaaactggagtggtgctctgaataatccatgtcgcgtaaagactattcctcgtcccattcctgaaaagaagtggtatctcactccctctgtggtttctctgatgggaggactgcttccctttggcagcatatttattgaaatgtattttgtattcacttccttctggaattacaaggtgtactatgtatatggctttatgctgctagtctttctgattcttatcatcgttactgtgtgtgtgacaattgtggggacatactttttgttaaatgctgagaactaccactggcaatggacttctttcttttcagctgcttcaacagctgtttatgtgtatttgtactcaatatactactactatgtgaagacgaaaatgtcaggcttcttccaaaccagcttctattttggatacactttgatgttttctctcggactaggaattctatgtggagctgtgggtttccttggttcaaatttgttcgtgagaaggatctacagaaacatcaagtgcgattaaggttttttgagttagacctgagcacttccataggtttgttgctgaagacaataaatttttggaggaagactctggtcgtgggggaacctaacaatgtttacaggtagaatcacagggttttgagaatgaggttgtattctttttctatattggggaagccctgagattttttccccgactgtaattgattgtcttttataattttagataattagtacaatatccaactctcgtgattactgtttcatccccttatgaaatagggggccattgaaggactgatatctaattccccaacatgttttcaactattcaatgtatgtaaagtggggatcgagtcgcggaaatgaattttgtgcgtctgaattttgtatgaagatctaaatatcattcttatctgtttccttaacagttaatattgttgtgtatgtactctttaccagttagctcctttttttcccctcttttttaccggctgtgtaaatattttggcattgcc

SEQ ID NO: 4040 - DNA, 2308 bp, Solanum phureja
gaaacgacaataactcagagttggtgctttgtcgagtcttagagctctcaaattgctcgtctgaaacttgagatctaaagaagacaaagagaagagtgaaagagaagaggagctcacaaaatctgatacgctgaaagagaagtacaacaaacccatacatacgttttcaagaatccatttttcattttcagatccgtttagcaatgctctccactgctcgatctctcgtcattttcgtcatcttctctctattccttgcatacccatctcatgcaaagtatcaagcggatgaacctgttactctttgggtaaataaggttggaccctataataatccacaagagacatacaactattacagccttccgttctgtcatcctggtgatggtggtcacaagtggggtggccttggcgaggttcttggtgggaatgaacttattgatagccgaattgatataaagttcaaaagagatgtggagaaaagcacaatctgtgaacttgtattggatgcagcaaaagtggcacaatttaaggatgctatcgaaagttcatattggtttgaatttttcatggacgatttgccattatggggtttcgtgggcgaagtgcttcctgatagaaaccgagataccaagcatgtgctctacacacacaagaattttcttattcaatataataaagaccagatcattcatgtcaacctaactcaagagaccccaaaaccactggaggaaggaagactcttaggcatgacatactctgtaaaatgggttccgacaaatattacctatgaacggcggtttgatgtatacttggattaccccttttttgaacatcagatccactggttctctgtgttcaattcgttcatgatggttattttcctcactggcttagtgtctatgattttgatgcgcactcttcgtaatgattatgctaaatatgctcgtgaagatgatgatctggagagtctggagagggatgtgaatgaagagtctggttggaaacttgtccatggtgatgttttccgacctccacaaaatttggcccttctttcagctgttgttggcactggtgctcagcttacaacacttgttctccttgtgatcgtatttgctattattggaatgttgtacatagggagaggagctattactacaacctttattgtatgttatgctcttacatcgttcattgccggatatgtgagtggtggcctgtactctcgtaatggtggtaaaaagtggataaagtcaatgatactaacggcatcacttttcccctttatgtgctttggcattgggttcattctaaatacgattgctatattttatggatctttagctgctattccctttggcacaatggtggtggttttggttatttgggcttttatttcattccctctggcacttcttggtactgttgtaggaagaaactggagtggtacgccaaacaatccttgccgtgttaagaccataccccgccctatccctgagaagaaatggtacctcacaccatctgtaatttctctaatgggaggtcttcttccctttgggagcattttcattgagatgtattttgtcttcacttccttctggaactacaaggtctactatgtctatggttttatgcttcttgtatttattattctcatcattgtcaccgtttgtgtgacaattgtgggcacgtatttcttgttgaatgccgagaactaccattggcggcggtggacttcattcttttctgctgcctcaacagctctttatgtttatctttacgccatatattactatcacgtaaagactaagatgtccggtttcttccagaccagcttttactttggctacactatgatgttctgccttggccttggcatcctctgtggtgctgtaggatatcttggctctaatttgtttgttaggaggatttacagaaatatcaagtgtgattaagtgcttaaacgaagcatatgaaacgatgcaccacagttttgcatgatccgtttctacctgtcacttgtggatttccagataataccacagcaatcggatcacctaatgtgaatgaagattattatttttagaagagatggaaggaagaaaattagttatttccaattttctggtttagaatgggtggaaatgtttagtaaagttgtatgggagaaaacagtggaatattgtgcaacttttgtagtgcatacatatattacttatacatttgtttttgttacttcaaaggccataatctgcattgtattttggaatatgttgagaatcattttttttatcaagtgacattactt

SEQ ID NO: 4041 - DNA, 2387 bp, Glycine max
ccactcatcgtcgtcattcatttcatttcatttgagtgtagtcctaacgtaaccttattttctcattcgtcgtcgacaacgtaaattaccattatagtccgttcgtgcttcctctgttcttcttcttgttgttgtgttgttctgttctctttctctctcttcaagcatcaccgccatgttcttcgaatcccgatccctcctcttcccgctccttttctctctcttcctttcttccgccttcgcttcagactcagatcacaagtatcaacacgatgaaccagttaacctttgggtgaacaaagttggtccttataacaatccacaagaaacatacaactattacagcctcccattttgtcatccatctagtagtgctagtgctgcacacaaatggggtggtcttggtgaggtcctgggtggcaatgagctcatcgatagccaaattgaaataaagttccaaagaaatgtggataagactgtcttttgccagatagatctcgatgaagcaaaggtgaaacagttcaaggatgcaatagagaataattactggtttgaattcttcatggatgatctacctttgtggggatatgttggtgagttacatcctgataagaacagtgataatggcaagcatgtcatttatacacacaaaaacattattgttaaatacaacaatgatcagattattcatgttaatctcactcaggatatcccaaagcctttggaagtgggaaaacatttggacatgacatattctatcaaatgggattctaccaatgtcacttttgggcgtcgctttgatgtctacctggatcatcctttctttgagcatcagattcattggttctccatttttaactctttcatgatggtcatcttccttactggattggtgtcaatgatattgatgcgaactctgagaaatgactatgcaaagtatgctcgggaagatgatgatttggaaagtctggagagagatgttagtgaagaatctggctggaaacttgtgcatggtgatgtttttcgaccgcctcgcaacttagttattctttcagctgttgttggcacaggtgctcagcttgcgttgctggttcttcttgtcgtcttgttggctattgttgggatgttgtatgttgggcgaggagccatcatcactactttcattgtgtgttatgctctcacatcttttatttctggttatgtgagtggggggatgtactcacgaaatgggggtaaacactggattaaatccatgattcttactgcttctctgttcccattcatgtgctttggaattggatttatcttaaacacaatcgctatattctatgggtctctagcagcaattccatttggcacaatggtggttgtatttgtcatttgggctttcatctctttccctctagcacttcttggcacagttgttggaagaaactggagtggtgctctgaataatccctgtcgcgtaaagactattcctcgtcccattcctgaaaagaagtggtaccttacaccctctgtggtttctctgatgggaggactgctaccctttggcagcatattcattgaaatgtattttgtattcacttccttctggaattacaaggtgtactatgtgtatggctttatgctgctagtctttgtgattcttatcatcgttaccatttgtgtgacaattgtggggacatactttttgttaaatgctgagaactaccactggcaatggacttctttcttttcagctgcctcaacagctgtttatgtttatttgtactcaatatactacttctatgtgaagacgaagatgtcaggcttcttccagaccagcttttattttggatacactttgatgttttctcttggactaggaattctatgtggagctgtgggttttcttggttcaaatttgttcgtgaggaggatctacagaaatatcaagtgcgattaaggttttgagtcagacctgagcacttccataggtttgttgctgaagacaataaatttttggaggaagcctctggtcatgtgtggggaaacctaacaatgtttacaggtgaatccacagggttttgagaatgaggatgtattatttttctatattggggaagccctgagattttttttccccggctgtaattgattgtctttataattttagataagtagtacaatattcaactcttgtgattaccgtttcatccccttataaaataggggtccattgaagaactggtgcccaattcccaattccccaacatgggtttcaactatcaatataagtaaagagggggatcaagtctcggaaatgaattttgtatgaagatctgaatatcattcttatctgcttcctttacactccttttaaatgataaataatttttgtagtg

SEQ ID NO: 4042 - DNA, 2515 bp, Glycine max
ctcagtcacagaacacagtttcactctattacccaaaaaaccgtaataataataatgaaatgaaagaaattccactcatcgtcgtcattcatttcatttcatttgagtgtagtcctaacgtaaccttattttctcattcgtcgtcgacaacgtaaattaccattatagtccgttcgtgcttcctctgttcttcttcttgttgttgtgttgttctgttctctttctctctcttcaagcatcaccgccatgttcttcgaatcccgatccctcctcttcccgctccttttctctctcttcctttcttccgccttcgcttcagactcagatcacaagtatcaacacgatgaaccagttaacctttgggtgaacaaagttggtccttataacaatccacaagaaacatacaactattacagcctcccattttgtcatccatctagtagtgctagtgctgcacacaaatggggtggtcttggtgaggtcctgggtggcaatgagctcatcgatagccaaattgaaataaagttccaaagaaatgtggataagactgtcttttgccagatagatctcgatgaagcaaaggtgaaacagttcaaggatgcaatagagaataattactggtttgaattcttcatggatgatctacctttgtggggatatgttggtgagttacatcctgataagaacagtgataatggcaagcatgtcatttatacacacaaaaacattattgttaaatacaacaatgatcagattattcatgttaatctcactcaggatatcccaaagcctttggaagtgggaaaacatttggacatgacatattctatcaaatgggattctaccaatgtcacttttgggcgtcgctttgatgtctacctggatcatcctttctttgagcatcagattcattggttctccatttttaactctttcatgatggtcatcttccttactggattggtgtcaatgatattgatgcgaactctgagaaatgactatgcaaagtatgctcgggaagatgatgatttggaaagtctggagagagatgttagtgaagaatctggctggaaacttgtgcatggtgatgtttttcgaccgcctcgcaacttagttattctttcagctgttgttggcacaggtgctcagcttgcgttgctggttcttcttgtcgtcttgttggctattgttgggatgttgtatgttgggcgaggagccatcatcactactttcattgtgtgttatgctctcacatcttttatttctggttatgtgagtggggggatgtactcacgaaatgggggtaaacactggattaaatccatgattcttactgcttctctgttcccattcatgtgctttggaattggatttatcttaaacacaatcgctatattctatgggtctctagcagcaattccatttggcacaatggtggttgtatttgtcatttgggctttcatctctttccctctagcacttcttggcacagttgttggaagaaactggagtggtgctctgaataatccctgtcgcgtaaagactattcctcgtcccattcctgaaaagaagtggtaccttacaccctctgtggtttctctgatgggaggactgctaccctttggcagcatattcattgaaatgtattttgtattcacttccttctggaattacaaggtgtactatgtgtatggctttatgctgctagtctttgtgattcttatcatcgttaccatttgtgtgacaattgtggggacatactttttgttaaatgctgagaactaccactggcaatggacttctttcttttcagctgcctcaacagctgtttatgtttatttgtactcaatatactacttctatgtgaagacgaagatgtcaggcttcttccagaccagcttttattttggatacactttgatgttttctcttggactaggaattctatgtggagctgtgggttttcttggttcaaatttgttcgtgaggaggatctacagaaatatcaagtgcgattaaggttttgagtcagacctgagcacttccataggtttgttgctgaagacaataaatttttggaggaagcctctggtcatgtgtggggaaacctaacaatgtttacaggtgaatccacagggttttgagaatgaggatgtattatttttctatattggggaagccctgagattttttttccccggctgtaattgattgtctttataattttagataagtagtacaatattcaactcttgtgattaccgtttcatccccttataaaataggggtccattgaagaactggtgcccaattcccaattccccaacatgggtttcaactatcaatataagtaaagagggggatcaagtctcggaaatgaattttgtatgaagatctgaatatcattcttatctgcttcctttacactccttttaaatgataaataatttttgtagtgtctttaccgtttagtttattattataagattatcaatggttcgatatcgttgctgct

SEQ ID NO: 4043 - DNA, 2029 bp, Tabernaemontana elegans
ctgtgtttcgccctcactcgacctttgtcgccgtgagatccaaaccaacgccggcgattcttccccgagatgcggctcaccgtccgatccttcgctcttctttctcttttctcctcccttctccttgtttcgccggcgcttgcctccgagtacgatcataagtatcaagagggagacaaggttatactatgggtaaacaaagtagggccatacaataacccacaggagacgtacaattattacagtcttccattttgtaagccagagggcattgctgctcacaaatggggtggtcttggtgaagttcttggtggaaatgagcttatcgatagtcttattgacataaagttcaaaaaaaatgtggagaagactaccttttgtgatgttgagcttgatgaagccaaggttaaacaatttaaggatgcaattgaaaacaactattggtttgaattcttcatggatgatctgcctttgtggggttatattggggagcttcatgccgacagaaacagtgataacaaacatgtgctttacacccataagagtattgatgtcaaatacaataaggatcagatcattcatgttaatctcactcaagtcagcccaaaaccattggaagttggacgaagattggatatgacatattctgtcaaatggacatctacaaatgtcacgtttgcacatcgcttcgatgtctaccttgactaccccttttttgaacatcagattcactggttctccatttttaattccttcatgatggttatctttcttactggattggtctcaatgatactcatgcgaactttgagaaatgattatgctaaatatgctcgggaagatgatgatcttgaaaccctggaaagagatgttagtgaagagtctggttggaagcttgtgcacggagacgtatttcggcctcctcgcaatttagtattaatttctgcgcttgttggcactggtgcacaactagcagtgctggttcttgttgtcatcttatgtgcaattgtgggaatgttatatgttgggagaggaacaattggcactgctttcattgtttgctatgccttgacatcaattgtttcgggctatgtaagtggtggaatgtactcgcgcaatggtggtaaaaactggattaaatcgatgatccttacagcaacacttttcccatttttatgctttgggattggtttcattctcaacacaattgcaatattttatgggtctttggcagccattccttttggaacaatggtggtggttcttgtcatctggactttcatctccttccctctggcacttgttggtacagtaattggaaggaactggagtggtgctccaaacaatccatgccgggtgaaaaccattcccaggccaattcccgagaagaagtggtacttgacaccttctgtagtttccttgatgggaggcctgttgccgtttggcagtatattcattgaaatgtattttgttttcacctccttttggaactacaaggtttattatgtctatggttttatgctgctggttttccttattctcatcattgttacagtctgtgtgacaattgttggaacatatttcctgcttaatgctgaaaattatcactggcaatggacctctttcttctcagctgcatccacagctgtatacgtgtacttgtattctgtgtactactactatgtgaagaccaagatgtcgggtttcttccagacgagcttctattttggttatacactcatgttttgcattggattaggaattctctgcggggctgttggttatctaggctctaatctgtttgtgagaaggatctaccgaaatatcaaatgtgattaagttgtgctcaaaggacgatgagactttgcttctgccggcacattaaactcaacaagaattgaagaagcaagaaatcatttttttgtgtccccgagaatgtttcatcaagggatggacaggatggtttgtaacacagtattgtggggaagctctgaaaattttccctgttccccaggctgtagaaaaaaga

SEQ ID NO: 4044 - DNA, 1936 bp, Sciadopitys verticillata
cttggttcggagtacgatcataagtatggatcaggtgaccctgtgaccttatgggtgaacaaagttggcccttacaacaatcctcaagaaacatataactactacagtcttccattttgccagccaagaaaaaaccctgtacacaaatgggagggcttggtgaggttcttggaggaaatgagctcatcaacagccaaattgatataaaatttggaaaacctgttgagagaggcacaatatgtgaatttgagcttgatgctgcaaaagtgaagcagttcaaggatgcaattgagaatacctattggtttgaattcttcatggatgatctgccactgtggggttttgttggcgagcagcacccacagaagacagatgaccagaaatatttgttatacactcacaagaatatagttgtgaaaaccaataatgaccagataattcatgtcaaccttactcaggaaaatcctaccctcctcgttgctgggaagacagtggagcttacttattcagtcaagtgggttgagacgaatgttacctttgctaggcgatttgatgtatatctggactatcctttctttgaacaccagatacattggttctccatattcaattcatttatgatggttatttttctacgggtttagtatcaatgatcctgatgaggactctgagaaatgactatgcaaagtatgctcgagaagatgatgatttggaaagcctggagagggatgttagtgaagagtcaggttggaagcttgttcatggagatgttttccggacaccccgaaacttggtcatgttgtcggcattagtgggcacaggtgcacaacttgctacgctcgtgcttctcgtcatcttgctggcaatcattggcatgctatacattgggcgtggagcaattgtgacaactttcattgtctgctatgctctgacttcgtttatatctgggtatatgagtggaggcttgtattcacgtaatgatggaaaacactggataaagtcaatggttctcacagcatctcttttcccatttatgtgctttggtattggatttatactgaacaccgttgctatattctatggttctctggctgctattccttttggcacaatggtggtggttttcataatgtgggcatttatctctttccctctagcacttcttggaacagttgttggaagaaattggagtggggctccaaacaatccttgccgtgtgaagaccattcctaggccaattccagagaagaagtggtatctgacaccaactgtagtatcacttatgggtggtctgcttccttttggaagcatttttattgagatgtactttgttttcacctcattttggaactacaaggtatactatgtttatggcttcatgttgctggtatttttgattctcattattgtgaccatctgtgtcacaattgtgggaacgtacttcttgcttaatgctgaaaattatcactggcaatggacgtcattcttctcggctgcatcaacagctgcctatgtgtatctttattccatatactactactatatgaagacaaagatgtctgggtttttccagaccagtttctattttggctacactttgatgttctgtcttgggttaggcatcctttgtggggctgttggttatttaggctcaacaatgtttgtaagacgaatctatcgaaatatcaaatgtgattgaagagtaaatgaagaatctgtagatcagaaacaaaaaacatatttggatgtctgaagctgttggcgcttctgtgctgcaggggcttgccattccccaggaaaaaggttcacggtttcttaggtttacttattttaatttgagctgttcaatcaatggtattcctgggtgtagcattgatttttgtattatggaacattaggcatgagcaaattgtagatcactctactactatgtctg

SEQ ID NO: 4045 - DNA, 2033 bp, Cedrus atlantica
gtcgcggcatggggtacagtgtttgcatccgagtatgatcataagtatcgagcaagtgaccctgttacattatgggtgaacaaagttggcccttacaataatcctcaagaaacgtataactactatagtcttccgttctgccatccagcccaccctacacataagtggggtgggcttggtgaggttctgggaggaaatgagctcatagatagcaaaattgacatcaaatttggaaaaaatgttgagaaaagctctatatgcgaaattgagcttgatgctacaaaagtgaaacagttcaaggaagctattgaaaacacctactggtttgaattcttcatggacgatctacctctctgggggtttgttggtgagatgcatcaagacaagagcgatgatcagaagcatttgctatacacacacaaggatattattgtgaaaatcaataatgaccaaataattcatgtcaacctcactcaggagaatccaaagccacttattgctgggaagacactagaacttacctattcagtcaattgggttaacaccaatgtaaccttcgccaggcgctttgatgtatacttagactatcctttctttgaacatcagatccattggttctccatcttcaattcatttatgatggttatttttctcacgggtttagtctcaatgatcctgatgcggactctgagaaatgactatgcaaaatatgcccgagaagaagatgatttggaaagcctggagagggatgttagtgaagagtcgggttggaagcttgttcatggagatgttttccgaacaccacgaaacttggtcttgttgtcagcattagtgggcacgggtgcacaacttgctatgcttgtgcttcttgtgatcttgctggcaattgttggaatgctatatattgggcgtggagcaattgtcacaactttcattgtctgctatgcccttacttcatttatatctggctatgtgagcggaggattgtattcacgtaatgatggcaagcactggataaagtcaatggttctcacggcatctcttttcccatttatgtgctttggtattggatttgtactgaacatcatagctatattctatggttctcttgctgctattccttttggcactatggtggttgtctttataatctgggcatttatttctttccctctagcactacttggaacagttgttggaaggaattggagtggggctccaaataatccttgccgtgtgaagaccattcctcgtccaattccagaaaagaagtggtatctgacaccaacagtggtgtcactgatgggtggcctgcttccgtttgggagtattttcattgaaatgtattttgttttcacctcattttggaactacaaggtatattatgtatacggttttatgttgctggtatttttgattctcgttattgtgaccgtctgtgttactattgtgggaacatacttcttgcttaatgctgaaaattatcactggcaatggacatcattcttctcagctgcatcaacagctgcctatgtgtatctttattcgatatactattaccacatgaagacaaagatgtctggatttttccagaccagtttctattttggctacactctgatgttctgccttggtttaggcatcctttgtggggctgttggttacttgggctctactttatttgtaagaagaatttatcggaatatcaagtgtgattgaggacaaatagatcggaaacaaaatgaatcatattttatgcctcatctattgcagggcctgttttaggcgcctgtttcttcccaggaaaaaggttcatagttccatatattcactgtttatccttgagccatttgttcaatgctattcctgggtgtagcatgcatactgaacattgtaagttagttcacttgtaggaaaatcacttcagtgactgcaagtcttgcatctctattcattcaaaatggcacaagtccacataacacacttttagaagggcatttttgatttgcaagatgactacttttgctttagaa

SEQ ID NO: 4046 - DNA, 2365 bp, Orobanche aegyptiaca
tacttctctttctccactccgctctgtaaatcagattccaaaatcttagattggatcaaatgatgacgacctaaacaccacagatcaaatcgaagtctcacgctgtcaaaaaatcgagagatctaaattaattcagcacgaaagaggattttccgattcgttccccaatccggcgactcattcttcattccgaccaacgacgcgatgctctccgccgtccgatcgtcgtgcatcttcatcttcttcttcctcacgttccttgtctcttcctccttcggcaagtatcaagcagatgaggcggtcactctctgggtgaacaaggttggcccgtataataacccccaagagacttacaattattacagcctcccgttttgccgcccacctggtaacactgctcacaagtggggtgggctcggtgaggttctcggagggaacgagctaattgatagcctgatccaaataaaattcaagagagatgtggagaagactaaaatttgtgaaatagaactcgatgcagcaaaagctaaacagtttaaggatgcaatcgagaattcatattggtttgaattttttatggatgatctaccgttgtggggttttgttggtgaggttcttcctgatagaaaccgtgacattaagcatgttctgtggacacacaagaatcttgtcattaactacaatgggaaccagattattcatgtcaatctcactcaagataaccctaagccacttgaagaagggagagtattggagatgacttactctgtcaaatgggttccaactaatactacgtttgcgcgccggtttgatgtttatctggattaccccttttttgaacaccagatccactggttttccgtctttaactctttcatgatggtaattttcctcactggtttggtgtctatgatattaatgcggactctccgcaacgactatgcaaaatatgcccgggaagatgatgatatcgagactctggaacgggatgtaagcgaagaatctggttggaaacttgtccacggtgatgtgtttcggcctccccaaaatctggctttactttcagcagttgtcggcactggcgcacagctagccacacttgttctactcgtcatcattttggcaattgttggaatgctatacatagggagaggagctattgtcactacctttatcgtgtgctatgctttcacctcatttattgctggttatgtgagcggtggcatgtattcccgcaatggcggtaagaaatggattaagtcaatgatcctcacggcatcactatttccattcttgtgctttggtattggcttcatcctaaacacagttgctatattttatggttctctggctgccattccctttggtactatgatggttgttcttgtcatatgggcctttatttccttcccgttggctcttcttggcaccgttgtcgggagaaactggagtggcatgccaaacaatccttgtcgagtaaagaccatccctcgtccaattcccgagaagaaatggtatctgacaccctccattatatctctcatgggtggacttcttcctttcggtagcatctttatcgaaatgtatttcgtcttcacctccttctggaattacaaggtttactatgtgtatggcttcatgcttctcgtgtttgtaatcctgatcattgtcaccgtgtgcgtgacgattgtgggggcgtatttcttgttgaatgccgagaactatcactggcaatggacttcattcttctccgcggcttcaactgctctatatgtgtacttctattctatatattactatcatgtcaagaccaagatgtcgggcttcttccaaaccagcttttatttcggatacactttgatgttctgtcttggtcttggaatactatgtggtgcggttggatatctgggctccaacttgtttgtgaggagaatttacaggaacatcaagtgtgactagttctagaatgtatacaagagttgtttggtttgattgtctcacatcatatatataagttaaatgccaaagggagacgggaaaaaggactccggtaaaactttgatctttttgtagcgatgaattcatgatgatgttacagttgggtagaggcttttgattgttaactagaagaaaaaagaactccattttgcatactcccattaaactttaaaatctctgtagcttgtaaaaatcgcttgccacttaggcgtttgtcactcggctcgttttccttaatgtagagactcacgatagtcgatttttcatggcatgtgagtgatgtcagaacacattcatgcttgaggaaggaataagatcgccctagtaatttacggctagtgacgtgtggtttaattagcttgctaca

SEQ ID NO: 4047 - DNA, 2422 bp, Arachis hypogaea
gtgtctgtgtttctctctccaagtcttctcccccaatctgagagattccgagatccgaaccctctctcactccctctccttccaccatgtccttcttccaatcccgatccattttcttcttcttcctctctctcttcctttcttcagcgtttgcttccgaatcagatcacaagtatcaacaagatgaacaggttaccctttgggtgaataaagttggtccttataacaatccacaagaaacatataattattacagcctcccattttgtcatccatctagtacttctgaagctgcacacaagtggggtggccttggtgaggtccttggtggcaatgaactcattgatagccaacttgagataaaattccagaaacatgtggaaaagactgtcttctgccagatagctctggatgaggcaaaggttaaacagttcaaggatgctatagagaataattactggtttgaattcttcatggatgaccttcctttgtggggatatgttggtgagctacatcctgacaaaaacagtgataatggcaagcatgttctctacacacacaagaatattatagtgaaatataacaaagatcagatcattcatgtcaatctcactcaggatataccaaaacctttggaagtagggagacatttggacatgacatatgctgttaaatggattcctactaatatcacctttggacgacgttttgatgtttacctggactatcctttctttgagcatcagatccattggttctccatttttaactcttttatgatggtcatcttccttactggattggtgtcaatgatattaatgcgaactctgagaaatgactatgccaaatatgctcgggaagatgatgatcttgaaactctggagagggatgttagtgaagaatctggctggaaacttgtgcatggtgatgtatttcgccctcctcgcggtttagttattctttccgctgttgttggcacaggtgcccagcttgcattgctggttcttcttgtcatcttattggctattgttgggatgttatatgttgggcgaggagcaattgtcacaaccttcattgtgtgttatgctctcacatcattcatttctggttacgtaagtgggggaatgtattctcggaatggggggaaaagctggattaaatcaatgattcttacagcttcactgttcccattcatgtgctttggaattggatttatcttaaacacaattgctatattctatgggtctctagctgccatcccatttggcacaatggtggtggtttttgttatttgggcttttatctctttccctctagcacttcttggtacagttgttggaaggaactggagtggtgttccaaataatccctgtcgtgtgaaaaccattcctcgccccattcctgagaagaagtggtacctcacaccatctgtggtttctatgatgggagggctgctaccctttggaagcatatttattgaaatgtatttcgtattcacttccttctggaattacaaggtttactatgtgtacggcttcatgctactggtttttctgattcttatgattgttactgtctgtgtgacaattgtgggtacatacttcttgttaaatgctgagaactatcactggcaatggacgtctttcttttcagctgcctcgacagctgtttatgtgtatttgtactcaatatactactactatgtgaagacaaagatgtcgggcttcttccagacgagcttctatttcggatacactttgatgttttctcttgggctaggaattctatgtggagctgtgggttttcttggttcaaatttgtttgtgaggaggatctacagaaacatcaagtgcgattaaggattttttctttgttcagacgcggagcacttctattaatttgttgttggagacaatgaacactttggagggggcctatggttatatgtggggaacctaacaacatttacaggtagaatcacagggttttgaggatgttgaggatgaattctttctgtattgggccctgagaatttttttccccggctgtaattgattgtctttataatttagatagatagtttaatatcaaactcttgtggctactatttcatccctttataagataggtgccaattgaagaacgagaactggtctttgattcccctacatggttaagtggttaactattcaatgtatgtaagagggggatgaagtctgaattttgtatgaagatctgaatatcattcctatctgcttccttcgcacaccccatatgtttacatttcagtttaatgcttccaagtttccaatgtatttgacccttttggctgtgtaaaatgtttttagtttgcccataatcgaattaacaaaaggcattctggatggaaatgtaggacactgcacagataatcttataatat

SEQ ID NO: 4048 - DNA, 2042 bp, Ambrosia trifida
cacacacaaatttatcttctgaatcacaatcaccggcgatcccgatgcgtcccaccgtcagatcctccaccgttgcagcactcatctccacccttcttctctttgcatcgccggtgtttgcttccgattatgatcacaagtatcaatcagatgaaaaagtcaccctttgggtgaataaagttgggccttacaataacccacaagaaacatacaatttctacagtcttccgttttgtcgtcaagatggtcatgctcaagctgcacacaagtggggcggtctgggtgaagtattaggtggaaatgagcttattgacagccaaatggatgtcaagtttcaaaagaatgtggataaaactactgtctgcgagctggaacttgatgattcaaaagccatgcagtttaaacaggctattgagaataactactggtttgaattattcatggacgatctgccactgtggggttttgtgggcgagctacactctgataagaacagtgacaacaaacatatgctattcacacatatgaatatcaccatacaatataacaaagaccagatcattcacgttaatctctctcaagaaaacccaaaacctttagaagttggtaaaacactggacatgacatattcagtaaagtggactgaaactaatgtcatgtttgctcgccgttttgatgtttacctagattaccatttttttgagcatcagattcattggttctcgatattcaattcatttatgatggttatctttctgactgggttggtctctatgatactgatgcggactcttagaaatgactacgctaaatatgcccgagaagatgatgatcttgaaactctggaaagagatgtcaatgaagaatctggttggaaacttgtccatggagatgttttccggccacctcgtaatttggttttgcttgtctgcagttgttgggactggtgcccaattggcactattgattcttcttgtcatcgtttttgcaattattggaatgctgtatgtaggacgaggatcaattgtaacaacgtttatagtttgctatgctctcacttcttttgtttctggctatgttagtggtgggatgtactcacgcaatggcgggaaaacttggataaagtcaatgatcctaaccgcgtcactttttccattttgtgctttggaatcggtttcattctcaacactattgcaatattctatggatctctagcagcaattccatttggcacaatggtggtcgtattcgtcatttgggcttttatttcttttcctcttgctcttcttggcacagttgttggaaggaactggagtggggccccaaacaacccgtgtcgggtgaagactattcctcgcccaattcctgtgaaaaagtggtatctcacaccatctgtagtttcactcatgggaggactgcttccttttggtagcattttcattgagatgtacttcgtcttcacttccttttggaattataaggtgtattatgtgtacgggtttatgctacttgtgtttctgattcttataatagtgactgtgtgtgtgacaattgtggggacatatttcttgctaaacgctgagaattattattggcaatggacttcattcttctctgcggcctctacagctatttacgtctacttgtattccatatattactactacgtcaagactaagatgtctggcttcttccaaaccagcttctactttggatatactgctatgttctgccttggattaggaattctatgcggagctgttggtcacctgggctcgaacctgtttgtcagaaggatctaccgaaacatcaagtgcgactaagtcacatccacaggaagaacaccgcccacagtgtacccgaccttggcagtaaacagcaaatcccgattggacgcttgcatcaggtatgtaaacccgaagggccgggcagtgattaagtagtagtagtatacctagctcctgagattgagggagtttgataagttttccttcttttcatggagtgtaagaaaaaagttagatgagaattttaaatgagag

SEQ ID NO: 4049 - DNA, 2073 bp, Cannabis sativa
tattgtataaagtagttcaacgtttttattgttgcatctaactccattcttatttcacttatatctgtcttggattcttttgcagtataaaaaagaggatgcagttacactttgggtaaataaagttggtccttacaacaacccacaagaaacgtacaactattatagccttcccttttgtcatccagctggaagttctgctgctcacaaatggggtggtcttggtgaggtcttgggaggaaatgaacttattgagagcgggtttgagataaagttccaacaaaatgtggagaagactgtcatttgtcaacttgaacttgatgaagcaaaggttaaacaattcaaggatgcaattgagaatagctattggtttgaattctttatggacgatctgccattatggggctttgttggtgagttgcatcctgataagaacagcgataatggcaagcatgttctgtacacacataagaatattaatgttcagtacaataaagatcagataattcacgtgaacctctctcaagagagtccaaagcctttggaagttggtcgaacactggacctgacatactctgtcaaatggactccaacgaatgtcacctttgcacgtcggtttgatgtgtatttggattaccccttttttgagcatcagatccattggttctcaatattcaattcattcatgatggtcatcttcctcactggattggtttcaatgatattaatgagaactttgaggaatgactacgcaaaatacgcacgagaagatgatgatcttgagactttggaaagagatgtaagcgaagagtctggctggaaacttgttcatggggatgttttccggcctcctaggaacttagtgattctttctgccgttgtaggaacaggtgcccagttagcattgcttgttctccttgtcatcttgttggcaattgttggaatgctatatgttgggagaggagcaattgttacaacgttcatagtatgctatgctcttacgtcattcatttctggttatgtaagtggtgggatgtactcgagacatggtggtaaaagctggataaagtcaatgattctgacagcatccctatttccatttatgtgctttgggattggatttatcttgaacacaattgccattttctacgggtctttagcagctatcccatttggcacaatggtggttgtctttgtcatttgggctttcatctcttttcctttggcacttcttggtacagttgttggaagaaattggagtggtgcccctaataatccttgtagagttaagaccattcctcgacctattcctgagaagaagtggtacttgacaccatctgtagtctcattgatgggaggacttctaccatttggcagcatatttattgagatgtacttcgtcttcacatcattctggaattacaaggtgtactatgtttatggttttatgctgctcgtttttctgattctcgttattgtcactgtttgtgtgacaattgtgggcacatatttcttgctgaatgctgagaactatcactggcaatggacttctttcttttcggctgcttcaacagccgtgtatgtgtacttgtattcaatctattactactacgtaaagacaaaaatgtctggcttcttccagaccagcttctattttggatacactatgatgttttgtctcggattgggaatcctctgcggtgctgttggctatctcggctcaaatttgtttgtgaggaggatctacagaaacatcaagtgtgattaagatttcttgaagaggaacagcctgatagagcttcctgaattgcattgttgataaaatacagttggagaggaacgattatcggtcttatatgaagaagccacagagtatcatcaggttgaaaggatggtgttatattaggatgaggatgtattcttctttctctggttttggggaagccttgagattttcctccttttttttgtttcatttttttttaacttcagttctttttccccggctgtaagtgaaagccttaatttagaattatgagattattctatactcttaagaaaattagcaaatta

SEQ ID NO: 4050 - DNA, 2253 bp, Zostera marina
cttattacaatttaatccatcgtcccgaccattatgcgcgattactataccgacttccgatcttagattcttactgatttgactctagttctgaagctacgcggccgtatcagtagatctcgccggacgagatgctccccaatgtcccatcgacgaccaccctcctctctctcttccttctcgttttatcagcttcggcaggggaatccgaccacaagtatcaaccagaagatttagttgtgctctgggtgaataaagttggtccatataataatccccaagaaacctacaactatcacagccttccatttttgtcagccacaagagaatcctgttcatagatggggtggtcttggggaggttttgggtggaaatgaactcattgacagtcagatcgaaataaaatatcagaaacccgttgataaggttaccatctgttcgattgaccttgatgaaacaaaggtgacacagttcaaaaatgcaattgatagctcgtattggtttgaattatttatggatgatctgccactttggggctttgttggagaggctcgaactgataaaagcaatgaaaataacattttctttcactcataaagatatcattattaaatataacggttttcagataattcatgtaaatctcacacaagatggcgcaaagcttttagaagttggaaagacattagacatgacttacagtgttaaatggataaagacaaacatagaatttgcacgtcgttttgatgtttatttagattatccattctttgaacaccagattcattggttttccatcttcaattcctttatgatggttattttcctcactggtctggtgtcaatgattctgatgagaactcttagaaatgattatgcaaagtatgcccgtgaggatgacgaccttgaaactctggaaagagacgtgagtgaggaatcggggtggaagcttgtccatggagatgtcttccgacctcctctaaatttgatcgtcctatcagctgtggtcggcacaggtgctcagtttgccatgcttgttcttatggtcattttattggcaatcattgggatgctttacattgggcgtggatcaattgtcacaaccttcattgtttgctatgctcttacttcatccatatctggatatgtgagtggtggaatgtactcaaggaatggtggtaaaaactggattaagtccatgatcttctcagcatctcttttcccattcatgtgctttggaataggcttcattctaaacaccattgctattttctatggatcactggctgctatcccatttggaacaatgatggttgtttttataatttggggattcatatcattaccccttgcttttcttggcactcttgttgggagaaattggagtggttatccaaatattccttgtcgtgtgaagacaattcctcgtctgatccccgaaaagaaatggtacctgacgccatctgtaatctccttgatgggaggtctccttccctttggcagcatattcattgagatgtactttgtcttcacatccttttggaattacaaggtgtactatgtttatggttttatgctgctggtttttatcatccttataattgtaaccgtctgtgtcaccattgtgggcacatatttcttgctgaatgctgagaactaccattggcaatggacctcatttttctctgctgcttcaaccgcgggatatgtttatctgtattctatatattactaccattcgaagactaagatgtctggatttttccagactagtttttactttggctacaccctgatgttctgcttgggcttgggtatcctctgcggtgctgtgggatatctagggtctacaatgtttgtgaggagaatctacagaaacataaagtgtgactagtaagaagagttcggctagcaatgtaaaattaaattaaatgttgggaaacattacataaatttttccatatgatagtgtttgtactataaatatttacccttttattgtgagacgatgactacaatacagtcattgccaagttagcatttagcatctacttattgggatcaggaagcctgatgatgaacaagaacatactattctgttatatagtaacaaaaatatccaggtgcgatttacttcaaacgatcgagaatttttacatttaattattatttttctattatgtatttcgacaatgaataataaatacattttttggttttaagagattaccaaacttttgaggttggttatcc

SEQ ID NO: 4051 - DNA, 2598 bp, Pinus taeda
atgaatttcttctgccattgggagcacacagtgaaactctctgcataggagggaatacgagatccaggcgtcccataacccgaccgggctagatctaaatctattgtgaacaagatggggtataaggaaggcgtctggttctgctggatgctctacttgatcgcggccttgggtacagtgtttgcatcagagtatgatcataagtatcgagcaagtgatcctgttactttatgggtgaacaaagttggcccttacaataatcctcaagaaacgtataactactatagtcttccgttctgccaaccagctaaaaatccctcgcataagtggggtgggcttggtgaggttctgggaggaaatgagctcatagacagccaagttgacatcaaatttggaaaaaatgttgaaaaaagtccaatatgcacaattgagcttgatgctaccaaagtgaaacaatttaaggaagctattgaaaacgcctactggtttgaattcttcatggatgatctacctctctgggggtttgttggcgaaattcatctagacaagagtgatgatcagaagcatttgctatacacacacaagaatattattgtgaaaatcaataatgaccaaataattcatgtcaacctcactcaggagaatccaaagccgcttattgctgggaagacactagaacttacctattcagtccattgggttgagaccaacataacctttgccaggcgttttgatgtctacttagactatcctttctttgaacatcagatccattggttctccatcttcaattcatttatgatggttatttttctcacgggtttagtctcaatgatcctgatgcggactctgagaaatgactatgcaaagtatgctcgcgaagaagatgatttggaaagtctggagagggatgttagtgaagagtcagggtggaaacttgttcatggagatgttttccgaacaccacgaaacttggtcttgctgtcagcattagtgggcacgggtgcacaacttgctatgcttgtgcttcttgttatcttgctggcaattgttggcatgctatatattgggcgtggggcaattgtcaccactttcattgtctgctatgcccttacctcatttatatctggctatgtgagtggaggactgtattcacgtaatgatggcaagcactggataaagtcaatggttcttacggcatctctcttcccatttatgtgctttggcattggatttgtactgaacatcattgccatattctacggttctctggctgccattccttttggcactatggtggttgtctttgtaatctgggcatttatttctttccctctagcactccttggaacggttgttggaaggaattggagcggggctccaaataatccttgccgtgtgaagaccattcctcgcccaattccagaaaagaagtggtatctgacaccaacagtggtgtcactgatgggtggtctgcttccctttgggagtattttcattgaaatgtattttgttttcacctcattttggaactacaaggtatattatgtttacggcttcatgttgctggtgtttttgattctcgttattgtgaccgtctgtgttacaatcgttggaacatacttcttgcttaatgctgaaaattatcactggcaatggacatcattcttctcagccgcatcaacagctgcttatgtgtatctttattctatatactattaccacatgaagacaaagatgtctggatttttccagaccagtttctattttggctacactctaatgttctgccttggtttaggcatcctttgtggggctgttggttacctgggctctacattgtttgtaagaagaatttatcggaatatcaagtgtgattgagaagtagattggaaacaaaatgaaatatatttatgccagagctattgcagggcttgtttaaggcacatgtttcttcccagggaaaaaggattatagttccatagattcactctttatccttgagccatttgttcaatgctattcctgggtgtggcatgcattttgtattactgaacattgtaagttagttcagttgtagcaaaatcacttacagtgactgcaagtcttgcatctctattcattcaaagcagtacaagtacgagtccacaaaaaacacttataggagggcatttttgatttgcaagatgactacttcagcctgcagatgttgttcattgggagggatggcttttagaaccgggtccttatctagtagagagtggcagagtgtagctattttcaagttccaacaccttttaagagttcggaattaatttttatgcagttcacttagatagagtcattctgctttagtacctttttagtgggcttttgcagattcattactgtcgtgcttttatgactgaaattaacagttgaagatggctagtggtttcaggatataacttcttcaaaaatattcatccaatctttcagaaacattactgctttccttagttcatgtttacttcattctaatttcttgtttggcttttcccttcttcaccttgtgcaaaattcctttaattttgaattatatattttcttttattgacc

SEQ ID NO: 4052 - DNA, 2207 bp, Pseudotsuga menziesii
caagagtctctgcgtcagaggcaagacgagatccagccttccggtaacctgtctcggtcagatctgattatactgttaacaagatggggcataaggaatgtgtctggttatgcttggctctctacatggtcgcggcattgggggcagtgtttgcatcagaatacgatcataagtatcgagcaaatgaccctgtcaccttatgggtgaacaaagttggcccttacaataatcctcaagaaacgtataactactatagtcttccgttctgccattcaggtaaaaaccctacacataagtggggtgggcttggtgaagttctgggtggaaatgagctcatagatagccaaactgaaatcaaatttggaaaaactgttgagaaaaattcaatatgcacaattgagcttgatgctaccaaagtgaaacaattcaaggaagctattgaaaacgcttactggtttgaattcttcatggatgatctacctctttgggggtttgttggtgaatttcatccagacaagagtgatgatcagaagcatttgctatacacacacaaggatattattgtgaaaaccaataatgaccaaataattcatgtcaacctctctcaggagaatccaaagccacttgttactgggaagacactagaacttacttattcagtcaattgggttgccaccaatgtaacctttgccaggcgctttgatatctacttagattatcctttctttgaacatcagatccattggttctccatcttcaattcatttatgatggtcatttttctcacgggtttagtctcaatgatcctgatgcggactctgagaaatgactatgcaaagtatgcacgagaagaagatgatttggaaagcctggagagggatgttagtgaagagtcgggttggaagcttgttcatggtgatgtcttccgaactccacgaaacttggtcttgctgtcagcattagtgggcaccggtgcacaacttgcgatgcttgtgcttcttgtgatcttgctggcaattgttggcatgttatatatcgggcgtggggctattgtcacaacttttattgtgtgctatgcccttacctcatttatatctggctatgtgagtggaggattgtattcacgtaatgacggcaagcactggataaagtcaatggttcttacggcatctcttttcccatttatgtgctttggcattggatttgtactgaacatcattgccatattctatggttctctggctgctattccttttggcactatggtggttgtctttataatatgggcatttatttctttccctttagcactccttggaacagttgttggaaggaattggagtggggctccaaataatccttgccgcgtgaagaccattcctcgcccaattccagaaaagaaatggtatctgacaccaacagtagtgtcactgatgggtggtctgcttccctttgggagtattttcattgaaatgtattttgttttcacgtcattttggaactataaggtatattatgtatacggcttcatgttgctggtatttttgattcttgttatagtgaccatctgtgttactattgttggtacatactttttgcttaatgctgaaaactatcactggcaatggacatcattcttctcagctgcatcaacggctgcctatgtgtatctttattccatatactattaccacatgaagacaaagatgtctggattcttccagaccagtttctattttggctacactctaatgttttgccttgggttgggcatcctttgtggggctgttggttacttgggctctacattgtttgtaagaagaatttatcggaatatcaagtgtgattgaggacaagcagatcagaaactaaatgaaccatatttgatgcgtgagctattgcagggcctgttttaggtgcctgtttcttcccagggaaaaggattatagttccatatattcactctttatgcatgagcatttggtcaatgctattcctggttggagcatgcattttgtattactgaacattgtaagtagttcacttgtaggaaaatcacttcagtgactgcaagtcttgcatttctattcattcaaaatggtacaagtccatacaacatacttttagaagggcatttttgatttgcaagatgattacttctgcctgcagatgttattcattgggagaatggctttttaaaccgggtc

SEQ ID NO: 4053 - DNA, 2204 bp, Trigonella foenum-graecum
ctctctcgctcgtttcgtttctctctcgtcgaggttagagatccaccaccaccatgttcttcagattctcgctcctcctgcttctcctcctctctccggccttcgcttccgagtcagatcacaagtaccaaccagatgacccagttaccctttgggtcaacaaagtaggtccgtacaataatcctcaagaaacgtataattactacagcctgccgttttgccgtccacctggtaatgctgcacacaaatggggtggtctaggtgaggtccttgggggcaatgaacttattgatagccaaattgagatcaagttcctagttaatgtggaaaggaccactttttgccgtttgaatcttgatgaggcaaaggttaaacagttcaaggatgcaatagaaaataattactggtttgaattcttcatggatgatcttccgttgtgggggtatgttggcgagctacatcctgataagaacagtgatagtggcaagcatgtcctttacacacacaagaacatcattgttaagtacaataaagatcagatcattcatgtgaatctcactcatgatgaccccaaacctttggaagcaggaagatctttggacatgacatattctgttaaatggatttccactaatgtcacttttagacaccggtttgatgtctatctggactatccattctttgagcatcagattcattggttctctatttttaactcttttatgatggtcatattcctaactggattggtgtctatgatattgatgcgaactttgagaaatgactatgcaaagtatgctcgggaagatgatgatttggaaactctggaaagagacgttagtgaagaatctggctggaaacttgtgcatggtgatgttttccggcctcctcgcagtttggctcttctttcagctgttgttggtacgggtgctcagcttgcgttgttgattcttcttgtcatcttgttagctattgttgggatgttgtatgtcggacgaggagccattgtcacgacattcattgtttgttatgctctcacgtcagtcatttctggttatgtaagtggggggatgtactcacgtaatgggggtaaaagttggattaaatccatgatccttacagcgtcactgttcccattcctgtgctttggaattggatttatgttaaacactgtggctatattctatggatctctagcagcaatcccctttggtacaatggtggttgtctttgttatttgggctttcatctctttccctctagcacttcttggcacagttgttggaaggaactggagtggtgctccaaataatccctgtcgcgttaagaccattcctcgtcccattcctgagaagaagtggtacctcacaccctctgtagtttctctgatgggtggactgcttccttttggcagcatattcattgagatgtattttgtatttacttccttctggaattacaaggtgtattatgtctatggcttcatgctactggtttttctgattctcatcgttgttaccgtatgtgtgacaattgtggggacatactttttgttaaatgctgagaactacaactggcaatggacttcttttctttcagctgcctcaacaggtgtttatgtatatttctactcaatatactactactatatgaagacaaagatgtcaggcttcttccaaactagcttctattttggatacactatgatgttttgtcttggactgggaattctatgtggagctgtgggtcatcttggttcgaatttgtttgtgaggaggatctaccggaatatcaagtgtgactaaggcttggaggaagcctctggtcatgtgtggtgtccaagcaaatgtttatagggtagtatgacggggttttgaggatgggaatgtattctttctctatattagggaaaccctgagatttttttccctggctgtaattgaaagctttgatttagaatgcagggattgttttttattataattcataatttagatagtagctagcaaaatatcagactcttatggtttcttttaagtccttttattacaaaataggtgcccgattgacgaactgatgtctgattcccatacgcggtttatctattgtacgtagaggggatgaagtctcggatatgaattttgtatcaactcggttctgagtacttcctccacattccttcatgttttaattttaattttaat

SEQ ID NO: 4054 - DNA, 1777 bp, Amborella trichopoda
gtgggagcggcgctcctccaacatctacaacgtcagatccgcccctcgccatatcccgcaatgctccccaccttccgatcccgctccttcttctctgacctcttcctcttcttcctgttcatcaccccatccattgcttcagaatcagatcacaagtatcaagaagatgagcctgttatgctctgggtgaacaaggtgggaccttataacaatcctcaggagacatataattattacagccttccattttgccaaccagctggtaatcctgctcataagtggggaggtcttggtgaggttcttggtggaaatgagctcattgacagtcaaatagaaataaagtttaaaagaaatgttgacaagcgctccatttgtgagcttgagctggatgatgcgaaggcaaagctgttcaaggatgcaattgagaacgcttactggtttgaattctttatggatgatttacttctccggggctatgttggtgatattcgttctgacaaagtcaatgacaataagcatgttcttttcacacataaaaatattgttgtcgaatacaatggagatcagattattcatgtaaatcttacccaagaaaatcctaaaactcttgaggctgggaagtcattggaccttacttattctgtcaaatggatttctacaaatgtaacatttgcacggaggtttgatgtttacttggactaccctttctttgagcaccagatccattggttctccattttcaattcctttatgatggttattttcctcactgggttggtgtcaatgatattgatgcgaactctcagaaatgactatgccaaatatgctagagaagatgacgatctggagactctggaaagagatgtaagtgaggagtcgggctggaaacttgtacacggtgatgttttccgtcccccacgcaacttggttatactatcagcagttgttgggacaggtgcacagctagcaatgcttgttcttctggtgatcttgctggccatagttggaatgctgtacataggacgcggagcaattgtgacaacttttattgtatgttacgccctcacttcattcatttcgggccatgtaagtggaggactctattcacgcaatggaggtaaaaattggataaagtcgatgatccttactgcctcacttttcccatttatgtgctttggcatcggcttcatactaaacacaattgctatattttatggatctttggctgctatcccctttggaacaatggttgttgtattcataatctgggcctttatttcattccctctcgcacttcttggcacggtggttggaaggaactggagtggagctcctaacaacccttgtcgggtcaagaccattcctcgccccattccggagaagaagtggtatctcaccccatctgttgtgtcactgatgggtggcctccttccttttggcagcatattcatcgagatgtattttgtgtttacatcattctggaactataaggtttactatgtctatggttttatgcttctcgtcttcctaattctcataatcgtcacggtgtgtgtgacaattgtgggaacatattcttgctgaatgccgagaactaccactggcaatggacctcatttttctctgctgcatcaacagctgtctatgtatacctgtactccatttactactactatgtgaagaccaagatgtcggggttctttcagaccggtttctattttggctacactctgatgttttgccttggtttaggcattctatgtggtgctgttggtta

SEQ ID NO: 4055 - DNA, 1769 bp, Ambrosia trifida
aatcatagttagatccaaacccaatcacctgcaaccatcatgtgggccgccgtcctcttctctgctttctttctccttatctcttcacctgtctttgcttctgagtatgatcacaagtatcaaacagatgaagcaattaacctttgggtgaataaggttgggccgtacaataacccacaggaaacatataactactacagcctccgttttgtcgtaacctggtaaccctgggcataagtggggtggcctgggtgaagtattgggcggaaatgaacttattgatagtcaatatgacatcaagtttcaaaagaatgtggagaaggctacaatttgtaagcttgaacttgatgaatcgaaggttaagcagtttaaagaggccatcgagaataactactggtttgaatttttcatggatgatctgccattctggggttttgttggggagctacatactgataagaacagcgataccaagcatatgctattcacccataagaatattactatacactacaacaaagatcagatcattcatgttaatcttactcaagagaacccgaaaccactggaagctgggaaaacactagacatgacttactcggtcacgtggaccgaaactaatatcacttttgcacgccgttttgatgtttacttggattaccatttttttgagcatcagatacattggttttctatctttaactcctttatgatggttatcttcctcaccgggttggtttcaatgattttgatgcggacacttagaaatgattatgccaagtatgcgcgggaagatgatgatctggacagtctggaaagagatgtaagtgaagaatccggttggaagcttgtgcacggggatgtcttccgatcacctcgtagtttggctttattgtcggcagtggttggaacgggtgctcagttggctctgctgattcttcttgttattttgtttgcaatcgttgcaacattgtacattgggagaggagcaattgtcactacattcatcgtctgctatgccttgacatcatttgtctctgggtatgtgagtggtgggatgtattcacgccatggtgggaaaaactggataaagtcgatgatcctgaccgcatcccttttcccatttttgtgcttcggaatcggctttgttctgaacacgattgccatcttttacgggtctttagcagcaattccatttggaacaatggtgattgtttttgtcatatgggctttcatctctttcccgcttgctcttctcggtacagttgttggaaggaactggagtggtgccccaaacaacccttgtcgtgtgaagaccatccctcgccctattcctgacaagaagtggtatctcacaccgtctgtagtctccataatgggaggattgttaccttttggcagtattttcatcgaaatgtactttgttttcacatccttttggaattacaaggtgtactatgtttatgggttcatgctacttgtttttctgattctcatcatcgtgaccgtgtgcgtgacgattgtgggaacatatttcctgctaaatgctgagaattaccactggcaatggacttccttcttctctgcagcctctactgctatttacgtctacttgtattcaatatattactaccatgtgaagaccaagatgtcaggctttttccaaaccagcttctacttcggatacaccgccatgttctgctttggtttaggaattctctgtggcgctgtcgggtatttgggctctaatctctttgtcagacggattt

SEQ ID NO: 4056 - DNA, 2169 bp, Euphorbia peplus
atttcttcgacctctaattgactgacacctgtactattagatcgccggcgatcgccatgtcctcctccgccaccgccgtccgattcctcttcctccctatcttcgtttcatttctccttctttcccccgtgctttcctccgagtcggatcacaagtatctagcagatgactcggtaactctgtgggtgaataaagttggcccttacaataatcctcaagaaacgtacaactactacagccttccattttgccatccagcgggtagcgcagcacataaatggggtggccttggtgaggttctgggaggaaacgaacttattgatagcaagattcacataaagtaccagaaaaatgtggaaaaagctgtcatttgttcacttgagcttgatgaatcaaaagtcaagcagttcaaggatgcaattgagaacaactattggtttgagtttttcatggatgacctgccactgtggggctttgtgggtgaattgcatcctgacaaaaacagtgataatggaaaacatgtcctttacacgcataagactgtcactgtcagatataacaaagatcagattattcatgtcaaccttacacaagataatccaaagcccttggaagctgggagaatattagacatgacatattctgtcaaatggattccaactaatattagctttgcacgtcgttttgatgtgtatttggactaccctttctttgaacaccagatccactggttctccattttcaattccttcatgatggttatctttctcactggtttggtgtcgatgatattgatgcgaactctgagaaatgactatgccaagtatgcacgggaagatgatgatctcgagtctctggaaagagatgttagtgaggaatctggttggaaacttgttcatggggatgttttccgaccaccacgcaatttagtggttctttcagctgttgttgggacaggtgctcagctagcgttactggtgcttcttgtcatcttgatggcaattgttggaacactatatgttgggaggggagcaattgtcacaactttcattatatgctatgctctcacatcatttgttgctggttatgttagtggagggatgtattctcggcatggtggtaaaagttggataaaatcaatgatcctcacagcatctctgtttccatttatgtgctttgggattgggttcatcttgaacactattgctatattctatggatcattagctgccattccctttggcaccatggtggtggtttttgtcatttgggctttcatttctttccctctggccctacttggcacagttgttggaaggaattggagtggtgctccaaataatccatgccgtgtgaagactattcctcgtccaattcctgagaagaagtggtacctcacaccttctgtggtctcgttgatggggggattactacccttcggtagcatattcattgagatgtattttgtcttcacatccttctggaattacaaggtctactacgtctatggctttatgcttctcgttttccttatactcgttatcgtcacagtttgcgtgacaattgtggggacatatttcttgcttaatgctgagaattatcactggcaatggacatcatttttttctgctgcctcaactgcagtttatgtctacttgtactcgatatattactactacgtgaaaactaagatgtcaggcttcttccaaacaagtttttattttggatacacattgatgttctgtctgggcttgggaattctctgtggagctgtgggttacttggggtcaaacttatttgtgaggaggatttacagaaacatcaagtgtgactaaaacataagagaggagagacctgggagcttctgtgtgcaacattcttcttaaggaaataaactttagaggaagcctctggtcatgttaggggacagggcagggcagcgccagaccagccatgctaacagtaaatcaatatggttgaggacggaccgtattcttctttctctggacttggggaaggccctgagattgtttttggttttatttttccccggatgtaagtgaaacccttaatttagaattcagagattgttcttataaatcatgttaagatagccaaaattatatcaactgttcgcctccttatactcgttatcgtcacagtttgcgt

SEQ ID NO: 4057 - DNA, 2305 bp, Eutrema parvulum
atctctggtcgctctttcgatcgctcgcgtccgaggaaaataattgaagtagctgataaaattgtaacatcatatacatacactgatacatatatatatatgctacctgaatcgcatctccgagacgagtcattggtctaacatttctccagcaccgtctttgtctcccgtcagatctgccggattccgatatgccgtcttcctccgccgtcaaatctctcttctccgtgtattccgccgtcgcatgcgtcttccttcttctctctccggctttggccaccgagtcagatcacaagtatcaaggtgatgagcaggttactctgtgggtgaacaaagttggcccatataataatccacaagaaacatataactattatagcctcccgttttgccgcaaaaccgaaaacagcattcacaaatggggtggtcttggtgaggttcttggtggaaatgagctcatcgacagccagatagatataaagttcttgaaaaatgttgacagaagcgtgatctgtcaattggaacttgatgaagctaaggtcaagcatttcaaagatgccatcgaaaatagttactggtttgaattatttatggatgatctgcctttgtggggctttgtgggcgagctgcctcctggaaaaaatagtgaaaacggcaagcatgttctttacactcataagaatattattatcaaatacaacaaagaccagattattcatgtgaatctcacacaagacaacccgaggccgttagaagcagggagaacggtggacttgacatattctgtgaattggatcccaaccaatgtcacatttgctcgtcgttttgatgtttatctagattatccattcttcgaacaccagatccattggttctccatctttaactcgttcatgatggttatcttcctcactggtttggtctcaatgatattaatgaggactctcagaaatgattatgcaaagtatgctcgggaagacgacgatctggagagcttggaacgggatgtaagtgaagaatctggatggaaactcgtgcacggagatgtgttccggtcaccacgtagttttgttcttctctcggctgttgtcggtacaggtgcacagttagctttgcttgttcttcttgtcatattaatggcaatcattgggacactttatgttgggagaggagcgattgtcacaacttttattgtttgctatgctctgacgtcatttatctctggttatgtgagcggtggaatgtactcaagaagtgggggtaaacattggatcaagtgcatgatcctcacggcttctctcttcccattcttgtgctttgggattggattcctcctaaacacggttgccatattctatggatctcttgcggctattccctttggaacaatggtggttgtgtttgtaatttggggtttcatttcgttccctctcgccctcctcgggacagtagttggtagaaactggagtggtgccccaaacaatccatgccgagtgaagacaatcccacgtccaatccctgagaaaaaatggtacctaactccatcagtagtctctcttatgggaggtctcttaccctttggtagcatcttcattgaaatgtacttcgtcttcacatccttctggaattacaaggtatactatgtgtatgggttcatgcttctagtctttttgattcttgttgtcgtaaccgtctgtgtgacgatcgtgggaacatatttcttgctgaacgccgaaaactatcactggcaatggacatcgttcttctcagctgcttcgactgcggtttatgtctacttatactcaatctattactactacgtaaagaccaagatgtttggttttttccaaaccagcttctacttcggatacaccttgatgttctgtctcggcctcggaatcctttgcggagctgttgggttcttaggatcaaatctatttgttagaaggatctacagaaacatcaagtgcgactagagagagttactaaaccaaaatcaaaacgcgataaaaaatggttggtggaatgttcttggaggcagttaagtctgttagaaagaaagcttcttacaggtttagtttataaacaagcgaaagtggggaatgtagtggaggagaagcttgtatcgttatataaaattccaacttatattataattcttcttgatctcgttttttttttgctaggagagtttttattttttttaatatttctttcttctcttttttgttttttgtttaatcctcctttttggtaaagtggaatctgctctattttaatttaggattcggagatattgttggtt

SEQ ID NO: 4058 - DNA, 1980 bp, Triphysaria pusilla
gccatttatagtgagattgaatcgaatgcagatttctcaggggagctaaagaagaaatcccctatttttttctttttgcaggtcaaatttcaatcggttgagcttttttcgagtcagatcggatcaatcctagaggcgatgtggcccgtcttcagattcttcatcatctgcatttgcatctcctcgttcctcgtatcttccactgtaggcaagtatgaagacggtgaggccgtcactctatgggtaaacaaggtcggcccatataacaatccccaggagacctacaactattacagcctcccgttttgccacgcacctggcaacctagcgcataagtggggtgggcttggtgaggttcttggagggaatgagcttattgatagccagatcgaaataaaatataagagagatgtggaaaagacttcagtctgtgaaattgaacttgaagcagcaaaggttaaacagtttaaagatgcaattgaccattcatactggtttgagttttttatggatgatttgccgttgtggggttttattggtgaggtggttcctgatagatcccatgatactaagcatgtactttggacacacaagaatcttgtcattaactacaacgggaaccaaattatccatgtaaatcttactcaagaaaaccctaagcctcttgaggaagggcgagtgttggatatgacttactctgtcaaatgggttccaactaatataacgtttgcacgccgtttcgatgtttatctggactaccccttttttgagcaccagattcactggttctcagtctttaattctttcatgatggtaattttccttactggtttggtgtctatgatactaatgcgcaccctccgcaacgactatgctaaatatgctcgtgaagatgatgatctggagactctggaacgggatgtgagtgaagaatctggttggaaacttgtccatggtgatgtgtttcgaccttctcaatatctcgctctacattcagctgttgttggcactggtgctcaactagctacacttgttctgcttgtcatcattttcgcaattgttggaatgttgtacatagggagaggagcaattgtcacaaccttcatcgtgtgttacgcttttacatcatttatcgctggttatgtgagtggtggcatgtattcgcgccatgggggtaaaacatggataaagtccatgatcctcactgcatcttttttcccattcatttgcttcggtattggcttcatcttaaacacaattgccatattttatggttctcttgctgccataccttttggtacgatggtggttgtttttgtcatatgggcttttatttctttccctctggcgcttcttggcactgtggtgggaagaaactggagtggtgctcctaacaatccttgccgtgtgaaaacaatccctcgtccgattccagagaagaagtggtatctcacaccttctgttatttccctcatgggaggtttacttcctttcgggagcatttttattgaaatgtatttcgtcttcacgtccttctggaattacaaggtttactatgtgtatggcttcatgctactcgtgtttgtgatcctaatcatcgtcaccgtctgtgtgacaattgtcggcacatatttcttgctgaacgctgagaattatcattggcaatggacttcattcttctctgctgcctcaacttctctttacgtgtacctctattctatttattactattatgtgaagacaaagatgtccggctttttccagaccagcttttattttggatacactgcgatgttctgtcttggtttgggaatactatgtggtgctgttggatatctgggctcaaacttgtttgtgaggagaatttacagaaacataaagtgtgactgagttgtgaaaatacagagtgctttagtttcgtttttccattataagttagttccgatcaggagaaatggaaaaaagaaagctctgaaaagc

SEQ ID NO: 4059 - DNA, 2387 bp, Orobanche aegyptiaca
ttaaacccaacatttgcaattttcccctctggaaaaatactcatcagatcgaaattgatcggatgcagacataaactgaggcgttaggagagattgatttctctttgagatctgaatcgccgtcaaaagaatcaggggagctaaaggagaaacccccattttatatctcgtcaaatttcaatccgttgaatttttctcgatccagatcggaaggatcttacacggaggcgatgtgctccgtcttcagatttgtctgcattttcttccttttgttcatcgtcccctccgctctaggcaagtatcaagctggtgagactgtaactctatgggtaaacaaggtcggcccgtataataatccccaggaaacctacaactattacagcctcccgttttgccgtccacctggcaacccatctcataagtggggtgggcttggagaggttctcggagggaatgagcttattgatagccagatcggaataaagtttaaaggaaatgtggagaagactccaatctgtgaaattgaactggaagcagcaaaggttaaacagttcaaagatgcaattgacaattcatattggttcgaattttttatggatgacttgccactgtggggttttattggtgaggtggttcctgatagagcccatgatactaagcacgtgctttggacacacaagaatcttgttattaattacaacgggaatcaaattattcatgtaaatcttactcaagaaaaccctaagccacttgaggaggggcgcgtgttggatatgacttactcagtcaaatgggttccaactaacattacatttgcacgtcgttttgatgtttatctggattatcccttttttgagcaccagattcactggttctctgtctttaattcgttcatgatggtaattttccttactggtttggtgtctatgatactgatgcgcactctccgtaatgactatgccaaatatgctcgagaagatgatgatctggagtctctggaacgggatgtgagtgaagaatcaggttggaaacttgtccatggtgatgtgtttcggccttcacaaaatcttggtttactttcagctgttgttggcactggtgctcagctagcaacacttgttctgcttgtcatcattttcgcaattgttggaatgttgtacatagggagaggagcaattgtcacaacttttatcgtatgttatgcttttacatcatttattgctggttacgtgagtggtgggatgtattcgcgcaatgggggtaaaacatggataaagtcaatgatcctcacggcatcgcttttccctttcatttgttttggtattggctttgtcttaaacacagttgcaatattttacgggtctcttgctgccatacctttcggtacgatggtggttgttttggtcatatgggcttttatttctttcccgttggcgcttcttggcactgttgttggaagaaactggagtggtgctcctaacaatccttgccgtgttaaaaccatccctcgcccaattcccgagaagaagtggtatctcacaccttctattatctctctcatggggggtcttcttccttttgggagcatttttattgaaatgtatttcgtctttacgtccttctggaattacaaggtttattatgtgtatggattcatgctactcgtgtttgtgattttgatcatcgtcacggtttgcgtgacaattgttggcacatatttcttgctgaatgcggagaactatcactggcaatggacttcattcttctctgctgcctccaccgctctttacgtgtacctctattctatatattactatcatgtgaagacgaagatgtcgggcttttttcagactagcttttactttggatacactttgatgttctgtcttggtctgggaatactatgtggggctgttggatatctcggctccaacttgtttgtcaggcgaatttacagaaacatcaagtgcgattgagttgagttgtaagaatacacggtactgtaggttcattctttaatggtaagttaatgtcgcttgccgttgtggagagactcttgaaacactagcgaacggaactttctgcagcgaagagatgcgagaggatgtaatgaaaagcttggttcaagtcttcagagttgagaccataaactacgttactaaaatgtttcctgcgaaatgttttgtagcttgtaaattttggcttcataggcttttgttgcttcaatttgtctattttatataaactcctgcagtagattcgcgtttgatattgtgaaccagtcattttgagaacaaatgagatactcatattgagatcgagatgattaaacattataaatttgcagttcgaatcctactcttgctcaatgaaggggaaagttgccc

SEQ ID NO: 4060 - DNA, 1858 bp, Ambrosia trifida
cagcactcatcgccacccttcttttccttgcatcgccggtgtttgcttccgattatgatcacaagtaccaatcagatgaaaaagtcaccctttgggtgaataaagtcgggccttacaataacccacaagaaacatacaatttctacagtcttccgttttgtcgtcaagatggtcatgctcaagctgcacacaaatggggcggtctgggtgaagtattaggtggaaatgagcttattgacagccaaatggatgtgaagtttcaaaagaatgtggataaaactagtgtctgcgagctggaacttgatgattcaaaagccatgcagtttaaacaggctattgagaataactactggtttgagttatttatggatgatctgccactgtggggttttgtgggcgagctacactctgataagaacagtgataacaagcatacgctattcacacatatgaacatcaccatacaatacaacaaagaccagatcattcatgttaatctctctcaagaaaacccaaaacctttagaagttggtaaaacactcgacatgacatattcagtaaagtggactgaaactaatgtcccgtttgctcgccgtttcgatgtttacctggattaccatttctttgagcatcagattcattggttctcgatattcaattcatttatgatggttatctttctgactgggttggtctcgatgatactgatgcgcactcttagaaatgactatgccaaatatgcaagagaagatgatgatttagaaactctggaaagagatgtcaatgaagaatctggttggaaacttgttcatggagatgttttccggccacctcgtaatttggttttgttgtctgctgttgttgggacaggtgcccaattggcactattgattcttcttgtcatcgtgtttgcaattattggaatgctgtatgtaggacgaggatcaattgtaacaacatttatagtttgctatgctctcacttcttttgtttctggctatgtgagtggtgggatgtactcacgcaacggcgggaaaacttggataaagtcgatgatcctaaccgcatcactttttccatttttgtgctttggaatcggtttcattctcaacactattgcaatattctatggatctctagcagcaattccatttggcacaatggtggtcgtattcgtcatttgggcttttatttcttttcctcttgctcttcttggcacagttgttggaaggaactggagtggggccccaaacaacccgtgtcgtgtgaagactattcctcgcccaattcctgtgaaaaagtggtatctcacaccatctgtagtttcactcatgggaggacttcttccttttggtagcattttcattgagatgtacttcgtcttcacttccttttggaattataaggtgtattatgtgtacgggtttatgctacttgtgtttctgattcttataatagtgactgtgtgtgtgacaattgtggggacatatttcttgctaaacgctgagaattattattggcaatggacttcattcttctctgcggcctctacagccatttacgtctacttgtattccatatattactactacgtcaagactaagatgtctggcttcttccaaaccagcttctactttggatatactgctatgttctgccttggattaggaattctatgcggagctgttggtcacctgggctcgaacctgtttgtcagaaggatctaccggaacatcaagtgcgactaagtcacatctacaggaagaacaccgcccacagtgtacccgaccttgggagtaaacagcaaatcccgattggaagctttgcatcaggtatgtaaacccgaagggccgggcag

SEQ ID NO: 4061 - DNA, 2115 bp, Trigonella foenum-graecum
ctctcttcatttcttcatccttcgcttctgactcagatcacaagtatcaacgagatgacccagttaatctttgggtgaacaaagttggtccctataataatccacaagaaacatacaattattacagtctcccgttttgccatccatctagtacttctactgctgcacacaaatggggtggtcttggtgaggttctgggtggcaatgaactaatcgacagccaacttgagatcaagttcctaagaaatctggataagactgtcttttgccagatggatcttgatgatgcaaaggttaaacagttcaaggatgcaatagagaataattactggtttgaattatttatggatgatcttcctttgtggggatatgttggtgagctacatcctgataagcatagtgataacggcaagcacgtcctttacacacacaagaatattattgttaaatacaataatgatcagatcattcatgttaatctcactcaagatatcccaaagactttggaggcaggaaaacatttggatttgacatattctgttaaatgggttcctactaatgtcacttttggacggcgctttgatgtgtaccttgactatcctttctttgagcatcagattcactggttctccattttcaactctttcatgatggtcatcttccttactggattagtatcaatgatattaatgcgaactctaagaaatgactatgcaaaatatgctcgggaagatgatgacttggaatctctggagagagacgttagtgaagaatctggctggaaacttgtgcacggtgatgtttttcggcctcctcgctatttagttattctttcagctgtagttggcacaggtgctcagctagcgttgctggttcttcttgtcatcttgctggctattattgggatgttgtatgtcgggcgaggagcaattgtcacaaccttcattgtttgttatgctctcacatcattcatttctggttatgtgagtgggggaatgtactcacggaatgggggtaaaagctggattaaatccatgatccttacagcttctttgttcccattcatgtgctttggaattggatttgccttaaacactattgctatattctatgggtctctagccgctatcccatttggcacaatggtggttgtttttgtcatttgggctttcatctctttccctctagcacttcttggcacagttgttggaagaaactggagtggtgctccaaataatccatgtcgtgtaaaaactattcctcgtcccattcctgagaagaaatggtacctcacaccttctgtggtttctctgatgggaggactgctaccctttggcagcatatttattgaaatgtattttgtatttacttccttctggaattacaaggtgtactatgtgtatggctttatgctactggtttttctgatcctcaccatcgttactgtttgcgtgacaattgtcgggacatactttttgttaaatgccgagaactaccactggcaatggacttccttctgttcagctgcctcaacatcagtttatgtgtatttatactcaatatattattactacgtgaagacaaagatgtcagggttcttccaaaccagcttctattttggatacactttgatgttttctcttggattaggaattctatgcggagctgtaggttttcttggttcgaatttgtttgtgaggaggatctacagaaacattaagtgcgattaaggttttccgattcatacctgagcacttccataggtttgttgctggagacaataaattcttggaggaagcctttggtcatgtgtggggaacccaacaacgtttacaggtagaatcacagggttttggtaacgagggtgtattctttttctatattggggaagccctgagattttttccccggctgtaattgactgtctttataattttagagttagtacaatatcggactcttgttactgtttcatacctttataaaataggtgccccattgaaggacttatgtctaattccccaacatgttttgaagtttaaactatccaatgtaaagaggggaagaagtctgaaaaatgaattttgtatgaagatctgaatatcattcttatct

SEQ ID NO: 4062 - DNA, 2016 bp, Lotus japonicus
tcctcctcgatccgccatgttcttcagattctctctcttgtttctcttcctctctgcggcggccttcgcttccgagtcagatcacaggtatcaacaagatgacccggttaccctttgggtgaacaaagttggtccgtataataatccacaagaaacatacaactattacagcctcccattttgccgtccacctggtagtgctggacacaaatggggtggtctcggtgaggtcctgggtggcaatgaactcattgatagccaaattgagatcaagtacctagtaaatgtggacaagaccaccttttgccgtttgagtctcaatgaggcaaatgtcaaacagttcaaagatgcaatcgagaataattactggtttgaattcttcatggatgatcttccattatgggggtatgttggcgagctacatcctgataaaaacagtgacaatggaaagcatgtcctttacacacacaagaacgtcattgttaaatacaataaggatcagatcattcatgtgaatcttactcatgaagacccaaagtctttggaagtaggaagatctttggacatgacatattccgtcaaatggattcctactaatatcactttcagacgccgatttgatgtatatctagactatccgttctttgagcatcagattcattggttctccattttcaactctttcatgatggtcatctttctaactggattggtgtcaatgatattaatgcggactttgagaaatgactatgctaagtatgctcgggaagatgatgatttggaaactttggaaagagatgttagtgaagaatctggctggaaacttgtgcatggtgatgtttttaggcctcctcgctatttgattcttctttcagcagttgttggcataggtgctcagcttgcaacgctggttcttcttgtcatcttgttagctattgttgggatgctgtatgttgggcgaggaaccattgtcacaaccttcattgtatgttatgctctcacgtcattcattgctggttatgtgagtggggggatgtactcgcgaaatgggggtaaaaattggattaaatccatgattctcacagcttcactgttcccattcttgtgctttggaattggatttatcttaaacacaattgctatattctatggatctctagcagccatcccctttggtacaatagttgttgtctttgttatatgggcttttatctctttccctctagcacttcttggcacagttgttggaagaaactggagtggcgctccaaataatccctgtcgtgtaaagaccattcctcgtcccattcctgagaagaagtggtacctcacaccctctgtagtttctatgatgggaggattgcttccctttggcagcatattcattgagatgtattttgtatttacttccttctggaattacaaggtgtactatgtctatggcttcatgctactggtttttataattcttctcattgttaccgtatgtgtgacaatcgtggggacatactttttgttgaatgctgagaactaccactggcgatggacttctttcttttcagctgcctcaacagcagtttatgtgtatttgtactcaatatactactactatgtgaagacaaagatgtcaggcttcttccaaaccagcttctattttggatacactttgatgctttgtctaggactgggaattctctgtggagctgtgggttatcttggttcgaatttgtttgtgaggaggatctacagaaacatcaagtgtgactaaggcttttgtgcgagtctgagtcgagaccagagcaatttcatatgatggttacgttacgggagacaataaattgttgaaggaaagcctctggtcatatgtggaggaccaaagcatgtttacaggttgtatcacagggttttaaggatgggggatgtattctttctctgtattagggaagccctgagatttttttcccctggctgtaattgaaagcctttagtgaatgcaggcaggcactactataattt

SEQ ID NO: 4063 - DNA, 1934 bp, Centaurea maculosa
  misc_feature (99)..(99): n is a, c, g, or t
  misc_feature (112)..(112): n is a, c, g, or t
  misc_feature (118)..(118): n is a, c, g, or t
  misc_feature (169)..(169): n is a, c, g, or t
  misc_feature (179)..(179): n is a, c, g, or t
  misc_feature (272)..(272): n is a, c, g, or t
  misc_feature (425)..(425): n is a, c, g, or t
  misc_feature (668)..(668): n is a, c, g, or t
  misc_feature (869)..(869): n is a, c, g, or t
  misc_feature (872)..(872): n is a, c, g, or t
  misc_feature (875)..(875): n is a, c, g, or t
  misc_feature (878)..(878): n is a, c, g, or t
  misc_feature (882)..(882): n is a, c, g, or t
  misc_feature (886)..(886): n is a, c, g, or t
  misc_feature (893)..(893): n is a, c, g, or t
  misc_feature (895)..(895): n is a, c, g, or t
  misc_feature (897)..(897): n is a, c, g, or t
  misc_feature (961)..(961): n is a, c, g, or t
  misc_feature (964)..(964): n is a, c, g, or t
  misc_feature (976)..(976): n is a, c, g, or t
  misc_feature (979)..(979): n is a, c, g, or t
  misc_feature (985)..(985): n is a, c, g, or t
  misc_feature (988)..(988): n is a, c, g, or t
  misc_feature (991)..(991): n is a, c, g, or t
  misc_feature (1100)..(1100): n is a, c, g, or t
  misc_feature (1114)..(1114): n is a, c, g, or t
  misc_feature (1789)..(1789): n is a, c, g, or t
  misc_feature (1795)..(1795): n is a, c, g, or t
  misc_feature (1798)..(1798): n is a, c, g, or t
aatatagaggaaaaaagaagagtcagatccagactacatctgatctgactgatctgaatcataatccaatttctcagccggcgatcccgatgcggcccnccatcgttgcagnactctntgcctctttcatcttcatctcatcatcgccgccggtggtcttcgcatctgnatatgatcanaagtatcaatcagatgaaagagtcaccctttgggtgaataaagttgggccgtacaataatccacaagaaacatacaatttctacagtcttccnttttgtcataaagctggtcatgctgcacacaagtggggtggtctgggtgaagtattgggtggaaatgagcttattgatagccaaatagatgtcaagttcccaaaggatgtggaaaagactactgtttgtgagctggaacttgatgaaccaaangtcatgcagtttaaacaggctattgagaatagctactggtttgagttgttcatggatgatctgccgctatggggttttgttggcgagctacattctgataggaacagcgatagcaagcatacactattcacacatatgaacatcactatacaatacaacaaagaccagatcattcatgttaatctcagtcaagaaaacccgaaaccgttggaagttggtagaacactcgacatgacatattcngtcaagtggactgaaaccaatatcacatttcttcgccgttttgatgtttacttggattaccatttttttgagcatcagattcattggttctccatattcaattcatttatgatggttatctttctcactgggctagtttcaatgatactgatgcgaactcttaggaatgactatgccaaatatgccagagaagatgatganctnganacnctgnaaanagatgtnantnaagaatctggttggaaacttgttcatggggatgttttccggccacctcgcaatttggttttctntcngcagttgttggnacnggtgcncanttngcactattgattcttcttgtcatcttgctcgcgattgttggaatgttgtatgttgggcgaggagcaattgtaacaactttcatagtctgctatgctctcacatcttttntctctggctatgtnagtggtgggatgtactcacgcaatggcgggaaaacttggataaagtcgatgatcctgaccgcatcactctttccctttttgtgctttgggattggtttagttcttaacacgattgccatattctatgggtctctagctgctattccatttggcacaatggtggttgtttttgtcatttgggctttcatctctttcccactggctcttcttggtacagttgttggaaggaactggagtggtgctcctaacaacccttgtcgtgtgaagaccattccacgcccaattccggagaagaagtggtatctcacaccgtctgtagtttcactaatgggaggactgctaccttttggaagtatttttattgagatgtactttgtcttcacatccttttggaattacaaggtgtattatgtgtatgggtttatgctacttgtgtttctgattcttatcatagtgacggtttgtgtgacgattgtgggaacatatttcttgctaaatgcggagaattattactggcaatggacttccttcttctctgcagcctctacagccgtttacgtgtacttgtattcaatatattactactatgtgaagaccaagatgtctggcttctttcaaaccagcttctactttggatacacagcaatgttctgccttggattaggaatcctctgnggagcngtnggtcatctggggtcgaatatgtttgttagaaggatctaccgaaacatcaagtgcgactaggcagccacggtgttgttaagtgcaaatagcaagtggaagggttaagggtcgggaagtgagtgattagtatacgtac

SEQ ID NO: 4064 - DNA, 2388 bp, Vaccinium corymbosum
acctcctcctgctcgtcgtgctctctaagagaagcgagtgtatacacgacgaggtcggcgtactaccggtaccgggcgggggtcgtctctctctctacactcccgaacaaagcaaagctcaaccaaggacatcaaattaccggcctctgacctctatcttcaccgacggatccaaagcgccggcgatcccgatgcggctcaccgtcggatccctccccttcttcgccttcatcgccttcctcatcgtctcgccggcgttcgcttcagaatacgatcacaagtatcaaccagacgacccagttaccctatgggtaaataaagttggtccttataacaatccacaagaaacatataactattacagccttccattctgtcatcagcccggcaatgcggctcacaaatggggtggtcttggtgaggttctcggtgggaatgaactcattgatagtcagattgacataaaattcctaaaaaatgtggataagaactacaattgcgatatcgaacttgatgaagcaaaggtagaaacaatttaaggatgctgttgagagtagttattggtttgaaatttttcatggatgatctacctctatggggttttgtcggtgagctacttattgacaagaatagtgatagcaagaagcatgtgcttaacacacataagagcattattgttaaatacaacaagaatcagatcattcatgttaatctcactcaagagagccctaaaccattggaagtggggacaacgctagacatgacatattctgtcaaatggatcgaaactaatgtcacttttgctcgtcgcttcaatgtttacttggattaccttttttgtagcatcagatacactggttctccatttttaattcgttcatgatggttatctttctcactggtctggtgtcaatgatactaatgcgaactctcagaaacgactatgcaaatatgctcgggggatgatgatttggagactttggaaagagatgtgagtgagagtctggttgaagcttgtccatgggatgtttttcgcctccccgcaatctagttttactttctgctgttgttgggactggtgctcagctggcgttgcttgtctccttgtcatcttggttgcaattgttggaacattgtacatcgggagaggagccatagtcacaaccttcatactgtgctacgctttgacatcatttatatcgggttacgtgagtggtggaatgtattcacgcaacggaggtaaaaactggataaaatcaatggtcctcagtgcatcactttttccatttatgtgctttgggattggtttcgttttgaatacaattgctatattctatggatcgctagctgctattccttttggcacaatggtggtggttttccttatttgggctttcatctcttttcccccttgcacttcttggtaccgttgtgggaagaaactgcagtggtgccccaaacaatccatgccgtgtgaagaccattcctcgtccaattccagagaagaaatggtaccttacaccatctgtagtttctttgatgggagggctactaccctttggcagcatattcattgagatgtattttgttttcacatccttctggaattacaaggtgtactatgtctatggatttatgcttctggtttttgtgattctcctaattgttacggtttgcgtcacaattgttggggcatatttcttgctaaatgctgagaactatcactggcagtggacttcatttttctctgctgcctcaacggctgtctatgtgtatttgtattcaatatattactactctgttaagactaagatgtcgggcttcttccagaccagcttctatttttggatacactctaatgttttgccttgggttaggaattctctgcggagctgttggttatttgggttccaatttgttcgtaagaaggatctaccgaaacatcaagtgtgattagggtacttgcctaagctttcaacaccattattgttgagaatgagcaagaggaaacctctggacacgtgcgggggaaccaatgatgtctacacatggaaatcacctggagggcatgtaactctttagatacagagaagccctgagattttagccctttttgtcctgggctatagatggaaagcctttaaaattttcattattacagagattgtttgaaaaacccggttagtattctctacttattgtcgtcctcttcgcttccctgtgatgtcccttgtagcggcttgtctcctgtgttgtcgtttggtttagttttctatatatgtaagcttttggcagaagaaactttttgagggaatgatactgggaaatgtattttgtggcagtgaacatgtgcaataacaaaatgctcctatctaatacattgctttt

SEQ ID NO: 4065 - DNA, 2289 bp, Vigna unguiculata
ggaattcaacgcagcttgtactgtaattgtaaccttaatttctccttcttcgacaacgtaaattacaattatagtgcttcctgcttgctctgttcttttcttccattctcttctctctcttttctcctgtccccgccatgttcgtcctataccgatccctcctgttcccgctcttcatatctctcttcctttcttccgccttcgcttcggagtcagatcacaagtatcaacgtgatgaaccagttaacctttgggtgaacaaattgggtccttataacaatccacaagaaacgtacaactattacagcctcccattttgtcatccatcaagtaatgctactgctgcacacaaatggggtggtcttggtgaggtcttgggtggcaatgaactcattgatagccaaattgacataaagttccaaagaaatgtggataagactgttttttgccagatagatctcaatgaagcaaaggtgaaacagttcaaggatgcaatagagaataattactggtttgaattcttcatggatgatctacctttgtggggatatgttggtgagatacgtcctgataagaatggtgatggcaagcatgtcctttacacacacaaaaacattattgttagatacaacaatgatcagattattcacgtcaatctcactcaggatatcccaaaacctttggaagtaggaaaacatttggacatgacatattctgtaaaatgggattctaccaatgtcacttttgggcaccgctttgatgtctacctggaccatcctttttttgaacatcagattcattggttctccatttttaactctttcatgatggttatctttcttactggattggtgtcaatgatcttgatgcgaactctgagaaatgactatgcaaaatatgctcgggaagatgatgatttggaaagtctggagagagatgttagtgaagaatctggctggaaacttgtgcatggtgatgtttttcggcctcctcgcaacttagttattctttcagctgttgttggcacaggtgctcagctagcattgctggttcttcttgtcgtcttgttggctattgttgggatgttgtatgttgggcgaggagcaatagtcactaccttcattgtgtgttatgctcttacatcttttatttctggttatgtgagtgggggaatgtactcacggaatggtggtaaaagctggattaaatccatgatccttacagcttctctgttcccattcttgtgctttggaattggatttatcttaaacaccattgctatattctatgggtctctagcggcaattccatttggcacaatagtgattgtatttgtcatttgggctttcatctctttccctctagcacttcttggcacagttgttggaagaaactggagtggtgctttgaataatccctgtcgtgtaaagactattcctcgtcccattcctgaaaagaagtggtacctcacaccctctgtggtttctctgatgggaggactgctaccctttggaagcatatttattgaaatgtattttgtattcacttccttctggaattacaaggtgtactatgtgtatggctttatgctgctagtctttctaattcttatcatcgttacagtttgtgtgacaattgtggggacatactttttgttaaacgctgagaactaccactggcaatggacttctttcttttcagctgcctcaacagctgtttatgtgtatttgtactcaatatactactactatatgaagacgaagatgtcaggtttcttccagaccagcttctattttggttacactctgatgttttctcttggactaggaattctatgcggagctgtgggttttctgggttcaaatttattcgtcaggaggatctacagaaatatcaagtgcgattaaggtattccgagtcagatctgagcacttccataggcttatatttctaaagagaataaatttttggaggaagcctctggtaatgtgtggggaacctaacaatgtttacaggtagaatcacaatgagggtgtattctttctatattggggaagccctgagattttttccccggctgtaattgattgcctttatataatttagataattagtacaatatccaactctagtgttcatccccttataaaataggactcattgaatgactgatttctaattccccaacatggtttcaactattcaatatatgtaaagaggggatgaagtctcggaaatgaattttggtgcatctgaattttgtatgaaagatctgacatgtcattctta

SEQ ID NO: 4066 - DNA, 2382 bp, Mimulus guttatus
actgcgttctcttaatctacacgatcgaaaatcctaaaaggaggaaattcatacataggactaataaaatcgagttaacacatgaaaatctgagttcgaatcggtgcgtcagaaattcgatttctctttgagatctgaattaccgaaaaagcaatcgagggagatatagaagaacatcccattttttttcataattgtgagatttcctgattcagatccgaggaaaccctattcacccagagggaatgggctacgccgtcagatttttctgcacattcgctttcttctttttgttcttcgtctcctccaccctcggcaagtaccaagatgatgaggccgtcacactttgggtaaacaaggttggcccgtacaacaatccccaagaaacctacaactattacagtctcccgttttgccacccacctggcaatgcagctcacaagtggggtgggctgggtgaggttatcggagggaatgagcttattgatagccaaatcgaaataaaatttaagagagatgtcacgaaggctaaaatctgtgaaatcgaactggaagctgcaaatgttaaacagtttaaggatgcaattgataattcatactggtttgaattttttatggatgatttgccattgtggggttttgttggtgaggtgcttcctgataaagcccatgatagtaagcacgtacttctgactcacaagaatcttgtcattaactacaacggggatcagattattcatataaatcttactcaagagaaccccaggccacttgaagaagggcgggtgttggatatgacctactctgtcaaatgggttcgaactaacgttacatttgcacgccgttttgatgtttatctggattacccctttttcgagcaccagattcactggttctctgtcttcaattctttcatgatggtaattttccttactggtttggtgtctatgatattgatgcgtacgctacgcaacgactacgctaaatatgctcgggaagatgatgatctggaaactctggaacgggatgtgagtgaagaatctggttggaaacttgtccatggtgatgtgtttcgtccttccaagaacctggctctactttcagctgttgttggcactggtgctcagctagcaacacttgttctgcttgtcatcattttagcaattgttggaatgttgtacatagggagaggagcaattgtcacaacctttatcgtatgctatgcttttacatcatttattgctggttacgtgagtggtggcatgtattcccgccatgggggtaaaacttggataaagtcgatgatccttaccgcgtcactgttccccttcatgtgtttcggcattggcttcatcttgaacacaatcgccatattttatggttctctagccgccatcccctttggtaccatggtggttgttttagtcatatgggcttttatctcttttccccttgcacttcttggtactgttgtgggaagaaattggagtggtgctccaaacaatccatgccgagtgaagacaatccctcgtccgattcctgagaagaaatggtatcttacgccatctgtcgtctccctcatgggaggtctgctgccttttggaagcatttttattgaaatgtattttgtcttcacctccttctggaattacaaggtgtactatgtgtatggtttcatgctactagtgtttgtgatactgatcatcgtcaccgtttgcgtgacaattgtggggacgtatttcttgctgaatgccgaaaattatcactggcaatggacttcattcttctctgcagcctccacctcgctctacgtgtacctctactctatatattactattatgtcaagactaagatgtcgggttttttccagaccagcttttattttggatacactttgatgttctgcatgggtttgggaatactatgtggtgctgtcggatatctgggatccaatttgtttgtccgaagaatctacagaaacatcaaatgtgactaaattttggagccctttatcgaatttcccatgatataatttagcatccccgatctagtaggacaatcgaccagctctaaagtattgcattcaaaagcaaacctaggaaattttctggcagagatagaatggagggatatccgtgtttcgctgaagtcttcgactgttaacaagagatgttgctttactccaatttacgtattcgcagatacttttgctgccaaaaacatctctgtggctttgtatatttttgctacataggcatttgttgattcactatgtttcattaatggagacccttttttgcaatactttattttcttcccacaatattttcaaccatataaatatatcccttgctaataagatttatatattttctctatgt

SEQ ID NO: 4067 - DNA, 2165 bp, Ambrosia trifida
cggatcctcagcactcatcgcctacccttcttttccttgtcatcgccggtgtttgacttccgattatgatcacaagtaccaatcagatgaaaaagtcaccctttgggtgaataaagtcgggccttacaataatccacaagaaacgtacaatttctacagtcttccgttttgtcgtcaagatggtcatgctcaagctgcacacaagtggggcggtctgggtgaggtattaggtggaaatgagcttatcgacagccaaatggatgtgaagtttcaaaagaatgtggataaaactagtgtctgcgagctggaacttgatgattcaaaagccatgcagtttaaacaggctattgagaataactactggtttgagttatttatggatgatctgccactgtggggttttgtgggcgagctacactctgataagaacagtgataacaagcatacgctattcacacatatgaacatcaccatacaatacaacaaagaccagatcattcatgttaatctctctcaagaaaccaaaacctttaggagttggtaaacactcgacatgacatattcagtaaagtggactgaactaatgtcccgtttgctcgccgtttcgatgtttacctggattaccatttctttgagcatcagattcattggttctcgatattcaattcatttatgatggttatctttctgactgggttggtctcgatgatactgatgcgcactcttagaaatgactatgccaaatatgcgagagaagatgatgatttagaaactctggaaagagatgtcaatgaagaatctggttggaaacttgttcatggagatgttttccggccacctcgtaatttggttttgttgtctgctgttgttgggacaggtgcccaattggcactattgattcttcttgtcatcgtgtttgcaattattggaatgctgtatgtaggacgaggatcaattgtaacaacatttatagtttgctatgctctcacttcttttgtttctggctatgtgagtggtgggatgtactcacgctaacggcgggaaaaacttggataaagtcgatgatcctaaccgcatcactttttccatttttgttgctttggaatcggtttcattctcaacactattgcaatattctatggatctctagcagcaattccatttggcacaatggtggtcgtattcgtcatttgggcttttatttcttttcctcttgctcttcttggcacagttgttggaaggaactggagtggggccccaaaacaacccgtgtcgggtgaagactattcctcgcccaattcctgtgaaaaagtggtatctcacaccatctgtagtttcactcatgggaggactgcttccttttggtagcattttcattgagatgtactttgttttcacttccttttggaactataaggtgtattatgtgtacgggtttatgctacttgtgtttctgattcttataatagtgactgtgtgtgtgacaattgtgggaacatatttcttgctaaatgctgagaattattattggcaatggacttcattcttctctgcggcctctacagctatttacgtctacttgtattccatatattactactacgtcaagactaagatgtctggcttcttccaaaccagcttctactttggatacactgctatgttctgccttggattagggattctatgtggagctgttggtcacctggggtcaaacctgtttgtcagaaggatctaccggaacatcaagtgcgactaagtcacattcacaggaagaacaccgcccacagtgtacccggccttcgcagtagcacatcccgattggaaggttgcatcaggtatgtaaacccgaaggcccgggcagtgattaagtagtagtagtatacctagctcctgagattgagggaggtttgataagtttttccttcctaccttttcatggagtgtagaaaaaagttagatgagaattttaaattcagaggttattttattatccaggaaaaaagggctactttggttcccacatgtctttccgttttcgatttctttcgtgtgaatgagtttgcggttttgtctttgaacaagtggcggggagggggtacatttatgtgcttgtcaacttttgtgcaaaacagataatgtttattgtatacttgttcttttca

SEQ ID NO: 4068 - DNA, 2241 bp, Amorphophallus konjac
ctagcttgccactggtagggactagggaggtccgcccgacggtggcgcgcgcagatccggcggcggcgatgcgtcccgcggcgagatccgccccgctcctcgccctcctcctcgtcgccgcctccggctccgcctccgcctccgagtcagaccacaagtatcaagtagatgaacctgttacattgtgggtaaacaaggttggcccttactataatcctcaagaaacttataactactacagccttcctttctgccagccagctgggaacccagttcacaagtggggagggcttggcgaggttctaggtggaaatgaacttatcgacagccagattgagataaagtataaaaaaatggtcgacaaggcctctatttgtgctattgaatttgatgctgcaaaggtgaagcagttcaaagatgccattgaaaattcatattggcttgagttcttcatggatcgtttacctttatggggctttgttggggaggtgcgttctgataagaacaatgaaaataagcattaccttttcactcacaaggatattgttgtcagatataacggtgatcagataattcgtgtgaatcttactcaaggggcccctaaacctctggaagttgggagaacattagatatgacatattctgtcaggtggattaaaatagacatcacgtttgcaaggcgctttgatgtttatttggactaccctttctttgaacatcagatccattggttctcaattttcaattcttttatgatggttattttcctcgctgggctggtatctatgatattgatgcgaactctgagaaatgactatgcaaagtatgctcgtgaagatggtgatcttgagactatggaaagggatgtaagtgaagagtctggatggaagcttgtacatggagatgtctttcggcctccatgcagtttggttcttctttcagctcttgttggtataggtgctcagctagcattgcttgtcctcctcgtcattttattgacaatcagtgggatgttgtacattggacgaggagaaattatcacaactttcattgtgtgttatgctcttacttcattcatctctggctatgttagtggtgggctttactcacgtaatgttggcaaaaactggataaagacaatggtcttgacagcatcactcttcccatttatgtgctttggtattgggttcgtattgaacatggtggctatcttctatgggtcactggcagctattccgtttggaacaatgctggtcttgttcataatttgggcttttatctcattccctctggcactccttgggactgttgtgggcagaaactggagtggttctccaaacaatccttgccgtgtgaagaccattcctcgccccattcctgaaaagaaatggtacctaacaccatctgtagtctcactgatgggaggactgcttccctttggtagcatcttcattgagatgtactttgtcttcacatcattttggaattacaaggtgtattatgtgtatggtttcatgctgtttgttttcctcatcctcatagttgtcactatctgtgtgacaattgtgggcatttatttcttgttgaatgctgaaaactaccactggcaatggacttcgttcttttctgctgcctccacggcggcctatgcctacctttactccatatactactactacatgaagacaaagatgtcgggctttttccagacaagcttctactttggttacactttaatgttttgtctgggcttagggattctttccggtgctgtgggttatctgggttcttccctgtttgtgagaaggatttatgggaacatcaaatgtgactgactcgggagacagatttggagacgatatcacgtaaatgggcatcggcaaaaaaaaaaaaaatacgctctgggttatatgcctggttaaccccttaacgcaaatcattctccaagtgcatgattcttcttcatttgggggcttttgctgtcgaattgcggctttcacgttccttttaggtgatagtaccatagtatacaacttgtttgtactagtagctgattttgggttgctttaaactcgaagttactgtattacacgagctaatgaaggctcccctctgtattctatcattctatgtccattctaaaaaattgttaactggtactccaattagatttacctacgaggaggtacttattacgtcgtagtgatactacaaactaaaaaatagtatacttaattagta

SEQ ID NO: 4069 - DNA, 2303 bp, Brassica rapa
gccgaacaaacagtaggactgtgctgtgctctctcgctctctcgatcgctgccgagaaacgagagagctgacactgtactgccacgatgcagtatacacaaatttgaatcagatcatcgagtctaacgcatttcaacctccgtctccgtctttctcagatccgatcacccgccggatttcgcaatgccgtcttcctccgccgtactccttcttctcgttccccttctcgcaactgctctcgcctccgattcagatcacaagtatcaagcggatgagcaggttaccctgtgggtgaacaaagtcggcccatataacaacccacaagaaacatacaactactacagcctcccgttctgccgcccctctcaaaacgatgttcacaaatggggtggtctcggtgaagttctcggcggaaatgagctgattgacagcgagataccgataaagttcctgaaaaatgttgacagaaatgttatctgtcaccttgaactcgatgaagctaaggtcaatcacttcaaagacgccatcgaatctagctactggtttgagttctttatggatgacctgcctttgtggggcttcgtgggtgagctgcctcttgacaaaaatagtggaaacggcaaacatgtactctacacacataagagcattattgtcaaatacaacaaagaccagataattcatgttaatctcactcaagataacccaaggccactggaagcagggaggacagtggatctgacgtattctgtgcaatggattccaactgatgtcacatttgcccgacgttttgatgtatatctggattatccgttctttgagcaccagatccattggttctccatctttaactcgttcatgatggttatttttctcaccggtttggtctcaatgatattgatgaggaccctcagaaatgattatgcgaagtatgctcgtgaagatgatgatctcgagagcttggaacgggatgtaaatgaagaatccggttggaaacttgtgcatggagatgtattcagaccaccatggagtctagttcttctctcagctgttgttggcacaggtgcacagttggcgctgcttgttcttcttgtcatattaatggccatcgttgggactctatatgttgggagaggagctatcgttacaactttcatagtttgctatgctctgacttcctttgtctctggttatgtgagtggtggaatgtactcaagaagcgggggtaaacattggatcaagtgcatggtcctcacggcttctctcttcccctttttgtgctttggaatcggctttcttctaaacacaattgccatattctatggatcccttgcggctattcctttcggaacaatggtggttatgttcgtcatttggggcttcatttcctttcccttagctctcctcgggacagtcgttggaagaaactggagtggtgtcccaaacaatccatgccgtgtaaagaccattccacgcccaatccctgagaaaaaatggtacttaactccatcggttgtctctctgatgggaggtttgctaccatttggaagcatcttcatcgagatgtactttgtcttcacatccttctggaattacaaggtgtactatgtgtatggattcatgctactggttttcgtgattctagtgatagtgacggtctgtgtcacaattgtgggaacttatttcctgctgaacgcagagaactatcactggcaatggacttcttttttctctgctgcttcaacggctgtctatgtctacttatactccatctattactactacgtaaagaccaagatgtctggattcttccagacaagcttctactttggatacacaatgatgttctgtcttggccttggaatcctttgcggagctgttggattcttaggatcaaatctctttgtaaggaggatatacagaaacatcaaatgcgactagacgaatgatcgaaaaagaggaaagcacatccagttcagaagaaagcctctgatggggggttatatattatataaacgcagtggagagcgatgaagtttgagcatatatatattattcaatctgggatttttgcccttttattgtctccctttttggtaagtgcactgttctctttagattagaattgagtggatgtaatatactattactacctgtgtttagttcacttcacgtcagttagatcattgaatgtcatttaggaacaattggatataaccaagtttttgtttgtaattgatagcttgctacctttttattctatccgagaataagtatacatccaagaaactgtggtggtcgtg

SEQ ID NO: 4070 - DNA, 1972 bp, Brassica napus
ccgtttactccgccgtcgcatgcgtcttccttcttctctctccggctttggcctccgagtcagatcacaagtatcaaggggatgagaaggttacgctttgggttaacaaagttggcccatataataatccacaagaaacatataactattatagcctcccgttttgccgcaaaactgaaaatagcattcacaaatggggtggtcttggtgaggtccttggtggaaatgaactcatcgacagccagatagacataaagttcttgaaaaatgttgacagaggcgtgatctgtcagttggaactcgataaagctaaggtcaagcatttcaaagatgccatcgaaaatagttactggtttgagttatttatggatgatttgcctttgtggggttttgtgggcgagctgcctcctaggaaaaaaaagtgaaaacggcaagcatgctctttacactcataagagtattaatgtcaaatacaacaaagaccagattattcatgtgaatctcacacaagataatctaataccgttagaagcagggaggacggtggacttgacatattctgtgaattggatcccaaccgatgtcacatttgcccgtcgttttgatgtttatctagactatccgttcttcgaacaccagatccattggttctccatctttaactcgttcatgatggttatcttccttactggtttggtctcaatgatattaatgaggacactcagaaatgattatgctaaatatgctcgggaagacgacgacctggagagcttggaacgggatgtaaatgaagaatctggatggaaactcgtgcacggagatgtgttcagaccaccaagtagtctggttcttctgtcggctgttgttggcacaggtgcccagttggctttgcttgttcttcttgtcatattaatggcaatcattgggacactttatgttgggagaggagcgatcgtcacaacttttatagtttgctacgctctgacgtcatttatctctggttatgtgagcggtggaatgtactcgagaagtggtggtaaacactggatcaaatgcatgatcctcacagcgtccctcttcccattcttgtgctttgggattggattcgtcctaaacacaatcgccattttctacggttctcttgctgctattcctttcggaacaatggtggttgtcttcgtaatttggggtttcatttcgttccctcttgccctcctcgggacagtcgttggtagaaactggagtggtgccccaaacaatccatgccgagtgaagacaatcccacgtcctatccctgagaaaaagtggtacttgactccatcagtagtctctcttatgggaggtctcttacccttcggcagcatcttcattgaaatgtactttgtcttcacatccttctggaattacaaggtatactatgtgtacgggtttatgctgcttgtctttttgattcttcttgtggtgaccgtctgtgtgacgatcgtgggaacatacttcttgctgaatgcggaaaactatcactggcaatggacatcgttcttctcagctgcttctaccgcggtttacgtctacttatactcgatctattactactacgtaaagacgaagatgtttgggtttttccagaccagcttctacttcggatacaccttgatgttctgtctgggcctcggaatcctttgcggagctgtggggttcttaggatcaaatctgtttgtgagaaggatctatagaaacatcaagtgcgactagagagagtgaccgaaccaaaaacgcggtaaagatggatcgtggaatgttcttggaggcagttaattctgttagaaagaatcttctaggttattatacacaagggaaagttgagaatgaatggagaaagaggttatatggtaatcaaaaatttatatttattttaggattcagagatacttgctggttctattgtctttatagtctgctagccagccaccag

SEQ ID NO: 4071 - DNA, 2026 bp, Cirsium arvense
tctcctcgccggtcttcgcttctgaatatgatcacaagtatcagccagatgacccgattaacctttgggtgaataaagtggggccttacaataatccacaagaaacatacaactattacagccttccattttgtcgtcgacttggtaatcctgggcataagtggggtggtctgggtgaagtattgggtggaaatgagcttattgatagccaaatcgatgtcaagttccaaaagaatgtggagaagacaacaatttgtgagcttgaactcgatgaagcgaaggttaaacagtttacggaggctattgagaataactattggtttgaatttttcatggatgatctaccattgtggggttttgttggtgaacttcattctgatagaaacagtgatagcaagcatatgctattcacacacaagaatattactatacaatacaacaaagatcagatcattcatgttaatctcagtcaagagaacccaaaaccattggaagttgggagaacagtagacatgacttactcagtcaagtggactgaaactaatatcacatttgcacgccgttttgatgtttacctggattaccatttctttgagcatcagattcactggttctcgatattcaattcattcatgatggttatcttcctcactgggttggtttcaatgatactgatgcggactcttagaaatgactatgcaaagtatgctcgggaagacgatgatcttgaaagtctggaaagagatgtaaatgaagaatctggttggaagcttgtgcatggggatgttttccgaccagctcgcaatttggttttattgtcagcagttgttggaacgggtgctcaattggcgctactgattcttcttgtcattttgtttgcaattgttgcaacgctgtacatcgggagaggagcaattgtcactacatttatagtatgttatgccctcacgtcatttgtctccgggtatgtgagcggtggcatgtattcacgcaatggtgggaaacactggataaagtcgatgatcctcactgcatctcttttcccatttttgtgctttggaattggtttctttctgaacaccattgctatattttatgggtctctggcggcaattccattcggcacaatggtggttgtatttgtcatttgggctttcatctcattccctctagcccttcttggtacagttgtgggaaggaactggagcggtgctccaaacaacccttgtcgtgttaaaaccattcctcgccctattcctgagaagaagtggtatctcacaccatctgtggtctcgataatgggaggactgctaccttttggtagtattttcattgagatgtactttgtcttcacttccttctggaattacaaggtgtactatgtttatgggtttatgctacttgttttcctcattttgatcattgtcactgtgtgtgtgacaatcgttggaacgtatttcttgctaaatgctgagaattaccactggcaatggacttcattcttctctgcagcctccacagctatttacgtctacttatattcaatatattactactacgtgaagactaagatgtcagggttcttccaaaccagcttctactttggatacacggccatgttctgtcttggtttaggaattctatgcggggctgttgggtatttggggtctaatctgtttgtgagacggatctaccgaaatatcaagtgcgattgagggaagaagaacaacggccaacttggtttttttgtagtttactgtgtggataccaattccaagtgcatcaaatgtaacttttgggcaatggaaggaaggaaggaaggaagaaagaaagaaaaggttagagaaatgaagagattgtttttattatgcagcaggaggaaaaaaggggagtggggtaaggtagcaagcatcattgtctgttaatgtagccaaccaaacaaacttgttatatacagcatcaacttctattgtattcttattcatccaccattccaaaaaagaaaaaagtaccgactgcgtggccg

SEQ ID NO: 4072 - DNA, 2455 bp, Medicago truncatula
ctaaattgcatttgaccctaattaatattttatttacccataagaccaaaaccaccattcatcatttcaattgaatgaaaaccttaccttcttttctactcttcaatcttcaacaacgttaattactattatagtctttcttctgttcagtttctctctttctcttctcgtaacgcttttgtgttgtgttgtgttgggttctctcttcaatccaatccaattcaacccatccttcaccaccatgtccttccaatcccgatccatcttcttcctcttcttctctctcttcatttcttcaaccttcgcttcagaatcagatcacaagtatcaacgggatgatccagttaacctttgggtgaacaaagttggaccctataacaatcctcaagaaacttacaattattacagtctcccattttgccacccatctagtacttctgctgctgcacacaaatggggtggtcttggtgaggttctgggtggcaatgaactcatcgacagccaaattgagatcaagttcctaagaaatgtggagaagactgtcttttgccagatggttcttgatgatgcaaaggttaaacagttcaagcatgcaatagagaataattactggtttgaatttttcatggatgatcttcctttgtggggatatgttggtgagctacatcctgataagcatagtgataatggcaagcacgtcctttacacacacaagaatattattgttaaatacaataatgatcagatcattcatgttaatctcactcaagacgtcccaaagcctttggaggcaggaaaacatttggatttgacatattctgtcaaatgggttcctactaatatcacttttggacgccgctttgatgtctacctggactatcctttctttgagcaccagattcactggttctccattttcaactctttcatgatggtcatcttccttactggattggtatcaatgatattaatgcgaactctaagaaatgactatgcaaaatatgctcgggaagatgatgatttggaatcgctggagagagacgttagtgaagaatctggctggaaacttgtgcacggtgatgtttttcggcctcctcgctatttggttattatttcagctgtagttggcacaggtgctcagctagcactgctggttcttcttgtcatcttactggctattattgggatgttgtatattgggcgaggagcaatcgtcacaaccttcattgtttgttatgctctcacatcgttcatttctggttatgtgagtgggggaatgtactcacgaaatgggggtaaaagctggattaaatccatgatccttacagcttctttattcccattcatgtgctttggaattggatttgccttaaacactattgctatattctatgggtctctagctgctatcccatttggcacaatggtggttgtttttgtcatttgggctttcatctctttccctcttgcacttcttggtacagttgttggaagaaactggagtggtgctccaaataatccatgccgtgtaaaaactattcctcgtcccattcctgagaagaagtggtacctcacaccttcagtggtatctctgatgggaggactgctaccctttggcagcatatttattgaaatgtattttgtatttacttccttctggaattacaaggtgtactatgtgtatggctttatgctactggtttttctgattctcaccatcgttactgtttgtgtgacaattgtcgggacatactttttgttaaatgccgagaactaccactggcaatggacgtctttcttttcagctgcctcaacatcagtttatgtgtatttatactcaatatattattactacgtgaagacaaagatgtcagggttcttccaaaccagcttctattttggatacactttgatgttttctcttggactaggaattctatgcggagctgtaggttttcttggttccaatttgtttgtgagaaggatctacagaaacattaagtgcgattaaggtttactgaggcattctggagcacttccataggcttgttgctggagacaataaattcttggaggaagcctctggtcatgtgtggggaacccaacaatgttcacaggtagaatcacagggttttggtaatgagggtgtattctttttctatgttggggaaagccatgagattttttccccggctgtaattgactgtctttttttataattttagagttagcacaatatcggactctcgttactgtttcatccctttataaaataggggctccattgaaggacttatgtctaattccccaacatggtttcaagttccaactacccaatgtaatgtaaagaggggaagaagtctgaaaaatgaattttgtatgaagatcactgaatatcattcttatatgcttcgttcatgtttaaatttcaattattgcttgcattgtatttaag

SEQ ID NO: 4073 - DNA, 1019 bp, Hordeum vulgare
cggcacgagggtccgtcttcgccacggcccttccaccaaaccccgtgcactcttcgcctcgcagtcaagctcctagcgcgcgaccatggcagcggcaggagccctggtcgtgtacagggcggtgttcgccgcgctcggctgcctcatggtgggcaccctggtgtacacctgcatcaccgatggctcgccgtttcgcatcgagctgctgactccgtggatcgtgacaacattggttgatttttatgtaaatatagcagcgatttcgacttgggttgtctacaaggaaggaaattggattagttctatcttctgggtagtactgttgatttgtttcggcagtgctactacatgtgcttatattgttagcaagttatttgagataacatcttcagggctttcccaaaatccgcttgatcttttgttgctcaggcaagataatctacccgaaaggaagtgttcttttgttgtcatcgggagaactattttcagcattttgggcatactcatggctgcacttgtcacgtatactgtcattacagatggactgcctttcaggaaggatttgttgacaccgtggatggctgcaaccttaattgacttctatataaatgtctttgcaatatcggtatgggttgttcacagggagtcgacttggatctcagcagtcatatggatatgcttgttgatatgctttggaagcatcacaacatgtggctacattgtggttcaacttctccaagtgtcgtaccaagacccagtctaccatctgctactgaactccccatagcaagaagatctgaaaactcattgaaggggtatgttcttggtacacaataatgtcacctatgttcataatggttcttcaataaagggtataccagagtagcaatagaagttttttcttcgtggaatggaatgatttcttaacgaagttgaagctccttcacttgttattgtctcaaagctggttttgtaattgtataccaaatttaattgcttggcaaatgatagacaccaga

SEQ ID NO: 4074 - DNA, 1447 bp, Setaria italica
atggcgtcatttccttgtcccgccgggcgaaacccgttttcttctcatacacacacacacgtttcgttcccccgccgtcatcgcggggctccgcccgtcgccgccggcgactcggctcccgcaagaagcctactcctaaccgcaacttcggtgccctccacgacttccaagtcgcgagatgcggcggcggcgcctcccgcggcctacgtggccgcgcccccacctccgcttccgccgcgccgacgtgtcagcgtcccatccactccccgttcctcctattacttgtctccgccggcaactgttcgccccccactaaatccgcgggccgtttcctctcgaggggtgatcatggcggcgcagggatccctagtcgcgtggagggtggtgttcgcggcgctgggattgctgatggtgggcacgctggtgtacacctgcgccaccgacggctcgcctttccgccccgagctgcttacgccgtggatgaatgcaacactgattgatttctatgtgaatgtaattgcaattgcggcgtgggttatctacaaggaagcaaactggattagttctgccgtgtgggtggttctgttgttttgctttggcagtgctgctacttgtgcttatattgttacaaagctttttgaagtgacacctggagggccatctcacgatccacttgatcttctgtttatcaggcagggtaatctgtcccaaagaaagtgctcttatgtcataattggaaggattatgttcagcattttggggatattcatggctgccgttgtcacatatactgtcatcactgatggacttccttttaggaaggaattattgacaccgtggatggcggcaaccttaattgatttctacataaatgtctttgcaatatcggtttgggttgctcacaaggaatcgtcttggatatcaactaccatttggattgtcttgttgatatgctttggaagcatcacaacatgcggctacattgctctccaacttttccaagtatcatatcaagatccaatctaccacgtgctattgaactctcacagcaagtatggaactgcgacttccttgtaatccttcatcttctatgagcctggttagcttacagctgtctaaacttctgcttgacatttggtcattgatcagccattcataattcacatctgttttaaatgtaggaagatttgaaaatttattgaagtgatatgttcagactggctcatgataatacaaatgttccctactatctatatgtaaagttacttctgcaaaatgaactgaaagctgaagctcttttattgtacttctgatccaattgcatggacaatgatcctttttttttttgtcacccttgtgataatcctgaactgtttgatgcaaacaatttccgaaatcaagcgatcttatttgtaggggtgcaatgggcacttcatgttccaaacat

SEQ ID NO: 4075 - DNA, 1858 bp, Panicum virgatum
cggcacaatgtagattcagaggtcggtttaatttttttattaaaaaatattagttaaatgtccacttttaacttttcaaaagcggaagctgggcatggcaaacacacaaggggttcagacgaaataaaaagaaacaagaacggaagccaacacacctgtttctttcatgggcctccagcatccagttcttcgaaccaggcccagttttctttgggcgtaccaaatgggccggggcgtccgggtgaaatccggaaacccgttttctcccccacgcacgcacgtttccgtttccgaacccccgccgccgtcgccgctcgtcgccgccggcgactcgactccgccaaccaacctactcccaaatcccaacactcaaccaagtcgcgagatgcggcggtggcgccgcccacagcctacgtggccgcgcctccgcctctgctcccgccgcgccgacgtgtcagcttcccgtccactccccattctcctcctattacttggctccgccggcaactattcgcccccgcactaactccgcggccgtttcctctcgagcggtgatcatggcggcgcaggggtccctagtcgcgtggagggcggtgttcgcggcgctgggcgtgctcatggtgggcacgctggtgtacacctgcgccaccgacggctcgccgttccgctccgagctgcttacgccatggatggtggcaacactggttgatttttatgtgaatgtaattgcaatctcggcatgggttatctacaaggaagcaagctgggttagttctgccgtgtgggtggttctgttgttttgctttggcagtgctgctacttgcgcttatattgttatgaagctttttgaagtaacacctacaggaccatctcaagatccacttgatcttctgtttatcaggcaaggtaacccatcccagagaaaatgctcttatgtcataattggaaggattattttcagcattttgggaatattcatggctactgttgtcatatatactgttatcactgatggacttccttttaggaaggaactgttgacaccgtggatggcagcgaccttaattgatttctacataaatatctttgcaatatcggtttgggttgctcataaggaatcatcttggatatcaactaccatttggattgtcttgttgatatgcttcggaagcatcacaacatgcggatacattgttctccaacttctccaagtgtcatatcaagacccaatctaccacgtgctattgaactctcatagcaagtatggaattgcgacttccctgtaatcattcgtcttctacgagcctggttagcttacagctgtctaaacttcttgaaatgtaggaagatttgaaaattcattgaagtgttatgttcagcctggttcgtaataatacaaatgttcccttctatctacatgtaaaggtaccacaactaagggtgtatgaagatagcaattagagaagttcctttttagttgagtgaaatgatgactttgccaacttctctgcaaaatggactgaaagctaaatctctgttattgtacttctgattcaattgcttggacagtgatcttttcttttcttttcttttttttttgttgccactcttgtggaaatcctgatccgttcaatgccaacaatttcaaaaatcaagtgaagattttatttgtaagaatgcataattggcgctggatgttccaaacattgttctgattgtcaattaagttgaataaaacttctgcttgctctatatggtacatatcgctcctgagtaggtgaaggagcctcagtgtccagtagggaagaactttatacagtagatctcccatgtcccttcagttaatggatggttggtg

SEQ ID NO: 4076 - DNA, 1364 bp, Zea mays
tttgctttggaataccaaatgtgcgatacgtcatgtcctgcttgctggccgttgtctcattgtctggccgccggaccaaatccgaaaacccaccgagtaactgacaatctcgatccccgcagtcatcgcgggatcggcccgtcctcgccggcgactcattcccgcaactcacctgctctcaaccgcgaactcggcgccctgcacggcctccaagtcgcacgatgcggcggcgcccacatcatacgtggctgcgtctccgcctccgctttcgccgcgccgacgtgtcagcttcccgtccactacagagtccacattgtcctcctattacttgctccgccggcaactattagcccctccccagtcgccactaaatccgctgccgtttcttctcgagtgtgaccatggcggctcagggatccctcgtcatgtggagggcggtcttcgcagcgctgggcttgctcatggtggccacgctggtgtacaccttggccaccgacggctcgccgttccgccttgagctgtttacgccgtggatggtggcaacactggctgatttttatgttaatgttattgcaatctcggcttgggttatctacaaggaagcaaactgggttagttctgctgtgtgggtggttctgttgttttgctttggcagtgctgtcacttgcgcttatattgttaagaaacttcttgaagtaacatctgcagggtcatcccaagatcctcttgaccttctatttatcaggcaaggtaatctatcccaaagaaagtgctcttatgttgtaattggaagggttattttcagcattttggggatattcatggctgcggttgtcacatatactgtcatcactgatggactaccttttaggaaggaattgttgacaccgtggatggcggcaaccttaattgatttctacataaatgtctttgcgatatcggtctgggttgctcacaaggaatcatcatggatatcaactaccatttggattgtcttgctgatatgctttggaagcatcacaacatgcggctacattgtcatccaacttttcaaagtatcatatcaagatccaatctaccacgtgctattgaactcccacagcaagaagatttgaaaatttattgaagttttatgtgcagcttggctggtaatattaaaatgttccttctatctatatgtaaggtaccacaattaaggggacaggaggatagcaattagacaagttgttttactttgaataaaataactcatgtgctgagttatctgctaaatgaactgtaacgtgaaatcctttattgtatttctgattgaaattgcttgaacaataatctcctttgttatggtttcattgcaaacaatttag

SEQ ID NO: 4077 - DNA, 1326 bp, Eragrostis curvula
aagtgttttctccctctaatcagcgtccatttcgacaagcagtaaggtagcagcgcggtcatggcggcgcccgggagcttggtcgtttggagggcggtgttcgcggcgctgggcacgttcatggtgggcacgttggtgtacacctgcgccaccgacggatcgccgttccgacctgagctgcttacgccgtggttggtggcaacactggttgatttttatgtgaatgtgattgcgatctcggcttgggttatctacaaagaaacaaactggattagttctgccatctgggtggttctattgttttgttttggcagtgctgctacctgtgcttatattgttaagaagctttttgaagtaacacctacagggccttcccaagatccacttgatcttctattgctcaggcaaggtaatccatctcaaagaaactgctcttgcgtaacagccgagaggattattttcagcattttggggatattcatggctgccgttgccacatatactgtcataactgatggactaccttttagggcggaactattgacaccgtggatggcagcaaccttaattgacttctacataaatatctttgcaatatcggtctgggttgcccacaaggagtcatcttggatatcaacagccatttggatttgcttgctgatatgcttcggaagcatgacaacatgtggctacattgtcattcaactctttcaagtatcatatcaagacccaatctaccacgtgctactgaattgtcatagcaagtacggaactgtgacttccccataattcatcttgaagatttgaaaattcagcaaagggacatgttcttcatggccagggtaatacagatgttcccttctatcaatgtgtaagagttaaagaaccacagtaaagggtatttcaggaaagcaattagaaaaccctttactttgactaaccgccttttgttctatccaacaggtcaaaccctttatttttaaaaaaaaaaaaaaaaaaaaaaaaaaaaaaattctgccttgaaacccctgctaatcaaattcccccggccgcatgggggcggggaacaaggaacttccggcccacttccccctaaataaattcctaaaacatctccttgccgcctttttactaccctcagctggaaaaaacccggggttacccacctataccccctgggacaaaccccccttcccccctcggctaaaaccaaaaaggcccccccccacccccccccccacctctcccccccccacaggacaaggaaacccggcccaatcgccctcgaaataccagacggggggtggggggagtgtcctgcaaatt

SEQ ID NO: 4078 - DNA, 1044 bp, Panicum virgatum
ggcactaactccgcggccgtttcctctcgagcggtgatcatggcggcgcaggggtccctagtcgcgtggagggcggtgttcgcggcgctgggcgtgctcatggtgagcacgctggtgtacacctgcgccaccgacggctcgccgttccgctccgagctgcttacgccatggatggtggcaacactggttgatttttatgtgaatgtaattgcaatctcggcatgggttatctacaaggaagcaagctgggttagttctgccgtgtgggtggttctgttgttttgctttggcagtgctgctacttgcgcttatattgttatgaagctttttgaagtaacacctacaggaccatctcaagatccacttgatcttctgtttatcaggcaaggtaacccatcccagagaaaatgctcttatgtcataattggaaggattattttcagcattttgggaatattcatggctactgttgtcatatatactgttatcactgatggacttccttttaggaaggaactgttgacaccgtggatggcagcgaccttaattgatttctacataaatatctttgcaatatcggtttgggttgctcataaggaatcatcttggatatcaactaccatttggattgtcttgttgatatgcttcggaagcatcacaacatgcggatacattgttctccaacttctccaagtgtcatatcaagacccaatctaccacgtgctattgaactctcatagcaagtatggaattgcgacttccctgtaatcattcatcttctacgagcctggttagcttacagctgtctaaacttcttgaaatgtaggaagatttgaaaattcattgaagtgttatgttcagcctggttcgtaataatacaaatgttcccttctatctatatgtaaaggtaccacaactaagggtgtatgaagatagcaattagagaagttcctttttagttgagtgaaatgatgactttgccaacttctctgcaaaatggactgaaagctaaatctctgttattgtacttctgattcaattgct

SEQ ID NO: 4079 - DNA, 3792 bp, Oryza sativa
cacaaattaagatgcattgctttcttcctggcactgtcagcatatgtaaattttgtcagctattagtaaatgccacactgctggcacacagagaaaagagcttgtctgctaaatgagtcttgtctgtttttgcaaacaagggataaacatatagagacagacaaattggaaggaacaatttgcaagccacatgttctggtgactttcactcactcatcaaaggcaaggagctctcctcctccaatgtatctatctatctctagctcaagatatctggcttgccattctcatagcttgccagtttctgatgagccaagggagctctgtgcgtcgtcagctctccagcccgggacagtgatgagggcaaggagccatgcttgtcaggttaggcgtcgttgttgtagcctccgtcgcagctttaactcttaagagagccaacagtggcaacagagatggccaagcaaggaaaggaaaagacaaaactcgctactctgaacatggggagaaagaagaagagaaggaagaggttaaaacaatcagcggcataatcaattcagctctttcagatgatgacgacatgctctccgagatcgagagcctcctatcaggggagattgacatccccctaccaagtgacaggtttgacgtcaaagaacgctcttggtacaacagtgttaactccgagctggagaggctgcgtggacttgtgcgtgagctggaggagagggaagtgaagcttgagggagagctgctggagtactatggcctcaaggaacaggagactgatgttgtagagctacacagacagctcaagatcaagatggtggagatcgacatgctcaaaatgaccatcaactcgctgcaagaggagaggaagaagcttcaggatgacgtcgcccgtggcacaggagccaagagggagctggaggctgcgaggaacaagatcaaggagctgcagcgacagatacagatggaggcgaaccagacgaaagggcagctgatgcttctaaagaaccaggtgattgcgctgaagtccaaggaggaggaggcagccatcaaggacgcagaggtgcagaggaagctgaagaagctcaaggagctggaagtggaggtagttgagctgaggaggaagaacaaggagctcttgtatgagaaaagggatctcatcgttaagctggatgcagcacaaggaaaaataacagagagtgatgtagtttcccatgcaagagaggagatcaacaagctgaggcatgtaaatgaagaccttaccaagcaagtagaaggcctacaaatgaacagattcagtgaagtagaagagttggtttacctgcgttgggttaatgcttgtctgagatatgagctccgcaactaccaggcaccatctgagaaaatttctgctcgttaccttaacaagaccctgagcccaaaatcgcgtgagagggccaaacttctaatgctggaatatgcaggatcagaacgaggacagggcgacactgaccttgaaactgcttcttctgcaccttcttcacccagaagcgaagacttggacaatgtttcagttgacagttcttctagcagatacagcttctttggcaaaaggcccaatctgatgcaaaagctcaagaagtggggaaggggcaaggatgatgaaagcagattagcttcaccgacacagttcttcactagtgactccccaaagagcgccagccagaaaccaaaggggcccctagaggctctcatgctcagaaatgcaggagatggtgtgggcattacaacctttggaaagagggaacaggatcccagtgatatcatggatgaggcaaatgttgcatcttcattccatttgatgtcaaagactgtacaaggttttgctgatgacaagtatcccgcttacaaagataggcataaacttgccacagaacgggagaaggtaataaaagagaaagccgagaaagctagggtacaaagatatggcggtgtcaacagttcaggtattgtgccatctccaagatctgcactccctccaaaacttgctcaaataaaggaaaaggctcctacagctaatgctgaatccagtgaccaacctagtgataaccagaacaaccctctagttgtgacacaactgaaacttgcaaatattgagaagagagctccaagagttcctaggccacctcctgcaccatcagccactgccaacactgcaagtgcgttgtctccaccgccgccacgcccgccaggtgcacctcctccaccaccgcctcctggcaaacctggtggcccgccaccgccgccaccaccccctggttccctacctaggaatcttgctggtggtgacaaggtacaccgtgctccagaggttgtagagttttatcaaagtctcatgaagcgtgaagccaagaaggacacaacttctctgggatcaacaacatcaagtgcctttgatgtgagaagcaacatgattggagagattgagaatagatcaacattcctcttagctgtcaaagcggatgtggagacacaaggagactttgtcgagtctctagcaaatgaggtccgagcagcaagttttgtaaatatcgacgatgttgttgcatttgtaaattggcttgatgaggaactatccttcttggtcgatgagcgggcagtactaaagcactttgattggccagagagcaaaactgatgcactaagagaggcagcctttgagtatcaagacctgctaaaattagaacataaggtttcgtcgtttactgatgatccaaagcttgcatgtgaagaagctctcaagaagatgtattccttgcttgaaaaagtggagcagagtgtttatgcgctacttcgtactagagacatggccatatcacgctacagggagtacggactaccggtggattggctgtctggttccggggtagttggcaagatcaaattggcatctgttcagctggcgaagaagtatatgaagagggttgccacagagcttgatgccttgcaaggcaccgagaaagagcccaacagagagttcttgcttcttcagggtgtgagatttgctttccgagttcatcagtttgccggagggttcgatgaggaaagcatgaaggcatttgaagagctaagaagcaagatgtctacacagacatctgctccacaaatttccgatgtatagctctaaccatgatgcatttcacacttcttcactggtttctttgttgaaaggcaagattaattgagtagctaaaagtagtagaaaaagagaagtataaatcccaatataatattgctgtctccatcaagatgtatatggcaggaaagaatgataagtgtacagatgataaatacatgtattactagattagtgtgtgtatttatttgtatttaaaggcagcaagcgcattttaaaagcaaaagaagaactagtagtaccaatcagctagactgcttatagaagctactcctgaagaagctattctcaacactgaaaagaggcggaacaaaccttgagagctgaagtgggaatgccatatgctgatatgtcatatgcccaggcccagccctgtttaaaaaaggaaaaaggaaaatgagaaaggaaggtaatacagtaaaaaagaggaaatggcccatgcaggtctcgaacctgcgaccttcgcgttattagcacgacgctctaaccagctgagctaataggccttttatgttttaatgcatactcctccatccaataaaaaacgaatctcgtcgacttcgcgatgttgctcctctaccactcccggcaccgtgaagcggcgacgcgtc

SEQ ID NO: 4080 - DNA, 3528 bp, Brachypodium distachyon
ccaacagagaaaactgaaaagatgctcttctttgtgcccgtctctggagctgctgctcaactctatccgataaacatagatagacaaaattgcagagccaggcaagctgggatgaagaataaggccagccacatgttccagtggcgttggctagctcttgcaaagctaatatatggagaaggttcagccagccgcctgcctcggccattcacagacacacacaactacacaagagctctcagctgctgcccacttctcttgatgagcagagctagagctgcctccctcctgcggcttgaacagggatgagtggacggagtcatgctggtgagactgggattcgtggtcgtcgcatccgtcgccgccttcactcttaagcgaggaagaggacctaacaaagacaatggccaagcaaggaaaaggaaggacaaggctaggagttctgaacatggggagaaagaagaagagaaggaagaggttaagacgatcagcggcataatcaactccgtagaagacgacgacgatgatatgttctcggagatcgagagcctcctgtcaggggagatcgacattccgataccaagcgacaggttcgacgtcaaagaacggtctcggtacaatgcgcacatggccaacaacggggccgagatggagcggctgcgtggcctggtgagggagctggaggagagggaggtgaagctcgaaggtgagctgctcgagtactatggcctcaaggagcaagagactgacgtcactgagctgcagaagcagcttaagatcaagacggtggaggtcgacatgctcaacatcaccatcagctcgctgcaagcggagaggaagaagctgcaggacgacgttgtccgcggcgcagcaaccaagaaagagctcgaagcgtcgaggagcaggattagagagctgcagaggcagatacagatggaggcaaaccaaacaaaaggccagctgatgctgctgaagcagcaggtaatggggttgaaggccaaggaagaagaggtggccaagaaggacgcagagatcgaacaaaagctgaagaagctcaaggagctggaagtggaggtgcttgagctcaggaggaagaacaaggagctgttgtatgagaagagggatctcatagtgaagttggatgcagcacaaggaaaaataacagagagtgatgtagttgcccatgcaagagaggagatcagcaatttaagacatacaaatgaggacctaacgaagcaagtcgaaggcctacaaatgaatagattcagtgaagtagaagagctggtgtacctgcgttgggtcaatgcttgtctgagatttgagctccgcaactaccagacaccatctgggaaaatctctgcacgcgacctcaacaggacgcttagccccaaatcacaggcgagggccaaacagctaatgttggaatacggatctgaacgaggtcagggtgacacagacctcgatagtgcttcttctgcaccttcttcccccagaagcgaagacttcgacaccgtttcaatcgacagctcttccagcagatatagcttcttaagcaaaaggcccaatctgatgcaaaaacttaagaagtggggaaggagcaaggatgacagcagcaatttatcatccccgacacaatccctgacaagtggctctccaaagaggagccaaaaacctaaaggccccctggaatctctcatgctcagaaatgcaggagatggtatgtccataacaacgtttggaaagagggagcaagattccagtgacatactggatgaggcaaatgttgcatcttctttccaattgatgtcaaagaatgtcgaaggctttgctgatgagaagtatccagcttataaagaccggcataagcttgctacagaacgggagaaggcaataaaagagaaggccgaacaagctagagcacagaggtttggtggtggctatagttcagctcttgttccctctccaaaagctgcactccccccaaaacttgcacaaataaaggagaagaaggtccctgcagttaatgctgaatccggcgaccaatctagtgataaccagaacaaccccctggcggtgacccagttgaagcttgcacaaattgagaagagagctccaagagtgccccgtccacctcccacggcatcagccattgcttctggacctaccaatactgcaagcggtgcacctccgccgccacgcccacctggtgcacctcctcctccaccacctcctgggaaacctggcggcccaccgccaccgccgcctcctcctgggtctctatccaggagcctcgctggtggtgaaaaggtacaccgtgctccggaggtcgtggagttttatcagagtctcatgaagcgtgaagctaagaacacaacctctttgggatcaaagacatcaagtgtttctgataacagaagcaacatgatcggagagattgagaacagatcgacattcctcttagctgtcaaagctgatgtggagacacaaggagactttgtcgagtctctagcaagtgaggtccgagcagcgagattcgtaaatattgatgatgttgttgcctttgtacattggctggatgaggagttagcattcttggttgatgagcgagcagtcctgaagcactttgattggccagagagcaaaactgatgcattaagagaggcagcctttgagtaccaagacctgttgaaactagagaacaaggctacgtcctttgccgatgatccaaagcttccatgtgaagaagctctgaagaagatgtactcgttgcttgaaaaagtggagcagactgtctatgcccttctccgtacaagagacatgaccacctcacgctacaaggagtatggaataccagttgattggctatctgattctggaaaagttggcaagatcaaattggcatctgttcagctggcaaagaagtacatggagagggttgcctcagaacttgatgctttagaaggcactgagaaagagccaaatagggagttcttgcttctccagggtgtcagattcgctttccgagttcatcagtttgctggaggctttgatgcggacagcatgaaagtttttgaagagctgagaagcaagatgaccacacagacatccggtcctccggcatctgatacatgagtggaatcaggactctacacttaatctattctatttattgaggaggcatgattagttacactaaaaaaaagaaggcatgattagttggctagctaaaatgtacaaaagaggaactgtaaattccagtgttgtctcaaccaagttgtatatgtcaggaagggaatacaagtccacaggttctgattatatgtatactggtttttgtctttgtctattcggttactttgtaatcgggcagtttgtcaaaacttaaccacagcatgagtgacagagtgagatacctagctttcttgctgctgcctgctacttgtaagtttagtgctaactaaaacttatgttacagtgcaaagatctgcttcaatgtccaaagtaacctcatcactccatcaggtttaa

SEQ ID NO: 4081 - DNA, 3223 bp, Setaria italica
ggccagccacatgttctggtggtgtatgttcaccagctctcgcaggcaccgagtttcttctccaatccatcttcaggctaaacatacgaagagagtttagccggctaggccaatcatacctgctccagctctgcttcgccatctttttgatgagtagaggctccccatctcggccctcctgccggttgaggccggcagagtgatgagtgatcggagtcatgctcgtgagattgggcttcgtcgttgtagcctccgtcgcagctttaactcttaagagagttaacagtgggggcaggcataataaagacaatggccaagcaagggaaaggaaggacaagacacaccattctgaacatggtgagaaagaagaagagaaggaagaggttaaaacaatcagtggcataatcaactcagcccggtccctagacgatgacgacgatgatatgctttctgagattgagagcctcctgtcaggagacattgacatccctataccaagcgatcggttcgatgtcaatggacggtcacagtacaacgctcacatggctaatgaggccgctgagatagacaggctgcgcagcctggtgagggagatggaggaaagggaggtgaagctcgaaggcgagctgctggagtactacggcatgaaggagatggagaccgacgttactgagctgcagaagcagctcaagactaagacagcggagatcaacatgctcaacaacaccatcaactcaatgcaggcagagcggaagaagctgcaggatgaggttgcgcgtggagcggtagccaagaaagagcttgaagcggctacgagcaagattaaggagctgcagcggcagatgcagctggaggccggccagacaaaaggtcagctgatgctgctaaagcagcaggtcattggattgaaggccaaggaagaagaggcggcaaaaaaagaagccgaggtccagcgaaagctcaagaagctcaaggaattggaagtggaggtaattgagctcaggaggaagaacaaggagcttttgtacgagaagagagatctcatagtgaagttggatgcagcagaaggaaaaataacagagagtgatgtagtcgccaacgcaagagaagagataaacaagctgaggcatacaaatgaggacctcacaaagcaagtggaaggcctacaaatgaacagattcagtgaagtagaggagctggtgtacctgcgttgggtcaatgcttgtctgagattcgagctccgtaactatcagatgccatcagggaaagtctctgcacgtgatcttaacaagaccctgagccccaaatcacaggagagggccaaacagctgatgttggagtacgcaggatctgaacgaggtcagggtgatacagaccttgagagtgtttcttcaatgccttcttcacccggaagcgaagactttgacaatgtttcaattgatagttcttccagcagatacagcttcctaagcaaaaggcccaatctgatgcaaaagctcaaaaggtggggaaggagcaaggatgacagcagtagtttagcctcctcaatcagtggctctccaaggaggaaaccaagggggcccctggaagctctcatgcttaaaaatgcaggagatggtacagccataacgacgtttggacagagagatcctaatgacatcttggacgaggaaaatgtcgcatcctcattccaattgatgtcaaagacagtcgaaggttttgctgatgagaagtatcctgcttacaaagataggcacaaacttgcaactgaacgggagaatgcaataaaagagaaggctggacaagtaagagcacaaaggtttggcggtgggcatagttcagctcttatttcctctccaaaaggtgcacttccaccaaaacttgctcagattaaggagagagcccctgcagctaacgccgcatccagcgagcaatctagtgacaaccagaacaacatcctggtggtgagccagttgaagctcgccaacattgagaagagagcaacaagagtccccaggccacctccccctcgatcaaccactgcttcaggggctacaaatactgcaagtggagtacaaacaccacgtccaccaggtgcacctcctcctccaccaccacctcctgggaaaactggtggcccaccgccaccgccaccacctccaggtgctctacccaggagtgttgctgggagtgacaaggtacatcgtgcaccggagattgttgagttctatcaaagtctcatgaagcgtgaagcaaagaaggagacatctctaggatcagtgtcatccaatgtttctgacgccaggagtaatatgattggagagattgagaacagatcaacattcctcttggctgtcaaagctgatgtggagacgcaaggagaatttgtcgagtctctagcaagtgaggtccgagcagcaagctttgtaaatattgatgatgtcgttgcatttgtaaattggttggatgaggagttatccttcttggttgatgaacgagcagtgctaaagcatttcgattggccagagagcaaaactgatgcaataagagaagcatcttttgagtaccaagacctgataaagttacagaacaaggtttcatcctttaccgatgatcgacaacttgcatgtgaggaagctctcaacaagatgtattccttgcttgagaaagtggagcagagtgtctatgcactactccgtactagagatatggccgtctcacggtacaaggagtatgggatcccagttgactggctgtctgattctggagtagttggcaagatcaaattggcatctgtccagctcgcaaacaagtatatgaagagggttgcttcagaacttgatgcattgcaaggcaccgagaaagagcccaatagagaatttttgcttctccagggtgtgagattcgctttccgagttcatcagtttgccggaggcttcgatgcagaaagcatgaaagcttttgaagagctaaggagcaagatgactacacagacaccagctccacagatatctgaagtgtaatttgaacacaggattcgatacccatctagtttggaaagccatttttagtcgattagcttaagtgtacaaagagaagtgtaaatttcagtgttgcaatgtatatgctaagaagacaataaaggtcttcaggttttgttcatacgtataccagttttagtgaaagcgtatacctttttcatctgaaggttgtaaactgtaca

SEQ ID NO: 4082 - DNA, 3340 bp, Avena sativa
cgtcttgcaggctgaagatatggagaaagtttaagccccctgcccgccttgacaattcatacatgctcctcctattcccagctctgcttttgctagttctctgatgatcagagccggagcagcttgtacgtctctgccctgctgccggttgaggccggcatagtgatgagcggacagagtcatgcttttgcggttgggattcgtggtcgtagcaaccttcgccgcgttcactctcaagagagggaaggggcctaacaaaggcaatggccaagcgaacaagaagaaggataaggcttgggattccgaacatggggagaaagaagaagaggcggaagaggttaaaacgatcagcggcataatcaactcggccctgtcattggacgacgaagatgacgacgacatgttctcggagatcgagagcctgctgggcggggaggtcgacatcccgataccgagcgacaggttcgacgtcaaggagcggtcgcggtacaacgcgcacatggcgggcaacgccgccgagatggagaggctgcgcggcctggtgcgcgagctggaggagcgggaggtgaagctcgagggcgagctgctcgagtactacggcctcaaggagcaggagaccgacgtcaccgagctgcagaagcagctcaagatcaagaccgtggaggtcgacatgctcaacatcaccatcaactcgctgcaggccgagaggaagaagctgcaggaagacgttgtccgcggtgctgcggcgaagaaagagctcgaggcgtcgaggaccaggatcaaggagctgcagcgccagatacagatggaggcgaaccagacgaaaggacagctgatgctgctcaagcaacaggtgatggggctcaaggccaaggaggaggaggtggccaagaaggacgcggagatcgaacagaagctcaagaagctcaagaatttggaagtggaggtccttgagctgaggaggaagaacaaggagctgctctatgagaagagggacctcatggtcaagttggatgcagcacaagggaaaataacagagagtgatgtagttgcccatgcaagggaggagattaacaacctgagacataccaatgaggacctcacaaagcaagtggaaggcctacaaatgaatagattcagtgaagtagaagagctagtgtacctgcgttgggtcaatgcttgtctgagattcgagctccgcaactaccagataccatccggaaaaatgtctgcccgtgaccttaacaggacgcttagcccaaaatcacaggagagggccaaacagctgatgttggaatatggatccgaacgaggtcagggtgacactgaccttgatagtgctccttcttctgcaccttcttcccccagaagtgaagacttcgacaccatgtcaattgacagttcttccagcagatacagcttcctaagcaaaaggccaaacctgatgcaaaaactcaagaagtggggaaggagcaaggatgacagtagctatttagcatctccgacacggtccctgaccagtggctctccaaagaggagccagaaaccaaagggccccttggaatctctgatgatcagaaatgcaggagatggtatctccattacaacatttggaaagagggagcaagattctggtgaaatagatgacgctaatgtcacatcttcattccaattgatgtcaaagagtgtggaaggctttgctgacgagaagtatcccgcttacaaagaccgccataagcttgctacagaacgggagaaggcgataaaagagaaggccgagcaagctagagcacaaaggtttggtggtggctttagctctgctctagtcccctccccaagagctgcactccccccaaaacttgctcaaataaaggagaagaaggtccctgcaattaatgctgaaaccggtgagcaaactagtgataaccagaacaaccccctggcggtcacccagttgaagcttgcccaaattgagaagagagctccaagagtcccccgtccacctcccacggcatcggccgttgcttcaggtgctaccaacactgcaggtggagctccgctgccgccacgcccaccaggtggacctccgcctcctccaccacctcctggaagacctggtggtccaccacctcccccaccgcctcctggttctctatccaagagccctgctggtggtgacaaggtacaccgtgctccggaggtcgtggagttctatcagagtctcatgaaacgtgaagcaaagaacacaacttctttgggatcaaaaacatcaaatgtttccgataacagaagcaacatgatcggagagattgagaacagatcaacattcctcttagcagtcaaagctgacgtggagacacaaggagattttgtcgagtctctagcaggcgaggtccgagcagcaagattcgtgaatattgatgatgttgttgcatttgtacattggctggatgaggaattatctttcttggttgatgagcgagcagttctaaagcattttgattggccagagagcaaaactgatgcattaagagaagctgcttttgagtatacggatctgcaaaaattagaaaacaaggctacatcctttgccgatgatcctaaaattccatgtgaggaagctctgaagaagatgtattcgctgcttgaaaaagtggagcagagtgtttatgcactgcttcgtacaagagacatgaccaccgcacgctacaaggagtacggaataccagttgactggctatctgattcaggaaaagttggcaagatcaaattggcgtctgttcagctggcaaggaagtacatggagagggttgcctcagagctcgacgcaatgcaaggcaccgagaaagagcacaacagagagttcttgctcctccagggtgtcagattcgctttccgggttcatcagtttgccggaggcttcgacgcggacagcatgaaggttttcgaagagctgagaagcaagatgagcacgcagacacctgctccgccaacatctgaaacgtaaggcggagtcggggttccactcttctcttctccagacacgattagtttgctaggtaagctgtacagaacataactgtaaatcccaatcttgtctctgtcaagttgtatatgtcaagtctacaggttgtgatgatacgtataccatttttttgcccaagtttgtttgtgaggttgcattttgtgaccggaagtttgtaaagagtgaaccacagtaatgtaacaccttgtttttttgctactcctaatttggtagtaacatgtttacggaattacagtggagatttttactactcctaatttgataagaagtagagtgggaaatttctgcttgcca

SEQ ID NO: 4083 - DNA, 4286 bp, Panicum virgatum
ccaaaccaaaagacacaaggatgcagtcttccctccctgcaccatcagcatatggaaattttgtcagctaccaggtagtaccacactgctggacacagagagatgaaagcgacttgtgtgatacattgacttcgtttttgcaaggggataaacacagataggcaattgcagagccaatatgggatgaataaggccagccacatgttctggtggtgtatgttcggcgcccagtttctccttctccaatccattttcaggctaaagatatgaagagagtttagccggttaggccattcatacttgctttagctctgcttcagcgtctttttgatgagtagaggctccctgtctcggccctcctgccggttgaggccggcagagtgatgagttatcggagtcatgcttgtgagattgggcttcgttgttgtagcctccgtcgcagctttaactcttaacagagctaacagtcggggcaggcatcatagagacaatggccaagcaagggaaaggaaggacaagacacgcaattctgaacatggtgagaaagaagaagagaaggaagaggttaaaacaatcagcggcatgatcaactcagaccgatcgctagacgatgacgatgatgatatgctttccgagattgagagcctcctgtcaggagacattgacatccctataccaagggatcggttcgatgtaaatggacggtcagggtacgacgcacacatggctaatgaggccgctgagatagacaggctgcgcatcctagtgcgggagatggaggagagggaggtgaagctcgaaggcgagctgctggagtactacggcatgaaggagatggagaccgatgtcgctgagctgcagaagcagctcaagaccaaggcggtggagatcaacattctcaacaacaccatcaattctatgcaggcggagcggaagaagctgcaggatgaggttgctcgtggagaggtagccaaggaagagctcgaaaaggctaggagcaagattaaggagctgcagcggcagatacagctggaggctggccagacaaaaggtcagctgatgctgttgaaacagcaggttatcggattgaaggccaaggaggaagaggcggccaaaaaagaagccgaggtccagcgaaagctgaagaagctcaaggaattggaattggaggttgttgagctcaggaggaagaacaaggagcttctgtacgagaagagggatctcatagtgaagttggatgcagcagaagggaaaataacagagagcgatgttgtcgcccacgcgagagaagagataaacaagctgaggcatacaaatgaggacctcacaaagcaagtggaaggcctacaaatgaacagattcagtgaagtagaggagttggtgtacctgcgttgggttaatgcttgtctgagattcgagctccgcaactatcagacgccgtcagggaaagcctctgcccgtgatcttaacaggaccctgagccccaagtcacaggaaagggccaaacagcttatgttggagtatgcaggatctgaacgaggccagggtgatacagaccttgagagtgcttcttcaatgccttctacacctggaagtgaagactttgacaatgtttcaattgacagttcttccagcagatacagcttcctaagcaaaaagtctaatctgatgcaaaagctcaaaaaatggggaagcaggaaggatgacagcagtactttagcctccccaatcaatggctctccaatgaggaaaccaaagggtcccctggaagctctcatgctaaaaaatgcaggagatggtacagccataacaacgtttggacagagagatcccaatgacatcttggacgaggaaaatgttgcatcctcattccaattgatgtcaaagacagtcgaaggttttgcggatgagaagtatcctgcttacaaagataggcacaaacttgctactgaacgagagaaggcggtaaaagagaaggctgggcaagcaagagcacaaaggtttggcggtggtcatagttcagctcttgtttcttctccagaaggtgcactcccaccaaaacttgctcagattaaggagagagcccctgcagctaatgctgcatccagtgagcaatctagtgacaatcaaaacaacaccctggtggtgagccagttgaagctcaccaacattgagaagagagcaacaagagtccccaggccacctcccactcgatcaaccgctgcttcaggggctaccaatacttcaagtggagtacaaacaccacgtccaccaggtgcacctcctcctccaccgccacctcctgggaaaggtggccccccgccaccgccaccgcctccaggtgctctacccaggagccttgctgggggtgacaaggtacaccgtgcaccggagatcgtggagttctatcaaagtctcatgaagcgtgaagcaaagaaggagacatctctaggatcagtgtcatccaatgtttctgatgccaggagtaatatgattggagagattgagaacagatcaacattcctcttggctgtcaaagctgatgtagagacacaaggagaatttgttgagtctctagcaagcgaagtccgagcagcaagctttgtaaatattgatgttgttgttgaatttgttaattggttggatgaggagttatccttcttggttgatgagcgagcagtgctaaaacatttcgattggccagagagcaaaactgatgcaataagagaagcagcttttgagtaccaagacctgataaagttacaaaacaaagtctcatcctttaccgacgatccacatcttccatgtgaagaagctctcaagaagatgtattccttgcttgagaaggtggagcagagtgtctatgcactactccgcactagagacatggccatctcacgttacaaggagtatgggatcccagttgactggctgtctgattctggagtagttggcaagataaaattggcatctgtccagctcgcaaacaagttcatgaagagggttgcttcagaacttgatgctttgcaaggcaccgagaaagagcccaatagagagtttttgcttctccagggtgtgaggttcgctttccgagttcatcagtttgccggaggctttgatgcagaaagcatgaaagcttttgaagagctaagaagcaagatggctgcacagccatcagctccgcagataactgaggcgtaatttgaccacaggagtcaatacacatctggttcggaaagccatttttagttgattagcttacgtgtacaaaagggaagtgtaaatttcagtgttgcgtaggacaataaaagtcttcaggttttgttcatagatataccagttttagttaaagcgtatagcttttcatttaaaggttgcaaattgtacacaaacaatttctgaaaaaggaaacctagcaggtagccagataaatagttttgctacttttttttggactgagcatagttttgctactaatgagtgtctattcaggtagtctgaaactatggagattatttttttttctcgatccgaggcatcccccatttccatttcatcaatggaaataccgaacttacagagtatcagggacaagaagttcaagcgaggagagggggaggaaaagaggagggagtgtcggagcagggctgcatcagtccggcttgacacaacaggtttgacccaggcatcccaggtcgtagcctcagtaattattacagaccgagagttttagcacaaaagcagtaagcgaccaaaggatcgcacagaaagcacttcatcgcttcacaatcagcagtcgcccccgtccgaagtcgagtcgccttcttgaggagcaggaagaagtcttgccgcagatgaagccacattttgcctcgccaagatcctgtgagcgcacgccaggaggccttgcacctcatccagaatcttttcctgcatcatctcattgtagagacctgcccaatatgttaagaaagagcaaacatgtatcataatttccattgggcttttaagatattttttgtcaaagcaggctttgtttctgcatttccagattgcccaacaaaccaccgcacatccgctttgtgtaaacccgcttgtgtaaacggtttcacccctagggagccatttggctacccagttattatattgctgaatgctccgaggaatatcatttgcaccaaagcaaagaccaattatcccccaaatgatttttgcaattggacaatgaaagaacaggtgctcaatggattctgtatcatggcagaatgagcatgttggatccccaa

SEQ ID NO: 4084 - DNA, 4240 bp, Panicum virgatum
ctaccaggtagtactacactactggacacagagagatgaaagcgacttgtgtgatacatgacttcgtttttgcaaggggataaacgcagataggcaattgaagagccagtatgggatgaataaggccagccacatgttctggtggtgtatgttcaccagctctcgcaggcgccgagtttctcctccaacccatgttcaggctaaagatatgaagagtttagccggttaggccattcatacttgctttagctctgcttcagcgtctttttgatgagtagaggctccctgtctcggccctcctgccggttgaggccggcagagtgatgagtgatcggagtcatgcttgtgagattgggcttcgtcgttgtagcctccgtcgcagctttaactattaacagagctaacaatcggggcaggcatcataaagaaaatggccaagcaagggaaaggaaggacaagacacaccattctgaacatggtgagaaagaagagaaggaagaggttaaaacaatcagcagcatgatcaactcagcccgatcgctagacgatgacgacgatgatatgctttccgagattgagagtctactgtcaggagacattgacatccctataccaagggatcggttcgatgtaaatggacggtcagggtacaacgctcacatggctaatgaggctgctgagatagacaggctgcgcagcctagtgcgggagatggaggagagggaagtgaagctcgaaggcgagctgctggagtactacggcatgaaggagatggagaccgacgtcgctgagctgcagaagcagctcaagagcaagacggtggagatcaacattctcaacaacaccatcaattcaatgcaggcagagcggaagaagctgcaggatgaggttgctcgtggagcggtagccaaggaagagctcgacaaggctagaagcaagattaaggagctgcagcggcagatacagctggaggctggccagacaaaaggtcagctgatgcttctgaaacagcaggttatcggattgaaagccaaggaggaagaggcagccaaaaaagaagccgaggtccagcgaaagctgaagaagctcaaggaattggaattggaggttgttgagctcaggaggaagaacaaggagcttctgtacgagaagagggatctcatagtgaagttggatgcagcagaagggaaaataacagagagcgatgttgtcgcccacgcaagagaaaagataaacaagctgaggcatacaaatgaggacctcataaagcaagtggaaggcctgcaaatgaacagattcagtgaagtagaggagttggtgtacctgcgttgggtcaatgcttgtctgagattcgagctccgcaactatcagacgccatcagggaaagtctctgcccgtgatcttaacaggaccctgagccccaagtcacaggaaagggccaaacagcttatgttagagtatgcaggatctgaacgaggccagggtgatacagaccttgagagtgtttcttcaatgccttctacacctggaagtgaagactttgacaatgtttcaattgacagttcttccagcagatacagcttcctaagcaaaaggcctaatctgatgcaaaagttcaaaaagtggggaagcaggaaggatgatagcagtactttagcctccccaatcagtggctctccaatgaggaaaccaaagggccccctggaagctctcatgctaaaaaatgcaggagatggtacagccataacaacgtttggacagagagatcccagtgacatcttggacgaggaaaatgttgcatcctcattccaattgatgtcaaagacagtcgaaggttttgcagatgagaagtatcccgcttacaaagacaggcacaaacttgcaactgaacgggagaaggcgataaaagagaaggctgggcaagcaagagcacaaaaatttggtggtggccatagttcagctcttgtttcttctccagaaggtgcactcccaccaaaacttgctcagattaaggagagagccccagcagctaatgctgcatccagtgagcaatctagtgacaatcaaaacaacaccctggtggtgagccagttgaagctcgccaacattgagaagagagcaacaagagtacctaggccacctcccactcgatcaaccgctgcttcaggagctaccaatacttcaagtggagtacaaacaccacgtccaccaggtgcacctcctcctccgccgccgcctcctgggaaagctggtggcccaccgccaccgccaccacctccaggtgctctacccaggagccttgctgggggtgacaaggtacaccgtgcaccggagatcgtggagttctatcaaagtctcatgaagcgtgaagcaaagaaggagacatctctaggatcagtgtcatccaatgtttctgatgccaggagtaatatgattggagagattgagaacagatcaacattcctattggctgtcaaagctgatgtagagacgcaaggagaatttgttgagtccctagcaagcgaggtccgaggagcaagctttgtaaatattgatgttgttgttgcatttgttaattggttggacgaggagctatccttcttggttgatgaacgagcagtgctaaaacatttcgattggccagagagcaaaactgatgcaataagagaagcagcttttgagtaccaagacctgataaagttacaaaacaaggtctcatcctttaccgatgatccacaactttcatgtgaagaagctctcaagaagatgtattccttgcttgagaaggtggagcagagtgtctatgcactactccgcactagagacatggccatctcacgttacaaggaatatgggatcccagttgactggctgtctgattctggagtagttggcaagataaaattggcatctgtccagctcgcaaacaagtatatgaagagggttgcttcagaacttgatgctttgcaaggcaccgagaaagagcccaatagagagtttttgcttctccagggtgtgaggttcgctttccgagttcatcagtttgccggaggctttgatgcagaaagtatgaaagcttttgaagagctaagaagcaagatggctacacagccatcagctgcgcagataactgaggcataatttgaacacaggagtcaatacacatctggctcgaaaagccatttttagttgattagcttacgtgtacaaaagagaagtgtaaatttcagtattgcgtaggacaataaaagtcttcaggttttgttcatagatataccagttttacttaaagagtatagatcttttttttcatttaaaggctgtaaattgtacacaagcaatttctgaaaaaggaaacctagcaggtagccagatatattctaactgagcgtagttttgctgctaatgaatgtccattcgggtagtctgaaactatggagattattcttgtaaatgaaccttactaccttactggatttgcaattctgaagggattgcccagtcactacccacagacacacaatgctggaacagcagatctaacttcgaaaaatcataccaggacaaaagtccacctgaagtgaagggagaaggtcgaggttgcggcggcgagctccaccagaacggagaagcgaccgcttgcggtgggcgactttccctcgtttcgccgcctactagccgccggagcctcctcggctcgcggcagcgatcagagcggttaccggtggcgacgtcgctcctcagtggaagcaagtcactgcagagtgcagaggcggctcttccggattcaggacggtgaagcaaggcgacatcgttggttatttggacccttgacgactgggccgcaaattggccctatctcatttatcagcccacgtgcagtcgaaccaggatccagcccatctcaagtcgccccgccgcccgctcgaaatttcccccgcagccagtacacagcgaagtcagcctacgtcctacgatgtgaaattcagaggttccttttgcagcttcaactccaaccgagtctggaaggcgtatgctgaaccaaaacacaagtttttcacttggctactagtacaagaaaagattttgacagcagacaggttgcagcaaagaacgtggccttgcgatccattgtgccagctttgccgtcaggagcctgagacggcgactcacctatgcttgcactgcccattcgcgcagcgagtctgggatcacgttcaggcgtggacaggcaacaggg

SEQ ID NO: 4085 - DNA, 3206 bp, Triticum aestivum
agggccacggccattcacacgtgcttcttcctcctcccagctctgcttttgcagctgttctgtgatgagcagagccagagctgcctggccttgccctcctcctgccggtcgaggccggaacggacagtgatgagtgcacggagtcatgcttgtgagactcggattcgtggtattagcaaccttcgccgcgttcactcttaagcgaggcaaggggcctaagaaagacaatggccaagcgggcaagaggaaggagaaggctcggcatactggacatggggagaaagaagacgaggaggaagaggttaagacgatcagcggcataatcaactcggccccgtcggtggacgacgacgatgaggacgacatgttctcggagatcgagagcctcctgggcggggaggtcgacatcccgataccgggtgacaggtacgacgtcaaggagcggtcccggtacaacgcgcacatggccaacaacgccgccgagatggagcggctgcgtggcctggtgagggagctggaggagcgggaggtgaagctcgagggcgagctgctcgagtactacggcctcaaggagcaggagaccgacgtctccgagctgcagaagcagctcaagatcaagacggtggaggtcgacatgctcaacctcaccatcagctcgctgcaggccgagaggaagaagctgcaggaggacgtggcccgcggcgcggccgccaagaaggagctcgacgcgtccaggagcaggatcaaggagctgcagcggcagatacagatggaggccaaccagacaaaaggccagctgatgctgctgaagcaacaggtgatggggctcagggccaaggaggaggaggtggccaagaaggacgccgagatcgaacagaagctcaagaagctcaagaacctggaggtggaggtgcttgagctgaggaggaagaacaaggagctgctgtatgagaagagggatctcatggtgaagctggatgcagcacaaggaaaaataacagagagtgatgtagttgcccatgcaagagaggagatcaacaacctgagacatacaaacgaggacctgacaaagcaagtggaaggcctacaaatgaacagattcagtgaagtagaagagctggtgtacctgcgctgggtcaacgcctgtctgcgattcgagctccgcaactaccagacaccatctgggaagatctctgcccgcgacctcagcacgaagctcagcccaaggtcgcaggagagggccaaacagatgatgctcgaattcgggtctgaacgaggccagggcgacactgaccttgacagtgtctcctccgcaccttcttcccccagaagcgaagacttcgacaccgcctcgatcgacagctcttccagcagatacagcttcctaagcaagaggccgaacctgatgcagaaactcaagaagtggggaaggagcaaggatgacggcagctatctgtcatccccgtcctcgcggtccctgaccagtagctctccgaagaggagccagaaaccaaaggggcccctggagtctctcatgatcagaaatgcaggagatggtatgtccattacaacatttggaaaaagggaccaagaatccggtgacgcagatgatgcaaatgttgcatcttcattccagttgatgtcgaagaatgtggaaggctttgctgatgagaagtatcccgcttacaaagaccggcataagcttgcgacggaacgggagaaggcgatcaaagagaaggccgagcaagccagggcacaaaggtttggtggtggctatagttcagttctggttccctccccgagagctgcactccccccaaaactcgctcaaataaaggagaagaaggcccctgcagttaattctgaacctggtgagcaatctagtgatatcccgaacaaccccctggctgtcacccagttgaagcttgcccaaattgagaagagggccccaagagtcccccgtccaccacccacggcatcggccgctgctgcttcaggagctaccagtaccgcgagcggtgcaccaccgatgccgccacgcccaccaggtgcacctcctccaccaccacctccagggagacccggtggccctccgccgccaccgccgcctcccggctctctatccaagagccttgctggtggtgacaaggtgcaccgtgctccggaggtcgtggagttctatcagagtctcatgaaacgtgaagccaagaaggacaccacctctttgggatcaaaaacatcgaatgtttctgacaacagaagcaacatgatcggagagattgagaacagatcaacattcctattagctgtcaaagctgatgtggagacacaaggagaatttgttgagtccctggcgagtgaggtccgagcagcaagattcgcgaatatcgatgatgtcgttgcatttgtacactggctggatgaggagttgtcattcttggttgatgagagagcagtgctaaagcatttcgattggccagagagcaaaactgatgcattaagagaggccgcctttgagtatcaggacctggtgaaactagagaacaaggccacatcctttgtcgacgatccaaaacttccatgtgaagaagctctaaagaggatgtattcgttgcttgagaaagtggagcagagtgtttacgcacttcttcgtacaagagacatgaccaccgcacggtacaaggagtatggaataccagtcgattggctatctgattcaggaaaagttggcaagatcaaactggcatccgttcagcttgcaaagaagtacatggagagggtcacctcggagctcgacgcgctgcagggcaccgagaaagagcccaacagggagttcctgcttctccagggcgtcagattcgctttccgagttcatcagtttgccggaggcttcgacgcggacagcatgaaagtctttgaggagctgagaagcaagatgagcagcacgcagacacccgctccaccggcatctgacacatagtgcggagtcttcaggttaacttcgagggcacaactagttggctagctaaactgtacaaaagagaagtgtaaattccagtgttgtcttaatcaagttgtatatgtcaagtctacaggttcagatcatactataagcataccagattttttgtccaagtttgtttgttcggctgcaattctgtaaccgggcagtttgtaaaaagtgaaccacagtaatgagatactac

SEQ ID NO: 4086 - DNA, 3335 bp, Hordeum vulgare
gggtggtgttccttcgcccgctcctgcaggccaaagatatgagggaggtttagcagccccgaccacggccattcacacgtgctgctcctcctactctgcttttgcttgcagctggtctgtgatgagcagagccagagctgcctgcccctgcccctgcccacctcccgccggtcgaggccggaacggacagtgatgagtgcacggagtcatgcttgtgagactcggattcgtggtattagcaaccttcgcggcgttcactcttaagcgaggcaaggggcctcctaacaaagacaatggccaagcaaagaagaaggagaaggctcggggtactgcacatggggagaaagaagaggaggaggaagaggtcaagacgatcagcggcataatcaactcggccccgtcggtggacgacgatgaggacgacatgttctcggagatcgagagcctcctgggcggggagatcgacatcccgataccgggcgacaggtttgagcggtcccggtacaacgcgcacatggccaacaacgccgccgagatggagcggctgcgcggcctggtgagggagctggaggagcgggaggtgaagctcgagggcgagctgctcgagtactacggcctcaaggagcaggagaccgacgtgtccgagctgcagaagcagctcaagatcaagacggtggaggtcgacatgctcaacatcaccatcagctcgctgcaggccgagagaaagaagctgcaggaggatgttgcccgtggcgctgccgccaagaaggagctcgacgcgtccaggagcaggatcaaggagctgcagcgccagatacagatggaggctaaccagaccaaaggccagctgatgctgctcaagcaacaggtgatggggctcagggccaaggaggaggaggtggccaagaaggacgccgagatcgaacagaagctcaagaagctcaagaacctggaggtggaggtgcttgagctgaggaggaagaacaaggagctgctgtatgagaagagggacctcatggtgaagctggatgcagcacaaggaaaaataacagagagtgatgtagttgcccatgcaagagaggagatcaataacctgagacatacaaatgaggacctcacaaagcaagtggaaggcctacagatgaacagattcagtgaagtagaggagctggtgtacctgcgttgggtcaacgcctgtctgcgattcgagctccgcaactaccagacaccatcgggcaaaatctctgcccgcgacctcagcacgaagctcagcccaaagtctcaggagagggccaaacagatgatgctcgaatttgggtctgagcgaggccagggcgacactgaccttgacagtgtctcctcggcaccttcttcccccagaagcgaagacttcgacaccgcttcgatcgacagctcttccagcagatacagcttcctaagcaagaggccgaacctgatgcagaaactcaagaagtggggaaggagcaaggatgatggcagctatttgtcatctccgtcatcgcggtccctgaccagtagctctccgaagaggagccagaaaccaaagggccccctggaatctctcatgatcagaaatgcaggagatggtatgtccattacaacatttggaaaaaaggatcaagaatccggtgacatagatgatgcaaatgttgcatcttcattccagttgatgtcgaagaatgttgaaggcttcgctgatgaaaagtatcccgcttacaaagaccggcataagcttgcgacggaacgggagaaggcgataaaagagaaggccgagcaagccagagcacaaaggtttggtggtggctatagttcagctctagctccttccccgagagctgcacttccccccaaactcgctcaaataaaggagaagaaggcccctgcagttaatgctgaatccggcgagcaatctagtgatatcccgaacaaccccctggctgtcacccagttgaagcttgcccaaattgagaagagagctccaagagtcccccgtccacctcccacttcatcggccgctgcttcaggagctacgaatactgcaagtggtgggccaccgatgccgccacgcccaccaggtgcacctcctccaccaccacctccagggagacccggtggccctccgccgccaccaccgcctcccggttctctatccaagagccttgctggtggtgacaaggtacaccgtgctccggaggtcgtggagttctatcagagtctcatgaaacgtgaagccaagaaggacaccacctctttgggatcaaaaacatcaaatgtttctgataacagaagcaacatgattggagagattgagaacagatcaacattcctattagctgtcaaagctgatgtggagacacaaggagaatttgtcgagtccctagcgggtgaggtccgagcagcaagattcgcgaatatcgatgatgttgttgcatttgtacattggctggatgaagagttgtcattcttggttgatgagagagcagtgctaaagcatttcgattggccagagagcaaaactgatgcattaagagaggccgcctttgagtatcaggacctggtgaaactagagaacaaggctacatcctttgtcgatgatccaaaacttccatgtgaagaagctttgaagaggatgtattcgttgcttgagaaagtggagcagagtgtttacgcacttcttcgtacaagagacatgaccaccgcacggtacaaggagtatggaataccagttgattggttatctgattctggaaaagttggcaagatcaaactcgcgtcagttcagctggcaaggaagtacatggagagggtcacgtcggagctcgacgcgttgcaaggcacggacaaagagcccaacagggagttcttgcttctccagggcgtcagatttgccttccgtgttcatcagtttgctggaggcttcgacgcagacagcatgaaagtcttcgaggagctgagaagcaagatgagcagcacgcaggcacccgctccgccgacatctgacacatagcaaggactcatccggattccactctggttcattcggagggcacgattagttggctagctaaactgtacaaaagagaactgtaaattccattgttgtgttaatcaagttgtatatgtcaggtctacaggttctgatcatatactatacctatacccgttttttgtccgagtttgtctgtccggttgcatattgtaaccgagcagtttgtaaaaagtgaaccacagtaatgagataccactacctagtttttgctagttccaattcggcagtctgtaacggtgtaaatgtctgctcctgccttcaccct

SEQ ID NO: 4087 - DNA, 3265 bp, Zea mays
aggccactcgtacctgctgctctaactccggttcaccattttttgatgagtagagggggctccccgtctcggccctcctgccggttgaggccagcagagtgatgagtgaacggagtcatgcttgtgagattaggctttgtcgttgtagcctccgtcgcagctttaactcttcagagagctaacagtggggccaggcacagcaaagactatgtccaagcaaggaaaaggaaggataaggctaacaattctgaacatggggagaaagaagaagagaaggaagaggttaaaacaatcagcggcataatcaactcagcccgctcgctaggcgatgacgacgatgatatgctttccgagatcgaaagcctcctatcaggagacattgacatccctataccaagcgatcgcttcgacgttaatggacggtcacggtacaacaacgcttacatggctaacgaggcctctgagatagagaagctgcgcagcctggtgagggaaatggaagagagagaggcgaagcttgagggcgagctgctagagtactatggaatgaaggaaatggagactgacatcgccgaactgcaaaagcagctcaagatcaagacagcggagatcaacatgctcaacgacaccataaactcactgcaggcggagcggaagaagctgcaagatgacgttgcatgtggagaggttgccaataaagagcttgaagcggctagaggcaagatcaaggagctgcagcggcagatacagctagaagcaggccagacaaagggtcagctgatgttgctgaaacaacaggtcatcggattgaaggccaaggaggaagaggcggggaaaaaggaagctgaggttcaacggaagctgaagaagctcagggagttggaagtggaggtacttgagctaaggaggaagaacaaggagttgttgtatgagaagagagatctcattgtgaagttggatgcagctgaagggaaaataactgagagtgatgtagttgccaatgcaagagaagagataaacaagctgaggcatacaaatgaggacctcacaaagcaagtggaaggcctacagatgaacaggttcagtgaagtagaggagttggtatacctgcgctgggtcaatgcctgtctgagattcgagctccgcaattatcagactccatcagggaaggtctctgcacgtgatcttaacaggacactgagccccaaatcacaggagagggccaaacaactgatgttggagtacgcaggatctgaacggggtcagggtgacacagaccttgagagtgttgtttcttcaatgccttcttcacctggaagcgaagactttgacaacatgtcaattgacagttcttccagcagatacagcttcctaagcaaaaggtctaatctgatgcaaaaattcaaaaggtggggaaggagcaaggatgacagcagtagtttagcctcctccatcagtggctctccaaggaggaaaccaaagggcccactggaagctctaatgctaaaaaacgctggagatggtacagccataacaacatacggaaagagggatcccaatgatgtcttggatgacgaaaatgtcgcgtcctcattccaattgatgtccaagacagttgaaggttttgctgatgagaagtatcctgcttacaaagataggcacaaacttgcaactgaacgggagaaggctataaaagagaaggctgggcaagcaagagcacaaaggtttggtggtggccacagttcagctctaatttcctctccaaaaggtgcactccctccaaaacttgctcaaattaaggagagatcccctgcagctaatgctgaatccagtgagcaatccagtgacaaccaaaacaacaccctggtggtgagccagatgaagcttgccaacgttgagaagagagcaacaagagttcccagaccacctccccctcgatcaaccgctgcttcaggggctaccagtattgcaagtggagtacaaacgccacgggcaccaggtgcaccacctcctccaccaccacctccagggaaagttggtggcccaccgccaccaccgccacctccaggtgctctaccaaggaaccttggcgggggtgacaaggtacaccgtgcgccggagattgtagagttctatcaaagtctcatgaagcgtgaagcaaaaagggagacatctttagggtcaatatcatccaatgtatctgatgccagaagtaatatgattggagagattgagaacagatcaacattcctcttagctgtaaaagctgatgtggagacacaaggagaatttgttgaatctctagcaaatgaggtccgagcagcaagcttcataaatattgatgacgttgttgcatttgtaaattggttggatgaggagttgtctttcttggttgatgagagagcagtgctaaaacattttgattggccagagagcaaaacagatgcaataagagaagcagcttttgagtaccaggatctgataaagctacagaacagggtttcaacctttaccgatgatccacaacttgcgtgtgaagaagctctcaagaagatgtattctttgcttgaaaaagtggagcagagtgtctatgcactactccgtacaagagacatgaccgtctcacgctacaaggagtacgggatcccatttgactggctgtcagattctggagtagttggcaagatcaaagtggcatctgttcagcttgcaaacaagtatatgaagagggttgcctcagaacttgatgcattagaaggcactgagaaagagcccaatagagagtttttgcttctccagggtgtgaggttcgctttccgggttcatcagtttgctgggggctttgatgcagaaagcatgaaagcttttgaagagctaagaagcaagatgaccacacaggcatctgctccaccaatatctcaaggctgaagcataaattgagcacaggattcagcacacatctggtcttacttgctggagagtgatttttagttgtgtatattaagtgtacagactacagaagagagattcaaattccggtgttgtgtcaagcaagttgtatatgccaagataatacaagtcaggtttgttcatttgtataacagttttagctcaagcataacacttttcattttgaaggttgtaactgtaaacaggcagttccagaatcacagtagagatcagatgcatagttttgcaactgttttttttccagctgggcatgattttgctactacgactaataaaatgtcaaaaaacatccatt

SEQ ID NO: 4088 - DNA, 1776 bp, Sorghum bicolor
ggccgcttcactcttcacattcaccacacgccccgtgcgcgcgtacgcggctggccccgcccgcccggtcggtcggccggccggtgcgcccctggccctgccctcgcgcatccgaccatgcggacagcgcatttacgcagacgccggccgctcgccgggcgtccccagcgcccgcactgccgctttgcctaaagctctcctgagtcgcgcccgcgcatgcgccagcgccaccctgaccctgctgcctgccaacctcttaaaagcgtctcggcacttcggctccgcgtccgccaaggcaacccatcgaatactctcgccgcgcgcgcgcgctcgcctgccctcggaacctcccattattgccatcacgcgccgcgcgcacgcccgcacgcaaagggagctcgctgatcgagcgagctctagagctagcgagcttatccatccatccatccatcccaatcccatcatggcgagagccttccgcgcggcctccccgctgcccctgccgagctcgaggagcggcgccgccaccgcggtgacgaacggcggcgggagagggaacttcccgtggctaacgaagaagagctcgagcaagccggcggcgccgagcgggggcagccaagagagcaagggtgacgagcccgagggggcgaacaccacccccgccgccgccgccaccgggtccgtcgagcagtctccgtccccgccgtcgtcgtcgtcgaggaagcgcgcggacgcgctggcgcggctgcgggcggcgttcctggcggcgatcacgcacaggcgccggcgccggcagctggggtcctgcgtgacgggcaccatcttcggccggcggcgcgggcgcgtgcacgtcgcgctgcagacggacccgcgctccgcgcccgtgctgctggtggagatggccgcctactccacaggcgcgctcgtcagggagatgtcctcgggcctcgtgcgcctcgcgctcgagtgcgagaagacgccgctcgccgccggggagaagcggcgggggttgctggaggagccaacgtggcgcgcgtactgcaacggtcgcaagtgcgggttcgcggtgcggcgggagtgcggcgcggacgagtggagggtgctcggcgcggtcgagccggtgtccgtgggcgccggcgtgctcccggacgacgtcgccggcgccggagccgtggagggcgacctgatgtacatgcgggcaaggttcgagcgcgtggtgggctccagggactcggaggcgttctacatgatgaaccccgacggcagcggcggccccgagctcagcatctaccttctacgagtctgaccggcaccggcggacctggccggtggatcggacatggctgagaatgcttcagctttgcaattggattccgtctttgtatgtagtgtacgcatgcatgcatagtctggttgggctttttgtgtagttgtgttttttcacgtaatttggagaacgggatggatggcttggcaaaggtgtatgtacaatattactgatcacttacatggttattaaggttaattgctgtgggtgattggtctctagcgtgcgctggtgtggtgctaccgtgctagcaaactctccagtttgtgaaatctttctctttcggtctgtgataaaatggcttggaagaccggagatctctctctgtaccgtagaataaatttttctcgacgagacaggaagtagatcaaacatagaaacgcgatacaagcacgccaataggagattaccggtccaacagcctgagataagatgctaacgagaacgtg

SEQ ID NO: 4089 - DNA, 2225 bp, Setaria italica
ccaccacctgcgctctcacgtcaaacggtttcccccctcactccctccccggctttatcttttcctctgtcctgccttcttttaccatttccgcccgtcgccttccacctctcgcactcccctcccctcccccctttcaccccaacacaagcgcgcggcaacccactccccccttcttctactccactcctcgccgcactctttctccccgtgccctccgcttgaagcaaaactcgatctgtgttgctatattagccatcttcctcttctttgccgcggcggcggaggcggtggcggcggcattgcgggaaatggagaaggagaggaagcaggggttcttcgcggcgctgaaggaggaggtggtgcgggggctgtcgccggcgaggtcgagggggaagtcccctgcgccgccgcggagcgcgtcgccggccaggatgctgatcccgcggcggcgcaagtcggcggcgccgccgcagccgccgccggagaaggtgctgcagcagtacctcggggagcagctcatcgcgcgctccggcagcctgcggcccggcggggaggcgctggcgccgctcatcgaggggcccgacgccgagcgcctcgccgctggcgaccccgacgccgaggactccggccgccgggaggggttcgggaactgggtgcgcggccaccttacccgcacgccgtccatggcatccgctgccgccggccccggcggatcgggcgcctccttccgccggtccgacctccgcctcctcctcggcgtcatgggcgcgccgctcgcgcccatcccgtccaagctggctgagccgctgcccctcctctccatcaagggaacccccattgagtcgtcgtccgcgcagtacatcctgcaccagtacacggcggcgtcgggcggctacaagctgctgcagtcggtgcgaaacgcgtacgccatgggcaaggtgcggatggtggcgtccgagttcgagacggcgacgcgcgtcgtcaagaaccgcgggcccaccggccgcggcgccgcagccgtcgagcagggcggcttcgtgctctggcagatggcccccgacatgtggtacgtcgagctcgccgtcggcggcagcaaggtccacgccggctccaacggccgcctcgtctggcgccacaccccatggctcggcgcccacgccgccaagggccccgtccgcccccttcgccgcgtcctccagggcctcgatccgctgaccacggcggggctgttcgcggaggcgcggtgcgtgggcgagaagaaggtgaacggcgaggactgcttcatcctgaagctgaccgccgacccgcagacgctgaagctccgcagcgagggcccggcggagatcatccgccatgtcctattcggctacttcagccagcgcacgggcctgatcgtgcaaatcgaggactcgcacctgacccgcatccagccgcacgctggcggggacgccgtctactgggagaccaccatcagctccgccctggaggactaccgccccgtggagggcgtcatgatcgcgcactcgggccgctccgccgtcaccctgttccggttcggcgaggccgccatgagccacaccaagacgcggatggaggaggcatggagcatcgaggaggtggccttcaacgtccccggcctgtccgtcgactgcttcatcccgcccgccgacatccggtccggctccgtaggcgaggcgtgcgagctgccgtcccagtcccacggcgagcgcgccagggccggcgccgtgcacccgtcgcgcgtggccgccgtggagcgcgctcacgcccactacccccacagcgccaatgccggcgctgccggtgccggcggccgcggcgagaaggtcatgtggagagtggaagtgtgaggaatagttagcactttagcagctgcagcagtgctagagagaattgaatcgagtccaatctgtttatactagagtttaattttccccagcccagtcataaatcagtccaccaaatcactaacctctcttgcatctagagctggtttagatttctgtaaataggagcataaacgatcccaacccaggccgctgccctagtcctctcctccggctgcctggatgaatctttatcctctgaatgcagaagtttttagctctgtagtctgtaatgatcgtcgatcgaggtctcatggcctttcatgttactgccatttcttggtcgcggcatttgacagctgaaccctttgattcctc

SEQ ID NO: 4090 - DNA, 2311 bp, Sorghum bicolor
ttgcctgctcacctgcgctctcacgtcaaacggtttccccctccgcctccgctcggcctcccccccccctctctctctctctctcccctccggcctccgctttatcttttcctcggccctgcctgcttttaccatttccgcccgtcgccttccacctctcgcactccctctctccctttcactccaactcaagcgcagccggcaccgtacgtccccgactccccccttcttctactccactcctccgccgcactctctccatgccctccccgtgaagcgaaaaccaaatccttttcgctctattactagccctccctcgtcctctccttggtcgcggcggcggaggcggcattgcgagatatggagaaggagaggaagcaggggttcttcgccacgctcaaggaggaggtcgtgcgggggctgtcgccggcgaggtccagaggcaagtccccggcgccgccacggagcgcgtcgccggcgaggatgctgatcccgcgccggcgcaaggcgcccgcggctccgccgccgccgccgccggagaaggtgctgcagcagtacctcggggagcagctcgtctcgcgctccggcagcctgcgccccggcggggaggctctggcgccgctcatcgaggggcctgacgccgagcgcctcgccgccggcgaccccgacgccgaggactccggccgccgcgaggggttcggacactgggtccgcggccacctgacgcgcacgccgtctatggcctcctccgccgcagctggcggtggtggtcccggtgggtccagcggctcgttccggcggtccgacctgcgtctcctcctcggcgtcatgggcgcgccgctcgcgccgatgtcgtccaaaccggcggagccgctgcccctcctctccatcaagggaacccccattgagtcgtcgtccgcgcagtacatcctgcatcagtacacggcggcgtccggtggctacaggctgctgcagtcggtgcggaacgcgtacgccatgggcaaggtgcggatggtggcgtccgagttcgagacggcgacgcgcgtcgtgaagaaccgcgggcccagcggccgcggcgccgccgccgtggagcagggcggcttcgtgctgtggcagatggcccccgacatgtggtacgtcgagctcgccgtcggtggcagcaaagtccatgccggctccaatggccgcctcgtctggcgccacaccccctggctcggcgcccacgccgccaaggggcccgtccgccccctccgccgcgtcctccagggtctggatccgctgacgacggcgggtctgttcgcggaggcgcggtgcgtgggcgagaagaaggtgaacggcgaggactgcttcatcctgaagctgaccgccgaccctcagacgctcaagctgcgcagcgagggtccggcggagatcatccggcacgtgctgttcggctacttcagccagcgcacggggctgatcgtgcacatcgaggactcgcacctgacccgcatccagccacacgccggcggggacgccgtgtactgggagacgaccatcagctccgccctcgaggactaccgcgccgtggaaggcatcatgatcgcgcactcgggccgctccgcggtgaccctgttccggttcggcgaggccgccatgagccacaccaagacgcgcatggaggaggcctggagcatcgaggaggtggcgttcaacgtccccggcctgtccgtcgactgcttcatcccgccggccgacatccggtccggctccgtcggcgaggcctgcgagctgccgtcccagtcccagtcccacggcgagcgcgccaagaccggcgccgtgcacccttcgcgcgtggccgccgtggagcgcgcccacgcccacagcgccaatgctggcgccggcgccgccggccgtggagagaagatcatgtggagagtggaagtgtgagggatgtcatcggcatgcatcagttagcagcagcggcagagagaattgaaccgagtctaatctgtccataccagtagagtttaattttcgcgagcccaagtcatgaatcaatcaatcgaatcactaacctgttgcatctagtagagctggtttagatttctgtaaataggagcataaacgatcccaggccgtcgtcgctgatgtctggtcctcgggctggatgaatctttatcctctgaatgcagaagttttagcaccattttcccctaatccactcccgtgagtaccacttctgctactgatacagttccgttcgtgttactgccatttcttggtaacggcacttttgtgactgcctgattcctagtacagcaatgctgaa

SEQ ID NO: 4091 - DNA, 2070 bp, Hordeum vulgare
cccgccctttatcttttcctcttttccgccttctttttccgtctcatctctcatcacagtctcactcctcacccccgtccgtcgccgtctacctctcgcgctcgcttcacatttttccccactgccctccttgtactccactcctggccgcccgcactctccatgccctcctcgtgaagcaagcagatcctttcgcgtccctattagagcccccagccgagttccgcgatggacaaggagaggaagcagggcttcttcgccgctctcaaggaggaggtggtgcgcgggctctcgccggccaggtcccgggggaagaccccggccaggagcgcgtcgccggccagaatgctcatcccgcgccgtcgcaaggcgcagccgccgcccccagacaagcagcagcagcagcagtacctcccggagcagctcataccgcggtctggcagccttcggccgggtggcgaggtgctcgagccgctcattgagggccccgacgccgaccgcctcgccgccggggacttcgtcggagaggactccggccggcgggaggggttcgggcactgggtccgcggccacctcacgcgcaccccgtccatggcttccgcctccgccggccccggcggctcgagcggctcgttccggcactccgacctccgcctcctgctcggcgtcatgggcgcgccgctcgcgccaatctcgtccaacctggccgacccgctgcctctcctctccatcaagggcacccccattgagtcgtcgtccgcgcagtacatcctgcagcagtacatggcggcgtccggcggctacaagatgctgcagtcggtgaggaacgcctacgccatgggcaaggtgcggatggtggcgtccgagttcgagacggcgacgcgcgtcgtcaagaaccgcgggcccagcggccgcggcaccgctgccgtcgagcagggcggcttcgtgctctggacgatggcccccggcatgtggtacgtcgagctagccgtcggcggcagcaaggtccacgccggctgcaacggccgcctcgtctggcgccacaccccctggctaggcgcccacgccgctaaaggcccggttcgcccgctccgccgcgtcctgcagggtcttgatccgctgacgacggccggcctgttcgcggaggcgcggtgcgtcggcgagaagaaggtgaacggtgaggactgcttcatcctgaagctgtcggcggatccgcagacgctgaagctgcggagcgaggggccggcggagatcatccggcacgtgctgttcggctacttcagccagcgcacggggctcatcgtgcacatcgaggactcgcacctgacccgcatccagccgcactcgggcggcgacgccgtgtactgggagaccaccatcagctcgtgcctggaggactaccgcgccgtggaaggcatcgtgatcgcgcacgcgggccgctccgccgtgacgctgttccggttcggcgaggcggccatgagccacaccaagacgcggatggaggaggcctggagcatcgaggaggtggccttcaacgtcccggggctgtcggtggactgcttcatcccgcccgccgacatcaggtccggctccgtcggcgaggcctgcgagctgccgccgcacggcgaccgcgccaagtccatcgccgtgcaccccgcccgcgtcgcggcggccgcagagcgcgcccacgcgcacggtggcgccggcgccggaggccgcggcgagaagatcgtgtggagagtggaagtgtaatagtaataataaggagcggagcgaaggattagccgcagttgctagctagtcagcctgcctgctggtagagataaattaaattaaagcagtccaatttgttcatactactcctagagatcgagctcgattttcctctgcctgcccagtgagtgatcatcagacacttctactccagttctaactcgctgcttgcttcgggagcttcatccatccatccatttcctctgtaaataggagcataaatgttgattctgaggccgctcgtgtcatctttatcctctgaatgcaggaattttagtgcaaccttttctctgcaac

SEQ ID NO: 4092 - DNA, 2146 bp, Zea mays
ctctctcctccctccgctttatcttttcctcggccctgcctgctttttaccacttccgcccgtcgccttccacctctcgcactccctccctccctccctccctttcactccaactcaagcgcagcgctgtaccgtacgtccccgactccccccttcttctactccactcctcgccgcactctccatgcccaccccgtgaaggcgaagcgaaaaccaaaaacccctttgctacatcactttactagctagtcgtccccgttctctccttggtcgcggcgccggacgagggcgacggcattgtgagatatggataaggagaggaagcagggtttcttcgccgcgctcaaggaggaggtcgtacgggggctgtcgccgtcgaggtccagggggaagtccccggcgccgccgcggagcgcgtcgccggcgaggatgctgatcccgcgccggcgcaaggcgcccgcggctccgccgccgccgccgccggagaaggtgctggagcagtacctgggcgagcagctcgtcgcgcgctccggcagcctgcgccccggcggggaggctctggcgccgctcatcgaggggcccgacgccgagcgcctcgccgccggcgaccccgacgcggaggactccggccgccgcgaggggttcgggcactgggtccgcggccacctgacgcgcacgccgtccatggcctcctctgccgcaggtggtggtggtggtcccggcgggtcgagcggctcgttccggcggtccgacctccgcctgctcctcggcgtcatgggcgcgccgctcgcgcccatcccgtccaagacggcggagccgctgcccctcctctccatcaagggaacccccattgagtcgtcgtccgcgcagtacatcctgcatcagtacacggcggcgtccggtggctacaagctgctgcagtcggtgcggaacgcgtacgccatgggcaaggtgcggatggtggcgtccgagttcgagacggcgacgcgcgtcgtcaagaaccgcgggcccagcggccgcggcgccgccgccgtggagcagggcggcttcgtgctgtggcagatggctcccgacatgtggtacgtagagctcgccgtcggcggcagcaaggtccatgccggctccaatggccgcctcgtctggcgccacaccccctggctcggcgcccacgccgccaaggggcccgtccgccccctacgccgcgtcctccagggcctcgatccgctgaccacggccgggctgttcgcggaggcgcgatgcgtgggcgagaagaaggtgaacggcgaggactgcttcatcctgaagctgagcgccgacccgcagacgctgaagctgcgcagcgagggcccggcggagatcatccggcacgtgctgttcggctacttcagccagcgcacggggctgatggtgcagatggaggactcgcacctgacccgcatccagccgcacgccggcggggacgccgtgtactgggagacgaccatcagctcggccctggaggactaccgcgccgtggagggcgtcatggtcgcgcacgcgggccgctccgcggtgaccctgttccggttcggcgaggccgccatgagccacaccaagacgcgcatggaggaggcctggagcatcgaggaggtggcgttcaacgttccgggactgtccgtggactgcttcatcccgccggccgacatccggtcgggctccgtcggcgaggcctgcgagctgccgtcccagccccacggcgagcgcgccaggaccggcgccgccgtgcacccctcgcgcgtggccgccgtggagcgcgccggcactgctgccggcgccggaggccgcggcgagaaggtcatgtggagagtgcaagtgtgagaggaatggcgcgcatcagttagcagcggcagagagaattgaaaccgattgcccgattctaatctgtgtccatactagtagagttttaattttcgccagcccaagtcatgaatcaaatcaatcgaatgaatcacactaactcgctgcatctagtagtagagagctggtttaggtttctgtaaataggagcataaacgatcccaggccgtccgtcactgatgtcttgtcctcgggctggatgaatcttttatcctctgaaaacgcagaagttttagcaccatcctccgtt

SEQ ID NO: 4093 - DNA, 2255 bp, Brachypodium distachyon
atcaagggagcatgagaaagggcgcagacacgcgtttgctgtttcctactactcccgacatatcccccacacctcgctcggccagcctcttttccttttcacgtcaaacggttttcgccatctgcctttatcttttgctcttttccgcccttctttcccgtttctcagttcaccccagtcgccttctacctctcgcagtcgcttcacattttccccacacacactctcccccttcttctactccactcctcgccgcacactcccttccatgctgccctccccttgaagcaagcaagcaagcagacagatctctttgtttgtcctccttctgtcgccgctcgttggctggggctagcttcttgctttgcgtgaggcggagcttagagagctctgcgatggagaaggagaggaagcaggggttcttctccgcgctcaaggacgaggtggtgcgggggctgtcgccggcgaggtcccgcgggaagaccccggcgaggagctcgtcgccggcgagaatgctgatcccgcgccgccgcaaggcgccgccgccttcggagaagcagatgcggcaggaacagcagcagcagcagtacatcccggagcagctcatcccgcgctccggcagccttcggcccggcggcgaggcgctcgagccgctcatcgagggccccgacgccgaccgcctcgccgccggcgacttcgtcggcgaggactccggccggaggggggaggggttcgggcagtgggtccgcggccacctgacgcgcacgccgtccatggcgtccgccggccccggcgggtcaagcggctcgttccggcactcagacctccgccttctccttggcgtcatgggcgcgccgctcgcgcccatctcctccaacctcgccgacccgttgcctctcctctccatcaaggggacccccattgagtcgtcgtcggcgcagtacatcctgcagcagtacatggcggcgtcgggcgggcacaggctgctgcagtcagtgcggaacgcgtacgccatgggcaaggtgcggatggtggcgtccgagttcgagacggcgacgcgcgtcgtcaagaaccgcgggccgagcggccgcggcgccgccgccatcgagcaaggcggcttcgtgctctggaccatggcccccggcatgtggtacgtcgagctcgccgtcggcggcagcaaggtccacgccggctgcaacggccgcctcgtctggcgccacaccccctggctcggcgcccacgccgccaagggccccgtccgccccctccgccgcgtcctccagggtcttgatccgctgacgacggcggggctgttcgcggaggcgaggtgcgtgggggagaagaaggtgaacggcgaggactgcttcatcctgaagctatcggccgacccacagactctgaagctgcgcagcgaggggccggcggagatcatccggcacgtgctgttcggctacttcagccagcggacggggctgatcgtgcacatcgaggactcgcacctgacccgtatccagccgcactcgggcggcgacgccgtctactgggagaccaccatcagctcctccctggaggactaccgggccgtggagggcatcgtgatcgcgcacgccgggcgctccgccgtcacgctcttccggttcggtgaggccgccatgagccacaccaagacaaggatggaggaagcatggagcatcgaggaggtggccttcaacgtccccggcctgtccccagactgcttcatcccgcccgccgacatccggtcgggatccgtcggcgaggcctgcgagctccctccgacacacggcggcggcgaccgcgcggcaaacaagggcggcgccgtgcacccggctcgtgtcgccgccgtcgagcgctcctcccacggccacaatggtgctgtcggcgtcaacgtcggcgccgccgcgggaggtcgcggcgagaagatcgtgtggagagtacaagtgtagtaagccggagcccggagcagagggggagttttagctgcggttaattgttgctagtccgctagagaagaaattaaaccagtccaatttgttcatactagagtttgatctttcctctgcctagctagctagggatcaaatactaacccgttgcattctctaccgttgttcatcttcttctctgtaaataggtgcgtataaacgttctcagcaggccgctcatgtctttcctcctggcctggcctggatgaatatttatcctctgaatgcagaaaattcagtgcaacttttatt

SEQ ID NO: 4094 - DNA, 2059 bp, Zea mays
cccctcctctcctctcctctcctctctcctccctccgctttatcttttcctcggccctgcctggcgcctgctttcaccgtttccgcccgtcgccttccacctctcgcattccctccctcccgccctccctctcactacagctcaagcgcagcgcggcacggcaccctacgtccccgactccctccttcttccactccactactcgccgcgctccccatgccctccccgtgacgccgaaaccaaatcctttttgctcttccatattactagtcctcctctccttggtcgcggcggcggtgtaggtcggcggcattgcgagatatggagaaggagaggaagcaggggttcttcgccgcgctcaaggaggaggtcgtacgggggctgtcgccggcaaggaccagagggaagtccccggcgccgcggagcgcgtcgcccgcgaggatgctgatcccgcgccggcggaaggcgcccgcggctccgccgccgccgccgccgccgccggagaaggtgctgcagcagtacctgggggagcagctcgtcgcgcgctccggcagcctgttgcgccccggtggggaggctctggcgccgctcatcgaggggcccgacgccgagcgcctcgccgccggcgaccccgacgaggaggactccggccaccgcgaggggttcgggcactgggtccgcggccacctgacgcgcgcgccatccatggccgccgcaggtggtcccgacggctcgttccggcggtccgacctccgcctgctcctcggcgtcatgggcgcgccgctcgcgcctatcccgtccaagccggccgagccgctgcccctcctctccatcaagggaaccaccattgagtcgtcgtcggcgcagtacatcctgcaccagtacacggcggcgtccggtggctacaagctgctgcagtcggtgcggaacgcgtacgccatgggcaaggtgcggatggtggcgtccgagttcgagacggcgacgcgcgtcgtgaagaaccgcgggcccagcggacgcggcgccgccgccgtggagcagggcggcttcgtgctgtggcaaatggcccgcgacatgtggtacgtcgagctcgccgtcggcggcagcaaggtccacgccggctccaatggccgcctcgtctggcgccacaccccctggctcggcgcccacgccgccaaagggcccgtccgccccctccgccgcgtcctccagggcctggatccgctgaccacggcggggctgttcgcggaggcgcggtgcgtgggcgagaagaaggtgaacggcgaggagtgcttcatcctgaagctggccgccgacccgcggacgctgaagctgcgcagcgagggcccggcggagatcatccggcacgtgctgttcggctacttcagccagcgcacgggcctgatggtgcacatcgaggactcgcacctgacccgcatccagccgcacgccggcggggacgccgtgtactgggagaccaccaccagctccgccctggaggactaccgcgccgtggagggcgtcatggtcgcgcactcggggcgctcggcggtgaccctgttccggttcggcgaggccgccatgagccacaccaagacgcggatggaggaggcatggagcatcgaggaggtggcgttcaacgtccccggcctgtccgcggactgcttcatcccgccggccgacatccagtccggtccagtcggcgaggcctgcgagctgccgtcgtcccagtcgcgcgccaaggccgtcgccgtgcacccttcgcgcgtggccgccgtggatcgcgccactgccgccgccgcctgccgtggccggaagaccacgtggagagtggaagtgtgaggagtgagtggcatgcgtcagttattagcacttttagcagcggcagagtctaatctgtccatactagagtttaattttggccagtccagtcatgaatcaaacaatcgaattgaatcggatccactaacctgttgcgtctagtagatatctgtaaatagaaccgtgactgatcctgggcctggatgaatctttttatccctctgaccgcagaaattctagc

SEQ ID NO: 4095 - DNA, 1265 bp, Saccharum officinarum
tggtgcggtcccggtgctgaattcccggcttgaccgacgcgttcgcgcccagcctcttcctccccgccgtcgccccgctcgctcgcccgaagcagccgccggcaaaatggccccgaagagaggcggcaaggcgccggtccccgccaagaagaaggcggtggtgacgaacccgctgttcgagaagaggccgaagcagttcgggatcggcggcgctcttccgcccaagaaggacctccaccgtttcgtcaagtggcccaaggtcgtgcgcatccagcgccagcgccgcatcctcaagcagcgcctcaaggtgcccccggcgctcaaccagttcacacgtaccctcgacaagaaccttgcaacaaacttgttcaagatgcttcttaagtaccgccctgaggacaaagctgccaagaaggagaggcttttgaagagggcccaggctgaaaatgaggggaaaactgttgaggcaaagaaaccaattgttgtgaagtatggccttaaccatgtgacatacctcattgagcagagcaaggcccaactggttgtcatagcccatgatgttgatccgattgagctggtcgtgtggctcccagccctttgcaggaaaatggaggttccatactgcattgtcaagggaaaagcacgccttggatcgattgttcacaagaagaccgcatctgttctttgcctgaccaccgtcaagaatgaggacaagcttgagttcagcaagatcctggaggctattaaggccaacttcaacgacaagtttgatgaggtcaggaagaagtggggtggtggtatcatgggctccaaatcacaggcgaaaaccaaggccagggaaaagctgcttgccaaggaagctgcccagcggatgacctaagtcaggccctgttaaatttatcttgtactccttgcgatcgcgtgcaatcgtagcggttgtcagatctagttttgagagttttgctcctaagaccaaccatgctagaaagacatgtaagaattccaagtttttgttctgtaccacctagttcatgtgactcaaacttctataatggttatgaatctcctgtttatgtttatgcctgtaacgagtttagaattacattgtgtcatgttatcctgtgttgctgctggcaattggcaccgatttgacctccatagtacacaagaatgtacctcccgagccagatgaaatggcttgatttcttctaccctgtacttgtattgctagattcaccctgtatgtgatttgctgtgcaaatgtt

SEQ ID NO: 4096 - DNA, 1253 bp, Setaria italica
gctcgcttctccaccccacatctgacggccagggagcgtccaactcggcgcgaggcatcctttatagaaccacctctccgcctccaagctccactcgccgcctcccccttcccccgcgtcgccgtcgtctcccgttcggaacgccaagctcccctccggcgaaatggccccgaagcgaggtggtaaggcgccggtaccggccaagaagaaaacagtatgtggtaacgaaccctctgttcgagaagaggccgaagcagttcggtattggcggtgcgcttccgcccaagaaggacctgcaccggttcgtcaagtggcccaaggttgtgcgcatccagcgccagcgccgcatcctcaagcagcgcctcaaggtgccgccggcgctcaaccagttcacccggactctcgacaagaacctcgctaccaacctgtttaagatgcttctcaagtaccgccctgaggacaaggctgccaagaaggagaggcttttgaagagggctcaggctgaggctgaagggaaaaccgttgaggccaagaaaccaattgttgtgaaatatggccttaaccatgtgacctacctcattgaacagaacaaggcccagcttgttgtcatcgctcatgatgtggatcctattgagctggtcgtgtggcttccagccctgtgcaggaagatggaggtcccttactgcattgttaaaggaaaggctcgccttggatcgattgttcacaagaagactgcatctgtcctgtgcctgaccactgtcaagaatgaggacaagcttgagttcagcaagatcttggaggctattaaggcgaacttcaacgacaagttcgacgaggtcaggaagaagtggggaggtggcatcatgggctccaagtcgcaagcgaagaccaaggccagggaaaagctgctcgccaaggaggctgcacagcggatgacctagattatctatcccctgctgagtccgcctgtagttccttgtttcgacctgaagagctgatgagaattgtgcactcgtattgtggtttcctgaatctagtttcacatgttttcgtttgccagaccatgtctagaaactatgcaagacaagagtttacagtgtttatgagatgttttgagcctcgaagtctctttgacatgtgctctgctaacgtatctctctgcgagtctgcattgctgaggtttgctgaagacccatacatgatgttgcttgcaaaattgatttactacaaactctgcattgctgaggtttact

SEQ ID NO: 4097 - DNA, 1194 bp, Setaria italica
cgtggctccggagccgctcttataaaggcaccgcccggcttcaaagctaccgccgccgccaccactcgcctcttcctccccgccgccgccgctccgctcgctcgcagcagccgccggcaaaatggctccgaagagaggaggcaaggcgcctgttcccgccaagaagaagacagtggtgacgaacccgctcttcgagaagaggccgaagcagttcgggatcggcggtgcgctgccgcccaagaaggacctccaccgcttcgtcaagtggcccaaggttgtgcgcatccagcgccagcgccgcatcctcaagcagcgcctcaaggtgcccccggcgctcaaccagttcacccgtaccctcgacaagaaccttgcaacaaacttgttcaagatgcttcttaagtaccgccccgaggacaaagctgccaagaaggagaggcttttgaagagggcccaggctgaaactgaagggaaaactgttgaggcgaagaaaccaattgttgtgaagtatggccttaaccatgtgacttacctcattgagcagagcaaggcccagctggttgtcatagctcatgatgttgatccgattgagctggttgtgtggctcccagccctctgcaggaaaatggaggttccatactgcattgtcaagggaaaagcacgccttggatcgatcgttcacaagaagaccgcatctgttctctgcctgaccactgttaagaatgaggacaaacttgagttcagcaagatcctggaggctattaaggcaaacttcaacgacaagtttgatgaggtcaggaagaagtggggtggtggtatcatgggctccaaatcgcaggcgaaaaccaaggccagggaaaagctgctcgccaaggaggctgctcagcggatgacctaaatcccgtcctgttatatttatcttgtacttctcccgatcgtgtgcaatcatattgtggttgtctgatctggttttgagagttttgctcctgagacgtgctagaaagaaaaccttgtaagaattcaaagtttttgttcagcgctggttagttaatatgactccaacttctatatcagtaacgaatctctcgcttatatttatgcgcattactgcagagttcatgttagcatgacgtacaggctctgttataatggaaaacatcatgttcgcctgaacatgtgccattggcggcattattc

SEQ ID NO: 4098 - DNA, 984 bp, Pennisetum glaucum
cgtctcccgttcggaacgccaagctcccatccggcgaaatggccccgaagcgaggtggtaaggcgccagtgccggccaagaagaaacaagtggtaacaaaccctctgttcgagaagaggccgaagcagttcggtatcggcggtgcgcttccgcccaagaaggacctgcaccggttcgtcaagtggcccaaggtcgtgcgcatccagcgccagcgccgcatcctcaagcagcgcctcaaggtgccaccggcgctcaaccagtttacccgtactctcgacaagaaccttgctaccaacctatttaagatgcttctcaagtaccgccctgaggacaaggctgccaagaaggaaaggctcttgaagagggctcaggctgaggcggaagggaaaactgttgaggccaaaaaacctattgttgtgaagtatggtcttaaccatgtgacctacctcattgagcagaacaaggcccagcttgttgtgatcgctcatgatgtggatcctattgagctggtcgtgtggcttccagccctgtgcaggaagatggaggtcccttactgcattgttaaaggaaaggcccgccttggatcgattgtccacaagaagactgcatctgtcctgtgcctgaccactgtcaagaatgaggacaagcttgagttcagcaagatcttggaggctattaaggcgaacttcaatgacaagttcgatgaggtcaggaagaagtggggaggtggcatcatgggctccaagtcgcaggcgaagaccaaggccagggaaaagttgctcgccaaggaggctgcacagaggatgacctagattatctaatctatcctctgttgaatctgcccgtagttccttgtttcgacctgaaggctgatgtgtgcgctcgtattgtggtttcctgaatctagtttcacatgtttttgtttgccagaccatgtctagaaactatgcaagacaagagtttacagtgtttaagagatgtttt

SEQ ID NO: 4099 - DNA, 1090 bp, Panicum virgatum
ctcgcctcttcctccccgacgccgccgctccgctcgctagcaggtcgcagcagccgctgccgccggcaaaatggccccgaagagaggaggcaaggcgccggttcccgccaagaagaagacggtggtgacgaacccgctgttcgagaagaggccgaagcagttcgggatcggcggcgcgctgccgcccaagaaggacctccaccgcttcgtcaagtggcccaaggttgtgcgcatccagcgccagcgccgcatcctcaagcagcgcctcaaggtgcccccggcgctcaaccagttcacccgtaccctcgacaagaaccttgcaacaaacttgttcaagatgcttctgaagtaccgccctgaggacaaagctgccaagaaggagaggcttttgaagagagcccaggctgaaaatgaagggaaaactgttgaggcaaagaaaccaattgttgtgaagtatggcctcaaccatgtgacatacctcatcgagcagagcaaggcccagctggttgtcatagctcatgatgttgatccgattgagctggttgtgtggctcccggccctttgcaggaaaatggaggttccatactgcattgtcaagggaaaagcacgccttggatcgatcgttcacaagaagaccgcatctgttctttgcctgaccactgtcaagaatgaggacaaacttgagttcagcaagatcctggaggctattaaggccaacttcaacgacaagtttgatgaggtcaggaagaagtggggtggtggtatcatgggctccaaatcgcaggcgaaaaccaaggccagggaaaagctgctcgctaaggaggctgctcagcggatgacctaagtcttgccctgttaaatttatcctgtacttcttggatcgtgtacaatcatattgtcgttgtctgatctagtttttttgctcgtgagaccatgctagaaagaaaccttgtaagaattgaaagtttttgttcggtgcgggttagtttgtatgactcgactgctatattggtggtgaatcactccctccacttattctgtgcaattactagtttactactttaattgagttcatgtgagcctgatgatc

SEQ ID NO: 4100 - DNA, 1152 bp, Panicum virgatum
gcatcgggtgacaccactcgcctcttcctccccgccgccgctccgctcgctcgcaggtcgcagccgccgccggcaaaatggccccgaagagaggaggcaaggcgccggttcccgccaagaagaagacggtggtgacgaatccgttgttcgagaagaggccgaagcagttcgggatcggcggcgcgctgccgcccaagaaggacctccaccgcttcgtcaagtggcccaaggtcgtgcgcatccagcgccagcgccgcatcctcaagcagcgccttaaggtgcccccggcgctcaaccagttcacccgtaccctcgacaagaaccttgcaacaaacttgttcaagatgcttctgaagtaccgccctgaggacaaagccgccaagaaggagaggcttttgaagagagcccaggctgaaaatgaagggaaaactgttgaggcaaagaaaccaattgttgtgaagtatggcctcaaccatgtgacatacctcatcgagcagagcaaggcccagctggttgtcatagctcatgatgttgatccgattgagctggttgtgtggctcccagccctttgcaggaaaatggaggttccatactgcattgttaagggaaaagcacgccttggatcgatcgttcacaagaagaccgcatctgttctttgcctgaccactgtcaagaatgaggacaaacttgagttcagcaagatcctggaggctattaaggccaacttcaacgacaagtttgacgaggtcaggaagaagtggggtggtggtatcatgggctccaaatcgcaggctaaaaccaaggccagggaaaagctgctcgctaaggaggctgctcagcggatgacctaagacttgccctgttaaatttatcctgtacttcttagatcgtgtgcaatcatattgtggttgtctgatctagttttgagagtttttccccgtgagaccatgctagaaagaagaaaccttgtaagaattgaaattttttgttcggtgctggttagtttatatgacctgactgctatatcggtggtgaatctcccgcttattctgtgcaattactagtttactacattaatcgagatatgttagcctgatgatcattttctgctagattgattatattcttgagaaaaaagaacaagttagcctg

SEQ ID NO: 4101 - DNA, 1571 bp, Panicum virgatum
agccacgtgtcagcgaggtcgggacgacggagtgggcccgcctcgcggtgagctcactacctccacgtccatggcggaggaaatgaggcgcccgtctgccggcgggccggccggccggccatttggacgccggcgccgagtcatgacgtcgtttttcatgggccgcggcctgctacctaccgaagtaattcagccaagctcagtccgatacaccttccggctcggcccgtctaacacaatcgcgcggtggacctgtctgggccgttcggcccaaacgtgactgccgaaaccctaatcagcagaacggacggggaaaagcccaccgagcctccggcacgacgaatccaacgatccaggcgcgcccaacgtggctcgggagccgctcctataaaaccgcctcccggcttctaagcggccgccgccgccaccactcgcctcttcctccccgccgccgctccgctcgctcgcaggtcgcagcagccgccggcaaaatggccccgaagagaggaggcaaggcgccggttcccgccaagaagaagacggtggtgacgaatccgttgttcgagaagaggccgaagcagttcgggatcggcggcgcgctgccgcccaagaaggacctccaccgcttcgtcaagtggcccaaggtcgtgcgcatccagcgccagcgccgcatcctcaagcagcgccttaaggtgcccccggcgctcaaccagttcacccgtaccctcgacaagaaccttgcaacaaacttgttcaagatgcttctgaagtaccgccctgaggacaaagccgccaagaaggagaggcttttgaagagagcccaggctgaaaatgaagggaaaactgttgaggcaaagaaaccaattgttgtgaagtatggcctcaaccatgtgacatacctcatcgagcagagcaaggcccagctggttgtcatagctcatgatgttgatccgattgagctggttgtgtggctcccagccctttgcaggaaaatggaggttccatactgcattgttaagggaaaagcacgccttggatcgatcgttcacaagaagaccgcatctgttctttgcctgaccactgtcaagaatgaggacaaacttgagttcagcaagatcctggaggctattaaggccaacttcaacgacaagtttgacgaggtcaggaagaagtggggtggtggtatcatgggctccaaatcgcaggctaaaaccaaggccagggaaaagctgctcgctaaggaggctgctcagcggatgacctaagacttgccctgttaaatttatcctgtacttcttagatcgtgtgcaatcatattgtggttgtctgatctagttttgagagtttttccccgtgagaccatgctagaaagaagaaaccttgtaagaattgaaattttttgttcggtgctggttagtttatatgacctgactgctatatcggtggtgaatctcccgcttattctgtgcaattactagtttactacattaatcgagatatgttagcctgatgatcattttctgctggattgattatattcttgagaaaaaagaacaagttagcctgaagaa

SEQ ID NO: 4102 - DNA, 1144 bp, Zea mays
cgtggcgcggaaagacgctcctataaaaccgccgctcagtttcaaagctctcgtcgccgccaccactctcccagcctctcttactctccgccgtcgccctgctcgcccgaagcagccgccggcaaaatggccccgaagagaggcggtagggcgccggtccccgccaagaagaaggcggtggtgacgaacccgctcttcgagaagaggccgaagcagtttgggatcggcggcgcccttccgcccaagaaggacctccaccgcttcgtcaagtggcccaaggtcgtgcgcatccagcgccagcgccgcatcctcaagcagcgcctcaaggtgcccccggcgctcaaccagttcacacgtaccctcgacaagaaccttgcaacaaacttgttcaagatgcttcttaagtaccgccccgaggacaaagctgccaagaaggagaggctcttgaagagggcccaggctgaaaacgaggggaaaactgttgagtcaaagaaaccaattgttgtgaagtacggccttaaccatgtgacttacctcatcgagcagagcaaggcccagctggttgtcatagctcatgatgttgatccgatcgagctggtcgtgtggctcccggccctttgcaggaaaatggaggttccatactgcattgtcaagggaaaagcacgccttggatcgatcgttcacaagaagactgcatctgttctttgcttgaccaccgtcaagaacgaggacaagcttgagttcagcaaaatcctggaggctatcaaggctaacttcaacgacaagtttgatgaggtcaggaagaagtggggtggtggtatcatgggctccaaatcacaggcgaaaaccaaggccagggaaaagctgcttgccaaggaagctgcccagcggatgacctaagtcttgccctgttaaattaaaattttcttgtacttgcgatcgtgtgcaatcacggtggttgtcagatctagtttttgagagttttgcttcagggagagacaccgagtcaccgaccatgacagaaagacatcatgtaagaattcaaagttttggttctgtaccatctagttcatgtgaatcatcttctatgatggctatgatgtttatgcgcatagctatttcagaattaaatgtcattttatca

SEQ ID NO: 4103 - DNA, 1178 bp, Pennisetum glaucum
ccggttcccgccaagaagagaggaggcaaggcgccggttcccgccaccactcgcctcttcctccccgccgccgccaccgctccgctagctcgcagcagccgccggcaaaatggccccgaagagaggaggcaaggcgccggttcccgccaagaagaagccggtggtgacgaacccgctgttcgagaagaggccgaagcagttcgggatcggcggcgcgctgccgcccaagaaggacctccaccgcttcgtcaagtggcccaaggttgtgcgcatccagcgccagcgccgcatcctcaagcagcgcctcaaggtgcctccggcgctcaaccagtttacccgtaccctcgacaagaaccttgcaacaaacttgttcaagatgcttctaaagtaccgccctgaggacaaagctgccaagaaggagcggcttttgaagagggcccaggctgaaaccgaagggaaaactgttgaagcgaagaaaccaattgttgtgaagtatggccttaaccatgtgacctacctcatcgagcagagcaaggcccagttggttgttatagctcatgatgttgatccgattgagctagttgtgtggctcccagccctttgcaggaaaatggaagttccatactgcattgtcaagggaaaggcacgccttggatcgatcgttcacaagaagaccgcatctgttctctgccttaccactgtcaagaatgaggacaaacttgagttcagcaagatcctggaggctattaaggccaacttcaacgacaagtttgatgaggtcaggaagaaatggggcggtggtgtcatgggctccaaatcacaggcaaaaaccaaggcgagggaaaagctgctcgccaaggaggcagctcagcggatgacctaaatcctgtcatgttatattttatcctgtactcctgatcgtgtgcaatcatattttggttgtctgatctagttttgagggttttgctcctgagacgctagaaagaaaccttgtaagaattcaagtttttgttcggtgctgttagttaatatgactcaacttccatatctgtggtgaatctcctgcttttatctcataactacagagatcacgttagcctgaagatgtcaccataagcctccatttactaagaaaatttcattgttgtcagtatgaaatagtaaatttttagtaccct

SEQ ID NO: 4104 - DNA, 1200 bp, Oryza sativa
accagtcgccgccttcttcctcctcctcctccgccgcccgcctcgccgcctcccgagagctccaccctcgcctccggcgaaatggcaccgaagcgaggcggcagggcgccggtgccggcgaagaagaagacggagaaggtgaccaacccgctgttcgagaagaggccgaagcagttcggcatcggcggcgcgctgccacccaagaaggatctgcacaggttcgtgaagtggcccaaggtggtgcgcatccagcgccagcgccgcatcctcaagcagcgcctcaaggttcccccggcgctcaaccagttcacccgcaccctcgacaagaacctcgcaaccaacctgtttaagatgcttctcaagtaccgccctgaggacaaggctgccaagaaggagaggcttttgaagagggcccaggctgaggctgaagggaaaaccgttgaggccaagaagccaattgttgtgaagtatggtcttaaccacgtgacttacctcattgagcagagcaaggcccagctggttgtcatcgctcatgatgttgatccaattgagctggttgtgtggcttccagccctgtgtaggaagatggaggtcccttactgcatcgttaagggcaaagctcgccttggatcgattgttcacaagaagactgcatctgttctgtgcttgaccactgtcaagaacgaggacaagcttgagttcagcaagatcttggaggccatcaaggcgaacttcaacgacaagttcgacgaggtcaggaagaagtggggaggcggcgtcatgggctccaagtcgcaggcgaagaccaaggccagggaaaagcttctcgctaaggaggccgcccagcggatgacctaaattatattcgccccccgccgttgagctcgccctgtagtttcatttttcagtgtaatgattttgacgaggaactcagttagcaccatgcgacagtgctgtggttttctgaagtctagtttcatatattttctgttcaccggaccatgttgggaaactatgcaagatatcagagctttacaatgtttggtttctacgcagtttatgctgtgtgttttgctactcgtttgtttgccttggctgaacctgaacatagggcttgatcactttgatgccattttcagccttatcaaattttggtaaagttacctaaaaaaaagtggatatatttagtttgctgcctaa

SEQ ID NO: 4105 - DNA, 1206 bp, Oryza sativa
cacctctcgccgccgccaccgcctccccctccaccccccgcctcgccgtctcccgttcggaacaccaagctccagcgccccccctccggcgaaatggccccgaagcgaggcggcagggcgccggtgccggcgaagaagaagacggagaaggtgacgaacccgctgttcgagaagaggccgaagcagttcggaatcggcggcgcgctgccgcccaagaaggaccttcaccggttcgtcaagtggcccaaggtggtgcgcatccagcgccagcgccgcatcctcaagcagcgcctcaaggtgcccccggcgctcaaccagttcactcgcaccctcgacaagaacctcgcaactaatctgtttaagatgctcctcaagtaccgccctgaggacaaggctgctaagaaggagaggcttttgaagagggcccaggctgaggctgaaggtaaaaccgttgaggcaaagaaaccaattgttgtgaagtatggtcttaaccatgtcacatacctcattgagcagagcaaggcccaactggtcgtcattgctcatgatgtcgatccgattgagctggttgtgtggcttccagccctgtgcaggaagatggaggtcccttactgcattgtgaaaggaaaagcccgtcttggatcaattgttcacaagaaaactgcatctgtcctctgcttgaccactgtcaagaacgaggacaagcttgagttcagcaagatcctggaggctatcaaggcgaacttcaacgacaaattcgatgaggttaggaagaagtggggaggcggcgtcatgggatccaagtcgcaggcgaagaccaaggccagggaaaagctgctcgccaaggaggctgcccagcggatgacctaaattatagctcctgtagtttcatttttcagtcagattttgacgaggaactcgaattagcactgtacaaccgtgctgtggttttctgagtcttggtttcatatcttctctgttcaccggaccatgttgggatactatgcaattagtacaaccgtgcttcaaaaacctttttgtttcgttcctgttttagcggagtgactaagaaatagcttaaatagttgttcattcctgttttagcgaagtgactacggaatagcttaaattgttgttcagagctaaaaagaactttggctgtgtttagatccaaagtttgtatccaaacttcagtcctttttcatc

SEQ ID NO: 4106 - DNA, 1094 bp, Saccharum officinarum
catcctttatagaaccacctctcagcctccaagcgccagtcgccgcctcctccccctccctcgcgtcgccgtcgtctcccgttcggaacgccaagctcccctccggcgaaatggccccgaagcgaggtggcagggcgccggtgccggccaagaagaagacggataaagttgtgaaccctctgttcgagaagaggccgaagcagttcggcatcggcggagcgttgccgcccaagaaggacctgcaccggttcgtcaagtggcccaaggtcgtgcgcatccagcgccagcgccgcatcctcaagcagcgcctcaaggtgccaccggcgctcaaccagttcacccgcaccctcgacaagaacctcgccaccaacctgtttaagatgcttctgaagtaccggcctgaagacaaggctgccaagaaggagaggcttctgaagagggctcaggctgagaatgaaggaaaaactgttgaggccaagaaaccaattgttgttaagtatggccttaaccatgtgacttacctcattgagcagaacaaggctcagcttgtcgttatcgctcatgatgtggatccgattgaactggttgtgtggcttccagccctatgcaggaagatggaggtcccttactgcattgttaaaggcaaggctcgccttggatcgattgttcacaagaagactgcatcagttttgtgtctgaccactgtcaagaacgaggacaagcttgagttcagcaagatcttggaggctattaaggcaaacttcaacgacaagttcgatgaggtgaggaagaaatggggaggtggcatcatgggctccaagtcgcaggccaagaccaaggccagggaaaagctgctcgccaaggaggctgcgcagcggatgacctagattatccactgctgagtgtgccctgtagtttgacggggaagaactgataagcattgtgcactcgtattgtggttttctgaatctagtttcatatgtttctgtccaccagaccatgtttagaaactttgcaagacagagtttacagtgtttatgcgatgtctcagctctaagtacatcattttgggccccaggcaaactttgtcttta

SEQ ID NO: 4107 - DNA, 1073 bp, Panicum virgatum
gcctcccccatcttcccccgcgtcgacgtcgtctcccgttcggaacgccaagctcctctccggcgaaatggccccgaagcgaggtggcaaggcgccggtgcccgccaagaagaaaacagagaaggttaccaacccgctcttcgagaagaggccgaagcagttcggtatcggcggtgcgcttccgcccaagaaggacctgcaccggttcgtcaagtggcccaaggtcgtgcgcatccagcgccagcgccgtatcctcaagcagcgcctcaaggtgccgccggcgctgaaccagtttacccgtaccctggacaagaacctcgcaaccaacctgtttaagatgcttctgaagtaccgccctgaggacaaggctgccaagaaggagaggcttctgaagagggctcaggctgagaatgaagggaaaaccgttgaggctaagaaaccaattgttgtgaagtatggccttaaccatgtgacctacctcattgagcagaacaaggcccagcttgttgtcatcgctcatgatgtggatccgattgagcttgttgtgtggcttccagccctgtgcaggaagatggaggttccttactgcattgttaaaggaaaggctcgccttggatcgattgttcacaagaagaccgcatccgtgctgtgccttaccactgtcaagaatgaggacaagcttgaattcagcaagatcttggaagctattaaggcaaacttcaatgacaagttcgacgaggtcaggaagaagtggggaggcggcatcatgggctccaagtcgcaggccaagaccaaggccagggaaaagctgctcgccaaggaggctgcccagcggatgacctagattacctatcttctgctgaatccatctgtagttcctgtgtcgactgggaacagctgatgagcattgtgcactcgtattgtggttttctgaatctagtttcacttgttttcgttcgccagaccatgtctagaaactttgcaaggcaagagtttacagtgtttgagatgttttgagcctcgaagtctcttatcatgcacccctatgccaaagcatggggaacattgtcttc

SEQ ID NO: 4108 - DNA, 2808 bp, Panicum virgatum
actcagaaaatcgcttaactgaaagtggtggcgcagctgcccaagcattgataggggtgcatgagcaatagtagtacctacgagggttcatttgaaaagtatcaaaagtgggctcgaacaagaattactaccacactccacggaccactcgaacaaacggcccagcccatataagcccagccacctatccctcggccgcggcccaagtgtgcatcgcctaaaccctaatccctgcaccggacggctgagaccgccccgctcgcggcgccacccggcatctgacggccaaggagcgtccaactcggcgcgagacatcctttatagaaccacctctccgcgtccaagcgcccactcgccgcctccccccctcccccccgcgtcgccgtcgtctcccgttcggaacgccaagctccactccggcgaaatggccccgaagcgaggtggcaaggcgccggtgccggccaagaagaaaacagagaagattaccaacccgctctttgagaagaggccgaagcagttcggtatcggcggtgcgcttccgcccaagaaggacctgcaccggttcgtcaagtggcccaaggtcgtgcgcatccagcgccagcgccgtatcctcaagcagcgcctcaaggtgccgccggcgctcaaccagtttacccgtaccctcgacaagaacctcgctaccaacttgtttaagatgcttctgaagtaccgccctgaggacaaggctgccaagaaggagagacttttgaagagggctcaggctgagaatgaagggaaaaccgttgaggctaagaaaccaattgtcgtgaagtatggccttaaccatgtgacctacctcattgagcagaacaaggcccagcttgttgtcatcgcccatgatgtggatccgattgagcttgttgtgtggcttccagccctgtgcaggaagatggaggtcccttactgcattgttaaaggaaaggctcgccttggatcgattgttcacaagaagaccgcatccgtgctgtgccttaccactgtcaagaacgaggacaagcttgagttcagcaagatcttggaggctattaaggcaaacttcaacgacaagtttgacgaggtcaggaagaagtggggaggtggcatcatgggctccaagtcgcaggccaagaccaaggccagggaaaagctgctcgccaaggaggccgcccagcggatgacctagattatcttattctgagtcccgtctgtagttcctgtgccgacccggaaaagctgatgagcattgtgcactcgtattgtggtttctgaatctagtttcacatgttttcattcgccagaccatgtctagaaactttgcaagacaagagtttacagtgtttatgagatgttttgagcctcgaagtctcgtatcatgtgctgaggtttactgatgacaattcacgctgcattgctgagcgaaaattgttttctgagaactcttcattgctgaggtttactgaggtcattcacgctgttgctggcgatattattccatgttcttgccggtgctgttgcgtgcatgcagaaatggcttgactagacatcaagtgcaaaccaatttttgaagtgtttatcactaacttttggcctagatgacagttgcatacttgtttttagggcccacgtgtcaatttgctagtgggtcaggtgttggtaagtgcacgtggacccctctggagacgccgggctcgtccacaaggcccggatggagaagccattagcccaacgaaaagacaaggtcccgtgctctctaatcccgatctcgcgagtcacttacaaggaggagctccgtgaaggagacgggggcagaggttgatttccctgacagagttcaaggccagctccgaacccgcctccgtccagatccaggcctcctcccatccaccacagccgcactacctctcgccggcgtcctctcggacttggggttggttggcttccttcttcttcagctggaggccgggcgatgggggttgtcaggaggaggagcctcggatcgggggtgctcttggcccttgtgcctcgtggctctcctgcgcggtgccgcggccatccgcttcgtgatcgacagggaggagtgcttctcccacaacgacgactacgaaggggacaccgtccacgtgtccttcgtcgtcatcaaggcggagacgccgtggcattacacccaggacggcgtggatcttgtgattaaagatcctagaggtgatcaaatccatgattgtcgtgacaagattagcgataagttcgaattcatagttcacaagcgaggtgtccatcgcttctgcttcactaataagtcaccatatcatgaaacggtggacttcgatgtgcatattggccatttttcatattttgaccagcatgccaaagatgagcattttggccctttgtttgaacaaattgcgaagttggatgaggccctctacaacatccagttcgaacagcactggttagaggcccaaactgaccgccaagcaatattaaacgagaacatgagcaggagggcagttcacaaggcactcattgaatcagctggcctagttgcagccagtgttgtgcaggtctacctaatgcgccgcctcttctagcgtaagctggggagttctagggtctaattctgtggtagcagctctccttttgctgtcagcaaaacagaatgtccatatcgcattgtatcattgcaagattgggtacatactgttcaattgttcatgaattttgttccagaactatgtaattcactcgacaaagtgcagtgaagcattaaattttttaacatcccatttcaaa

SEQ ID NO: 4109 - DNA, 1095 bp, Panicum virgatum
cctccccccctcccccccgcgtcgccgtcgtctcccgttcggaacgccaagctccactccggcgaaatggccccgaagcgaggtggcaaggcgccggtgccggccaagaagaaaacagagaagattaccaacccgctctttgagaagaggccgaagcagttcggtatcggcggtgcgcttccgcccaagaaggacctgcaccggttcgtcaagtggcccaaggtcgtgcgcatccagcgccagcgccgtatcctcaagcagcgcctcaaggtgccgccggcgctcaaccagtttacccgtaccctcgacaagaacctcgctaccaacttgtttaagatgcttctgaagtaccgccctgaggacaaggctgccaagaaggagagacttttgaagagggctcaggctgagaatgaagggaaaaccgttgaggctaagaaaccaattgtcgtgaagtatggccttaaccatgtgacctacctcattgagcagaacaaggcccagcttgttgtcatcgcccatgatgtggatccgattgagcttgttgtgtggcttccagccctgtgcaggaagatggaggtcccttactgcattgttaaaggaaaggctcgccttggatcgattgttcacaagaagaccgcatccgtgctgtgccttaccactgtcaagaacgaggacaagcttgagttcagcaagatcttggaggctattaaggcaaacttcaacgacaagtttgacgaggtcaggaagaagtggggaggtggcatcatgggctccaagtcgcaggccaagaccaaggccagggaaaagctgctcgccaaggaggccgcccagcggatgacctagattatcttattctgagtcccgtctgtagttcctgtgccgacccggaaaagctgatgagcattgtgcactcgtattgtggttttctgaatctagtttcacatgttttcattcgccagaccatgtctagaaactttgcaagacaagagtttacagtgtttatgagatgttttgagcctcgaagtttcgtatcatgtgctgaggtttactgatgacaattcacgctgcattgctgagcgaaaattgttttttggg

SEQ ID NO: 4110 - DNA, 1121 bp, Hordeum vulgare
gaattcggcacgagccctcccccagcgtcgcctcccgttcggaaccccaagctcccccccgccgccggcgaaatggccccgaagcgaggcggcaaggcgccggtgccggcgaagaagaaggcggcggacaaggtggtgaacccgctgttcgagaagaggccgaagcagttcggcatcggcggggcgctgccgcccaagaaggacctccaccggttcgtcaagtggcccaaggtcgtgcgcatccagcgccagcgccgcatcctcaagcagcgcctcaaggtgcccccggcgctccaccagttcacccgcaccctcgacaagaacctcgccaccaacctgttcaagatgcttctcaagtaccgccctgaggacaaggcggctaagaaggagaggcttctgaagagggcccaggctgaggctgaggggaaaaccgttgaggccaagaagccaattgttgtgaagtatggtcttaaccatgtcacttaccttattgagcagagcaaggctcagctggttgtcatcgctcatgatgttgacccaattgagctggttgtgtggctcccagccctatgcaggaagatggaggtcccatactgcattgttaagggaaaatcacgccttggatcgatcgttcacaagaagactgcctccgttctgtgcctcaccactgtgaagaacgaggacaagcttgagttcagcaagatcttggaggctatcaaggcgaacttcaatgacaagttcgatgaggtcaggaagaagtggggtggtggtgtcatgggctccaagtcgcaggcgaagaccaaggccagggaaaggctcatcgccaaggaggctgcgcagaggatgaactaagcctagatttatatgtcagagcatatgccatgtagtttccctttagcagcactgtggaatcgtattgtggtttcctgattctctgttccgttcgccagacttatgcaaagatcagatgaggtttacccatgtttggattctatatagttttatgtcctgtttcggttcaatatttgttgtgtgtcatgtcttccgaacttagctgattttttgttaaactgtaatgacgaccagctcagtctgtttgtgaatttaattaaaattgcatg

SEQ ID NO: 4111 - DNA, 1079 bp, Cenchrus ciliaris
  misc_feature (260)..(260): n is a, c, g, or t
  misc_feature (719)..(719): n is a, c, g, or t
ctcctctccgtcttcgccggccgtctcttcgctcgatccaagcagccgccggcaaaatggccccgaagcgaggcggcaaggcgccagttccggcgaagaagaagccgacggtgacgaacccgctgttcgagaagaggccgaagcagtttggtatcgggggcgcactcccgccaaagaaggatctccaccgcttcgtgaagtggcccaaggtcgtgcgcattcagcgccagcgccgcatcctcaagcagcggctcaaggtncccccagcactcaaccagttcacccgtaccctcgacaagaaccttgcaacaaacttgttcaagatgcttcttaagtaccgccctgaggacaaagctgccaagaaggaaaggcttttgaagagggcccaggctgaagctgaagggaaaactgttgaggcaaagaaacctatagttgtgaagtatgggcttaaccatgtgacttacctcattgagcagaacaaggcccagcttgttgtcattgctcatgatgttgatcctattgagctggttgtgtggcttccagccctttgcaggaaaatggaggttccatactgcattgtcaagggaaaagcacgccttggatcgattgttcacaagaagaccgcatcggttctatgcctaaccactgtcaagaacgaggacaaacttgagttcagcaaggtcctggaggctattaaggcgaacttcaacgacaagttngatgaggtcaggaagaagtggggcggtggtgtaatgggctccaaatcacaggcgaaaaccaaggccagagaaaagctgcttgccaaggaggcagctcagcggatgacctaaatctagtcgcattacatttatcctgtatttcacccgagtagtgtgtcagccaaactatgatcgtctcgtcggatttagtttgaagtcatttttgtttgtagtagcagaagaaaagtgaaccctgtaaggattcattttttttgttttgctcagtgcctgctggtgcatatgactgtacttctcaatggatcaatctttcatgtcctacaactttctgtgctttcaagtatttgaaggtcagaaagctga

SEQ ID NO: 4112 - DNA, 1024 bp, Cenchrus ciliaris
  misc_feature (45)..(45): n is a, c, g, or t
  misc_feature (66)..(66): n is a, c, g, or t
  misc_feature (81)..(81): n is a, c, g, or t
  misc_feature (111)..(111): n is a, c, g, or t
  misc_feature (114)..(114): n is a, c, g, or t
  misc_feature (126)..(126): n is a, c, g, or t
  misc_feature (132)..(132): n is a, c, g, or t
  misc_feature (153)..(153): n is a, c, g, or t
  misc_feature (171)..(171): n is a, c, g, or t
  misc_feature (244)..(244): n is a, c, g, or t
  misc_feature (252)..(252): n is a, c, g, or t
  misc_feature (273)..(273): n is a, c, g, or t
  misc_feature (328)..(328): n is a, c, g, or t
  misc_feature (579)..(579): n is a, c, g, or t
  misc_feature (615)..(615): n is a, c, g, or t
  misc_feature (762)..(762): n is a, c, g, or t
  misc_feature (798)..(798): n is a, c, g, or t
  misc_feature (835)..(836): n is a, c, g, or t
  misc_feature (898)..(899): n is a, c, g, or t
  misc_feature (901)..(902): n is a, c, g, or t
  misc_feature (904)..(904): n is a, c, g, or t
  misc_feature (907)..(907): n is a, c, g, or t
  misc_feature (909)..(911): n is a, c, g, or t
  misc_feature (915)..(915): n is a, c, g, or t
  misc_feature (957)..(959): n is a, c, g, or t
gcagccgccggcaaaatggccccgaagagaggaggcaaggcgccngttcccgccaagaagaagccngtggtgacgaacccnctgttcgagaagaggccgaagcagttcggnatnggcggcgcgctnccgccnaagaaggacctccaccgcttngtcaagtggcccaaggtngtgcgcatccagcgccagcgccgcatcctcaagcagcgcctcaaggtgcccccggcgctcaaccagttcaccngtaccctngacaagaaccttgcaacaaanttgttcaagatgcttcttaagtaccgccctgaggacaaagctgccaagaaggagnggcttttgaagagggcccaggctgaaaatgaagggaaaactgttgaggcgaagaaaccaattgtcgtgaagtatggccttaaccatgtgacctacctcatcgagcagagcaaggcccagttggttgtcatagctcatgatgttgatccgattgagctggttgtgtggctcccagccctttgcaggaaaatggaggttccatactgcattgtcaagggaaaggcacgccttggatcgattgttcacaagaanaccgcatccgttctctgcctgaccactgtcaagaangaggacaaacttgagttcagcaagatcctggaggctattaaggcgaacttcaacgacaagtttgatgaggtcaggaagaagtggggtggtggtatcatgggctccaaatcgcaggctaaaaccaaggccagggaaaagctgctcgcnaaggaggctgctcagcggatgacctaaatcctgtcntgttatatttatcttgtacttctcccggtcatatttnngttgtctgatctagttgagggttttgctcctgagacgtgctagaaagagaccttccatatcnntnntnaanannncctncctttgtttatgctcactgatgtgcgggcacttttcgaatgnnncttaagggtttcactgttgtcagtatgaaatggttccctcttcggctagcctgtgactactccca

SEQ ID NO: 4113 - DNA, 1101 bp, Setaria italica
ctaaacacacaggtcaccgccgcccccctctccctccctccgtcctcgccggccgtctcttcgctcgatccaagcagccgccggcaaaatggccccgaagcgaggcggcaaggcgccggttccggcgaagaagaagccggagaaggtgacgaacccgctgttcgagaagaggccgaagcagtttggaatcgggggcgcactgccgccgaagaaggatctccaccgcttcgtgaagtggcccaaggtcgtgcgcatccagcgccagcgccgcatcctcaagcagcggcttaaggtgcccccggcactcaaccagttcacccgtaccctcgacaagaaccttgcaaccaacttgttcaagatgcttcttaagtaccgccctgaagacaaagctgccaagaaggagagacttttgaagagggcccaggctgaagctgaagggaaaactgttgaggcaaagaaaccaatagttgtgaagtatggccttaaccatgtgacttacctcattgagcagaacaaggcccagcttgttgtcattgctcatgatgttgatcctattgagctagttgtgtggcttccagccctttgcaggaaaatggaggttccatactgcattgtcaagggaaaagcacgccttggatcgattgttcacaagaagaccgcatcggttctatgcctaaccactgtcaagaacgaggacaaacttgagttcagcaaggtccttgaggctattaaggcgaactttaacgacaagtttgatgaggtcaggaagaagtggggcggtggtgtaatgggctccaaatcacaggcgaaaaccaaggccagggaaaagctgcttgcaaaggaggctgcgcaacggatgacctaaatatatttgtgttacatttatcctgtatttcacctgagtagtgtcagcatactatgatggtctcgtcagatctagtttgaagtcatttttgtttgtagtagacagaagaaaagtgaacactgtaagaattcagtattttgctcaatgcctgccactgcatacgactcaacttctcaatgggtcaatctttgatgtcctacaactttctgtgctttcaagtattttaaggtcagaag

SEQ ID NO: 4114 - DNA, 1165 bp, Leymus cinereus x Leymus triticoides
  misc_feature (17)..(17): n is a, c, g, or t
  misc_feature (28)..(28): n is a, c, g, or t
  misc_feature (56)..(56): n is a, c, g, or t
  misc_feature (927)..(927): n is a, c, g, or t
  misc_feature (981)..(981): n is a, c, g, or t
cccccctccacctcctnccccagcgtcncctcccgttcggaaccccaagctccccncgccgccggcgaaatggccccgaagcgaggcggcaaggcgccggtgccggcgaagaagaaggcggcggacaaggtggtgaacccgctgttcgagaagaggccgaagcagttcggcatcggcggggcgctgccgcccaagaaggacctccaccggttcgtcaagtggcccaaggtcgtgcgcatccagcgccagcgccgcatcctcaagcagcgcctcaaggtgcccccggcgctccaccagttcacccgcaccctcgacaagaacctcgccaccaacctgtttaagatgcttctcaagtaccgccctgaggacaaggcggctaagaaggagaggcttctgaagagggcccaggctgaggctgagggtaaaaccgtcgaggccaagaagccaattgttgtcaagtatggtcttaaccatgtcacttacctcatcgagcagagcaaggctcagttggtcgtcatcgctcatgatgttgacccaattgagttggttgtgtggctcccagccctgtgcaggaagatggaggtcccatactgcattgttaagggaaaatcacgccttggatcgatcgttcacaagaagaccgcctcagttctgtgcctcaccactgtgaagaacgaggacaagcttgagttcagcaagatcttggaggctatcaaggctaacttcaatgacaagttcgacgaggtcaggaagaagtggggcggtggcgtcatgggctccaagtcgcaggccaagaccaaggccagggaaaggctcatcgccaaggaggctgcgcagaggatgaactaagcctagccttataattatgtcagagcatatgccatgtagtttccctttcagtgtgtcctgattttgacgaggaactcnaacccttttagcagcactgtggaatcgtattgtggttttctgattctctgttcngttcgccagacttatgcaaagatcagatgaggtttacccatgtttgaattctatatagtttcatgtcttgtctagggtcaaagttggttgtgtgtgatgtcttccgaacttgctgaatttgggttaacgtgcgatgacgtccaggtcaatctgttggcaaatttggttaaactgagctgaaaaa

SEQ ID NO: 4115 - DNA, 1260 bp, Sorghum bicolor
gcttgcttgtccacctagcatccgacggccagggtgcgtccagctcggcgcgagtcatcctttatagaaccacctctccgcctccaagcgcctctagccgcctcctccccctacctcgcgccgccgtcgtctcccgttcggaacgccaagctcccctccggcgaaatggccccgaagcgaggtggcagggcgcctgtgccggccaagaagaagacggataaagtggtgaaccctctgttcgagaagaggccgaagcagttcggcatcggcggcgcgttgccgcccaagaaggacctgcaccggttcgtcaagtggcccaaggtcgtccgcatccagcgccagcgccgcatcctcaagcagcgcctcaaggtgccaccggcgctcaaccagttcacccgcaccctcgacaagaacctcgctaccaacctgttcaagatgcttctcaaataccggcctgaagacaaggctgccaagaaggagaggcttctgaagagggctcaggctgagactgaaggaaaaactgttgaagccaagaaaccaattgttgttaagtatggccttaaccatgtgacttacctcattgagcagaacaaggctcagcttgttgtcatcgctcatgatgtggatccgattgaactggttgtgtggcttccagccctgtgcaggaagatggaggtcccttactgcattgttaaaggaaaggctcgccttggatcgattgttcacaagaagactgcatcagtcttgtgtctgaccactgtcaagaacgaggacaagcttgagttcagcaagatcttggaggctattaaggcaaacttcaacgacaagttcgatgaggtgaggaagaagtggggaggtggtatcatgggctccaagtcgcaggccaagaccaaggctagggaaaagctgatcgccaaggaggctgctcagcggatgacctagattatccacttctgagtgtgcgctgtagttttgacgtggaagaactgataatcgttgtgcactcgtattgtggttttctgaatcaagtttcatatgtttctgtccaccagaccatgtttagaaactttgcaagacagagtttacagtgtttatgcgatgtctcagctagtatattattttgtgccccaggcaaccttgtttttatttgcctaagatcaactataatagtatctttatatctttatatattgatagagtgattttgataatgccctatgacagcttgtttaattatattttaaaatattgccacctttt

SEQ ID NO: 4116 - DNA, 1232 bp, Sorghum bicolor
ccagggcgcgtccagctcggcgcgagtcagcctttatagaaccacctctccgcttccaggcgccagtcgccgccgcctccccctccctcgcgtcgccgtcgtctcccgttcggaacgccaagctcccatccggcgaaatggccccgaagcgaggtggcagggcgcctgtgccggccaagaagaagacggataaagtggtgaaccctctgttcgagaagaggccgaagcagttcggcatcggcggcgcgttgccgcccaagaaggacctgcaccggttcgtcaagtggcccaaggtcgtgcgcatccagcgccagcgccgcatcctcaagcagcgcctcaaggtgccaccggcgctcaaccagttcacccgcaccctcgacaagaacctcgctaccaaccttttcaagatgcttctcaaataccggcctgaagacaaggctgccaagaaggagaggcttctgaagagggctcaggctgagactgaaggaaaaactgttgaagccaagaaaccaattgttgttaagtatggccttaaccatgtgacttacctcattgagcagaacaaggctcagcttgttgtcatcgctcatgatgtggatccgattgaactggttgtgtggcttccagccctgtgcaggaagatggaggtcccttactgcattgttaaaggaaaggctcgccttggatcgattgttcacaagaagactgcatcagtcttgtgtctgaccactgtcaagaacgaggacaagcttgagttcagcaagatcttggaggctattaaggcaaacttcaacgacaagttcgatgaggtgaggaagaagtggggaggtggtatcatgggctccaagtcgcaggccaagaccaaggctagggaaaagctgatcgccaaggaggctgctcagcggatgacctagattatccacttctgagtgtgccctgtagtttgacgcggaagaactgataatcgttgtgcactcgtattgtggttttctgaatcaagtttcatatgtttctgtccaccagaccatgtttagaaactttgcaagacagatgttacagtgtttatgcgatgtctcagctagtatattattttgcgccccaggcaaccttgtttttatttgcctaagatcaactataatagtatctttatatctttatatattgatagagagattttgttaatgccctataacaggttgtttaattatattttaaaatattgccaccttttt

SEQ ID NO: 4117 - DNA, 1296 bp, Panicum virgatum
aattactaccacactacggaccactcgaacaaacggcccagcccatataggcccagccacctatccctccgctgcggcccaagttagcgtctcctaaaccctaatccctgcgttggacggctgagaccgccctgctcgctgcgccaccccgcatctgacggccagggagcgtccaacacggcgcgaggcatcctttatagaaccacctctccgcctccactcgccgcctcccccatcttcccccgcgtcgacgtcgtctcccgttcggaacgccaagctcctctccggcgaaatggccccgaagcgaggtggcaaggcgccggtgcccgccaagaagaaaacagagaaggttaccaacccgctcttcgagaagaggccgaagcagttcggtatcggcggtgcgcttccgcccaagaaggacctgcaccggttcgtcaagtggcccaggtcgtgcgcatccagcgccagcgccgtatcctcaagcagcgcctcaaggtgccgccggcgctgaaccagtttacccgtaccctggacaagaacctcgcaaccaacctgtttaagatgcttctgaagtaccgccctgaggacaaggctgccaagaaggagaggcttctgaagagggctcaggctgagaatgaagggaaaaccgttgaggctaagaaaccaattgttgtgaagtatggccttaaccatgtgacctacctcattgagcagaacaaggcccagcttgttgtcatcgctcatgatgtggatccgattgagcttgttgtgtggcttccagccctgtgcaggaagatggaggttccttactgcattgttaaaggaaaggctcgccttggatcgattgttcacaagaagaccgcatccgtgctgtgccttaccactgtcaagaatgaggacaagcttgaattcagcaagatcttggaggctattaaggcaaacttcaatgacaagttcgacgaggtcaggaagaagtggggaggcggcatcatgggctccaagtcgcaggccaagaccaaggccagggaaaagctgctcgccaaggaggctgcccagcggatgacctagattacctatcttctgctgaatccatctgtagttcctgtgtcgactgggaacagctgatgagcattgtgccctcgtattgtggttttctgaatctagtttcacttgttttcgttcgccagaccatgtctagaaactttgcaaggcaagagtttacagtgtttgagatgttttgagcctcgaagtctcttatcatgcacccctatgccaaagcatggggaacattgtctt

SEQ ID NO: 4118 - DNA, 1258 bp, Triticum aestivum
cccccacgtcgcctcccgttcggaaccccaagctcccccgccgccggcgaaatggccccgaagcgaggcggcaaggcgccggtgccggcgaagaagaaggcggcggacaaggtggtgaacccgctgttcgagaagaggccgaagcagttcggcatcggcggggcgctgccgcccaagaaggacctccaccggttcgtcaagtggcccaaggtcgtgcgcatccagcgccagcgccgcatcctcaagcagcgcctcaaggttcccccggcgctccaccagttcacccgcaccctcgacaagaacctcgccaccaacctgtttaagatgcttctcaagtaccgccccgaggacaaggtggctaagaaggagaggcttctgaagagggcccaggctgaggctgaggggaaaaccgttgaggccaagaagccaattgttgtgaagtatggtcttaaccatgtcacttacctcatcgagcagagcaaggctcagctggtcgtcatcgctcatgatgttgacccaattgagctggttgtgtggctcccagccctgtgcaggaagatggaggtcccatactgcattgttaagggaaaatcacgccttggatcgatcgttcacaagaagactgcctcagttctgtgccttaccactgtgaagaacgaggacaagcttgagttcagcaagatcttggaggctatcaaggctaacttcaacgacaagttcgacgaggtcaggaagaagtggggcggtggcgtcatgggctccaagtcgcaggccaagaccaaggccagggaaaggctcatcgccaaggaggctgcgcagaggatgaactaagcctagccttatatgtcagagcatatgccatgtagtttccctttcagtgtgtcctgattttgacgaggaactcgaacccttttagcagcactgtggaatcgtattgtggttttctgattctctgttccgttctccagacttatgcaaagatcagatgaggtttacccatgtttggattctatatagttttatgtcctttgtcgagtcaaagttggttgtgtttgacatcttcctaacttggctgggttttggttaacatgcaatgacgaccagctcaatctgtttgcgaatttgtgacacatcataagcaggaaatttatgatgttgagatcgtttcacggaggcgcgtggtgaaactgagttgaaacgtgtattgtgcccaatttgcctatagcatgaaacattcgtttaattttttctgttgcat

SEQ ID NO: 4119 - DNA, 1241 bp, Hordeum vulgare
cgtatcccagacgtcgcctttataaaacttcctccccgcaccgaagcgccagtcggccgcctcccccctccaccccctcccccagcgtcgcctcccgttcggaaccccaagctcccccccgccgccggcgaaatggccccgaagcgaggcggcaaggcgccggtgccggcgaagaagaaggcggcggacaaggtggtgaacccgctgttcgagaagaggccgaagcagttcggcatcggcggggcgctgccgcccaagaaggacctccaccggttcgtcaagtggcccaaggtcgtgcgcatccagcgccagcgccgcatcctcaagcagcgcctcaaggtgcccccggcgctccaccagttcacccgcaccctcgacaagaacctcgccaccaacctgttcaagatgcttctcaagtaccgccctgaggacaaggtggctaagaaggagaggcttctgaagagggcacaggctgaggctgaggggaaaaccgttgaggccaagaagccaattgttgtgaagtatggtcttaaccatgtcacttaccttattgagcagagcaaggctcagctggttgtcatcgctcatgatgttgacccaattgagctggttgtgtggctcccagccctatgcaggaagatggaggtcccatactgcattgttaagggaaaatcacgccttggatcgattgttcacaagaagactgcctctgttctgtgcctcaccactgtgaagaacgaggacaagcttgagttcagcaagatcttggaggctatcaaggcgaacttcaatgacaagttcgatgaggtcaggaagaagtggggtggtggtgtcatgggctccaagtcgcaggcgaagaccaaggccagggaaaggctcatcgccaaggaggctgcgcagaggatgaactaagcctagatttatatgtcagagcatatgccatgtagtttccctttagcagcactgtggaatcgtattgtggtttcctgattctctgttccgttcgccagacttatgcaaagatcagatgaggtttacccatgtttggattctatatagttttatgtcctgtttcggttcaatatttgttgtgtgtcatgtcttccgaacttagctgattttttgttaaactgtaatgacgaccagctcagtctgtttgtgaattttattaaaattgcatgaaaattgtgatgtgaaattgtttcaggaacgcaatctggcataaacatgtgaaatcgatg

SEQ ID NO: 4120 - DNA, 1079 bp, Secale cereale
tcccgttcggaaccccaagctccccccgccgccggcgaaatggccccgaagcgaggcggcaaggcgccggtgccggcgaagaagaaggcggcggacaaggtggtgaacccgctgttcgagaagaggccgaagcagttcggcatcggtggcgccctcccgcccaagaaggacctccaccggttcgtcaagtggcccaaggtcgtgcgcatccagcgccagcgccgcatcctcaagcagcgcctcaaggtgcccccggctctccaccagttcacccgcaccctcgacaagaacctcgccaccaacctgtttaagatgcttctcaagtaccgccctgaggacaaggtggctaagaaggagaggcttctgaagagggcccaggctgaggctgaggggaaaaccgttgaggccaagaagccaattgttgtgaagtatggtcttaaccatgtcacttacctcattgagcagagcaaggctcagctggttgtcatcgctcatgatgttgacccaattgagctggttgtgtggctcccagccctgtgcaggaagatggaggtcccatactgcattgttaagggaaaatcacgccttggatcgatcgttcacaagaagactgcctcagttctgtgcctcaccactgtgaagaacgaggacaagcttgagttcagcaagatcttggaggctatcaaggctaacttcaacgacaagttcgatgaggtcaggaagaagtggggcggtggcgtcatgggctccaagtcgcaggccaagaccaaggccagggaaaggctcatcgccaaggaggctgcgcagaggatgaactaagcctagccctataagtatgtcagagcatgtgccatgtagtttccctttcagtgtgtcctgattttgacgaggaactcaaacccttttagcagcactgtggaatcgtattgtggttttctgattctctgttccgttcaccagacttatgcaaagatcagatgaggtttgcccatgtttggattctatatagttttatgtcctttgagtgagagttggttgtgcgtttgttctgagatgtaggaatttaagatattgcaagc

SEQ ID NO: 4121 - DNA, 1167 bp, Zea mays
ccagagtgcgtccaactcggcgcgagtcatccttatagaatcacctctccgcctccaagcgccagtcgccgcctctccccactccctctcgtcgccgtcctctcccgttcgcaacgccacgctccccaccgccgaaatggccccgaagcgaggtggcagggcaccggtgccggccaagaagaagacggataaagtgacgaaccctctgttcgagaaaaggccgaagcagttcggcatcggcggcgcgttgcctcccaagaaggacctgcaccgattcgtcaagtggcccaaggtcgtgcgcatccagcgccagcgtcgcatcctcaagcagcgcctcaaggtgcctccggcgctcaaccagttcacccgcaccctcgacaagaacctcgctaccaacctgttcaagatgcttcttaagtaccggcccgaagacaaggctgccaagaaggagaggcttctgaagagggcccaggctgagaatgaaggaaaaactgttgaatccaagaaaccaattgttgtgaagtatggccttaaccatgtgacttacctcattgagcagaacaaggctcagctcgttgtcatcgctcatgatgtggatccgattgaactggttgtttggcttccagccctgtgcaggaagatggaggtcccatactgcattgttaaaggaaaggctcgccttggatcgatcgttcacaagaagactgcatcagtcttgtgtctgaccactgtcaagaacgaggacaagcttgagttcagcaagatcttggaggctattaaggcgaacttcaatgacaagtttgatgaagtcaggaagaagtggggaggtggcatcatgggctccaagtcgcaggccaagaccaaggccagggaaaagttgctggccaaggaggccgcccagcggatgacgtagattatccactgttgagtttgcccctgtagtttgacgtggaagaaccgatgagcattgtgcactcgtattgtgtttttttgaatctactttcatatgtttctgtccatcagaccgtgtttagaaactttggaagacagttctacagtgtttgtgcaatgtcttatatcgaagtatatcatttgcgcctcaggcagttttgcttttatttgcctaagcaattggtcccgaattcagcattcgtgctgttagtcatg

SEQ ID NO: 4122 - DNA, 1240 bp, Zea mays
agggtgcgtccacctcggcgtgagccatcctttatagaaccacctctcggcttccaagcgccactcgccgcctcctccccactgcctcgtgtggccgtcgtctcccgttcggaacgccaagccccccctccggcgaaatggcccccaagcgaggtggcagggcgccggtgccggccaagaagaagacggataaagtgacgaaccctctattcgagaagaggccgaagcagttcggcatcggcggcgcgttgccgcccaagaaggacctgcaccggttcgtcaagtggcccaaggtcgtgcgtatccagcggcagcgccgcatcctcaagcagcgcctcaaggtaccaccggcgctcaaccagttcacccgcaccctcgacaagaacctcgctacgaacctgtttaagatgcttctcaagtaccggcctgaagacaaggctgccaagaaggagaggcttctgaagagggcccaagctgagaatgaaggaaaaactgttgagtcgaagaaaccaattgttgtgaagtatggccttaaccatgtgacttacctcattgagcagaacaaggctcagcttgttgtcatcgctcacgacgtggatccgattgaactggttgtgtggcttccagccctgtgcaggaagatggaggtcccttactgcattgttaaaggaaaggctcgccttggatcgattgttcacaagaagaatgcatcagtcttgtgtcttaccactgtcaagaacgaggataagcttgagttcagcaagattttggaggctattaaggcaaacttcaacgacaagttcgatgaggtcaggaagaagtggggaggtggcatcatgggatccaagtcgcaggccaagaccaaggcccgggaaaagctgctcgccaaggaggctgcgcagcggatgacctagattgtctactgctgtgtctgccctgtagtttaacggggaagaactgatgaactcgtattgtggttttccgaatctagtttcatatgtttctgtccaccagaccatgtttagaagctttgcaagacagagtttacagtgtttatgtgatgcctcagatccatgcagctttgcttctaattgcctaagagcaacctcaaaagtatttcatgaaaaaatgcccttctacagctttttaaatttagaattttaaatgttgccatcttttgtgactgtttgcgagcgaatggtttttaaatgaggatttagaaagtgggtttatgctctaa

SEQ ID NO: 4123 - DNA, 1185 bp, Secale cereale
gcccgcgcctagccccacgccgttccaccgcgcttcgtcctcctggacggatcccccgcgcttcttcttttctgcggttttgatttggtgttcgaatctcgttctaagtgtatggatcgcgaatcttgcaggccccgaagcgaggcggcaaggccccggtgccggcgaagaagaaggcggcggacaaggtggtgaacccgctgttcgagaagaggccgaagcagttcggcatcggcggcgccctcccgcccaagaaggacctccaccggttcgtcaagtggcccaaggtcgtccgcatccagcgccagcgccgcatcctcaagcagcgcctcaaggtgcccccggccctccaccagttcacccgcaccctcgacaagaacctcgccaccaacctgtttaagatgcttctcaagtaccgccctgaggacaaggtggctaagaaggagaggcttcttaagagggcccaggctgaggctgaggggaaaaccgttgaggccaagaagccaattgttgtgaagtatggtcttaaccatgtcacttacctcattgagcagagcaaggctcagctggttgtcatcgctcatgatgttgacccaattgagctcgttgtgtggctcccagccttgtgcaggaagatggaggtcccatactgcattgttaagggaaaatcacgccttggatcgatcgttcacaagaagactgcctcagttctgtgcctcaccactgtgaagaatgaggacaagcttgagttcagcaagatcttggaggctatcaaggccaacttcaacgacaagttcgatgaggtcaggaagaagtggggtggtggtgtcatgggctccaagtcgcaggccaagaccaaggccagggaaaggctcatcgccaaggaggctgcgcagaggatgaactaagcctagccctataagtatgtcagagcatgtgccatgtagttcccctttcagtgtgtcctgattttgatgaggaactcgaacccttttagcagcactgtggaatcgtattgtggttttctgattctctgttccgttcgccagacttatgcaaagatcagatgaggtttacccatgtttggattcatatagttttatgtcctttgagtgagagttggttgtgcgtttcttctgagatgtaggaatttaagatattgcaagctcctgtccagcatgaagg

SEQ ID NO: 4124 - DNA, 936 bp, Secale cereale
ccccgaagcgaggcggcaaggcgccggtgccggcgaagaagaaggccgcggacaaggtggtgaacccgctgttcgagaagaggccgaagcagttcggcatcggcggagccctgccgcccaagaaggacctccaccggttcgtcaagtggcccaaggtcgtgcgcatccagcgccagcgccgcatcctcaagcagcgcctcaaggtgcccccggccctccaccagttcacccgcaccctcgacaagaacctcgccaccaacctgtttaagatgcttctcaagtaccgccctgaggacaaggtggctaagaaggagaggcttctgaagagggcccaggctgaggctgaggggaaaaccgttgaggccaagaagccaattgttgtgaagtatggtcttaaccatgtcacttacctcattgagcagagcaaggctcagctggtcgtcatcgctcatgatgttgacccaattgagctggttgtgtggctcccagccctgtgcaggaagatggaggtcccatactgcattgttaagggaaaatcacgccttggatcgatcgttcacaagaagactgcctcagttctgtgcctcaccactgtgaagaacgaggacaagcttgagttcagcaagatcttggaggctatcaaggctaacttcaacgacaagttcgatgaggtcaggaagaagtggggcggtggcgtcatgggctccaagtcgcaggccaagaccaaggccagggaaaggctcatcgccaaggaggctgcgcagaggatgaactaagcctagccctgtcagagcatgtgccatgtagtttccctttcagtgtgtcctgattttgacgaggaactcgaacccttttagcagcactgtggaatcgtattgtggttttctgattctctgttccgttcgccagacttatgcaaagatcagatgaggttta

SEQ ID NO: 4125 - DNA, 1048 bp, Festuca arundinacea
  misc_feature (384)..(384): n is a, c, g, or t
  misc_feature (387)..(387): n is a, c, g, or t
  misc_feature (390)..(390): n is a, c, g, or t
  misc_feature (417)..(417): n is a, c, g, or t
  misc_feature (423)..(423): n is a, c, g, or t
  misc_feature (426)..(426): n is a, c, g, or t
  misc_feature (429)..(429): n is a, c, g, or t
  misc_feature (648)..(648): n is a, c, g, or t
  misc_feature (734)..(734): n is a, c, g, or t
  misc_feature (874)..(874): n is a, c, g, or t
  misc_feature (901)..(901): n is a, c, g, or t
  misc_feature (921)..(921): n is a, c, g, or t
  misc_feature (923)..(923): n is a, c, g, or t
  misc_feature (934)..(934): n is a, c, g, or t
ggcacgaggcctccgcctgctccgcgtcgtcgcctcccgttcggaaccccaagctcccccgccggcgaaatggccccgaagcgaggcggcaaggccccggtgccggcgaagaagaagccggcgcaggtgacgaacccgctgttcgagaagaggccgaagcagttcggcatcggcggcgcgctgccgcccaagaaggacctccaccggttcgtcaagtggcccaaggtcgtgcgcatccagcgccagcgccgcatcctcaagcagcgcctcaaggtgcccccggcgctccaccagttcacccgcacactcgacaagaacctcgccaccaacctgtttaagatgcttctcaagtaccgccctgaggacaaggctgccaagaagganagnctnttgaagagggcccaggctgaggctgangggaanacngtngaggccaagaagccaattgttgtgaagtatggtcttaaccatgtcacttacctcattgagcagagcaaggcccagctggttgtcatcgcccatgatgttgacccaattgagctggttgtgtggctcccagctctctgcaggaagatggaggtcccatactgcattgtcaaggggaaatcacgccttggatcgatcgttcacaagaagaccgcctctgtnctgtgcctgaccactgtcaagaacgaggacaagcttgagttcagcaagatcttggaggctatcaaggcgaacttcaacgacaagtncgatgaggtcaggaagaagtggggaggtggtgtcatgggctccaagtcccaggcgaagacaaaggcaagggagaggctcatcgccaaggaggctgcacagcggttgacttaagcagagccctttatgttgagcatatgcnatgtagtttccctttcagtgtcctgantttgacgaggaactcgaaantnttttagcagcncctgtggaatcaatcgtattgtggttttctgattcttgttccgttcgctagaccatgtcaagatcagatgatgttcccatgtttgctatatagatttgtgtcttatgttaagcc

SEQ ID NO: 4126 - DNA, 1002 bp, Leymus cinereus x Leymus triticoides
gtctgccctctcgccgtcgccccgctgacctcaaccagccgccggcgaaatggcccctaagcgaggcggcaaggcgccggtcccggcgaagaagaaaacggagaaggtgaccaacccgctgttcgagaagaggccgaagcaattcggcatcggcggcgccctcccgcccaagaaggacctccaccgcttcgttaagtggcccaaggttgtgcgcatccagcgccagcgccgcatcctcaagcagcgcctcaaggtgcccccggcactccaccagttcacccgtaccctggacaagaaccttgcaacgaacttgttcaagatgcttcttaagtaccgtcctgaagacaaagctgccaagaaggagaggcttctaaagagggcccaggctgaagctgaagggaaaactgtcgaggcaaagaagccaattgttgtgaagtatggccttaaccatgttacctacctaattgaacagagtaaagcccagctggttgtcatagctcatgatgttgatccgattgagctggttgtgtggctccctgccctttgcagaaaaatggaggtcccttactgcattgttaagggaaaatctcgccttggatcgattgttcacaagaagactgcctctgttctgtgcctgaccacagtgaagaacgaggataagcttgagttcagcaagatccttgaggctatcaaggcaaacttcaatgacaaatttgacgaggttaggaagaagtggggtggtggtgtcatgggctccaagtcgcaagcgaagaccaaggccagggaaaggcttatcgcaaaggaggctgcgcagcggatgaactaagttcagtattgttaaaccatatctattgctcatccctgagtagtgtgcaagcatactgtggctgtttggctccagttttgaaagtcatttttgtttgtctgagacatcttggaaaggacagtgtaagaatgaagtatttttgtttaatgccagttagtatccatgatcaagctcta

SEQ ID NO: 4127 - DNA, 1054 bp, Pseudoroegneria spicata
gcctccgtctgccccctcgccgtcgcgccgctgacctcaaccagccgccggcgaaatggcccctaagcgaggcggcaaggcgccggtcccggcgaagaagaaaacggagaaggtgaccaacccgctattcgagaagaggccgaagcaattcggcatcggcggcgccctcccgcccaagaaggacctccaccgcttcgttaagtggcccaaggttgtgcggatccagcgccagcgccgcatcctcaagcaacgcctcaaggtgcccccggccctccaccagttcacccgcaccctcgacaagaaccttgcaactaacttgttcaagatgcttcttaagtaccggcctgaagacaaagctgccaagaaggagaggcttctaaagagggcccaggctgaagctgaagggaaaactgtcgaggccaagaagccaatagttgtgaagtatggccttaaccatgttacctacctaatcgaacagagtaaagcccagctggttgtcatagctcatgatgttgatccgattgagctggttgtgtggctccccgccctttgcaggaaaatggaggtcccttactgcattgtcaagggaaaatctcgccttggatcgattgttcacaagaagactgcctctgttctgtgcctgaccacagtgaagaatgaggataagcttgagttcagcaagatccttgaggctattaaggcgaacttcaacgacaaattcgacgaggttaggaagaagtggggtggtggtgtcatgggctccaagtcgcaagcgaagaccaaggccagggaaaggctcatcgcaaaggaggctgcgcagcggatgaactaagtttatcattgttaaaccatatctattgctcatccttgagtagtgtgcaagcatactgtggctgtttggctccagttttgaaagcatactgtgtgcaagcatactgtggctgtttggctccagttttgaaagtcatttttgtttgtctgagacatctcggaaagaacagtgtaagaatttagtatttttgtttaatgccagttagtatccaaaaaaaaatgc

SEQ ID NO: 4128 - DNA, 1095 bp, Triticum aestivum
gggtagtgattagcgtggtcgcggccgaggtctcgccgtcgctccgctgacctcaaccagccgccggcgaaatggcccctaagcgaggcggcaaggcgccggtcccggcgaagaagaaaacggataaggtgaccaacccgctgttcgagaagaggccgaagcaattcggtatcggcggcgccctcccgcccaagaaggacctacaccgcttcgttaagtggcccaaggttgtgcgcatccagcgccagcgccgcatcctcaagcagcgcctcaaggtgcccccggcactccaccagttcacccgcaccctcgacaagaaccttgcaacaaacttgttcaagatgcttcttaagtaccggcctgaagacaaagctgccaagaaggagaggcttctaaagagggcccaggctgaagctgaagggaagactgttgaggccaagaagccaatagttgttaagtatggccttaaccatgttacctacctaatcgagcagagtaaagcccagctggttgtcatagctcatgatgttgatccgattgagctggttgtgtggctccctgctctttgcaggaaaatggaggtcccttactgcattgtcaagggaaaatctcgccttggatcgattgttcacaagaagactgcctctgttctgtgcctgaccacagtgaagaatgaggataagcttgagttcagcaagatccttgaggctattaaggcgaacttcaacgacaaatttgacgaggttaggaagaagtggggtggtggtgtcatgggctccaagtcgcaagcgaagaccaaggccagggaaaggcttatcgcaaaggaggctgcgcagcggatgaactaagtttagcattgttgaaccatatctattcctcatccttgagtagtgtgcaagcatactgtggctgtttggctccagttttgaaagtcatttttgtttgtctgagacatcttggaaagaacagtgtaagaatgaagtatttctgtttaatgccagttagtatttttgtcgaacacgtcatgaggctgccaaacgttaagtgcagtatattcttccaaaaaaaaaaaaaaacagggcggccgctctggta

SEQ ID NO: 4129 - DNA, 1210 bp, Hordeum vulgare
ccccaccccgcatccaacgctccgtaagcttcccttcttatcgaactagcccttataaaggcgccgcctggcttcggaaccgcttctcccccgcctccgtctgcccctcgccgttgccccgctgacctcaaccagccgccggcgaaatggctcctaagcgaggcggcaaggcgcctgtcccggcgaagaagaaaacggaaaaggtgaccaatccgctgttcgagaagaggccgaagcaatttggcatcggcggcgccctcccgcccaagaaggacctccaccgcttcgttaagtggcccaaggttgtgcgcatccagcgccagcgccgcatcctcaagcagcgcctcaaggtgcccccggcacttcaccagttcacccgcaccctcgacaagaaccttgcaacgaacttgttcaagatgcttcttaagtaccgtcccgaagacaaagttgccaagaaggagaggcttctaaagagggcccaggctgaagccgaagggaaaactgttgaggcaaagaagccaattgttgtgaaatatggccttaaccatgttacctacctaattgaacagagtaaagcccagctggttgtcatagctcatgatgttgatccgattgagctggttgtgtggctccctgccctttgcaggaaaatggaggtcccttactgcattgttaagggaaaatctcgccttggatcgattgttcacaagaagactgcctctgttctgtgcctgaccacagtgaagaatgaggataagcttgagttcagcaagatccttgaggctatcaaggcaaacttcaatgacaaattcgatgaagttaggaagaagtggggtggtggtgtcatgggctcgaagtcgcaagcgaagaccaaggccagggaaaggcttatcgcaaaggaggctgcgcagcggatgaactaagttcagcattgttaaaccatagctattgctcatccctgagtagtgtgcaagcatactgtggctgtttggctccagttctggaagtcatttttgtttgtccgagacatcttggaaagaagagtgtaagaattgagtatttttgtttaatgccagttagtatccatgacaaggtctatccggtatgtgtgtatcaagggcgtgttttgtttcctgggcgcatccagcctgcatcgcatgaaggtgcttgcctggttgagctgatgcaagtacttttttccttgcgattc

SEQ ID NO: 4130 - DNA, 1343 bp, Hordeum vulgare
aaaccctaatcctcacgacggacggtcagagcagcccgtgcccaccccaccccgcatccaacgctccgtaagcttcccttcttatcgaactagcccttataaaggcgccgcctggcttcggaaccgcttctcccccgcctccgtctgcccctcgccgttgccccgctgacctcaaccagccgccggcgaaatggctcctaagcgaggcggcaaggcgcctgtcccggcgaagaagaaaacggaaaaggtgaccaatccgctgttcgagaagaggccgaagcaatttggcatcggcggcgccctcccgcccaagaaggacctccaccgcttcgttaagtggcccaaggttgtgcgcatccagcgccagcgccgcatcctcaagcagcgcctcaaggtgcccccggcacttcaccagttcacccgcaccctcgacaagaaccttgcaacgaacttgttcaagatgcttcttaagtaccgtcccgaagacaaagttgccaagaaggagaggcttctaaagagggcccaggctgaagccgaagggaaaactgttgaggcaaagaagccaattgttgtgaaatatggccttaaccatgttacctacctaattgaacagagtaaagcccagctggttgtcatagctcatgatgttgatccgattgagctggttgtgtggctccctgccctttgcaggaaaatggaggtcccttactgcattgttaagggaaaatctcgccttggatcgattgttcacaagaagactgcctctgttctgtgcctgaccacagtgaagaatgaggataagcttgagttcagcaagatccttgaggctatcaaggcaaacttcaatgacaaattcgatgaagttaggaagaagtggggtggtggtgtcatgggctcgaagtcgcaagcgaagaccaaggccagggaaaggcttatcgcaaaggaggctgcgcagcggatgaactaagttcagcattgttaaaccatagctattgctcatccctgagtagtgtgcaagcatactgtggctgtttggctccagttctggaagtcatttttgtttgtccgagacatcttggaaagaagagtgtaagaattgagtatttttgtttaatgccagttagtatccatgacaaggtctatccggtatgtgtgtatcaagggcgtgttttgtttcctgggcgcatccagcctgcatcgcatgaaggtgcttgcctggttgagctgatgcaagtactttttttcttgcgattcaagagctatattgattatcgacgagttggtttgctttgtagggaggtgtgtaagatcgttagctgtggtccgcagaggtcgaaacttgt

SEQ ID NO: 4131 - DNA, 1143 bp, Avena sativa
gcatcgtcgcctcccgttcggaaccccaagctcccccgccggcgaaatggccccgaagcgaggcggcaaggcgccggtgccggcgaagaagaagacggcgcaggtgacgaacccgctgttcgagaagaggccgaagcagttcggcatcggcggcgcgctgccgcccaagaaggacctgcacaggttcgtcaagtggcccaaggtcgtgcgcatccagcgccagcgccgcatcctcaagcagcgcctcaaggtgcccccggcgctccaccagttcacccgcaccctcgacaagaacctcgccaccaacctgtttaagatgcttcttaagtaccgccctgaggacaaggtggctaagaaggaaaggcttctgaagagagcccaggctgaggctgaagggaaaaccgttgaggccaagaagccaattgttgtgaagtatggtcttaaccatgtcacctatctcattgagcagagcaaggcccagctggttgtcatcgctcatgatgttgacccaattgagctggttgtgtggctcccagctctgtgcaggaagatggaggtcccatactgcattgttaagggaaaatcacgccttggatcgattgttcacaagaagacctcctctgttctttgcctgaccactgtcaagaatgaggacaagcttgagttcagcaagatcttggaggctatcaaggcgaacttcaacgacaagttcgatgaagtgaggaagaagtggggaggcggcgtcatgggctccaagtcccaggcgaagaccaaggccagggaaaggctcatcgccaaggaggccgcacagcggttgacctaagcatagccttctatgtcgagcatatgccatgtagtttccctttcagtgtcctgattttgacgaggaacttcaaaactcttttagcactgctgtggaatcaatcttattgtggttgtctggttttcattatggtcgccagaccatgttggtaactatgcaaagatcagatgaggttgtcaccatgtttggtttctatatagtaagtactatctattatgttgagctggttaatcgtgtgtgctcagccagattatttagaaattgttttggcatgggaagttgagattttgtgtcatattgtgtattttgttttctttgat

SEQ ID NO: 4132 - DNA, 1104 bp, Secale cereale
gactgagcagcccgtgcccaccccacccagcatccaacgctccgtaagcttccttcttatcggactagcccttataaaggcgccgcctggcttccgaaccgcgtctcccccgcctccgtctgccccctcgccgtcgctccgctgacctcaaccagccgccggcgaaatggctcctaagcgaggcggcaaggcgcctgtcccggcgaagaagaaaacggagaaggtcaccaacccgctgttcgagaagaggccgaagcaattcggcatcggcggcgccctcccgcccaagaaggacctccaccgcttcgttaagtggcccaaggttgtgcgcatccagcgccagcgccgcatcctcaagcagcgcctcaaggtgcccccggcactccaccagttcacccgcaccctcgacaagaaccttgcaacaaacttgttcaagatgcttcttaagtaccggcctgaagacaaagttgccaagaaggagaggcttctaaagagggcccaggctgaagctgaagggaaaactgttgaggccaagaagccaatagttgtgaagtacggccttaaccatgttacctacctaatagaacagagtaaagcccagctggttgtcatagctcatgatgttgatccgattgagctggttgtgtggctccccgccctttgcaggaaaatggaggtcccttactgcattgtcaagggaaaatctcgccttggatcgattgttcacaagaagactgcctctgttctgtgcctgacaacagtgaagaatgaggataagcttgagttcagcaagatccttgaggctattaaggcgaacttcaacgacaaattcgacgaggttaggaagaagtggggtggtggtgtcatgggctccaagtcgcaagcgaagaccaaggccagggaaaggcttattgcaaaggaggctgcgcagcggatgaactaagcttagcattgttaaaccatatctattgctcatcctgtgtccaagcatactgtggctgtttggctccagttttgaaagtcatttttgtttgtccgagacatcttggaaagaacagtgtaagaatgaaatatttttgtttaatgccagttagtatcaatgat

SEQ ID NO: 4133 - DNA, 1127 bp, Triticum aestivum
gcgtggtcgcggccgaggtctcgccgtcgctccgctgacctcaaccagccgccggcgaaatggcccctaagcgaggcggcaaggcgccggtcccggcgaagaagaaaacggagaaggtgaccaacccgctgttcgagaagaggccgaagcaattcggcatcggcggcgccctcccgcccaagaaggacctccaccgcttcgttaagtggcccaaggttgtgcgcatccagcgccagcgccgcatcctcaagcagcgcctcaaggtgcccccggcactccaccagttcacccgcaccctcgacaagaaccttgcaacaaacttgttcaagatgcttcttaagtaccggcctgaagacaaagttgccaagaaggagaggcttctaaagagggcccaggctgaagctgaagggaaaactgttgaggccaagaagccaatagttgtgaagtatggccttaaccatgttacctacctaatcgagcagagtaaagcccagctggttgtcatagctcatgatgttgatccgattgagctggttgtgtggctccctgctctttgcaggaaaatggaggtcccttactgcattgtcaagggaaaatctcgccttggatcgattgttcacaagaagactgcctctgttctgtgcctgaccacagtgaagaatgaggataagcttgagttcagcaagatccttgaggctattaaggcgaacttcaacgacaaattcgacgaggttaggaagaagtggggtggtggtgtcatgggctccaagtcgcaagcgaagaccaaggccagggaaaggcttatcgcaaaggaggctgcgcagcggatgaactaagtttagcattgttgaaccatatctattcctcatccttgagtagtgtgcaagcatactgtggctgtttggctccagttttgaaagtcatttttgtttgtctgagacatcttggaaagaacagtgtaagaatgaagtatttctgtttaatgccagttagtatttttgtcgaacacgtcatcgaggctgccaaacgttaagtgaagtattcttcagacaagggtggcaaaacattcagagttcttaagctagggtcctgacaactcccagactgagatcgaacttgtcctcaag

SEQ ID NO: 4134 - DNA, 1055 bp, Avena sativa
ctccgtggacctcaatcagacgccggcgaaatggccccgaagcgaggtggcaaggcgccggtcccggcgaagaagaagacggttcaggtgacgaaccctcttttcgagaagaggccgaagcagttcggcatcggcggcgcgctcccgcccaagaaggacctccaccgcttcgtgaagtggcccaaggttgtgcgtatccagcgtcagcgccgcatcctcaagcagcgcctgaaggtgcccccggctctccaccagttcactcgcaccctggacaagaacctcgcaacaaacttgttcaagatgctacttaagtaccgccctgaggacaaagctgccaagaaggagaggcttctaaagagggcccaggctgaagctgaaggcaaaactgttgaggcaaagaagcctattgttgtgaagtatggtctaaaccatgttacttacctgatcgagcagagcaaggcccagttggttgtcatagctcatgatgttgacccgattgagctggttgtgtggctcccagccctttgcaggaaaatggaggttccttactgcattgttaagggaaaatctcgccttggatcgattgttcacaagaagactgcctctgttctgtgcttgaccacggtgaagaatgaggataaacttgagttcagcaaggtccttgaggctattaaggcaaacttcaacgacaaattcgacgaggtcaggaagaagtggggtggtggtgtcatgggctccaagtcgcaggcaaaaaccaaggccagggaaaggctgatcgcaaaggaggctgcccagcgtctgacctaggtttagccttgttaaaccatatctattgctcatccttgagtagtgtgcaagcatactgtggctgtttggatctagttttggaagtcatttttgtttgttgagacatcttggaaggaacagtgtaagaatggagtatttttgtttactgccagttagtaaccatgatcacgtctatcttttagatgcattgaagaaattcacgatctggcagcggatttttattcatctaccatcatcctgtgtgttaa

SEQ ID NO: 4135 - DNA, 1229 bp, Musa acuminata
aaaccctacagtgtctaaactgggggccgtcgtatataaattccccttttcaagagccagccgacgccgcttcggtgtttgcccgccgtcgtccgattccaaaccctaattcgcgagagacgagatggccccaaaaagaggtgggaaggcagccgttccggcaaagaagaaaccggagaaggttgtgaacccattgtttgagaagcgcccgaagcagtttggaatcggaggggcattgccgccgaagaaggatctgcatcggttcgtgaaatggccaaaggttgtccggattcagaggcaaaagaggatattgaagcagcggttgaaggttcccccggcgttgaatcagttcactcggactttggacaagaaccttgctacgaacctcttcaagatgcttctcaagtacaggcctgaagaccgagctgcaaagaaggaaaggcttctgaagagggcacaagctgaggctgaagggaagacagttgaagtgaagaagcccattgttgtcaagtatgggctcaatcatgtcacttaccttattgagcagaacaaggcacagttggtggtgattgctcatgatgtggacccaattgagcttgtggtatggcttcctgccttgtgcaggaaaatggagattccctactgtatcgtcaagggaaaagcccgcttgggagcgatcgtacataagaaaaccgcatcagtcctgtgtctgaccactgtgaagaatgaggacaaactggaatttagcaagattctggaggccattaaggctaacttcaatgacaagtttgacgagattagaaggaagtggggtggtggaattatgggttccaagtctcaggcaaaagccaaagctagggagaaattgctggccaaggaagctgcccagaggatgagctaggtcttcttatctttcatggcggtccgctaccggagttggcaccttgtacgatgcttgcataaattccgttgccggagttgctggaggttttctgagattttccgatgatggatagtgtttttgtttatttgaagctttattcaactcacattaaaccctttttgcttacccaaaattctttgcaactatcagactcgtactactactgtttcctgcgcactttctgatatgaagttctacaagttatataaacgtctgtgtccgcttgttttggttgcgtcaggaatatttctgcctatcaacagtttcaatgtggcaagtaaacccg

SEQ ID NO: 4136 - DNA, 1081 bp, Musa acuminata
atgtcacgtgcggtggacatgcttcaaaaccctatcgtgtcacagcgcctggaagaaatggctccaaaaagaggtgttaaggtgcccgttcctggaaagaagaaaccggagaaggtcgtcaaccccttgtttgagaagcgcccgaagcagttcggaatcggaggggcactgccgccgaagaaggatctgcatcggttcgtgaaatggcccaaggtggtccggattcagaggcagaggaggatattgaagcagcggttgaaggttcctccggctcttaaccagttcactcggactttggacaagaacctcgctacaaatcttttcaagatgcttctcaagtacaggcctgaagaccgagctgcaaagaaagaacggcttctgaagagggcacaagctgaggctgaagggaagactgttgaagttaagaagcccatagttgttaagtatgggctcaatcatgtcacttaccttattgaacagaacaaggcacaattggtggttatcgctcatgatgtggacccaatcgagcttgtagtttggctgcctgcattgtgcaggaagatggagatcccttactgtattgtcaaaggaaaagcccgattgggagcgatcgtacataagaaaacagcatcggtgctttgtctgaccactgtgaagaacgaggataaactggaatttagcaaaatcctggaagccatcaaggccaacttcaatgataagtttgatgaggtccggagaaagtggggtggtggaattatgggcaccaaatctcaggcaaaatccaaggctagagaaaagctgctagctaaggaagctgcccagaggctgacataggtcatctcgtcttgtcattgatgctacaagatttcattttgtaggtcttttgcttgaattctgtatctggattggcatcactgttggttggatactgttgtttcttgtttggagctttattcaactttgttaacttagaatgtgacttaatttaaattctcccttagtaagaaaaacttggaatgtaacttagaatgtgagttatagtctacatgatgactggtaagaggtcgttcaacagttagtg

SEQ ID NO: 4137 - DNA, 1143 bp, Musa acuminata
atgaactctctccgtggcttcgaagtcatagatgccatcaaggcacgcacgcgtggaatcactttgcagggggactgtgtcttgcgccgacatccttggccttgcaactcgagaaagtgtcgcactgtttggaggaccgtcttgggcggtatttctaggccgcgggggcgcgaggacgacaagccaggcctccgccacggcgaaccttccgccgcccagcgcgagcttatccggcctcgtttcctcgttcgcctccaagggactcgctccctgggacgtgatctcgctctccggcgcacacaccgtaggccaagcacgctgcaccagctgccgccccccgcatctacggcgacagaaacagacgagatggccccaaaaagaggtgggaaggcagccgttccggcaaagaagaaaccggagaaggttgtgaacccattgtttgagaagcgcccgaagcagtttggaatcggaggggcattgccgccgaagaaggatctgcatcggttcgtgaaatggccaaaggttgtccggattcagaggcaaaagaggatattgaagcagcggttgaaggttcccccggcgttgaatcagttcactcggactttggacaagaaccttgctacgaacctcttcaagatgcttctcaagtacaggcctgaagaccgagctgcaaagaaggaaaggcttctgaagagggcacaagctgaggctgaagggaagacagttgaagtgaagaagcccattgttgtcaagtatgggctcaatcatgtcacttaccttattgagcagaacaaggcacagttggtggtgattgctcatgatgtggacccaattgagcttgtggtatggcttcctgccttgtgcaggaaaatggagattccctactgtatcgtcaagggaaaagcccgcttgggagcgatcgtacataagaaaaccgcatcagtcctgtgtctgaccactgtgaagaatgaggacaaactggaatttagcaagattctggaggccattaaggctaacttcaatgacaagtttgacgagattagaaggaagtggggtggtggaattatgggttccaagtctcaggcaaaagccaaagctagggagaaattgctggccaaggaagctgcccagaggatgagctag

SEQ ID NO: 4138 - DNA, 1124 bp, Elaeis guineensis
cgctaaagtgcaacgccgaaatggctcccaaaagaggtggaaaggctgcggtgccggcgaagaagaaaccggagaaggttgcgaaccctctgtttgagaagcggccgaagcagtttgggatcggtggggctttgcctccaaagaaggacctccaccggttcgtcaggtggccgaaggtggtcagaatccagaggcagaggaggattctcaagcagcgtttgaaggtcccaccggccttgaaccagttcacgaggactttggataagaaccttgcctcaagcctgttcaagatgcttttaaaatatcgtccagaagacagagctgcaaagaaggaacggcttctgaagagagctcaggcagaggctgaggggagaactgttgaagttaagaagcctattgttgtgaagtatgggcttaatcatgtcacttaccttatcgaacagaaaaaggcacaacttgtggtcattgctcatgatgttgacccaatcgagctagtagtttggctgccagcgttgtgccggaaaatggaaattccatactgtattgtgaagggaaaagcacggcttggagcgattgtacacaagaagactgctactgtattgtgtttgaccactgtaaagaatgaggataaactggagttcagcaaaatcctggaggctatcaaggctaacttcaatgataagtttgatgagatccgtaagaagtgggggggtgggataatgggttccaaatctcaggcaaaaatgaaggccagggaaaagctgctagcaaaggaagctgctcagaggatgagctaggtttctttctcttgatatttggatctgtggatttcacctcttgcattttccagtctgtagatgtagtcacatgagtaatgagctgactagcagccatatcttaaatttttgaaccagctatgtcttaagttaggtggaactttttattatctggattgtctctgaacttaccaagacatgtttcagtttctttttcttctgagcttttaaagggccagttaatattattttgtctttttttgtttgtattatttttttgtgtcgtcttttacatttgctgacttattttatctaatctgtttgcttgtcttattgaataataaaaaa

SEQ ID NO: 4139 - DNA, 1289 bp, Brachypodium distachyon
agaaaacgtccacgccggctatacgcttcctttataaaactgccccggagcacccctcgccgcctactccttcacctcctacccctcgtcgccgcccccctcgcggaaccgcaagctccccgtcggcgaaatggccccgaagcgaggcggcagggcgccagttccggcgaagaagaaagcggagaaggtcacgaacccgctgttcgagaagaggccgaagcagttcggcatcggtggcgcgctgccgcccaagaaggacctccaccggttcgtgaagtggcccaaggtcgtgcgcatccagcgccagcgccgcatcctcaagcagcgcctcaaggttcccccggcgctccaccagttcacccgcaccctcgacaagaacctcgctaccaacttgtttaagatgcttctgaagtaccgccctgaggacaaggctgccaagaaggagcggcttttgaagagggcccaggctgagactgaaggaaaaactgtcgaggcgaagaagcctattgttgtaaagtatggccttaaccatgtgacttacctcattgagcagggcaaagcccagctggtcgtcattgctcatgatgttgatccaattgagcttgttgtgtggctcccagccctgtgcaggaagatggaggtcccttactgcattgttaaaggaaaatcacgccttggatcgattgttcacaagaagacctcctccgttctgtgcctgaccaccgtcaagaatgaggataagcttgacttcagcaagatcttggaggctatcaaggcgaacttcaacgacaagttcgatgaggtcaggaagaagtggggaggcggtgtcatgggctccaagtcacaagctaagaccaaggccagggaaaggctcatcgccaaggaggctgcgcagcggatgacctaattctagcctgtgcaaagcatgctcttctttagtttccctttcattgtcatgtttttgacgaggaactcgaactcatttagcgctgtggaatcatgttatggttttctgatttttgttgtgttcgccagaccttgtgggaaactatgcaaagatcagaagtggttgttatgtttggtttctatagagtatatgtcataatatccttccctaagtctagctgtcttgagcgtgtcaaattagtgcagagcttgtgtttctggaaaaaatacgctctatttttatttgaacttgtctcacagcagtctgttttttggtcatccttaattcatgttgtcactccaaaggcctcctttttataacgcgcgtcgccgagaaattcgga

SEQ ID NO: 4140 - DNA, 1272 bp, Brachypodium distachyon
gcgctggacagccgagatcgcgcacatctcgcatctgacgttcagaaaacgtgcacgtcgccgagacgcttcctttatcaccagccccggagcgccagccgccgcctcctccttcatctcctaccccgtcgtcgcctccagctccaggaaccccaagctccccgccggcgaaatggccccgaaacgaggtggcagggcgcctgtaccggcgaagaagaaggcggagaaggtcacgaacccgctgttcgagaagaggccgaagcagttcggcatcggtggcgcgctgccccccaagaaggacctccaccggttcgtcaagtggcccaaggtcgtgcgcatccagcgccagcgccgcatcctcaagcagcgcctcaaggttcccccggcgctccaccagttcacccgcaccctcgacaagaacctcgcaaccaacttgtttaagatgcttctcaagtaccgccctgaggataaggctgccaagaaggagcggcttttgaagagggctcaggctgagactgaagggaaaacagttgaggcaaagaagcctattgttgtgaagtatggcctaaaccatgtcacttacctcattgagcagggcaaagcccagttggtcgtcatcgctcatgatgttgatccaattgagctcgttgtgtggctcccagccctgtgcaggaagatggaggtgccttactgcattgttaaaggcaaatcacgccttggatcgattgttcacaagaagacctcctctgttctgtgcctgaccactgtcaagaacgaggataagcttgacttcagcaagatcttggaggctatcaaggcaaacttcaatgacaagttcgatgaggtcaggaagaagtggggaggcggtgtcatgggctccaaatcgcaggcgaagacaaaggccagggagaggctcatcgccaaggaggcggcacagcggatgacctaattctagcttctgctaagcatgccctgtagtatccctttcagtgcggtgtttttgacgagcaactcgaactcatctagctctttgaaatcgtattgtggttttctgattcttgtttcattcgcgggaccatgatggaaactatgcaaagataagagtttatatgtcctagtcctacgactcttttgagtcaagtgagcttgagaattacgcgatctgaatattgcttcgtaccgttgcccatataccttaaccagatcccagctgggtttcaaatattttcatcaaagttaaaatgcgaatgtgatattagagctatctgcaag

SEQ ID NO: 4141 - DNA, 1369 bp, Musa acuminata
atggggagtggttacgagggatctgacggtgatggaacgtctgatttctccaggagagggattcgaacggcggtgactattggacttagtcccttatatgggcctctggggttgagcccaaacacgagatggcacgcgtcagtcacgtgctcaaaccctggtagcgacttacactgttccgtactatataaaagcgcgcgcccgcctccccctttagcggtccctctgcgccgtctcccgacacgaaaccctaatcggagcgaaggaatggcccccaaaagatctgggaaagcgcccgttccggcaaagaagaaaccggagaaggttgtgaatcctttgtttgagaagcgcccgaagcagttcggaatcggaggggcattgcctccaaagagggatctgcacagattcgtgaaatggccgaaggtggtccggattcagaggcagagaaggatactgaagcagcggctgaaggttccaccagctttgaatcagttcactcggacattggacaagaaccttgctacaaatctcttcaagatgcttctgaagtacaggcccgaagaccgagctgcaaagaaggaaaggcttctgaagagggcacaagctgaagctgaagggaagactattgaactgaagaagcccattgttgtcaagtatgggctcaaccatgtcacttaccttatcgaacagaacaaggcacagttggtggttatcgcacacgatgtggatccaattgagcttgtcgtgtggctacccgccttgtgtaggaagatggagatcccttactgtattgtcaaaggaaaagcccgtttaggagcgatcgtgcataagaaaacagcatcagtcttgtgtctgaccactatgaagaacgaggacaaactagaattcagcaaaatcctggaagcgattaaggccaatttcaatgacaagtttgatgaggtcaggaggaagtggggtggtggaatcatgggttccaaatctctggcaaaatccaaggccagggagaaggtactagcaaaggaagctgcccagagaatgacttaggtcttctcatctcgtcattggtagcgctataaatgtcatcaaataggttgcttgatttctgtagctggaggcggaagagtataattgaacattttgttgatggcaagcttttgttcagagaactcttaacttaatcggcttttgcttactagtttgcttgttggtggtttggcacttgtttcgacttatgttaacttttgagtgtttttatttggcgcattcatattctattaaaacctagactattttgtttgtgggtaatttagagggttgtatgctggttattagttttttaaaatattagaaattaaattagaaagttggc

SEQ ID NO: 4142 - DNA, 1118 bp, Secale cereale
gcggcaaggcgccggtgccggcgaagaagaaggcggcggacaaggtggtgaacccgctgttcgagaagaggccgaagcagttcggcatcggcggagccctgccgcccaagaaggacctccaccggttcgtcaagtggcccaaggtcgtgcgcatccagcgccagcgccgcatcctcaagcagcgcctcaaggtgcccccggccctccaccagttcacccgcaccctcgacaagaacctcgccaccaacctgtttaagatgcttctcaagtaccgccctgaggacaaggtggctaagaaggagaggcttctgaagagggcccaggctgaggctgaggggaaaaccgttgaggccaagaagccaattgttgtgaagtatggtcttaaccatgtcacttacctcattgagcagagcaaggctcagctggttgtcatcgctcatgatgttgacccaattgagctggttgtgtggctcccagccctgtgcaggaagatggaggtcccatactgcattgttaagggaaaatcacgccttggatcgatcgttcacaagaagactgcctcagttctgtgcctcaccactgtgaagaacgaggacaagcttgagttcagcaagatcttggaggctatcaaggctaacttcaacgacaagttcgatgaggtcaggaagaagtggggcggtggcgtcatgggctccaagtcgcaggccaagaccaaggccagggaaaggctcatcgccaaggaggctgcgcagaggatgaactaagcctagccctataagtatgtcagagcatgtgccatgtagtttccctttcagtgtgtcctgattttgacgaggaactcaaacccttttagcagcactgtggaatcgtattgtggttttctgattctctgttccgttcaccagacttatgcaaagatcagatgaggtttgcccatgtttggattctatatagttttatgtcctttgagtgagagttggttgtgcgtttgttctgagatgtaggaatttaagatattgcaagctcctgtccagcatgaagggctttgatttcaccagcaagggaggccatcaatgacctatttagtgttgcactcactgatccagaatatggttgtt

SEQ ID NO: 4143 - DNA, 1124 bp, Amorphophallus konjac
ggattagggtttgtggccgcttcatagcctgcctgcgcgaaggaggaagaagagagaaaaatggctcccaagagaggtggaaaagctcccttaccagtgaagaagaagccggagaaggtggtgaatcctttgttcgagaagcgacctaagcagttcgggatcggaggggctctgcctcccaagagggacctgcaccgtttcgtgaaatggcccaaggtggtgcgcattcaaaggcagaggaggatcctgaagcagcggttgaaggtgcccccggcgttgaaccagttcacaaggaccttggacaagaacctcgcaaccaatcttttcaagatgctcctcaaatacagaccagaggacaaagctgcaaagaaggaaaggcttcttaagagggctcaggccgagactgaagggaagactattgaggtgaagaagcctattgttgtcaagtatggccttaatcatgtcacttaccttattgagcagaacaaagctcagttggttgttatagcccacgatgtggatccgatagaattggtcgtctggttgcctgcactgtgcaggaagatggagatcccttattgcattgtgaaaggaaaggcacgcctaggatcgatcgtacacaagaagactgcatctgttttgtgtttgacttcagtgaagaatgaggacaaactcgaattcagtaaaatcttggaagctatcaaggctaacttcaacgacaaatttgacgaaataagaaagaagtggggtggcggtatcatgggttcgaaatctcaggccaagacaagagctaaggagaagcttctagccaaggaagctgctcagaggatgagttagtttctctgtgcagccatcaaacgtgcttccttagtctgcaggtcttttgttgtggcatcttatcttattttgtagtttatagttatgctgaatggccaagtaaaagaacttccatttttgttatccataaagatttcactctaccttcagcagagacgggggggtatcatttcttcggtcgaaggaggtttttttttttggtagaagtgtagttgaaaccgtaaaatggttgcttcggtagcttgttgacggccttcttttgagctttacgttcgataatggcttat

SEQ ID NO: 4144 - DNA, 1172 bp, Elaeis guineensis
tgacgccgtctttaaagccctaacgctaagcacatggctcccaaaagaggtgggaaggctgcggtgccggcgaagaagaaaccggagaaggttgtgaaccctctgtttgagaagcggcctaagcagtttgggatcggaggggctttgcctccgaagaaggacctccaccggttcgtcaaatggccgaaggtggtcagaatccagaggcagcggaggattctcaagcagcgcttgaaggtcccaccggccctgaaccagttcaccaggaccttggataagaaccttgcctcgagcctgtttaagatgcttctgaagtatcgtcctgaagacagagctgcaaagaaggaaaggcttctgaaaagggctcaggcagaggctgaagggaagcctgttgaagtgaagaagcctattgttgtgaagtatggtcttaatcatgtgacctacctcattgaacagaacaaggcacaactggtggtcattgctcatgatgttgacccagttgagctggttgtttggctccctgccttgtgccggaagatggagatcccttactgtattgttaaaggaaaagcacgacttggagcgatcgtgcacaagaagactgcagctgtattgtgtttgaccactgtaaagaatgaggataaactagaattcagcaaaatcttggaggctatcaaggccaacttcaatgataaatttgatgaggtccgtaggaagtggggaggtgggataatgggtaccaagtctcaggcaaaaaccaaggcaagggaaaagcttttagcaaaggaagctgctcagaggatgagctagatttctttatttttggtcatgtggtttcgccccaaggttttttcttttccccagcttgtagctgtagtcactggatcagcagatggactagtagccatatctgaaagtagatggtatttttatcatctggttctcttgtgaacttccccaggcatctctcttggtgtcacccaaccttttgggttcttctgaggctttggatcaattattattgtgtgctttgcattgctgatttatttttgttctaattttctgtgcttgtctattaaacttatcttgaatttttctttgatgaaaaacttatctggaattttaaccatcattttattaggacacttgactacgatgactggtgatatgga

SEQ ID NO: 4145 - DNA, 1038 bp, Secale cereale
gcgccggtgccggcgaagaagaaggccgcggacaaggtggtgaacccgctgttcgagaagaggccgaagcagttcggaatcggtggcgccctcccgcccaagaaggacctccaccggttcgtcaagtggcccaaggtcgtgcgcatccagcgccagcgccgcatcctcaagcagcgcctcaaggtgcccccggctctccaccagttcacccgcaccctcgacaagaacctcgccaccaacctgtttaagatgcttctcaagtaccgccctgaggacaaggtggctaagaaggagaggcttctgaagagggcccaggctgaggctgaggggaaaaccgttgaggccaagaagccaattgttgtgaagtatggtcttaaccatgtcacttacctcattgagcagagcaaggctcagctggtcgtcatcgctcatgatgttgacccaattgagctggttgtgtggctcccagccctgtgcaggaagatggaggtcccatactgcattgttaagggaaaatcacgccttggatcgatcgttcacaagaagactgcctcagttctgtgcctcaccactgtgaagaacgaggacaagcttgagttcagcaagatcttggaggctatcaaggctaacttcaacgacaagttcgacgaggtcaggaagaagtggggcggtggtgtcatgggctccaagtcgcaggccaagaccaaggccagggaaaggctcatcgccaaggaggctgcgcagaggatgaactaagccctagccctataagtgtgtcagagcatgtgccatgtagtttccctttcagtgtgtcctgattttgacgaggaactcgaacccttttagcagcactgtggaatcgtattgtggttttctgattctctgttccgttcaccagacttatgcaaagatcagatgaggtttacccatgtttggattctatatagttttatgtcctttgagtgagagttggttgtgtgtttgttctgagatgtaggaattaaagatattgcaagctcctgtccagcgtgaagggca

SEQ ID NO: 4146 - DNA, 903 bp, Platanus occidentalis
caggagcctttccacctctcttcggggccgttctctgaccctaacgacacaggcgaacgaaggaaggaagaaaaaaaaaaaatggccccgaagagaggtggaaaggctcctgcagcaccagctaagaagaaaccggagaaggtcgtgaacccattatttgagaagcgtccgaagcagtttgggattggaggggcattgcctccgaagagggatctgcaccggtttgtgaagtggcccaaagttgttcgcattcagaggcagaggaggattctcaagcagaggttgaaggtccctccagctttgaaccagttcacaaagacactggacaagaaccttgcaacaaacctattcaagatgcttctcaagtacagacctgaggacaaagctgcaaagaaggaacgtcttctgaagagagctcaggctgaggcagaaggaaagaccgttgaagttaagaagcctattgtcgtgaagtatgggctcaaccatgttacctaccttattgagcagaacaaggcacaattggtagttattgcacatgatgtggatccgatagagcttgttgtctggcttcctgccttgtgtaggaagatggagatcccctactgcattgtgaagggaaaagctcgcttgggagcaattgtccacaagaaaactgctgctgttctgtgtttaactacggtcaagaatgaggataaattggagtttagcagaatcttagaggctatcaaggccaatttcaatgacaagtatgacgagtaccggaagaagtggggaggcggtattatgggctccaaatcccaggccaaaaccaaagccaaggagaggcttcttgccaaggaagctgcgcagaggatgacctaggactgttggtatcactttttatatgttgttaaatgaatcaga

SEQ ID NO: 4147 - DNA, 1293 bp, Amborella trichopoda
ctcagattttgtcgttagggttttcgtccacagcgccgcgccttctttatatccccgttttcttactcgctccatctatcgaggcccttaccagtgaggcggagctcgaactatctccttcaccgcaaatggctcccaaaagaggcggaaaggctcctgttccggccaagaaaaaggctgaaaaggtagtgaatcccttatttgagaaacgcccaaagcagttcggaattggtggtgcattacctccaaagagggaccttcacaggtttgtgaagtggcctaaagttgttcgtattcaaaggcaaagaagaatactaaagcagaggctaaaggtccctccagctttgaatcagtttacaaagacattggataagaaccttgctacaaaccttttcaagatgcttctgaagtataggcctgaggacaaagctgccaagaaggaaaggcttttgaaaagggctcaagctgaggctgaaggaaagactgtagaatctaagaagccaattgttgtcaaatatgggttgaaccatgtgacatacctcatagagcagaacaaagcccaattggtgattattgcccatgatgtcgatcctatagagctggttgtctggttgcctgcactgtgcagaaagatggagattccttacgcaatagtgaagggaaaagctcgattgggaacgattgttcataagaaaactgcttccactctgtgtcttacatcggtgaaaaatgaggataaattggagttcagcaaaatagtggaggcaatcaaggccaacttcaatgataagtatgatgagtacaggaagaaatggggtggtggcatcatgggatcgaaatccctggccaaaaccaaagcccgagaaaggcttcttgccaaggaagcggcacaaaggatgacttagaaatgcacttgggaggctacccttcgaactttctaaacgtttcgcttcttgagtttaggaacagtttcttttggtggtgaacaattaatttgtcattcctttcccttgcaaattttgaaagtaatcagtaatgtagtaatatgactgcaaaatggaacgtgatcatatttcacttttaagggttcatgacattagaatttggcataattcgatacagcctaatatttttgggtatcggaggggaagacttgaagacacatgcatggtttgtatggaaatactctgtgaaagtattttcatttgaaaaaaactcttacgtgattagacatggaaatattttcacatcaattggcttaccaattggtgtgagaaaattcgttgggatcaa

SEQ ID NO: 4148 - DNA, 1110 bp, Musa acuminata
gcttccgctggttcttctgcgtcgtctccccacagtaaaccctaacgcctgcgccgagaaatgggcccaaagagaggtgggaaggcgcccgtaccggcaaagaagaaaccggagaaggttgtgaaccctttgttcgagaagcgcccgaagcagttcggaatcggaggggcattgccgcctaagagggatcttcatcggtttgtgaaatggccgaaggtggtccgcattcagagacagaggagaatattgaagcagcgattgaaggttcctccggctctgcaccagttcactcggactttggacaagaatcttgctacaaatctcttcaagatgcttctcaaatacaggcctgaagaccgagctgcaaagaaggaaaggcttctgaagagggcgcaagctgaggctgaagggaaaactgttgaagttaagaagcccattgttgttaagtatgggctcaatcatgtcacttaccttattgaacagaacaaggcacagttggtggttattgctcatgatgttgacccaatcgagcttgtggtttggctacccgctctgtgcaggaagatggagataccctattgtattgtcaaaggaaaagctcgtttgggagcggttgtgcataagaaaacagcatcagtcttgtgtctaaccactgtgaagaacgaggacaaattggaattcagcaaaatcctggaggccattaaggccaacttcaatgataagttcgatgagatcagaaggaagtggggtggtggagttatgggttccaaatctcaggcaaaatccaagtctagggagaagttgctagcaaaggaagctgcccagagaatgagctaaggcttctctttgtcttgttattggtgctatcagatttgcgccagtagggttttttgattaaattctgttggtggcaaatattttttggtttatttggagcttcagtcaacttatatcaaacccagtgtcttgctcatcaaagattttccaaccagtggactcactaccatattgcttggtagtattttggtgccatgaaggtctcgctattaaccattttggttacatgacagactcctcagttgcctatgtgaatttttcgattgtgcagac

SEQ ID NO: 4149 - DNA, 1128 bp, Elaeis guineensis
aagcgaaacgcgaagatggctcccaaaagaggtgtgaaggctgcagtgccggcgaagaaaaaaccggagaaggttgtgaatcctctgttcgagaagcggccgaagcagtttgggatcggaggggctttgcctccgaagaaggacctccaccgtttcgtcaagtggccgaaggtggtcagaatccagaggcagcggaggattctcaagcagcgcttgaaggtcccacctgcgttgaaccagttcacgaggactttggataagaaccttgcctcgagcttgttcaagatgcttctgaagtatcgtcctgaagacagagctgcaaagaaggaacggcttctgaaaagggctcaggcagaggctgaagggaagcctgttgaagtcaagaggcctattgttgtgaagtatgggcttaatcatgtgacctacctcattgaacagaacaaggcacaactggtggtcattgctcatgatgttgacccagttgagctagttgtttggctccctgccttgtgccggaagatggagattccttactgtattgttaaaggaaaagcacgacttggagcgattgtgcacaagaagactgcagctgtattgtgtttgaccaccgtaaaaaatgaggataaactagaattcagcaaaatcttggaggctatcaaggccaacttcaatgataagtttgatgaggtccgtaggaagtggggaggtgggataatgggttccaagtctcaggcaaaagccaaagcgagggaaaagcttctagcaaaggaagctgctcagaggatgagctaggtttctttattttaggtcatgtggtttcgcctctagcttgcagctgataagcagatggactagcagccatatctgaaagtggatagtatttgtcttgttctctggcgaacttccccaagcatgtttcttggtgtcaccaaaatttttgttttcttctgatgttttaaaagattgattattattgtgtgctttgcattgctgattcatttttgttctaattttatgtgcttgtctgttaaacttatctggaattttaaccgttattttatcaggacacttaactatgacgactgctgatatgagaaaatgctttcgttctaaaaaaaaaaaaaaaaa

SEQ ID NO: 4150 - DNA, 1272 bp, Phalaenopsis aphrodite
agattgcccttgggggcagctctaattcattggtgtgcccatcgatataaagtcggctctaaccagtcatcttcgtcagagctccttggttgctccaaatctcgaagtaaccctagaagttagccgtcgcaactcgaattgaaatggctccgaagagaggaggtaaggcaccggtcgcggggaaaaagaagacggagaaggttgtgaatccgttatttgagaagaggccgaagcagttcgggattgggggtgctctacctccaaagagggatttacatcgttttgtcaaatggcctaaggtggtaagaattcagaggcagaggaggattcttaagcagcgtctgaaggttccgccagctattaaccagttcaccaggaccttggacaagaatcttgcaacaaatctgtttaagatgcttttgaagtataggcccgaggacaaagctgccaagaaggaacgtcttttgaagagggcacaagctgagactgaagggaagacaattgaatccaagaaaccaattgttgtgaaatatgggcttaatcacgtcacttacctcattgagcagaacaaggcccaattggttgttattgctcatgatgttgatccaattgaactggttgtttggcttccagcattgtgcaggaagatggaaatcccctactgcatagtgaagggaaaggcacgtttgggaacaattgttcacaagaagactgctgctgtattgtgccttaccactgtgaagaatgaagataagcttgaatttagcaaaattttagaggctattaaggccaacttcaatgacaagttcgatgagatcaggaaaaagtggggaggcggaattatgggttccaaatctcaggcaaaaagtaaggcaaaggaaaagctcatggctaaagaagctgctcagaggatgagctaggctgtttttcaacttttgaaatatgcattatgtagctgttttgttctttgatccgtattttattagattttgatctccgttggtggctgcgtagactatgttttatggaccgaagtttttttttcacatacgtgtattaactattttattctggggcacaattttctgtgaatcctacttgctccttagaaatattgcttgataagagttcttggatcaatggagaagaggatacgagcattcatttcaggttagactttgttaccattacatcagcgagtagttggttagcaactattagttttagctgcaggtcatgtttgtgtgatgaaatcctagaatttgatttgtt

SEQ ID NO: 4151 - DNA, 822 bp, Musa acuminata
ggtccctctgcgccgtctcccgacacgaaaccctaatcggagcgaaggaatggcccccaaaagatctgcgaaagcgcccgttccggcaaagaagaaaccggagaaggttgtgaatcctttgtttgagaagcgcccgaagcagttcggaatcggaggggcattgcctccaaagagggatttgcacagattcgtgaaatggccgaaggtggtccggattcagaggcagagaaggatactgaagcagcggctgaaggttccacctgctttgaatcagttcactcggacattggacaagaaccttgccacaaatctcttcaagatgcttctgaagtacaggcctgaagaccgagctgcaaagaaggaaaggctactgaagagggcacaagctgaagctgaagggaagactgttgaactgaagaagcccattgttgtcaagtatgggctcaaccatgtcacttaccttatcgaacagaacaaggcacagttggtggttatcgcacacgatgtggatccaattgagcttgtcgtgtggctacccgccttgtgtaggaagatggagatcccttactgtattgtcaaaggaaaagcccgtttaggagcgatcgtgcataagaaaacagcatcagtctttgtgtctgaccactgtgaagaacgaggacaaacaagaattcagcaaaatcctggaagcgattaaggccaatttcaatgacaagtttgacgaggtcaggagaagtgggggtgggtggaatcatgggttccaaatctctggcaaaatccaagccagggagaagtactagcaaaggaagctgcccagagaatgac

SEQ ID NO: 4152 - DNA, 999 bp, Liriodendron tulipifera
  misc_feature (285)..(285): n is a, c, g, or t
gcgcaggaaagcacctcttctctagaaatggctccaaaaagaggaggaaaagcacctgtaccagcgaagaagaaaccggagaaggttgtgaatcctttgtttgagaagcgcccaaagcagtttgggattggaggggcattgcctccaaagagggacttgcatcgttttgtgaagtggccgaaggttgtccggatccaacggcagaggaggatcctcaagcagcggttgaaggtcccgccggccttgaaccagtttacaaaaacgttggacaaaaatcttgcaacnagcctctttaagatgcttctcaagtacaggcctgaagacaaagctgcaaagaaggaacggctgctgaagagggctcaggctgaggctgaggggaagactgctgaggtcaagaagcctattgtcgtgaagtatgggctcaatcatgttacataccttattgagcagaacaaggcgcaattggtagtcatcgcccatgacgtggacccaatcgaactggtcgtttggttgcctgccttgtgccggaagatggagattccttactgcattgtgaagggaaaagcacggttgggagcgattgttcacatgaaaaccgcagccgcattgtgtctgaccactgtgaaaaacgaggacaagctggaattcagcaagatcttagaggctatcaaggccaatttcaacgacaagtacgatgagtacaggaagaaatggggaggtggaatcatgggatccaaatctcaagccaaaaccaaagccaaggagaggctgctggccaaggaagctgcccagaggatgaactaggtgtagtctctcactctcttccattcccctaggattttgtttcaagatttctttttgtagcagttatcttgtgtttgccttagctgcctttcgtttttgatatatgggatagtatctttttgcttgttcaaaacattcttagaccctaggataagcagttatctgcccttttattatggtatttttgtttctcct

SEQ ID NO: 4153 - DNA, 1036 bp, Amorphophallus konjac
aagagaggagccaaggtgcccgtgccagcgaagaagaagccggagaaggtggtgaaccctttgttcgagaagcgcccgaaacagttcgggatcggtggggctttgcctccgaaaagggacctgcaccggttcgtgaaatggccgaaggtggtccgcatccagaggcagaggaggattctgaagcagcggctgaaggttcccccggcttgaatcagttcactcgcaccttggacaagaaccttgctaccacccttttcaaaatgcttctcaagtacaggcccgaggataaagctgcaaagaaggaaagacttcttaagagggctctggctgagtctgaaggcaagactgttgaggttaagaagcctattgttgtcaagtatgggcttaatcatgtgacttaccttattgagcagaacaaggctcagctggttgttatagctcatgatgtggatccgattgagttggttgtctggctgccagctctgtgcaggaagatggagatcccctactgtattgtgaaagggaaagcacgattgggaacgattgtacacaagaagaccgcatctgttttgtgcttgacttcggtaaagaatgaggacaagcttgaattcagtaaaattctggaggccatcaaggccaacttcaatgacaagtttgacgagatcagaaagaaatggggtggcggtatcatgggctcaaagtctcaggccaaaacaaaagccaaggaaaagcttctagccaaggaggcagctcagaggatgagctagacaggaaagaaacttcttcagtcaaagtattcagccttgtggctttccatttggcttttggtagatcagcagatgtaatactattgagcagccaattgcaaccgcctagaactcagtaaccgtgacgttgtattttgccttgccatccttggggcatgaatttcattttcggacagttttttggggaattttttgctagcctcgtgacttttgaattaatcactgccattcttccttcttttaaatacaaacttagcctatcttgatga

SEQ ID NO: 4154 - DNA, 1052 bp, Musa acuminata
ttcgtcttccaggccccaaaaaaaggtgggaaggcacccgttccggctaagaagaagccggagaaagttgtgaaccctttgttcgagaagcgcccgaagcaatttggaatcggaggggcattgccaccgaagagggatctgcatcggttcgtgaaatggccaaaggttgtccggattcagaggcaaaagaggatattgaagcagcggctgaaggtcccgccggcgttgaaccagttcactcggactttggacaagaaccttgctacaaatctcttcaagatgcttctcaagtacaggcctgaagaccgagctgcaaagaaggaaaggcttctgaagagggcacaagctgaggctgaagggaagactgttgaagttaagaagcctattgtcgtcaagtatgggctcaatcatgtcacctatcttattgagcagaacaaggcacagttggtggtcatcgctcatgatgtggacccaatcgagcttgtcgtttggcttcctgcattatgcaggaagatggagatcccctactgtatcgtcaaagggaaagcccgtttgggagcgatcgtacacaagaaaaccgcatcagtcctgtgtctgaccaccgtgaagaacgaggacaaattggaattcagcaagattctggaggccattaaggccaacttcaatgataagtttgatgagatcaggaggaagtggggtggtggaataatgggttccaaatctctggcaaaaagtaaggccaaggagaagttgctagccaaggaagctgcccagaggctgacctaggtctcatcgtgttgttgtccatggtgctatcagattccggcctgtggaatttttgcttaaattctttgactgaaatcactggagtgtattctggatctttagatggtggataatgtgtttgtttacttggaacttttattcatcttttatcaacttcgaatgcctttttctaattcaaactcttcataaatcctacaactttcttttgctggtatttttgtgctatgctcatctatgaataagttcatggtgtcgaccattttggt

SEQ ID NO: 4155 - DNA, 1110 bp, Castanea mollissima
tttttcttcctctgccgttagcaaaaggtaaaccagacgagacctcctacacatcggcacaaatggctccaaagagaggtggaaaggcaccagtgccagcagcagcatcgaagaagaagacagagaaggtgttgaacccattgttcgagaagcgcccgaagcagtttgggatcggtggggctttgccaccaaagagagatctgacccgattcgtcaaatggcctaagactgttcagcttcagaggaagaagaggatcctcaagcagaggctcaaggtcccacctgctctaaaccagttcaccaaaaccctcgacaagaaccttgcaacaaacctgttcaagatgctactcaagtacaggcctgaggacaaggctgcaaagagggaacgtctcttgaaaagggctcaggctgaatctgaaggcaaaactgttgaagcaaagaagcctattgttgtgaagtatggtctcaaccatgtcacatacctcattgagcagaacaaggctcaactggttgttattgcacatgatgtggacccaatcgagttggttgtctggcttcccgcattgtgcaggaagatggaaatcccatactgcattgtgaaaggaaaagcccgcttgggatcgatcgtccacaagaaaactgcatcagttttgtgcttgacaacagtcaagaatgaagataagttggagttcagcaagatcttagaggctatcaaggccaacttcaacgacaagtacgatgagtacaggaaaaagtggggtggtggaatcatgggttccaaatctcaggccaaaaccaaggccaaagagagacttcttgccaaggaagctgctcagaggatgacttaggagcaatgattatgtgtttcttcttgttacttagatatgattgtctgagcctgtttttatctagaattttgtttgttcaaggttatttgcattaactacataagttttgtttctttagaggcagcttatataaattaagaaacagctaatgttggtgtttgagtttaagctgccttgcattcatagctttcgggtgagactatcatgattccttctttttggtataagaagcaactagaccaccattttgcaaaaaaaaaaa

SEQ ID NO: 4156 - DNA, 1794 bp, Quercus alba
gccgttagcaaaggtaaaccagacgagacctccaacacatcgctacaaatggctccaaagagaggtggaaaggcaccagtgccagcagcagcatcgaagaagaagacggagaaggtgctgaacccattgttcgagaagcgtcctaagcagtttgggatcggtggggctttgccaccgaagagagatctgacccgattcgtcaaatggcctaagactgttcagcttcagaggaagaagaggatcctcaagcagaggctcaaggtcccaccagctctcaaccagttcaccaaaaccctcgacaagaaccttgcaacaaacttgttcaagatgctactcaagtacaggcccgaggacaaggctgcaaagagagagcgtctcttgaaaagggctcaggctgaatctgaaggcaaaactgttgaagcaaagaagcctattgttgtgaagtatggtctcaaccatgtcacatacctcatcgagcagaacaaagctcaactggttgtcattgcacatgatgtggacccaatcgagttggttgtctggcttccagcattgtgcaggaagatggaaatcccatactgcattgtgaaaggaaaagcccgcttgggatcgattgtacacaagaaaactgcttcagttttgtgcttgacaacagtcaagaatgaagataagttggagttcagcaagatcttagaggctatcaaggccaacttcaacgacaagtacgacgagtacaggaaaaaatggggtggtggaatcatgggttccaaatcccaggccaaaaccaaggccaaagagagacttcttgctaaggaagctgctcagaggatgacttaggagccacgattatgtgtttcttcttgttacttagatatgattgtctgtctgagctgtttttatctagaattttgtttgttcaaggttatttgctttaactacatgagttttgtttctttttagaggcagcttatataaattaaggaacagctaatgttggtgtttaagtttaagctgccttgcattcatagctttcgggtgagactatcatgattccttatttttggtataagaagcaacttgaaccccccattttgcaattttcactcgctactgataagatccccaagcataaaccagatatgtgcctttattttatttctgtcaatgtctgtggagtgatgaaatgccatttaaggtagagctcatggagattatgatttttaaaatttcttttttcatattttaataatcgtactatttttatatgatctagtagatgttgattagtcttatgagaccaatattttctagttatgccctttcagaggaacctaacaaatgaaaatgctctggcttgtgtaataaggattatatttttctttgaaagatggtcggttggaaaaatgtttggaataagattcagtgtatcccaacacaggataccctctcttgtttagggcatttatgcatccttctttgacgttaatttagagtaggtcctaatgtttttaaggctttactgtctgttaatgatttcttgattctttttgtctttttaatgtgcggctttattgggtcggggttgcctgatttcatatgtgatgtgtggccagacttttagtgaattaaaagtctctattttagtttgtggtgtttcttgcacatgttaatagcacttgcaagtttcatatactattcccgtttgattcgtgttctcaattccaacttacacgtttgtttctatgaaactttatgtaaaattattttttttctatatttttctagtgtttgatagca

SEQ ID NO: 4157 - DNA, 1225 bp, Quercus alba
taaacggtcccttagtatatataggataccgcactagggtttttcttcctctgccgttagcaaaggtaaaccagacgagaccttcaacacatcggcacaaatggctccaaagagaggtggaaaggcaccagtgccagcagcagcatcgaagaagaagacggagaaggtgttgaacccattgttcgagaagcgtcctaagcagtttgggatcggtggggctttgccaccgaagagagatctgacccgattcgtcaaatggcctaagactgttcagcttcagaggaagaagaggatcctcaagcagaggctcaaggtcccaccagccctcaaccagttcaccaaaaccctcgacaagaaccttgcaacaaacctgttcaagatgctacttaagtacaggcctgaggacaaggctgcaaagagagagcgtctcttgaaaagggctcaggctgaatctgaaggcaaaactgttgaagcaaagaagcctattgttgtgaagtatggtctcaaccatgtcacatacctcatcgagcagaacaaggctcaactggtcgttattgcacatgatgtggacccaatcgagttggttgtctggcttcctgcattgtgcaggaagatggaaatcccatactgcattgtgaaaggaaaagcccgcttgggatcgattgtccacaagaaaactgcatcagttttgtgcttgacaacagtcaagaatgaagataagttggagttcagcaagatcttagaggctatcaaggccaacttcaatgacaagtacgatgagtacaggaaaaagtggggtggtggaatcatgggttccaaatcccaggccaaaaccaaggccaaagagagacttctagccaaggaagctgctcaaaggatgacttaggagcaatgattatgtgtttcttcttgttacttagatatgattttctgagctgtttttatctagaattttgtttgttcaaggttatttgcattaactacataagttttgtttctttagaggcagcttatataaattaaggaacagctaatgttggtgttggagtttaagctgccttgcatacatagctttcgggtgagactatcatgattccttctttttggtataagaagcaacttgaccccccattatgcaattttcactagctaatgataagatccccaagcctaaaccggatatgtgcctttattttatttgtctgacaatgtctgtggagtgatg

SEQ ID NO: 4158 - DNA, 1047 bp, Persea americana
ttcttgtttctagtggtttttcctacaccgttcagctgacaccttctgccctaaaatggccccaaaaagaggaggaaaggctcctgtacctgcaaagaagaaaccggagaaggttgtgaatccattgtttgagaagcgcccaaagcagtttgggatcggaggggcattgcctccgaagagggacttgcatcggtttgttaaatggccgaaggttgttcgcattcaaagacagaggaggattctcaagcagcgattgaaggtcccgcctgcattgaaccagtttaccaaaacattggacaagaaccttgcaacaaatctctttaagatgcttttaaagtacagacctgaggacagagctgccaagaaggaacgtcttctcaaaagggctcaagctgaggctgaagggaaggctgtcgaggtcaagaagcctattgttgtcaagtatgggcttaatcacattacataccttattgagcagaacaaggcacaattggttgttatagctcatgatgtggaccccattgaactggtcgtctggttgcctgccttatgccgtaaaatggagattccttactgtattgttaaaggaaaagcacgtttgggagcgattgtccacaagaaaactgcagcagttttgtgtctgacaacagtgaaaaatgaggacaagctagaattcagcaaaatcttagaagccatcaaggcaaacttcaacgacaaatacgaggagtaccggaagaaatggggaggtggtataatgggctccaagtcccaagccaaaaccagggccaaggagaaggttctatccaaggaggctgcccagaggatgtgaatgtcctagttcattgtctttcctttaagatagataactacaactcttgttccagggtttgatatctccattttgcagctgtagctatttgagcggactcctccacagttttgagtattttaacttcgccattaccgcaatgttggattgattcgattgaatatttgcactacattaagggagatctatatgaagggtactctccacttggtatttct

SEQ ID NO: 4159 - DNA, 1098 bp, Nuphar advena
gcgatcaccactctgcgttcgcctcgccggagagaaagtgaaagagagagagagcagagtttaccacaaagaaatggcccccaaaagaggtggaaaagcaccagtccctgccaagaagaaggcggaaaaagttgtgaatccattgtttgaaaagcggcccaaacaatttggaattggtggtgcattaccaccaaaaagagatttgcataggttcgtgaaatggccaaaagttgttcgtattcaaaggcaacgcaggattctaaaacagcgattgaaggttcctcctgctttgaaccagttcacaaagacacttgacaagaatgttgcaacaaatctttttaagatgctgcttaaatatcgtccagaggacaaggctgccaagaaggaaaggcttttgaaaagggctcaggcagaggctgaaggcaagcctgtggaggtcaagaaaccaattgttgtcaagtatggtatcaatcatgtgacttaccttattgagcagaacaaggcccagttggtggttattgctcatgatgtggacccaatcgagcttgttgtatggctacctgccttgtgccggaaaatggaaatcccttactgcattgtgaaaggcaaagcacgtcttggagcgattgttcacaagaaaactgccacagctctctgtcttacttcagtgaagaatgaagacaagctggagttcagcaagatcattgaggcggtcaaggccaacttcaatgacaaatatgatgagcacaggaagaaatggggtggtggcattatgggatctaaatctctggcaaagactaaggccaaagaaaagcttctagctaaggaagccgcacagaggatgagttgagaataaacatgagcggataaatctaggaaaattggtagttgagctgtttttcttctaggagaatatagctcaagagaatttcctttgtctatttgtcctttttaacgagttttggtttgattttgtgctttctgaattgctttgtgaattgcccatctgtctcccgttttttcctgttctaatagattgagaacattggactctgtgctctttatctataatgcacattttctctggacccttcacac

SEQ ID NO: 4160 - DNA, 1235 bp, Citrus clementina
gccctaactataaaacatacttcaagtcctcttacttagtctgttctggctagggtttttcttttcattcgccgttctccaaaaccacagagcctagcagaagcggcacgaaatggctccgaagagaggaggaaaggttgctgcagcaccagcaaagaagaagccggagaaggttgtgaatccactgtttgagaagcgtccgaagcagtttggtatcggtggggctctgccgccgaagaaggatcttcaccgttatgtgaagtggcccaaggctattcgtattcagaggcagaggaggatcctcaggcagaggttgaaggttccacctgctttgaaccaattcaccaagactttggacaagaatcttgcctcaagtcttttcaagttgctcctcaagtacaggcctgaggatagagctgctaagaaggaacgtcttttgaagagagctcaggctgaggctgaagggaagactgtggaggctaagaagcctattgttgtgaaatatggcttgaaccatgtgacatacctcattgaacagaacaaggcacaattggttgtcattgctcatgatgttgacccgattgagttggttgtctggcttcctgccttgtgcaggaagatggagatcccatactgcattgtcaaaggaaaatcacgtttgggatcgattgtccacaagaagacagcttctgtattgtgtttgacaacagttaagaatgaggataagatggaattcagcaagatccttgaggccatcaaggctaacttcaacgacaagtacgaggagttaagaaagaagtggggaggtggtattatgggctccaaatcacaggcaaaaaccaaggccaaggagaaacttcttgccaaggaagctgctcagaggctgacctaggattttgctcagtcttaagagagtcccaatgttttgttatttcttgtgctttcatcatctttttattttaatgaacatgtttctatgtagtctcttagcattttaccttattaagatttttaattgaacttctgaactgttatatgtttgcaccattagtatgtgcctttttgatatgaggaacttattgcaagtccacattcctatatagattttgtgtgatcttttgttgcagcaatgtgattgattccccagttttaatttttttttaattaacatagccacactgccttttcttgaggatattagctgttaatggaatgtgctaatctcatggttgagg

SEQ ID NO: 4161 - DNA, 1235 bp, Citrus sinensis
gccctagctataaaacatacttcaagtcctcttacttggtctgttctggctagggtttttcttttcattcgccgttctccaaaaccacagagcctagcagaagcggcacgaaatggctccgaagagaggaggaaaggttgctgcagcaccagcaaagaagaagccggagaaggttgtgaatccactgtttgagaagcgtccgaagcagtttggtatcggtggggctctgccgccgaagaaggatcttcaccgttatgtgaagtggcccaaggctattcgtattcagaggcagaggaggatcctcaggcagaggttgaaggttccacctgctttgaaccaattcaccaagactttggacaagaatcttgcctcaagtcttttcaagttgctcctcaagtacaggcctgaggatagagctgctaagaaggaacgtcttttgaagagagctcaggctgaggctgaagggaagactgtggaggctaagaagcctattgttgtgaaatatggcttgaaccatgtgacatacctcattgaacagaacaaggcacaattggttgtcattgctcatgatgttgacccgattgagttggttgtctggcttcctgccttgtgcaggaagatggagatcccatactgcattgtcaaaggaaaatcacgtttgggatcgattgtccacaagaagacagcttctgtattgtgtttgacaacagttaagaatgaggataagatggaattcagcaagatccttgaggccatcaaggctaacttcaacgacaagtacgaggagttaagaaagaagtggggaggtggtattatgggctccaaatcacaggcaaaaaccaaggccaaggagaaacttcttgctaaggaagctgctcagaggctgacctaggattttgctcagtcttaagagagtccaatgttttgttatttcttgtgctttcatcatctttttattttaatgaacatgtttctatgtagtctcttagcattttaccttattaagatttttaattgaacttctgaactgttatatgtttgcaccattagtatgtgcctttttgatatgaggaacttattgcaagtccacattcctatatagattttgtgtgatcttttgttgcagcaatgtgattgattcctcagttttaattttttttttaattaacatagccacactgccttttcttgaggacattagctgttaatggaatgtgctaatctcatggttgagg

SEQ ID NO: 4162 - DNA, 1155 bp, Prunus mume
gccgttcgcaggtttcagaggtacccagcaaactccaagagcagcctgcgcaaatggctccgaaaagaggtgtcaaagctccagtcgcagcgaagaagaagacggagaaagtggtgaacccactgttcgagaaacgtcccaagcagtttgggattggaggggcattgccaccaaagagagatcttacccgtttcgtcaaatggcccaaggttgttcaagttcagaggaagaaaaggatcctcaagcagaggttgaaggttccaccagctttgaaccagttcaccaagaccctagacaagaacctggctaccagcctgttcaagatgcttctcaagtataggccagaagacaaagcagcaaagaaggagcgccttttgaagagggcacaagcagagtctgagggaaaaactgttgaagccaaaaaacctattgttgtgaaatatggtctcaaccatgtcacctacctcattgagcagaacaaagcccagcttgttgttatcgcacatgatgttgacccaatagagttggtggtttggctgcctgcattatgtaggaagatggaaatcccatattgcatagtgaagggcaaagcacgcttgggatcgattgtccataagaaaactgcatcagttttgtgcttgacaacagtcaagaatgaagataaattggagttcagcaaggtgctagaggcaatcaaggccaacttcaatgacaagtatgatgagtacaggaaaaagtggggcggcggcatcatgggttccaaatcccaggccaaaactagggcgaaagagaggctccttgcaaaagaagctgctcaaaggatgaattaaattttggttgatcttgaatttgttttttacttaggataagattgtcctagtctggttctagaattgtgattgttcaagtttatttagatcaaccgcagaggttttgtttcctgaggatgtgtctgaggttaaagctgcaatgttgtttagctgtttggattagacttattcatggacatgccctttttgttatggctgttgggctttctaatgattatcatttattttacatttcatgattacaatttctgtgcgatgatatttctggtatcttagtcatagaataaaatagggtttaaggttctgtttggtttccatttattta

SEQ ID NO: 4163 - DNA, 1073 bp, Zostera marina
atcaaggggtaattttgatagaaagtgaaaaaatatgtcccgaacacattccatataaatagcaaatacacacttccgatctcctcatctctttctagggtttttgccgcctccgcctccatttcatccagaagctgcaaccaacagcggcgacaaggagaatggctccgaaaagaggtgttaaaccgtctgctccagcaaagaagaaagtggaaaaagttgtcaaccccttgttcgagaagcggccaaagcagtttggcattggaggagctcttcctcccaagagagacctccataggtttgtaagatggcctcaggtggttcgtatccaaaggcagagaaggattctcaaacaaagattgaaggttcctccagccctcaaccagtttactagaacccttgacaaaaatctagcaacgaacctttttaagatgttactgaagtatagacctgaagataaagcagctaagaaggaacgtcttttgagcagagctcaggctgaggctgagggtaaaactgtggaacttaagaagcccattgttgtgaagtatgggttgaatcatgttacttatctcattgagcagaaaaaagctcagctagtggtcattgcccatgatgtcgatcctatcgaattggttgtatggctcccagccctctgcaggaagttggagatcccatattgcattgtaaaagggaaatcaagattgggagcggttgttcatcagaaaacgtcagctgtgctgtgcttgaccacagtgaaaaatgaggacaaattggaattcagtaaaatattggaagccatcaaggcgaatttcaacgacaaattcgatgaagtccgcaagaaatggggaggtggaatcatgggttccaaatctcaagccaaaaccaaagcaaaggagaggcttatagctaaagaagcagcccaaaggatgaattgatgagtacctatcctaatttctgttgtttttattctgtgttctttcaaaccagtattttttcccgttaaaattatgttgtttaccttgtgtactactttttgtcaccgttaaccttaagttgcagtcctaaaatta

SEQ ID NO: 4164 - DNA, 999 bp, Secale cereale
agaagaaggcggcggacaaggtggtgaacccgctgttcgagaagaggccgaagcagttcggcatcggtggcgccctcccgcccaagaaggacctccaccggttcgtcaagtggcccaaggtcgtgcgcatccagcgccagcgccgcatcctcaagcagcgcctcaaggtgcccccggctctccaccagttcacccgcaccctcgacaagaacctcgccaccaacctgtttaagatgcttctcaagtaccgccctgaggacaaggtggctaagaaggagaggcttctgaagagggcccaggctgaggctgaggggaaaaccgttgaggccaagaagccaattgttgtgaagtatggtcttaaccatgtcacttacctcattgagcagagcaaggctcagctggttgtcatcgctcatgatgttgacccaattgagctggttgtgtggctcccagccctgtgcaggaagatggaggtcccatactgcattgttaagggaaaatcacgccttggatcgatcgttcacaagaagactgcctcagttctgtgcctcaccactgtgaagaacgaggacaagcttgagttcagcaagatcttggaggctatcaaggctaacttcaacgacaagttcgatgaggtcaggaagaagtggggcggtggcgtcatgggctccaagtcgcaggccaagaccaaggccagggaaaggctcatcgccaaggaggctgcgcagaggatgaactaagcctagccctgtcagagcatgtgccatgtagtttccctttcagtgtgtcctgattttgacgaggaactcgaacccttttagcagcactgtggaatcgtattgtggttttctgattctctgttccgttcgccagacttatgcaaagatcagatgaggtttacccatgtttggattctatatagttttatgtcctttgagtgagagttggttgtgtgtttgttctgagatgtaggaattaaagatattgcaagctcctgtc

SEQ ID NO: 4165 - DNA, 973 bp, Phalaenopsis aphrodite
cccattctcccgccgtcgacgaaaccctaacttgagccgtctgtcatcgaagcgagatggctcccaagagagcagggaaggcgccggctgcggtgaagaagaagacggagaaggtcgtgaaccctctttttgagaagaggcctaagcaatttgggattggtggggctctacctcctaagagggatcttcatcgcttcgtgaaatggcctaaggtagtgagaatccagaggcagaggaggatcctcaagcagcgtttgaaggttcctcctgcgattaatcagttcacgaggactttggacaagaaccttgcaacaaacctgtttaagatgctcctgaagtacagacctgaggatagtgctgcgaagaaggaacgccttctcaaacgtgcacaagccgagactgaaggaaaggttgtggagtccaagaagccaattgttgtcaaatatggccttaatcatgttacttatctcatagaacagaacaaggcccagctggtggttatagctcatgatgtagacccaatagagcttgtggtttggcttccagcattgtgcaggaagatggagatcccttactgcattgtgaagggaaaagctcggttgggagcaattgtccacaagaaaaccgctgcggtattgtgcttaacaactgtgaagaacgaagacaagcttgagttcagcaaaatcttggaagctattaaggccaacttcaatgacaaattcgatgagattcgaaagaaatggggaggaggaattatgggttcgaaatctcaggccaaaagtaaggccaaagagaagctcatggctaaagaagctgctcagagaatgagttaggtttatatattattatagcttttctatattcaaacattatgttctttctgtagatttcagttttttgagctgagaatgtcctttcagacttcacaattttaactttattaactcctcttttctgattgtttaatgttttt

SEQ ID NO: 4166 - DNA, 1009 bp, Eschscholzia californica
cctcctccttcagcttcaccaccagcagcgaagcaatggctcccaaaagaggcgtgaaggctccagtacccgccaagaagaagactgacaaggttgtaaatccattgttcgagaagcgaccaaagcaatttggaattggtggggctttgccaccaaagaaggatctccataggtttgtcaaatggccgaaggttgttcgcattcagaggcagaggaggattttgaagcaacgattgaaggttccacctgctttgaatcagttcaccaaaactctggataagaaccttgcaaccaatctatttaagatgctactcaagtacagaccagaggacaaggctgccaagaaggaaagacttctgaaaagagcacaggctgaatccgagggaaagacagttgagtcgaagaagcccattgttgtcaaatatggacttaatcacattacctacctcattgagcagaacaaggcccaattggtagtgattgcccatgatgttgatccaattgagcttgttgtctggcttcctgctttgtgccgaaaaatggagatcccttacgcaattgtgaagggcaaggctcgtcttggagcgattgtccacaagaaaacagcttcagctttgtgcttaacatcagtgaagaacgaagacaagatggagttcagcaaggttgtggaagcaatcaaggcgaacttcaatgacaagtttgacgagcacaggaagaagtggggaggtggtattatgggatcgaaatctcaagccaagaccaaagccaaggacagggttctagcaaaagaagcagcacaaaggttgacctgagcgaagaggggatttttgttataccatctccagtttttttggttgtttttgactatttttcttttctgcgtgttagtttaatgttaaccgaattatgtattggttttcgtcattaaagaattggaccttggtctattttaaattacgtcagttgatcttcaaatattcagcttcaaattgcgactatttgtacgact

SEQ ID NO: 4167 - DNA, 1011 bp, Eschscholzia californica
cagcagcagcagaaacgaacagttcgcagaaatggctcctaaaagaggtgtgaaggctccagttcccgccaagaaaaaaactgataaggttgtcaatcctttgtttgagaagaggccaaagcaatttggaattggtggtgcattgccaccgaaaaaggatttgcataggtttgttaaatggccgaaggttgttcgtattcaaaggcaaagaaggattttgaagcaaaggttgaaggttccacctgctttgaatcagttcactaagactctggacaagaaccttgcaaccaatctatttaagatgctactcaaatacagaccagaggacaaggctgctaagaaggaaagacttctgaaaagagcacaggctgaatctgaaggaaaaactgtcgagtcaaagaagcctattgttgtcaaatatggacttaatcacattacttacctcatcgagcagaacaaggcccaattggtggtgattgcccatgatgtcgaccctattgagcttgttgtctggctcccagctttgtgccgtaaaatggagataccatatgcaattgtgaagggcaaagctcgtcttggagcgattgtccacaagaaaacagcctcagctttgtgcttaacatcagtgaagaatgaagataagatggacttcagcaagattgtggaggcaatcaaggccaacttcaacgacaaattcgatgagcacagaaagaaatggggaggtggtattatgggatcgaagtctcaggccaaaacaaaagcaaaagacagggtcttagcaaaggaagcagcacaaaggttgacttaattttgtagcaagtaagagagttaccgttggtacggatttagctttgttattcaaaacaccttttagttgttgctgttgatctgagaagttttgttttgttttgccctttaatgttaactgttagcggacgaaataaacccattcctaagaattttgttttgttatacattttctacatctatatccctgttatgaggaatcta

SEQ ID NO: 4168 - DNA, 1088 bp, Zostera marina
atcaaggggtaattttgatagaaagtgaaaaaatatgtcccgaacacattccatataaatagcaaatacacacttccgatctcctcatctctttctagggtttttgccgcctccgcctccatttcatccagaagctgcaaccaacagcggcgacaaggagaatggctccgaaaagaggtgttaaaccgtctgctccagcaaagaagaaagtggaaaaagttgtcaaccccttgttcgagaagcggccaaagcagtttggcattggaggagctcttcctcccaagagagacctccataggtttgtaagatggcctcaggtggttcgtatccaaaggcagagaaggattctcaaacaaagattgaaggttcctccagccctcaaccagtttactagaacccttgacaaaaatctagcaacgaacctttttaagatgttactgaagtatagacctgaagataaagcagctaagaaggaacgtcttttgagcagagctcaggctgaggctgagggtaaaactgtggaacttaagaagcccattgttgtgaagtatgggttgaatcatgttacttatctcattgagcagaaaaaagctcagctagtggtcattgcccatgatgtcgatcctatcgaattggttgtatggctcccagccctctgcaggaagttggagatcccatattgcattgtaaaagggaaatcaagattgggagcggttgttcatcagaaaacgtcagctgtgctgtgcttgaccacagtgaaaaatgaggacaaattggaattcagtaaaatattggaagccatcaaggcgaatttcaacgacaaattcgatgaagtccgcaagaaatggggaggtggaatcatgggttccaaatctcaagccaaaaccaaagcaaaggagaggcttatagctaaagaagcagcccaaaggatgaattgatgagtacctatcctaatttctgttgtttttattctgtgttctttcaaaccagtattttttcccgttaaaattatgttgtttaccttgtgtactactttttgtcaccgttaaccttaagttgcagtcctaaaattattttaatatgaaatt

SEQ ID NO: 4169 - DNA, 1180 bp, Amborella trichopoda
atgaattatggcttgcaggctcccaaaagaggcggaaaggctcctgttccggccaagaaaaaggctgaaaaggtagtgaatcccttatttgagaaacgcccaaagcagttcggaattggtggtgcattacctccaaagagggaccttcacaggtttgtgaagtggcctaaagttgttcgtattcaaaggcaaagaagaatactaaagcagaggctaaaggtccctccagctttgaatcagtttacaaagacattggataagaaccttgctacaaaccttttcaagatgcttctgaagtataggcctgaggacaaagctgccaagaaggaaaggcttttgaaaagggctcaagctgaggctgaaggaaagactgtagaatctaagaagccaattgttgtcaaatatgggttgaaccatgtgacatacctcatagagcagaacaaagcccaattggtgattattgcccatgatgtcgatcctatagagctggttgtctggttgcctgcactgtgcagaaagatggagattccttacgcaatagtgaagggaaaagctcgattgggaacgattgttcataagaaaactgcttccactctgtgtcttacatcggtgaaaaatgaggataaattggagttcagcaaaatagtggaggcaatcaaggccaacttcaatgataagtatgatgagtacaggaagaaatggggtggtggcatcatgggatcgaaatccctggccaaaaccaaagcccgagaaaggcttcttgccaaggaagcggcacaaaggatgacttagaaatgcacttgggaggctacccttcgaactttctaaacgtttcgcttcttgagtttaggaacagtttcttttggtggtgaacaattaatttgtcattcctttcccttgcaaattttgaaagtaatcagtaatgtagtaatatgactgcaaaatggaacgtgatcatatttcacttttaagggttcatgacattagaatttggcataattcgatacagcctaatatttttgggtatcggaggggaagacttgaagacacatgcatggtttgtatggaaatactctgtgaaagtattttcatttgaaaaaaactcttacgtgattagacatggaaatattttcacatcaattggcttaccaattggtgtgagaaaattcgttgggatcaa

SEQ ID NO: 4170 - DNA, 1081 bp, Secale cereale
gccgccggcgaaatggccccgaagcgaggcggcaaggcgccggtgcggcgaagaagaaggccgcggacaaggtggtgaacccgctgttcgagaagaggccgaagcagttcggcatcggtggcgccctgccgcccaagaaggacctccaccggttcgtcaagtggcccaaggttgtgcgcatccagcgccagcgccgcatcctcaagcagcgcctcaaggtgcccccggccctccaccagttcacccgcaccctcgacaagaacctcgccaccaacctgtttaagatgcttctcaagtaccgccctgaggacaaggtggctaagaaggagaggcttctgaagagggcccaggctgaggctgaggggaaaaccgttgaggccaagaagccaattgttgtgaagtatggtcttaaccatgtcacttacctcattgagcagagcaaggctcagctggtcgtcatcgctcatgatgttgacccaattgagctggttgtgtggctcccagccctgtgcaggaagatggaggtcccgtactgcattgttaagggaaaatcacgccttggatcgatcgttcacaagaagactgcctcagttctgtgcctcaccactgtgaagaacgaggacaagcttgagttcagcaagatcttggaggctatcaaggccaacttcaacgacaagttcgacgaggtcaggaagaagtggggcggtggcgtcatgggctccaagtcgcaggccaagaccaaggccagggaaaggctcatcgccaaggaggctgcgcagaggatgaactaagccctataagtatgtcagagcatgtgccatgtagtttcccctttcagtgtgtcctgattttgacgaggaactcgaacccttttagcagcactgtggaatcgtattgtggttttctgattctctgttccgttcgccagacttatgaaaagatcagatgaggtttacccatgtttggattcatatagttttatgtcctttgagtgagagttggttgtgagtttgttctgagatgtactaggagttaaagatattgcaagctcctgtccagcatgaaggggctttgatttcaa

SEQ ID NO: 4171 - DNA, 1100 bp, Castanea mollissima
cagcagccaagggtttgtgtaatactagggttttcctcagaattatcagaaatggcccctaaaagaggtggaaaagtggctgctgcacctgctaaaaagaagactgagaaggttttgaatccattatttgagaagcgttctaagcagtttggtattggtggtgctttgccgccaaagagagatctgcaccgatttgtgaagtggccagtggttgtccgtcttcagaggaagaagcgtatccttaagcagcgtttgaaggtcccaccagcattgaaccagttcactaagaccctggacaaaaaccttgcgacaaatttgttcaagttgcttctgaagtacaggccggaggacaaatcagcaaagaaggaacgccttttgaagagggctcaagcggaggccgaaggaaaaactgttgaagctaagaagcccattgttgtaaaatacggactcaaccatgttacctacctgattgaacagaacaaggcacagttggtagttattgctcatgatgtggacccaatagaattagttgtatggcttccagccttgtgcaggaagatggagatcccttactgcattgtgaaggggaagtcacgtcttggatcgattgtccacaagaaaacagcttccgtcttgtgtttgaccactgtcaagaatgaggataagctggagttcagcaaaatcctggaggcaatcaaggctaactttaatgacaagtatgatgagtaccgaaagaagtggggtggtgggatcatgggatccaaatcacaagccaaaaccaaggcaaaggaaagacttctagcaaaggaagctgctcagaggatgacttaggagtattattcatccttgggggacttgctctgccattgtgtttttttttctttgttggtcttattggttaaacttcttctatttagtttcgtgctgcattgtgtcacctctctagtcaaggaagtgatatgtttttgatacaactttaaatactccaattagctatctttcttgattatatataaagatttgttttgaatgatcaacatgttgatcacattaagtttgttagctataaaaatgaccattggtgtgattattttgtaact

SEQ ID NO: 4172 - DNA, 971 bp, Thalictrum flavum
agacgaaggaaaccagcatcaaccacaaatggcaccaaagaaaggcgtaagagctcctgctgcagcagctaagaagaagcctgagaaggtagtgaatccattgtttgagaagagacctaagcagtttgggattggaggagcattgcctccaaagaaggatctacatcgatttgtgaaatggcctaaggttgttaggattcaaagacaacggaggattcttaaacagcgtttgaaggttccacctgcattgaaccagttcaccaagacacttgacaagagccttgcaacaaacctattcaaaatgcttctgaagtataggcctgaagacaaagctgcaaagaaggaacgacttcttaaaagggctcaagctgaatctgaagggaagactattgaggctaagaagcctattgttgtgaagtatggactgaaccatatcacgtatctcattgagcagaacaaggcgcagttagtagttatcgctcatgatgtcgatcccatagaacttgttgtctggctaccagccctttgcaggaagatggagattccatactgcattgttaagggaaaagcacgactcggatcgatgttcacaagaagacagcatcagttttatgtttaacctcggttaagaatgaggataagatggatttcagcaagattctagaggctattaaggcaaacttcaatgataagtacgacgagtaccgtaaaaaatggggaggtgggatcatgggatccaaatcccaggccaaaacaaaggccaaggagaggcttcttgctaaggaagctgcacaaaggatgaattaggttatcttagtaaacaatagatgagtgctatccctaggctcactttggttcagattttctcctttttagctgtagtctatcttcagaatccaaaaaatgacatctttattcatatcgttatacaatttgctgatttgtgatattgctattccatactggagtgg

SEQ ID NO: 4173 - DNA, 1103 bp, Arachis hypogaea
cttcggccggggcaaaaccctaaattgcacatatatagaggttccgaattcgcctccccttccctcccctcgcagcaccacagtagctatggcccccaaaagaggtgttaaagctccggttccagctgccaagaagaaacccgagaaggttacgaatccgctgtttgagaagcggcctaagcagtttgggatcggtggggcgttgccgccgaagagggacctgacgcggttcgtgaagtggccgaagactgttcaaatccaaaggaagaagagaatcctcaagcagaggttgaaggtccctccagctttgaaccagttcaccaaaacccttgacaagaaccttgcaacaagcctgttcaagatactactcaagtataggcctgaggataaagcagagaagaaggagcggcttttgaaaagggctcaggctgaaactgagggaaaaactgttgaggccaagaagccaattgttgtgaagtatggcctcaatcatgttacctaccttattgagcagaacaaagcacagctggttgtgattgctcatgatgtggacccgattgaattggttgtttggcttcctgcattgtgcaggaagatggaaatcccatactgcattgtgaagggcaaggctcgcttgggatcaattgttcataagaaaactgcttctgttttgtgcttgacaagcgttaagaatgaagacaaattggagttcagcagagtccttgaggctatcaaggctaacttcaatgacaagtttgacgagtacaggaagaagtggggtggcggtatcatgggttccaaatcccaagccaaaaccaaggcaaaggaaagacttcttgccaaagaagctgctcaaaggatgtcttaggcttcatatatttttgttggtttaggattttcatttttgtgttttaacttcaattcaaggttagttttcgaagatatgttgctgaattgtctctacacaaattttgattgtcttgtgcatttcattgctttgttcttattagttattactaccttttattgtccaaattcttaatacaagacaaggtctaaacttgaaaccgatgtcattagtcatttctttatatttcgatttc

SEQ ID NO: 4174 - DNA, 1601 bp, Gossypium hirsutum
ttttccttcgccgtttccatctaacccaaaaaaaccttggaaaaagcttcaggaggttccaaaaatggccccaaagagaggaggaaaggtagttgtgccggccaagaagaaacaagagaaggttgtgaatccattgtttgagaagcgtccaaagcaattcggtattggaggagctttacctccaaagaaggatctgcaccgttttgtgaagtggcctaaggttgttcgcattcaaaggaaaaagaggatccttaagcagaggttgaaagtcccaccagcactgaaccagtttacaaagactcttgataaaaaccttgcaacaagtctgttcaagttgctcctcaagtataggccggaggacaaggcggccaagaaggaacgtctcctgaagaaagcccaagctgaggctgaaggaaaagctcccgaatcaaagaagccaattgttgtaaaatatggactcaaccacgttacctacctcattgagcagaacaaagcacaattggtagttattgctcatgatgtggatcccatagagttggtagtatggctccctgcattgtgcagaaagatggaggttccatactgcattgtgaaggggaaatcacgtttgggatcgattgtccacaagaaaactgcttccgtcttatgcttgactactgtcaagaatgaggataagttggacttcagcaaaatccttgaggctatcaaggcaaacttcaatgacaaatacgatgagtaccggaagaagtggggaggtggtatcatggggtccaagtcacaggccagaaccaaggcaaaggagaagcttcttgcaaaagaagctgcacagaggatgacttagaaataccatagtttctcccaaaggcagcttgggttttacttttattttctatttttcttgattgattaagtggccctgagtagtcagctgcaacttgtgtttaagtggatttgctttcccctttattgattttgatggaattgtcattagaagttcatctttcaacttcgcctttcattttatatttcttattgaactgtattctcatcttattaggaaaggttttctgttgagttttgtgtcctggtttctgattaatgttatataagattatgagatgtttatgtatacttttttggtatttggggctttcatgaattggtcaactttgttgccccgccttgaccctactattgttctgagaccaatgatagggttcaggttgaagacgggactccaaaagctgttgggatcttggccacttctgattctttacggccggttgttaaggggaagaacaatggcggtgggaatgtggatagtggagtcaagttgtggcctctgttggtatgtttttgatgatttgaagagggctgtattgttgcagttgtgggggataattgtgactctgaatgctgtgaatataacaaggcaaatcttttaatcttgactgctttcaagctaattttagcttggaatcgtttgatccccgaattatccaaagaatactgctttattaatgtgatttttcgcttgattttgtacgtataatcacattttacttgttattaacttcgtcttttttatcaatctattatca

SEQ ID NO: 4175 - DNA, 1672 bp, Gossypium raimondii
cttaaataaaatgaaataccatattaaatatcttaaataacatgaaatatttgatttctctcttttatatgtagaaaggtccaacaagcccaaaactttcgacaactggcccaaacttgggctttttttcttatataattataaaccctaatttttcgtattttctccttcgtttagggttttccttcgccgtttccatctaacccaaaaaaaccttggaaaaagcttcaggaggttccaaaaatggccccaaagagaggaggaaaggtagttgtgccggccaagaagaaacaagagaaggttgtgaatccattgtttgagaagcgtccaaagcaattcggtattggaggagctttacctccaaagaaggatctgcaccgttttgtgaagtggcctaaggttgttcgcattcaaaggaaaaagaggatccttaagcagaggttgaaagtcccaccagcactgaaccagtttacaaagactcttgataaaaaccttgcaacaagtctgttcaagttgctcctcaagtataggccggaggacaaggcggccaagaaggaacgtctcctgaagaaagcccaagctgaggctgaaggaaaagctcccgaatcaaagaagccaattgttgtaaaatatggactcaaccacgttacctacctcattgagcagaacaaagcacaattggtagttattgctcatgatgtggatcccatagagttggtagtatggctccctgcattgtgcagaaagatggaggttccatactgcattgtgaaggggaaatcacgtttgggatcgattgtccacaagaaaactgcttccgtcttatgcttgactactgtcaagaatgaggataagttggacttcagcaaaatccttgaggctatcaaggcaaacttcaatgacaaatacgatgagtaccggaagaagtggggaggtggtatcatggggtccaagtcacaggccagaaccaaggcaaaggagaagcttcttgcaaaagaagctgcacagaggatgacttagaaataccatagtttctcccaaaggcagctttagttgggttttacttttattttctatttttcttgattgattaaatggccctgagtagtcagctgcaacttgtgtttaagtggatttgctttcccctttattgattttgatggaattgtcattagaagttcatctttcaacttcgcctttcattttatatttcttattgaactgtattctcatcttattaggaaaggttttctgttgagttttgtgtcctggtttctgattaatgttatataagattatgagatgtttatgtatacttttttggtatttggggctttcatgaattggtcaactttgttgtcccaccttgaccctactattgttccgagaccaatgatagggttcaggttgaagacgggactccaaaaggtgttacggctggttgttaaggggaagaacaatggtggtgggaatgtggatagtggagtcaagttgtggcctctgttggtatgtctttggtgatttgaagagggctgtattgttgcagttgtgggggataattgtgactctgaatgctgtgaatataacaaggcaattcttttaatcttgattgctttcaagcttaattttagcttggaatcgtttgatccccgaattatccaaagaatactgc

SEQ ID NO: 4176 - DNA, 1011 bp, Chelidonium majus
agtagcagaagcacaagcacaagcacaagcacaacagcgacaacatcagcgatggcccctaaaagaggtgtcaaggccccagtaccggccaagaagaaaacagctgaaaaggttgtgaatcctttgttcgagaagcgaccaaagcaatttggcatcggtggtgcattacctccaaaaaaggatcttcatagatttgtcaaatggccgaaggttgttcgtattcagcgacaaaggaggattctgaagcaacggttgaaggttccacctgccctaaaccagttcacaaaaactcttgacaagaacctagcgacaaacgtgtttaagatgctactaaaatacagaccagaggacaaggctgctaagaaagaaaggcttttgaagagggcgcaggctgaatctgagggaaagaccgtggagtcaaagaagcccattgttgtcaaatatggactcaatcacattacttacctcattgagcagaacaaggcacaattggtacttattgctcatgatgtggatccaatcgagcttgttgtctggctgcctgctttgtgtcgacagatgaagatcccttatgcaattgtgaagggcaaggctcgtcttggagcaattgtccacaagaaaaccgccgcagcattgtgcttgacatcagtcaaaaacgaagataaaatggagtttagcaagattgttgaggcaatcaaggctaacttcaatgacaaatttgatgagcaccggaagaagtggggaggcggtattatgggttccaagtctcaggccaagaccaaagcaaaggaaaggctcatagcaaaggaagcagcacaaagaatgacttgattctttttttggctgcagagtgcagacaacaagagagtaagagagtcttcaatagacaggaaactggaatttttgttatacaaaccatctgtagttcttgctgtttatttggaattagttctgttttggttttagttttaattaaaactttattatctaatgcccatcagtttggatttt

SEQ ID NO: 4177 - DNA, 964 bp, Platanus occidentalis
agaaggtggagatttggtctgctcccagcaaaaaatggcgcccaaaagaggtgtaaaggctccattaccagccaagaagaagcctgagaaggttgcaaacccattgtttgagaagcgcccaaagcagtttgggattggtggagcattaccaccgaaaagggatttgcatagatttgtcaaatggccaaaagttgttcgtattcagaggcaaaggaggattctgaagcaacgtctgaaagttccacctgctttgaatcaattcacaaagacacttgacaagaaccttgcaacaaatctttttaagatgctgctcaagtataggcctgaggacaaggctgctaagaaggaaaggcttcttaaaagggcgcaagctgaagctgagggaaagcctgtagagtcaaagaagcccattgttgtcaaatatggccttaaccacattacttacctcattgaacagaacaaggcccagttggtggttattgctcacgacgtggacccaatcgagcttgtggtttggctgcccgccttgtgccggaaaatggagatcccttatgcaatcgtgaaggggaaagcacgacttggagcgattgtacacaagaaaactgccactgctttgtgcttgacatcagtgaagaacgaagataaaatggaattcagcaggattgtggaagcaataaaggctaactttaatgataagttcgaagagaaccgcaagaaatggggaggtgggatcatgggttccaagtctcaggccaaaaccaaagcaaaggagaggctcttagccaaggaagcagcacaaagaatgacttgagcttaaagcaaatgggggagactagtaggaatgcaaccttaggaattgcttttgttttctttttaccccttcaaccttattgttttggctgttgccctggagttttgtagttttgattgtctactgctactttctttttcccctcttctttaa

SEQ ID NO: 4178 - DNA, 1038 bp, Papaver somniferum
tcgaacaccatctctcttcacgactcaggaaggattagagtctcatcagtacccttaaaactatggctcccaaaagaggtgtaaaggccccagtggcatcaaagaaaaagactgaaaaggtagtaaatcctttatttgagaaaaggccaaaacagttcggcataggtggtgcattacctccaaaaaaggatttgcatagattcgtgaaatggccaaaggttgttcgtattcaacgccagaggaggattcttaaacaacgtttgaaggttccacctgcattgaaccagttcaccaaaaccctagacaaaaacctcgctacaaaccttttcaaaatgttgctcaaataccgtccagaagacaaggctgcaaagaaggaaaggctactgaaaagagctcaggccgaaacagagggaaagactgttgaggcaaagaagccaattgtggtgaaatatgggcttaaccacatcacttaccttattgagcagaacaaggcccagttggttgtcattgctcatgatgtggatcctattgagcttgttgtctggctacctgctttgtgccgaaaaatggagatcccatatgctattgtgaagggcaaggctcgtcttggagcgattgtccataagaaaacagccagtgctttgtgcctaacatcagttaagaacgaggacaagatggacttcagcaagattgtagaggcagttaaggctaacttcaacgataagtttgatgaacaccggaagaaatggggaggtggaattatgggatccaagtcacaggccaagaccaaggcaaaggaaagagtgctagctaaagaagcagctcaaaggcttaactaagatttagccgtgagaaaactaaaaattgtaaacttcgttatacaaagttcttgagttcccaactcattagccttttgttgtgttaaaggagagaaattttgttttggttttctgctgaagttttggcattagtaacaatcttttttttcttagattattttgacacccaccatgagatctttacgaatattttgttgtt

SEQ ID NO: 4179 - DNA, 1088 bp, Aristolochia fimbriata
aacaaacgcatccgacgcggggggttggagtcttaaatactctccaagcttcgccgctctcgtctgttttccttcaccggcgagcgaaatggcccccaagagaggtggtaaagctcctgcagcagccaaaaagaagcctgaaaaggtggtgaaccccttatttgagaagagacctaagcagtttggaattggtggtgcacttccaccgaaaagagacctacacagatttgtaaaatggcccaaagttgtgaggatccaaaggcagaaaaggatcctcaagcaacggttgaaggttccgcctactttgaaccagttcactaagacccttgacaagaaccttgctacaaatctgtttaagatgcttctcaaatatagacccgaagataaggcggcaaagaaagaaaggcttctgaaaagggcacaggcagaaactgaaggaaaaactgtagaggccaaaaagcccattgttgtcaaatatggccttaaccacattacctatctcattgagcagcaaaaagcccagctagtggtcatcgcccacgatgttgatccaattgagttggttgtgtggcttccagcattgtgcaggaaaatggaagtcccatactgtattgtgaagggcaaggcacgcctaggagcgattgttcacaagaaaacagctactgccctttgccttacttctgtaaagaatgaggataaactggagtttagcaagattctggaggccgtgaaggctaacttcaatgacaagtttgatgagcaccgtaagaagtggggtggtggcatcatgggatccaagtctcaggcaaagaccaaagccaaggagagggtcttggccaaggaagcagcacagagaatgtcttaattcacgtgaaagcatttctagcattatatacttttgttttaattttgggatttggatttccggcaacttctctattttgttagcggagttttgtattgaggctgtagctatggttctcattaacgtgcctcttgcttttgttgtttctctgttatatcttaatgcaggtaggaaaaccaaagattatcatttgctatacgtttttagtacattattcagggcc

SEQ ID NO: 4180 - DNA, 1256 bp, Eschscholzia californica
agtactcaacatcaaattcttccctcccctcttttagcaaactgattagggtttcatcttcaactaaaaaaaaaaatggctcccaaaagaggtgtaaaggccccagtagcagctaaaaagaagacggataaggttgtgaatcctctatttgagaagcgcccaaagcaatttggcattggtggtgcattacctccaaagaaggacctgcatagatttgtgaaatggcccaaggttgtccgcattcagaggcagaggaggatcttgaagcaaagattgaaggttccaccagctttgaaccaattcaccaagacattggacaagaaccttgcaacaaaccttttcaagatgttgctcaaataccgacccgaggacaaggctgcaaagaaggaaaggcttttgaaaagagcacaagctgaatcagagggcaaaacagtagagtcaaagaagcctattgttgttaaatatggtcttaaccacatcacctatctcattgaacagaataaggctcaattggtggttatcgcacatgatgttgatcctatcgaacttgttgtctggcttcctgctctttgccgaaaaatggagatcccatatgccattgtgaagggcaaagctcgtcttggagcgattgtccacaagaaaacagcaagtgcattgtgcttaacatcagttaagaacgaagacaaaatggacttcagcaagattgttgaagcaatcaaggcaaacttcaacgacaaatttgacgagcacaggaaaaagtggggaggtgggattatgggatcaaaatctcaggccaagaccaaagccaaggacagggttctagcaaaggaacaagcacaaaggatgagttaagattgtccattttaagaggtgtgggtgagcaaggaaggattaaggaagctaatcagtagagaggcaggacactttgtatcgtttcttgtagaaaccatctttatttcatatatttagtaatttgatgtcgacctcgacagttttcgaggttactcttatgtcactgatttgaggtttttctttttttatcttatcgaccatttatgtacaagtcatcttattttagaattcttagatggttgaatttttggatatggcatcattaatagtctctattatactccgaaggtatggggagtatggtttaagcttttcctactagttttgggttccccggacactttcatcatatatttcgatcaactgttcgtcaaaaattccaatgatttgatataaaatgtaca

SEQ ID NO: 4181 - DNA, 1157 bp, Arachis hypogaea
agcagcaagcattttgcagaagccgaatcagtgagagaagcttgcaacgcagatatggctcctaaacgaggtggaaaagcgccagttccagcttcgaagaagaagcctgagaaggttacgaacccgttgttcgagaagcgtcctaagcagttcgggatcggaggagcattgccgccaaagagggatttgactcgttttgtgaagtggcctaagaccgtacaaatccagaggaagaagaggatcctcaagcagaggttgaaggttccaccagctttgaaccagttcaccaagacccttgacaagaaccttgcaaccagccttttcaagatacttctgaagtacaggccagaggataaagctgaaaagaaggagcgacttttgaaaagggcccaggccgagactgagggcaaaaccgttgaagctaaaaagcctattgttgtgaagtatggtctcaatcacgttacctaccttattgagcagaacaaagctcaattggttgtgattgctcatgatgtggacccaattgaattggttgtctggcttcccgcattgtgtaggaagatggaaattccatactgcattgtcaagggcaaggctcgccttggatcgattgtacacaagaagacggcatctgttttgtgcttgaccagtgtcaagaacgaagacaaattagagttcagcagggtcctagaggctatcaaggctaacttcaatgacaagtatgatgagtacagaaagaaatggggtggcggtatcatgggttctaaatcccaagccaaaactaaggcaaaggagaggcttcttgctaaggaggctgctcagaggatgtcttaagagtattcttatattttgttgctttagagttgctatttttgtgttttaatctacctttgatcttttaattaaatctaaggatatttttgggagactactctttgtattgtcacaatatatacgtttggttttcaaatgagctgagcatttcattgtttatttttcgaccgccccttagtccttaatggaaacaaggtagccgttcacatattctcgtggatctaaagatgacttaaattggtatagatccaaatttaattgttcgagttacaatattaacttgataccgtctgtctttgtttttagatattattgcttgaacc

SEQ ID NO: 4182 - DNA, 800 bp, Prunus persica
ctttctgaacctaatcgatgcaggctccgaaaagaggtgtcaaagctccagtcgcagcgaagaagaagacggagaaagtggtgaacccactgttcgagaaacgtcccaagcagtttgggattggaggggcattgcctccaaagagagatcttacccgtttcgtgaaatggcccaaggttgttcaagttcagaggaagaaaaggatcctgaagcagaggttgaaggttccaccagctttgaaccagttcaccaagaccctcgacaagaacctggctacgagtctgttcaagatgcttctcaagtataggccagaagacaaagcagcaaagaaggagcgccttttgaaaagggcacaagcagagtctgagggaaaaactgttgaagccaaaaaacctattgttgtgaaatatggtctcaaccatgtcacctacctcattgagcagaacaaagcccagcttgttgttatcgcacatgatgttgacccaatagagttggtggtttggctgcctgcattatgtaggaagatggaaatcccatattgcatagtgaagggcaaagcacgcttgggatcgattgtccataagaaaactgcatcagttttgtgcttgacaacagtcaagaatgaagataaattggagttcagcaaggtgctagaggcaatcaaggccaacttcaatgacaagtatgatgagtacaggaaaaagtggggtggcggcatcatgggttccaaatcccaggccaaaactagggcgaaagagaggctccttgcaaaagaagctgctcaaaggatgaattaaatt

SEQ ID NO: 4183 - DNA, 1079 bp, Gossypium hirsutum
cttcgtagggtttcctccgccgttagtaaaagcttggaagaagactaacgtggtgcaaaaaatgggccccaagcgaggtggaaaggtggccgtcccagccaagaagaaacaagagaaggttgtcaatccattgtttgagaagcgtccaaagcagtttggtattggaggggctctacctccaaagaaggatttgcatcggtttgtgaagtggccaaaggttgtccgcattcaaaggaaaaagagaatccttaagcagaggttgaaggtcccacctgcattgaaccagtttaccaagactcttgataagaaccttgcaacaagtttgtttaagttgcttctcaagtacaggccagaggacaaggcagccaagaaggaacgtctcctgaaaaaggcccaagctgaggctgaaggaaaagcccccgagtctaagaaaccaattgttgtgaaatatggacttaaccatgttacctaccttattgagcagaacaaggctcaattggtggttattgctcatgatgtggatccgatagagttggtggtgtggctccctgctttgtgcagaaaaatggaagtgccttattgcatcgtcaaggggaaatcacgtttgggatcgattgtccacaagaaaactgcttcagtcctgtgcttgaccacagtcaagaatgaggataagttggacttcagcaaaatcctcgaggcgatcaaggcgaacttcaatgataagtacgatgagtacaggaagaagtggggaggtggtatcatgggatccaagtcacaggcccgaaccaaggcaaaggagaagcttcttgcaaaggaagctgcacagaggatgacttaaaagatcaccatttttatccttccggttgtactttcagttttgttttcgattttgtttagattaaatggtcctctttttaagtaaaagctgcaatcaactttcaaactttagtttcttttcttttttacagaggaatatttatagatttctgtttgaacttttgaaataactttctagctactgttttgatgaaattttgtgggcttataatgaaaaactatcaattatgcggttgatttaa

SEQ ID NO: 4184 - DNA, 1150 bp, Gossypium hirsutum
gccgttcttcttaaaccattaaagcttggaacaagcttaaggaagtgcagaaatggccccaaagagaggtgtaaaggttgctgccccggccaagaagaaacaagagaaggttgtgaatccactgttcgagaagcgtccaaagcagtttggtattggcggggcactacctccaaagaaggatctacatcgatttgtaaagtggcctaaggttgtccgcattcaaaggaaaaagaggatccttaagcagaggttgaaggtcccaccagcattgaaccagtttaccaagactcttgataagaaccttgctacgagtctattcaagctgcttctcaagtacagaccggaggacaaggcagccaagaaggaacgtctactgaaaaaggctcaggctgaggctgaaggcaaagcttctgagtctaagaaaccaattgttgtgaaatatggacttaaccatgttacctaccttattgaacagaacaaggcacaattggttgttatcgctcacgatgtggatcccatagagcttgtagtctggcttcctgctttgtgtagaaagatggaggtcccctactgcattgtcaaggggaaagcacgattgggatcgattgtctacaagaaaactgcatccgtcttgtgcttgaccacggttaagaacgaggataagatggaattcagcaaaatcctcgaggcaatcaaggccaacttcaacgacaagtacgatgagtacaggaagaagtggggaggtggtatcatgggctcgaaatcacaagccagaaccaaggcaaaggagaagcttcttgcgaaggaagccgcacaaaggatgacttaagccaaccattgctccctttggttaccaagtcaaatttactcctttgcccgaggattacttatatattttctagtttaactttcaaaacatcgagtagctgctgtttgtgatgtaactttgtgccttttcttaatgaaaattatgcccaaaccatcatttatgctgagccatcttacttaaatagtataatcagtttcgtcctcttgactaaaaagcaactctttttcttaaggtttatttattatatgttaattgagtaccaacattggaggtgtttttaccattttatataaaaagtataaaaaatacatatgtcttttt

SEQ ID NO: 4185 - DNA, 1320 bp, Gossypium raimondii
gtatcgggctgtaccatttgggaccataggctttgatgtctgagcaccgttaggcccatgttgtttttacaaactagcccaaacataggccttgttcttgtataaaacccgacttgtttcccttcgccttcttccttcttttagggtttcgttagccgttcttcttaaaccacaaaagcttggaacaagcttaaggaagtgcagaaatggccccaaagagaggtgtaaaggttgctgccccggccaagaagaaacaagagaaggttgtgaatccactgttcgagaagcgtccaaagcagtttggtattggcggggcactacctccaaagaaggatctacatcgatttgtaaagtggcctaaggttgtccgcattcaaaggaaaaagaggatccttaagcagaggttgaaggtcccaccagcattgaaccagtttaccaagactcttgataagaaccttgctacgagtctattcaagctgcttctcaagtacagaccggaggacaaggcagccaagaaggaacgtctactgaaaaaggctcaggctgaggctgaaggcaaagcttctgagtctaagaaaccaattgttgtgaaatatggacttaaccatgttacctaccttattgaacagaacaaggcacaattggttgtcatcgctcacgatgtggatcccatagagcttgtagtctggcttcctgctttgtgtagaaagatggaggtcccctactgcattgtcaaggggaaagcacgattgggatcgattgtccacaagaaaactgcatctgtcttgtgcttgaccacggttaagaacgaggataagatggagttcagcaaaatcctcgaggcaatcaaggccaacttcaacgacaagtacgatgagtacaggaagaagtggggaggtggtatcatgggctcgaaatcacaagccagatccaaggcaaaggagaagcttctcgcgaaggaagccgcacaaaggatgacttaagccaaccattgttcccttccagaggttccctctggttaccaagtcaaatttactcctttgcccgaggattacttatatattttctagtttaactttcaaaacaccgagtagctgctgtttgtgatgtaattttgtgcccaaaccatcatttatgctgagcgatcttacttaaatagtcgtgtatgatatatataatcagtttcgtcctcttgactaaaaagcaactctttttcttaaggtttatttattatgttaattgagtaccaacattggaggtgtttttatcattttatataaaaaataaaaaaatacatatgcttttttagtttttaaaaac

SEQ ID NO: 4186 - DNA, 1135 bp, Aristolochia fimbriata
aaaatccccggcccatccctcctagggtttttgaacattttaggttagtcttaaaacccatcgaagggcggccgactcgtcttctcccgccacttctaaagatcagagtctcgtctccgtcctccaccggcgagcgcaatggcccccaaaagaggaggaaaggcccctgtacctaccaaaaagaagcctgagaaggtggtgaacccactttttgaaaaaagaccaaagcagtttggaattggtggtgcccttccacctaagcaggacttgcatagatttgtgaagtggcccaaagttgttcgaattcagaggcagaagaggattctgaagcaaaggttgaaggtcccgcctgctttgaatcagttcacaaaaacccttgacaagaatcttgctacgaatctttttaagacgcttctcaaatatcggcctgaggataaggcagccaagaaggagagacttctgaggagggcacaggctgagaccgaaggaaagacagtggaggcaaagaagcctattgttgttaaatatggtcttaatcacattacttatcttattgagcagcaaaaggcgcaattggtggttattgctcatgacgtcgatccaattgagcttgttgtctggcttcctgctttatgccgtaaaatggaagtgccctactgcattgtgaaggggaaagcacgtcttggagcgattgttcacaagaaaacagcaactgcactttgccttacttccgtaaagaatgaagataaacttgagttcagcaagatcctggaggcagtaaaggctaatttcaatgacaagtttgatgagcacagaaagaaatggggcggtggcataatgggttctaaatctcaggcaaagactaaggcgaaggaaagggtattggccaaggaagctgcacagagaatgtcttagtgatgtagttctaaatttatttttaattttgctgtggttgcttttttatgcctttggcattaggaagttttgtattgattttgtagtcatgatactggaaaagttcatttgtgcatgaagacatgagtgttggtaatgcagcctggtactagaaatgtttgtttgcggtctagcgtgccaattatcagactccaaatgaaaaaaggaaagatatttcata

SEQ ID NO: 4187 - DNA, 1148 bp, Tropaeolum majus
cataaactaaaccctactcctcaacttctctattaccaccgacgtaggtgttgctcaacccttttctcacgcccgcttgctagagcaacttaggaagaaggatacttatggccccaaagaaaggaggaaaagctgtggcaccagccaagaagaaaactgataaggttgtgaatcctctatttgagaagcgcccaaaacagtttggtattggaggtgcattgccccctaaaaaagatctgcatcgatttgtcaaatggcccaaggctattcgcattcaaaggcagagaaggatcctgaagcagaggttgaaggtcccaccagcactgaaccagttcactaaaactctggacaagaaccttgctacaaacttgtttaagctgctattgaagtatagacctgaggacaaagcagcaaagaaggaacgtctcttgaacaaggctcaggccgaggctgaaggcaaaactgtggaaaccaaaaagcccattgtcgtgaaatatgggcttaaccatgtgacctaccttattgagcagaacaaagcacaattggttgttattgcccacgacgtggatcccattgagttggtcgtgtggttgcctgctttgtgtaggaagatggaaattccttactgcattgtaaaggggaaatcacgcttgggagcgattgtccataagaagacagcatctgccctctgtttgaccacagtcaagaatgaggataagatggactttagcaaaatccttgaggccattaaggcaaacttcaacgacaagtacgatgagtacagaaagaaatggggtggcggtatcatgggctccaaatcacaagccaagaccaaggccaaagagagagtacttgcaaaagaggctgcccagaggatgaactaggatcatctttagtcacaaatacttgtttttgttgtcacctttctttctttgattaaaaagttgaagcactgttacattttaaaatagtaatcagctcagttatttaatacttttttttatatatggtagacagtagtgatatagcttatttgttgttgtttggactttttgctttggtatttggactaagtctttccttatacgtgtatgagtcgcgaacacccttctactttgtaactgtaattgagtaattctgaaaaacta

SEQ ID NO: 4188 - DNA, 1216 bp, Picea glauca
acccaaccattaaaacaatgcaaataactccattaaacaaacctaatggaatttgcccactggcacttgttattatctacaaacttgattgcccatcaccttatttgcagtgcgtagggtaggagggaatagtccagtaggtcatctgcctgcttgtagtacgtaggcttggaggtagcaacctagcaggtaagctaacagagcgagggcgcagatcgatccgagcaatggctccgaagagaggggtcaaggctcctgttgctgctaagaagaaggtgccgaaggttgttaatccattgtttgagaagcggccgaaacagtttggaatcgggggagctctgccgcccaagaaggatttgcacagatttgtgaaatggccgaaggttgttcgcatccagaggcaacggagggtattgaagcagcgtttgaaggtccctccggctttaaaccagttcaccaaaacactcgacaagaatctcgcggccaaccttttcaagatgctcctaaaatacaggccagaagacaaagctgcaaaaaaggaaaggcttctgaagaaagctcaggctgaggcagaaggaaaaactgttgaagtaaagaagcctattgtcgtgaaatatgggattaatcatgtaacttaccttattgagcagagtaaagctcagttggtagttattgcacatgatgttgatccaatagagctggtggtgtggcttcctgcactttgtagaaaaatgaacatcccatatgcaattgtcaaagggaaagcacgtcttggtgccattgtgcacaagaaaacagcaactgctttgtgtttgacttctgtgaagaacgaggacaagatggaattcagcaagattgtcgaggcaataaagggcaacttcaacgacaagtttgacgagtatcggcgccaatggggaggtggcatcatgggcacaaaatctcaggcaaaaacaaaggccaaggaaaaagtcttggcaaaggaagcagcacaaaggctcacataggaataatattatggaagatttttcccatcttgaagagtttattgcagtatttttcggaatatgttgtgaatttgatttagaggtgtagaaaaatattggattttatgctgagaaaattttaaagctaactttagctttttcatccaagaaaacagcatgcctaattgtcacctctgggtaaaaatgctaagttattgctatacttttttgat

SEQ ID NO: 4189 - DNA, 1340 bp, Amborella trichopoda
atgtatgtgcacgagttgtcgttactgttgcctgaacaaggtgcgtttcttgctcattctcctctgtttatctttcaggcccctaaaagaggtggaaaggcacctgcacgagccaagaagaaggctgagaaggttgtgaatcccttattcgaaaagcgtcctaagcaatttgggattgggggagctttacctccaaaaagggatttgcatagatttgtgaaatggccaaaggtcatacgcattcaaaggcagaggaggatccttaagcagcgtttgaaggttcctcctgctctgaatcagttcaccaaaacattggacaagaaccttgcaacaaatcttttcaagatgcttcttaagtaccgacctgaagataaggcagagaaaaaggaaaggcttttgaaaagggctcaggcagaggcagaagggaagactgttgaatcaaagaagcccattgtcgtcaagtatggtctcaatcatgttacataccttattgagcagaacaaggctcagcttgtgattattgctcatgatgtggatcccatcgagcttgttgtttggttgccagctttgtgccgcaaaatggaaatcccttacgccatcgtaaaggggaaggctcgcttgggcactattgtgcacaagaagacagctgcagtcttatgtttgacctcagtgaagaatgaggataagttggatttcagcaagattgtggaggcaatcaaggccaatttcaacgacaagtatgatgaataccgcaagcgatggggtgggggcatcatgggctccaaatccttggccaagaccaaagctagggagaggctcttggccaaggaagcagctcagagaatgacttgaagaaagggagcattttgcttctgtaaatttagagcaaggaagagtgtttgctcttttcttgtcaccctgtttcttggttttagattttcttgatttcaatctcatcatcatttcatcagcatcttcgagattaggttttttgtgtttttgagcatgagctgaatcaggtatcttcaactttgattgtatccgtgccagttttccgtgggaatatattttgctacttgatatgccttctctctctctctcgttctttttcgtttttgtggatgtttgcaatgcgatactgatttaatttattgaaaaaataaattctgattagcagggttatacaattgcagtgattctttcaatgtttgatacatggggttgtttgataccttgaaaataattcagaatgtacatgcggttgtttgatggcttgaaaataattcagaatgtacattgttaatctctcctcatatataagatgaatggcaatgtacttg

SEQ ID NO: 4190 - DNA, 1544 bp, Theobroma cacao
agggttttttcccttggatgttcgttgtcgacagatagagctgaacagctgaaggagccgaagaaccgaagctgcagaaatggctccaaaacgaggtgtgaaagccccggtggttgcagctaagaagaaaacggacaaggtggtcaatccgttgttcgaaaagaggccgaagcagtttgggattggaggggatttgccacccaagaaggatctcacccggttcgttaagttccccaaaaccgttaggattcagaggcagaagaggatcctcaagcagaggcttaaggtcccacctgctttgaatcagttcaccaagacactggataagaatctagcatcaaacctgttcaagatgcttctcaagtaccggcctgaggacaaggctgcaaagaaggagcgactattgaaaaaggctcaatcagaggctgaaggaaagcctgctgaggctaagaagcccattgttgtgaagtatggtcttaaccatgtcacctatcttattgagcagaacaaggcacagcttgtaattattgctcatgatgtggatcccatagagttggttgtctggctgccagcattgtgcaggaagatggagatcccatactgcattgtcaagggaaaagcacgcttgggagcgattgttcataagaaatctgcatcagttttgtgcttgactactgtcaagaatgaagataagttggaattcagcaggatcttggaagctatcaaggccaacttcaatgacaagtatgatgagtacaggaagaaatggggtggcggtatcatgggtaccaaatcccaggcaagaaccaaagccaaagagaagttacttgccaaggaagctgcccagaggatgacctaagagctaatatagagttcatttcctgttagttaggacattatgtttggaagccatcggcatctttcatttttggttattttaaagtagttcatgataaaagcatagtgtttcttttctttaaaggcaggttataatcgaattttctggtaatgctgtttgagggtgactggttttttccatactcgaagctgcctactttattcatgaattgttagcgttagactcaatgcaattggcccatcattttaatcattttattacagctcaatcatggtgtcctaatataaattttgtattcttttcacatggccctacctcatctgaatctttcgatggttttctgctaagtaccatgataaaccaacagcttagacttgaaatggaagaactatgttgtgattgagattcttgtgtcacctctgtttcttactttgctcatggtttcacgctaatgggtttccccaccttagaatattactttaatccacttattttagacctgggaatcaaggccaggtgaagagctgatgtggttactgttgacagtgttgaaagtcatatttggaattgagttgggcaatgttgatttttgattttgagttttcttgtctgccttttctgtcctttggacattgtagttgaagtgtaaagaagcagccaagcaaaatcaatcatatttcacctt

SEQ ID NO: 4191 - DNA, 1054 bp, Chelidonium majus
acgaatgcgacagacacccggagaaggaagagagggttttatcaaactaaaccctaggtagctcgcagaccaatcctttcgcaatggctcccaaaagaggtgtgaaggccccagtaccagccaagaagaagactgaaaatgttgttaatcctttgttcgagaaacgaccaaagcagttcggcattggtggtgcattacctccaaagaaggatcttcataggtttgtaaaatggcccaaagttgttcgtattcaacgtcagcgaaggattttgaagcaaagactgaaggttccacctgcattgaaccagtttaccaaaactctggataagaaccttgctacaaacctcttcaagatgcttctcaagtacagacctgaggacaaggctgctaagaaggagaggcttttgaaaagggcacaggctgaatctgagggaaagactgtggagtcaaagaagcccattgttgtcaaatacggacttaaccatatcacctatctcattgagcagagcaaggctcagttggtgattattgcccatgatgtagatccaatcgagcttgttgtctggcttcctgctttatgccggcaaaagcagatcccttacgcaattgttaagggcaaggctcgtcttggagcgattgtccacaagaaaactgccgcagcattgtgcttgacctctgtcaagaacgaagataaaatggatttcagcaagattgttgaggcaatcaaggctaacttcaacgacaagtttgatgagcaccggaagaaatggggaggtggcatcatgggttccaagtctcaggccaagaccaaagctaaagagaggctcatagcaaaggaagcagcacaaaggatgaattaagttttcatttgcgtgacagcgagagaagagagaaagtagaaagaaaattttggaacttttgttatacaaaccatgtttattcttggcattgatctagagatgttatgttgttttagttctggtctaaatattagtcgcatattactttgcctaatgacatttaaggagaaaaccagtttttataaatgtagaat

SEQ ID NO: 4192 - DNA, 1449 bp, Cicer arietinum
aatacaatatcatcactaattgatgagtgacaaaaaaatcactacaataatcaattgggccgaacaactagcttcataagcccgtttcagtttaaaaagccgaattaatagaatcggttttgggctcaacccgtcaataaaaagccctcattttcagaacccttttaagttcacctcacacataagacattagggtttctactttgtattctcgttctccttccttcgccacttccatcaacaaccgcagcaatggcaccaaagcgcggtggaaaagcaccagttgtagctgcgaagaagaagcagccagagaaagttacgaacccacttttcgagaaaaggccaaagcagttcgggatcggtggtgctttacctccaaagagggatttgactcgctttgtgaaatggcctaagaccgttcaaattcagaggaagaagaggatcctcaagcagaggcttaaggttccaccagcactcaatcagttcactaagacactcgacaagaaccttgcaaccaaccttttcaagatgctccttaagtacaggcctgaggacaaagctgaaaagaaagagcgtcttttgaaaagggctcaagccgagtctgaggggaaaacagttgagacaaagaagcctattgttgtgaaatatggtctcaaccatgttacctatcttattgagcagaacaaggcacagcttgttgtcattgcccatgatgtcgaccccattgagctcgttgtctggcttccagcgttgtgcaggaagatggaaattccctactgcattgtcaagggcaaagcacgcttgggaactattgttcacaagaaaactgctgcagttttgtgcttgacaactgtcaagaacgaagacaaaatggaattcagtagaatcctagaagccattaaggccaacttcaacgataagtttgatgaaaacagaaagaagtggggtggtggtattatgggttccaaatctcaagcaaaaaccaaagccaaggaaaggctcattgccaaggaagctgctcaaagaatgacctagaaattttgtgtgctttggctattttagaacttttgaggttattcttctatatttttgatggaggctttatacaagtcaaatgtgaggttttcctttcattttggtagcttgtaaacaatcaatggtttaaatgtttagactttttgctgatttatttcagtagttgttttagacttaaaatggaatatgtttgtgttcaaaagtaatttgtgtctttccagtatacttatgtatttatgcttattgcatgtttgctacagtttttcaattacccttcatgtatttcatgccgtctaaagctatttctcagttattttatgtcaatcaagttgatgatttttatgccttggtaagaaggttatcatcttaatgttcatgtcttgattaacacatttctgtttcatttttcttttt

SEQ ID NO: 4193 - DNA, 938 bp, Eschscholzia californica
cctcctccagcttcaccagcagcagcaaagcaatggctcccaaaagaggcgtgaaggctccagcacccgccaagaagaagactccggagaaggttgtgaatccattgtttgagaagcgaccaaagcaatttggaatcggaggtgctttgccaccaaagaaggaccttcataggtttgtcaaatggccgaaggttgttcgaatccaaaggcaaaggaggatcttgaagcaacggttgaaggttccacctgctttgaatcagttcactaaaactcttgacaagaaccttgcaacaaatctattcaagatgatgctcaagtacagaccagaggacaaggctgcgaagaaggaaagacttctgaaaagagcacaagctgaatccgaaggaaagactgtggagtcgaagaagcccattgttgtcaaatacggacttaatcacattacctacctcattgagcagaacaaggctcaattggtagtgattgcccacgatgttgatccaatcgagcttgttgtctggcttcctgctttgtgccgaaaaatggagatcccttacgcaattgtgaagggcaaggctcgtcttggagcgattgtccacaagaaaacagcctctgcgttgtgcttgacatcagtgaagaacgaagacaagatggatttcagcaagattgtagaagcaatcaaggccaacttcaatgacaagttcgacgagcacaggaagaagtggggaggcggtataatgggatcgaaatctcaagccaagaccaaagcaaaggacagggttctagcaaaggaagcagcacaaaggttgaactaagtttttgtttcaagtagtagaaagtaaactctggcgtttggttttagaaactcagatctttaggtcttgctgttcaattgaactagttttctttttctatatttttgttcttaaatgttaactaca

SEQ ID NO: 4194 - DNA, 1425 bp, Vitis vinifera
ccactatatagtccccaactcgctatatcgtgtgggggacggctggtttaggttttagggtttctccttcgccgttcgctaacccttatcacagatggctccaaagaaaggagtaaaagcaccagcagcattagccaagaagaaacaggagaaggtagtgaatcccttgttcgagaaacgtccaaagcagtttggaataggaggggcattgcctccaaagagggatcttagccggtttgtgaaatttccgaagcatgttcagattcagaggaagagacgaatcctcaagcagcggttgaaggttcccccagctctgaaccaatttaccaagacccttgacaagaaccttgcaacaagcctgttcaagatgcttcttaagtacaggcctgaagacaaagcagcaaagaaggagcgtctcttgaaaagggctcaggctgaggctgaagggaaaaccgctgagaccaagaagcctattgttgtgaaatatggtctcaatcatgtgacctaccttattgagcagaacaaagcacaattagtagttattgcgcatgatgtggaccctatagagttggttgtttggcttcctgcattatgcaggaagatggaaatcccatactgcattgtcaagggaaaatctcgcttgggatcgattgttcacaagaaaactgcctctgttttgtgcttgaccacagtcaagaacgaagataaattggagttcagcaaaatcttggaggctatcaaggcaaacttcaatgataagtacgatgaaaataggaagaagtggggtggtgggatcatgggttccaagtcccaggctagaactaaggctaaagagaggcttgttgccaaggaagccgcccagaggatgacctaggaggcagtgccctgtattgctgtttacttagaatatgagagttttgatggtttatttgtagaattttggttatttcaattcatttggattttaactgcgaggttctgttttttggaaaaggcggataatggtcttgctcactctttgaacttgcatctgtcttgttatatctgtttgggctaaacttatatggcggtgctctatttggaagaattacctagaaaatctcatcaatggctgatgacactgtgttatgaagtggggaacttttgccccatagctccggagtagctcgtgatcacatactatcagtccgtagataatgttgcagtgaatgggttatggttatgagaaattatttgagtgattttagtattttgtttttcaacactactaagttaaaaatgtctctagcctctccatcagaattgattttctttgagctataacagttgtgttttcagagtgaatttataggaatcttccatttggcaatgacattgttgattgggccatcctttgcaaccaatataatccaatttggatctgaa

SEQ ID NO: 4195 - DNA, 1101 bp, Carpinus betulus
cctcgctgttcaacacatatataaaatccaacttctctagggttttgctttgccattcgcagactccagagttgaaccagaggagctcttcatcacatcctcacaaaatgggtccgaagaaaggtggaaaggcaccagtagtagcagcgaagaagaagccggagaaagtgacgaacccattgttcgagaagcgcccgaagcagttcgggatcggaggtgcgttgccgccaaagagggatctgacccggttcgtgaagtggcccaagaccgttcagatccagaggaagaagaggatcctcaggcagcggctcaaggtcccacccgctctcaatcagtttactaagacacttgacaagaatctagcaacaaacttgttcaagatgcttctcaagtacaggcctgaggacaaggctgcaaagaaagagcgtctcctgaaaagggctcaggcagagtctgagggaaagcctgttgaagcaaagaagcccattgttgtaaaatatggtctcaaccatgtcacttacctcattgagcagaacaaagctcagctggtggtcattgcacatgatgtggacccaatagagttggttgtgtggcttccggcattgtgcaggaagatggaaatcccatactgcattgtgaaagggaaagctcgcttgggggcggttgtccacaagaaaactgcatcagtcttgtgcttgaccactgtcaagaacgaagataagttggagtttagcaagatcttagaggctatcaaggccaacttcaatgacaaatacgacgagtacaggaaaaagtggggtggtggaatcatgggttccaaatcccaggctaaaactaaggccaaggagagacttcttgccaaggaagctgctcagagaatgtcttaggggcgatgattctccgtttctcgttacttagatttgattgtacgaggatgttattttttgacatttttgttggttaaagtttattctcatcaactgcagaggttttgcttcttttgagtcagcttttatataaattgagaaacagctaatgttggtgtttgaacttaagttgccgtgctgtaatagcttttgggttagacattaatgcatgacg

SEQ ID NO: 4196 - DNA, 1105 bp, Tropaeolum majus
cggccgggggcaggtgtaactacaggaagaagagaaatggcaccaaagaaaggtggaaaagctgtggcaccagcaaagaagaaaacggataaggttgtaaaccctctatttgagaagcgcccaaaacagtttggtattggtggtgctttgcctcccaagaaagatttgcatagatttgtcaagtggccgaaggcgattcgcatccaaaggcagaggaggatccttaagcagaggttgaaggttccaccagcactgaaccagttcactaaaactctggacaagaaccttgcaaccaacttgttcaagttgcttctcaaatacagacctgaggataaagcagctaagaaggaacgtctcctgaaaaaggctcaagctgaggctgaagggaaaactgctgaatccaaaaaaccaattgttgtgaagtatgggcttaaccatgtgacttaccttattgagcagaacaaagcacaaatggtagttattgctcatgacgtggatcccattgagttggttgtatggctgcccgcattgtgtaggaagatggaaattccttactgcatcgtaaagggaaagtcacgcttgggagcgattgttcacaagaaaacagcatccgtactctgtttgactacagtcaagaatgaggataagatggaattcagcaaaatcctagaggccatcaaggcgaatttcaatgacaagtacgaagagtacaggaagaagtggggaggtggtatcatgggctccaaatctcaggccaaaaccaaggccaaagaaagagtccttgctaaagaggctgcacagaggttgaattagaagcatcattagtccaaaaacctttttctgttccctggatttggtctgtagtcactttaattagtacaatgttcgctggctggctttttgaaaccgtattttggcgtaaaggatattgacactttttttttgatgcaatggttttgtgtagtaatgtcctcccgattctttactgcacttaacatgccaaatgaatccttaacttagtcaattaggcagcacaagcttttacaaatttgacaagaaacctcaataataaaatctgatatggaatcccaatctttcaactaag

SEQ ID NO: 4197 - DNA, 992 bp, Papaver somniferum
aattagggttttgattttcatcaaatggctcccaaaagaggtgtaaaggcccctgtagccgccaagaaaaagatagaaaaggttgctaatccttgtttcgagaagcgcccgaaacagtttggtattggtggtgctttacctccaaagaaggatcttcatagattcgttaaatggcccaaggtcgttcgtatccaaaggcagcgaaggattttgaagcaacgattgaaggttccacctgctttgaaccagtttaccaaaacacttgacaagaaccttgccacaaatcttttcaagatgttgctgaagtacagacctgaagacaaggctgctaagaaggaaaggctgttgaaaagggctcaagctgaatcagaaggaaaaacagtcgaggcgaagaagcctattgttgtgaaatatggacttaaccacattacatatctcattgagcagaacaaggcccaaatggttattattgcacacgatgttgatcccattgagcttgttgtctggcttccagcattatgccgtaaaatggagatcccatatgccattgtaaagggcaaggctcgtcttggggcgatcgtacacaagaaaactgcctcagcattgtgcttgacatcagtgaagaatgaagataaaatggaattcagcaagattgtggaagctgtcaaggctaatttcaatgataagtttgacgagcaccgaaagaaatggggaggtggaatcatgggatcaaagtcgcaagctaagaccaaagctaaggaaagggttttggcaaaggaagcagctcagaggttgaattagattttcagttgtacgaagccctaagagagaaatactattaggcaagcaattttggatttctgtgtatacagatacgattcatctttagtttggattcttgattgtgagaagttctcttataattcccttactctaaatgttgactgcattgtttttattagcatatcaagtttaagttaaaaaaaaaaaaa

SEQ ID NO: 4198 - DNA, 1150 bp, Zostera marina
tagtctccttgcagtaatattacttagatttcttcttgtcatcggcgcgcaaagtactcgaagaggcggaagaacaaaacaaagaaatggcaccgaagaaaggcgtgaaggccacagtcgcttcgaagaaaaagccggagaaagtgaccaatcctctgttcgagaaacggccgaaacagttcggtattggaggcgcacttcctccaaagagggatcttcacaggtttgtaagatggcctcaggttgttcgcatccagagacagaggagaattctcaagcagaggttgaaggtgcctccagcgctcaatcaattcaccagaacactggataagaatttagcaacaaatcttttcaaaatgcttctcaaatatagaccagaagacaaagttgcaaagaaggaacgtcttcttagcagagctcaagctgaagctgagggtaagaccgttgagctcaagaaacctattgtcgttaaatatggtctgaaccatgtcacttacctcattgaacagaaaaaagctcaacttgttgtcatagcccatgatgtagacccgatagaattggtagtatggctaccggcactatgcaggaagttggaggttccttattgcattgttaaaggaaaatctagattgggagcggtcgttcaccaaaagacttctgctgtgttgtgtttgactacagtgaagaatgaggataagctggagttcagcaaaatcctagaggctatcaaggctaatttcaacgacaagtttgacgaggtgcgtaaaaaatggggtggtggtataatgggttccaaatcccaagcaaagacaaaagcaaaagagcgtctcatagcaaaagaagctgctcaaagaatgaattagatttattttgtttcttacaattttgctaagaagaaataagaattcttgttttcagaagcgttagctgcatcttttttcatcagaaaagttatcttggatctatttatctatctatttaagaatcttccaatacattcaattcaatttaaattcataatctaatatgaccaatcacaaatcctttctcaaacaaagctctaagcaattcaagaacatgttccatctttggtgcggttgaaagagattctacaagttgagtcaacagaaattctaccgtctgaggtgat

SEQ ID NO: 4199 - DNA, 1200 bp, Cajanus cajan
gagggttcttgcaaggcccattgcacatatatattatacaaccctagttagggttttattgagagtcagttttgctcccgtcgccacacaccagaagctgcagcaatggctcccaaacgaggtggaaaggctccagttctagcttcaaagaagaagcctgagaaggttacgaatccgctgttcgagaagcgcccgaagcagttcgggatcggaggtgcgttgcctccgaagagagacctgactcggttcgtgaagtggccgaagaccgttcagattcagaggaagaagaggattctcaagcagaggctgaaggttcccccagctttgaaccaatttaccaagactcttgacaaaaacctagcaaccagcctgttcaagatacttttgaagtaccggccagaggacaaagcagaaaagaaggagaggctcttgaaaagggctcaggctgaggctgaaggcaaaactgttgaagctaagaagcctattgttgtgaagtatggtctcaaccatgttacctaccttattgagcagaacaaagcacagctggttgtgattgctcatgacgtagatccaattgaattggttgtctggcttcctgctttgtgcagaaagatggaaattccatactgcattgtgaagggaaaggcacgcttgggaacggttgtccataagaaaactgcatctgttttgtgcctgacaactgttaagaatgaagataaattggagttcagcagagtgttggaggctatcaaggctaacttcaatgacaaatatgacgagtacaggaagaagtggggtggtggaatcatgggatccaaatcccaagccaaaacccgggcaaaggagaagcttcttgccaaggaagctgctcagaggatgtcttaggaggagtttcttacattttgttgctttgcgaatgctcttttgtgtgttttgtttattagtgttactctattttacttattgtctccataaaaacatttgttattcacatgagctagagtatttcattatgatcttctgccgattgccccaatccttatcccttgaatacttttcattttgtttcgagtacttcatgaaggaactgcattaggatgtaattgcattgcatccaattttttatttttggtatgttttttatttctaatttataattctttctggttataataatgtttttaaatagtttctaattga

SEQ ID NO: 4200 - DNA, 1316 bp, Glycine max
ctgagagtcagattcgctcgcattgcttcgcctcacaacagcagctgcagcagcaatggctcccaaacgaggtggaaaggctccggctcttgccgctaagaagaagcctgagaaggtcacgaatccgttgttcgagaagcgtccgaagcagttcggaatcggaggggcgttgcctccgaagagagacttgactaggttcgtgaagtggccaaagaatgttcaaattcagaggaagaagaggattctgaagcagaggttgaaggttcccccagctttgaaccagtttaccaaaactcttgacaaaaacctagcaacaagtctgttcaagttgcttctgaagtacaggcccgaggacaaagctgaaaagaaggagaggctcttgaaaagggctcaggcagaggctgaaggcaaaactgttgaagctaagaagcctattgttgtgaagtatggtctcaaccatgttacctacctcatcgagcagaacaaagcacagctcgttgtgattgctcacgatgtggacccaattgaattggttgtctggcttcctgctttgtgcaggaagatggaaattccgtactgtattgtgaagggaaaggcccgcttgggaacggttgtccacaagaaaactgcatccgttttgtgtttgaccactgttaagaatgaagataaattggagttcagcagagttttggaggctatcaaggctaacttcaacgacaaatatgacgagtacagaaagaagtggggtggtgggatcatgggatccaaatcccaagcgaaaaccagagcaaaggagaagcttcttgccaaggaagctgctcagaggatgacttaggaggagtttcttatattttgttgttttgcgaatgctatttagtctgtgttttttaatgttactctcttttaattattgtctttataaaaacatttgttattcacatgagctagagtatttcgttaaaatctcatgccgtctgtcccaattcctgaaccctaagatttatttctttttggttgcagacttttttcggatactttatgaaggaactgcatgcggatgcagttgcatccaatttttgatatttgatatttttgtatttgattctctatgattatagtataaaatagtttgtgatcctctctaaacaaaataactgcaaaggatcattctgctgcaggtgatcattttagctagtcaaattgaagtgtgcaagtgaaccgagaattgtatattttcgtgctaaacttgtcgattatactcacaagtctctgtttgtctgcataatatattgaagcgtaataaattgattaatctt

SEQ ID NO: 4201 - DNA, 1371 bp, Glycine max
cgttattaccaggcccaatactcatatataatacacaaccttaactagggtttttctgagagtcagattcgctcgcattgcttcgcctcacaacagcagctgcagcagcaatggctcccaaacgaggtggaaaggctccggctcttgccgctaagaagaagcctgagaaggtcacgaatccgttgttcgagaagcgtccgaagcagttcggaatcggaggggcgttgcctccgaagagagacttgactaggttcgtgaagtggccaaagaatgttcaaattcagaggaagaagaggattctgaagcagaggttgaaggttcccccagctttgaaccagtttaccaaaactcttgacaaaaacctagcaacaagtctgttcaagttgcttctgaagtacaggcccgaggacaaagctgaaaagaaggagaggctcttgaaaagggctcaggcagaggctgaaggcaaaactgttgaagctaagaagcctattgttgtgaagtatggtctcaaccatgttacctacctcatcgagcagaacaaagcacagctcgttgtgattgctcacgatgtggacccaattgaattggttgtctggcttcctgctttgtgcaggaagatggaaattccgtactgtattgtgaagggaaaggcccgcttgggaacggttgtccacaagaaaactgcatccgttttgtgtttgaccactgttaagaatgaagataaattggagttcagcagagttttggaggctatcaaggctaacttcaacgacaaatatgacgagtacagaaagaagtggggtggtgggatcatgggatccaaatcccaagcgaaaaccagagcaaaggagaagcttcttgccaaggaagctgctcagaggatgacttaggaggagtttcttatattttgttgttttgcgaatgctatttagtctgtgttttttaatgttactctcttttaattattgtctttataaaaacatttgttattcacatgagctagagtatttcgttaaaatctcatgccgtctgtcccaattcctgaaccctaagatttatttctttttggttgcagacttttttcggatactttatgaaggaactgcatgcggatgcagttgcatccaatttttgatatttgatatttttgtatttgattctctatgattatagtataaaatagtttgtgatcctctctaaacaaaataactgcaaaggatcattctgctgcaggtgatcattttagctagtcaaattgaagtgtgcaagtgaaccgagaattgtatattttcgtgctaaacttgtcgattatactcacaagtctctgtttgtctgcataatatattgaagcgtaataaattgattaatctt

SEQ ID NO: 4202 - DNA, 1563 bp, Theobroma cacao
atcagctaccatgtcatcttttattatggcactgttagaatatcacgtcagcgtcacgcggtataaaataacaagtgacattttaattaataaaaattaatcaataattaattataaatgtttatttagtttaaaataaaatataaatatttaattgaatgtaataaaagactaagagtttagtcaaatttttttaaatatttttaggagcttctttagatattatgaataatttaaaacatataaaaatttttaaatatggactctggatttctacatgaaaattcatggagtaaaaacgatttagtgaagaactgggcccccaaactggaggtaaagcccaactgtatcttgctcagtggtcaagcccaagcagcgcaaatgcccgtaaacgataagaaaaagggccagcaatatatacctacccactctcttatataaaacctagttgtttcgccttagcttcttcgtttttcctagggttttcctccgccgtttctcagttaacaacaaagcttggaagaagcttcaggaggcgcagaaaatgggcccaaagagaggtggaaaggtggctgcaccagccaagaagaaacaagagaaggttgccaatccattgtttgagaagcgtccaaagcagtttggtattgggggggctttacctcctaagaaggatctgcaccgatttgtgaagtggcctaaggttgttcgcattcaaaggaagaagaggatccttaagcagaggttgaaggtcccaccagctttgaaccagtttaccaagacccttgataagaaccttgcaacaagtctgttcaagttgctcctcaagtacaggccagaggacaaggcagccaagaaggaacgtctccttaaaaaggcccaggctgaggctgaaggaaaagctcctgagtcgaagaaaccaattgttgtgaaatatggacttaatcatgttacctaccttattgagcagaacaaggcacaattagttgttattgctcatgatgtggatcccatagagttggtagtgtggctccctgctttgtgcagaaagatggaggtcccttactgcattgtcaaggggaaatcacgtttaggatcgattgtccacaagaaaactgctgctgtcttgtgcttgaccacagttaagaatgaggataagttggagttcagcaaaatccttgaggccatcaaggctaacttcaatgataagtatgatgagtacaggaagaagtggggaggtggtattatgggctccaagtcgcaggccagaaccaaggcaaaggagaagcttcttgcaaaggaagctgcacagaggatgacttaggagaaccattgtttccttccagaggcacctttagttgtggtttttttgttatattttcttgtttgattaaaattgtcctgtgtagtcagctgcaaaaacttttgactcgtttcactattttctagaggaatatttatatcttttccagttgaacttttaaagtactacctcgtagctgctgtctgtggtgaaattttgtgtctttgtaatgaatttatatcaatgatgagcgtcatttttac

SEQ ID NO: 4203 - DNA, 1074 bp, Gossypium hirsutum
ttcgtagggttttcctccgccgttcgtaaaagcttggaagcagactaaagtggtgcaaaaaatgggccccaagcgaggtggaaaggtggccgtcccagccaagaagaaacaagagaaggttgtcaatccattgttcgagaagcgtccaaagcagtttggtattggaggggctttacctccaaagaaggatttgcatcggtttgtgaagtggccaaaggttgtccgcattcaaaggaaaaagaggatccttaagcagagattgaaggtcccacctgcattgaaccagttcaccaagactcttgataagaaccttgcaacaagtttgtttaagttgcttctcaaatacaggccagaggacaaggcagccaagaaggaacgtctcctgaaaaaggcccaagctgaggctgaaggaaaagcccccgagtctaagaaaccaattgttgtgaaatatggactaaaccatgttacctaccttattgagcagaacaaggctcaattggtggttattgctcatgatgtggatccgatagagttggtggtgtggcttcctgctttgtgcagaaaagtggaagtgccttattgcatcgtcaaagggaaatcacgtttgggatcgattgtccacaagaaaactgcttcggtcctgtgcttgaccacagtcaagaacgaggataagttggacttcagtaaaatcctcgaggcaatcaaggcgaacttcaatgataagtacgacgagtacaggaagaagtggggaggtggtatcatgggatccaagtcacaggcccgaaccaaggcaaaggagaagcttcttgcaaaggaagctgcacagaggatgacttaaaagatcaccattgttatccttccggttgtactttcagttttgttttagattttgtttagattaaatggtcctcttttttaagtaaaagctgcaatcaactttcaaactttagtttcttttcttttttacagaggaatatttatagatttctgtttgaactttcgaaataactttctagctactgttttgatgaaaatttgtgggcttataatgaaaaactatcaattatgcggttg

SEQ ID NO: 4204 - DNA, 1941 bp, Gossypium raimondii
caatcacaccaaagaaaaaacaaataccttttcaattgacaaaggtttgggagtggaagacctggcaacagatggaaccgagtacctttcaacgactttcctttcccttgtaggcctatcactactgggtgtcataggctctttcttctcagctgaacctcgattgggtttcctggagcttcgctttcgactactatcttctcccttcttagcacctttctctctgttctcttcgttgtcttccttttcatcctcctcttcgttctcttcaacttccttcttttcctcactttcccgagaaacctctttagtttcctccttttctttttccttctccttctcttcccccatcggcttgttctcgtctggggtttccgtctccatagaaactaccaatcaaacaaccaaaaatctgagtttttcccctaaaaccctaaaattgaaacaaaccctcaaaggatcaaagagagagagttagtagccctcgtggttggttaactagtccagtgaaatgaaacaaaatttggtgttttcactgctttttggattggattcaggggaattgcggggcaaaattcagataagaataacatttcttcgttagatcgaagagtcagaacgagcgggcaatcaaaaaacgggggaaagtaagttttgctattttttttttataaatggacttttggtcgggtccaataggctttaatgtctcaaacccgtttacgtctgttagctaacagttcagacatgtacaagaatccgacaagcccatagttttggggaactggccgagacatcgatcttgttattatataaacctcagtcgtttcgcctatactttgtcgttcttcgtagggttttcctccgccgttagtaaaagcttggaagaagactaacgtggtgcaaaaaatgggccccaagcgaggtggaaaggtggccgtcccagccaagaagaaacaagagaaggttgtcaatccattgttcgagaagcgtccaaagcagtttggtattggaggggctctacctccaaagaaggatttgcatcggtttgtgaagtggccaaaggttgtccgcattcaaaggaaaaagaggatccttaagcagagattgaaggtcccacctgcattgaaccagttcaccaagactcttgataagaaccttgcaacaagtttgtttaagttgcttctcaagtacaggccagaggacaaggcagccaagaaggaacgtctcctgaaaaaggcccaagctgaggctgaaggaaaagcccccgagtctaagaaaccaattgttgtgaaatatggacttaaccatgttacctaccttattgagcagaacaaggctcaattggtggttattgctcatgatgtggatccgatagagttggtggtgtggcttcctgctttgtgcagaaaagtggaagtgccttattgcatcgtcaaagggaaatcacgtttgggatcgattgtccacaagaaaactgcttcggtcctgtgcttgaccacagtcaagaacgaggataagttggacttcagtaaaatcctcgaggcgatcaaggcgaacttcaatgataagtacgatgagtacaggaagaagtggggaggtggtatcatgggatccaagtcacaggcccgaaccaaggcaaaggagaagcttcttgcaaaggaagctgcacagaggatgacttaaaagatcaccatttttatccttccggttgtactttcagttttgttttcgattttgtttagattaaatggtcctctttttaagtaaaagctgcaatcaactttcaaactttagtttcttttcttttttacagaggaatatttatagatttctgtttgaacttttgaaataactttctagctactgttttgatgaaattttgtgggcttataatgaaaaactatcaattatgcggttgatttaacttttacatttccg

SEQ ID NO: 4205 - DNA, 1195 bp, Gossypium raimondii
ctccaacaagcccacagttcttttaccactggcccaaacgcaggccttgttctaatataaaccctagtttgttcattgggtttgctttctacgtgttttctagggttttcttccgccgttctaaatcacagaaagctttgaagaagaagcttttggaggtgcaaaacatggggccgaagaaaggtggaaaggtggctgtgcccgccaagaagaaacaagagaaggttgtcaatccgttgtttgagaagcgtccaaagcagttcggcattggaggggctttacctcctaagaaggatttgcatcgattcgtgaagtggcctaaggttgttcgtattcaaaggaagaagaggatcctcaagcagaggttgaaggttccaccagcattgaaccagttcaccaagactcttgacaagaacctcgcaacaagtctgttcaagttgctcctcaagtacaggccagaggacaaagcggccaagaaggaacgtctcttgaaaaaggcccaggccgaggctgaaggaaaagcccccgagtctaagaaaccaattgttgtgaaatacggtcttaaccatgttacttaccttatcgagcagaacaaggctcaattggttgttattgctcatgatgtggatcccatagagttggtagtgtggcttccagctttgtgcaggaaaatggaggtcccatattgcattgttaagggaaaatcacgtttgggatcgattgtccacaagaaaactgcttccgtcttgtgtttgaccacggttaagaacgaggataagctggaattcagcaaagtactcgaggcaatcaaggcaaacttcaatgacaagtacgacgagtacaggaagaagtggggtggcggcatcatgggctccaagtcacaagcccgaaccaaagcgaaggagaagcttcttgcaaaggaagctgcacagaggatgacatagaggaattaatagaccttttgtcgcagttcgtgtttttgattaaatagtcttttgtagtaaggtacgatcgattttcgactcgggtttactctcttttccggaggaacattcatatacttttgtggttgaactttctaaatgcctagtttgttgtttgtgctgaagttttgtgattttctaatgaattgtcaatcaatgtttttattttacatgttggccaattcatcattagttttgtgattttctttaat

SEQ ID NO: 4206 - DNA, 966 bp, Rosa hybrid cultivar
aaccgaagcagctgcgcaaaaatgggtccaaagaagggtggaaaagctccagttgctgcttctaagaagaagccggagaaggtggtgaacccacttttcgagaagcggccgaagcagtttgggatcggaggggcgttgccacccaagagggatctcacccgcttcgttaaatggcccaaggctgttcagattcagaggaagaaaaggatcctcaagcagaggttgaaggttcctccagctctgaaccagttcaccaagaccctcgacaaaaacctcgctacaactctgttcaagatgcttttgaagtacaggcctgaggacaaagcagagaagaaggagcgtcttttgaaaagggcacaggcagaaactgaaggaaaaactgttgaagccaagaagcctattgttgtgaaatatggtctcaaccatgtcacctacctcattgagcagaataaggctcaactcgtagttattgctcatgatgtggatccgatagagttggttgtctggctccctgccttgtgcaggaagatggaaatcccctactgcattgtgaagggcaaagcacgcttgggagcgatcgtccatcagaaaactgcttcggttttgtgcctgacaacggtcaagaatgaagataagatggagttcagcaaggttttggaagcaataaaggccaacttcaatgacaagtatgaggaaaacaggaaaaagtggggtggtggcatcatgggttccaaatcccaggccaaaactaaggcaaaggaaaggctcctcgcaaaagaagccgctcaaagaatgacctagttttcgttctccgtgtaatttgtttcacttagattatgctactagaattttgtgattgttaaagtttattcatatcaacaacagaggttttgtttccctttttaaaatgcagcttttgttttaaacaaaatcagttaaatttagttgttcaacctctgttgtttg

SEQ ID NO: 4207 - DNA, 1275 bp, Fragaria vesca
atttaggtcatttagggtttacgccgtcctcagtctctccagcaaattgaagagcgcagctgccgcaaatgggtccaaagaaaggtgccaagctcccagtcgcagcttccaagaagaagccggagaaggtggtgaacccactcttcgagaagcgtccgaagcagttcgggatcggaggggcattgccaccgaagagggatctgacccgattcgtcaaatggcccaaggctgttcagattcagaggaagaagaggatcctcaagcagaggctcaaggtcccaccagctctcaaccagttcaccaagacccttgacaagaacctcgctacaagcctgttcaagatgctactgaagtacaggcctgaagacaaagcagagaagaaggagcgtcttttgaaaagggcacaagcagagactgaagggaaaactgttgaaaacaagaagcctattgttgtgaagtatggtctcaaccatgtcacctaccttattgagcagaacaaggcccaacttgttgtgatcgctcatgatgttgatccaattgagttggttgtatggctccctgctctgtgcaggaagatggaaattccttactgcattgtcaagggcaaagcacgtttgggagcaattgttcacaagaaaactgcttcagttttgtgcttgacaacagtcaagaatgaagataaaatggagttcagcaaggtcttggaggctatcaaggccaacttcaatgacaagtatgaggaatacaggaagaagtggggtggtggcatcatgggttccaaatcacaggccaagaccaaggcaaaggagaggctccttgcaaaagaagctgctcaaagaatgacttaattttggtcacggtgtattgtgattcacttagattgtgcttctgagtatctatctactggatttcgtattgtagcagagattttgtttccttttatcaaatgcagctttggtttggtattaagacacacatgtcctgaaatctgcaactgtttttgttagacttaaaggacaagtttttatgcctttggtataccatgtagtgtttttccattttcgcatgaattcatttcttcccctctttctacgttgacataacagttccacaatgttgatagctcctttgttcaaggaggtgccatgttagcatagtatatgttcaaggaggttccatgttattagcatagtatatgaaatttgaggagatgagccattgagccttctcagatttctgttctttcattgatgcgataatatatacgaaatgctt

SEQ ID NO: 4208 - DNA, 1140 bp, Malus domestica
atggtgagtatccgctccctcaccgtcttcctccgcctcccattccacctccgtcgcattggaacttccattaatcttcactgtcttgattctcttctcacattttcatttgttttactcaggcccccaaaagaggcgtaaaagctccagtcgcagcttccaagaagaagacggacaaggttgtaaacccgctgttcgagaagcgcccaaagcagttcggtatcggaggggcattgccaccgaagagggatctgacccggttcgtgaaatggcccaaggtggttcagattcagaggaagaagaggatcctcaagcagaggttgaaggttcctccagctttgaaccagttcaccaagaccctcgataagaacctcgccaccagcctgttcaagatgcttctcaagtacaggcctgaggacaaagctgcaaagaaggagcgccttttgaaaagggcccaggccgagaccgaaggcaaatctgttgaggccaagaaacctattgttgtgaagtatggtctcaaccatgtgacctacctcatagagcagaacaaggcccagcttgttgttatcgcacacgatgttgacccaatagagttggttgtctggcttcctgctttatgcaggaagatggaagtcccatattgcattgtgaagggcaaagcacgcttgggatctattgtccacaagaaaactgcgtcagttttgtgcttgacaacagtcaagaatgaggataagttggagttcagcaaggtcttggaggcaatcaaggccaacttcaatgacaagtatgaggagtacaggaaaaagtggggtggcggcatcatgggttccaaatcccaggcaaaaactagggcgaaggagaagctccttgcgaaagaagctgcgcaaaggcttaattaaatttggttgttttttgtacttctttctacttgggaaaagattgtccgagtctgcttctcgattttgtgtagttaaagtttatttagatcaaccgctgaggttttcttttcctttaaatgccgcaatgttgtttagctggttggattaagactgaatggacatgccgattttggtacggttttggggatatccagtgatgagcaattacattatgttttatgatgattgtttctgttgcaca

SEQ ID NO: 4209 - DNA, 1173 bp, Abies balsamea
agcttgctattgccgtgcgcgtgtaaggaggtagcgggtcaggtagtagagcgaagcagggagaggacgcaaatcgattatagcaatggctcctaaaagaggggttaaggctccagttgccgcgaagaagaaggtcccgaaggttgttaatccattgtttgagaagcggaccaagcagtttgggattgggggagccctgccgccaaagaaggatttgcacagatttgtgaaatggccgaaggttgttcgcatccagaggcagcggagggtattgaagcagcgtttgaaggtccctccggccttaaaccagttcaccaagactcttgacaagaatctcgctgccaaccttttcaagatgctccttaagtacaggccagaagataaagctgcaaagaaggagaggcttctgaagaaagctcaggctgaggcagaaggaaagaccgttgaagtgaagaaacctattgttgtgaaatatgggattaatcatgtaacgtaccttattgaacagagtaaagctcaattggtggttattgcacatgatgttgatcccatagagctggtagtttggcttcctgcactttgtagaaaaatgaacatcccttatgcaattgtcaaggggaaagcacgtcttggagcgattgtgcacaaaaagacagcaactgccttgtgcttgacttctgtgaagaatgaggacaagatggaatttagcaagattgttgaggcagtaaaggccaacttcaatgataagtttgatgagtaccggcgacaatggggaggtggcattatgggaactaaatctcaggcaaaaacaaaggccaaagaaaaactcgtggccaaggaagcggcacagaggctcacttaggaataattccttggaatattttttccatgttgaagtttattggattgtttgcaatttgttgtaatttgatttataggtatagtaatatatcagagtttatactaaagaagttttaaagctaactctagctttgaccttagaaaacagcaggtcaattttgcaaataggtaaactgttgagtaaacataacatttcatagccagaaattggcctcatgtgttacaacatattgtatgctgtgatgatggtattttcattttctcctcttatatgttagtgttattgataattattttcaaaaaaaaaaaaaa

SEQ ID NO: 4210 - DNA, 1169 bp, Vaccinium corymbosum
tttagtttttagggttttcccttcgccgtcttcttcgaagtagctgaagcccagaagacagaccttaaaccctccagaaatggctccaaagaaaggcgtcaaaccagtcgtggcagctaaaaagaaaccggagaaggttgtgaacccactattcgagaaacgcccaaagcagtttgggataggaggggcattgcctccaaagaaggatctccatcggtttgtgaagtggccaaaggttgttcagattcagaggaagaaaaggatcctcaaccagcgtttgaaggtcccaccaccattgaaccaattcaccaagacccttgacaaaaaccttgcaacgagtctgtttaagatgcttctcaagtacaggcccgaggacaaagcagccaaaaaggagagacttttgaaaagagctcaggccgagactgaaggaaaaacaattgaagctaagaagcctattgttgtgaaatacggtcttaaccatgtcacctaccttattgagcaaaacaaagctcaattggtggttattgctcatgatgtggacccaatagagcttgttgtctggcttcccgcgttgtgcaggaagatggagatcccatactgcattgtgaaaggaaaagctcgtttgggcactattgtccatcagaaaactgcggcagttctgtgcttgaccactgtcaagaatgaagacaagttggaattcagcaaaatcttggaggctatcaaggccaacttcaacgacaagtacgacgagtaccggaagaagtggggtggaggtatcatgggttccaaatcccaagccaagacaaaggccaaagagaggcttcttgctaaggaggttgctcaaaggatgggttagagagtgtgttgcttgttaggatgtctatttgatgaccttccatcttggattttttgctatcgtgtctgcgttttccttgcaaacttgcagtttttgtttctgttgaggacaggttgttttaaaactatagtgatgttccttcttgtattagttttgaagttctgctacatttttccgacactgggttccatttctgttttgaactgggttcggttgcataatgctttatatggtactggtccgttttagatttccaggatcagttcatggacgataccctaccagttcaaggttttgataatcagtcgttatg

SEQ ID NO: 4211 - DNA, 1081 bp, Cedrus atlantica
ataaacagcttcagtagcttgctattgccgtgcccgtgtaaggacgtagcaggtcaggaagcagagagaaggagagcaagggcgcagatcgactctagcaatggctccgaagagaggggttaagactccagtagctgctaagaagaaggtcccgaaggttgttaatccattgtttgagaagcggcccaagcagtttgggattgggggagctttgccgccaaagaaggatttgcatagatttgtgaaatggccgaaggttgttcgcatccagaggcagaggagggttttgaagcagcgtttgaaggtccctccggccttgaatcagttcaccaagactctcgacaagaatctcgctgccaaccttttcaagatgctcctaaaatataggccagaagataaagctgccaagaaggagaggcttctgaagaaagctcaggctgaggcagaaggaaagactgtggaagtgaagaagcctattgttgtgaaatatgggattaatcatgtaacttaccttattgaacagagtaaagctcaattggtggttattgcacatgatgttgatccaatagagctggtagtgtggcttcctgcactttgtagaaaaatgaacatcccttatgcaattgttaaggggaaagcacgtcttggagcgattgtgcataaaaagacagcaactgccttgtgcttgacttctgtgaagaacgaggacaagatggaattcagcaagattgttgaggcagtaaaggctaacttcaatgacaagtttgatgagtaccggcgacaatggggaggtggtatcatgggaactaaatctcaggcaaaaacaaaggccaaggaaaaactcatggccaaggaagcggcgcaaaggcttacttagaaatagttccttcaatatttttaccttgttgaaattttcattggattgtcttttgcaatttgttgtaatttgatttataggtatagtagcatagcagagtttatactaaggaagttttaagactaacttagctttgacctcagaaaacagcaggtcagttttgcaactgggtaaattattgagtaaacaaaacattttgtacgc

SEQ ID NO: 4212 - DNA, 1009 bp, Eschscholzia californica
gagaggttcctttcgaacaaatcgcctccttcctcaggacctcagctacagcagcatccatggctcccaaaaaaggtgtgaaaacttcagtacctgccaagaagaagactgagaaggttgtgaatcctttgtttgagaagcggccgaagcaatttggcattggtggggctttaccacctaaaaaggacctgcataggtttgtcaaatggccgaaggttgttcgaattcagaggcagcgtaggattttgaagcaacggttgaaggttccacctgcattgaatcagttcactaaaaccctcgacaagaacctcgcaacaaatctatttaagacgctactcaagtacagaccagaggacaaggctgccaagaaggaaagacttttgaaaagagcacaagctgaatctgagggaaagacggtggagtcgaagaagcccattgttgtcaaatatggacttaaccacattacgtatctcattgagcagaacaaggcccaattggtggtgattgcccatgacgtggatccaatcgagcttgttgtctggcttcctgccttgtgccgaaaaatggagataccatacgcgatcgtgaagggcaaggcccgccttggagcgattgtccacaagaaaacagcctcagcattgtgcttgacatccgtgaagaatgaagacaaaatggagttcagcaagattgtggaagcaatcaaagctaacttcaacgacaagtttgatgagcacagaaagaagtggggaggtgggattatgggatccaaatctcaagccaagactaaagcaaaggaaagagtcatagcaaaggaaacagcccaaaggatgaattaggtttttctttgtaggagttaaactatgagctatccttcaatggacaggaaactctgaaatttttgttatacaagccgtctttagttcaagttttgttatggttttagtcatttaaatcttaactgtgttatctttatcaggtcttgtactacaattaatcatctttatacatt

SEQ ID NO: 4213 - DNA, 1222 bp, Eucalyptus grandis
atggataagttaacttcaccgctttatatgggccttatgaattcaaatccggaaagaggcgaagctagggttttggaaacccttaccctccattgccgtcgccactgcggagctgaaccctcccccttcaactcggcaaccatgggtcccaagagaggcggaaaggctgcggtcgcgggcaagaagaagcaggagaaggtgacgaacccgctgttcgagaagcggccgaagcagttcgggatcgggggcgccctgcccccgaagagggacctgacccggttcgtcaagttcccgaagaccgtccagattcagcggaagaggaggattctgaggcagaggctgaaggtcccgccggctcttaaccagttcaccaagacgctcgacaagaacttggcaaccaacctattcaagatgcttctcaagtacaggcccgaggacaaggctgcaaagaaggagcgactcttgaaagaggctcaggcaaaggcagaaggcaaaactgttgaggcgaaaaaaccaattgttgtgaaatatgggcttaatcacgtcacttacctcattgagcagaataaggcacaattggtggttattgctcatgacgttgatccgatcgagctggttgtgtggcttccagcattatgcaggaaaatggaaattccatactgcattgtgaagggcaaggcacgcctgggaacgattgtccataagaaaactgcatctgcattgtgcctgacgacggtgaaaaacgaggacaagctggagttcagcaaaatcttggaagccattaaggctaacttcaatgacaagtatgacgagtacaggaagaagtggggtggtggaatcatgggttctaaatcccaggccaagaccaaggcaaaagaacgggttcttgccaaggaagctgcccagaggatgaattagggttgatatcgagcatttgcttttccttaggatcaagctctcttgagtcttttatcctggtttttggtttgtgcccttgatataagagtagacgcagaagttttggtttcttcgtggaaggttgggatctaaaatattccttgagacatcgattgttggcttaaacttgaagttttaatgtactgtagccttcttttacgggagacttgtcttgatgcctttataccttgcactgtcgtcaatcatgcgcatctgtggagcttggtatcggtttcctgatcatggagcagtagcatttcatttt

SEQ ID NO: 4214 - DNA, 985 bp, Euonymus alatus
ttgtaggctacacggtagaacgaaggagcttgaactgcagtcacaaaaatggctccaaagcgaggtgtgaaggcgccgtcggcggcgaagaagaaacaggagaatgtggcgaaccctttgtttgagaagcgacccaagcagtttggcattggaggtgctttgcctcccaaaagggaccttactcggttcgtgaaatggccgaaggtggtccagattcagaggagaaaaaggatcctcaagatgaggttgaaggttcctccagcgttgaaccagttcaccaaaaccctcgacaagaaccttgcatcaaatctgtttaagatgctgctcaagtacagaccagaggacaaagcatcaaagaaggagcgtctcttgaaaaaggctcaagcagaggctgaaggcaagtctgctgaggctaagaagccgattgtcgtgaaatatggtctcaaccatgtgacctaccttattgagcagaacaaagcacagttggttgttattgctcacgatgtggatccaatagagttggttgtgtggctaccagctttatgccggaagatggaaatcccttactgcattgtcaagggaaaatctcgtttgggatcgattgttcacaaaaaaactgcatccgtcttgtgcttgaccacagtcaagaatgaagataaactcgagttcagcaggatcttagaggccattaaggccaatttcaatgataagtatgatgagtataggaaaaagtggggaggtggaatcatgggttccaaatcgcaggcgaagagcaaggccaaagagaaggtgcttgccaaggaagctgctcaaagaatgacttaggagtcagtattacatatttgtttttctcttgaaaattgacttggtgggctgtttctccaaaatttttgtcaatgtgctcttattaatcgcagaatttatttttttcagaagtaaattttgagcggctatcatagttaataacttaatattgcctcttgtt

SEQ ID NO: 4215 - DNA, 1118 bp, Vitis vinifera
ctctcccagtgtagggtgccgctagggtttatttcgccgcatcagaagtcggaaggagcactgcacactcagaaatggctccaaagaaaggtggaaaagttttggcacagacaaagaagaaacctgagaaggttgtaaatcctctatttgagaagcgtccaaagcagtttggaatcggaggagcattgcctcccaagagagacttgcaccgatttgtgaagtggccacatgttgttcgcattcagaggaagcgaaggatcctcaagcagcggttgaaggtcccaccagcattgaaccagttcacaaagactttggacaaaaaccttgcaacaagccttttcaagatgcttctcaagtaccgtccagaagacaaagcagcaaagaaggaacgccttctgaaaagggcacagtcagaggctgaaggaaaaaccattgaggttaagaagcccattgttgtgaaatatgggctcaaccatgtcacctaccttattgagcagaacaaggcacaattagtggttattgctcatgatgtggacccgatagagttggttgtgtggcttcctgccttgtgcaggaagatggagatcccttactgcattgtgaaggggaaatcgcgcttgggagcgattgtccacaagaagactgcagctgttttgtgtttgacaacagttaagaatgaggataagttggagttcagcaaaatcctcgaggcaatcaaggcaaacttcaatgacaagtacgatgagaacaggaagaaatggggaggagggatcatgggttccaaatcacaagccaaaaccaaggccaaggagaagcttcttgccaaggaagctgctcagaggatgtcctagagtattttaattcttatagaacctttctttcttcaattttttgttttcccccctctttctttttgggagattatcaaaatgcctttgaggattcacttagacggcaactcttaactcatttcactacctcttgtcacaggaatgagaattatcccaattttatcagacatataaagtatgaattagtttgccaacatttagctgaggcatgaagttttcctttctatggatgtttttgatagtaaggcaggcggatgaagtttttga

SEQ ID NO: 4216 - DNA, 1104 bp, Carpinus betulus
actagtctggtactagggtttcatcgccgttatcacgaacctgccaggcgagtcgaggcctagctccacccggaaatggcccctaaaagaggtgtaaaagtggcagcagcacctgccaagaagaaacctgagaaggttgcgaacccgttatttgagaagcgctcaaagcagtttggtataggtggtgctttgcctccaaagagagatcttcaccgatttgtgaagtggccaaaggttgttcgcatccagagaaagaagcggatccttaggcagcgcttgaaggtcccaccagcattgaaccagttcaccaagaccctggacaaaaaccttgcaacaaatttgttcaagttgcttctcaagtaccggccagaggacagagcagcaaagaaggaacgccttttgaagagggctcaagctgagtctgaaggaaaaactgttgaagctaagaagcccattgttgtgaaatatggactcaaccatattacctacctgattgagcagaacaaggcacagttggtagttatagctcatgatgtggacccaatagagctggttgtctggcttcctgcattgtgcaggaagatggagatcccttactgcattgtgaaggggaagtcgcgtttgggagcgattgtccacaagaaaacagcttctgccttgtgtttgaccactgtgaagaatgaggataagttggagttcagtaaaatcctggaggccatcaaggcaaacttcaatgacaagtatgatgagtacagaaagaagtggggaggtgggatcatgggctccaaatcacaggccaaaaccaaggccaaggaaaaacttctagctaaggaagctgctcaaaggttgtcttaagagtataagtagtcctagagagatgaccagttcttacgttgtgtttttttgtttttccatattagtttaacttcataaccgaatttgcctcgtctctctctagtcatgggactgtgatatatttttttatactcttgttagctccctttttttgattagacataaagaactgttctgttttttgaacgatctacaactttcatcacaagtttgtgatccacataatgaccaatgatgtgattatttcgg

SEQ ID NO: 4217 - DNA, 997 bp, Ipomoea nil
agtgagttagggttttcgccgataggaagtgaaaatggctccgaagaaaggtgtaaagcttccggccgcggcggcaaagaagaagccggagaaggtggtgaacccgctttttgagaagcggccaaagcaatttggaatcggaggtgcattgccgcccaagaaggatcttacaaggttcgtcaaatggccgcaagttgttcgcatccagaggaagaggaggatcctcaagcagcgcttgaaggtcccgccagcactcaaccagttttccaagacccttgataagaacttagcaacgaatctcttcaagatgcttctcaagtacaggcctgaggataaggctgctaagaaggagcgccttttgaaaagggcccaggctgaaagtgagggaaagactcctgaactaaagaagcctattgttgttaagtatgggctcaagcatgtcacttacctcattgagcagaataaagcccaattggtggttattgctcatgatgtagacccgattgagctcgttgtctggctcccggctttgtgcaggaagatggaaattccctactgcattgtgaagggaaaagcaagattgggttccattgtccacaagaagactgcatcagttttgtgcttgacctcagtgaagaatgaggataagttggagttttctaagattttggaggctattaaggccaacttcaatgacaaatatgaagagaatcgcaaaaagtggggaggtggaatcatgggttctaaatcccaagctaggacaaaggccaaggaaaggcttcttcaaaaggaggcagcgcagaggatgtcttaaggatatttgttatccatgtttttggacagaccaaagtagactgatcttgtgttgtgagcagagtttattttttttacttgtatttgcttttgacaaaaaacttaatgtgtcgttttacttgtatttgcttttgacaaaaaacttaaaatgtgtcgttttcctgcatacaatatagtcattgca

SEQ ID NO: 4218 - DNA, 1014 bp, Actinidia deliciosa
  misc_feature (25)..(25): n is a, c, g, or t
  misc_feature (106)..(106): n is a, c, g, or t
  misc_feature (262)..(262): n is a, c, g, or t
  misc_feature (304)..(304): n is a, c, g, or t
  misc_feature (971)..(971): n is a, c, g, or t
  misc_feature (984)..(985): n is a, c, g, or t
gttttcgcttcgccgtcttcacagnagagagaagaaatcttcagaaatggctccaaagaaaggcgtcaaaccagttgcagcagcaaagaagaaaccggagaaggtngtgaacccgctgttcgagaagcgtccgaagcagtttgggataggaggggcattgcctccaaagaaagatctgcaccggtttgtgaagtggcctaaggttgtgcaaattcagaggaagagaaggatcctcaaccagcgcttgaaggtcccaccaccnttgaaccaattcaccaagaccctcgataagaacctcgctacnagtctatttaagatgcttcttaagtacaggcctgaggatagagctgcaaaaaaggagcgccttttgaaaagggctcaggctgaggctgaaggtaagcctgttgaagcaaaaaagcctattgttgtgaaatatggtctcaaccatgtcacctacctcattgagcagaacaaagcacaattggttgttattgctcatgatgtggacccaatagagcttgtcgtctggcttcctgcattgtgtaggaagatggagatcccatattgcattgtgaaaggaaaatctcgattgggaactattgtacatcagaaaactgccgccgttctgtgcttgaccactgtcaagaatgaagacaagttggaattcagcaaaatcttggaggctatcaaggccaacttcaatgacaaatatgacgagtacaggaagaagtggggtggtggtatcatgggttccaaatcccaagccaaaaccaaggccaaagagagggttctcgcgaaggaagctgctcagagaatgaactaagagacttgatcatatatatctcacttgttagtcgttgaggtggtttgaaaactttcttcaattctggatatttttgtcatgagcagttttattaactgcggagttttgttttcgaatagtgttatattcagggattcaacgttctccntcatatctttttnngctagattctgttgcataaaaaaaaaaaa

SEQ ID NO: 4219 - DNA, 1132 bp, Tropaeolum majus
ttagcacgaaccagaaggagatttcaggggaagaagaaaatggcacccaagaaaggaggaaaagctgttgcactagccaagaagaaaactgataaggttgtcaatcccctttttgagaagcgaccaaagcagttcggtattggaggagctcttccaccaaagaaggatctgcacaggttcgtaaagtggcccaaggctattcgcattcaaaggcagaggaggatcctcaagcagaggttgaaggttccacctgcattgaatcaattcaccaagacacttgataagaaccttgcaacaagcttgttcaagttgcttctcaagtatagacctgaagacaaggcagcaaagaaagagcgtctgttgaagaaggcgcaggccgaggctgaaggaaagacagtcgaaagcaagaagcccattgtagtgaaatatggacttaaccatgtgacctacttgattgagcagaacaaggcacaacttgtgattattgctcatgatgttgatcccattgagttggtcgtttggttgcctgccctatgcaggaaaatggagattccatactgcatcgtgaagggaaaatccagattgggagcgattgtacacaagaaaaccgcctccgccttatgtttgaccacagtaaagaacgaggacaagatggacttcagcaaaatcttagaagctatcaaggctaactttaacgacaagtacgatgagtacagaaagaaatggggtggtggtataatgggatccaaatcacaagccaagaccaaggccaaggagagagttctggcaaaggaagctgcacagaggatgaactagaaaaccttttgtcacatttcggatacatacctctttggtgccggctatctacttaatcaggatttgttttgctatattttattcgccagagtcttattttatgttattaaacttgaatcgaaccgttagcgctgttaatgtctgatttcacacattttgtagttcctcccatttttggtgggtggatgagattttgtgacatgttttttgtttctcttcgattcgtttaagcttcactttttactttgtttggtaagaaggttggaaaagtacattgaaaagtacatgggaaagtagagaatttcgaaagatagat

SEQ ID NO: 4220 - DNA, 1078 bp, Cajanus cajan
tttctctctggcggcaacgacacacagcacaccgcgtccaaaacctttctctctcgcggcaccgacgcaacgcaatggctccgaagcgaggtgcgaaaccagtggtagcagcagcgaagaagaagccggagaaggtgacgaacccgctcttcgagaagcgcccgaagcagttcggcatcggaggcgcgttgccaccgaagcgtgacctcacgcgcttcgtcaagtggcccaagaccgtccaaatccagcgcaagaagcgcatcctcaagcagcgcctcaaggtccctcccgcactcaatcagttcaccaagaccctagacaagaacctcgcgacgaacctgttcaagatgctgctcaagtacaggcccgaagataaagcggagaagaaggagcgcttgttgaagagggcccaggctgaggctgatgggaagcccgtcgaggccaggaagcccattgttgtcaaatacggtctcaaccatgttacctaccttattgagcagaataaagcacaactagttgtgattgctcatgatgtggatccaattgagctggtggtctggcttccagcattgtgcaggaagatggaaattccatactgcattgtcaaggggaaagcacgcctaggaacggttgtccacaagaaaactgcttcagttttgtgtttgacaactgtcaagaatgaagacaaactggagttcagtagaatccttgaagcgattaaggccaacttcaatgacaagtatgatgaatacagaaagaagtggggtggtgggatcatgggttccaaatcccaagccaagacccgggcaaaagagaagctccttgccaaggaagcagcccaaagaatgtcctagatttacttgtttttacaagtttgaggttgtcatttttctatattttatatgggagcatatacaagttaaaatgtgaggtctcacttaattttggtagttcgtaatccacaagtactaattttgatctgtgattttcagtagctatttttatagacttaacatggattggtttcctttttcagttcaggagttaatattatcattagtaagattttgcagcaatt

SEQ ID NO: 4221 - DNA, 1327 bp, Papaver somniferum
ctagagtatatataagaatctctggaatgtctcactaaaaaattcagccggggacactcttaataaaccctagtttcttcccttaaccccatttctcttcgcgaatcaggagggatttctttcatcaacacgcgacatggctcccaaaagaggggtgaaggcaccagtggcggtgaagaataagactgataaggttgtgaatccttgttttgaaaagcgtccaaaacagtttggcattggtggtgcgttgcctccaaaaaaggatttgcataggttcgtgaaatggccaaaagttgtccgcattcagcgtcagaggaggatactcaagcaacgtttgaaggttccacctgctttgaaccagttcactaaaaccctagacaaaaaccttgctacaaacctattcaaactgttgctcaagtaccgtccagaggataaggctgctaagaaggaaagactattgaaaagagcacaggctgaatcagaaggaaagactgtcgaggcaaagaagccgattgttgtgaaatatgggcttaaccacattacctacctcattgagcagaacaaggcccagttggtggttattgcacatgatgtggatcccatcgagcttgttgtctggttacctgctttgtgccgaaagatggaaatcccatatgctattgtgaagggcaaggctcgtcttggagcgattgtccataagaaaactgccagcgcactgtgcctaacatcagttaagaacgaggacaagatggactttagcaagattgtagaggcaattaaggctaacttcaatgataagttcgacgaacaccgaaagaagtggggtggtggtattatgggttccaagtcacaagcaaagaccaaggctaaggaaagagtcttagcaaaggaagctgcacaaaggttgaattagatattagttgaagataaaagagaccatcttgtgtgtagttggaattaaccgaaatttgtagctacatacaattaagatattagtcatttgctttttgtagttttggtctggagaggcatttttatttctggtctagtgcaaattttaactgattctcagatcctatatatatgaagtcgaatcttttgtttctggtgtgattacagtttttaaccctctgtattacacaaattttacagttaaaattgtatgattcacaaatacagagggttaactggagaggcatttttagtttctgttgtgactctacttgggttgaaagggtttgcaacttcccgttgcatcgttttctaaactatgatcgacttttttggccttcctttgattggataaataaaataatactctactccc

SEQ ID NO: 4222 - DNA, 1048 bp, Papaver somniferum
cccttaaccccatttctcttcgcgaatcaggagggatttctttcatacaacacgcgacatggctcccaaaagaggggtgaaggcaccagtggcggtgaagaagaagactgataaggttttgaacccttgttttgaaaagcgtccaaaacagtttggtattggtggtgcattgcctccaaaaaaggatttgcataggttcgtgaaatggccaaaagttgtccgcattcagcgccaaaggaggattcttaagcaacgtttgaaagttccacctgctttgaaccagtttactaaaaccttagacaaaaaccttgctacaaacctattcaaaatgttgctcaagtaccgtccagaggacaaggctgctaagaaggaaagactattgaaaagagcacaggctgaatcagagggaaagactgttgaggcaaagaagccgattgttgtgaaatatggacttaaccacattacctacctcattgagcagaacaaggcccagttggtgattattgcacatgacgtggatcccatcgagcttgttgtctggttacctgctttgtgccgaaagatggaaatcccatatgctattgtgaagggcaaggctcgtcttggagcgattgtccataagaaaactgccagcgcactgtgcctaacatcagttaagaacgaggacaagatggactttagcaagattgtagaggcaattaaggctaacttcaatgataagttcgacgaacaccgaaagaagtggggtggtggtattatgggttccaagtcacaagcaaagaccaaggctaaggaaagagtcttagcaaaggaagctgcacaaaggttgaattagatattagttgaagataaaaagaccatctcgtggggagtgggaattaaccgaaatttgtagctacatataattaagatattagtcatttgctttttgtagttttggtccggagaggcatttttatttctggtctagtgcaaattttaactgattctcagatctttctctatatgaagtcgagtttattactccaaatttgtttttttactactt

SEQ ID NO: 4223 - DNA, 866 bp, Papaver somniferum
atcaaatggctcccaaaagaggtgttaaggcccctgtagccgccaagaaaaagactttaaaggttgttaatccttgttttgagaagcgcacaaaacagtttggtattggtggtgctttacctccaaagaaggatcttcatagattcgttaaatggccaaaggttgttcgtatccaaaggcagcgaaggattttgaagcaacgattgaaggttccacctgctttgaaccagtttaccaaaacacttgacaagaaccttgccacaaatcttttcaagatgttgctgaagtacagacctgaagacaaggctgctaagaaggaaaggctgttgaaaagggctcaagctgaatcagaaggaaaaacagttgaggcgaagaagcctattgttgtgaaatatggacttaaccacattacatatctcattgagcagaacaaggcccaaatggttattattgcacacgatgttgatcccattgagcttgttgtctggcttccagcattatgccgtaaaatggagattccatatgccattgtaaagggcaaggctcgtcttggggcgatcgtacacaagaaaactgcctcagcattgtgcttgacatcagtgaagaatgaagataaaatggaattcagcaagattgtggaagctgtcaaggctaatttcaatgataagtttgacgagcaccgtaagaaatggggaggtggaatcatgggatcaaagtcgcaagctaagaccaaagctaaggaaagggttttggctaaggaagcagctcagaggttgaattagttgtttttcagttgtagcaagccctgagagagaaacattattaggcaagcaattttggtatttctgtgtatacagatacaattc

SEQ ID NO: 4224 - DNA, 972 bp, Rosa hybrid cultivar
ggagggtttacgccgttcgcacttcgcagtcttccaagcaaattgaagcagctgccgcaatgggtccaaagaaaggtggaaagctcccagtcgcagcttctaagaagaagccggagaaggtggtgaacccactgttcgagaagcgcccgaagcagttcgggatcggaggggcattgcctccgaagagggatctgacccggttcgtcaaatggcccaaggctgttcagattcagaggaagaagaggatcctcaagcagaggctcaaggtcccaccagctctcaatcagttcaccaagacccttgataagaacctcgctacaagcctgttcaagatgctcctgaagtacaggcctgaagacaaagccgagaagaaggagcgtcttttgaaaagggcgcaggcagagactgaaggaaagactgttgaagccaagaagcctattgttgtgaagtacggtctcaaccatgtcacctacctcattgagcagaacaaggcccagcttgtggttatcgctcatgatgtcgatccaattgagttggttgtatggctccctgctttatgcaggaagatggagatcccctactgcattgtgaagggcaaagcacgtttgggagcgattgttcaccagaaaactgcctcagttttgtgcctgacgacggtcaagaatgaagacaaaatggagttcagcaaggtcttggaggctatcaaggccaacttcaatgacaagtatgaggaatacaggaagaagtggggtggtggcatcatgggttccaaatcgcaggccaagaccaaggcaaaggagaggctccttgccaaggaagctgctcaaagaatgacttaattttggtcacggtgtattgtgattttacttagtttatgcttctgagtatctactggatttcttattgtagcagagattttgtttccttttatcaaatgcagctttgcttaaagagatttggtattttagacgt

SEQ ID NO: 4225 - DNA, 1032 bp, Manihot esculenta
ccgcttctcttttcttctcttctatcacccgcctttcctcgaactgcagctagggtttccatctgcacatctccacactcccatggctcccaaaagaggtgttaaggccccagtactttcaaagaagaaacctgaaaaggttgtcaaccctttgtttgagaagcgaccaaaacagtttggaattggtggtgcattgccaccaaagaaggacttgactaggtttgtcaagtggcctcatgttgttcgtattcagaggcaaaggaggattctgaagcaacgtctgaaggttcctcctgctgttaaccagttcacaaaaacacttgacaagaaccttgccacacaactcttcaagttattgctcaaatataggcccgaggacaaggcagctaagaaggagaggcttcttaaaagagcacaagctgaagcagaggggaaaactgttgaatcaaagaagcccattgttgtcaaatacgggcttaaccatgttacatacctcattgagcagaacaaggcccaattagtggttattgcacatgatgttgatcccattgagcttgttgtttggttgcctgccttgtgccggaaaatggaggtcccttatgcaattgtgaagggcaagtcacgccttggagctattgttcacaagaaaacagcagcagctttgtgccttacatcagttaagaatgaagataaattggaatttagcaaaatcttggaggcagttaaggctaacttcaacgacaagtttgatgagcaccgcaagaggtggggtggtggcatcatgggctccaaatctcaggcaaagacaaaagctaaggagaaactcttggcaaaggaggctgcacagaggatgtcttaagcttctaggtagtagttgagagagagttatcaggaacttgtaatgatgaattttggattttcattttgattttatggctttgttttcatggactaattttgcattgttggaagatatatgaacatttctcttaagatttatggtgggagaatgaatttatagtctatttcttc

SEQ ID NO: 4226 - DNA, 1090 bp, Gossypium hirsutum
ataaaccctagtttgttcattgcttttgctttctacgtgttttctagggttttcttccgccgttctaaatcacagaaagctttgaagaagaagcttttggaggtgcaaaacatggggccgaagaaaggtggaaaggtggctgtgcccgccaagaagaaacaagagaaggttgtcaatccgttgtttgagaagcgtccaaagcagttcggcattggaggggctttacctcctaagaaggatttgcatcgattcgtgaagtggcctaaggttgttcgtattcaaaggaagaagaggatcctcaagcagaggttgaaggttccaccagcattgaaccagttcaccaagactcttgacaagaacctcgcaacaagtctgttcaagttgctcctcaagtacaggccagaggacaaagtggccaagaaggaacgtctcttgaaaaaggcccaggccgaggctgaaggaaaagcccccgagtctaagaaaccaattgttgtgaaatacggtcttaaccatgttacttaccttatcgagcagaacaaggctcaattggttgttattgctcatgatgtggatcccatagagttggtagtgtggcttccagctttgtgcaggaaaatggaggtcccatattgcattgttaagggaaaatcacgtttgggatcgattgtccacaagaaaactgcttccgtcttgtgtttgaccacggttaagaacgaggataagctggaattcagcaaagtactcgaggcaatcaaggcaaacttcaatgacaagtacgacgagtacaggaagaagtggggtggcggcatcatgggctccaagtcacaagcccgaaccaaagcgaaggagaagcttcttgcaaaggaagctgcacagaggatgacatagaggaattaatagaccttttgtcgcagttcgtgtttttgattaaatagtcttttgtagtaaggtacgatcgattttcgactcgggtttactctcttttccggaggaacattcatatacttttgtggttgaactttctaaatgcctagtttgttgtttgtgctgaagttttgtgattttctaatgaattgtcaatcaatgtttt

SEQ ID NO: 4227 - DNA, 1129 bp, Gossypium hirsutum
cttggaacaagcttaaggaactgcagaaatggccccaaagagaggtgtaaaggttgctgccccggccaagaagaaacaagagaaggttgtgaatccactgttcgagaagcgtccaaagcagtttggtattggcggggcactacctccgaagaaggatctacatcgatttgtaaagtggcctaaggttgtccgcattcaaaggaaaaagaggatccttaagcagaggttgaaggtcccaccagcattgaaccagtttaccaagactcttgacaagaaccttgctacgagtctattcaagctgcttctcaagtacagaccggagggcaaggcagccaagaaggaacgtctactgaaaaaggctcaggctgaggctaaaggcaaagcccctgagtctaagaaaccaattgttgtgaaatacggacttaaccatgttacctaccttattgaacagaacaaggcacaattggttgtcatcgcccacgatgtggatcccatagagcttgtagtctggcttcctgctttgtgcagaaagatggaggtcccctactgcattgtcaaggggaaagcacgattgggatcgattgtccacaagaaaactgcatctgtcttgtgcttgaccacggttaagaacgaggataagatggagttcagcaaaatcctcgaggcaatcaaggccaacttcaacgacaagtacgatgagtacaggaagaagtggggaggtggtatcatgggctcgaaatcacaagccagatccaaggcaaaggagaagcttctcgcgaaggaagccgcacaaaggatgacttaagccaaccattgttcccttccagaggttccctctggttaccaagtcaaattttactcctttgcccgaggattacttatatattttgtagtttaactttcaaaacaccgagtagctgctgtttgtgatgtaattttgtgcccaaaccatcatttatgctgagcgatcttacttaaatagtcgtgtatgatatatataatcagtttcgtcctcttgactaaaaagcaactctttttcttaaggtttatttattatgttaattgagtaccaacattggaggtgtttttatcattttatataaaaaataaaaaaatacatatgcttttt

SEQ ID NO: 4228 - DNA, 1163 bp, Glycine max
aatattcatatataatacacaaccctagctagggtttttccgagagtcagattcgctcgccttgcttcgccacacaacagcaactgcagcaatggctcccaaacgaggtggaaaggctccggctcttgccgctaagaagaagcctgagaaggtttcgaatccgttgttcgagaagcgtccaaagcagttcggaatcggaggggcgttgcctccgaagagagacttgactcggttcgtgaagtggccaaagaatgttcaaattcagaggaagaagaggattctgaagcagaggttgaaggttcctccagctttgaaccagttcaccaaaactcttgacaaaaacctagcaacaagtctgttcaagttacttctgaaatacaggccagaggacaaagcagaaaagaaggagaggctcttgaaaagggctcaggcagaggctgaaggcaaaaccgttgaagctaagaagcccattgttgtgaagtatggtctcaaccatgttacctacctcattgagcagaacaaagcacagcttgttgtgattgctcacgatgtggacccaattgaattggttgtctggcttcctgcattgtgcaggaagatggaaattccgtactgcattgtgaagggaaaggcccgcttgggaacggttgtccataagaaaactgcatctgttttgtgcttgacaactgttaagaatgaagataaattggagttcagcagagttttggaggctatcaaggctaatttcaatgacaaatatgacgagtacagaaagaaatggggtggtggaatcatgggatccaaatctcaagcgaaaaccagagcaaaggagaagcttcttgccaaggaagctgctcagaggatgaattaggaggagtttcttatatcttgttgctttgcgaatgctattaagtttgttttttaatgtactcttttaattattgtcttcataaaaacatttgttattcacatgagctagagtatttcgctaaaatctcctgccgactgttccaattcctgaacccttggattactttaattttggtagtggacttttttcgggtactttatgaaggaactgcattaggatgcagttgcatccaattttttatatttgattctccatggttatagtataaaatagtttgattgagaggtcctct

SEQ ID NO: 4229 - DNA, 1215 bp, Glycine max
aaaaagaatgttaagaaccgggccgaaggcgttgttgccaggcccaatattcatatataatacacaaccctagctagggtttttccgagagtcagattcgctcgccttgcttcgccacacaacagcaactgcagcaatggctcccaaacgaggtggaaaggctccggctcttgccgctaagaagaagcctgagaaggtttcgaatccgttgttcgagaagcgtccaaagcagttcggaatcggaggggcgttgcctccgaagagagacttgactcggttcgtgaagtggccaaagaatgttcaaattcagaggaagaagaggattctgaagcagaggttgaaggttcctccagctttgaaccagttcaccaaaactcttgacaaaaacctagcaacaagtctgttcaagttacttctgaaatacaggccagaggacaaagcagaaaagaaggagaggctcttgaaaagggctcaggcagaggctgaaggcaaaaccgttgaagctaagaagcccattgttgtgaagtatggtctcaaccatgttacctacctcattgagcagaacaaagcacagcttgttgtgattgctcacgatgtggacccaattgaattggttgtctggcttcctgcattgtgcaggaagatggaaattccgtactgcattgtgaagggaaaggcccgcttgggaacggttgtccataagaaaactgcatctgttttgtgcttgacaactgttaagaatgaagataaattggagttcagcagagttttggaggctatcaaggctaatttcaatgacaaatatgacgagtacagaaagaaatggggtggtggaatcatgggatccaaatctcaagcgaaaaccagagcaaaggagaagcttcttgccaaggaagctgctcagaggatgaattaggaggagtttcttatatcttgttgctttgcgaatgctattaagtttgttttttaatgtactcttttaattattgtcttcataaaaacatttgttattcacatgagctagagtatttcgctaaaatctcctgccgactgttccaattcctgaacccttggattactttaattttggtagtggacttttttcgggtactttatgaaggaactgcattaggatgcagttgcatccaattttttatatttgattctccatggttatagtataaaatagtttgattgagaggtcctctaaacaaa

SEQ ID NO: 4230 - DNA, 1151 bp, Vaccinium corymbosum
ttttagggttttcccttcgccgtcttcttcaaagtagctgaagcccagaagacagaccttaaaccctccagaaatggctccaaagaaaggcgtcaaaccagtcgtggcagctaaaaagaaaccggagaaggttgtgaacccactattcgagaaacgcccaaagcagtttgggataggaggggcattgcctccaaagaaggatctccatcggtttgtgaagtggccgaaggttgttcagattcagaggaagaaaaggatcctcaaccagcgtttgaaggtcccaccaccattgaaccaattcaccaagacccttgacaaaaaaccttgcaacgagtctgtttaagatgcttctcaagtacaggcccgaggacaaagcagccaaaaaggagagacttttgaaaagagctcaggccgagactgaaggaaaaacaattgaagctaagaagcctattgttgtgaaatacggtctcaaccatgtcacctaccttattgagcaaaacaaagctcaattggtggttattgctcatgatgtggacccaatagagcttgttgtctggcttcccgcgttgtgcaggaagatggagatcccatactgcattgtgaaaggaaaagctcgtttgggcactattgtccatcagaaaactgcggcagttctgtgcttgaccactgtcaagaatgaagacaagttggaattcagcaaaatcttggaggctatcaaggccaacttcaacgacaagtatgacgagtaccggaagaagtggggtggaggtatcatgggttccaaatcccaagccaagacaaaggccaaagagaggcttcttgctaaggaggttgctcaaaggatgggttagagagtgtgttgcttgttaggatgtctatttgatgaccttccatcttggattttttgctatcatgtctgcgttttccttgcaaacttgcagtttttgtttctgttgaggacaggttgttttaaaactatagtgatgttccttgtattagttttgaagttctgctacatttttctgacactgggttccatttctgttttgaactgggttcggttgcataatgctttatatggtactggtccgttttcgatttccaggatcagttcatggacgataccctaccagttcaaggttttgataatc

SEQ ID NO: 4231 - DNA, 1196 bp, Cajanus cajan
atcctcaaaaagaagaacctttctctctctgtcgcggcacacagagacaatggtgagtccgcgtcaccttcgtttttggtttatcattttgatcaaacttggatggttcgattttctataacaggctccgaagagaggtgcgaaaccagtggtggcagcgaagaagaagcccgagaaggtgacgaacccgctcttcgagaagcgtccgaagcagttcggaatcggaggcgcgttgccgccgaagcgtgacctcacgcgcttcgtcaagtggcccaagaccgttcaaatccagcgcaagaagcgcgtcctcaagcagaggctcaaggtccctcccgcactcaatcagttcaccaagaccctcgacaaaagcctcgcgacgaacctgttcaagatgctgctcaagtacaggcccgaagataaagcggagaagaaggagcgtttgttgaagagggcccagtctgaggctgatgggaagcccgttgaagctaagaagcccattgtcgtcaaatatggtctcaaccatgttacctaccttattgagcagaataaagcacaactagttgtgattgctcatgatgtggatccaattgagcttgtggtctggcttccagcattgtgcaggaagatggaaattccatactgcattgtcaagggcaaagcacgattaggaacggttgtccacaagaaaactgcttcagttttgtgtttgacgactgtcaagaatgaagacaaactggagttcagtagaatccttgaagctattaaggccaacttcaatgacaagtatgatgaatacagaaagaagtggggtggtgggatcatgggttccaaatcccaagccaagacccgggcaaaagagaagctccttgccaaggaagcagcccaaagaatgtcctagatttacttgtttttacaagtttgaggttgtcatttttctttattttatatgggggcatatacaagttaaaaatgtgaggtttcacttcattttgttagttcgtaatccacaagtactgattttgatctgtgattttcagtagctattttatagacttaacatggattgttttcctttttcagatcaggagttaatattatcagtattaagattttgcagcaatttagtagtttttgggcgtcttgttgcttaaaacatcgattgtggctcttttttctggatagtttttctatgtttg

SEQ ID NO: 4232 - DNA, 1121 bp, Picea glauca
agggtttaggagcagggctttgtgtaaagaataaacggcttcagcagtttgttattgccgtgcgcgtggaaggaggtcgcaggtcagctagcaaagcgaagtatagcgagggagcagatcgattctagcaatggctccgaagagaggggttaaggctccggctgcagctaagaagaaggtcccaaaggttgttaatccattgtttgagaaacggcaaaaacagtttgggattggtggagctctgccgccaaagaaggatttgcacaggtttgtgaaatggccgaaggttgttcgcatccagaggcagcggagggtattgaagcaacgtttgaaggtccctccggccttgaaccagttcaccaagacccttgacaagaatctcgctgccaaccttttcaagatgcttctaaaatataggccagaagataaagctgcaaagaaggaaaaggcttctgaagaaagctcaggctgaggcagaaggaaagactgttgaagtgaagaagcctattgttgtaaaatatgggatcaatcatgtaacttaccttattgagcagagtaaagctcaactggtagttattgcacatgatgttgatccaatagagttggtagtgtggcttccggcactttgtagaaaaatgaacatcccttatgcaattgtcaaggggaaagcacgccttggagcgattgtgcacaaaaaaacagcaactgccttgtgcttgacttctgtgaagaatgaggacaagatggaatttagcaagattgtcgaggcaataaagggcaacttcaacgacaagtttgacgagtatcgtcgccaatggggaggtggcattatgggcaccaaatctcaggccaaaacaaaggccaaggagaaacttgtggccaaggaagcggcacagaggctcacttaagaataattccttggaatatattttttaacgtgaaattttattggattgtttttgcaatttgttgtaatttggttctaggtatgtaaacataagtaaacaagagtttataccaaggaattttaaagctaagctgtagcttagacctcagaaaacggcaggtcaaattttgcaaactcagtaaaatgttgagtaaaacaatattttcgtaacaac

SEQ ID NO: 4233 - DNA, 1058 bp, Trifolium pratense
  misc_feature (530)..(530): n is a, c, g, or t
  misc_feature (731)..(731): n is a, c, g, or t
cttttgtataagctttctccttcgttccgccacttccatcaacaacaacaacagcaccaatggcaccaaagcgcggtggaaaagcaccagttgcagctgctaagaagaagcagccagagaaagtggtgaacccacttttcgagaaaagacctaagcaatttgggatcggtggtgctttacctccaaagagagatttaacaaggtttgtgaaatggcctaagaatgttcaaatccagaggaagaagagaatccttaagcagaggttgaaggttccaccagcacttaatcagttcactaagactcttgataagaaccttgccacaaaccttttcaagatgctcctcaagtataggccagaggacaaagctgagaagaaagagcgtcttttgaaaaaggctcaagccgaaactgagggcaaaaccgttgagacaaagaagcctattaatgtgaaatatggtctcaaccatgttacatatcttattgagcagaacaaggcacagcttgttgtgattgctcatgatgtcgacccnattgagcttgtcgtctggcttccagcattgtgcaggaagatggaaattccttactgcattgttaagggcaaagcacgtttgggaactattgttcacaagaaaactgctgctgttttgtgcctgaccactgtcaagaatgaagacaaaatggaattcagcagaatcctagaagccattaaggccaacttcaacgacaagtangatgaatacaggaagaagtggggtggtggtattatgggttccaaatctcaagccaagaccaaggccaaggaaagactcattgccaaggaagctgctcaaagaatgacctagaaatttcatatgcttttggttattttagaactttctgttttgttattcttctatatttttggtggaggctttaaaaacaagtataatgtgcaattttcctttcattctgctgttagcttgtaattcacaaccatggtttcattacctgcaccttttgctgaattatatttcagtagttgttttagacttaaatatggattgtgtttttttgtcttc

SEQ ID NO: 4234 - DNA, 1452 bp, Glycine max
atgggcccggcccaaacctgacccggcaacccaatcttttaaatcgagttccgaagccatattctcagtctctagggtttttgatcgttgttgttctaaagcactcatccacacattctccgtcgccacgacaacaatggctccaaagaaaggtgcgaaaggtggagttgtagcagcaaagaagaaggttcaggagaaggtaacgaaccctttgttcgagaagcgtccgaagcagttcgggatcggaggcgcgctgccgccgaagcgggacctgacgcgcttcgtgaagtggccgaagaacgtccaaatccaacgcaagaagcgcatcctcaagcagaggctcaaggtccctccggctctcaaccagttcaccaaaaccctcgacaaaaatctcgcaacaaatctttttaaaatgctgctgaagtacaggccggaggacaaggcggagaagaaggagaggctgttgaagagggctcaggctgaggctgatgggaaacctgttgaggccaagaagcctattgttgtcaaatatggtctcaaccacgttacctaccttattgagcagaacaaggcacaactggttgtgattgctcatgacgtggacccaattgagctggtagtctggcttccagcattgtgcaggaagatggaaattccatactgcattgtcaagggcaaagcacgcttgggaacaattgtccacaagaaaactgcttcagttttgtgcttgacaactgtcaagaatgaagacaagatggagttcagtagaatcctagaagctattaaggccaacttcaatgacaagtacgatgaatacagaaagaagtggggtggtggaatcatgggttcgaagtcccaagccaagaccagggccaaggagaagctccttgccaaggaagcagcccaaagaatgaactagattaagttgcttttacattattaaggttgtcatttttctatatcttatatgggagcatatacaagttaaaatgtgaggttttacttcattttggtagctggtaatccacaaggaccgattttgatcgttgatttttcgaagttattttaaacttagcattggaatgttttcctttttcggttcaggagttcctataatcagtattgagattttgcagcaattcagtagtgtggtgttgcttattgatcgtggacccttttcaacatgttgggagcgtatacgtctaaaaataaggaaaaagggggattataatttcatagtttatgtgcttcatgtgcttaaactttatgatcgtatcaagtcgtatttgtgttctgctttttcttgttggaatatattgtaggcatattttaaaaagaaaacgtgatacctattttcaccaagacattagaaatacaacataacaaactatcattcaattgtattggtgattctcatctcatccaatgattctttaactgtgttttggggta

SEQ ID NO: 4235 - DNA, 1096 bp, Citrus clementina
tggttcgcaaacccagctactcaaaatggccccaaaacgaggcgtaaaagcactagtcgctgcatcgaagaggaaaacggagaaggtagtaaatccactgttcgagaagcggccgaagcagtttggaatcggaggtgcattgccaccaaagaaggacctgacccgctttgttagatggccgacacaagtcaacattcagaggaagaagaagattcttaaactcaggctcaaggtcccacctgctttgaaccaattcaccaagaccctcgacaagaacctcgcatcaaacttgttcaagatgcttctcaagtacaggcctgaggatagagcagcaaagaaggagagactgctgaaaaaggctcaggcagaggctgaaggaaaaacggttgagagtaagaaacccattgttgtaaaatatgggcttaaccatgtgacctatcttattgagcagaacaaggcacaattggtggttattgcccatgacgtggacccagtagagttggttgtctggctaccagccttgtgtaggaagatggagatcccatactgcattgtgaaggggaaagctcgcttgggagtgattgtccacaagaaaactgcatctgttttgtgcttgaccacagtcaagaatgaagataagatggagttcagcagaatcttagaggctatcaaggctaattttaatgataaatacgacgagcataggaaaaagtggggtggtggaattatgggttcaaaatcacaagccaagaccaaggctaaagaaaagctccttgctaaggaagctgcccagagaatgtcttaagagccaatcttttgcaattttgttaatctactgcaattttgttatttaggatatgagcattggggctttttaccctctgagatttttggttattttgaagttgttcaggctgattacagaggttttctttcattatagggtgattaaatttaattgagaagcaggatatttttttacatgaatatgcattcttgtcatgggtttagtcctgattcaatgcaaatgcttgtttagtataagttgtttttcaccatcattgaacatttatatctctgccttcagtctcctagt

SEQ ID NO: 4236 - DNA, 995 bp, Distylium racemosum
ggaggaggacgaattagctgcgaagcgaattcaacaatggctccaaagagaggggtaaaggcccccgtccctgcaaagaaaaaggcaccgaaagttgtgaatccattgtttgagaaaaggccgaagcagttcggcatcggcggagcgctgccgcccaagaaggacttgcacagattcgttaaatggccgaaggtgatccgcatccagaggcagcgcaggatcctgaagcagcgcttgaaggtcccccctgctctcaatcagtttacaaaaacacttgacaagaatctcgcatcaaaccttttcaagatgcttctgaaatacaggccagaagataaagctgccaaaaaggagaggcttctgaagaaggcacaagcagaggcagaagggaagacagttgaagttaagaagcctattgttgtgaaatatggtatcaatcatataacttaccttatcgagcagagtaaagctcagttggtgattattgcacatgacgttgatcctatagagctggttgtatggcttcctgcgctctgtaggaaaatgaatattccttattgtattgtcaaggggaaatcacgtctgggagcgattgttcacatgaaaaatgccgctgctttgtgcttgacatcagtgaagaacgaagacaaaatggaatttagcaggattgttgaggcagtaaaggctaatttcaatgataagtttgatgagtatcggcgccaatggggaggaggtattatgggttcaaagtctcaggcgaaaacaaaggccagagaaaaacttttggccaaggaagcggcacaaaggctgacttagtatgattttggagatgcttcctatgtcacagagtttcatctgttctattttgtttggaatttgatttgaggggatctgaacctggtagtcatcatgggagaagacgagagtcccctcgtagagaaccttaagcttggtaacgagttatggagggcctgtctgttgctgcaatggcgccaagg

SEQ ID NO: 4237 - DNA, 1118 bp, Euonymus alatus
ccacactgttaggctaaacgaaggagcttgaactgcaataacaaaaatggctccaaagcgtggtgttaaggcgccgtcggcggcgaagaagaatcaggagaaggtggcgaaccctttgtttgagaagcgacccaaacagtttggcattggaggtgcgttgcctcctaaaagggaccttactcggttcgtgaaatggccgaaagttgtccagattcagaggaggaaaaggatcctcaagatgagattgaaagttcctcctgcgttgaaccagttcaccaagaccctcgacaagaaccttgcatcaaatctgtttaagatgctgctcaagtacagaccagaggacaaagcatcaaagaaggagcgtctcttgaaaaaggctcaagctgaggctgaaggtaagtctgctgaggctaagaagccgattgtcgtgaaatatggtctcaaccatgtgacctaccttattgagcagaacaaagcacaattggttgttattgctcatgacgtggatccaatagagctggttgtgtggctaccagctttgtgcaggaagatggaaatcccctactgcattgtcaagggaaaatcacgtttgggatcgattgtccacaaaaaaactgcatccgtcttgtgcttgaccacagtcaagaatgaagataaactagagttcagcaggatcttggaggccattaaggccaacttcaatgataagtatgacgagtacaggaaaaagtggggaggtggaatcatgggttccaaatcccaggctaagagcaaggccaaagagaaggtccttgccaaggaagctgctcagagaatgacttaggagacagtattacatgtttgttttttctcttgaaagttgactttttgagctgttcctccaaattttttgtcaatgtgctcttattaattgcagaatttattttttcctaagtagaagtgtaaaactttgagttggggtgatacttgataggtaattttgcagtttgttggaactttaatattgccttgctattatagcctctcttgagctcatgcatgaagcatcttttgatcggtgtagaaaaaaaaaaaaaaagaacgccccgcaccctgcgtgataccaacctgcgttcttc

SEQ ID NO: 4238 - DNA, 1014 bp, Zingiber officinale
cacagccgtctttccaccctcgttctcgatctcgaggacagaagaaatggcgccgaaaagagctggaaatgcccccgtcccagcaaaaaagaaacgggagaatgttgtcaatcctttgtttgagaagcgcccgaagcaattcggcattggcggagcattgcctccgaagaaggatctgcgtcgttttgtcaaatggccaaaggttgtccggattcagaggcaaaaaaggattctaaaacagcggttgaaggttcctcctgctcttaatcagttcactcgaacattggacaagaaccttgcaacaaatctgttcaaattacttctcaagtacagacctgaagaccgagctgctaagagggaaaggctccttaagagggcacaggctgaggccgagggaaagactcttgaagttaagaaacccattgttgtgaagttcgggcttaatcatattacgtaccttattgagcagaacaaggcacagttggtggtcatagctcacgatgtggatccagttgagcttgtagtttggctaccagctttgtgcaggaaaatggagattccctactgtatcgtcaaaggaaaatcccgtttgggagcgattgtgcataagaaaactgcaactgcactatgtttgaccacagtgaagaacgaggacaaattggatttcagtaaaattctcgaagccatcaaggccaacttcaacgacaagtttgatgagatcaggaggaagtggggcggcggcataatgggttctaagtctcaagcaaaggccaaggccaaggagaaattgctcgcaaaggaaactgctcagaggatgacataggctttcaactgccatattttgacatgtagggttttacgttgagttcgtttgttagcctaacgcattggcaactgcattaggtgtcactgaagtgttcccatcattttcttcttaagggttctgtgaacttgactgctacatacgtgatgtcagtttttttagcattgttttctggtttgggatatttgttt

SEQ ID NO: 4239 - DNA, 1072 bp, Ipomoea nil
gtttagggacctagggtttacgcgatggctccgaagaaaggtgtaaagctttctgccgcggcggcaaagaagaagccggagaaggtggtgaacccgctattcgagaagcggccaaagcaatttggaatcggaggtgcattgccgccgaagaaggatcttaccagattcgtcaaatggccgcaagttgttcgcattcaaaggaagaggaggatcctcaagcaacgattgaaggtcccaccagcactcaaccagttttccaagacccttgataagaacctagcaacgaatctcttcaagatgcttctcaagtacaggcctgaggataaggctgctaagaaggaacgtcttttgaaaagggcccaggctgaaagtgagggaaagacccctgaactgaagaaacctattgttgttaagtatgggctcaagcatgtcacttacctcattgagcagaataaagcccaattggtggttattgctcatgatgtagacccaattgagctggttgtctggcttccagccttgtgcaggaagatggaaattccctactgcattgtaaagggaaaagcaagattgggttccattgtccacaagaagactgcatcagttttgtgcttgacctcagtgaagaatgaggataagttggagttctctaagattttggaggctattaaggcgaacttcaatgacaaatatgaggagaaccgcaaaaagtggggaggtggaatcatggggtctaaatcccaagctaggacaaaggccaaggaaaggcttcttcaaaaggaggcagctcagaggatgtcttaagattttatgatgatatttgctgttatccaggttttttgaacagatcaaagtagacttgattttgtgttgtgagcagaggttattgttgaattttattgcttttgacaaaaactaaatgtgccattttactgcatacaatcatctcaccctgatattcattgcattcactttgatgttttctgctggaattcctttcaccacgtgagctgcccagtttgtactacgcatctcaggaatggcattgtatgctttgagttttgagctagta

SEQ ID NO: 4240 - DNA, 2710 bp, Actinidia deliciosa
  misc_feature (1335)..(1335): n is a, c, g, or t
  misc_feature (1371)..(1372): n is a, c, g, or t
  misc_feature (1377)..(1377): n is a, c, g, or t
  misc_feature (1380)..(1380): n is a, c, g, or t
  misc_feature (1396)..(1396): n is a, c, g, or t
  misc_feature (1401)..(1401): n is a, c, g, or t
  misc_feature (1418)..(1419): n is a, c, g, or t
  misc_feature (1452)..(1452): n is a, c, g, or t
  misc_feature (1470)..(1470): n is a, c, g, or t
  misc_feature (1472)..(1472): n is a, c, g, or t
  misc_feature (1495)..(1496): n is a, c, g, or t
aattccgcacgagggggtagcggccccgtacgagttattgaaaaggcaaaaaggttcctcaaacctgagttgctgaaactcctggataatatatatgtgtttgagaagaggctttcaaataaacttattgctagggttaaattgagggacatggttagatcaataactgaacgaaaggttgtcgtatatccttccgaggaagcgttaaatctattgtctctcgagctgcctaacggagatggacatgtcctgaaccgatggctgtctgaaaatgtgctgccgatgctgtctaagatggtcatggatggtaagattgatgatcccactgccgtatacattgacacgctagtgggaatgaggaagctgtcattcagattggagtcaagtgaaaatcttgtggaagattggttgtctagaaagtataaaatgtccttgaggaaattgagggccatttacaggactgagagggaagtactcaatctgatccttaacttgaaatgcgtgtgttctaagttgatgcatggcttcacggatgggaggccagattttgatctggaatccgtggctgttaatgctggtattgcgacggaattgctagtagcactccagagatctctgaattcagtgcttgaggaccctaacgtgaaagctccgcagaggattgtaatctgccatcgccacaaaaaggcggtgaagaaacgggtacagaatctaagatgcggattgcaagatcgacttaaaggacagcatgaagctattgatgtgatagcagatgctgtattaaggtcaattgatgcaccatcaaacctgcaaaatgggccagctggtgcttatctcctcttaggtctcagcaatgctggtaaacaggaacttgctgatggtctttctaagcttctggtgactactgaaggggaaactccagtaatccaagttgacttatcaaaacagttggactcccaatcactgcaatttagtgctcctaagagccatgagaaatggtcgttgtcaatcctagaagccgtgaagaggtggccgtatagcgttctactgtttgacaaagttgagaaggctgatgcttctgtttttagcactctgctccgggttttagacactggcatgctgtcttgcagcgacgaatttatgattgactttagaaacactacaattgttctgatatcagatctggggaataaagatatcatttctagactttttggctgctcttacaaaggtagtggtaatgatgagggcacccaacagcaggaagataatcgctttaggtttgagttgcttaatcgcgtggatgaagttatttttttcaatcctgcctcgcanaaccagagggacatagctaggcttcctatgacggannagcanaanaagggtttgccaatgncagcnttctttcatctgttccnnaccagtcataatccaagactttacaagcttggnaaattcaatgcatttgangnagtggtgtctaaaatttccatgnngcttcggggtgtggataaaagtttgtgcccatcaaacggtctagtaccttttttacagggaacagtctaatacctccttagagggtgtcaagttcttttggtccttgggctgtcttaatgcgagctatgatgcggtctctaagctactgtctttcttgttttaccttttgctttctataactgcttaatgcagcttgtaagttttaaccatgggtaaaaactctttcctttgtatgcaaaaaaaaatcgccgtccgcaaaccctaatcgagccgaggagagagaaccaaatcctgcagaaatggctccgaagaaaggtgtcaaaccagttgtggccaagaagaaaccggagaaggtggtgaacccgttgttcgagaagcgtccgaagcagtttgggataggaggggcgttgccgcccaagaaagatttgcaccggtttgtgaagtggccgaaggtggtccaaattcagaggaagagaaggatcctcaaccagcgcttgaaggtcccaccacctctcaatcagtttaccaagacacttgacaaaaacctcgctaccagtctcttcaaaatgcttctcaagtacaggcctgaggacagagcagcaaaaaaggagcgactcttgaaaagggctcaggctgaggctgaagggaaacctgttgaggccaaaaagcctattgttgtgaaatatggactcaaccatgtcacctacctcattgagcagaacaaagcgcaactggttgttattgcccatgacgtggacccaatagagttggttgtctggcttcctgcactgtgtaggaagatggagattccatactgcattgtgaaaggaaaatctcgattgggaacgattgtccaccagaaaactgcggcagttttgtgcttgaccactgtcaagaatgaagacaagatggagttcagcaaaatcttggaggccatcaaggccaacttcaatgacaagtatgacgagtacaggaagaagtggggaggcggtatcatgggttccaaatcccaggccaaaaccaaggccaaagagagggttcttgcaaaggaagctgctcagagaatgagctaagagaatcatataggctgcttctaggctgaagctattaaggaccgtcttccatgctaaattttgtgtcaatgttttccagattaattggttagtttttgtttttgttgagggaacaatgtggtcgtgaatgtatgaattca

SEQ ID NO: 4241 - DNA, 1434 bp, Pinus pinaster
acttcagcattccccccttattcattgcacatctgggtggaattgctaattataattgtgttagtataaaattaatttaaccaacgataatctaaaaacactatcgttttcccattggtttccccaccatttatcgtgccctgacttaacccagggtcagagatttgaccctagactcagaagagtagttagtctagcggtggtaagggtttgtagaatcagggtttaggaggagggctgtgtaaaaggaacaaacagcttaatactttgctattgacatgcgcgtgtaaggaggtaccaggttagttagcagagtgaggcagagagaggaagcagatcgattccagcaatggctccgaagagaggggttaaggctccagctgctgcgaagaagaaggtcccgaaggttgttaatccattgtttgaaaagcggaccaagcagtttgggattgggggagctctgccaccaaagaaggatttgcacagattcgtgaaatggccgaaggtcgtacgcatccagaggcagcggagggtattgaagcagcgtttgaaggttcctccggccttaaaccagttcaccaagacccttgacaagaatctcgcttccaaccttttcaagatgcttttaaaatataggccggaagataaagctgcaaagaaggaaaggcttctgaaaaaggctcaggctgaggcagaagggaagactgttgaagtgaaaaagcctattgttgtgaaatatggaattaatcatgtaacataccttattgagcagagtaaagctcaattggtagtcgttgcacatgatgttgatccaattgagttggtagtgtggcttcctgcactttgtagaaaaatgaacattccttatgcaattgtcaaggggaaagcacgtcttggatcgattgtgcacaaaaaaacagcaacagccttgtgcttgacttctgtgaagaatgaggacaagatggaatttagcaagattgttgaggcagtaaaggctaacttcaatgacaagtttgatgagtatcggcgacaatggggaggtggcattatgggaaccaaatctcaggcaaaaacaaaggccaaggaaaaacttgtggccaaggaagcagcacagaggctcacttaagaataattcctcggaatatttttcccattttcaaatttttattggattgtcttttgcagtttgttgtaatttgatttacaggtatagtaacatatcaaagttttgtactaaggaattctctaagccaattttaactcaaggctcagaaaacatgtcaattttgcaactggataaattgttgagtaaacaatatttcatacacattcattggccttacgcattctctacaacattttgtatgctgtgatgatgatatcttcattttgtccttctgtatgttagtgttgttgatatttaatgctatatac

SEQ ID NO: 4242 - DNA, 1239 bp, Tropaeolum majus
gattatatttaaatcctaagcaacttcagctggagtctcttagggtttcaagtcggcgttagcaagaaccggagagggcacaggaagacgaaaatggaccccaagaaaggaggaaatctgttgcagtagcaaaaaagaaaacggataaggttgtaaatcctttatttgaaaagcggccaaaacagtttggtattggtggtgctttgcctccaaagaaggatttgcatagatttgttaaatggcccaaggcaatccgcattcaaaggcagagaaggatacttaagcagaggttgaaggtcccaccggcacttaaccaattcaccaagacactagataagaaccttgcaacaaacttgttcaaattgctccttaagtatagacctgaggacaaggctgcaaagaaagagcgtcttttaaataaggcccaagctgaggcagaagggaaaactgttgagaccaagaaacctatcgttgtgaaatatggacttaaccatgtgacctaccttattgagcagaacaaggcccaacttgtggttattgctcacgatgttgatcccattgagttggttgtttggttgcctgctttgtgtaggaagatggaaattccttactgcattgttaagggaaagtcccgtttgggagcgattgtgcacaaaaaaactgcctctgctctttgcttgactacagtaaagaacgaggacaagatggacttcagcaaaatcctagaagctatcaaggcaaacttcaacgacaagtatgatgaatacagaaagaaatggggaggtggcatcatgggttccaaatcacaggccaagaccaaggccaaagaaagagttcttgcaaaggaagctgcacaaaggatgaattaggacaatctttggtttctgatagtcctctttcttattctgatcagttaatcattattgacctgcttaatttactagcagaatatttacattttgagatctaaagttctccactcccctgtactctgggaattttgtagcttgcttaatttattgactcagatgtctttttcttatttaaagtaaaaactttttctttaatgctaagcctttagcttctagtgttagttcagctctcctttaaggccaagttgtaaaggctaagaattcatttttttatcaactctagctctttaaatgtttagattagggggttcttcgaaagaaagaatttgccaaacagaatgcctaatatagtagtgaagtatgataa

SEQ ID NO: 4243 - DNA, 833 bp, Citrus sinensis
tggttcgcaaacccagctactcaaaatggccccaaaacgaggcgtaaaagcactagtcgctgcatcgaagaggaaaacggagaaggtagtaaatccactgttcgagaagcggccgaagcagtttggaatcggaggtgcattgccaccaaagaaggacctgacccgctttgttagatggccgacacaagtcaacattcagaggaagaagaagattcttaaactcaggctcaaggtcccacctgctttgaaccaattcaccaagaccctcgacaagaacctcgcatcaaacttgttcaagatgcttctcaagtacaggcctgaggatagagcagcaaagaaggagagactgctgaaaaaggctcaggcagaggctgaaggaaaaacggttgagagtaagaaacccattgttgtaaaatatgggcttaaccatgtgacctatcttattgagcagaacaaggcacaattggtggttattgcccatgacgtggacccagtagagttggttgtctggctaccagccttgtgtaggaagatggagatcccatactgcattgtgaaggggaaagctcgcttgggagtgattgtccacaagaaaactgcatctgttttgtgcttgaccacagtcaagaatgaagataagatggagttcagcagaatcttagaggctatcaaggctaattttaatgataaatacgacgagcataggaaaaagtggggtggtggaattatgggttcaaaatcacaagccaagaccaaggctaaagaaaagctccttgctaaggaagctgcccagagaatgtcttaagagccaatcttttgcaattttgttaatc

SEQ ID NO: 4244 - DNA, 1191 bp, Pinus taeda
gaaggactgtgtaaaatgaacaaacagcttgagtattttgttattgacgtgcgcgtggaaggaggtaccaggccagttagcagggtgaggcagagagacggagcatatcgattccagcaatggctccgaagagaggggttaaggctccagctgctgcgaagaagaaggtcccgaaggttgttaatccattgtttgaaaagcggcccaagcagtttgggattgggggagctctgccgccaaagaaggatttgcacagattcgtgaaatggccgaagatcgtacgcatccagaggcagcggagggtattgaagcagcgtttgaaggttcctccggccttaaaccagttcaccaagacccttgacaagaatctcgctgccaaccttttcaagatgcttctaaaatataggccagaagataaagctgcaaagaaggaaaggcttctgaaaaaagctcaggctgaggcagaagggaagactgttgaagtgaagaagcctattgttgtgaaatatggaattaatcatgtaacttaccttattgagcagagtaaagctcaattggtagtcattgcacatgatgttgatccaattgagttgattgtgtggcttcctgcactttgtagaaaaatgaacatcccttatgcaattgtcaaggggaaagcacgtcttggagcgatcgtgcacaaaaaaacagcaacagccttgtgcttgacttctgtgaagaacgaggacaagatggaatttagcaagattgtcgaggcagtaaaggctaacttcaatgacaagtttgatgagtatcggcgacaatggggaggtggcattatgggaaccaaatcgcaagcaaaaacaaaggccaaggaaaaacttgtggccaaggaagcagcacagaggctcacttaagaataattcctcggaatattttttccattttgaaatttttattggattgttttttgcagtttgttgtaatttgatttacaggtatagtaacatatcaaaatttgtactaaggaattctctaagccaattttaactcgaggctcagaaaacatgtcaattttgcaactggataaattgttgagtaaacaatatttcatacacattcattggccttacgcattctctacaacgttttgtatgctgtgatgatgatatcttcattttgtctttctgtatgttagtgttgttgatattt

SEQ ID NO: 4245 - DNA, 1307 bp, Pinus taeda
catgcgcgtgtaaggaggtaccaggttagttagcagagtgaggcagagagaggaagcagatcgattccagcaatggctccgaagagaggggttaaggctccggctgctgcgaagaagaaggtcccgaaggttgttaatccattgtttgaaaagcggaccaagcagtttgggattgggggagctctgccaccaaagaaggatttgcacagattcgtgaaatggccgaaggttgtacgcatccagaggcagcggagggtattgaagcagcgtttgaaggttcctccggccttaaaccagttcaccaagacccttgacaagaatctcgctgccaaccttttcaagatgcttctaaaatataggccggaagataaagctgcaaagaaggaaaggcttctgaaaaaggctcaggctgaggcagaagggaagactgttgaagtgaagaagcctattgttgtgaaatatggaattaatcatgtaacataccttattgagcagagtaaagctcaattggtagtcgttgcacatgatgttgatccaattgagttggtagtgtggcttcctgcactttgtagaaaaatgaacattccttatgcaattgtcaaggggaaagcacgtcttggatcgattgtgcacaaaaaaacagcaacagccttgtgcttgacttctgtgaagaatgaggacaagatggaatttagcaagattgtcgaggcagtaaaggctaacttcaatgacaagtttgatgagtatcggcgacaatggggaggtggcattatgggaaccaaatctcaggcaaaaacaaaggccaaggaaaaacttgtggccaaggaagcagcacagaggctgacttaagaataattcctcggatatttttttccatttggacttttttattggattgtcttttgcagagttcgttgtaatttgatttataggtatagtaatgtgtcagtttatactaatgaattctttaagccaattttagcttaaggctcagaaaacatgtcaattttgcaactggataaattgttgagtaaacagtattttgtacacattcattggccatatgcattttctctacaactttttgtatgctgtgatgatgatatcttcattttgcccttctgtatgttagtgccattgatatttatcttaagcatgtacagtgtttaaatgtgcatgtagctatctattttgggtttgtgtgccttattttgaagtgctaagaactatatactcaatcttgtagcatggctttatatgaactttcatatattttactatttacactacggggtaaaagtatctcc

SEQ ID NO: 4246 - DNA, 1011 bp, Papaver somniferum
agcgctcccttctacttcagaaccagctccaacctacagcagcaatggctccaaagaaaggtgttaaaactccagtagcagcaaagaagaagagtgagaaggttgtaaaccctttgtttgagaggcgaccaaagcaatttggaattggtggtgcattaccccccaagaaggatttgcataggtttgtcaaatggcccaaggttgttcgtattcaacgtcaaaggaggattttgaagcaaaggttgaaggttccaccagctttgaaccagttcacaaagaccctagacaagaacctagcaacaaatctattcaagatgttgcttaaatacagacctgaagacaaggctgccaagaaggaaaggcttttgaaaagggcacaggctgagtctgagggaaagaccgttgaggcaaagaagcccattgttgtcaaatacggacttaaccacataacctacctcattgaacagaacaaggcccaaatggtggttattgcccatgatgtcgacccaattgagcttgttgtgtggctgcctgctttgtgccgtaaaatggagatcccttatgctattgtgaagggcaaggcccgccttggagcgatcgtccacaagaaaactgcctcagcattgtgcttgacctcagttaagaatgaagataagatggactttagcaagattgttgaggcaattaaggccaacttcaatgacaagtttgatgagcacagaaagaaatggggaggtggtattatgggatcaaagtcgcaagcaaaaaccaaagcaaaggagagagtgttggccaaggagcaagctcaacgtaacaactaagttgtctggttcttgtagttctaaacattttcttacaaccctctgtagttctgtagcctgatctagagaagagaagcattttgtcacaaacacttgtagttttgagattttattttactattctgtcttttggaaagaccagaaaccggatttatatatgctggatttatctagatgtttatttctcata

SEQ ID NO: 4247 - DNA, 1032 bp, Primula obconica
tagctccacagtgagtgtgtttttagggttttcgccgccgtatcgcaagagagagaacacacacccatctctcccaaatggccccgaagaaaggtattaagccagctgcagctgctaagaagaagcaggttaaggttgtgaacccgttgtttgagaaacgttcgaagcaatttgggatcggtggtgcattgcctccgaagaaggatcttcaccgttttgtgaaatggccaaaggttgttcagatccaacggaagaggaggatcctcaaccagcgtttgaaggtcccaccaccattgaaccaatttaccaagactctcgacaagaacctcgcgacaagtctgtttaagatgcttctcaagtacaggccagaggatagagctgccaagaaggagcgtcttctgaaaagggcccaagccgaagctgagggaaagactgttgaggctaaaaagcctattgtggtgaaatatggtcttaaccatgttacttaccttattgagcagaacaaagcccaactagtggttatcgctcatgatgtggacccaattgagctggttgtgtggcttcctgcattgtgcaggaagatggagatcccatactgcattgtgaaaggcaaagctcgtcttggaactattgttcaccagaaaaccgcctctgttctgtgcctgaccactgtcaagaacgaagacaagatggatttcagcaaaatccttgaagctatcaaggccaacttcaatgacaagtatgatgagtacaggaagaaatggggtggtggtattatgggttccaagtctcaagcaaaaacaaaggccaaggaaagggttcttgctaaggaagctgctcagaggatgaactaaaaagagagcttgttattttgttaaaagataatagcatcccgtccgattctcgagtttttgttaccgcctttctatcagtttctttctaggttaagtgctgaacttgttttttgttgtgtatttgtttttatcaaaacgcagtgttggttgacgtttggatttgaaatcatatattcta

SEQ ID NO: 4248 - DNA, 1202 bp, Prunus mume
ccactcgtgagctccagcttagtttagggtttcattcgccgttccagaaaccccaaggccactgaagatcttgaccacccgaaaatggctcccaaaagaggtgtaaaaccggccgctgcagcaaagaagaaaactgagaaggttgtgaacccattatttgaaaagcgtacaaagcagtttgggatcggcggtgctttgcctccaaagagagatttgcaccgatttgtgaaatggcccaaggttgtccgtatccaaaggaagaagaggatccttaagcaacgcttgaaggtcccaccagcacttaaccagttcaccaagactttggacaagaaccttgctacaagtctcttcaagttgttgctcaagtacaggcctgaagacaaagcagcaaagaaggaacgtctgctgaaaagagctcaagctgaaactgaagggaaaaccgttgaggcaaagaagccaattgttgtgaaatatggactcaaccacgtaacctacctgattgagcagaataaggctcagctagttgttattgctcatgatgtggaccccatcgagttggttgtatggcttccagccttgtgcaggaagatggagatcccatactgcattgtgaaggggaaatcacgcttgggagcgattctccacaagaaaacagcggctgcactttgcttgaccactgttaagaatgaggataagttggagttcagcaagattctggaggctatcaaggccaacttcaacgacaagtacgatgagtacagaaagaagtggggaggtggtatcatgggctcgaaatcacaggccaggaccaaggcgaaggagaagctcttagcaaaggaagccgcacagaggctgaactaggaagtatcttccagagagaggagagggtgttggtcattttcttctgttttttctggttctttgaagactagcctgtcccccctattatcacttacaaatcaacttgagcttttatatcactctggttagagtgtggatatggtttttgatagaacatctgtagcatctacatttctcttcatctattttcatccaaaccagttctcctttaatatgttcctttcttcaaccatggttgcataatttgtctggttttataaaatagtaactgttgttttttgctttcatatgaatgctattacgagcctgaaaggaaaatcatccgcatctctctccttgaa

SEQ ID NO: 4249 - DNA, 1176 bp, Prunus persica
gtgagctccagcttagtttagggtttcattcgccgttccagaaaccccaaggccactgaagatcttgaccacccgaaaatggctcccaaaagaggtgtaaaaccagctgctgcagcgaagaagaaaactgagaaggttgtgaacccactatttgaaaagcgtacaaagcagtttgggatcggcggtgctttgcctccaaagagagatttgcaccgatttgtgaaatggcccaaggttgtccgtatccagaggaagaagcggatcctcaagcaacgtttgaaggtcccaccagcacttaaccagttcaccaagactctggacaagaaccttgctacaagtctcttcaagttgctgctcaagtacaggcctgaagacaaagcagcaaagaaggagcgtctgctgaaaagagctcaagctgaaactgaaggaaaaactgttgaggcaaagaagccaattgttgtgaaatatggactcaaccacgtaacctacctgattgagcagaataaggctcagctagttgttattgctcatgatgtggaccccatcgagttggttgtatggcttccagccttgtgcaggaagatggagatcccatactgcattgtgaaggggaaatcacgcttgggagcgattctccacaagaaaacagcggctgcactttgcttgaccactgttaagaatgaggataagttggagttcagcaagattctggaggctatcaaggccaacttcaacgacaagtacgatgagtacagaaagaagtggggaggtggtatcatgggctcgaaatcacaggccaggaccaaggcgaaggagaagctcttagcaaaggaagccgcacagaggctcaactaggaagtatcttccagagagaggagagtgtgttggtcattttcttctgttttttctggttctttgaagactagtctgtccccctattatcacttacaaatcaacttgcgcttttatatcactctggttagagtgtggatatggtttttgatagaacatctgtagcatctacatttctcttcatctattttcatccaaaccagttatcctttactgtgttccattcttcaaccatggttgcataatttgtctggttttatcaaatagttactgttgtttttgcgttcatatgaatgctattacgagcctgaaggattctcatcc

SEQ ID NO: 4250 - DNA, 1133 bp, Sciadopitys verticillata
gccgaggtagggtctgttgtttaggaggtagcgaagggagagtagtgcgagagcatcgattgacaattaaaatcaataatggctccaaagagaggggtaaaggctccggctggtgcaaagaaaaaggcacccaaggttgtgaaccctttatttgagaaacgccccaaacagtttggtattggaggagcattgccgccaaagaaagacttgcacaggttcgtgaaatggcccaagatcatacgtatccagaggcagcgcaggattctcaagcagcgtttgaaggtgccccctgcattgaaccagttcacgaaaactctggacaagaatctcgcatcaaacctgttcaagatgcttctgaaatacaggccagaagacaaggctgcaaagaaggagaggctcttgaagagggctcaggctgaggcagaagggaaagctattgaagtcaagaagcctatagttgtaaaatatggtatcaatcatgtaacttaccttattgagcagagtaaagcgcagttggtggttattgctcatgatgttgatcctatagagctcgtcgtatggcttcctgcactttgtaggaaaatgaatattccttattgcattgtcaaggggaaagcacgacttggaacaattgtccacaagaaaactgccactgctttatgcttgacatctgtgaaaaatgaagacaagatggagtttagcaggattgttgaggcagtaaaggcaaatttcaatgataagtttgatgagtatcgacgacaatggggaggtggtgttatgggctccaaatcgcaggcaaaaacaaaggccagagaaaaactgatggccaaggaagcggcacaaaggctgacataagatttttcttttttatgaatgcttcctgtctcaaagagtttatggtcatctgtttcaaatttgtttagctgtaggtctagatatttatggtatattgagatttgaatttcatggaaagcagagaagcaattttgcaactgggtagagtattagggatttttcattttatctgcagctcatgactagtgtacttcattcaattttgtctgcatgagtattattcaaatatattcctttgttgtaatgttttggccttcttgatccagataatagttttc

SEQ ID NO: 4251 - DNA, 886 bp, Sequoia sempervirens
ggatccattataccagaagcggcggagctgctacagccaaccagagttttgagatcgagaggctttcaactaattataatggctccaaagagaggggtgaaacccccagtagctgccaagaagaaggtggccaaggtggtcaaccctttgtttgagaagcggccgaagcagtttgggattgggggagcgttgccgcccaagaaggatctgcaccgatttgtaaaatggccaaagataatccgcatccaacgccagcgccgcattctcaagcagcgcctcaaggtcccccctgctctcaaccagttcacgaaaacccttgacaagaatcttgcatcaaacctgttcaagatgctcctaaaatacaggccagaggacaaagctgctaaaaaggagaggcttttgaaaaaggcacaggcagaggcagaaggaaaacctattgaagtcaagaagcctattgttgtgaaatatggtatcaatcatgtaacttatcttattgaacagagtaaagctcagttggtggttattgcacatgatgttgatcctatagagcttgtagtgtggcttcctgcactttgtaggaaaatgaatgttccttactgcattgtcaagggaaaagcacgacttggaactattgtgcacaagaaaactgccactgcactatgcttgacatctgtgaagaatgaagacaaaatggaatttagcaggattgttgaggcaataaaggctaacttcaatgataagtttgatgagtaccgacgacaatggggtggtggcattatgggcaccaagtctcaggcaaaaacaaaggccagggaaaaactcttggccaaagaagcagcacaaaggttgacttaagattctcattttgaattgtttatgatcatct

SEQ ID NO: 4252 - DNA, 1015 bp, Sequoia sempervirens
caggcgagaagaagaaggcgtggaggagcgacattgcaacgaataatggctccaaagagaggggtgaagcccgcggcacctgcgaagaagaaggtggccaaggtggtcaatcctttgtttgagaagcgcccgaagcagtttgggatcggaggagcgctgccgcccaagaaggatctgcaccgcttcgtcaaatggcccaagattatccgcatccaacgccagcgacgcattctcaaacagcgtctcaaggtccccccagctcttaaccagttcaccaaaaccctcgacaagaatctcgcatcaaacctgtttaagatgcttctgaaatacaggccagaagacaaagctgcaaaaaaggaaaggcttttgaagaaggcacagtcagaggccgaaggaaagcccattgaagtcaagaaacccattgttgtgaaatatggtatcaatcatgtaacctaccttattgaacagagtaaagctcaattggttgtaattgcacatgatgttgatcccatagagcttgtagtgtggctccctgcactttgtaggaaaatgaacattccttactgcattgtcaagggaaaagcacgacttggaactattgtacacaagaagactgccactgctctatgcttgacatctgtgaagaatgaagacaagatggaatttagcaggattgttgaggcaataaaggccaatttcaatgataagtttgatgagtaccgacgacaatggggaggtggcattatgggctccaagtctcaggcaaaatcaaaggctagggaaaaactcttggccaaggaggcagcacaaaggatgacttaggattctgattttgaatagtttatgaacatctataccaaatttgtttggaggggtaaaaagttatgaattttaagtttacttgtagctttccttaatgtggttttgtttgatggccactgtatctcattaaattttctttgtacggatgagtataaatttaattttccctttttatgattaatatagagataat

SEQ ID NO: 4253 - DNA, 862 bp, Picea glauca
tggaaggaggtcgcaggtcagctagcaaagcgaagtatagcgagggagcagatcgattctagcaatggctccgaagagagggttaaggctccggctgcagctaagaagaaggtcccaaaggttgttaatccattgtttgagaaacggcaaaacagtttgggattggtggagctctgccgccaaagaaggatttgcacaggtttgtgaaatggccgaaggttgttcgcatccagaggcagcggagggtattgaagcaacgtttgaaggtccctccggccttgaaccagttcaccaagacccttgacaagaatctcgctgccaaccttttcaagatgcttctaaaatataggccagaagataaagctgcaaagaaggaaaggcttctgaagaaagctcaggctgaggcagaaggaaagactgttgaagtgaagaagcctattgttgtaaaatatgggatcaatcatgtaacttaccttattgagcagagtaaagctcaactggtagttattgcacatgatgttgatccaatagagttggtagtgtggcttccggcactttgtagaaaaatgaacatcccttatgcaattgtcaaggggaaagcacgccttggagcgattgtgcacaaaaagacagcaactgccttgtgcttgacttctgtgaagaatgaggacaagatggaatttagcaagattgttgaggcagtaaaggctaacttcaacgacaagtttgatgagtatcgtcgacaatggggaggtggcattatgggaaccaaatctcaggccaaaacaaaggccaaggaaaaacttgtggccaaggaagcggcacagaggctcacttaagaataattccttggaatatattt

SEQ ID NO: 4254 - DNA, 1293 bp, Picea glauca
gcacgaggggtcaattgacaactttatcgtgtggtaagagttaacccagggtcagagtgttgaccctggagtcagaagggcagttactctagcggggttaagggtttgtagaattagggtttaggagcagggctttgtgtaaagaataaacggcttcagcagtttgttattgccgtgcgcgtggaaggaggtcgcaggtcagctagcaaagcgaagtatagcgagggagcagatcgattctagcaatggctccgaagagaggggttaaggctccggctgcagctaagaagaaggtcccaaaggttgttaatccattgtttgagaaacggcaaaaacagtttgggattggtggagctctgccgccaaagaaggatttgcacaggtttgtgaaatggccgaaggttgttcgcatccagaggcagcggagggtattgaagcaacgtttgaaggtccctccggccttgaaccagttcaccaagacccttgacaagaatctcgctgccaaccttttcaagatgcttctaaaatataggccagaagataaagctgcaaagaaggaaaggcttctgaagaaagctcaggctgaggcagaaggaaagactgttgaagtgaagaagcctattgttgtgaaatatgggatcaatcatgtaacttaccttattgagcagagtaaagctcaactggtagttattgcacatgatgttgatccaatagagttggtagtgtggcttccggcactttgtagaaaaatgaacatcccttatgcaattgtcaaggggaaagcacgccttggagcgattgtgcacaaaaagacagcaactgccttgtgcttgacttctgtgaagaatgaggacaagatggaatttagcaagattgttgaggcagtaaaggctaacttcaacgacaagtttgatgagtatcgtcgacaatggggaggtggcattatgggaaccaaatctcaggccaaaacaaaggccaaggaaaaacttgtggccaaggaagcggcacagaggctcacttaagaataattccttggaatatattttttacgttgaaattttattggattgttttttgcaatttgttgtaatttggtttctaggtatagtaaacatgtcagagtttataccaaggaattttaaatctaactgtagcttagacctcagaaaacagcaggtcaattttgcaactcagtaaattgttgagtaaacaatatttcgtacacattcattggccttgtgtactctacaactttttgtatgctgtgatgatgatattttcattttttccttt

SEQ ID NO: 4255 - DNA, 1407 bp, Picea glauca
ggcttcagcagtttgttattgccgtgcgcgtggaaggaggtcgcaggtcagctagcaaagcgaagtatagcgagggagcagatcgattctagcaatggctccgaagagaggggttaaggctccggctgcagctaagaagaaggtcccaaaggttgttaatccattgtttgagaaacggcaaaaacagtttgggattggtggagctctgccgccaaagaaggatttgcacaggtttgtgaaatggccgaaggttgttcgcatccagaggcagcggagggtattgaagcaacgtttgaaggtccctccggccttgaaccagttcaccaagacccttgacaagaatctcgctgccaaccttttcaagatgcttctaaaatataggccagaagataaagctgcaaagaaggaaaggcttctgaagaaagctcaggctgaggcagaaggaaagactgttgaagtgaagaagcctattgttgtaaaatatgggatcaatcatgtaacttaccttattgagcagagtaaagctcaactggtagttattgcacatgatgttgatccaatagagttggtagtgtggcttccggcactttgtagaaaaatgaacatcccttatgcaattgtcaaggggaaagcacgccttggagcgattgtgcacaaaaagacagcaactgccttgtgcttgacttctgtgaagaatgaggacaagatggaatttagcaagattgttgaggcagtaaaggctaacttcaacgacaagtttgatgagtatcgtcgacaatggggaggtggcattatgggaaccaaatctcaggccaaaacaaaggccaaggaaaaacttgtggccaaggaagcggcacagaggctcacttaagaataattccttggaatatattttttacgttgaaattttattggattgttttttgcaatttgttgtaatttggtttctaggtatagtaaacatgtcagagtttataccaaggaattttaaatctaactgtagcttagacctcagaaaacagcaggtcaattttgcaactcagtaaattgttgagtaaacaatatttcgtacacattcattggccttgtgtactctacaactttttgtatgctgtgatgatgatattttcattttttccttttgtatgctattgttgttgatatttattgccaaatactttcaagcgtgtgtagtgtttatatgtgcacatagctatctaatttggtttgcgtgccttctcttgaagtcctgagtaagtatatactcagacttgtaccatgactttatatgaactttcctatattttgctagaaaaaaaaaaaaaaaagtaaaactctgcgttgtataaccaacctagtcttcttgagactcgccaacggacgaccaacaacggggaaggtaaggta

SEQ ID NO: 4256 - DNA, 1234 bp, Picea glauca
ggagggtttaggagcagggctttgtgtaaagaataaacggcttcagcagtttgttattgccgtgcgcgtggaaggaggtcgcaggtcagctagcaaagcgaagtatagcgagggagcagatcgattatagcaatggctccgaagagaggggttaaggctccggctgcagctaagaagaaggtcccgaaggttgttaatccattgtttgagaaacggcaaaaacagtttgggattggtggagctctgccgcccaagaaggatttgcacaggtttgtgaaatggccgaaggttgttcgcatccagaggcagcggagggtattgaagcagcgtttgaaggtccctccggccttgaaccagttcaccaagacccttgacaagaatctcgctgccaaccttttcaagatgcttctaaaatataggccagaagataaagctgcaaagaaggaaaggcttctgaagaaagctcaggccgaggcagaaggaaagactgttgaagtgaagaagcctattgttgtgaaatatgggatcaatcatgtaacttaccttattgagcagagtaaagctcaactggtagttattgcacatgatgttgatccaatagagttggtagtgtggcttccggcactttgtagaaaaatgaacatcccttatgcaattgtcaaggggaaagcacgccttggagcgattgtgcacaaaaagacagcaactgccttgtgcttgacttctgtgaagaatgaggacaagatggaatttagcaagattgttgaggcagtaaaggctaacttcaacgacaagtttgatgagtatcgtcgacaatggggaggtggcattatgggaaccaaatctcaggccaaaacaaaggccaaggaaaaacttgtggccaaggaagcggcacagaggctcacttaagaataattccttggaatatattttttacgttgaaattttattggattgttttttgcaatttgttgtaatttggtttctaggtatagtaaacatgtcagagtttataccaaggaattttaaatctaactgtagcttagacctcagaaaacagcaggtcaattttgcaactcagtaaattgttgagtaaacaatatttcgtacacattcattggccttgtgtactctacaactttttgtatgctgtgatgatgatattttcattttatccttttgtatgctattgttgttgattatttattgccaaattactttcaagcgtagtaaa

SEQ ID NO: 4257 - DNA, 1118 bp, Picea glauca
ttcagcagtttgttattgccgtgcgcgtggaaggaggtcgcaggtcagctagcaaagcgaagtatagcgagggagcagatcgattctagcaatggctccgaagagaggggttaaggctccggctgcagctaagaagaaggtcccaaaggttgttaatccattgtttgagaaacggcaaaaacagtttgggattggtggagctctgccgccaaagaaggatttgcacaggtttgtgaaatggccgaaggttgttcgcatccagaggcagcggagggtattgaagcaacgtttgaaggtccctccggccttgaaccagttcaccaagacccttgacaagaatctcgctgccaaccttttcaagatgcttctaaaatataggccagaagataaagctgcaaagaaggaaaggcttctgaagaaagctcaggctgaggcagaaggaaagactgttgaagtgaagaagcctattgttgtaaaatatgggatcaatcatgtaacttaccttattgagcagagtaaagctcaactggtagttattgcacatgatgttgatccaatagagttggtagtgtggcttccggcactttgtagaaaaatgaacatcccttatgcaattgtcaaggggaaagcacgccttggagcgattgtgcacaaaaagacagcaactgccttgtgcttgacttctgtgaagaatgaggacaagatggaatttagcaagattgttgaggcagtaaaggctaacttcaacgacaagtttgatgagtatcgtcgacaatggggaggtggcattatgggaaccaaatctcaggccaaaacaaaggccaaggaaaaacttgtggccaaggaagcggcacagaggctcacttaagaataattccttggaatatattttttatgttgaaattttattggattgttttttgcaatttgttgtaatttggtttctaggtatagtaaacatgtcagagtttataccaaggaattttaaatctaactgtagcttagacctcagaaaacagcaggtcaattttgcaactcagtaaattgttgagtaaacaatatttcgtacacattcattggccttgtgtactctacaactttttgtatgctgtgatgat

SEQ ID NO: 4258 - DNA, 984 bp, Picea glauca
attgccgtgcgcgtggaaggaggtcgcaggtcagctagcaaagcgaagtatagcgagggagcagatcgattctagcaatggctccgaagagaggggttaaggctccggctgcagctaagaagaaggtcccaaaggttgttaatccattgtttgagaaacggcaaaaacagtttgggattggtggagctctgccgccaaagaaggatttgcacaggtttgtgaaatggccgaaggttgttcgcatccagaggcagcggagggtattgaagcaacgtttgaaggtccctccggccttgaaccagttcaccaagacccttgacaagaatctcgctgccaaccttttcaagatgcttctaaaatataggccagaagacaaagctgcaaaaaaggaaaggcttctgaagaaagctcaggctgaggcagaaggaaaaactgttgaagtaaagaagcctattgtcgtgaaatatgggattaatcatgtaacttaccttattgagcagagtaaagctcagttggtagttattgcacatgatgttgatccaatagagctggtggtgtggcttcctgcactttgtagaaaaatgaacatcccatatgcaattgtcaaagggaaagcacgtcttggtgccattgtgcacaagaaaacagcaactgctttgtgtttgacttctgtgaagaacgaggacaagatggaattcagcaagattgtcgaggcaataaagggcaacttcaacgacaagtttgacgagtatcggcgccaatggggaggtggcatcatgggcacaaaatctcaggcaaaaacaaggccaaggaaaaagtcttggcaaaggaagcagcacaaaggctcacataggaataatattatggaagatttttcccatcttgaagagtttattgcagtattttttggaatatgttgtgaatttgatttagaggtgtagaaaatattggattttatgctgagaaaattttaaagctaacttt

SEQ ID NO: 4259 - DNA, 1101 bp, Juglans hindsii x Juglans regia
  misc_feature (52)..(52): n is a, c, g, or t
  misc_feature (64)..(64): n is a, c, g, or t
  misc_feature (98)..(98): n is a, c, g, or t
  misc_feature (161)..(161): n is a, c, g, or t
  misc_feature (520)..(520): n is a, c, g, or t
  misc_feature (526)..(527): n is a, c, g, or t
  misc_feature (529)..(529): n is a, c, g, or t
  misc_feature (566)..(566): n is a, c, g, or t
ggttcgcagactgcagaggtaaaccagcagggcttccaatctcgcagccgcncaaatggctccnaagagaggtggcaaggcaccggtagcagcagctnagaaaaagacggagaaggtgactaacccactgttcgagaagcgtccgaagcagtttggaatcngaggggcgttgccaccgaagagggatctgacccggttcgtgaaatggcccaagaccgttcagatccaaaggaagaagaggatcctcaggcagaggctcaaggccccaccagctctcaaccagttcaccaagaccctcgacaagaacctagcaacaaacctgttcaagatgcttctcaagtacaggcctgaggacaaggcagcaaagaaggaacgtctcttgaaaagagctcaggcagaggctgaaggaaaacctgttgaagcaaagaagcctatcgtggtcaaatatggcctcaaccatgtcacatacctcattgagcagaacaaggcacaattggtggttattgcccatgatgtgganccaatnnanttggttgtctggcttccagcattgtgcaggaagatgnaaatcccatactgcattgtaaaagggaaagcgcgtttgggagcggttgtccacaagaaaactgcatcagttttgtgcttgaccacggtgaagaatgaagataagttggagtttagcaagatcttagaagcaatcaaggccaacttcaatgacaagtacgatgagtacaggaaaaagtggggtggtggaatcatgggttccaaatctcaggctaaaactaaggccaaagagagacttcttgcaaaggaagctgctcagagaatgtcttaggagccatgactgcgtgtgtcttgttacctagacatgattatccaaggctgttgttttttagatttttgtttgctcaaatttattcccttcgactgcagaggttttctttatttagcagcagcttttataaattaagcaagagtttgtgtttgtgttttgacttgagctgccatgcttttatatagctttggcgttggacattaatgcgtaatgccttcttcttggtacaagcagcaacctaaacgccataatataatttttcttgg

SEQ ID NO: 4260 - DNA, 859 bp, Persea americana
gaactctctcttcttcagaggtttttagggtttttctgcggcgccgttctccagacttcttctgccctagaaatggcccccaaaagaggaggaaaagcgccagtgcccgcaaagaagaaaccggagaagattgtgaatccattgtttgagaagcgcccgaagcagtttgggataggaggggcattgcctccaaaaagggacttgcatcggtttgttaaatggccgaaggttgtccgtattcaaaggcagaggaggattctcaagcagcggttgaaggttccaccagctttgaaccagttcaccaaaacactggacaagaaccttgcaacgaacctctttaagatgcttctgaagtacagacctgaggataaagctgcaaagaaggaacgccttctcaagagggctcaggctgaaactgaagggaagacagttgaggtcaagaagcctattgttgtcaagtatgggctcaatcatgttacataccttattgagcagaacaaggcacaattggttgtcattgctcatgatgtggacccaattgaacttgtggtctggttgcctgccttgtgccgcaagatggagattccttactgtatcgtgaaaggaaaagcacgtttgggagcgattgttcacaagaaaactgcagcagttttgtgtctgaccactgtgaaaaatgaggacaagctggaattcagcaaaatcttagaagctatcaaggctaactttaatgacaagtacgaggagtaccgaaagaagtggggaggtgggataatgggctccaagtcgcaagccaaatccaaggccaaggagaaggactaaccacagaaggaagcttcccagaggatgaactaggctttat

SEQ ID NO: 4261 - DNA, 1035 bp, Hevea brasiliensis
cccccgggctgcaggaattcggcacgagcgagctgcatctagggttttcatctgcacatctctacacccacatggctcccaaaagaggtgttaaggccccagtactttcaaagaagaaacctgaaaaggttgtcaatcctttgttcgagaagagacccaaacagtttgggataggtggtgcattgcctccaaagaaggacttgactagatttgtcaagtggcctcatgttgttcgtattcagaggcaaaggaggattctgaagcaacgtctgaaagttcctcctgctgttaaccagttcacaaaaacacttgacaagaaccttgccacacaactcttcaagttgtcgcttaaatatagacccgaggataaggcagctaagaaggaaaggcttcttaaaagagcacaagcagaagcagaggggaaaactgttgaatcaaagaaacccattgttgttaaatatgggcttaaccatgttacttacctcattgagcagaacaaggcccaattagtggttattgcacatgatgttgatcccattgagcttgttgtttggttgcctgccttgtgccggaaaatggaggtcccttatgctatcgtgaagggcaagtcacgccttggagctattgttcacaagaaaacagctgcagctttgtgccttacatcagtgaagaatgaagataaattggaatttagcaaaatcttggaggcagttaaggcaaacttcaatgacaagtttgacgagcaccgcaagagatggggtggtggcatcatgggatccaaatctcaggcaaagaccaaagctaaggagaaactcttagcgaaggaggctgcacagaggatgtcttgagcttctaggtagtagcggagagttataatcaggaaggaatttgtcatgatgaattttggatgtcattttgattctgtctttgttttcttggactaattttgcattgacgttgtggttcagatatttgacattttctcttagatttatggtgggagaacgaatctatactctacaaatgaatttcttg

SEQ ID NO: 4262 - DNA, 1213 bp, Fagus grandifolia
taaaatcccattgttctccacttcctctacccccttgcagccgccaagcctggtattagggttttttcatcactctcctcacaaaatgggccctaagaaaggtggaaaagtggcagcggcacctgctaagaagaagcctgagaaggttttgaacccgttatttgagaagcgtccaaagcagtttggcattggtggtgctttgcctccaaagagagatctgcaccgatttgtaaaatggccaaaggttgtccgtatccagaggaagaagaggatccttaagcagcgtttgaaggtcccaccagcattgaaccagttcactaagaccctggacaaaaatcttgcaacaaatttgttcaagttgcttcttaagtacagaccggaggacaaactagaaaagaagatgcgccttgtgaagagggctgaagctgaggctgaaggaaaaactgttgaagctaagaagcccattgttgtgaaatatggactcaaccatgttacctacctgatcgagcagaacaaggcccagttggtagttattgctcatgatgtggacccaatagagttagttgtatggcttcctgccttgtgcaggaagatggagatcccttactgcattgtgaaggggaagtcacgtcttggagcgattgtccacaagaaaacagcttctgtcttgtgtttgaccactgtcaagaatgaggacaagttggagttcagcaaaatcctggaggcaatcaaggctaactttaatgacaagtatgacgagtacagaaagaagtggggaggtgggatcatgggatccaaatcacaggccaaaaccaaggcgaaggaaagactcctagcaaaggaagctgctcagaggatgtcttaagagtattgtccatcctttgggacttgctcttccattgtgttcttttttctttttctttttctttttggtcttattagttgaatttttatttaattttagtttcatgatcaactttgaattgagtcactctctctggtcttgggagtgtgatgtggtttttgatagaacttccaatactccaattagctttttttttattattatatataaagtattgttcttttttgttttgttttgttttgtaattgtaattaaattattcctttatcttctattgtaattttgtgtagtctactataatgtatctagtggttattggttttattttatcttactgtagtgtttacg

SEQ ID NO: 4263 - DNA, 1303 bp, Glycine max
aacttgaggtacagggggtaacagcccatggatcaatcccagtgcaacatagatgggcctggcccaaacctgacccggcaacccaatcttttaaattgagttcccaatgccttcttagtccttagggttagattcgttgttgttgttctaaaacgtccacacattctccgtcgccacaacaacaatggctccgaagaaaggtgtgaaaggttccgttgtagcagcgaagaagaaggttcaggagaaggtgacgaatcctttgttcgagaagcgtccgaagcagttcgggatcggaggcgcgctgccgccgaagcgggacctgacgcggttcgtgaagtggccgaagaacgtccaaatccaacgcaagaagcgcatcctcaagcagaggctcaaggtccctcctgcactcaaccagttcaccaaaaccctagacaagaatctcgccacgaatctatttaagatgctgctcaagtacaggccggaggacaaggcggagaagaaggagcggctcttgaagagggctcaggctgaggccgatgggaagcctgttgaggccaagaagcctattgttgtcaaatacggtctcaaccatgttacttaccttattgagcagaacaaggcacaactggttgtgattgctcacgacgtggacccaattgagctggtggtctggcttccagcattgtgcaggaagatggaaattccatactgcattgtcaagggcaaagcacgcttgggaacgattgtccacaagaaaactgcttcagttttgtgcttgacaactgtcaagaatgaagacaagatggagttcagtagaatcctagaagctattaaggccaacttcaatgacaagtatgatgaatacagaaagaagtggggtggtggaatcatgggttccaaatctcaagccaagaccagggccaaggagaagctccttgccaaggaagcagcccaaagaatgaactagattcacttgtttttacattattgaggttgccatttttctatattttatatgggagcatttacaagttaaaatgtgaggttttacttcattttggtagctcgtaatccacaaggaccgattttgatctttgattattcgtagttattttaaacttagaaatggaatgtttcccctttttcggttcaggagttgctagtcagtattcgagattttgcagcaattcagtagtttctgaccgtcgcgttgcttattgatcgtggtcccttttcagcattgctttactatatattgtgtatatcttttggtagcgtatatacgtccaaaaataggattggg

SEQ ID NO: 4264 - DNA, 1033 bp, Trigonella foenum-graecum
gggagggtttctcttttctatacatttcttctcctttgtccgccaccatcaaacaacagcggcaatggcaccaaagcgcggtggaaaagcaccagttgcagcagcgaagaagaagaccgcagagaaagtggtgaacccacttttcgagaagaggccaaagcaatttgggatcggtggtgctttgccaccaaagagggatttgacaaggtttgtgaaatggcctaagaatgttcaggttcagaggaagaagaggatccttaagcagaggttgaaggttccacctgctcttaaccagttcactaagacacttgataaaaatcttgccacaaaccttttcaagatgctccttaagtataggcctgaggacaaagctgaaaagaaagagcgtcttttgaaaagggcccaagccgaatctgatggcaaaacagttgagacaaagaagcctattgttgtgaagtatggtctcaaccatgttacctatcttattgagcagaacaaggcacagcttgttgtgattgctcatgatgtcgacccaattgagcttgtcgtctggcttccagctttgtgcaggaagatggaaattccctactgcattgtcaagggcaaagcacgcctgggaacaattgttcacaagaaaactgctgctgttttgtgcttgacaaccgtcaagaatgaagacaagatggaattcagtagaatcctagaagccattaaggccaacttcaacgacaagtttgaagaatacaggaagaagtggggtggcggtattatgggttccaaatctcaagcaaaaaccaaggccaaagaaagactcattgccaaggaagctgctcaaagattgccctagaaatttcatttgcttgttattttagaactttgaggttattgttctatatttttggtggagattttaaacaagtaaaatgtgcaattttccttttcattctgttagcttgtaatccagaatcaatggtttcaggacatgtacttttgctgaattatttcagtagttgttttagacttaaaaatgtgt

SEQ ID NO: 4265 - DNA, 1023 bp, Chelidonium majus
ttttctttcttctcgactcagggattagggtttcatcagtagtaactttgaagtgaagaagatggctcccaaaaagaggtgtgaaggccccggtggcggcgaagaagaagactgctgaaaaggttgtgaatcctttatttgaaaagcgccccaagcaattcggaattggtggtgctttacctccaaagaaggatttgcatagatttgtgaagtggccgaaagtagttcgtatccaacgacagaggaggattctgaggcaaaggttgaaggttccacctgcattgaaccagtttaccaaaactctggacaagaatatggcaacaaatgttttcaagatgcttctcaaatacagaccagaggacaaggctgctaagaaggaaaggctattgaaaagggctcaggcagagtctgagggaaagactgtggagtcgaagaagccaattgttgtgaaatatgggcttaatcacatcacttacctcattgagcagcaaaaggcccaattagtgcttattgcacatgatgtggaccccattgagctagttgtctggctacctgcattgtgccgtaaacaggaggtcccatacgctattgtgaagggcaaggctcgtcttggagcgatcgtccacaagaaaacagccagtgtcttgtgcctaacatcagttaaaaatgaggataagatggagttcagcaagatcgtggaggcagtcaaggcaaactttaatgataagttcgatgagcatcgtaagaaatggggtggcggaatcatgggttctaagtcccaggccaagaccaaagcaaaggaaaggctgattgcgaaggaagcagctcaaaggatgaattaagtttttatagtagcgaaagagttttcagtagggattaaactttgtaacttctctctttatataaacctgtcgtttgatattagtttttgttgttgatctggataagtttcaactggagaagttttgttttggggtttagtacaattttaactgcatattttgttgctcatcagctttgagg

SEQ ID NO: 4266 - DNA, 926 bp, Flaveria ramosissima
ttgctctatcgacggcttgagctcaaatttcaacaatggctccgaaaaaaggtgtgaaggcggttgcaaccaagaagaaaacggagaaggtggtgaatccgttgttcgagaaaaggccaaagcagtttggtattggtggagctttgccccctaaaaaaggatcttcacaggtttgtaagatggcctcaagttgttcgaattcaaaggaagaggaggatcctcaagcagcgtttgaaggtccaccagctttgaaccagtttaccaagacccttgacaagaatcttgcaactactttgttcaagatgctactcaaatacagacctgaggataaagctgcaaaaaaggaacgtcttttgaaaagagcacaggccgagtcagaagggaaaacagttgaagcaaagaagccgattgtcgtgaagtatggtctgaaccatgtcacttaccttatcgagcagaataaggcacaattggtaatcattgctcatgatgttgatccaatcgaattagttgtctggcttcctgcactttgcagaaagatggaaatcccctactgcattgtgaaagggaaatctcgattgggagccattgttcaccagaaaaccgctgcagcactgtgcttgactacagtcaagaacgaagataaaatggaattcagccgaatattggaagccatcaaggcaaacttcaatgataagtatgacgagtataggaagaagtggggcggtggtataatgggatcaaaatcacaggcaaagaccaaggcaaaagagagagttcttgccaaggaggctgctcagaggatgaattagcattgatcatatgttgaggttgtgttttcttgttcctccatttttgaactttgggaggtcaaatactttgcttgtttctgttgttctgtatgtgtttggtttctagacttgtgacaa

SEQ ID NO: 4267 - DNA, 979 bp, Papaver somniferum
gcttcttctttcggtctcggtaggaattagggttttgatttgcatcaaatggctcccaaaagaggtgttaaggcccctgtagccgccaagaaaaagacagaacaggttgctaatccttgttttgagaagcgcccgaaacagtttggtattggtggtgctttacctccaaagaaggatcttcatagattcgttaaatggcccaaggtcactcgtatccagaggcagcgaaggattttgaagcaacgattgaaggttccacctgctttgaaccagtttaccaaaacacttgacaagaaccttgccacaaatctttcaagatgttgctgaagtacagacctgaagacaaggctgctaagaaggaaaggttattgaaaagggctcaagctgagtcggaaggaaaaacagttgaggctaagaagcctattgttgtgaaatatggacttaaccacattacatatctcgttgagcagaacaaggcccaaatggttattattgcacacgatgttgatcccattgagcttgttgtctggcttcctgcattatgccgtaaaatggagattccatatgccattgtaaagggcaaggctcgtcttggggcgatcgtacacaagaaaactgcctcagcattgtgcttgacatcagtgaagaatgaagataaaatggaattcagcaagattgtggaagctgtcaaggctaatttcaatgataagtttgacgagcaccgtaagaaatggggaggtggaatcatgggatcaaagtcgcaagctaagaccaaagctaaggaaagggttctggcaaaggaagcagctcagaggttgaattagtttcttatttgtactaagccctgagagagaaatactaggcaagcaattttggatttctgtgtatacagatacaattcatctttagtttggattcttgattgtgagaagttctgttttaattccctactctagatgttgactgcattgtttttatt

SEQ ID NO: 4268 - DNA, 1178 bp, Picea glauca
gcagtttgttattgccgtgcgcgtggaaggaggtcgcaggtcagctagcaaagcgaagtatagcgagggagcagatcgattctagcaatggctccgaagagaggggttaaggctccggctgcagctaagaagaaggtcccaaaggttgttaatccattgtttgagaaacggcaaaacagtttgggattggtggagctctgccgccaaagaaggatttgcacaggtttgtgaaatggccgaaggttgttcgcatccagaggcagcggagggtattgaagcaacgtttgaaggtccctccggccttgaaccagttcaccaagacccttgacaagaatctcgctgccaaccttttcaagatgcttctaaaatataggccagaagataaagctgcaaagaaggaaaggcttctgaagaaagctcaggctgaggcagaaggaaagactgttgaagtgaagaagcctattgttgtaaaatatgggatcaatcatgtaacttaccttattgagcagagtaaagctcaactggtagttattgcacatgatgttgatccaatagagttggtagtgtggcttccggcactttgtagaaaaatgaacatcccttatgcaattgtcaaggggaaagcacgccttggagcgattgtgcacaaaaagacagcaactgccttgtgcttgacttctgtgaagaatgaggacaagatggaatttagcaagattgttgaggcagtaaaggctaacttcaacgacaagtttgatgagtatcgtcgacaatggggaggtggcattatgggaaccaaatctcaggccaaaacaaaggccaaggaaaacttgtggccaaggaagcggcacagaggctcacttaagaataattccttggaatatatttttatgttgaaattttattggattgttttttgcaatttgttgtaatttggtttctagttatagtaacatgtcagagtttataccaaggaattttaaatctaactgtagcttagacctcagaaaacagcaggtcaattttgcaactcagtaaattgttgagtaaacaatatttcgtacacattcattggccttgtgtactctacaactttttgtatgctgtgatgatgatattttcatttttctctttgtatgctattgttgttgatatttattgccaaatactttcaagcgtag

SEQ ID NO: 4269 - DNA, 1113 bp, Phaseolus coccineus
cattagggttccatcgttctttctccgtcgccactgcacccacttccttcgttctccgtcgcgacgcgaagcgcaaagcaatggctccgaaaagaggtgtgaaagctgcagcagtagctgcgaagaagaagcccgagaaagtgacgaacccgttgtttgagaagcgtccgaagcagttcgggatcggaggggcgttgcctccgaagcgggacctgactcggttcgtgaagtggccgaagaccgttcaaatccaacgcaagaaacgtatcctcaagcagagactcaaggtccctccagcactcaatcagttcaccaaaacccttgacaaaaatctcgcaacgaacctattcaagatgttgctgaagtacaggccagaagacaaagctgagaagaaggagcgtttgttgaagagggctcaggctgaggctgatgggaaaagtgttgaagccaagaagcctattgttgtcaaatacggtctcaatcacgttacctaccttattgagcagaataaagcgcaacttgttgtgattgctcatgatgtggacccaattgagcttgtcgtctggcttccagcactttgcaggaagatggaaattccatactgcattgtcaagggcaaagcacgcttgggaacggttgtccacaagaaaactgcttcagttttgtgcttgactactgttaagaatgaagataaaatggagttcagtagaatcctagaagctattaaggctaacttcaatgacaagtatgatgagtacagaaagaaatggggtggtggaatcatgggttccaaatcccaagccaagacgagggcaaaggagagactccttgccaaagaagcagcccaaagaatgtcctagatttacttgtttttataagtttgagttcatttttctatatgttattatatgggagcatatgcaagttaatatgtgaggtttaacttcattttggtagctcgtaatccagtaagacccgattttgatcgttgatatttgattttcagtagttattttagacttaatgaaacgtcatcttttttctgttcgggagttactattaccattaagattttgcagcaatttagtggttctaaatggtttgttttcttat

SEQ ID NO: 4270 - DNA, 895 bp, Fagus grandifolia
gggaaactagcagcggcaccagctaagaagaagcctgagaaggttttgaatccgttatttgagaagcgtccaaagcagtttggcattggtggtgctttgcctccaaagagagatctgcaccgatttgtcaaatggccaaaggttgtccgtatccagaggaagaagcgtatcctgaagcagcgtttgaaggtcccaccggcattgaaccagttcaccaagaccttggacaaaaaccttgcaacgaatttgttcaagttgcttcttaagtacaggccggaagacaaagcagcaaagaaggaacgccttttgaagagggctcaagctgagaatgaaggaaaaactgttgaagctaagaagcccattgttgtgaaatatggactcaaccatgttacctacctgattgagcagaacaaggcacagttggtagttattgctcatgatgtggacccaatagaattggtagtatggcttcctgccttgtgcaggaagatggagatcccttactgcattgtgaagggcaagtcacgtctcggagcgattgtccaccagaaaacagcttccgtcttgtgtttgaccaccgttaagaatgaggacaagttggagttcagcaaaatcctcgaggcaatcaaggctaactttaatgacaagtatgatgagtacagaaagaagtggggaggtgggatcatgggatccaaatcacaggccaaaaccaaggccaaagaaaggcttctagcaaaagaagctgctcagaggatggtttaagagtattatctatcctttgggggacctgctcctccattgtgttctttttttggtcttgatagttgaacttctcctatttagtttcatgaacaacttcggcttgagtcactctttctagtcatggaagtgttat

SEQ ID NO: 4271 - DNA, 1124 bp, Manihot esculenta
atcacgcgcccttccctccaaaggcagctagggttttctgagattctcttcacccacatggctcccaaacgaggtgttaaggccccagcgttggcaaagaagaaacctgaaaaggttgtcaacccattgtttgagaaacggccaaaacagtttggaattggtggtgcactgcccccaaagaaggacttgactaggtttgtcaagtggcctcatgttgttcgtattcagagacaaaggaggattctgaagcaacgattgaaggttcctcctgctgttaaccagttcacaaaaacacttgacaagaaccttgccacacaactattcaaattgtttctcaaatatagaccagaggacaaggcagctaagaaggaaaggcttcttaaaagggcacaggctgaagctgaagggaaaactgtggaatcaaagaaacccatcgttgttaagtatggtcttaaccatgttacttacctcatcgagcagaacaaggcccaattagtggttattgcacatgatgtcgatccaattgagcttgttgtttggttgcctgccctgtgccggaaaatggaggttccttatgcaattgtgaagggcaagtcacgacttggagcgattgttcacaagaaaacagctgcagctttgtgccttacatctgtgaagaatgaagataaattggaatttagcaagattttggaggcagtcaaggccaacttcaatgacaagtttgatgagcaccggaagaggtggggtggtggcatcatgggctccaaatcccaggctaagaccaaagccaaggagaggcttctagctaaggaggcggcacagagaatgtcttgagattctaacgagtagtgaagagacttatactaaaaaggatcctgagatgaattttgcatgttgattttgattgtattatgtattagttttgcattggaatagttgagatatttgaccattttctcttattatgtcgtgggagaatgaatatttatagtctactctctagcctatcagaaatgcagatacaatgagctttttaattcatttttagcatttaattaaggaagaacatgtaacaagttatttttgtcattataaaataaacaagatctgttattgagatgatt

SEQ ID NO: 4272 - DNA, 1074 bp, Manihot esculenta
gtcttcttatatccctttcctcctacgacagttagggttttccgggcaccacttctcccacatggctcccaaaagaggtgttaaggccccagtattggcaaagaagaaacctgaaaaggttgttaatcctttgtttgagaagcgaccaaaacagtttggaattgggggtgcactaccaccaaagaaggacttgactaggtttgtcaagtggcctcatgttgttcgtattcagaggcaaaggaggattctgaagcaacgtttgaaggttcctcctgctgttaaccagttcactaaaacacttgacaagaaccttgccacacagctcttcaaattgcttctcaaatatagacccgaggataaagcagctaagaaggaaagaattctcaagagggcacaagctgaagctgagggtaaaactattgaatcaaagaaacccattgttgttaaatatggtcttaaccatgttacttacctcattgagcagaacaaggcccaattagtggttattgcacatgatgttgatccaattgagcttgttgtttggttgcctgctttgtgtcgtaaaatggaagtcccttatgcaattgtgaagggcaaatcacggcttggagcgattgttcacaagaaaacagctgcagctttgtgccttacatcagtgaagaatgaagataaattggaatttagcaaaattttggaggcagttaaggccaacttcaatgacaagtttgatgagcatcgcaagaggtggggtggtggaattatgggatcgaaatctcaggcgaagaccaaagcaaaggagaggctcttagctaaggaggctgctcagaggatgtcttgagtttcttaggagggagtagtgtaagagagttataatcagaaaggaactcatgacgatgaattttgcatttttcatttgatgcacgggtttggttttatgtattagtctggcattgatggattaattcagaaatttggccaatttatcttgtctggatttgttgtgggaggagaatggatatttgtagtcggaaatgcagaaaccataatctttttttttttatttggtttttgagc

SEQ ID NO: 4273 - DNA, 1072 bp, Manihot esculenta
tgcgcttttttcacccccatttcgtggtacgacagcaggggtctcgatcttgcgcatctctttactcgcatggctcccaaaagaggcattaaggccccagtactggcaaagaagaaacctgaaaaggtggttaaccctttgtttgagaagcgacccaaacagtttggaattggtggtgcactgccaccaaagaaggatttaactaggtttgtcaagtggcctcatgttgttcgtattcagaggcaaaggaggattctgaagcaacgtttgaaggttcctcctgctgttaaccagttcacaaaaacgcttgacaagaaccttgctacgcaactcttcaaattgttgcttaaatatagacctgaggacaaggccgctaagaaggaaaggcttgttaaaagagcacaagctgaagctgaggggaaaactgtggaatcaaagaaacccattgttgttaaatatggacttaaccatgtcacttatctcgtcgagcagaacaaagcccaattagtggttattgcacatgatgttgatcccattgagcttgttgtttggttgcctgccttgtgccggaaaatggaggtcccttatgcaattgtgaaggggaagtcaagacttggagcgattgttcataagaaaacagctgcagctttatgccttacatctgtgaagaatgaagataaattggaatttagcaagatcttggaggcagtcaaggccaacttcaatgacaagtttgatgagcaccggaagaggtggggtggtggcatcatgggatccaagtctcaggccaagaccaaggctaaggagaggctcttggctaaggaggcggctcagagaatgtcttgagcgttctaggaactagagaagagagttgcaatgaagagggacttatgatgaattttgcatttttttatcttatggtttttcttttttgtatacttctattcgttaatggagtagatcagatatacctgaccattttctcttatttagatttgtgggggaagaacattggtccatttactgtggatttacgtgcaaaaatattttctaatttttatttttttgaagt

SEQ ID NO: 4274 - DNA, 1155 bp, Catharanthus roseus
tctcatctcaaaccctgcagaaccacagcagagatggctccaaagaagggtgccaagcttccggtgtcagcggcaaagaagaagcctgagaaggtcgttaatccactcttcgagaaaaggccgaagcagttcggtattggtggagctttgccgccgaagaaggatcttaccagattcgtgaaatggccgcagaacgtcaggatccagaggaagaagaggatcctcaggatgcgattgaaggttcccccggccatcaatcaatttgcaaaaacgcttgataagaacttggctactagtctgtttaagatgcttcttaaatacagacctgaggataatgctgcaaaaaaggagcgcctactgaaaagagctcaagctgaagcagacggtaaaaccgctgatgcaaagaagcccattgttgtgaagtatggtctgaagcatgtgacttatctgattgagcagaacaaggcacaattagttgttattgctcacgatgtggatccaattgaattggttgtttggcttccacatttgtgcagaaagatggaaattccatactgcattgtgaaaggcaaagcacgacttggatctattgtgcacaagaaaactgcttcagtgttatgcctaacctctgtgaagaatgaggataagttggaattcagcaaaattctggaagctatcaaggccaatttcaatgataaatttgacgaacaaaggaagaaatggggtgggggtgtcatgggctccaaatcccaagcaaaaaccaaggccaaggaaaggctacttgccaaagaagctgctcagagaatgtcttaatggccaattaacctcttggaggagggaaggacttgtgttctagaggtgttttcgattactttggtagtttgtgtttttgtattttgaagtttagagagacaagatacttgttgaattgagaatcttgataagaagttttgtctgagttgctttttcaattattactcatgaaaaaactgaattcatatgaaaattggcaacataatttattactgagaatgatactatagcattagaaggatttatgatttatgagtgactaggtgtgtggcttggtgtatgctaaacttggacaaaatcttgttagaatatgcaatttgggaaagtcctaatgtcattttt

SEQ ID NO: 4275 - DNA, 1131 bp, Cucumis sativus
gctgcggctctgtttgcttcacctcgtccctcttccaccgcgaaaaatggctccgaagaaggctgttggaaaagtttcagcaaagaagaagctggataaggtggtaaacccactatttgagaagcgtcccaagcagtttggaatcggtggggcattgccgcccaagagggatctcactcgctttgtcaaatggcccaaagttgttcaaattcagaggaaaaagaggattttgaagcagaggctcaaggttccacctgctttgaatcagttcaccaagacccttgacaagaatcttgcaacaaatttgttcaagatgcttttgaagtataggccagaggataaaacacagaaaagggagcgccttttgaaaagagctcaggaagaggctgaaggcaaaacattagatgccaaaaagcctatcgttgttaaatatggtctcaaccatgttacctacctcattgagcagaacaaggcacaactggttgtaattgcacacgatgtggatccaattgagttggttgtatggctcccagctctgtgcaggaagatggaaattccatattgcattgtcaagggaaaagcacgtttaggatcgattgtccataagaagactgcatcagttttgtgcttgacaacagtaaagaacgaagataagttggagttcagcaggatcctagaagccattaaggcaaacttcaatgacaagtacgacgagtacaggaagaaatggggtggcggaatcatgggttccaagtcacaagccaaaaccaaagcaaaggagaggcttcttgccaaggaagccgctcaaaggatgtcttaggaattcacagatcaacactagagcaaaggacaaaggagaagtttctagcagagcagaggatgtcaaagcatggcttagtatttggtaatgagctcttgtctaacttaagtcatttttctttgattacaaaacagattattaagaggcttgtcattgttattttcagttttaagtttattggattgagaaattttattttgttctacgagttctacattatattcaaagcaggacattttggaattaattctgttttgatgccatttttcttatataagttgggttatgtggtactttgaccatgttctctc

SEQ ID NO: 4276 - DNA, 968 bp, Flaveria ramosissima
tcttttagggttcttcacagtcgccgtctcgacgcctcggatccgaagttctaccaatggctccgaagaagggtgtgaaggttgcaactaagaagaagacggagaaggtggtgaatccgttgtttgaaaaacggccgaagcagtttgggattggtggagctttgcctcctaaaaaggatctacacagatttgtaagatggccacaagttgttcgaattcagaggaagaggaggatcctcaagcagcgtttgaaggtgccaccagcattgaaccagttcaccaagacccttgacaaaaatcttgcaacaaatttgttcaagatgctacttaagtacagaccagaggataaagctgcaaagaaagaacgtcttttgaaaaaggcccaggcagagtcagaggggaaaacagttgaagctaagaaacccattgttgtgaagtatggtctcaaccatgtcacctacctaattgagcagaacaaggcacagttggtaatcatcgcccatgatgttgatccaattgaattggttgtctggcttcccgccctctgcagaaagatggaaatcccctactgtattgtgaaaggcaaatcacgattaggagcaatcgttcaccagaaaaccgctgcagcactgtgcttgactacagtcaagaacgaagataaaatggaatttagccgaatattggaggccatcaaggcaaacttcaatgataagtatgatgagtataggaagaagtggggtggtggaataatgggatcaaaatcacaagcaaagaccaaggcaaaagagagagttcttgctaaagaggctgctcagaggatgaattagaaagagtatttgataatttttgagattttgagtttttttttctaaacataaaatattatggtactctttagattattcttccatttttcacttttgggagttcaagtacttgtatctgtttgttttggaatcatgtatgca

SEQ ID NO: 4277 - DNA, 854 bp, Flaveria ramosissima
gtctgcagaccttcaatctcaacactcagaaatggctccgaagaagggtggaaagccagtggcaacgaagaagaaaacggagaaagtggtgaatccgttgttcgagaagaggccgaagcagtttggaattggtggagcattgccaccgaagaaggatctgcatcggttcgtacgatggccccaagttgttcgcattcagaggaagaggaggattctcaagcagcggttgaaggttccacctgctttgaatcagttcaccaaaaccctagataagaatctcgcaaccactttgttcaagatgctgctcaagtaccggccagaggataaggcagctaagaaggaccgtcttcagaaaagagcccaggctgagtctgaaggaaaaactgttgaagcaaagaagcctatagttgtgaagtatggtctcaatcatgtcacatatctcattgagcagaacaaggcacaattggttatcatcgctcatgatgttgatcctattgagttggttgtctggctccctgctttgtgcagaaagatggaaatcccgtactgcattgttaaggggaaatctcgactaggagctattgtccatcagaaaacagcagcagctctatgcttgacaaccgtaaagaacgaagataagatggaatttagcagaattctggaagccattaaggccaacttcaatgacaagtatgatgagtacaggaagaagtggggtggtggaataatgggttccaaatctcaggcgaaaacaaaggccaaagagagggttttggcaaaggaggctgctcaaaggttgacttagatctcttagttatgtgtactgtatgcatttgaggtttttgagagctttg

SEQ ID NO: 4278 - DNA, 913 bp, Flaveria ramosissima
tctcaacattcagaaatggctccgaagaagggtggaaagccagtggcaacaaagaagaaaacggagaaagtagtgaatccgttgttcgagaagaggccgaagcagtttggaattggtggagcattgcctccgaagaaggatctgcataggttcgtacgatggccgcaagttgttcgcattcagaggaagaggaggatcctcaagcagcggttgaaggttccacctgctttgaatcagttcaccaaaaccctagataagaatctcgccaccactttgttcaagatgctgctcaagtaccggccagaggataaggcggctaaaaaggaccgcctccagaaaagagcccaggctgagtctgaaggaaaaactgttgaagcaaagaagcctattgttgtgaagtatggtcttaatcatgtcacatatctcattgagcagaacaaggcacaattggttatcattgctcatgatgttgatccaattgagttggttgtctggctccctgctttgtgcagaaagatggaaattccatactgcattgttaaggggaaatctcgactgggagctattgtccatcagaaaaccgccgcagctctatgcttgactacggtaaagaacgaagataagatggaatttagcagaattctggaagccattaaggccaacttcaacgacaagtatgacgagtacaggaagaagtggggtggcgggataatgggttccaaatctcaggcgaaaacaaaggccaaagagagggttttggcaaaggaggctgctcaaaggttgacttagatctcttggtaatgtactgtatgcatttgaagttattgggagctttgcctttagaaacttatgtctttagaactctttttgttgcttgatacttttcgaagttcaaatatttgatgttagactt

SEQ ID NO: 4279 - DNA, 899 bp, Flaveria ramosissima
tctcagctttcagccatggctccaaagaaaggtggaaagccagtagcaacgaagaagaaaacggagaaggtggtgaatccgttgttcgagaagaggccgaagcagtttggaatcggtggagcattgcctccgaagaaggatctgcataggtttgtaagatggccccaagtggttcgtattcagaggaagaggagaatcctcaagcagcggttgaaggtgcctcctgctttgaatcagttcaccaaaaccctagataaaaatctcgcaaccaacttgtttaagatgctgctcaagtaccgacccgaggataaggccgcaaagaaggaacgtcttcaaaaacgagctgctgcggaggacgaaggaaagacagtagaagcaaagaagcccattgttgtgaaatatggtctcaatcatgtcacatatctcattgagcagaacaaggcgcagttggtcatcattgctcatgacgtggacccaattgagttggttgtctggcttcccgctttgtgcaggaagatggagatcccttactgcattgtaaagggaaaatctcgacttggagctattgttcaccagaaaactgcagcagctctgtgtttgactacagtcaagaacgaagataagatggagttcagcagaatcctggaagccataaaggccaacttcaatgacaagtatgatgagtacaggaagaaatggggtggtggaataatgggttccaaatctcaggcaaaaacaaaggcaaaggagagggttttggccaaagaggctgctcagaggttgaattagagagattatttcctgatcatgtgttgtctgcagttgaattcattgagggcttttgtttagaattctatttgcttgctttaaactttggaagttaattacttgcttatctt

SEQ ID NO: 4280 - DNA, 915 bp, Flaveria ramosissima
atctcaacactcagaaatggctccgaagaagggtggaaagccagtggcaacaaagaagaaaacggagaaagtagtgaatccgttgttcgagaagaggccgaagcagtttggaatcggtggagcattgccaccgaagaaggatctgcatcggttcgtacgatggccccaagttgttcgcattcagaggaagaggaggatcctcaagcagcggttgaaggttccacctgctttgaatcagttcaccaaaaccctagataagaatctcgcaaccactttgttcaagatgctgctcaagtaccggccagaggataaggcagctaagaaggatcgtcttcagaaaagagcccaggctgagtctgaaggaaaaactgttgaagcaaagaagcctattgttgtgaagtatggtctcaatcatgtcacatatctcattgagcagaacaaggcacaattggttatcatcgctcatgatgttgatcctatcgagttggttgtctggctccctgctttgtgcagaaagatggaaatcccgtactgcattgtcaaggggaaatctcgattgggagctattgtccatcagaaaacggcagcagctctatgcttgactaccgtaaagaacgaagataagatggaatttagcagaattctggaagccattaaggccaatttcaatgacaagtatgacgaatacagaaagaagtggggtggtgggataatgggttccaaatctcaggcgaaaacaaaggccaaagagagggttttggcaaaggaggctgctcaaaggttgacttagatcccttagtaatgtactgtatgcatttgaggttgttgagagctttgcctttagaaactttatgtttttagaattctatttggttgcttgattacttttggaagttcaaatatttgatgttagac

SEQ ID NO: 4281 - DNA, 1078 bp, Ipomoea batatas
ggcaacgatcgggtcacgcgcgcctgcaggtcgtctctagtaatctccaaagaattcggcacgaggctaccttctgccttttgccttctgcaatggttccgaagaagggtgtgaagctcccagttggtgcttccaagaagaagccggagaaggtggtgaacccgttgttcgagaagcggccgaagcaattcggcatcggcggggcattgccacccaagagggatctgacgaggttcgtgaaatggcctcaggttgtccgtatccagaggaagagacggatcctcaagcagcgcttgaaggttccacctaccctaaatcagttctccaaaaccctcgataagaaccttgccacaaatctcttcaagatgctcctcaagtataggcctgaggacaaggcagcaaagaaggagcgacttctgaaaagagcccaggctgagagtgaagggaaaactcccgaaatcaagaagcctattgttgtcaagtatgggcttaagcacgtcacttatcttgtggagcagaacaaagcacaactggtggtcattgctcatgatgttgaccccatagaattggtggtctggcttccagctttgtgtaggaagatggaaatcccttactgcattgtcaaggggaaagcaagattgggttctattgtccacaagaagacagcatcagttttgtgcctgacttcagtcaagaatgaggacaaattggagttctccaagatcttggaggccatcaaggccaacttcaatgacaaatatgatgaaaaccgcaagaaatggggtggtggtatcatgggctcgaaatctcaagcgaggacaaaggccaaagaaagggttcttgcaaaggaggctgctcagaggatgtcttagtttgtattgtcatttaatcattatagtatttcctgttatcctgttataaggtttagacaaattttagacatttctttctctgggtgacaaagttcattaaattttggttgtcttctgaattttaaaggcttgtttggcctttggatttctgagttgttatttactagtactgagcaatgaaattcctttactatttgacaaaaaaa

SEQ ID NO: 4282 - DNA, 1036 bp, Actinidia deliciosa
aatcgccgtccgcaaaccctaatcgcagagctttaccgaggagagagaaccaaatcctgcagaaatggctccgaagaaaggtgtcaaaccagttgtggccaagaagaaaccggataaggtggtgaacccgttgttcgagaagcgtccgaagcagtttgggataggaggggcgttgcctccgaagaaagatctgcaccggtttgtgaagtggccgaaggtggtccaaattcagaggaagagaaggatcctcaaccagcgcctgaaggtcccaccacctctgaatcaatttaccaagacccttgacaaaaacctcgctactagtctcttcaaaatgcttctcaagtataggcccgaggacagagcagcaaaaaaggagcgactcttgaaaagggctcaggctgaggctgaagggaaacctgttgaggctaaaaagcctattgtcgtgaaatatggtctcaaccatgtcacctacctcattgagcagaacaaagcgcaactggttgtcgttgcccatgacgtggacccaatagagttggtcgtctggcttccagcactgtgcaggaagatggagattccatactgcattgtgaaaggaaaatctcgattgggaacgattgtccaccagaaaactgcggcagttttgtgcttgaccactgtcaagaatgaagacaagatggagttcagcaaaatcttggaggctatcaaggccaacttcaatgacaagtatgatgagtacaggaagaagtggggaggcggtatcatgggttccaaatcccaggccaaaaccaaggccaaagagagggttcttgcaaaggaagctgctcagagaatgagctaagagaatcatatagactgcttctaggcttaagctattgaggactttcctgcatgctatttttttttgttgatgttttccaaattaattggttagtttttgtttttgtcgagggcaggtcatgaaacaatgtgatggtgaatgcatgaattcagagttatatcctgtttaaattagattcggttggataaaaaaaaaaaa

SEQ ID NO: 4283 - DNA, 1133 bp, Lactuca sativa
ccaagttatgtgaaaccctaaaagctataaacctcgtctttcttataaacacgaaaacccttttaatccctgccgttttccagaccttcaatctctactttcagacatggccccaaagaaaggtggaaaggcggttgcaaccaagaagaaaacagcggagaaggttgtgaatccgttgtttgagaaaaggccgaaacaatttggaattggtggggcattgcctcctaagaaggatcttcacaggtttgtgagatggccacaagtcgttcggattcagaggaagaggaggatcctcaagcagcgtttgaaggtcccacctgccttgaatcagtttaccaaaaccctcgacaaaaatcttgctactacactgttcaagatgctgctcaaatataggccagaggacaaagcagcaaaaaaagaacgccttcttaaaagagctcaagctgagacagaaggaaagacagttgaggctaagaagcctattgtggtgaagtatggacttaaccacatcacctatctcattgagcagaacaaggctcaattggttgttattgctcatgatgtggatcccattgagttggttgtctggcttccagcattatgcagaaagatggaaatcccatactgcattgttaagggaaaatccagacttggaactattgtacatcagaaaacagcagcagctctttgcttgactacagtgaagaatgaagacaaaatggagttcagcagaatcttggaggctatcaaggcgaacttcaatgacaagtatgaagagtataggaagaagtggggtggaggaataatgggttccaaatcccaggctaaaacaaaggcaaaggaaagggttttggccaaagaagctgctcagaggttgaattagagaaaccttttttgtaatggagagctttgcatttagaaacatttcttgtttttagaacactctatctggtttttgacttttggaatttaatactttctgttttgacttattttaatgccaacttattcagattttgtcatctatgtccctttctgttatcagaaaacaaatcagagcgtatgcagttgatataatgaagttgaaattttgctcattaagttgagcataatccaatataaattaacaagaa

SEQ ID NO: 4284 - DNA, 1248 bp, Papaver somniferum
tcttcagaaccatctccaacctgcagcagcaatggctcccaagaaaggtgttaaaactccagtagcagcaaagaagaagagtgagaaggttgtaaaccctttgttcgagaggcgaccaaagcaatttggaattggtggtgcattacctcccaagaaggatttgcataggtttgtcaaatggcccaaggttgttcgtattcaacgtcaaaggaggattttgaagcaaaggttgaaggttccaccagctttgaaccagttcacaaagaccctagacaagaacctagcaacaaatctattcaagatgttgcttaaatacagacctgaagacaaggctgccaagaaggaaaggcttttgaaaagggcacaggctgagtctgagggaaagaccgtcgaggcaaagaaacccattgttgtcaaatacggacttaaccacattacctacctcattgaacagaacaaggcccaaatggtggttattgcccatgatgtcgacccaattgagcttgttgtttggctgcctgctttgtgccgtaaaatggagatcccctatgctattgtgaagggcaaggcccgtcttggagcgatcgtccacaagaaaactgcctcagcattgtgcttgacctcagttaagaatgaagataagatggactttagcaagattgtggaggcaattaaggccaactttaacgacaagtttgatgagcacagaaagaaatggggaggtggtattatgggatcaaagtcgcaagcaaaatccaaagcaaaggaaagagtgttggccaaggagcaagctcaacgtaacaactaagttgtctggttcttgttcttgtagttcgaaagattttcttatgaccctctgtagttctgtagctgatctagagaagagaagcattttgtcacaaacagttttttagttttgagatttattttactattctgtcttttgcaaaaacgagaaaccagatttatatatgctggatttatctagatgtttatttctcatatcgctgttagcatgacttttatgatggtttttagcggaccattgtctctccgtgttagcatgctgttgttgttcatagattgctgtcccttgttttttgctcttcgttcatcatgagaatgtcagggaatttcgattctagagctgttcctccggaagcagttcttatatttttatttttgtgagttctgaatgagaacaaactacatgtacaccacagttgagcaacaaaatactattttctc

SEQ ID NO: 4285 - DNA, 864 bp, Primula obconica
ctttggtgtttgctattttcgtgtttagggtttactcgccgtcgcactaagattcatctctcagaaatggccccgaagaaaggaattaaacccgctgcagcagcaaaaaggaagacggtgaaggtggtgaatcccttgttcgagaaacgtccgaagcagtttgggatcggtggtgctttgcctccaaagaaagatttgcaccgttttgtgaaatggccaaaggttgttcaaatccagaggaagagaaggatcctcaaccagcgtttgaaggtcccgccacctttgaaccaattcaccaaaactctcgacaagaacctcgcaacaagtctgtttaagatgctccttaagtacaggccagaagatagagctgccaagaaggaacgccttctgaaaagggctcaagccgaaactgaaggaaagactgtcgaagccaaaaagcccattgtggtgaaatatggtcttaaccatgttacttacctcattgagcagaacaaagcgcaactagttgttattgctcatgatgtggacccgattgagctggttgtgtggcttcctgccttgtgcagaaagatggagatcccttactgcattgtgaaaggcaaagctcgtctcggaactattgttcatcagaaaactgcctcggttctatgcctgaccacagtcaagaatgaagacaagatggatttcagcaaaatcctcgaagcaatcaaagccaacttcaatgataagtatgacgagtacaggaagaaatggggtggtggtatcatgggttccaaatcccaagcgaaaacaaaggccaaggagagggttcttgctaaggaagctgctcagaggatgaactaagaagagttcatgtgattttgt

SEQ ID NO: 4286 - DNA, 1341 bp, Pseudotsuga menziesii
aggtaatctgcttatgtgtagtacgcagggttcgaggtcgcaacctagaaggtaagctaacagagcgagggagcagatcgatcccagcaatggctccgaagagaggggtaaaggctcctgttgctgctaagaagaaggtgccgaaggttgttaatccattgtttgagaagcggaccaagcagtttggaatagggggttctctgccgccaaagagggatttacacagatttgtgaaatggccgaaggttgtccgcatccagaggcagcggagggtattgaagcagcgtctgaaggttcctccggctttaaaccaattcaccaaaacactcgacaagaatctcgcatccaaccttttcaagatgctcctaaaatacaggccagaagacaaagctgcaaaaaaggaaaggcttctgaagaaagctcaggcagaggcagagggaaaaactgttgaagtaaagaagcctattgttgtgaaatatgggattaatcatataacgtaccttattgagcagagtaaagctcagttggtagttattgcacatgatgttgatccaatagagttggtggtgtggcttcctgcactttgtagaaaaatgaacatcccatatgcaattgtcaaggggaaagcacgtcttggagcgattgtgcacaagaaaacagcaactgctttgtgtttgacttctgtgaagaatgaggacaagatggagttcagcaagattgtcgaggcaataaaggccaacttcaatgacaagtttgatgagtatcggcgccaatggggaggtggcatcatggggaccaaatctcaggcaaaaacaaaggccaaggaaaaagtcttggcaaaggaagcggcacaaagactcacataggaataatttaatgcaagatttttcccatcttgaagagtttgttagagtattttttcggaatatgttgtgattttgatttagaggtgtagagaagtattggatttatgctgagaaagttttaaagctaacaatggctttttcctccaagaaaacagcatgcctaattgtcaattctgggtaaaatgcttagctagctttcattcattgcaatttgttctaccacaatttgtttgatgtgatgttttttcctagaaaacaatgtattatgcattttggaaagaatttcaaatacaatcctcaagatgctagagagcacagatccctatactgggcctgcaagccaactgcccagaaagatatacacaaactatactcttaagacctcattcagagagcctttcagtccaatatgacagacttgactgaaaacaaaatcggcacacctagaaaaaactgactgttctaaatacagaca

SEQ ID NO: 4287 - DNA, 938 bp, Valeriana officinalis
aaatggccccgaagagaggtgtaaagcaaccagttgctgccgctaagaagaaatcggataagattgtgaatcctttgtttgagaaaaggccgaagcaatttggaatcggaggtgctttgccgccgaagaaagatctgcacaggtatgtgaaatggccgcaagttgttcgtatccaaaggaagaggaggatcctcaagcagagattgaaggttccgccagcattgaaccagttcactaagacgctggacaaaaatcttgcaacaagtttgttcaaaatgcttctcaagtacaggccagaagacaaagcagcgaagaaggaacgtctgattaagagggctcaagccgaatctgaaggaaaggctcctgaggctaaaaagccaattgttgttaagtacggcctaaaccacgtcacctatcttattgagcagaacaaagcacaattggttgtgattgctcatgatgtcgacccaattgagttggttgtatggctcccggcattgtgcaggaaaatggaaatcccatactgtattgtcaaaggaaaagcacgacttggagcgattgtacaccaaaagaccgcgtcagtattgtgcttgaccacagtaaagaatgaagataagatggatttcagcaaaatcttggaggcaatcaaggcaaactttaacgacaagtatgaagagaacagaaagaagtggggaggaggaatcatgggttcaaaatctcaagcaaaaacaaaggccaaagagagagttcttgcaaaggaagctgcccagagggcttgaactagttttctctctagttaacgcagttttgggaattgttgttacttgttcgattgattttgtttagaatttaatgaaacatcttgcagcccgtatttcttttgccgtttcatatgttgtggttatactatcgagtgcttattgatctttttaaactta

SEQ ID NO: 4288 - DNA, 1128 bp, Coffea canephora
cggccggggaacatgagtctttccttcctattcttcctattctcttctcgtctctcgtaacttgagtctttccttctcttcttttttctatcctaaactcccaaactaagccctagggtttttgacgtcgcgccgtcgtttctccaaacccctcaggcaacgaaatggctccaaagagaggtgcgagggctccagctgcagtggcgaggaggaaaaccgagaaggtggcgaatcctctgttcgagaagcgtccgaagcagttcggaattggaggagccctcccaccgaagaaggatctcaccaggttcgtcaaatggcctctcaacgtccggatccagaggaagaagaggatcctcaggcagcgcttgaaggttcctccggcgctcaaccagttctccaagactctcgacaaaaatcttgcaacaaatctgttcaagatgcttctcaagtacaggcctgaggacaaggcagccaaaaaagagcgtcttctcaagagagctcaagctgaggctgaagggaaagcttctgatgctaagaagccaattgttgtcaaatacggtttaaagcatgtgacgtaccttgttgagcagaacaaggcacaattggtggttattgctcacgatgtggacccaattgagttggttgtttggcttcctgctttgtgcagaaagatggaaattccctattgtattgtgaagggaaaatcgcgattgggagcgattgttcataagaaaactgcatcagtcttgtgcctgacctcagtgaagaatgaagataagttggagttctcgaaaattttggaggccattaaggctaacttcaacgataagtatgaggagtacaggaaaaagtggggtggtggagtcatggggtccaaatctcaagcaaaaaccaaggcgaaggagaagcttcttcaaaaggaagccgctcagaggatgtcttagaaagagcgattttccttgttgtcctgatttttatttgcggctttagattttttgcttctgacatacatatgtatttttggtagacatttatttggcatgtttgattatcaaagcttcgtgcaatagttaaattttgtgttgactgcttgctttatgaatggtagttgtttccttgagttgtggc

SEQ ID NO: 4289 - DNA, 1051 bp, Papaver somniferum
tgagcgcctcccttcttcttcagaaccagctccaacctgcagcagcaatggctcccaagaaaggtgttaaaactccagtagcagcaaagaagaagagtgagaaggttgcaaaccctttgtttgagaggcgaccaaggcaatatggaattggtggtgcattacctcccaagaaggatttgcataggtttgtcaaatggcccaaggttgttcgtattcaacgtcaaaggaggattttgaagcaaaggttgaaggttccaccagctttgaaccagttcacaaagaccctagacaagaacctagcaacaaatctgttcaagatgttgcttaaatacagacctgaagacaaggctgccaagaaggaaaggcttttgaaaagggcacaggctgagtctgagggaaagaccgttgaggcaaagaaacccattgttgtcaaatacggacttaaccacatttacctacctcattgaacagaacaaggcccaaatggtggttattgcccatgatgtcgacccaattgagcttgttgtctggctgcccgctttgtgccgtaaaatggagatcccctatgctattgtgaagggcaaggcccgtcttggagcgatcgtccacaagaaaactgcctcagcattgtgcttgacctcagttaagaatgaagataagatggactttagcaagattgtggaggcaattaaggccaacttcaatgacaagtttgatgagcacagaaagaaatggggaggtggtattatgggatcaaagtcgcaagcaaaaaccaaagcaaaggaaagagtgttggccaaggagcaagctcaacgtaacaactaagttgtctggttcttgtagttctaaacattttcttacaaccctctgtagttctgtagctgatctagagaagagaagcattttgtcaccagcacttgtagttttgagatttattttactattctgtcttttgcaaagacgagaaaccggatttatatatgctggatttatctagatgtttatttctcatatcgcagttagcatgacttttatgatggtttttagcgga

SEQ ID NO: 4290 - DNA, 964 bp, Amsonia hubrichtii
gctcaaacccaaattgcggaatcgcagaagagatggctccaaagaagggtgccaagcttccagtgtcagcggcgaagaagaagcctgagaaggtagtcaatccactgttcgagaagaggccgaagcagttcggtatcggtggagctttgccgccaaagaaggatctgaccaggttcgtcaaatggccccagaatgtgagaatccagaggaagaagaggatcctcaagatgcgattgaaggttcctccagccctcaaccaattctcaaaaacgcttgacaagaacttggctacaagtctgtttaagatgcttcttaaatacagacctgaagataatgctgtgaaaaaggagcgcctgctgaaaagggctcaagctgaagccgaaggaaaaacatctgatgtgaagaagcccattgttgtgaagtatggtctgaagcatgtgacctatcttgttgagcagaacaaggcacaattagtggttattgctcacgatgtggacccaattgagttggttgtttggctcccacttttgtgcagaaagatggaaatcccctactgcattgtgaaaggcaaagcacgccttggatctattgtgcacaagaaaactgcttcagtgttatgcctaacctctgtaaagaatgaggataaattggagttcagcaaaattcttgaagccattaaggccaatttcaacgataaatttgatgagcagaggaagaaatggggtgggggtgtcatgggctctaaatccctagcaaaaaccaaggccaaagaaaggcttcttgccaaagaagctgctcagagaatgtcttaatggggcatttaacctttgagagaagtgaatgacttgggttctagtcttcttggttactctctagttttaaaaaatctatctttagtattatgaattagagcgagacacggtacttgtgatactcttcatgagtgagaattttgacaattttt

SEQ ID NO: 4291 - DNA, 1149 bp, Aquilegia formosa
atcgccacacttcatttgttcttgcggcctctgcagactatctagggtttttatcgtcactctcattcatcactaacgaaatggcccccaaaaaaggtgcaaaggcagtagcaactaagaagaagcctgagaaagttgtcaatcctttgtttgaaaagcgaccaaagcagtttgggattggtggtgcacttccaccaaagaaggatttgcatcggtttgtcaaatggcctaaagtagtccgtattcagaggcaacgcaggattttgaaacaacggttgaaggttccaccagctttgaaccagttcacaaaaacacttgacaagtcccttgcaacaacacttttcaagatgctactcaaataccgaccagaagacaaggctgccaaaaaggaaagacttgtgaagagggctcaagctgaagcagagggaaagactattgagtcaaagaagcccattgttgtgaaatatggcctcaatcacattacgtaccttattgaacagaacaaagcccagttggtggtcatcgctcatgatgttgaccctattgagcttgttgtctggcttcctgccttgtgccgcaaaatggagattccttatgttattgtgaagggaaaggctcgtcttggagcggttgtccacaagaaaactgcagcagctttgtgcttaacctcagttaaaaatgaagataagatggaattcagcagaattgtcgaggcaatcaaggctaacttcaatgacaagtatgatgaaaatagaaagaaatggggtggtggcatcatgggatcaaagtctcaggctaagactaaagccaaggagaggctcttggcaaaggaagcagcacagaggatgaactgagcgtatagcagcagtagtagagaaagggcctatactaggaagttattagctactgtttcctacagttctgtcttgtttttctgcttgggagaagttttgtattggatttgtccttgtgatctttatatttgttttggttttcatgactactctagtagcaggaagcaaaatccattttatggatagaacctgttttttcagagaattggcttatttagacagattttgttcgaaaattggttgtgtttctcacattgctaatctaaatatgtttatgttctggatgatgctccac

SEQ ID NO: 4292 - DNA, 921 bp, Ocimum basilicum
gtgggcaaaacctcagacttcatcgcgcagctgcagagaaatggctccgaagaagggcgcgaagcttccagttgccgccaagaagaaggtggagaaggtggtgaatccactgttcgagaagaggccgaagcaattcggaatcggaggtgcgcttccgccgaagaaggatctgcacaggtttgtgagatggccgcaagttgtgcgcattcagaggaagaagatgatcttgaagcagcgcttgaaggtgcctccgccaattcatcagttctccaaaactctggacaagaatctcgccaccagcctcttcaaaatgcttttgaagtataggcctgaggatagagcacaaaagaaagagagactcttgaagagagctcaggctgaggccgaagggaaaactcccgagaccaagaaacccattgttgtgaaatatgggcttaaccatgtgacctacctcattgaacagaacaaggctcagctagtggtgattgcccacgatgttgatcctatcgagttggttgtatggctcccagccttgtgcaggaaaatggagatcccgtattgcattgttaagggcaaggctagactcggaagcatcgtgcacaagaagacagcctctgtcctatgcttgacctcggtgaaaaatgaggacaagatggaattcagcaaaatcttggaggccatcaaggccaacttcaacgacaagtacgatgagacgaggaagaagtggggcggtggtgtcatgggttcgaagtcgcaggctagaaccaaggcgaaagagagggttctggccaaggaagctgctcagaggatgacttaaatggattgtcattttgtttgtctagttatagtattactctttcttcatggatgggacatgaattttgtttaaagggtcaaccttcatttttgcttctattcctc

SEQ ID NO: 4293 - DNA, 1110 bp, Phaseolus coccineus
actcagagtcagcttctctcgcatagccacacaacagcagctgcagcaatggctcccaagcgtggtggaaaagctcctgctcttgccgctaagaagaagcctgagaaggttacgaacccgctttttgagaagcgtccgaagcagttcggaatcggaggagcgttgccgccgaagagagacttgactcgtttcgtgaaatggcccaagaccgttcagattcagaggaagaagaggattttgaagcagaggttgaaggttcctccagctttgaaccagtttacgaagacactcgacaaaaacctagcaacaagtctgttcaagattcttttgaagtacaggcccgaggataaagcagagaagaaggaaaggcttttgaaaagggcacaggcagaggctgaaggaaaaactattgaagccaagaagcctattaatgtgaagtatggtctcaaccacgttacctacctcattgagcagaacaaggcacagcttgttgtgattgctcacgatgtggacccaattgaattggttgtatggcttccagcattgtgcaggaaaatggaaatcccatactgcattgtgaagggaaaggcccgcttgggaacggtcgttcacaagaaaaccgcatctgttttgtgcttgacaactgtgaagaatgaagataaattggagttcagcagagtcttggaggccattaaggctaacttcaatgacaaatatgatgagtacagaaagaagtggggtggtggaatcatgggatccaaatcccaagccaaaacccgggcaaaggaaaggcttcttgccaaggaagctgctcagaggatgtcttaggaagaatttcttatatttggttgctctgcgactgctctctagtgtgtttttaatgttactcttttacttgttatctctttaaaaacatttgttttcacttgagctagagcatttcattaaaatctccattgcgactgtcccagtttttgaaccccattttactttcattttggtagtagacttttttacagtacttaatgaacgaactgcatgaggttgcagttgcatccaatttttgatattttatataactataatttatgattctgtttatactttaaa

SEQ ID NO: 4294 - DNA, 1130 bp, Cucurbita pepo
ggcggctcctttgtttggcctattgcagcgcagaaaatggcaccgaagaaggccgttggaaaagtttcggcaaaaaagaagccggtgaaggtagtgaatccactattcgagaagcgtccgaagcagtttggaatcggcggggcattgccgcctaagagggatctgacaaggttcgtcaaatggccgaaagctgttcaaattcagaggaagaaaaggattctcaagcagaggctcaaggttccacctgctttgaatcagttcaccaagacacttgacaagaatcttgcaacaaacttgttcaagatgcttctgaagtataggccagaggataaagcacagaagagggagcgtcttttgaagagagcgcaggaagaggccgaaggcaaatcacatgatgccaaaaagcctattgttgttaagtatggtctcaaccacgtaacctacctcatcgagcagaacaaggcacagctcgttgtgattgcgcacgatgtggatccgattgagttggtcgtttggctcccagctttgtgcaggaagatggaaatcccatattgcattgtgaagggaaaagcaagattgggagcgattgtccatcaaaagactgcatcagttttgtgcttgacaaccgtaaagaacgaagataagttggagttcagcagaatcctcgaagcgataaaggccaacttcaacgacaagtacgacgagtacaggaagaagtggggcggtggaatcatgggttctaagtcacaggccaaaaccaaagcaaaggagaggctccttgccaaggaagctgctcaaaggatgtcttaggaattcacaggccaacactagagcaaagaacaaaggagagaagcttttagcagagccagaggatgtcaaaggatggcttaggaatcggtaacgagctcgtctaactttcaattatcttcgattaaaaaaaggatcaacgaggcttgtcatttttattttcagctttaagtttattggattgagaaagtttagtttgtttctacgagttctacatgttcaaagcaagaccttatgaagttattctatttggacgccactttttttttcttgaactgtgtgttatatgacgtttggccttagttttgaatgagcctcctatt

SEQ ID NO: 4295 - DNA, 1147 bp, Eucalyptus grandis
ggggttcttcaagttccagttttgcaaattcggaaccagaggagccggcgctgcagcttcgccgacaatgggtcccaagaaaggtggaaaagctcctgttgcggccaaaaagaagcaggagaaggtgacgaaccctttgttcgagaagcggcagaagcagtttggaattggaggtgctctgcctccgaagagggacttgacacggttcgttaagttccctaagactgttcaaattcagagaaagaggagaattctgagacagaggttgaaggttccaccagctttgaaccagttcaccaagaccctcgacaagaacttggccacgagcctgttcaaaatgcttctcaagtacaggcctgaggacaaagcagcaaaaaaggagcggctcttgaagaaggcccaggttgaagcagaagggaagtcagttgaggctaagaagcccattgttgtgaaatatggtcttaaccatgttacttaccttattgagcagaacaaggctcagttggtagtcattgcacatgacgttgacccaatcgagttggttgtctggcttccggcattatgtaggaagatggaaattccatattgcatcgtgaagggaaaggcacgcttaggaacgattgtccataagaaaactgcgtctgtcttgtgcttgaccactgtcaagaatgaagacaaattggagttcagcaaaatcttagaggccatcaaggcaaacttcaacgacaagtatgatgaatataggaagaagtggggtggcgggatcatgggatctaaatcacaggccaaaaccaaggctaaagagagggttattgccaaggaagttgctcagagaatgacctagtggtgaaacaaaatgtgtttcttttttcttagagtattgtcatttgaggccaatgtttatgttcatttttgtttttgttctttctggcacttagcaccaaatatttcctttcccaaagtgagaccacaattttgaaatttatgcaactgctgttgaacatgcttttctttgaggttggagctgatgcatgatgtcatcatatttcattggctcgttattgctatggctctagctattttacctgctcatcaccttcggaagtcgactattctgcaatggcaacaagtaagacgatagcagttg

SEQ ID NO: 4296 - DNA, 790 bp, Flaveria ramosissima
ccttcaatctcagctttcagccatggctccgaagaaaggtggaaagccagtagcaacgaagaagaaaacggagaaggtggtgaatccgttgttcgagaagaggccgaagcagtttggaatcggtggagcattgcctccgaagaaggatctgcataggtttgtaagatggccccaagtggttcgtattcagaggaagaggaggatcctcaaacagcggttgaaggtgcctcctgctttgaatcagttcaccaaaaccctagataaaaatctagcaaccaatttgttcaagatgctgctcaagtaccgacctgaggataaggccgcaaagaaggaacgtcttcaaaaacgagccgctgcagagaacgatggaaagacagtcgaagcaaagaagcccattgttgtgaaatatggtctcaatcatgtcacatatctcatcgagcagaacaaagcacagttggtcatcattgctcatgacgtggacccaattgagttggttgtctggcttcccgctttgtgcaggaagatggagatcccttactgcattgtaaagggaaaatctcgacttggagctattgttcaccagaaaaccgcagcagcattgtgtttgactacagtgaagaacgaagataagatggagttcagcagaatcctggaagccataaaggccaacttcaatgacaagtatgatgagtacaggaagaaatggggtggtggaataatgggttccaaatctcaggcaaaaacaaaggcgaaggagagggttttggccaaagaggctgctcagaggttg

SEQ ID NO: 4297 - DNA, 1062 bp, Flaveria ramosissima
tctgagatcctatgcgaaaccctaaatgttaaaccatcgtgtttatggtaaaacgaaaaccatagatttctgttttagggttcttcacagtcgccgtctgacgccttggatccgaagttctatcaatggctccgaagaagggtgtgaaggttgcaactaagaagaaaacggagaaggtggtgaatcctttgttcgagaaacggccgaagcagtttgggattggtggagctttgcctcccaaaaaggatctacacagatttgtaagatggccacaagttgttcgaattcagaggaagaggaggatcctcaagcagcgtttgaaggtgccaccagcattgaaccagttcaccaagacccttgacaaaaatcttgcaactactttgttcaagatgctactcaagtacagaccagaggataaagctgcaaaaaaagaacgtctgttgaaaagggcccaggcagagtcagaggggaaaacagctgaagctaagaaacccattgttgtgaagtatggtcttaaccatgtcacctatctaattgagcagaacaaggcgcagttggtaatcattgcccatgatgttgatccaattgaattggttgtctggcttcccgccctctgcagaaagatggaaatcccctactgtattgtgaaaggcaaatcacgattaggagcaatcgttcaccagaaaactgctgcagcactgtgcttgactacagtcaagaacgaagataaaatggaatttagccgaatattggaggccatcaaggcaaacttcaatgataagtatgatgagtataggaagaagtggggtggtggaatcatgggatcaaaatcacaagcaaagaccaaggcaaaagagagagttcttgctaaagaggctgctcagaggatgaattagaaagagtatttggtaatttttgagattttgagggtttttttctaaacataaattattatggtactcttcagattattcttcctatttttccacttttgggagttcaagtacttgtatctgtttgtttttgtaatcatgtatgcaatgttttctatgttgtttggta

SEQ ID NO: 4298 - DNA, 909 bp, Flaveria ramosissima
ttcaatctcaacgctcagaaatggctccgaagaagggtggaaagccagtggcaacaaagaagaaaacggagaaagtggtgaatccgttgtttgagaggaggccgaagcagtttggaattggtggagcattgccaccgaagaaggatctgcatcggttcgtacgatggccccaagttgtacgcattcagaggaagaggaggatcctcaagcagcggttgaaggttccacctgctttgaatcagttcaccaaaacccttgataagaatctcgctaccactttgttcaagatgctgctcaagtacaggccagaggataaggcggctaaaaaagaccgcctccagaaaagagcccaggctgagtctgaaggaaaaactgttgaagcaaagaagcctattgttgtgaaatatggtctcaatcatgtcacatatctcattgagcagaacaaggcacaattggttatcatcgctcatgatgttgatcctattgagttggttgtctggctccctgctctgtgcagaaagatggaaatcccgtactgcattgtcaaggggaaatctcgattgggaactattgtccatcagaaaacagcagcagctctatgcttgactaccgtaaagaacgaagataagatggaatttagcagaattctggaagccattaaggccaatttcaacgacaagtatgacgaatacagaaagaagtggggtggcgggataatgggttccaaatctcaggcgaaaacaaaggccaaagagagggttttggcaaaggaggctgctcaaaggttgacttagatcccttagtaatgtactgtatgcatttgaggttgttgagagctttgcctttagaaacttatgttttagaattctatttggttgcttgatacttttggaagttcaaatatttgat

SEQ ID NO: 4299 - DNA, 788 bp, Flaveria ramosissima
tctcagcttttagccatggctccaaagaaaggaggaaagccagtagcaacgaagaagaaaacgaaggtggtgaatccgttgttcgagaagaggccgaagcagtttgggatcggtggagcattgccaccgaagaaggatctgcataggtttgtcagatggccgcaagttgttcgcattcagaggaagaggaggatcctcaagcagcggttgaaggtgcctcctgctttgaatcagttcaccaaaaccctagataaaaatctcgcaaccaacttgttcaagatgctgctcaagtaccgaccagaggataaggccgcaaagaaggaacgtcttcaaaaacgagctgctgcagagaacgaaggaaagacagttgaagcaaagaagcccattgttgtgaaatatggtctcaatcatgtcacatatctcatcgagcagaacaaggcacagttggtcatcattgctcatgacgtggacccaatcgagttggttgtctggcttcccgctttgtgcaggaagatggagatcccttactgcattgtaaagggaaaatctcgacttggagctattgttcatcagaaaaccgcagcagctctgtgtttgactacagttaagaacgaagataaaatggagtttagcagaatcctggaagccataaaggccaacttcaatgacaagtatgatgagtacaggaagaaatggggtggtggaataatgggttccaaatcacaggcaaaaacaaaggcaaaggagagggttttggccaaagaggctgctcagaggttgaattagag

SEQ ID NO: 4300 - DNA, 1131 bp, Lactuca sativa
atttttggaaaaacagagcaaggcccaccggcccaacccactctagatttgcgtaaaaaccctaaaaactccatcttccattgtctaccttctcgtcgctgtattggaacttcggatctccaactttcatcaatggctccaaaaaagggtgggaaggcggtcgcaacgaagaagaaaacggagaaggtagctaaccctttgttcgagaaaaggccgaaacaattcggcataggtggagcattgcctccaaagaaggatcttcacagatttgtgcgatggccacaagttgttcgtattcagaggaagaggaggattctcaaacagcgtttgaaggttccacctgctcttaatcagttcaccaagaccctcgacaagaatctagcaacaactttgttcaagatgcttctcaagtacagacctgaggataaagcagcaaaaaaggaaagacttctgaaaagggctcaagctgaatctgaaggaaagacggttgaagccaagaagcccattgttgtcaaatatggtcttaatcatatcacctatcttattgaacagaacaaggctcaattggtgatcattgctcatgatgtagaccccattgagttggttgtctggcttcccgctttgtgcagaaagatggaaatcccttactgcattgtgaagggaaaatctcgtttgggaactattgttcatcagaaaactgcagctgctctgtgcttgactacagttaagaatgaagataagatggagttcagtagaatcttggaagccatcaaggccaattttaatgataagtatgaggagtacagaaagaagtggggtggtggaataatggggtctaaatcacaggctaaaaccaaagcaaaagagagggttcttgctaaggaggctgctcagagattgacataaatacccttcattatctaaatacccttcttatatgttttcaaaggcaagatacatgagtttgattatgtcacagttttattcagttttggttggttatattagcaagcaacaagtcactattgattatgttatgcattattttttgtgttcttagtttttgttcttaactgggccaatcctccctctctctatcttcactccttgagtatcatttcccatctgcca

SEQ ID NO: 4301 - DNA, 1154 bp, Podocarpus macrophillus
aggaattccagcaggggaagcgacgagaagagcggaaagcgagggcggcgatccaccttgaaaccctgcaatggctccaaaaagaggggttaaggcccccgttgctgcaaagaaaaaggtacccaaggtcgtgaatccattgtttgagaagcggcctaaacagttcgggattgggggagcattgccgccaaagaaggatttgcatagatttgtgaaatggcccaaggttgtccgtatccaaaggcagcgcaggatcctcaagcagcgcttgaaggttcctcctgcgctcaaccagttcaccaaaaccctcgacaaaaatcttgcatcaaaccttttcaagatgcttttgaagtataggcctgaagacaaggctgcaaaaagggaaaggcttctgaaaagggctcagacagaggcttcaggagggactgttgaagttaagaagccaattgttgtgaaatatggtatcaatcatgttacttaccttattgagcagagtaaagctcagttggtggttattgctcatgatgttgatcctattgagcttgttgtatggctccctgcactttgtagaaaaatgaacattccctactgcattgtcaaggggaaagcacgtcttgggacaattgtgcataagaaaaatgctactgctctgtgcttgacatctgttaagaatgaagacaagatggaatttagcaggattgtagaagcagtaaaggctaacttcaatgataagtttgatgagtataggcgacaatggggaggtggtattatgggcacaaaatctcaggctaaaacaaaggccagggaaaagcttttggccagagaagcagcccaaaggctgacctaactcgtttcttatttggaaggctttatgattaaagatggatctgattttgaggtgttggaaaagatcttggacattaaaagggtattcttagttttttgaaaacatgacaattctgcagttgtgcagaatatgaggaattaaattgttgaatatcatgatatgcttttctagggaatatggatccttatgccaatagagttggtgagggttctatgaaagtttttccttttctgatgcatttattttcaattgatatcacttttttgtggtcaatccagttcttcatagtctagcaactaggaatgct

SEQ ID NO: 4302 - DNA, 1479 bp, Populus trichocarpa
caaagatgacccgattagaaaaagaaattagggcttgggaggtctatgggcttaccttcttcagtcccacataacatggagaaaataaaaaccctaattaccaaaccagccgcttccgctacgctccagagagctctcacccttccttcacagacacatctgccagtgttctttcgatctcctcttcgacatggctcccaaaagaggtgtgaaggccccgctagcagcaaagaaaaaacctgaaaaggttgtgaatcctttgtttgagaagcgaccaaagcagtttggaattggtggtgcccttccacccaagaaggatttgactagatttgtaaagtggccacatgttgttcgtattcagaggcaaagaaggattctgaaacagcgtttgaaggtccctcctgctgttaaccagttcacaaaaacccttgacaagaaccttgccacacaactttttaagttgttgctaaaatatagacctgaggacaaggctgctaagaaggaaaggcttcttaaaagagcacaagctgctgaagaggggaagactgtggaatcaaagaagcctattgtcgttaaatatggtcttaaccatgttacttacctcattgagcagaacaaggcccagttggtggtcatcgcacatgatgtggatccaattgagcttgttgtctggttgccagcattgtgccggaaaatggaggttccttatgcaatcgtgaagggcaagtcacgtcttggagcgattgtccacaagaaaacagcatcagttttgtgccttacatcagtgaagaacgaggataaattagaatttagcaaggttttggaggcagtcaaggctaacttcaacgacaaatttgacgagcacagaaagaaatggggtggtggcatcatgggttccaaatctctggctaagaccaaagctaaggagagagtcttagccaaggaggctgcacagagaatgtcatgagcttcttctagcaagctattggagtttggacagaagctatagtcgaaagtaattttcttagattattttagcttttgctgttcccctttgatttcactattgtttttgcgatcaagttttggattgattgggtagttgaaatattttatcatgggtaacatgcctgcttttgatggagagattgaaaacctgcacctgcatgcttttattttttattttgtttttaaattttttgttgtgaataactttccggaaaatgggctgcatgattcatgcagcagttcaagggcggtggtgatttgtggagtattggccacgcttaccactcactgttgaacagaaacatcgttctggaattgatcgatcaagtacttttccgatgtgtctttggactatgatgacagccaaccttctggtgtggtctggcctgtttgggattatggtaggctggtaacggttgcggtttaaagtgtttttggttagaaatacatgataataatgtttttttattt

SEQ ID NO: 4303 - DNA, 1660 bp, Populus trichocarpa
ttttattttagataatttatgaaattagatttatttttttaatgttattctcatttaattttttaatttgtaagattttttctcattattttaatatacttgaaaaaaaatattaacaatttattttgtggcttattttttatgatatagtcaaatactaaaaaatattttctaatttatttttataatattatcaaatataaaaaattaatttatttttaaaaattaaattttttaaaaaattatttatcaacaaacaaacaaacaggcttctttcccatcatccacagtcccgtgtttcagcaaagcctgcctcaatacaaaaaccctggcactgtaataccctttagggttttcttataactcttgccgccccttgcgtcacagaagtaaagcggaagccggaaggagcttgaaactgcgcaaaaatggcaccaaagcgaggtggaaagggtccggtggttgccggaaagaagaaaccggagaaggtgccgaatccattgttcgagaagaggccgaagcagtttggaattggaggggctttgccaccaaagagggatctgagccgattcgttaagatgccgaagatggttcagattcagaggcagaggaggattctcaagatgagattgaaggttccacctaccgtgaaccagttcaccaagacccttgacaagaatctcgcatcaaacttgttcaagatgcttttgaagtaccgtcctgaagacaaagcagcaaagaaggagcgcctcttgagaaaggctcaggcagagaccgaaggaaaaactgttgaggctaagaagcctattgttgtgaaatatggtctcaaccatgtaacctatctaatcgagcagaaaaaagcccagttggttgttattgctcatgatgtggaccccattgagttggttgtatggctaccagcattgtgcaggaagatggaaatcccatactgcattgtgaagggaaaatctcgattgggagcaattgtccacaagaagactgcatcagttttgtgcttgaccacagtcaagaatgaagacaagttggagttcagcagaatcttggaagctatcaaggctaacttcaatgacaagtacgatgagtacaggaagaagtggggtggtggaatcatgggttccaaatcccaggccaagagcaaggccaaagacaaggtccttgccaaagaagctgcccagaggatgacctaggagccattttattgtatttctctcaaggattttactggtggacaatttctcgtacattttcatgtacttttgaggtttttcggcttaaaagttttgttctgtttagagtaagattttgattaaagcaaaacacgcaagtgatgcggctgtttgcggtttcctgttgctgccttttgagttggtttccgcatgacaattgagatcttgagttcttgaatgccaatagttccaggcactatagttgataaaaatatgaagcctcgatgtattagcagtgctaaaagtgaacaaataattggagaattattatctgtgctaatggcgattaaaatagatgcatttttgcatcgcttgaaatgactgaaatctctgtgccccttaccaagagggtgggtgagatgacgtgtccttcttttgagcataaaaaaattggcatcgttttctcctctcac

SEQ ID NO: 4304 - DNA, 921 bp, Helianthus annuus
tgcgaccttcttcatctcaagcttacacaatggcccctaagaaaggagtaaagctagcaacgaagaagaaaacggagaaagtggtgaatccgttgtttgagaagaggccgaagcagtttggaatcggtggagcgttgccgccgaagaaggatgtgcataggtttgttagatggccacaagttgtcaggattcagaggaagaggaggattttgaaacagaggttgaaggttccaccggctttgaatcagttcactaagacgcttgataagaatctagcaaccaatttgttcaagatgctgctcaagtacaggcccgaagacaaggctgccaaaaaggaacgccttttgaaaaaagctcaagctgagtctgaaggaaaaactgtggaagcaaagaagcctattgtcgtgaagtatggtctcaatcacgtcacatatctcatcgagcagaacaaggcacaattggttatcattgctcatgacgttgatcctattgagttggttgtctggcttcctgcgttgtgcagaaagatggaaattccttattgcattgtaaagggaaaatctagacttggagctattgttcatcagaagactgcagcagctttgtgcttgactacagtcaaaaacgaggataaaatggagtttagcaggatcttagaagctatcaaggccaactttaacgacaagtatgacgagtataggaagaagtggggtggtggaatcatgggttccaaatctcaggcgaagacaaaggcgaaagagcgggttttggccaaggaggctgcccagagaatgaattagacaatctttgttatgtattgcatgctatatttgatatgttggagggccttgcatttagaaacttctgtttttagaactttatttggttgtttgatactttttgaattaaaatatttaatgc

SEQ ID NO: 4305 - DNA, 998 bp, Helianthus annuus
cgcggggagcccaccacgaaaccctaacctatcaaacctcatctttcttattataaacagaaaaaactcttttcaccaccgccgtctgcagaccttcttcaatctcaagcttacaacaatggccccgaagaaaggagtaaagctagcaacgaagaagaaaacggagaaagtggtgaatccgttgtttgagaagaggccgaagcagtttggaatcggtggagcgttgccgccgaagaaggatgtgcataggtttgttagatggccacaagttgtcaggattcagaggaagaggaggattttgaaacagaggttgaaggttccaccggctttgaatcagttcactaagacgcttgataagaatctagcaaccaatttgttcaagatgctgctcaagtacaggcccgaagacaaggctgctaaaaaggaacgccttttgaaaaaagctcaagctgagtctgaaggaaaaactgtggaagcaaagaagcctattgtcgtgaagtatggtctcaatcatgtcacatatctcatcgagcagaacaaggcacaattggttatcattgctcatgatgttgatcctattgagttggttgtctggcttcctgcattgtgcagaaagatggaaattccttattgcattgtaaagggaaaatctagacttggagctattgttcatcagaaaactgcagctgctttgtgcttgactacagtaaaaaacgaggataaaatggagtttagcaggatcttagaagctatcaaggccaactttaacgacaagtatgacgagtataggaagaagtggggcggtggaatcatgggttccaaatctcaggcgaagacaaaggcgaaagagcgggttttggccaaggaggctgcccagaggatgaattagacatctttgttatgtattgcatgctatatttgatatgttggagggccttgcctttacaaacttctgtttttagaactttatttggttgtttgatacttttggaattaaa

SEQ ID NO: 4306 - DNA, 801 bp, Helianthus annuus
gtctgcagaccttcttcaatctcaagcttacaacaatggccccgaagaaaggagtaaagctagcaacgaagaagaaaacggagaaagtggtgaatccgttgtttgagaagaggccgaagcagtttggaatcggtggagcgttgccgccgaagaaggatgtgcataggtttgttagatggccacaagttgtcaggattcagaggaagaggaggattttgaaacagaggttgaaggttccaccggctttgaatcagttcactaagacgcttgataagaatctagcaaccaatttgttcaagatgctgctcaagtacaggcccgaagacaaggctgccaaaaaggaacgccttttgaaaaaagctcaagctgagtctgaaggaaaaactgtggaagcaaagaagcctattgtcgtgaagtatggtctcaatcacgtcacatatctcatcgagcagaacaaggcgcaattggttatcattgctcatgatgttgatcctattgagttggttgtctggcttcctgcattgtgcagaaagatggaaattccttattgcattgtaaagggaaaatctagacttggagctattgttcatcagaagactgcagcagctttgtgcttgactacagtaaaaaacgaggataaaatggagtttagcaggatcttagaagctatcaaggccaactttaacgacaagtatgacgagtataggaagaagtggggtggtggaatcatgggttccaaatctcaggcgaagacaaaggcgaaagagcgggttttggccaaggaggctgcccagaggatga

SEQ ID NO: 4307 - DNA, 952 bp, Helianthus annuus
gaccttcttcatctcaagcttacaacaatggccccgaagaaaggagtaaagctagcaacgaagaagaaaacggagaaagtggtgaatccgttgtttgagaagaggccgaagcagtttggaatcggtggagcgttgccaccgaagaaggatgtgcataggtttgttagatggccacaagttgtcaggattcagaggaagaggaggattttgaaacagaggttgaaggttccaccggctttgaatcagttcactaagacgcttgataagaatctagcaaccaatttgttcaagatgctgctcaagtacaggcccgaagacaaggctgccaaaaaggaacgccttttgaaaaaagctcaagctgagtctgaaggaaaaactgtcgaagcaaagaagcctattgtcgtgaagtatggtctcaatcacgtcacatatctcatcgagcagaacaaggcacaattggttatcattgctcacgatgttgatcctattgagttggttgtctggcttcctgcattgtgcagaaagatggaaattccttattgcattgtaaagggaaaatctagacttggagctattgttcatcagaagactgcagcagctttgtgcttgactacagtaaaaaacgaggataaaatggagtttagcaggatcctagaagctatcaaggccaactttaacgacaagtatgacgagtataggaagaagtggggtggtggaatcatgggttccaaatctcaggcgaagacaaaggcgaaagagcgggttttggccaaggaggctgcccagagaatgaattagacatctttgttatgtattgcatgctatatttgatatgttggagggccttgcatttagaaacttctgtttttagtaactttatttggttgtttgatactttttgtaattaaaataatttaattagctggaggttgtcttagttttttaaggtttt

SEQ ID NO: 4308 - DNA, 894 bp, Helianthus annuus
tcttcttcatctcagcttacacaatggccccgaagaaaggagtaaagctagcaacgaagaagaaaacggagaaagtggtgaatccgttgtttgagaagaggccgaagcagtttggaatcggtggagcgttgccgccgaagaaggatgtgcataggtttgttagatggccacaagttgtcaggattcagaggaagaggaggattttgaaacagaggttgaaggttccaccggctttgaatcagttcactaagacgcttgataagaatctagcaaccaatttgttcaagatgcttcttaagtacagacctgaagacaaggcggccaaaaaggaacgcctcttgaaaaaagctcaagctgagtctgaaggaaaaactgttgaagcaaagaagcctattgtcgtgaagtatggtcttaatcatgtcacatatctcattgagcagaacaaggcacaactggttatcattgctcatgatgttgatcctattgagttggttgtttggcttcctgcgttgtgcagaaagatggaaattccctactgcattgttaagggaaaatctagactcggagctattgtccatcagaagactgcagcagctctgtgcttgactacagttaaaaacgaagacaaaatggagtttagcaggatcttagaagctatcaaggccaactttaacgacaagtatgacgagtataggaagaagtggggtggtggaatcatgggttccaaatctcaggcgaagacaaaggcgaaagagcgggttttggccaaggaggctgcccagaggatgaattagacatctttgttatgtatcgcatgctatattttatatgttggagggtcttgcatttagaaatttctgtttttagaactttttttggttgtttgatactttt

SEQ ID NO: 4309 - DNA, 906 bp, Helianthus annuus
cttcctccttcatctcagcttacacaatggcccctaagaaaggagtaaagctagcaacgaagaagaaaacggagaaagtggtgaatccgttgtttgagaagaggccgaagcagtttggaatcggtggagcgttgccgccgaagaaggatgtgcataggtttgttagatggccacaagttgtcaggattcagaggaagaggaggattttgaaacagaggttgaaggttccaccggctttgaatcagttcactaaaacgcttgacaagaatctagcaaccaatttgttcaagatgctgctcaagtacaggcccgaagacaaggctgctaaaaaggaacgccttttgaaaaaagctcaagctgagtctgaaggaaaaactgtggaagcaaagaagcctattgtcgtgaagtatggtctcaatcacgtcacatatctcatcgaacagaacaaggcccaattggttatcattgctcatgatgttgatcctattgagttggttgtctggcttcctgcattgtgcagaaagatggaaattccttattgcattgtaaagggaaaatctagacttggagctattgttcatcagaaaactgcagcagctttgtgcttgactacagtaaaaaacgaggataaaatggagtttagcaggatcttagaagctatcaaggccaactttaacgacaagtatgacgagtataggaagaagtggggcggtggaatcatgggttccaaatctcaggcgaagacaaaggcgaaagagcgggttttggccaaggaggctgcccagaggatgaattagacatctttgttatgtattgcatgctatatttgataagttggaggaccttgcctttagaaacttctgtttttagaactttatttggttgtttgatacttttggaattaaa

SEQ ID NO: 4310 - DNA, 998 bp, Tabernaemontana elegans
ccgtttttgagaaaccctagtcgcagtcgcagaaggaaaatggctccaaagaaaggcgcaaagcttccagcttcagttgctaagaagaaaacggagaaggtggtcaatcctttattcgaaaagcgtccaaaacagttcggaattgggggagctctgccacctaagaaggatcttaccagatttatcaaatggccccaagttgtccgcattcaaaggaagcgcaggatcttaagacagcgtttgaaggttcctccagccatcaaccagttctccaagacccttgacaagaacctagccacaaatctgttcaagatgcttctcaagtacagacccgaggataaagctgctaagaaagagcgcctgctgaaaagggctcaggctgaagctgaagggaaaacatctgaagtaaagaagcctattgttgtcaagtatggtctgaagcatgtgacatatcttgttgagcagaacaaggctcaattagtggttattgctcatgatgtggacccaatagagttagttatttggcttccccatttgtgtaggaagatggaaattccttactgcattgtaaagggaaaatcacgactgggggccattgtacacaagaaaacagcttcagttttgtgcttaacatctgtcaagaatgaagacaagttagagttcagcaagattcttgaggctattaaggcaaatttcaatgacaaatttgatgaaaatagaaagaagtggggtggaggcattatgggttcgaaatctcaagccaaaaccaaggccaaagaaaggcttcttgccaaagaagctgctcagaggatgtcgtagaatgttttttcatttgtagtatgatttgtggagagagcaggcaaacgtttttgttactacattgttgttccctctagttaagcttcttggaatttacatttgaatttaagacacattattgcttcgagtcttttgacataaatgcattttaggctttttatttcattatggttggtaat

SEQ ID NO: 4311 - DNA, 1008 bp, Tragopogon dubius
gttcagggttcatcgtcatcgccgtttcgaagccgtgaataccagttttcacaaatggctccgaagaagggtggaaagccgattgcaacgaagaagaaaacggagaaggtggtgaatcctctcttcgagaagaggccgaaacagtttgggatcggtggagctttacctccgaagaaggatctgcacagattcgtaagatggccccaagttgtccggattcagcgaaagaggaggatcctcaagcagcgtttgaaggtcccaccagctttgaaccagtttaccaaaacccttgataagaatctagcaacgaccttgttcaagatgcttctcaagtacaggccggaggataaagcagccaaaaaggaacgcttattgaagagagcccaggctgaatcagaaggaaagaccaccgaagctaagaaacccattgttgtgaagtatggtttgaaccacgtcacataccttatcgaacagaacaaggcacagctggtgatcattgcccatgatgttgacccaattgaattggttgtatggcttcctgctctctgcagaaagatggaaatcccatattgcattgttaaggggaaatctcgtttaggaactattgttcaccagaaaactgcagcagcattgtgtttgaccacagtcaagaacgaggataaaatggaattcagcagaatattggaggctatcaaggcgaatttcaatgataagtatgaagagtacaggaagaagtggggtggtgggataatgggttcaaagtcacaggcaaaaaccaaggcgaaagagagggttcttgctaaggaagctgctcagaggatgaattagagagtgattttggtaatgtattatttatggttttagaatcgttatttggagttttgttgtccatttttgaacttttggaaggacaagtattcactttttacttgcttatgtttcttgtatgtgtttggtttttggatttttgaccgttaaatgcgagtttcttaccaaaaaaaaaaaaaa

SEQ ID NO: 4312 - DNA, 921 bp, Tragopogon dubius
ggggtttttccagacctccaatcatcaaattttagacatggccccgaagaaaggtggaaaggcagtagcaaccaagaagaaaacggagaaggttgtcaatccgttgttcgagaagaggcctaagcagtttggaattggtggagcattgccacctaagaaggatctgcacagatttgtaagatggccgcaagttgttcggattcagaggaagaggaggatcctcaagcagcgtttgaaggtcccacctgctttgaaccagttcaccaagacccttgacaaaaaccttgccactacccttttcaagatgctgctcaagtacaggccggaagataaggctgccaaaaaggaacgtcttctcaaaagagctcaggctgagtctgaaggaaagactgccgaatccaagaagcctattgtggtgaagtatggtctgaatcacgtcacttatctcattgagcagaacaaggctcagttggttgtgattgctcatgatgtcgatccgattgagttggttgtctggcttccagccttgtgcagaaagatggaaatcccttactgcattgttaaaggaaaatccagacttggaaccattgttcatcagaaaactgcagcagctttgtgtttgaccacagtgaagaacgaagataagatggagttcagccgaatattggaggctatcaaggctaacttcaatgataagtatgaggagtataggaagaagtggggtggtggaataatgggttccaaatcccaggccaaaactaaggctaaggagagggttttggccaaggaggctgctcagaggatgaattaagggacaactttggagtttagaaacttttcttgtttttagaactatatttggtttggaagttggaaaagatacttgttgttttgacttattttaatcccatcttattcaat

SEQ ID NO: 4313 - DNA, 1122 bp, Tripterygium wilfordii
tctctagggtttagtatcgccgttgcagcaagagcaggcgaaaaatggccccaaagagaggagggaagttggctgctacctcagctaagaagaaaactgagaaggtagtgaatccgttgtttgagaagcgcccaaagcagtttggtattggaggagctttgcctccgaaaaaggaccttacccgatttgtcaaatggccgaaagttgttcgcattcaaagaaagaaaaggatcctcaagcaacggttgaaggtcccacctgcattgaatcaattcaccaagactctggacaagaatcttgcttcaagtctgttcaagttgcttctcaagtacaggcctgaggacaaagctgcaaagaaggaacggcttttgaagaaggcccaggctgaagcagaaggaaaaactgttgaggctaagaagcccattgtcgtgaaatatggacttaaccatgttacctaccttattgagcagaacaaggcccagttggttgttattgctcatgatgtagaccctgtggagttggttgtgtggcttcctgccttgtgcaggaagatggagatcccttactgcattgtcaaggggaaatcacgattgggaacaattgtccacaaaaagacagcagctgccttgtgtttgaccacggttaagaatgaggataagttggagttcagtaaaatactcgaggccatcaaggcaaacttcaatgacaagtatgacgagtacagaaagaagtggggaggtggcatcatgggctccaaatcacaagccaagagcaaggccaaagagcgacttcttgccaaggaagcagcacagaggatgaactaggttgagtatcagagtcttagcgggatatttcgttctgttatttttgttttattgttctgttaaaagcaatggcggatgaagttagcttaaaaactctctcaccctctagccatgcgaatgggttattcactttcaggcctcctgttgggctctaaactgcagcatttgttttgtctatgttcctattgccatctcattttagggtttagcttctgttaggctctttacatatgctaaactatagcatctgttttgtctatgttactgttgctatcatattaggcatatatacaggact

SEQ ID NO: 4314 - DNA, 1055 bp, Tripterygium wilfordii
gttactaaaccctagctagggtttagtaacgccgttgcagcaagagaagccgcaaaatggccccaaagagaggagggaagttggctgccacatcggctaagaagaaaactgagaaggtagtgaatccattgtttgagaagcgcccaaagcagtttggtatcggaggagctttgcctccaaaaaaggaccttacccgatttgtcaaatggccaaaagttgttcggattcaaagaaagaaaaggatcctcaagcagcgattgaaggtcccacctgcattgaatcaattcactaagactctggacaagaatcttgcatcaagtctgttcaagttgcttctcaagtacaggcctgaggacaaagctgcaaagaaggaacggcttttgaagaaggcccaggctgaagcagaaggaaaaactgttgaggctaagaaacccattgtcgtgaaatatggacttaaccatgttacataccttattgaacagaacaaggcccagttggttgttatcgctcatgatgtagaccccgtggagttggttgtgtggcttcctgccttgtgcaggaagatggagatcccttactgcatcgtcaaggggaaatcacgattgggaactattgtccacaaaaagacagcagctgccttgtgtttgaccacagttaagaatgaggataagttggagttcagcaaaatacttgaggccatcaaggcaaacttcaacgacaagtacgatgagtacaggaagaagtggggaggtggcatcatgggctccaaatcacaagccaagagcaaggccaaagagagacttcttgccaaggaagccgcacagaggatgaactaggtcgagtttcagtcttagagggatgttttgttctgttatttctgttttcttgttttgttacaacaattctgatgtagttggcttaaaaataactctcattatcaccctccagagtggggggttttccattcactttcaggcctcatgttaggctccttatatatgctaaactacaacatttgtttgcaaatttgagattatgacatatgagttgacatt

SEQ ID NO: 4315 - DNA, 3631 bp, Ricinus communis
gcaacaaaaaatagcagaatttcaattgggtgaaaaagttgacgtgaaaaagctggttagcttctgaacatcgcagcaacctaatttaaaaaagaaaaagcgaaaaccaattttacttttttcagattctctcatttccatttcaattctcacaccaaattcagtgaaaaaacaacaacaacagcactgtcgataaagatatagataacaagaattaaaaaaaaaaaaaaaaagaagctatttgatcgatcgacatcggcgatcgtcgtcgtcatcatcatcatgtcgttttcattcttcaagccgtcaaggcctaaaacgccgttagaggtggtgaaagcaatgaaagacagtcttatggctctcgataccaaaaccgttgttgaagttaaagcactcgagaaggcattggaagaagttgagaaaaatgttgtggcaatgagatgtcttctatgtggagacggtgaggttgaaccaaacaccgatcaggtttcacagctagtgcttgaagtctgtaaagaggatgttctcgctcttatgattcacaaacttcctaatttgggatgggaagcaagaaaggatttagtccattgttggtctgtgttgttgaagcaaaaggttgattccaaatattgctctgttgaatacatagagaatcattttgaattactggactttctggtcgtctgctatgataacaaggaaattgccttgaattgtggactcatgttaagggagtgcatcaaattttcatcacttgcaaaatacatattagagtctgcaagctttgagttgtttttcaaatttgtggaattgccaaactttgatgttgcttctgatgccttctctactttcaaggatttacttattaaacatgacactgtggttgctgaatatctaactgctcattatgatgagttctttgatctgtatgaaaaacttctgacatccccaaattatgtgacaaggaggcaatcattaaagcttctctcggattttcttttggagcctccgaattcccatataatgaagcgctatattttagaagttcgatacttaaaagtcatgatgacattgttgaaggactccagcaaaaatattcagatctcggcttttcacattttcaaggtctttgttgctaatcctaacaagccacgagaagttaaagtaattttagcaaaaaacaatgaaagactggtagaattgcttaatgatctttctgttggaaaaggtgcagaggatgaacaatttgaagaagaaaaagaactgatcatcaaggaaattaaaagattatcacgccagccaggtgcggacagctaggtacttctcaaacagctggtttctccttttctacggatatcctgtcttgaggttcatgctaattttacgtgatgagttcctggaattgccgtctgccaaaaacagggttcaggagggtatctcaaagcactagtagtagagatgtgtgcttgtaatcttttttgcacagaagtagtactgaacacattcacactatctgacaaagcatatttaaattgttggtttctatccccaacattatattcttgcttctggccatgtttgtgcaacactgatgcgcctaaggcatggtactgcttgtaagcaaatggtaaattttgctacgctttctcggcctcaagactggtgtttgtaacattgaaaaattcatatacggaatattttcaatggattgctggagtttggcatgattgtttcgtattacgtttgcatggcttcatctgaatgtaagctttgggcggagagagaaatgaagagattgctgcagcccgcgagtagaggtcagatagaggacggacacaagggatttacatgggcatatatgtttgactcgtggagtgctacgtgccatttaataccagcccatgcttgtccgcctcaaaacacaaatggagtgacctatccgaatttatcgagcaccagtgcggcccttcacctcacaagcgggtgatatcatttgaagagtatttgaattgcaataacaatgctagtcatagctttgatgaagcacaataatcactatcccaattcacaaccgataaaaagaagaaataagtagcagtaatactagttgaatctttttgaagaaacttaaattccaatctcgtatccaaacagagaatggaccaatattgaaggaatgaaacctttacacgtcattaatgctattttgaatattaattaacagaattctaaaactacgacctttataaacagtgggtcatccaacttttgatattgtagcccagaaaactttttatagatagtgtagttcaggcccaagaaaggtccaaaactgctagggttttatcattttctaactcagtagccgtcccttgttccctcttcttctttttcccttgttatatttgtttcttccgccctgctgctgtttttctttttcgaagctacgtatccactttccagttgaaggatccgggcacgttatggctcccaaaagaggtgtgaaggccccagtattgggaaagaagaaacctgaaaaggttgtcaaccctttgtttgagaagcggccaaagcagtttggtattggtggtgcactgccgccaaaaaaggacttgactaggtttgtcaagtggcctcatgttgttcgcattcagagacaaaggaggattttgaagcaacgtttgaaggttcctcctgctgttaatcagttcaccaaagcactggacaagaaccttgctacacaactcttcaagttgttgctcaaatatagacccgaggacaaggcagctaagaaggaaaggcttcttcaaagagcacaagctgaagctgaggggaaaactgtggaatcaaagaagcccattgttgttaagtatgggcttaaccatatcacctacctcattgagcagaacaaggcccaattagtggttatcgcacatgatgttgatccaattgagcttgttgtatggttgcctgccttgtgccggaaaatggaggttccttatgcaattgtgaagggcaagtcacgtcttggagcgattgtccacaagaaaacagctgctgctttgtgcctcacatcagtgaagaacgaagataaattagaatttagcaagattttggaggcagttaaggccaacttcaatgacaagtttgatgagcaccgcaagaggtggggcggtggcattatgggctccaaatctcaggccaagaccaaagctaaggagagactcttggcaaaagaagctgcacaaagaatgaattgagctcctcgaagttctatgcaaaaagaactttaggaaggcagaattttggcattttcgcatggatttgtttttcatggacaagtttttgcattgatcttgtagctcagatattcgttatattaacttgattttggctggagaaatgagtgtttattaaatgttgttcaatatcagcactgcaccaagttatgggcatagaatcatacccacgaccgaccgtaattggatgacacaaatgccgtttcagattaagagactgtcacattgataaatattctttcataaataaatttttatgaacaaaatttaaaatttatgtatttagctgaaacatttgttctttttatttacaatacataaaaggtcag

SEQ ID NO: 4316 - DNA, 1020 bp, Catharanthus roseus
tttctagattatctcctctcaaaccttgcagagtagcagcagagatggctccaaagaagggtgccaagcttccggtgtcagcggcgaagaagaagcctgagaaggtcgtcaatccactcttcgagaagaggccgaagcagtttggtattggtggagctttgccaccgaagaaggatcttaccagattcgtgaaatggcctcagaatgtcaggatccagaggaagaagaggatcctgaggatgcgattgaaggttcccccagccatcaatcaattctctaaaactcttgataagaatttggcaagtagtctgtttaagatgctacttaaatacagacctgaagataatgctgcaaaaaaggagcgcctgctagaaaagagctcaagctgaagcagatggtaaaacagccgatgcaaagaagcccattgttgtgaagtatggtctgaagcatgtgacctatctgattgagcagaacaaggcacaattagttgttattgctcacgatgtggatccaattgaattggttgtttggctcccacatctctgcagaaagatggaaattccatactgcattgtgaaaggcaaagcacggcttggatctattgtgcacaagaaaactgcttcagtgttatgcctaacctccgtgaagaacgaggataaattggatttcagcaaaattcttgaagctatcaaggctaatttcaatgataaatttgatgagcaaaggaagaaatggggtgggggtgtgatgggctcgaaatcccaagcgaaaaccaaggccaaggaaaggcttcttgccaaagaagctgcccagagaatgtcttgattggcattaaccctctaatgtcttgtgttcttctattgattacttttgtagtgttttaaatttatgtttagtagtgttatgaattttagagagacgatatttattacgattaaagaagttttgtctgagttgcattttcaattattacttgtggatacaatggagaggaattcatggtagcagaattgatttgta

SEQ ID NO: 4317 - DNA, 969 bp, Lippia dulcis
tttcgtcgaagaagaaacagcagcagcagagaaatggctccaaagaagggcgctaagcttccggtcgccgccaagaagaaggttgagaaagtcgtcaacccactcttcgagaagaggccgaagcagttcgggatcggcggcgctctcccgccgaagaaggacctccacagattcgtgagatggccccaagtcgtgcgcattcagcgcaagaagatgatcctcaagcagcgcttgaaggtgccgccgccaattcaccaattctccaaaaacattggacaagaatttggcgactagtctattcaagatgatcctcaaatataggcctgaggacagagctcagaagaaagacaggcttttgaagagagctcaagctgaggctgagggcaaaacccccgagagtaagaagccaattgtggtgaaatatggtttgaaccatgtgacttacctcattgagcagaacaaggcccagttggttgttattgcccatgatgttgatcccattgagttggttgtgtggctccctgccttgtgcagaaagatggagatcccgtactgcattgttaagggcaaagctcgattgggaagcatagtacacaagaaaactgcttctgtgctgtgcttgacctcagtgaagaacgaggacaagatggaattcagcaaaattctcgaggccatcaaggccaacttcaacgataagtatgatgagacgaggaagaaatggggaggtggtgtcatgggatccaagtcacaggccaagaccaaggcgaaggagagggttcttgccaaggaggctgctcaaaggatgacttaagtagctctttgttctctgtttgtcttagataatagcgtcaaatgagagatctcttattctgctattgtttttccaagatcagacatggattttgttcttcgaatgcaacctttttcttctgtttggagcacctatccttcagactatctaaaaaagaa

SEQ ID NO: 4318 - DNA, 1033 bp, Sarracenia psittacina
gcttcgccgtctgctagccttcgtcctgccgctgagtccagaagcgacccagaaatggccccaaagaaaggtgtcaaaccagttgcagcagctaagaagaaaccggagaaggtagtgaacccgctgtttgagaagcgtccgaagcagtttgggataggaggggcattgcctccgaagaaagatctgcaccggtttgtgaagtggccgaaggttgttcaaattcagaggaagaggaggattctctgccagcgcttgaaggtcccaccatcattgaaccaatttaccaagaccctcgataagaacctcgctacaaatctattcaagatgcttctcaagtacaggcctgaagataaagccgcaaaaaaagagcgccttttgaaagcagctcaagctcaggctgaaggaaacctctcgagtctaaaaagcctattgttgttaaatatggtctcaaccatgtcacctacctcgttgagcagaataaagcacagttggttatcattgctcacgatgtggacccaatagagctggttgtctggcttcccgcactgtgcaggaagatggaaatcccatactgcattgtgaaaggaaaagctcgattgggaacgattgtccataagaaaacttcatcagttttatgcttaacaactgtcaaaaatgaagacaagatggaattcagcaaaatcttggaggccatcaaggccaacttcaatgacaagtatgatgagaacaggaagaagtggggtggtggtatcatgggttccaaatctcaagccaaaaccaaggcaaaagagaggcttcttgcaaaggaagctgctcagaggattagctaagggacttgacaagatatatacaatcttgtttgttaggatgagaggttatttgagcacattctttgctgctgaattttggtttattgttatccagatgatagactgtggagtaattgttttgtttgcgtcgatgtcaagtcatgttttggacaatagttaatgcaaatggtttgcatttgaggttttctttcttatatgtttta

SEQ ID NO: 4319 - DNA, 1313 bp, Sorghum bicolor
cgtggcccggaagacgctcctataaatccgccgctcggcttcaaagctcgtgtcgccgccgccaccactcgcccagcctctcccacccccgtcgtcaccccgctcgctcgcccgaaatagccaccggcaaaatggcccgaagagaggcggcaaggcgccggtccccgccaagaagaaggcagtggtatcgaatccgctgttcgagaagaggccgaagcaattcgagctcggcggcgcgcttccgcccaagaaggacctccaccacttcgtcaagtggcccaaggtcgtgggcatccagcgctagtgccgcatcctcaagtagcgcctcaaggtgcccccggcgcttaaccagttcacccgtaccctcgacaagaaccttgcaacaaacttgttcaagatgcttcttaagtactgccctgaggacaaagctgccaagaaggagaggcttttgaagagggcccaggctaaaactgaactattgaggcaaagaaaccaattgttgtgaagtatggccttaaccatgtgacttatctcattgagcagagcaaggcccaactagttgtcatagcccatgatgttgatccgattgagctggtcgtttggctcccagccctttgcaggaaaatggaggttccatactgcattgtcaagggaaaagcacgccttggatcgattgttcacaagaagaccgcgtctgttctttgcctgaccacagtcaagaatgaggacaagcttgagttcagctagatcctggaggctatcaaggccaacttcaacgacaagtttgatgaggtcaggaagaagtggggtggtggtatcatgggctccaaatcacaggacaaaccaaggccagggaaaagctgcgcagcggatgacctaagtcacgccctgttaaatttatcttgtactccttgcgaattgcgatcgtgtgcaatcttagtggttgtcagatctagttttgagagttttgctcctgagaccgaccttgctagaaagacatcatgtaagaattccaagtttttgttcttcaccacctagttcatgtgacaacttctataatggttatgaatctcctgtttatgtttatgaccgtaacaattttagaattacaaaaggttctgccatgttatcctgtgttgctgctggaaattggcattggtttgcacgatttgacctccataatacgcaagaatgtagccgaaggttttcctcccaagcgagatgaaatggcttgattttgatttctgctaccctgtgcttgtattgctagattcactgttgcacttgtaatggtatgtgattgactgcaaatg

SEQ ID NO: 4320 - DNA, 1051 bp, Tragopogon dubius
ttgtatgcgtagaaaccctaatatatcctcgcttcgtttgcgttcttcttcgtcgctgttttgaaacctgaatctcaactatcatcaatggctccaaaaaaggtgcgaaggcggtcgcaaccaagaagaaaacggagaaggtagtgaaccctctgtttgagaagaggccaaagcagtttggcataggcggagcattgccaccgaagaaggatgttcacagatttgtgagatggccacaagttgtccgcattcagaggaagaggaggattctcaagcagcggttgaaggttccacctgccctgaatcaattcaccaagaccctcgacaagaatcttgcaaccacgttgttcaagatgctgctcaaatacagacccgaggataaagcagccaaaaaggaacgtctcctgaaaagggctcaggctgagtctgaaggaaagacagctgaaagcaagaagcccattgtagtcaaatatggtctgaaccatatcacctatcttattgagcagaacaaggctcaattggtgatcattgctcacgatgtggacccaattgagttggttgtctggcttcctgcattgtgcagaaagatggaaatcccttactgcattgttaagggaaaatctcgattgggaactattgttcatcagaaaactgcagcagctctgtgtttgaccacagtcaagaatgaagataagatggagttcagcagaatcttggaagccattaaggccaactttaatgataagtatgaagagtacagaaagaaatggggtggtgggataatgggttctaaatctcaggctaaaacaaaagccaaggagagggttcttgccaaggaagctgctcagaggatgacataagtgctcttagttatatcacaattttattcagttttggttgattatattagcagcacacaagttgtaatatgtttttaatgaccaaaatgccttttattggttttcctaatatcattcttgtcttataagttaatatgtttggtgttgagattttggacatggtttatcatataagtgactgcatggtcatt

SEQ ID NO: 4321 - DNA, 911 bp, Ambrosia trifida
ccgtctgcagaccttcaatctctagctttcagaaatggccccaaagaaaggaggaaagccagttgcaaccaagaagaaaacggagaaggttgtgaatccgttgtttgagaagaggccaaagcagtttggaatcggcggagcgttgcctccaaagaaggatgtgcatcggttcgttagatggccgcaagttgttcggattcagaggaagagaaggatccttaagcagaggttgaaggttccacctgctttgaaccagttcactaagacgcttgataagaatctagcaaccaatttgttcaagatgctgcttaagtacagacctgaagataaggcggcgaaaaaggagcgccttgtgaaaaaagctcaggctgagtctgaaggaaaaactattgaaacaaagaagcctattgttgtgaagtatggtctcaatcatgtcacatacctcattgagcagaacaaggcacaattggttatcattgctcacgatgttgaccctatcgagttggttgtctggcttcctgcattgtgcagaaagatggaaatcccttactgcattgttaagggaaaatctcgacttggagctattgtccaccagaaaactgcagcagctctgtgcttgactacagttaagaacgaagataaaatggagtttagcagaatcctagaagctataaaggccaactttaatgacaagtatgacgagtacaggaagaaatggggcggtggaataatgggttccaaatcccaagcgaaaacaaaggcgaaagagcgggttttggccaaggaggctgctcagcggatgaattagatattttggtaatgtattgtatgcatttgatgtcttggttggctttgcgtttagaaacttgtgtttttagaactcttttggttgcttgatactgttggaagtt

SEQ ID NO: 4322 - DNA, 987 bp, Amsonia hubrichtii
gggttcttcttcgccgtttttttgagaaaccctaatcgcagtcgcagagagaaaatggctccaaagaaaggcgcgaagcttcctgcgtcagctgctaagaagaaaccggagaaagtggtgaatcctttatttgaaaagcgtccaaaacagtttggaattggaggagctttgcctcctaagaaggatcttaccagatttgtcaaatggccccaagttgtgcggattcagagaaagcgcaggatcttaagacagcgtttgaaggtccctccagccatcaaccagttctccaagacccttgacaagaaccttgccacaagtctgttcaagatgcttctcaagtacagacctgaggataaagctgctaagaaggagcgactactgaaaagagctcaggctgaagctgaagggaaaacacctgaagcaaagaagcctattgttgtcaagtatggcttgaagcatgtcacgtatcttgttgagcagaacaaggctcaattagtggttattgctcatgatgtcgacccaatagagttggttgtttggcttccacatctgtgcaggaagatggaaattccttactgcattgtgaagggaaaatcacgactaggggccattgtacaccagaaaactgcttcagttttgtgcttgacatctgtcaagaatgaagataaaatggagttcagcaagattcttgaggctattaaggcaaatttcaatgataaatttgatgaaaatagaaagaagtggggaggaggcattatgggttcgaaatctcaagccaaaagcaaggctaaagaaagggttcttgccaaagaagctgctcagaggatgtcttagtatgtctttttgggagggcatttgtagtatgtttttggggagagcaggaaaacatttttgttatatcattgtggttctctagtaagctttttggaatttacctttgaacttaagacgtattatttgctcaaatctttgaaatacatatgtttt

SEQ ID NO: 4323 - DNA, 892 bp, Arnica chamissonis
cagctttcagaaatggctccaaagaaaggtggaaagccagttgtaacgaagaagaaaacggagaaagtagtgaatccgttgtttgagaagagaccgaagcagttcggaattggtggagcattacctccgaagaaggatgtgcataggttcgtaagatggccgcaagttgttcggattcagaggaagaggaggatccttaagcagcggttgaaggttccacctgctttgaaccagttcaccaagacgcttgataagaatctcgcaaccaatttgttcaagatgctgcttaagtacaggcctgaggataaggcagctaaaaaggaccgcctccagaaaaaagctttggctgagtctgaaggcaaaactgtggaagcaaagaagcctattgttgtgaagtatggtctcaatcatgtcacatatctcattgagcagaacaaggcccaattggttatcattgctcatgatgttgatcctattgagttggttgtctggcttcctgcattgtgcagaaagatggaaatcccttactgcattgttaagggaaaatctcgactgggagctattgtccatcagaaaactgcatcagctctgtgcttgactaccgtaaaaaacgaagataaaatggagtttagccggatccttgaagccatcaaggccaactttaacgacaagtatgatgagtataggaagaagtggggtggtgggataatgggttcgaaatctcaggcaaaaacaaaggctaaggagagggttttggccaaggaggcttctcagagaatgacttagacatcttggtaatgtagtgtgtatgcatttgagatcttggaaaactttgcatttagaaacttttgtttttaaactccatttggttgcttatttatgtttgacttgt

SEQ ID NO: 4324 - DNA, 1102 bp, Vaccinium corymbosum
cgttgttgtagttagggttttcgcgtcgtctgctctacactatactagtggagaggggcaaaggaaagaaccaatcttgcagaaatggctccgaagaagggtatcaaaccagcagcagcagccaagaagaaaccggagaaggtagtgaacccggtttacgagaagcgaccgaagcagtttgggataggaggggcattgcctccaaagagagatcttcacaggttcgtgaagtggcccaaggttgtacagattcagaggaagaaaaggatcctaaaccagcgcctgaaggtcccaccacctttgaatcagtttaccaagacccttgacaagaacctcgcaacaagtctcttcaagatgcttctcaagtacaggcccgaggataaggcagcaaaaaaggagcgccttctgaaaagggctcaggctgagactgaaggaaaacctattgaggctaaaaagcctattgttgtgaaatatggtctcaaccatgtcacctacctcattgagcagaacaaagcacaattggttgttattgctcatgacgtggacccaatagagttggttgtctggcttcctgcgttgtgcagaaagatggagatcccatactgcattgtcaaaggaaaagctcgattaggatcgattgtccaccagaaaactgcagcagttctgtgcttgaccactgtcaagaacgaggacaagttggagttcagcaagatcttggaggctattaaggctaacttcaatgacaagtacgatgagtataggaagaagtggggcggtggtatcatgggttccaaatcccaagccaaaaccaaggccaaggagaggcttcttgctaaggaagttgctcaaaggatgggctaagagagttaaccatatgatgaagccattcgacaacttgcttctatcctaaatttttgtttgtgtcaatgttacccacataataactttcctagtttttgttatttttgttgagggcaagtcgattttctcctctaggcaaataactggaggaatctgatcgattttatgattaatatcttgaggcagctgttattaagacaaaagaaacaaacaaatgttcggccggcctcggtctctagaa

SEQ ID NO: 4325 - DNA, 2320 bp, Ricinus communis
tatacaaaatcagaaagcaaatagtaaaaagtacagggagtaaatagaaaaaataatttggggtttgggcttgtacccttggctttcgcatgacaaataaaaaccctaggtgccgctttcctgctcttctacttcaagcacgcccaccatttcctcaaagaggggctttgatctgcacgtctccttacccacatggctcccaaaagaggtgtgaaggccccagtattggcaaaaaagaaacctgaaaaggttgtcaaccctttgtttgagaagcggccaaagcagtttggtattggtggtgcactgccgccaaaaaaggacttgactaggtttgtcaagtggcctcatgttgttcgcattcagagacaaaggaggattctgaagcaacgattgaaggttcctcctgctgttaaccagttcaccaaagcacttgacaagaaccttgctacacaactcttcaagctgttgctcaaatatagacccgaggacaaggcagctaagaaggaaaggcttcttcaaagagcacaagctgaagctgaggggaaaagtgtggaatcaaagaagcccattgttgttaagtatgggcttaaccatattacctacctcattgagcagaacaaggcccaattagtagttatcgcacatgatgttgatccaattgagcttgttgtatggttgcctgccttgtgccggaaaatggaggttccttatgcaattgtgaagggcaagtcacgtcttggagcgatcgtccacaagaaaacagctgctgctttgtgtcttacatcagtgaagaatgaagataaattagaatttagcaagattttggaagcagtgaaggccaacttcaatgacaagtttgatgagcaccgcaagaggtggggcggtggcatcatgggctccaaatctcaggccaagaccaaagctaaggagagagtcttggcaaaagaagctgcacaaaggatgacttgagcttctagtgtgtagcagagagaagaagttatatgcataaagaatttcttttctgaaggctgaaattttgcattttctttttattatggattatttttcgtggacaagtttttgcattgatcttgtagctcagatacttgtcatattatcttgttattaaggattaggagggagaaatgagtatttataggcaacacttaagtttatccttcaatttattcattatctggtatttaatatgatcataaatcctgctttgctgtgttgatgatcagcattttgccatagaataatgatgaagaccagagaagatggaagtttcagattatttcaggagattttcctttgggttgaggatttgaagttactcaggactctcataaaggacattccatatgttggatatgatgcctcactgttgcaagcagttgtttcatgtgtagatgtgttacttgcttgttcagaattggctttgaatttgcagacaaccatgcttatgttgagggtagtttggagggtctggtattgttgctgttggaagagtttcttctttttgccggggttgttttctgcaacagtaatgcatgtcagaatatcctagtatgcatagttgcttctgtattagataacttaaattcttctatatggagatacagcaaccctgccactaattcacagccttctctaatatactttcctcactctgttctttacttcttgaaaccatacaggatctcaaaaggcaaacatttcaggctcttgacatgaagggctttggtacagaaatggaaaatgcagtttgtcataaagatgaagccctctttcggaaccttttatatgaaggtagtcgctcagtgggatcaactgatggatttgagctaccactaccggctactgttaattcatgctctagcaattgtaatttgccaatacaagctaccactgcattattgagttttctgaaagagaatgtcttttctcatgaatggtctcctctttttgaggatgcctgcaaaaggctaagagaggaccgcatctaatatatatattcaagctaaagcaaagaggatggtttaaccaacttgtcatgtatgattattaaaagactgacatttattatttttttataaatactaatttacaagaaataatttttttctcttttaatttataatttataattataacagtaacaactttttattttttaatttttatgtgtatttttttattattttaatttatttgtttatttattcttctaatatggtatttctttatatttaacagtagccaatgttacggactccattaatttgttcttcaattattttcattccatgagatgaag

SEQ ID NO: 4326 - DNA, 1155 bp, Cephalotaxus harringtonia
tgaatggctgggcaggagggtataaatgggttgggaggcaaaggaggaagtggaatgagaggtggtgtctgttgtctttgcgggtggagaagacgagaagaaggtgaggaagagcgccgatcgaccgtaaaacgaataatggctccaaagagaggggttaaggcccctaccgctgcaaagaaaaagatagccaaggtggtgagcccgttatttgagaaacggccaaaacagtttgggatcggaggagctttgccgccgaagaaggatttgcatcgattcgtgaaatggcccaagattatccgcatccagcgccagcgtcgcattctcaagcagcgcctgaaggtcccccctgctctcaaccagttcaccaaaactctcgacaagaatctcgcatcaaacctgttcaagatgcttctgaaatacaggccagaagataaagctgcaaaaaaggagaggcttttgaagaaggcccaggcagaggcagaaggaaaacctattgaagtcaagaagcctattgttgtgaaatacggtatcaatcatgtaacttaccttgttgaacagagtaaagctcagttggtggttattgcacacgatgtcgatcctatagagcttgttgtgtggctccctgcactttgtaggaaaatgaacatcccttactgtattatcaaggggaaagcacgacttggagctattgtgcacaagaagactgcaaccgcattatgcttgacatctgtgaagaatgaagacaagatggaatttagcaggattgttgaggcaataaaggccaacttcaacgataagtttgatgagtaccgacggcaatggggaggtggcttaatgggctccaagtcgcaggcaaaaacaaaggccaaagaaaaactcttggccaaggaagcagcacaaaggcttacttaggtttctcatcttgaatagtttatgatcatatgtttcaaatttatttggagctgtaggaaagctctggatttttaaggtacttctagcatttgcttcatagaaaacataataacaattttgcatcagggtaaagtgtccggtagaacttttatttcatctgcatttaattatcagttaatttatttttctttgcaattgttagcatatgataattcttaatgttctctactttggtttggc

SEQ ID NO: 4327 - DNA, 923 bp, Cichorium intybus
cgtttccagaccttcatctcaactttcagacatggctccaaagaaaggtggaaaggcagtagcaactaagaagaaaacggagaaggtggtgaatccgttgtttgaaaaaaggccaaagcagttcggaataggtggagcattgcctcctaagaaggatctgcacaggtttgttagatggccgcaagtggtgcgcattcagaggaagaggagaatcctcaagcagcgtttgaaggtcccacctgctctcaaccagttcaccaaaacgctagacaagaatcttgccactactttgttcaagatgcttctcaagtacaggcctgaggataaggctgcaaagaaggaacgtcttattaaaagagctcaagccgagtctgaaggaaagacagctgaagccaagaagccaattgtggtcaagtatggtcttaatcacatcacctatctcattgagcagaacaaagcacaattggtggtgattgctcatgatgtggaccccattgagttggttgtctggcttccagcattgtgcagaaagatggaaatcccatactgcattgtcaagggaaaatcccgtcttggaactattgttcatcagaaaactgctgcagctttgtgcttgaccactgtcaagaacgaagataaaatggagttcagcagaatattggaagccattaaggccaacttcaatgacaagtatgatgagtataggaagaagtggggtggtggaattatgggatcaaaatcccaggctaaaacaaaggctaaggagagggttttggctaaggaggctgctcagaggttgaattagagagactgtttttgtaatgggagctatgcttttagaaacttttttttgtttttcaaactccatttgtttgcttcgactttttaaagttaaatacttgctgtttgacttgcttaaaaaa

SEQ ID NO: 4328 - DNA, 1037 bp, Gossypium hirsutum
agggttttcctccgccgtttagatttttaattagggaagcttggaagaagaaggttcaaaaaaatgggccctaagagaggtggaaaggttgtggcacttgccaagaagaaacagccggagaaggatgttaatcctttgttcgagaagcgtcccaaacagtttggtattggaggagctttacctccgaagaaggatctgcatcgatttgtgaagtggccgaaggttgttcgaatccaaaggaagaagaggatccttaagcagaggttgaaggtcccaccagcgttgaaccagtttaccaagactcttgataagaaccttgcaacaagtttgttcaagttgcttctcaagtacaggccagaggacaaggcagccaagaaggaacgtctgttgaaaaaagcacaggctgaagccgaaggaaaatctgccgagtctaagaaacccattgtcgttaaatacggtcttaaccatgttacctaccttattgagcagaacaaggctcaattggttgttattgctcatgatgtggatcccatagagttggtagtgtggctccctgcattatgcagaaagatggaggtcccttactgcattgtcaaggggaaatctcgtttgggatcgattgttcacaagaaaactgctgccgttttgtgcttgaccacagttaagaatgaggataagttggagttcagcagagtccttgaggccatcaaggcaaacttcaatgacaaatatgaggagaataggaagaagtggggaggtggtgttatgggctccaaatcacaggccagaaccaaggcaaaggagaagcttcttgccaaggaagctgctcagaggatgacctagaaatgttcattttttcctactataatcaccattaatggtgttttctttttcttttttgattaaatgctcctttgctgtcagctgcatttgactctctttttaagtttttttttttggcagaggaataattattatcattctagtgaaaactttcaaagccaccttagtaaatgaagtctttaatttaaggttta

SEQ ID NO: 4329 - DNA, 1035 bp, Vigna unguiculata
gagcagctgcagcaatggctcccaagcgtggtggaaaagctccggttcttgcctccaagaagaagcctgagaaggttactaacccgcttttcgagaagcgtccgaagcagttcggaatcggaggagcgttgccgccgaagagagacttgactcggttcgtcaagtggcccaagaccgttcagattcaaaggaagaagaggattctgaagcagaggttgaaggttcctccagctttgaaccagtttaccaagacactcgacaaaaacctagcaacaagtctgtttaagatcctgttgaagtacaggccagaggataaagcagaaaagaaagagagacttttgaaaagggcacaggcagaggctgagggaaaaactatcgaggccaagaagcctattaatgtgaagtatggtctcaaccatgttacctacctcattgagcggagcggggcgcgacttgttgtgattgctcacgatgtggacccaattgaattggttgtctggcttccagcattgtgcaggaaaatggaaatcccatactgcattgtgaaaggaaaggctcgcttgggaacggtcgtccataagaaaacagcatctgttttgtgcttgacaactgttaagaatgaagataaattagagttcagcagagtcttggaggctatcaaggctaacttcaatgacaaatatgacgaatacagaaagaagtggggtggtggaatcatgggatccaaatcccaagccaaaacccgggcaaaggaaaagcttattgccaaggaagctgctcagaggatgtcttaggaagaatttcttatatttggttgctttgcgactgttatttagtgtgtttttaatgttactctcctttacttggtatctctttaagaacatttgtttttcacatcagctagagtatttcgtgaaaatctccagcgcaactgtccctgtttttgcacccaatattattttgattttggtagtaaacttttttacggtactcaatgaacgaactgcatgtggatgctgttgcatccaatttttg

SEQ ID NO: 4330 - DNA, 1028 bp, Cucurbita pepo
tttcttcacgctacttcgtcgccgcttatttatatttgatccctcctcggactctgccttcaccacgttcgcggaaaatggcaccaaagaaggctgttggaaaagccttggcaaaaaagaagccggagaaggtggtgaatccactatttgagaagcgtccgaagcaatttggaattggtggggcattgccgccaaagagggatttgacacggtttgttaaatggcctaaagctgttcaaattcagaggaaaaagaggattcttaaacagaggttgaaggttccaccagctttgaaccagttcactaagacccttgacaaaaatcttgcaacaaacctgttcaagatgcttttgaagtataggccggaggacaaagcacagaaaagggagcgtcttctgaagagagctcaggaagaggctgaaggcaaggcacatgatgctaaaaaacctattgttgtgaaatatggtctcaaccatgttacctacctcattgagcagaacaaagcacagctggttgtgattgcccatgatgtggatccaattgagttggttgtttggctcccagccctttgcaggaagatggaaatcccatattgcattgtgaagggaaaagcacgattgggagcgatcgtccaccaaaagactgcatcagttctgtgcttgacgaccgtaaagaacgaagataagttggagttcagcaggatccttgaggctattaaggcgaatttcaacgacaaatacgacgagtacaggaagaaatggggaggaggaatcatgggctctaagtcacaggctaaaactaaagccaaggagaggctgctcgccaaagaagctgctcaaagaatgtcttagggatcatttttatagcttgaaaaaaccatggagacttggtgttattattttgggtcgttagtttcttgagcatcagaattttgaagtgtttttgtttacttataatttgctgatttcggatatagttttgatgtagcgcagacccttcccctttgttattcatattataatgtaatt

SEQ ID NO: 4331 - DNA, 1046 bp, Cucurbita pepo
cttattttgccctagccgtctgctctccctctctgcttcagtttgccgccgcttatttatattccatccttcttctcaatctccctttcaccaggctcgggtaaaatggcgccaaagaaagctgttggaaaagccttggcgaaaaagaaggctgagaaggtggtgaacccactatttgagaagcggccgaagcagttcggaattggtggtgcattgccaccaaagagggatttgacaaggtttgtcaaatggccaaaagctgttcaaattcagaggaagaagaggattcttaagcagaggttgaaggttccaccagctttgaatcagttcactaaaacccttgacaaaaatcttgccacaaacctgttcaagatgcttttgaagtataggccagaggacaaggcacagaaaagggagcgtcttattaagagagctcaggaagaggctgaaggcaagccacatgatgccaagaaacctattgttgttaaatacggtctcaaccatgtcacctatctcattgagcagaacaaggcacagttggtggtgatcgcccatgatgtggatccaattgagctcgttgtttggctcccggccctctgcaggaagatggaaattccatactgcattgttaagggaaaagcacgattgggagcgattgtccatcaaaagactgcatcagttttgtgcttgacaaccgtgaagaacgaagataagttggagttcagcaggatcctcgaagctattaaggccaatttcaacgacaagtacgacgagtacaggaagaaatggggtggtggaatcatgggttccaagtcccaggctaaaactaaagcaaaggagaggcttctcgccaaagaagctgctcaaagaatgtcttagagatgagagttggcaactatttttgggtcatagcttcttcaatatcatcatgagagaatttagaagttttgtttacttttcttcatttgctactcatttgctgatttcagatctagttttgttgttgcagactcttttaatggttaatacttttgatctcaaatcct

SEQ ID NO: 4332 - DNA, 983 bp, Cynara scolymus
  misc_feature (23)..(23): n is a, c, g, or t
  misc_feature (52)..(52): n is a, c, g, or t
  misc_feature (376)..(376): n is a, c, g, or t
  misc_feature (466)..(466): n is a, c, g, or t
  misc_feature (640)..(640): n is a, c, g, or t
  misc_feature (856)..(857): n is a, c, g, or t
cggggcgtttcagaccttcatcncaagttcagacatgggtccaaagaaagcnggaaagccagtagcaaccaagaagaagacggagaaggtggtgaacccgttgttcgagaaaaggcctaagcagtttgggataggcggtgcattgcctccgaagaaggatgtgcataggttcgtaagatggccacaagttgttcgcattcagaggaagaggaggatcctcaagcagcgtttgaaggtcccacctgccttgaaccagtttaccaagaccctcgacaagaatctcgcaactactttgttcaagatgctgctcaagtataggcctgaggataaagctgcaaaaaaggaacgtctcctcaaaagagctcaagctgagtcngaaggaaagacggccgaagctaagaagcctattgttgtgaagtatggtctgaatcacgtcacctatctcattgagcagaacaaggcacanttggttgtcattgctcatgatgtggatcccatcgagttggttgtttggcttcctgctttgtgcagaaagatggaaatcccttactgcatagtgaagggaaaatctcggctaggagctattgtccaccagaaaaccgcagcagctttgtgcttgaccacagtcaagaacgaaganaagatggagtttagccgaattttggaggccatcaaggccaatttcaatgacaaatatgaagagtataggaagaagtggggtggtggaataatgggttccaaatcccaggccaaaacaaaggctaaggagagggttctggccaaggaggctgctcagaggttgacatagatggaaagaaagatccctttgatcatgtaatgtctgctgcatttgagnnttttgcatttagaaacttttcttcctttttttttagaacccttttggaagttaaaatacttggcttatttcaccgtcaacttgttcaattttggtcaccatttctatgcattgctaggaaaaagtc

SEQ ID NO: 4333 - DNA, 1125 bp, Euonymus alatus
ccctcgcagcctcgctagggtttagcatcgccgttgcagcaaggggaggcgcggaatggctccgaagagaggagggaagttggctgctacatcagctaagaagaaaactgagaaggtagtgaatccgttgtttgagaagcgcccaaagcagttcggcatcggaggagctttgcctccgaaaaaggaccttacccgatttgtcaaatggccgaaagttgttcgcattcaaagaaagaaaaggatcctcaagcagcggttgaaggtcccacctgcattgaatcaattcaccaagactctggacaagaatcttgcatcaagtctgttcaagttgcttctcaagtacaggcctgaggacaaagctgcaaagaaggaacggcttttgaagaaggcccaggctgaagcagaaggaaaaactgtcgaggctaagaagcccattgttgtgaaatatggacttaaccatgttacataccttattgagcagaataaggcccagttggttgttattgctcatgatgtagaccccgtggagttggttgtatggcttcctgccttgtgcaggaagatggagatcccttactgcattgtcaagggcaaatcacgattgggaacaattgtccacaaaaagacagcagctgccttgtgtttaaccacggttaagaatgaggataagttggagttcagtaaaatactcgaggccatcaaggcgaacttcaacgacaagtatgatgagtacagaaagaagtggggaggtggcatcatgggctccaaatcacaggccaagagcaaggccaaagagagacttattgccaaggaagctgcacagaggatgaactaggtcgagtatcagtgacttagacggatgttttgttctgttattttgtttgcttgttctgttcaaacaatgaccgttgtagtcagcttaaaaataactctcaccctctagccatgcgaatgggttattcactttcaggcctcctgttaggttcttttatatgctatgctgtagcatttgttttgtctatgttcctgttgccatcatgttaagcatattgacaggactttcaaatgttctttcatttcttctgaactttaacgatttggactgttgatgtggttgctatgtga

SEQ ID NO: 4334 - DNA, 1030 bp, Linum usitatissimum
tcatcatcatctgccgtcgtcgtcgacatggctcccaaaagaggtgtcaaggctccagttgcttctaagaagaagacagagaaggttgtgaaccctctgtttgagaagcgaccaaaacaatttggaataggaggtgctctcccgccaaagagggacttgactagatttgtcaagtggccccatgttgtgcgtattcagaggcaaagaaggatcctcaagcagcgtttgaaggttcctccagctgttaaccagttcacaaaggcactggacaagaacttggctacacagctattcaagctgttgctgaagtatcgccctgaggataaggctgctaagaaggagaggcttcttaagaaagcacaagctgaggctgaagggaagacggtggaatctaagaaaccgattgttgtcaagtacgggctgaatcatgtcacttatctcatcgagcagaacaaggctcaactggtcatcattgcccatgacgttgatccaattgagcttgtcgtttggttgcctgctttgtgccgcaagatggaggtcccttacgcaattgtgaagggcaaatcaagacttggagcgattgtccacaagaaaacagctgctgctttgtgccttacttctgtgaagaacgaggataagatggagttcagcaagatactggaggcagtcaaggctaacttcaatgacaaattcgatgagcaccggaagaggtggggaggtggtattatgggatccaaatctcaggcgaagaccaaagctaaagagagactcttggccaaggaggctgcacaaaggatgacctaagttcttggtctcgttgaagggagttgttctgagttttgttagctgtcttttttgtgtagtcagacgagtactcttaccagttgttgggcaagttgagatgttagtactggacacattgctgtttctgttattggcgagtgaatttatctatcttatatttcaaaccaaatttttattcagtccttgaagctggtttgcaaagttataaacttgttctcccttatga

SEQ ID NO: 4335 - DNA, 1830 bp, Gossypium raimondii
ataaatatgaaaatctcaaaatacacttatccaaataaaaaaaaagcaaaatacaatcataaatattttttaaaaaattgcaaaatgtggaaagagtcccacgaggcccacagtttgtaacagtggcccaaacattgttcatgttcttatatagcccccctagttgctttgttctttgtagggttttcctccgccgtttagatttttaattacggaagcttggaagaagaaggttcaaaaaatgggccctaagagaggtggaaaggttgtggctcttgccaagaagaaacagccggagaaggatgttaatccattgttcgagaagcgtcccaaacagttcggtatcggaggagctttacctccgaagaaggatctgcatcgatttgtgaagtggccgaaggttgttcgaatccaaaggaagaagaggatccttaagcagaggttgaaggtcccaccagcgttgaaccagtttaccaagactcttgataagaaccttgcaacaagtttgttcaagttgcttctcaagtacaggccagaggacaaggcagccaagaaggaacgtctgttgaaaaaagcacaggctgaagccgaaggaaaatctgccgagtctaagaaacccattgtcgttaaatacggtcttaaccatgttacctaccttattgagcagaacaaggctcaattggttgttattgctcatgatgtggatcccatagagttggtagtgtggctccctgcattatgcagaaagatggaggtcccttactgcattgtcaaggggaaatctcgtttgggatcgattgttcacaagaaaactgctgccgttttgtgcttgaccacagttaagaatgaggataagttggagttcagcagagtccttgaggccatcaaggcaaacttcaatgacaaatatgaggagaataggaagaagtggggaggtggtgttatgggctccaaatcacaggccagaaccaaggcaaaggagaagcttcttgccaaggaagctgctcagaggatgacttagaaatgttcattttttttcctatcaccattaatggtgttttatttttcttttttgattaaatgctcctttgctgtcagctgcatttgactctctttttatgttttttttttttggcagaggaataattattatcattctagtgaaaactttcaaagctaccttagtaaatgaagtctataatttaagctttaatatgcttttcaaatgataatcattaatgaggattgcttttaatgaaacccaaaactcgaatgaaaaattcgtgagaagttgtggttgcagcttatgaatggtaccttcagtattgtattggctgtgagtaattttgatagacaaaaattgggttagtccattaacaaaatgcgttaacttcttggtgggtacttcattgtgggaattacaaggcattaataggaagccaatccaccgatccatgatgccaaggcaaaacaccttccacagtttggtccactcgtatcaacggcaggcccccttctactattgccttcccacactcagaggctgattccaatggcattacactgatttcaacgtcacgcattttaggatcaagttgtagatgctatgactatgatcttccctttgctcttctttaagtgcccatatgcataatatgtgttgtatactgatccccaaaagcttatttcctgctgcaaaataggcaaacacccacagtaacttttttcattcatttttactcttacataatcatctaatttccatgttttcattcccccccccccccttaatttactatcaatatatttactttttcattataaaaaaaa

SEQ ID NO: 4336 - DNA, 1167 bp, Actinidia deliciosa
cagtattctcaagaaaatcaatatattttgagaccactgatattagttaactatttctaaacatatacaaacttctagaaatgccaaaaggaaaaacctcccctcgataaatgtcatctagagcaatgtggtcagtttcctttcttcgttttcgcttcgccgtcctcacaggagagagaagaaatcttcagaaatggctccaaagaaaggcgtcaaaacagttgcagcagcgaagaagaaaccggagaaggtggtgaacccgctgttcgagaagcgtccgaagcagtttgggataggaggggcattgcctccaaagaaagatctgcaccggttcgtgaagtggcctaaggttgtgcaaattcagaggaagagaaggatccttaaccagcgcttgaaggtcccaccgcccttgaaccaattcaccaagaccctcgataagaaccttgcgacaagtctatttaagatgcttcttaagtacaggcctgaggatagagcagcaaaaaaggagcgccttttgaaaagggcccaggctgaggctgaaggaaagcctattgaagcaaaaaagcccattgttgtgaaatatggtctcaaccatgtcacctacctcattgagcagaacaaagcacaattggttattattgctcatgatgtggacccaatagagcttgtcgtctggcttcccgcattgtgcaggaagatggagatcccatattgcattgtgaaaggaaaatcacgattgggaactattgtccatcagaaaactgctgccgttctgtgcatgaccactgtcaagaatgaagacaagttggaattcagtaaaatcttggaggctatcaaggccaacttcaacgacaaatatgacgagtacaggaaaaaatggggtggcggtattatgggttccaaatcccaagccaaaaccaaggccaaagagagggttctcgcgaaggaagctgctcagagaatgaactaagagacttaatcatacatatctcactagtcacttgttagttgaggttgtttgaaaaattatgagcagttttattaactgcggagttttgttttcgttgaagactgttcatgcttaattcaatagttgtattcagggggtacggattcaaagttcttaatatctttttatgctagattccgttgcttaaaaaaaaaaaa

SEQ ID NO: 4337 - DNA, 1173 bp, Populus trichocarpa
gggaggcctatgggcttagccttactctctccagtccacgtaacaaagagaaaataaaaccctaacaataaaaggcaagccgctgcagctactcttccaaggtctaaggctctaacccttcatcggcagagaactaccagggtttctctcgatctcctcttccgcatggctcccaaaagaggtgtgaaggccccgttagcagcaaagaagaagcctgaaaaggtcgtaaaccctttgtttgagaaacgaccaaagcagtttggaattggtggtgcccttccacccaagaaggatttgactagatttgtcaagtggccacatgttgttcgtattcagaggcaaagaaggattctgaaacagcgtttgaaggttcctcctgctgttaaccagttcacaaaaacacttgacaagaaccttgctacacaacttttcaagttgttcctaaaatatagacctgaggacaaggctgctaagaaggaaaggcttcttaagagagcacaagctgaagctgaggggaagactgtggaaacaaagaagcctattgttattaaatatggtcttaaccatgttacttacctcattgagcagaacaaggcccagctggtggttatcgcgcatgatgttgatccaattgagcttgttgtttggttgcctgcattgtgccggaaaatggaggttccttatgcaatcgtgaagggcaagtcacgtcttggagcgattgtccacaagaaaacagcatcagttttgtgccttacatcagtgaagaatgaggataaattggaatttagcaaggttttggaggcagtcaaggctaacttcaatgataagtttgatgagcaccgaaagaaatggggcggtggcatcatgggttccaaatctctggctaagaccaaagctaaggagagagtcatagccaaggaggctgcccaaagaatgtcttgagcttcttctagcaagctattggagataagttttagtcagaaaggaacttccgtggatgattttagctcttctttttccccttcaattgctctgtttgttgttgtgaacaagttttgtattgattgggtagttaaaatattatcatgagtaacatttatagtttttatggaaagaatgttttctaagtagttttttcccagtaatttcaaattaaaaataccttttcaaaca

SEQ ID NO: 4338 - DNA, 1288 bp, Populus trichocarpa
aaaataaaaccctaattataaaatcagccgcttcagctgcgcttctaagctgtcacacttccttcacaaacacatctatcagcgtttctttcgatctcctcttccacatggctcccaaaagaggcgtgaaggccccactagcagcaaagaaaaaacctgaaaaggtcgtaaatcctctgtttgagaagcgaccaaagcagtttggaattggtggtgcccttccacccaagaaggatttgactagatttgtcaagtggccacatgttgttcgtattcagaggcaaagaaggattctgaaacagcgtttgaaggttcctcctgctgttaaccagttcacaaaaacacttgacaagaaccttgccacacagctttttaagttgttgctaaaatatagacctgaggacaaggctgctaagaaggaaaggcttcttaaaagagcacaagctgcagaagaggggaagactgtggaatcaaagaagcctattgtcgttaaatatggtcttaaccatgtaacttacctcattgagcagaacaaggcccagttggttgttatagctcatgatgtggatccaattgagcttgttgtctggttgccagctttgtgccggaaaatggaggttccttatgcaatcgtgaagggcaaatcacgtcttggagcgattgtccacaagaaaacagcatcagttttgtgccttacatcagtgaagaatgaggataaattggagtttagcaaggttttggaggcagtcaaggctaacttcaatgacaagtttgatgagcaccgtaagaaatgggggggtggcatcatgggttccaaatctctggctaagaccaaagctaaggagagagtcatagctaaggaggctgcacaaagaatgtcatgagcttcttctagcaagctattggacagaagttatagttgagaggaacttccatagatgttcttaagctcatgcttttcccctttgattgcactttatgttgttacagacaagttttgtattgattcggtagtagaagtattttatcatgagcaatatttagatattcaatggaaagaatgaaaaccaacaacctcagtttctcgtaaactgattgaatttttattggtattttagcattttggttgtgcagttccggaaaatttatgtggtcgtggttcaggaagcgcaagggcagttattgtcacagaaaaatgatcgagctaatactttttctgtaaccttgcccttcgaaaacaatgtttttggttctgggacgtcctctttttcgctgagaatgctctctt

SEQ ID NO: 4339 - DNA, 1075 bp, Sesamum indicum
ctttctataggtgcggtttaatattagggtttcccagccgttctcagaccctcactctgttcctcacagcgaaagggaaaaatggctccaaagaagggcgcaaagctgccggctgcagccaagaagaaggtggagaaagtcgtgaatccgctgtttgagaaaaggccaaagcagtttggcattggaggagctcttccgcctaagaaagacctgcatcggttcgtcaaatggccccaagttgtcagaattcagcggaagaagatgatactgaagcagaggttgaaggtgccacctccaattcatcagttctccaagaccctcgacaagaacttggcaacaagccttttcaagatgctcctcaaatataggcctgaggatagagctcaaaagaaagagcgtcttttgaaaagagctcaggctgaggctgaagggaaaactcctgaggtcaagaaacctattgtggtgaagtatggtctaaaccatgttacctatctcattgagcagaacaaagctcagttggtggtcattgctcatgatgttgacccaattgagttggttgtatggctccctgccctgtgcaggaaaatggagatcccatattgtattgtgaaggggaaggctagattgggaactattgtccataagaagaccgcctctgttttgtgcttgacctctgtgaagaatgaagacaagctggagtttagcaagatcctggaggcgataaaggccaatttcaatgataaatacgatgagatgaggaagaaatggggaggtggtgttatgggctcaaaatcccaggccaagacaaaagcaaaagagaggcttcttgccaaggaagctgctcagaggatgagttaagggctcgtggtatcagttttctgatagtgataggttcaaatgagaggaaatatttatgcccctgttgttcaagattcagatgcttgtttacaattattaactacctgctatttgaatccactttcttttctttacgatatatgatttggatacacgatatgggacaagatagctgtctaagatcctgctggatatgtcaaattcttgggttttcttg

SEQ ID NO: 4340 - DNA, 865 bp, Helianthus annuus
gcagggttcttcatcattgccgtctcgacgcctttgtgtctgatttttgactaatggctccgaagaaaggtgtgaaggcggttgcaacgaagaagaagacggagaaggtggtgaatccgttgttcgagaagcggccgaagcagtttgggatcggtggagctttgcctcctaaaaaggatgtgcatagatttgtaagatggcctcaagttgttcgaattcaaaggaagagaaggattctcaagcaaaggttgaaggttccaccggctttgaaccagtttaccaagacacttgacaagaatcttgcaacaaccctgttcaagatgctactcaaatacagacccgaggataaagcagcgaaaaaggaacgtcttttgaaaagggctcaggctgaatcagatgggaagaccgttgaagcaaagaagccgattgttgtgaagtatggtcttaaccatatcacttaccttattgaacagaacaaggcacaattggtaatcatcgcccatgatgttgatccaatcgaattagttgtctggcttcctgcactttgcagaaagatggaaatcccgtactgcattgtaaaagggaaatctcgattgggagctatcgttcatcagaaaacggctgcagcactatgcttgaccacagtcaagaacgaagataaaatggaattcagccgaattctagaagccatcaaggcaaacttcaatgataagtatgatgagtataggaagaagtggggtggtgggatcatgggatcaaagtctcaggcaaagacaaaggcaaaagagagagttttggctaaggaggctgctcagaggatgaactagatggcatttggtcatgtgttgaggtttttgtatttttt

SEQ ID NO: 4341 - DNA, 834 bp, Helianthus annuus
gaccttcctcatctcagcttacaacaatggccccgaagaaaggagtaaagctagcaacgaagaagaaaacggagaaagtggtgaatccgttgtttgagaagaggccgaagcagtttggaatcggtggagcgttgccgccgaagaaggatgtccataggtttgttagatggccacaagttgtcaggattcagaggaagaggaggattttgaaacagaggttgaaggttccaccggctttgaatcagttcactaagacgcttgataagaatctagcaaccaatttgttcaagatgctgctcaagtacaggcccgaagacaaggctgctaaaaaggaacgcctcttgaaaaaagctcaagctgagtccgaaggaaaaactgtggaagcaaagaagcctattgttgtgaagtatggtctcaatcacgtcacatatctcatcgagcagaacaaggcacaattggttatcattgctcatgatgttgatcctattgagttggttgtctggcttcctgcattgtgcagaaagatggaaattccttattgcattgtaaagggaaaatctagacttggagctattgttcatcagaaaactgcagcagctttgtgcttgactacagtaaaaaacgaggataaaatggagtttagcaggatcttagaagctatcaaggccaactttaacgacaagtatgacgagtataggaagaagtggggcggtggaatcatgggttccaaatctcaggcgaagacaaaggcgaaagagcgggttttggccaaggaggttgcccagaggatgaattagacatcttttgtatgtattgcatgctatatttgatatg

SEQ ID NO: 4342 - DNA, 945 bp, Tabernaemontana elegans
tattatcttcaaagctcaagctcaatttgcaggaccgcagctgagatggctccaaagaagggtgccaagcttccggtgtcagcggcgaagaagaagcctgagaaggtcgtcaatccactgttcgagaagaggccgagacagttcggtattggaggagctttgccgccgaagaaggatctgaccagattcgtgaaatggccccagaatgtgaggatccagaggaagaagaggatcctcaggatgcgattgaaggttcccccagccctcaaccaattctcgaaaacgcttgataagaacttggcgacaagtctgtttaagatgcttcttaaatacagaccagaagatactgccgcaaaaaaggagcgcctgctgaaaagggctcaggctgaagctgaaggaaaaacttctgatgtgaagaagcccattgttgtgaagtatggtctgaagcatgtgacctatcttgttgagcagaacaaggcacaattagtggttattgctcatgatgtggacccaattgagttggttgtttggcttccacacttgtgcagaaagatggaaattccctactgcattgtgaaaggcaaagcacgtcttggatctattgtgcacaagaaaactgcttcagttttatgcctaacctctgtgaagaacgaggataaattggagttcagcaaaattctggaagccattaaggccaacttcaacgataaatttgatgagcagaggaagaaatggggtggcggtgttatgggttctaaatcccaagcaagaaccaaggccaaagaaaggcttcttgccaaagaagctgctcagagaatgtcttaatgggcattaatcttggggggaagagaatgacttggtgttcattttgtcttcttggttactttctagttttaaaatcaattgaatctttagtactatggaaagtttacggagagatgtgtt

SEQ ID NO: 4343 - DNA, 1047 bp, Tripterygium wilfordii
gatagtaggctacacagtagaacggaggagagtgaactgcaattacaaaaatggctccaaagcgaggtgtaaaggcgccgtcggccgcgaagaagaaacaggagacggtggcgaatcctttgttcgagaagcgacccaagcagtttggtattggaggtgcgttgcccccgaaaagggaccttactcggttcgtgaaatggccgaaggtggtccagattcagaggagaaaaaggatcctcaagatgaggttgaaggttcctcctgcgttgaaccagttcaccaagaccctcgacaagaaccttgcatcaaatctgtttaagatgttgctcaagtacagaccagaggacaaaacatcaaagaaggagcgtcttttgaaaaaagctcaagcagaggctgaaggtaagtctgctgagactaagaagccgattgtcgtgaaatatggtctcaaccatgtgacctaccttgttgagcagaacaaagcacagttggttgttattgctcatgatgtggatccaatagagttggttgtgtggctaccagctttgtgcaggaagatggaaatcccttactgcattgtcaagggaaaatctcgcttgggatcgattgtccacaaaaaaactgcatccgtcttgtgcttgaccacagtcaagaatgaagataaactggagttcagcaggatcttagaggccattaaggccaacttcaatgataagtatgacgagtacaggaaaaagtggggaggtggaatcatgggttccaaatcgcaggcgaagagcaaggccaaagaaagggtccttgccaaggaagctgctcagagaatgacttaggagacagtattacatgtttggttttctcttgaaaattgacttcgttcctccaaaatttttgtcaatgtgctcttattaatcgcagaatttttccagaagtaaattttgagttgggtgcaatagataatattgcagcttgtcgggactttagtcgcatttccgattgtcactttgatgttgatcctttacatgtttgttttctactttgatgttgggactt

SEQ ID NO: 4344 - DNA, 1086 bp, Valeriana officinalis
gccgaggtactttaacattgtgaatcagtgcgaacttgtatcattctctagggtttccaccgagccgttcaaaaccctaagcatcgtcctctacaaatggctccgaagaaaggtgtcaagctatcggctgttgcagctaagaagaaattggataaagtagtgaatcccttgttcgagaaaaggcctaagcagtttggaattggaggtgctttgccgccaaagaaggatcttcacagatttgtgaaatggccgcaagttgttcgtattcagaggaagagaaggatcctcaagcagaggttgaaggttccaccagctttgaaccagttcaccaagactcttgacaaaaatcttgcaacaagtttgttcaagatgctactcaagtacaggcctgaagacaaggcagcaaagaaggagcgcctgataaaaagggctcaagctgagtctgaaggaaaggcccccgaggctaaaaagccaattgttgttaagtacggtctcaaccacgtcacctaccttattgagcagaataaagcacagttggtagtgattgctcatgatgttgacccgattgagttggtcgtgtggcttccagcattgtgcaggaaaatggaaatcccttactgtattgttaaaggaaaagcacggcttggagcaattgtgcaccagaagacagcatcggtattgtgcttgaccacagtgaaaaacgaagataagatggatttcagcagaatcttagaagcaatcaaggcaaacttcaacgacaagtacgaagagaacagaaagaagtggggaggtggaatcatgggctcaaaatcccaggcgaaaacaaaggccaaagagaagattcttgcaaaggaagctgcccagagggcttgaactagttaaagttttcttttctctctattttctgcctgctactcgggatgtaagacagttttgggaatttttgttacttgttcgattgattttgtttagaatttaatgcaacatcttgcaataggaatttctcctgcctttctatatgttgtgtgatactgggaatgtgttttagtcatctactatttgagcttattttcaaaagagtactgc

SEQ ID NO: 4345 - DNA, 915 bp, Valeriana officinalis
ggccccgaagagaggtgtaaagcaaccagttgcagcagctaagaagaaatcggataagattgtgaatcctttgtttgagaaaaggccgaagcaatttggaatcggaggtgctttgccgccgaagaaagatctgcacaggtatgtgaaatggccgcaagttgttcgtatccaaaggaagaggaggatcctcaagcagagattgaaggttccgccagcattgaaccagttcactaagacgctggacaaaaatcttgcaacaagtttgttcaaaatgcttctcaagtacaggccagaagacaaagcagcaaagaaggaacgtctgattaagagggcgcaagccgaatctgaaggaaaggctccggaggctaaaaagccaattgttgttaagtacggcctaaaccacgtcacctatcttattgagcagaacaaagcacaattggttgtgattgctcatgatgtcgacccaattgagttggttgtatggcttccggcattgtgcaggaaaatggaaatcccatactgtattgtcaaaggaaaagcacgacttggagcgattgtacaccaaaagaccgcgtcagtattgtgcttgaccacagtaaagaatgaagataagatggatttcagcagaatcttggaggcaatcaaggcaaactttaacgacaagtacgaagagaacagaaagaagtggggaggaggaatcatgggttcaaaatctcaagcaaaaacgaaggccaaagagagagttcttgcaaaggaagctgcccagagggcttgaactagttttctctctagttaagacagttttgggaattgttgttacttgttcgattgattttgtttagaatttaatgaaacatcttgcagcttgtatttcttttcccgttttatatgttgtggttatactatcgagtgctt

SEQ ID NO: 4346 - DNA, 1040 bp, Nicotiana benthamiana
ttgctttgctcctccatcgccgtttagcaaaacaatggtaagctacagccacagataggctctttttctcgacgatttagtattttgagtttaacgtttgattgtggggcattggttgcaggctccaaagaaaggtgtagcagtagcagcgaagaagaaacccgttcaagcgaaagtggtgaatccactgttcgagaagcggccaaagcagtttggaatcggtggtgcattgccacccaagaaggatctgacccgtttcgtgagatggcctcaggttgtccgtatccagaggaaaaggaggattcttaagcagcgtttgaaggttcctcctgctcttaaccaattctcaaaaacccttgacaagaaccttgccacaaaccttttcaagatgctactgaagtacaggcctgaagacaaagctgcaaagaaggagcgtctcttgaaaagagctcaagctgaagcagaagggaaaacaccagagaccaagaaacccattattgtgaaatatggtcttaagcacataacctaccttattgagcagaacaaagcacagttggtggttattgctcatgatgtggacccaatagagttagttgtgtggctgccagcattgtgcagaaagatggaaattccgtactgcattgtgaaggggaaagcacgtttaggatccatcgtgcacaagaaaactgcttccgctctatgcttgacaactttgaaaaatgaagataaaatggagttcagtagaattttggaggcaatcaaggcgaacttcaatgacaagtttgaggaaaacagaaagaaatggggcggtggtgtgatgggatccaaatcacaagccagaacaaaggcgaaagagagggttctcgccaaggaagcagcacagagaatgaactagagcttctattgtgtgttgctgttctctaccaattttgtgttttttgttcgcatgtttgagagatgttattagagatcctgcatggattagacttttatatttactttgttttaaagattgtgtttttatgcaaaagactttccta

SEQ ID NO: 4347 - DNA, 974 bp, Ambrosia trifida
ccgtctgcagaccttcattctcagcttacacaaatggccccaaagaaaggaggaaagccagttgcaaccaagaagaaaacggagaaggtggtgaatccgttgttcgagaagaggccaaagcagtttggaatcggtggagcgttaccgccaaagaaggatgtgcatcggttcgttagatggccacaagttgttcggattcagagaaagagaaggatccttaagcagaggttgaaggttccacctgctttgaaccagttcactaagacgcttgataagaatctagcaacaaatttgttcaagatgctgcttaagtacaggcctgaggataaggccgccaaaaaggaacgtcttcttaaaaaagctcaggctgagtctgaaggaaaaactgttgaaacaaagaagccaattgttgtgaagtatggtctcaatcatgtcacatacctcattgagcagaacaaggcacagctggttatcattgctcatgatgttgaccctatcgagttggttgtctggcttcctgcattgtgcagaaagatggaaatcccatactgcattgttaagggaaaatctcgacttggagctattgtccatcagaaaactgcagcagctctgtgcttgactacagttaaaaacgaagataaaatggagtttagcagaatcctagaagctatcaaggccaactttaacgacaagtatgatgagtacaggaagaaatggggcggcggaataatgggttccaaatctcaagcgaaacaaaggcgaagagcgggtttggccaaggaggctgctcagagaatgaattagatattttggtaatgtattgtatgcatttgtatgtcttgggtggctttgcgtttagaaacttgtgtttttagaactctttttggttgcttgatactgttggaacttaaaatatttaattttggacttgcttatttcagttttcatccaaaaaagaaaaagtaccgactgcg

SEQ ID NO: 4348 - DNA, 1024 bp, Ambrosia trifida
aatctgaatagttataagccttgacttttaatttggggttcttgcttttggctcgacgatggtgaccctgggttcatctgagaggttcttgagggtgagccttcatccacctgaaaggggtttgaatatgaaatttgattctgatgagaggtcagccttcaagcttcaccaatggaagtcaagaaggttctcgaagctgcttcaaaaactgtatctcaagcttccatcaatggctccgaagaaaggtgtgaagacagtggcaaccaagaagaaaacggagaaggtagtgaacccattgtttgagaaaagaccgaaacagtttggaataggaggagcattgccacctaagaaagatgttcataggtttgtgagatggccacaagttgttcggattcagaggaagaggaggattcttaagcagcgtttgaaggttcctcctgctttgaatcagttcactaagactcttgataagaatcttgcaactactttattcaagatgctgctgaaataccgaccggaggataaaacagctaaaaaagaacggcttcagaaaagggcgcaagctgagtctgaaggaaagaccgttgaaaccaagaagcctattgtagtgaaatatggtttgaaccatgtcacctatcttattgagcagaacaaggcacaattggttatcattgctcatgatgtggaccccattgagttggttgtctggctcccagcattgtgcagaaagatggaaatcccttattgcattgtgaagggaaaatctcgattaggagccattgtccatcagaaaactgcagcggctctatgtttgaccaccgtcaagaatgaagataagatggagttcagcagaatcttggaagccattaaggccaacttcaacgacaagtatgacgaatatagaaagaagtggggtggtgggattatgggatccaaatctcaggccaaaacaaaagcaaaggagagagttcttgcaaaggaggctgctcaaaggatgacatagagcgctacgccatccttggtt

SEQ ID NO: 4349 - DNA, 1026 bp, Ricinus communis
ttagcaatgactaaagctaaaatgacgaaagaggacagtctatataagctgtcccgcgtatctataaaacctcattcagcttgctggctctagggtttttgctctcgtagaaggcggcggaaaggcacagaaatggctccaaagagaggagtaaaagtgtctgcagcacctgccaagaagaaaccggagaaggttcagaatccattatttgagaagcggccaaagcaatttggtattgggggcgctttgcctcctaaaaaggatttgcacaggtttgtgaaatggcccaaggttgttcaaattcagaggaagaggaggattcttaggcagaggttgaaggttccacctgctttgaatcagtttactaagactttggacaaaaatcttgcgacaagcttgttcaagttgctcctcaagtataggcctgaggatagagctgcaaagagagaacgccttgtacagagggctcaggctgaagctgaaggaaaaactgttgaggctaagaagcctattgttgtgaaatatgggcttaaccacgttacttatcttattgagcagaaaaaggcacagttagttgttattgctcatgatgtggaccctgtcgagttggttgtatggcttccagctttgtgccggaaaatggaggttccttactgcattgtgaaagggaaatcacgattgggatcggttgtccacaagaaaactgcagctgtcttgtgtttgactacggtgaagaatgaagacaagttggagttcagcaaaattctagaggcaatcaaggcaaacttcaatgacaagtatgatgagctccggaagaagtggggaggtggcatcatgggttcaaaatcgcaagccaaaaccaaggctaaagagagagttcttgcgaaggaagcagctcagaggatgagttaggagaattgtcctagaggaacacactacgctgttgatttattaccccatgttaattgagatgttcttatgtcgtagtcctataaaaacagcttacttgtttggctcacttttttt

SEQ ID NO: 4350 - DNA, 964 bp, Cichorium intybus
cgcggggaggttctcgtcgtgccgtttcaagcagcgaatcccagtctccacaaatggctccgaagaagggtggaaagccgattgcagtcaagaagaaaacggagaaggtggtgaatccgttgttcgagaagcgaccaaagcagtttgggatcggcggagctttgcctcctaagaaggatctacacagattcgtaagatggcctcaagttgtacgaattcagagaaagaggaggatcctcaagcaacgtttgaaggtcccaccggccttgaaccagtttaccaagacgctcgacaagaatctcgcaactactttgttcaagatgcttctcaagtacaggccggaagacaaagcagcaaaaaaggaacgtcttctgaagagagctcaagctgaatcagagggaaagactgccgaagctaagaagcctattgtcgtgaagtatggtctgaaccatataacataccttattgaacagaacaaggcacaattggtgatcatcgcccatgatgttgatccaattgaattggttgtctggcttcctgcactctgcagaaagatggaaatcccatactgcattgtgaagggaaaatctcgtttaggaactattgttcatcagaaaacagcagcagcactgtgcttgactacagtcaagaacgaggataaaatggaattcagccgaatcttggaggccatcaaggcgaacttcaatgacaagtacgatgagtacaggaagaagtggggtggtggaataatgggttcaaaatcacaggcaaaaactaaggcaaaagagagggttcttgccaaagaggccgcccagaggttgaattagaatgcatgcttttgataatgtaatttgtggttttgattttgattttagaatctgaatctagttttggttgacattttggaaggacaaatactttacttgctatcttattgtatgagtttggtttcttgacttgttat

SEQ ID NO: 4351 - DNA, 851 bp, Cirsium arvense
catcgccgtttcgaagctctgaatcccaatttctaccaatggctccgaagaaaggtggaaagccgattgcaactaagaagaaaactgagaaggtcgtgaatccattgttcgagaagcgaccaaagcagtttgggatcggtggagctttgcctcctaagaaggatgttcacagatttgtaagatggccgcaagttgtcagaatccagaggaagaggaggatcctcaagcagcgtttgaaggttccaccagccttgaaccagtttaccaagacccttgacaagaatcttgcaactactttgttcaagatgctactcaagtacaggcctgaggataaggctgccaaaaaggaacgccttctgaaaagggctcaggctgagtctgagggaaaaacagctgaagctaagaagcccattgtggtgaaatatggtctgaaccatgtcacctaccttattgagcagaacaaggcgcaattggtaatcattgcccacgatgtcgatccaattgagttggttgtatggcttcctgctctttgcagaaagatggaaatcccgtactgcattgttaagggaaaatcccgattaggaaccattgttcatcagaaaactgcagcagcactatgcttgactacagtcaagaacgaagataaaatggaatttagccgaatcttggaggccatcaaggctaactttaacgacaagtatgaggagtatagaaagaagtggggaggcggtataatgggttcgaaatcacaggcgaaaacaaaggcgaaagagagggttcttgccaaggaggctgctcagaggttgaattagagtcgagaaagcttatcttgtctgaagttgtgttagaat

SEQ ID NO: 4352 - DNA, 1471 bp, Cirsium arvense
ttattataaaccgaaaaaccccttcgccactgccgtttccagaccttcaatctcaagtttcagacatggctccaaagaaaggtggaaagccagtagtaaccaagaagaagacggagaaggtggttaacccgttgttcgagaaaaggcctaagcagtttgggattggcggtgcattgcctcctaagaaggatgtgcataggttcgtacgatggccacaagttgttcgcattcagaggaaaaggaggatcctcaagcagcgtttgaaggttccacctgccttgaatcagttcaccaagacccttgacaagaatctcgcaactactttgttcaagatgctgctcaagtacaggcctgaggataaagctgcgaaaaaggaacgcctcctcaaaagagctcaagccgagtctgaaggaaagacagctgaagctaagaagccaattgttgtgaagtatggtctgaatcacatcacttatctcattgagcagaacaaggcacaattggttgtgattgctcatgatgtggatcccatcgagttggttgtttggcttcctgcattgtgcagaaagatggaaatcccatactgcattgtgaagggaaaatctcgactaggagctatcgtccaccagaaaaccgcagcagctttgtgcttgacgacagtcaagaacgaagataagatggaatttagccgaattttggaggccattaaggccaattttaatgacaaatatgaagagtataggaagaagtggggtggtggaataatgggttccaaatcccaggccaaaacaaaggcaaaggagagggttttggccaaggaagctgctcagaggttgaattagatagagagagaaagagcctttctttgatatcatgtaatgtttgcttgctgcatttgagggttttgcatttagaaactttttttcttttttcatattaaagttgggagaacagggtaccatcaataacaaaagctccagtacaagaaaatgttatttcccctaaagagaagtgggtttgagttttcataccagaacattactactaatcaagtcagcttacatcaatctgcatatatacgtcatgcgccttttggtggaatatattgcacccgctcttcttcacaaatagacctcagatcctccggcagtgcttctgagaccgccagtgtgtagcatccgggaacgtatttgccaattcgaagccacctagcagcccaacttctggcaggatccattaccgagatgataccagtaaaattaggtgtagtacaatcagcgacacgttcatgatcttcgtccatcttaaagaaagggcagttctcacaccctgattctcgaaactgatcgtaggttttgacgaggcggcaacgaagacatgctcgaagttcatggccgaagctcgtcggaatctgcgcagcggtcgccatcgtttacctcctgctttttctcgaaacttcaccttccacggcgtc

SEQ ID NO: 4353 - DNA, 1084 bp, Cryptomeria japonica
  misc_feature (132)..(132): n is a, c, g, or t
  misc_feature (449)..(449): n is a, c, g, or t
  misc_feature (697)..(697): n is a, c, g, or t
  misc_feature (716)..(716): n is a, c, g, or t
  misc_feature (737)..(737): n is a, c, g, or t
  misc_feature (758)..(758): n is a, c, g, or t
  misc_feature (770)..(770): n is a, c, g, or t
  misc_feature (923)..(923): n is a, c, g, or t
  misc_feature (1010)..(1010): n is a, c, g, or t
tggcctactagatgagattcaatgatattccttgatatcaattttgcccagggaggcggacgacgaggaggagtggaggagcaacactgcaacgaataatggctccaaagagaggggtgaagcccgcggcgncggcgaagaagaaggtggccaaggtggtcaatcctttgtttgagaagcggccgaagcagtttgggattggtggagctttgccgcccaagaaggatctgcatcgcttcgtcaaatggcctaagattatacgcatccaacgccaaagacgcattctgaagcagcgcctcaaggtcccccctgcactaaaccagttcaccaaaaccctcgacaagaatctggcatcaaacctatttaagatgcttctgaaatacaggccagaagacaaagctgcaaaaaaggaaagacttttgaagaaggcacagtcagaggcagaaggnaaacccattgaagtcaagaagcccattgttgtgaaatatggtatcaaccatgtaacgtaccttattgaacagagtaaagctcaattggttgtaattgcacacgatgttgatcccatagagcttgtagtgtggctccctgcactttgtaggaaaatgaacattccttactgcattgtcaaggggaaagcacggcttggaactattgtgcacaagaaaaatgccactgctctatgcttgacatctgtgangaatgaagacaagatggantttagcaggattgttgaggcnataaaggccaacttcaatganaagtttgatgantaccgacgacaatggggcggtggcattatgggcaccaagtctcaggcaaaaacaaaggccagggaaaaactcttggccaaggaagcagcacaaaggctgacttaagattctcattttgaatagtttatgatcatctgttccaaatttgttttngaggggtcaaaaagttttggattttaagtttactttgagcttttgctaattgtcaaggtttatctggagttaatgaccgctgtactnaattatatcttctgtatggataaatattaatttattttcctttgttattaataacttagagaaactgctgaggc

SEQ ID NO: 4354 - DNA, 865 bp, Cucumis sativus
agcacttccccccgccttcttaacactccccttctctttcgttcttcttgccagttttacatcgcctcttgcagcagcgccaaaacaatggcaccgaagaaggctgttggaaaagtttcagcaaagaagaagacggagaaagtggtgaacccgctatttgagaagcgtccaaagcagtttggaattggtggggctttgccacctaagagggatctcacacgatttgtcaaatggcccaaggttgttcaaattcaaaggaagaagaggattctgaagcagaggctcaaggttccaccagctttgaatcagttcaccaagacccttgacaagaatcttgcaacaaacttgttcaagatgcttttgaagtataggccagaggataaaacacagaaaaaggagcgtcttctgaaaagagctcaggaagaagctgaaggcaaatcacacgatgccaaaaagcctattgttgttaaatatggtctcaaccatgttacctacctcattgagcagaacaaggcacaactggttgtaattgcacacgatgtggatccaattgagttggttgtatggctcccagctctgtgcaggaagatggaaattccatattgcattgtgaagggaaaagcacgtttgggagcggttgtccaccaaaagactgcatcagttttgtgtttaacaacagtgaaaaatgaagataagatggagtttagcaggatcctggaagccattaaggctaatttcaacgacaagtacgacgaatacagaaagaagtggggcggtggaatcatgggatccaagtctcaggcaaaaactaaggcaaaggagaaattactggccaaagaagctgctcaaaggatgtcttaggtaa

SEQ ID NO: 4355 - DNA, 1119 bp, Cucurbita pepo
aaaaatggcaccgaagaaggctgttggaaaagctttggcgaagaagaagccggagaaggtggtgaacccgctatttgagaagcgtccgaagcagtttggaatcggtggggcattgccgccgaagagggatctcacacggttcgtcaaatggccgaaagctgttcaaattcagaggaagaagaggattctcaagcagaggctcaaggttccaccagctttgaatcagttcaccaagacccttgacaagaatcttgcaacaaacttgttcaagatgctgttgaagtataggccagaggataaagcacagaaaagggagcgtcttttgaaaagagctcaggaagaggctgaaggcaaatcacacgatgcgaaaaagcctatcgttgttaaatatggtctcaaccatgttacctatctcattgaacagaacaaggcacagctggtcgtgattgcacacgatgtggacccaattgagttggtagtttggctcccagctctgtgcagaaagatggaaattccatactgcatcgtgaagggaaaagcacgattgggagcgattgtccaccaaaagactgcatcagttttgtgcttgacaacagttaagaacgaagataagatggagttcagcaggatcctagaagctattaaggcaaacttcaacgacaagtacgacgagtacaggaagaagtggggtggcggaatcatgggttccaagtcacaggccaaaaccaaagcaaaggagaggctccttgccaaggaagcagctcaaaggatgtcttaggaattcacagacccaagtctaggatcgagcaaaggacaaagaagaagcttttagcagagcagagcatgtcaaagtatggccgagggagtcggtaatgatctaacttaagccattttctttgattacaaagcagatttttcacgaggcttgtttttattttcagcttttaagtttttggattgtgaaattttaaactgttcttctacgagttgacattatggaattattctattcggacaccgattttctcgtatatgtctagagttatacgtttgatatcgacattatggaattatacaacattgcacacattttattgatattttctcgacaattttagt

SEQ ID NO: 4356 - DNA, 1194 bp, Linum usitatissimum
cttcacccttcttcatcgtcatcatcatctgccgtcgtcgtcgacatggctcccaaaagaggtgtcaaggctccagttgcttctaagaagaagacagagaaggttgtgaaccctctgtttgagaagcgaccaaaacaatttggaattggaggtgctctcccaccaaagagggacttgaccagatttgtcaagtggccccatgttgttcgtattcagaggcaaagaaggatccttaagcagcgtttgaaggttcctccagctgttaaccagttcaccaaggcactggacaagaacttggctacacagctattcaagctgttgctgaagtatcgccctgaggataaggctgctaagaaggaaaggcttattaagaaagcacaagctgaggctgagggaaagactgtggaatctaagaaaccgattgttgtcaagtacgggctgaatcatgtcacatatctcatcgagcagaacaaggctcaactggtcatcattgcccatgacgttgacccaatcgagcttgtcgtttggttgcctgccttgtgccgcaagatggaggtcccttacgctatcgtgaagggcaaatcacgacttggagcgattgtccacaagaaaacagctgctgctttgtgccttacctctgtgaagaacgaggataagatggagttcagcaagatactggaggcagtcaaggccaacttcaatgacaaattcgatgagcaccgcaagaggtggggaggtggtatcatgggatccaaatcccaggcgaagaccaaagctaaagagagactcttggccaaggaggctgcacaaaggatgacctaaactctcttggtctcgttgaagggagttgttctgttgtgtgcgcaagtttttgttagctctatctttttctgtgtagtcagacgagtgctcttaccagttgttggggaagctgagatattagtactgggcacattgctgtttctgttttggagattgaattatctatcttatatgttaaacctagttaacttgcctggccgttcgatctggcacgcaatggggtcaagttctaagctgatcgagtagatttagtacaggataggccttccaagtaagctccggttaccggaggtaaaggaaaatcaattacggagtatcattcccctccaaatctcatatgatcaacaagtgaacaatatatatgcattgcga

SEQ ID NO: 4357 - DNA, 1726 bp, Vitis vinifera
tcacatataccccttacacataaaattctaggagaataagtttgcatcagtgtccccagatttgcaaaactggcttctgaggccatagctcgttttcgaccctattggcattgtcagcagcagaggccttccaagtagtcccagcaccgctaagcttagtggacaactgggaagttggactaactccatgtgctccaggagtttccggagtggctctcaggtttccatggctcttggaaacttgcttgtcgatttgctggctctgtatcttccacttgttgccccctgttgtgaagccggtatttctggaaaattatacatacatcaatttattaaagaaataaaaccctcggagaagcctcccgtcctcacgcagcctcctgcagcagcacatagggttccatctcaactctctctgcaacttatgggtcccaaaaaaggtgggaaggctgcagtgccggcaaagaaaaagactgaaaaggttgtgaaccccttgtttgagaagcgtccaaagcagtttgggataggtggtgcattaccaccaaagaaggacctgactagatttgtcaaatggccccatgtggtccgtatccagaggaaaaggaggattttgaggcaacggttgaaggttcctcctgctttgaaccagtttactaaaacccttgacaagaaccttgctacaaatctttttaagatgttgctcaaatatagacctgaggacaaggctgccaagaaggaaagacttctaaaaagagcacaagctgaagcagaggggaaaactgcagagtcaaagaaacccattgttgtcaaatatgggcttaatcacattacctacctcattgagcagaacaaggctcagttggtggtaattgcacatgatgttgatccaattgagcttgttgtttggctaccagctttgtgccggaaaatggaggtcccttacgcaattgtgaagggcaagtctcgtcttggagcgattgttcacaagaaaacagccacagctttgtgtcttacatcagtgaagaatgaggataagttggaattcagcaagattgttgaggctgttaaggccaacttcaacgacaagtatgatgaataccgcaagagatggggaggtggcatcatgggatccaaatctcaggctaagacaaaagccaaggagaaactcatagccaaggaggctgcacaaagaatgtcttaagtatttcaacgcatagtagaaggagaagcgcataatataacagaactcttctacaaaagtttcttgcatatcatccatcattttgcttgtcgactaggctaagttttgtatttggtcatctagctgagatactagtatcctatttgagttcttgagttatcctttggtaggagaaaattaaaacaacttctgctttttggagaactgatctgcagacttgagaagtgatgctttgttttattcacccctatgatttgctgttgctgttgaaagttttctccacaggagtttgtctctatgcattagtcttgatgtactaaccccagaggcgtcgtgcttctggttctcttcattcccagtgtggaggagtatgctcaagataacggtgttaccggggccacaatggtcttataaagtcatgataaatttacttaacctgaatatgatccatttaataattatgtcaaactgatttctcatttgttacatggataatacaattagaccctgtgtagtccatttaat

SEQ ID NO: 4358 - DNA, 1257 bp, Lotus japonicus
gcgatacaccaggaccaggtgcaggcaccagcagcagcaacagcaatggctcctaagaaaggtggaaaagctcctgttgcagcttccaagaagaaaactgagaaggttacgaatccgttgttcgagaagagaccgaagcagttcggaatcggaggtgcattgccaccgaagagggacctgaccagattcgtgaagtggcccaaaactgtgcagattcagaggaagaagagaatcctcaagcagaggttgaaggttcccccagctttgaaccagtttaccaaaaccctagacaaaaaccttgcaacaagcctgttcaagatacttctgaagtacaggcctgaggataaggctgaaaagaaggataggcttgtcaaaagggctcaggctgaggcagaaaacaaaactgtcgaaactaagaagcctattgttgtgaagtatggtctcaatcatgttacctaccttattgagcagaataaagctcaactggttgtgattgcacatgatgtggacccaattgaattggtcgtctggcttccagcattgtgcaggaagatggaaattccgtactgcatagtgaaaggcaaggcacgcctgggctcgattgtccataaaaaaactgcatctgttttgtgcttgacaagtgttaagaacgaagacaagttggagttcagcagagtcctcgaagctatcaaggcaaatttcaatgacaagtacgaagagtacagaaagaagtggggtggtgggatcatgggttccaaatcccaagccaaaaccaaggcaaaggaaagggtccttgccaaggaagctgcccagaggatgaattaggagctttatcaatatttgttgctttctatctgccgttttttgttcttgtatgtcaccgatagacacaacccttttttctgtgagattgattatcttgagaacagcatcagtaaattattcccagcttttctcgcatgagaacagcattgagtaagagaacaccctgaaatgaagttgaaattgtggtaagaattatatttcaaaaactccactcactttgtgaattaaaagggagttgggaattgggatggatcgtagtatcggagggagtgaggaaaaaagagaaggtaaaccaatgaggcttcatttattcaaagatgaacagatgagatgatacagtagaattttggagcatatttggccccatttggaaacaaaagcttaattaagcgcttattcataagctatatataagtataagctcttttttat

SEQ ID NO: 4359 - DNA, 1110 bp, Cucumis melo
gttttgcttcacctcgcccctcttccaccgtgaaaaatggctccgaagaaggctgttggaaaagtttcagcaaagaagaagctggagaaggtggtaaacccactatttgagaagcgtcccaagcagtttggaattggtggggcattgccgcccaagagggatctcactcgctttgtcaaatggcccaaagttgttcaaattcagaggaaaaagaggattttgaagcagaggctcaaggttccaccagctttgaatcagttcaccaagacccttgacaagaatcttgcaacaaacttgttcaagatgcttttgaagtataggccagaggatagaacacagaaaagggagcgccttttgaaaagagctcaggaagaggctgaaggcaaatcactcgatgccaaaaagcctatcgttgttaaatatggtctcaaccatgttacctacctcattgagcagaacaaggcacaactggttgtgattgcacacgatgtggatccaattgagttggttgtatggctcccagctctgtgcaggaagatggaaattccatattgcattgtcaagggaaaagcacgtttaggatcgattgtccataaaaagactgcgtcagttttgtgcttgacaacagtaaagaacgaagataagttggagttcagcaggatcctagaagctattaaggcaaacttcaatgacaagtacgaggagtacaggaagaaatggggtggcggaatcatgggttccaagtcacaagccaaaactaaagcaaaggagaggcttcttgccaaggaagccgctcagaggatgtcttaggaattcacagatcaacactagagcaaaggacaagggagaagtttctagcaaagcagaggatgtcaaagcatggcttagtatttggtaatgagctcttgtctaacttaagtcatttttccttgattgcaaaacagattgttaagaggcttgtcattgttattttcagttttaagtttattggattgagaaattttattatgttctacgagttctacattatgtttaaagcaggacattttggaattaattctgtttggatcccatttttcttgtataagttaggttatatggtaaaaaaaa

SEQ ID NO: 4360 - DNA, 1127 bp, Momordica charantia
ttctcttcctcctgttggccgccgcttcctctcccgcagcgtaaaatggcaccaaagaaggcagttggaaaagccttggcagcagcaaagaagaagccggagaaggtggtgaacccactattcgagaagcgtccaaagcagtttggaattggtggggcattgccacccaagagggatttgacacggtttgttaaatggccgaaagctgtccaaattcagaggaagaagaggattctcaagcagaggttgaaggttccaccagctttgaatcagttcacaaagacacttgacaaaaatcttgcgacaaacctgttcaagatgcttttgaagtataggcccgaggacaaagcccagaaaagggagcgtcttttaaagagagctcaggaagaggctgaaggaaaatcacatgatgctaagaagcctattgttgttaaatatggtctcaaccatgttacctacctcattgagcagaacaaggctcagctggttgtgattgcacatgatgtcgatccgatcgagttagtcgtttggctcccagccttgtgcaggaagatggaaattccatactgcattgtgaaaggaaaagcacgcatgggagcgattgtccataaaaagactgcatccgtcttgtccttgacaacggtcaagaatgaagataagttggagttcagcaggatcctagaagctatcaaggcaaacttcaacgacaagtacgacgagtaccggaagaagtggggcggtggaatcatgggatcaaagtcacaggccaaaaccaaagcaaaagagaagcttcttgccaaggaagctgctcaaaggatgtcttaggaatctacaggccaacactagattggtgaaaagcagaggatgtcaaaggatggcttaggagtcggtaatgagttcttgtccaacttaagtcttttctcttttcagatttaagtttatcggattgagtgatctagtttgttcattaccctacgagtagtacctattcaaggcaggaaattatggagagtttctatttggacgccaattttgctgtataagttgtattatcacgttttgcctaaattatgaacttacaatttactactattcacatgtgctctcaattgaaacctcatattatt

SEQ ID NO: 4361 - DNA, 1124 bp, Lippia dulcis
acactgctcgttagggtttgacagccgttcctccattgtcactgcaaaggaagaagaaatggctccgaagaagggcgcgaagcttccggcgaagaaaaagacggaaaaagttgtgaatccgctatttgagaagaggccgaagcagtttggtatcggaggagctctgccgccgaagaaggatctgcaccggttcgtgaaatggccgcaagtcgtcagaattcagaggaagaagatgatactgaagcagaggttgaaggttcccccaccaatccatcaattctctaaaactttggataagaacctagccactagcttgttcaagatgcttctcaaatataggcctgaggacaaagctcaaaagaaagagcgtcttttgaagagagcccaggctgaggctgaaggaaagacccctgagtccaagaagcccattgtggtgaaatacggtctcaaccatgtcacctatctcattgagcagaataaagctcagttggttgtcattgcccacgatgttgatccaattgagttggttgtatggctcccggcattgtgcaggaaaatggaaatcccatactgtattgtgaaggggaaggctaggttgggcactgttgtccacaagaaaactgcctctgttttgtgcttgacttctgtgaagaatgaggacaagatggaattcagcaagatcctggaggctatcaaggccaacttcaatgataaatatgatgagatgaggaagaaatggggaggtggtgttatgggctcaaaatcccaagccaggacaaaggcaaaggagaggcttcttgcaaaggaagctgctcagaggatgacctaagtactacttgttacaattttctatttactagtttgatagaagcaaatgagaggaattttcatatgccttcttattccaagattcaaaatagacacttgctttttgtttacaattgtcatctgctatcgagttcgcttattgctttagtactgtatgtgcttggatagatgaagtggatgaagctttgtccaaatgctacttgtactgtcaaattttgttgctatcttgtagtttaccgtaccggtttttaaaatttgaaatcaagttctgcctcttcgtttagttcaaaaaagaa

SEQ ID NO: 4362 - DNA, 1112 bp, Lippia dulcis
tttagggtttggctgccgttctcagaccctcactcgatccctcatagcaaaaggaaaaatggctccaaagaagggtgcgaagctgccggcggccgccaagaagaagacggagaaagttgttaatccgctcttcgagaaaagaccaaagcagtttgggatcggaggtgctctgccgccgaagaaggatctccaccggtttgtgaaatggccgcaagttgtgagaattcagaggaaaaagatgatcttgaagcagcggttgaaggttccgccgccaattcatcagttcagcaagaccctggacaagaatttggccactagcctattcaagatgctcctgaagtatagacctgaggataaggctcaaaagaaagagcgccttttgaagagagctcaggctgaggcggaaggaaaaactcccgaatcaaaaaagcctattgtcgtgaaatacggcctcaaccatgtgacttatcttattgagcagaacaaagctcagttggtggtcattgcacatgatgtggaccccatcgagttggttgtgtggcttccagcactgtgcaggaagatggaaatcccatactgcattgtaaagggaaaagctagattgggaaccattgtccacaagaagactgcctctgccttgtgcctgacctctgttaagaatgaagacaaaatggaattcagcaagattctggaggctattaaggccaatttcaatgataaatatgacgagaccaggaagaagtggggtggcggtgtcatgggctcaaaatcacaggccaggacaaaggccaaagagaggcttcttgccaaggaagctgcacagaggatgacttgaggaattcttgctatatttgtttattagtgatagaatcagatgagagaactatcaatgtgcacttgttttgctcaggttgagattagacatgaattttggttttgttttaaaattgagttttgtttggtatcgtctttgaatagacaacatgaatcaagccctttaattaagtatgtgctgccccgtttttataattcggtgacctcatatttcctcccttcctttattaatttgattttaaattgaaatacattgtgccctagtggcatgacttgtc

SEQ ID NO: 4363 - DNA, 1057 bp, Podocarpus macrophillus
gaagaaacgaaaggaggcgagagaagagggcgacgacgatcaacctcgaaatccaaaaatggctccaaagagaggggtgaaggcccctgttgctgcaaagaaaaaggcacctaaggtcgtgaatccgttgtttgagaagcggcctaaacagttcgggattgggggagctattccaccaaagaaagacttgcatagattcgtgaaatggcccaaggtggttcgtattcaaaggcagcgcaggatcctcaagcagcgcttgaaggttccgcctgcgctcaaccagttcaccaaaacactagacaagaatcttgcatcaaaccttttcaagatgcttctgaagtacaggccagaagataaggcctcaaaaagggaaaggcttctgaagaaggctcagatagaggcttcaggcgggaccgttgaagttaagaagccaattgttgtgaaatatggtatcaatcacgtaacttaccttattgagcagagcaaagctcagttggtggttattgctcatgatgtggatcctattgagcttgttgtatggcttcctgcactttgtagaaaaatgaacattccttactgcattgtcaaggggaaagcgcgccttgggacaattgtgcacaagaaaaatgctactgctctgtgcttgacatctgttaagaacgaagacaagatggaatttagcaggattgttgaggcagtaaaggctaacttcaatgataagtttgatgagtataggcgccaatggggaggtggtattatgggcacaaaatctcaggctaaaacaaaggccagggaaaagctattggctaaggaagcagcccaaaggctgaattaactatttgaagattttatgattattgttttgaagttcactctaattttgaggtgtagaaaaatatcttggacatgaaagggtattcttagtttatctttttgaaaacaacatgacaattttgcagttgtagagtatcaagaatttaaattgttgcatattgtgatatgcttttctttggaatatatgatttctcatactgattaagttattttctaaaatgac

SEQ ID NO: 4364 - DNA, 1258 bp, Populus trichocarpa
cgtttttgctgctcttctgcccctacccattttcacctcaaacacgttcaggttttcgatctgcaagtctcctcttctagatggctcccaaaagaggtgtgaagggcccactggcagcaaagaagaaacctgaaaaggtagtgaaccctttgtttgaaaaacgtccaaagcagtttggaattggtggtgcacttccaccaaagaaggatttgactagatttgtcaagtggccacatgttgttcgtattcagaggcaaagaaggattctgaaacagcgtttgaaggtccctcctgctgttaaccagttcacaaaaacacttgacaagaacctcgctacgcaacttttcaagttgttcctaaaatatagacctgaggacaaggctgctaagaaggaaaggcttcttaagagagcacaagctgaagctgaggggaagactgtggaaacaaagaagcctattgttattaaatatggtcttaaccatgttacttacctcattgagcagaacaaggcccagctggtggttattgcacatgatgtagatccaattgagcttgttgtttggttgcctgcattgtgccggaaaatggaggttccttatgccattgtgaagggcaagtcacgacttggagcgattgtccacaagaaaacagcttcagttttgtgccttacttctgtcaagaatgaggacaaattggaatttagcaaggttttggaggcagtcaaggctaacttcaacgacaagtttgatgagcaccgcaagaaatggggtggtggcatcatgggttccaaatctctggccaagagcaaagctaaggagagagttttagccaaggaggctgcgcaaaggatgtcttgagctcatctactttagaggctttggacacgagttgcagtgagaggatctttcctagatgatagggtgtggcttttatttctctttgttgactgctctgtttgttactattgtggacaagttttggattgatagggtgtggctgaaacatctcatcacaccctctgttatccatccttttggtgggagaacgaaaatctaaagccatctcttctcttaaacttaatattattttgccaagaaactagtcatttctaaaattgaaggttgcggccttcaattgttcagtatgaaagctctcgattgtgagtctatagctgttcccccatctggaagaaccccttccttcatctactgcagcatgggcaccattgctccatgttgagagatttatatatttcact

SEQ ID NO: 4365 - DNA, 1186 bp, Pseudotsuga menziesii
ggcagttaacctagccggttaagggtttgtagaattaaggtttaggagaagggatttgtgtagagaataaacagcttccgcagctcgttattgacgtgcgcgtgggaggaggtagcagatcagctagcagagcgagggagcagatcgattctagcaatggctccgaagagaggggtcaaggcgccggttgctgctaagaagaaggttccgaagattgttaatccattgtttgagaagcggacgaggcagtttgggattgggggagctctgccgccaaagaaggatttgcacagatttgtgaaatggccgaaggttgttcgcatccagaggcagcggagggtattgaagcagcgtttgaaggtccctccggccttaaaccagttcaccaagacgcttgacaagaatctcgcttccaaccttttcaagatgctcctaaaatacaggccagaagataaagctgcaaagaaggaaaggcttctgaagaaagcacagtctgaggcagaaggaaagaccgttgaagtgaagaagcctattgttgtgaaatatgggattaatcatattacatacctcattgaacagagtaaggctcaattggtagttattgcacatgatgttgatccaatagagttggtagtgtggcttcctgcactttgtcgaaaaatgaacatcccttatgcaattgtcaaggggaaagcacgccttggagcgattgtgcacaaaaagacagcaactgccctctgcttgacctctgtgaaaaacgaggataagatggaatttagcaagattgttgaggcagtaaaggctaacttcaatgacaagtttgatgaataccgccgacaatggggaggtggcattatgggaactaaatcccaggcaaaaacaaaggccaaggaaaaagtcatggccaaggaagcagcacagaggctcaattaagattagttccttggaatattttgtccacgttgaaaattttattggattgtttttttgcaatttgttgtaatttgcttaataggtatagtaacataccagagtttatactaaggaagttttaaagctaactttagctttgactttcgaaaacaacacgtcaattttgcaactgggtaagttgagtaaagaacattttgtactcattcattggctttatacacttcactaacttttgtatgctgtgatgatgata

SEQ ID NO: 4366 - DNA, 852 bp, Secale cereale
tcgagaagaggccgaagcagttcggcatcggtggcgccctcccgcccaagaaggacctccaccggttcgtcaagtggcccaaggtcgtgcgcatccagcgccagcgccgcatcctcaagcagcgcctcaaggtgcccccggctctccaccagttcacccgcaccctcgacaagaacctcgccaccaacctgtttaagatgcttctcaagtaccgccctgaggacaaggtggctaagaaggagaggcttctgaagagggcccaggctgaggctgaggggaaaaccgttgaggccaagaagccaattgttgtgaagtatggtcttaaccatgtcacttacctcattgagcagagcaaggctcagctggttgtcatcgctcatgatgttgacccaattgagctggttgtgtggctcccagccctgtgcaggaagatggaggtcccatactgcattgttaagggaaaatcacgccttggatcgatcgttcacaagaagactgcctcagttctgtgcctcaccactgtgaagaacgaggacaagcttgagttcagcaagatcttggaggctatcaaggctaacttcaacgacaagttcgatgaggtcaggaagaagtggggcggtggcgtcatgggctccaagtcgcaggccaagaccaaggccagggaaaggctcatcgccaaggaggctgcgcagaggatgaactaagcctagccctagtcagagcatgtgccatgtagtttccctttcagtgtgtcctgattttgacgtaggaactcgaacctttagcagcactgtgaatcgtatgtggtttctgatctctgtccgttcgccagacttaatgcaaagatcagat

SEQ ID NO: 4367 - DNA, 892 bp, Thalictrum flavum
agctaactagggttttatcgtcactctcatcactaacgaaatggcccccaaaaaaggtgtaaaggcagtagtaacaaagaagaagcctgagaaggtagccaatcctttgtttgagaaacgcccaaagcagtttgggattggtggtgcacttccaccaaagaaggatctgcatcgatttgtcaaatggcctaaagttgttcgtattcagaggcaacgtaggattctgaaacaacggttgaaggttcctccagctttgaaccagttcacaaaaacagtagacaagtccctcgcaacgactcttttcaagatgctactcaaataccgaccagaggacaaggctgccaaaaaggaaagacttgtgaagagggctcaagctgaagcagaggggaagactattgagtcaaagaagcccattgtcgtgaaatatggcctgaaccacattacataccttattgagcagaacaaggcccagttggtagttattgcccatgatgtggaccctatcgagcttgttgtttggcttcctgccttgtgccgcaaaatggagattccttatgttattgtgaagggaaaggcccgtcttggagcggtcgtccacaagaaaactgcggctgctttgtgtttaacctcggtgaaaaatgaagataaaatggaattcagcagaattgttgaggcaatcaaggctaactttaatgataagtacgacgagaacagaaagaaatggggtggtggcatcatgggatcgaagtctcaggcaaagactaaggcaaaggagaggctcttggcaaaggaagcagcacagaggatgaattgagtatagcagtagtagggaagggcctatactaggaagaagttttagttactgttttcaatagttctgtcctgtttctgt

SEQ ID NO: 4368 - DNA, 983 bp, Nicotiana tabacum
gagttcaaacatccatacacctaagttgctttgctcctccctcgccgtctagcaggaaaatggctccaaagaaaggtgtagcagtagcagcaaagaagaaaccggttcaggcgaaagtggtgaatccactgttcgagaagcggccaaagcagtttgggatcggtggtgcattgccgcccaagaaggatctgacccgtttcgtgagatggcctcaggttgttcgtatccagaggaaaaggaggattcttaagcagcgtttgaaggttcctccttctcttaaccaattctcaaaaacccttgacaagaaccttgccaccaacctgttcaagatgctactgaagtacaggcctgaagacaaagctgcaaagaaggagcgtctcttaaaaagagctcaagctgaagcagaagggaaaacacccgagactaagaaacccattattgtgaaatatggtcttaagcacataacctaccttattgagcagaacaaagcacagttggtggttattgctcatgatgtggacccaatagagttagtcgtgtggctgccagcattgtgcagaaagatggaaattccgtactgcatcgtgaagggaaaagcacgtttaggatcgatcgtgcacaagaaaactgcttcggctctatgcttgacaactgtgaaaaatgaagataaaatggagttcagcagaattttggaggcaatcaaggcaaacttcaatgacaagtatgaggaaaacagaaagaaatggggcggtggtgtcatgggatccaaatcacaagccagaaccaaggcgaaagagagggttctcgccaaggaagcagcacagagaatgaactagagcttctattgtatgttgctgttggattaaacctctacctctaccaattttgtgtttttggttcgcatgcttgagcaatgttagagatcctacgtggattagacttttatatttactttgtgttacagattatgtttttatgcaaaa

SEQ ID NO: 4369 - DNA, 958 bp, Valeriana officinalis
gccggttgttcgaactgcaaacctcatcaacaaaaatggccccgaagagaggtgtaaagcaaccagttgctgcagctaagaagaaatcggataagattgtgaatcctttgtttgagaaaaggccgaagcaatttggaatcggaggttctttgccgccgaagaaagatctgcacaggtatgtgaaatggccgcaagttgttcgtatccaaaggaagaggaggatcctcaagcagagattgaaggttccgccagcattgaaccagttcactaagacgctggacaaaaatcttgcaacaagtttgttcagaatgcttctcaagtacaggccagaagacaaagcagcaaagaaggaacgtctgattaagagggctcaagccgaatctgaaggaaaggctcctgaggctaaaaagccaattgttgttaagtacggcctaaaccacgtcacctatcttattgagcagaacaaagcacaattggttgtgattgctcatgatgtcgacccaattgagttggttgtgtggcttccggcattgtgcaggaaaatggaaatcccatactgtattgtcaaaggaaaagcacgacttggagcgattgtacaccaaaagaccgcctcagtattgtgcttgaccacagtaaagaatgaagataagatggatttcagcagaatcttggaggcaatcaaggcaaactttaacgacaagtacgaagagaacagaaagaagtggggaggaggaatcatgggttcaaaatctcaagcaaaaacaaaggccaaagagagagttcttgcaaaggaagctgcccagagggcttgaactagttttctctcaagttaagacggttttgggaattgttgttacttgttcgattgattttgtttagaatttaatgaaacatcttgcagccggtatttcttttgccgttttatatgttgtggttatactatcgagtgcttattgat

SEQ ID NO: 4370 - DNA, 981 bp, Vinca minor
gaaaccctagtttccacacagaaggaaaatggctcccaagaaaggcgctaagcctccaccttctgctgctaagaagaaatcggataaggtagtcaatcctttatttgagaagcgtccgaaacagtttggaattggaggagctctgccacctaagaaggaccttacaaggttcgtcaaatggcccaaagttgtgcagcttcagagaaaacgcaggattttaagacagcgcttgaaggtccctcctgctatcaatcagttctctaagaccctcgacaagaaccttgccacaaatctgttcaagatgcttctcaagtacagacctgaggataaagctgctaagaaagagcgcctgctgaaaagagctcaggccgagtctgaagggaaaacatctgaagtaaagaagcccattgttgtcaaatatggtttgaagcatgtcacatacctcgttgagcagaacaaggctcaattggtggttattgctcatgatgtggaccccatagagttggttgtttggcttccacatttgtgcaggaagatggaaattccttactgcattgtgaaggggaaagcaagactgggttctattgttcacaagaaaactgcttcagttttgtgcttgacatctgtcaagaacgaagataagatggaattcagcagggttcttgaggctattaaggcaaatttcaatgacaaatttgatgaaaatagaaagaagtgggggggaggtatcatgggttctaaatctcaagccaaaaccaaggcaaaagaaagggtccttgccaaggaacaagctcagaggatgtcttagtatgtgttttctgaggagcatatgtagtatgttttgtggagagcaggaatacttttttgttatatcatattggttctctcaagttgagtttttttttggggattttacatttgaatttaagacatattcttgcttctagtagttggcatacatgtgttttagactttcatttc

SEQ ID NO: 4371 - DNA, 976 bp, Citrullus lanatus
ggcaccgaagaaggctgttggaaaagtttcgacaaaaaagaagccggagaaggtggtgaatccgctatttgagaagcgtccgaagcagtttggaatcggtggggcattgccgcctaagagggacctcacacgctttgtcaaatggcccaaagttgttcaaattcagaggaagaagaggattctgaagcagaggctcaaggttccaccagctttgaatcagttcaccaagacccttgacaagaatcttgcaacaaacttgttcaagatgcttttgaagtataggccagaggataaaacacagaaaagggagcgtcttttgaaaagagctcaggaagaggctgaaggcaaatcacacgatgccaaaaagcctattgttgttaaatatggtctcaatcatgttacctatctcattgagcagaacaaggcacaactggttgtgattgcacacgatgtggatccgatcgagttggttgtatggctcccagctttgtgcaggaagatggaaattccatattgcattgtgaagggaaaagcacgattgggagcgattgtccacaaaaagactgcatcagttttgtgtttgacaaccgtgaagaatgaagataagttggagtttagcaggatcctggaagccattaaggctaatttcaacgacaagtacgacgagtacaggaagaagtggggtggtggaatcatgggatccaagtcccaggctaaaaccaaggcaaaggagaaattactcgccaaagaagctgctcaaaggatgtcttaggtaggtatcagagtttttcttttatgactttgcagagttttcttttatgagaaaaaatcagacaccaattatttttggtgtgtagtttacttacaacagtagaatttggaagttttgtttacttatgattgcttctttaagagaacttgttgtagtacttccatgtaagcctctattagtttagttttaattttgaatatttca

SEQ ID NO: 4372 - DNA, 1047 bp, Arnica chamissonis
aaaaaaaggtggaaagccagtagcaacgaagaagaaaacggagaaggtggtgaatccgttgttcgagaaaaggccgaagcagtttggaattggtggagcgttgcctccgaagaaggatgtgcacaggtttgtgagatggccgcaagttgttcgaattcagaggaagaggaggatcctcaaacagcgtttgaaggtgcctcctgctctcaaccagttcaccaaaaccctagacaaaaatctcgcaaccaatttgttcaagatgctgctcaagtataggcctgaggataaggcggccaaaaaaagaacgtcttaaaaaacgagctgaggctgaggttgatggcaaaactgtagaagcaaagaaaccaattgttgtgaaatatggtctcaatcatgtcacatatctcattgagcagaacaaggcgcagttggttatcattgctcatgatgtggacccgattgagttggttgtttggcttcctgcattgtgcagaaagatggagatcccttactgcattgtaaagggaaaatctcggttgggagctattgtccatcagaaaaccgcatcagtcctgtgtttgactacagtaaaaaacgaagataaaatggagttcagcagaatccttgaggctatcaaggccaacttcaatgataagtatgatgagtataggaagaaatggggtggtggaataatgggttccaaatctcaagcaaaaacaaaggcaaaggagagggttttagccaaagaggctgctcagaggttaaattagatcatatcttgatcatgtgttgtcagtatttgagttcatggagagcttttgattttagaattttatttatttgcttaaaacttttcgaagttcatttacttgtttatcttaacgagttgatgtatccgtgcgttcttacgggagtattaaaatatgtaagcctctgttttgacaacctataagttagtattagccccacaaaaaatgcgttttgatgtcggcgttgaacatctcactcaagggttgtggtgggtgaattaattttagcatagtttatgtt

SEQ ID NO: 4373 - DNA, 2216 bp, Cirsium arvense
taagctccgatcaggcgaggcgttgccggaggccgtcgattggagggagaaaggcgccgtcaccgccgttaaagatcaaggaagctgcggaagttgctgggcattttcgaccacgggatctgtggaagggatcagccagatcgtgacaggcgatttgatttctgtctcggaacaagagcttgtggattgtgatacatcctacaaccagggctgcaatggaggtctcatggactacgcttttcagttcattatcaaaaatggcggcattgacaccgaagaggactacccatacacgggcagagatggaaaatgcgatacttacaggaaaaacgcaaaggtcgttaccatcgatggctatgaagatgttccagtcaacgacgaatcagcactacaaaaggccgctgctaaccaaccgatcgcagtagccatcgaagccggtggcagggatttccagttttacacttcgggtattttcacgggtcaatgtggcacagccttggaccatggtgtgcttgttgttgggtatgggagcgaaaacggtaaagattattggatcgtgaagaactcatggggtgccgcatggggagagtcaggttacttgaagatggaacgaaacatcaaagagaacgtgggcaaatgtggaatcgcaatggaggcatcttatgcagtgaagacgggtcagaacccaccgaacccgggtccatctcctccgtccccggtctcaccggaaacggtttgtgatgagtacagcacttgccctgaaggcaccacctgttgctgtatctatgagtactatggttattgttttgcatgggggtgctgtcctttggagggtgcttcttgctgcgaagatcactacagctgctgtccccatgattaccccatctgcgatgtgcgccgtggtacctgctctaagagcaagaacagcccgttggaaatgaaggcgatacagaggattctagcgacaccgacgaaggcgaagaggagcagtgcttgaagatgaggatagagatggaattcttacgccatggaaggcggaaaattcaatctgatgatacttttgttttatcagatacttgatttgtaaatactactgcattgattcctttcctcctgtattttgcatttgaacttggttacttcttttttgttagtatttaatacatcttactcttaaaaatagtggcaatagctattcagaaaaattataacaaatccaaaccaagcaaagtcataatttaagatttttggatatgctgaaattgaatcaattgtgacaagttcaaaccataagagacatacaaagaacataacaaactaaaaagcactttgtcttcccaaatcacaacttcaaaaatggaaatttcagatttctaacaacttcagacaagatatttctctaattcaacctctgggcagcctccttggcaagaaccctctcttttgccttagttttcgcctgcgatttcgaacccattatcccgccaccccacttctttctatactcctcatacttgtcgttaaagttggccttgatggcctccaagattcggctgaattccatcttatcttcgttcttgactgtagtcaagcacagtgctgctgcggttttctgatggacaatggttcctaatcgagatttccccttcacgatgcagtacgggatttccatctttctgcaaagagcgggaagccatacaaccaactcaatcggatccacatcatgggcaatgattaccaattgtgccttgttctgctcaataaggtaggtgacatggttcagaccatacttcacgacaataggcttcttagcttcggctgttttcccctctgactcagcctgagcccttttcagaaggcgttcctttttggcagccttatcctcgggcctgtacttgagtagcatcttgaacaaggtagttgcaagattcttgtcaagggtcttggtgaactggttcaatgcaggtggaaccttcaatctctgcttaaggatcctcctcttcctctggattctgacaacttgcggccatcttacgaacctgtgtacatccttcttgggaggcaaagctccacctatcccaaactgctttggccgtttctcgaacaacggattcacgaccttctcggttttcttcttggttgcaatcggctttccacctttcttcggagccattggtgggagttgcgattcaaggcttcgaaacggcgatgatgaa

SEQ ID NO: 4374 - DNA, 1041 bp, Flaveria ramosissima
atttctcttttagggttcttcacagtcgccgtctcgacgccttggatccgaagttctaccaatggctccgaagaagggtgtgaaggtcgcaacaaagaagaaaacggagaaggtagtgaatccgttgttcgagaaacggccgaagcagtttgggattggtggagctttgcctcccaaaaaggatctacacagatttgtaagatggccacaagttgttcgaattcagaggaagaggaggatcctcaagcagcgtttgaaggtgccaccagcattgaaccagttcaccaagacccttgacaaaaatcttgcaactactttgttcaagatgctacttaagtacagaccagaggataaagctgcaaagaaagaacgtcttttgaaaaaggcccaggcagagtcagaggggaaaacagttgaagctaagaaacccattgttgtgaagtatggtctcaaccatgtcacctacctaattgagcagaacaaggcacagttggtaatcatcgcccatgatgttgatccaattgaattggtcgtctggcttcccgctctctgcagaaagatggaaatcccctactgtattgtgaaaggcaaatcacgattaggagcaatcgttcaccagaaaactgctgcagcactgtgcttgactacagtcaagaacgaagataaaatggaatttagccgaatattggaggccatcaaggcaaacttcaagtgagaagtatgatgagtataggaagaagtggggtggtggaataatgggatcaaaatcacaagcaaagaccaaggcaaaagagagagttcttgctaaagaggctgctcagaggatgaattaggaagggtatttggtaatttttgagattttgagtttttttttctaaagataaaatattatggtactcttcagattattcttccatttttcacttttgggagttcaagtacttgtatctgtttgtttttggaatcatgtatgcaatgttttgtatgtgtttggacttggtcttgtgactagtagttcattggattcaaaccaaaatgtca

SEQ ID NO: 4375 - DNA, 826 bp, Lippia dulcis
tagggttttgttcactctttcattccagcagctgaagaaaatggctccaaagaagggtgttaaaccggttgccgccaagaaaaaggttgagaaagttgtcaacccactcttcgagaagaggccgaagcagttcggaatcggtggcgccctcccgccaaagaaggaccttcataggttcgtgagatggccccaagtcgtgcggattcagcgcaaaaagatgatcttgaagcagcgcttgaaggtgccgccgccaatccaccaattctctaaaacgctagacaagaatttggcaactagcctcttcaagatggttctcaagtataggcctgaggacagagcacaaaaagaaagacaggcttttgaagagagctcaagctgaggctgagggcaaaacccctgagaccaagaagccaattgtggtcaagtatggtctgaaccatgtgacttacctgattgagcagaacaaggctcagttggttgtgatcgctcatgatgtcgatcccattgagttggttgtgtggctccctgctttgtgcaggaagatggagatcccatactgcattgtcaagggcaaagctagattgggaagtatcgtccacaaaaaaactgcctcagttttgtgcttgacctcagtaaagaatgaggacaagatggaattcagcaaaatccttgaggctatcaaggccaacttcaatgacaaatatgatgagaccaggaagaagtggggcggcggtgtcatgggatcaaagtcacaggccaagaccaaggctaaggagagggttcttgccaaggaggctgcccagaggatgacctaagtagttcttgt

SEQ ID NO: 4376 - DNA, 1000 bp, Thalictrum flavum
acgatgagaacagaaaagctaactagggttttatcgtcactctcatcactaacgaaatggcccctaaaaaaggtgtaaaagcagtagtaacgaagaagaagcctgagaaggtatccaatcctttgtttgagaaacggccaaagcaatttggcattggtggtgcacttccaccaaagaaggatctgcatcgatttgtcaaatggccaaaagttgttcgtattcagaggcaacgtaggattctgaaacaacggttgaaggttcctccagctttgaaccagttcacaaaaacactagacaagtctcttgcaacgactcttttcaagatgctactcaaataccgaccagaggacaaggctgccaaaaaggaagacttgtgaagagggctcaagctgaagctgaggggaagactattgagtcaaagaagcccattgttgtgaaatatggcctcaaccacgttacataccttattgagcagaacaaagcccagttggtggttattgcccacgatgtggaccctatcgagcttgttgtttggcttcctgccttgtgccgcaaaatggagattccttatgttattgtgaagggaaaggctcgtcttggagcggttgtccacaagaaaactgcagctgctttgtgtttaacctctgtgaaaaatgaagataaaatggaattcagcagaattgttgaggcaatcaaggctaactttaatgacaagtacgatgagaacagaaagaaatggggtggtggcatcatgggatcgaagtctcaggctaagactaaggccaaggagaggctcttggcaaaggaagcagcacagaggatgaattgagtatagcagtagtagggaagggcctatactgggaagaagttttagctactgttttctatagttctgccttgtttctgtgttggtgaagttttgtattggatttgtccttgtgatctttacatttgttttggttcaccgttttagtagcaggaaacaaatccattttatagg

SEQ ID NO: 4377 - DNA, 880 bp, Ambrosia trifida
gccgccgattgcatctgaagctacactaatggctccgaagaaaggcgtgaaaactgttgcaactaagaagaaaacggagaaggtggtgaatccgttgttcgagaaacggccgaagcagtttggaatcggtggagctttgcctcctaaaaaggatgtacacaggtttgtcagatggccgcaagttgttcgaattcagaggaagaggaggatcctcaagcagcgtttgaaggttccgccagctttgaaccagttcactaagaccctcgacaaaaatcttgcaactacattgttcaagatgctactcaagtacagaccagaggataaagccgcaaagaaagaacgtcttttaaaaagagctcaggctgagtcagatgggaaaacggttgaatctaagaaaccaattgttgtgaagtatggtctgaaccatgtcacttacctaattgagcagaacaaggcacagttggtaatcattgcacatgatgttgatccaattgaattggttgtctggcttcccgcactctgcagaaagatggaaatcccctactgtattgtgaaagggaaatcgagattaggagctattgttcaccagaaaaccgctgcagcactgtgcttgactaccgtcaagaacgaagacaaaatggaattcagccggattttggaggctgtcaaggccaacttcaacgacaagtacgatgagtacaggaagaagtggggcggtggaataatgggatcgaaatcacaggcaaagacgaaggcaaaagagagagttcttgccaaagaggctgctcagaggatgaactagacaagaatttggtaatattttgcgattttggaacattttgttactttttaagaatcttggttcttccatttttcagtt

SEQ ID NO: 4378 - DNA, 1011 bp, Aquilegia formosa
gattttctttatttgttttgcaggcaccgaagaaaggtgtaagaactgctgcagcagctaagaagaagcctgagaaggtagtgaacccgttgtttgagaaacgaccaaagcagtttgggattggaggagcattacctccaaagaaagatctacatcggtttgttaaatggcctaaggttgttaggattcaaagacaaaggaggattcttaagcagcgtttgaaggttccacctgcattgaatcagttcactaagacactcgacaagagccttgctacaaacctattcaagatgcttctgaagtataggcctgaggacaaagctgcaaagaaggaacgtcttcttaaaagagctcaagctgaatctgaagggaagactattgaggctaagaagcctattgttgtgaagtatggactgaaccatatcacctacctcattgagcagaacaaagcgcaattggttgtgattgctcatgatgtcgatcccatagaattggttgtctggctaccagccctttgcaggaagatggagattccatactgcattgttaagggaaaagctcgacttggatcgattgttcacaagaagacagcttcagttttatgtttgacctcagttaagaatgaggataagatggacttcagcaagatactagaggctattaaggcaaacttcaatgataagtacgatgagtaccgtaaaaaatggggaggtgggatcatgggatccaaatcccaggccaaaaccaaggccaaggagaggcttattgctaaggaagctgcacaaaggttgaattaggcgactagcggtatctctgttatcttagtaatcatagatgagtgctattcctaggttcactttggttcagattttatcttttttagctgtagtctatctatcagaatccccaaacaacatctttattcatattgttatacaatctgctgattttgatattgctattccatattggagtggattttgataatatgatgctcccagattttgtaat

SEQ ID NO: 4379 - DNA, 959 bp, Arnica chamissonis
cattgctgccgtattgacgaatcgactccgaatctctaccaatggctccgaagaaaggtgtgaaggcggttgcaacgaagaagaaaacggagaaggtggtcaatccgttgtttgaaaaacggccgaagcagtttgggattggtggagctttgcctcctaaaaaggatgttcacagatttgttagatggcctcaagttgttcgaattcaacggaagaggaggatcctcaagcagcgtttgaaggtcccaccagctttgaaccagttcaccaagacccttgataagaatcttgcaactaccctgttcaagatgctactcaaatacagacccgaggataaagcagaaaaaaaggaacgacttttgaaaagggctcaggccgagtcagaggggaagacagttgaagcaaagaagccgattgttgtcaagtatggtctgaaccatatcacttaccttattgagcagaataaggcacaattggtaatcatcgcccatgatgttgatccaattgaattagttgtctggctacctgcactttgtagaaagatggaaatcccctactgcattgtgaaagggaaatctcggttaggaaccattgttcatcagaaaactgctgcagcactgtgcttgactacggtcaagaacgaagataaaatggaattcagccgcgttttggaagccatcaaggcgaacttcaatgataagtatgaggagtataggaagaagtggggtggtgggataatgggatcaaaatcacaggcaaagaccaaggcaaaagagagagttcttgccaaggaggctgctcagaggatgaattagagagcttagccatatgttgaggttgtgtttgtttttgtttaaaaacattttgttaccttttaagaatcttgttcttccatttttggacttttgggagatctaaaatagtttacttgatgtttttgtgttctgtttttggacatg

SEQ ID NO: 4380 - DNA, 1168 bp, Catharanthus roseus
ctatactttgtcatcaaagctcaaaccgccgaaccgcagcagagatggctccaaagaagggtgccaagcttccggtgtcagcggcgaagaagaagcctgagaaggtcgtcaatcctttgtttgaaaagaggccgaaacagttcggtattggtggagctttgccgccgaagaaggatcttaccagattcgtgaaatggccgcagaacgtcaggatccagaggaagaagaggattctcaggatgcgattgaaggttcctccagccatcaatcaatttgcaaaaacgcttgataagaacttggctagtagtctgtttaagatgctacttaaatacagacctgaagataatgttacaaaaaaggagcgcctattgaaaagagctcaagctgaagcagacggtaaaacagctgatgcgaagaagcccattgtcgtgaagtatggtctgaaacatgtgacctatcttattgaacagaacaaggcccaattagttgttattgctcacgatgtggatccaattgaattggttgtttggcttccacatttgtgcagaaagatggaaattccatactgcattgtgaaaggcaaagcacgacttggatctattgtgcacaagaaaactgcttcagtgttatgcctaacctccgtgaagaatgaggataaattggatttcagcaaaattctggaagctatcaaggccaatttcaacgataaatttgatgagcaaaggaagaaatggggtgggggtgtcatgggctccaaatcccaagcaaaaaccaaggccaaggaaaggcttcttgccaaagaagctgcccagagaatgtcttaatgggcattaacctcttggaagcgggaatgtcttgtgttctagatgggtctttggttacttctcgttgcttttaaatttgtctttagtattatgaagtttagagagtgttacttacgatacttattgaatgaagaatcttgataggaagttttgtctgagttgcattttcaattattacttgtggaaccaatggaatgcatattgaatgggctgcagaattgatttgtattttttttttttcatacatgtcacatttttagatattacccattaagaaaatatgtattaaatggtttattgttatatagattagaatgatttttaaataaattattttcattatt

SEQ ID NO: 4381 - DNA, 1092 bp, Centaurea maculosa
  misc_feature (57)..(57): n is a, c, g, or t
  misc_feature (79)..(79): n is a, c, g, or t
gggggtctttttgttctgaaagaaaccctcgtgcatttgtgttagggttcttcatcntcatcgccgtttcgaagccttngaatcccaacttccaccaatgggtccgaagaaaggtggaaagccgattgcaacgaagaagaaaaccgagaaggtcgttaatccattgtttgagaaacggccaaagcagtttgggataggtggagctttgcctcccaagaaggatgtccatagattcgttagatggccacaagttgtcagaatccagaggaagaggaggatccttaagcagagattgaaggttccacctgctttgaaccagttcacaaagacccttgacaagaatcttgcaactactttgttcaagatgctactcaagtacaggcccgaggataaggccgccaaaaaggaacgtcttctgaaaagggctcaggctgagtcagaggggaaaacagccgaagctaagaagcctattgtcgtgaagtatggtctgaaccatgtcacctaccttattgagcagaacaaggcacaattggtaatcattgcccacgatgtggatccgattgagttggttgtatggcttcccgctctttgcagaaagatggaaatcccctactgcattgtgaaggggaaatcccgattaggaaccattgtccatcaaaaaaccgcagcagcactgtgcttgactacagtcaagaacgaagataagatggaattcagccgaatcttggaggccatcaaggcgaactttaacgacaagtatgaggagtatagaaagaagtggggtggtgggataatgggttcgaaatcgcaggctaaaacaaaggcaaaagagagggttcttgccaaggaggctgcccagaggttgaattagagaaaatatcatcatgtctgaagttgttagaaatctaaaatttccatttttgaagttgtgatttgggaggacaaagtggtttttagtttgttatgtttctttgtatgtctcttatggtttgaacttgtcacaattgattcaatttcagcatatccaaaaatctaaaattatgactttgtttggtttggattttgttataattttttgaagtagctgttgcc

SEQ ID NO: 4382 - DNA, 976 bp, Centaurea maculosa
  misc_feature (112)..(112): n is a, c, g, or t
  misc_feature (124)..(124): n is a, c, g, or t
  misc_feature (199)..(199): n is a, c, g, or t
  misc_feature (595)..(595): n is a, c, g, or t
cgcgggggccgtttcagaccttcagctcaacttttcagccatgggaccaaagaaaggtggaaaggcggtagcaaccaagaagaagacggagaaggttgtaaacccgttgttngaaaagaggccnaagcagtttggaattgggggagctttgcctcctaagaaggatgttcataggttcgttagatggccgcaagttgtncgcattcagaggaagaggaggatcctcaagcagcgtttgaaggtcccacctgcattgaaccagtttaccaagacccttgacaagaatcttgcaactactttgttcaagatgctgctcaagtacaggcctgaggataaagctgcgaaaaaggaacgccttcttaaaagagctcaagccgagtctgaaggaaagacagccgaagccaagaagcctattgttgtgaaatacggtctgaaccacgtcacctatctcattgagcagaacaaggcacaattagttattattgctcatgatgtggatcccatcgagttggttgtctggcttcctgctttatgcagaaagatggaaatcccatactgcattgttaagggaaaatctcgtctaggaactatcgtncaccagaaaaccgcagcagctttgtgcttgaccaccgtcaagaacgaagataagatggagtttagccgaattttggaggccatcaaggctaacttcaatgacaagtatgaggagtataggaagaagtggggtggtggaataatgggttccaaatcccaggctaaaacaaaggctaaagagagggttttggccaaggaggctgctcagaggttgaattagattgagtgagaaagatcccttctttgatcatgtaatgtctgatgcatttgagagttttgcatttagaaacttttttgtttttgtttttagaacccttattcaacttttggaagttaaaaatacttggcttatttcaatatcaacctgtcaaattttggtcat

SEQ ID NO: 4383 - DNA, 927 bp, Centaurea maculosa
  misc_feature (38)..(38): n is a, c, g, or t
  misc_feature (350)..(350): n is a, c, g, or t
  misc_feature (656)..(656): n is a, c, g, or t
  misc_feature (659)..(659): n is a, c, g, or t
  misc_feature (776)..(776): n is a, c, g, or t
  misc_feature (794)..(794): n is a, c, g, or t
  misc_feature (861)..(861): n is a, c, g, or t
gcgggggatttgattgtcttcctcttctcgccgctttnaaccagcaacctcctctacttccatcaatgggtccaaagaagggtggaaagccgattgcaacgaagaagaagacggagaaggtggttaatccgttgttcgagaagaggccgaagcagtttgggatagggggagcattgccaccaaagaaggatgttcatagatttgtgagatggccacaagttgttcgaattcagaggaagaggaggatcctcaagcagcgtttgaaggttccacctgctttgaatcagttcaccaagacacttgataagaatcttgcaactactttgttcaagatgctgctcaagtaccgncccgaggataaagcagccaaaaaggaacgtctcttgaaaagggcacaggccgagtctgaagggaagacagcagaagccaagaagcctattgttgtcaagtatggtctgaaccacgtcacctatctcattgagcagaacaaggcgcaactagtcatcatcgctcacgatgtggaccccattgagctggttgtctggcttcctgcattgtgcagaaagatggaaatcccttactgcattgtgaagggaaaatctcgattgggaactattgttcaccaaaaaaccgcagcagctctgtgtctgactacngtnaaaaatgaagacaagatggagttcagcagaatcttggaagcaatcaaggccaactttaatgacaagtacgaagaataccgaaagaagtggggtggtggaataatgggttccaaatcncaggcgaaaacaaaagcnaaggagagggttcttgccaaggaggctgctcaaaggttgaattagagcgctcttcattatctataanaaaaatatgcagttcagagagctatgtttagtacctttgttacattggtcagtgttgatttctttt

SEQ ID NO: 4384 - DNA, 973 bp, Centaurea maculosa
cgggggcgtttcagaccttcttcagctcaactttcagccatgggtccaaagaaaggtggaaaggcggtagcaaccaagaagaagacggagaaggttgttaatccgttgttcgagaagaggcctaagcagtttgggattgggggagctttacctcctaagaaggatgtgcataggttcgtgagatggccgcaagttgttcgcattcagaggaagaggaggatcctcaagcagcgtttgaaggtcccacctgcattgaaccagtttaccaagacccttgacaagaatcttgcaacgactttgttcaagatgctgctcaagtacaggccagaggacaaagctgcgaaaaaggaacgcctcctcaaaagagctcaagcagagtctgaaggaaagacagccgaagccaagaagcccattgttgtgaaatacggtctgaaccacgtcacctatctcattgagcagaacaaggcacaattagttatcattgctcatgatgtggatcccatcgagttggttgtctggcttcctgctttatgcagaaagatggaaatcccatactgcattgttaagggaaaatctcgtctaggaactatcgtccaccaaaaaaccgcagcagctttgtgcttgaccacggtcaagaacgaagataagatggagtttagccgaattttggaggccatcaaggctaacttcaatgacaagtatgaggagtataggaagaagtggggtggtggaataatgggttccaaatcccaggctaaaacaaaggctaaagagagggttttggccaaggaggctgctcagaggttgaattagattgagtgagaaagatccccttctttgatcatgtaatgtctaatgcatttgagagttttgcatttagaaacttttttgtttttgtttttagaacccttgttcaacttttggaagtaaaaatacttggcttattcaatatcaacctgtcaaattttggtca

SEQ ID NO: 4385 - DNA, 1198 bp, Cicer arietinum
ccggtagtggacaggcccaagttaacacatataagaaacgattccaattagggtttctcttcggagagttttgcgtcaccgcacggacacgaccagtagcacctacagcaatggcccccaaaaaaggtggaaaagctccagttctagcttctaagaagaaacctgagaaggttacgaacccgttgttcgagaaacgtccgaagcagtttggaattggaggtgcgttgccaccgaagagggacttgaccagattcgttaagtggccaaagactgttcagattcagagaaagaagaggattctgaagcagaggttgaaggttccaccagctttgaaccagttcacaaaaacccttgacaaaaacctagcaaccagcctgttcaagattcttctgaaatacaggcctgaagataaggcagaaaagaaagagaggcttttgaaaagggctcaggcagaggctgagggcaaaacaattgaaactaagaagcctattaatgtgaagtatggtctcaatcatgttacctacctcattgagcagaacaaagctcagcttgttgtgattgctcatgatgtcgacccaattgaattggttgtgtggcttccagcattgtgcaggaagatggaaattccttactgtattgtcaagggcaaggctcgccttggaacagttgtccacaagaaaactgcatccgttttatgtttgacaactgttaaaaatgaagacaaaatggagttcagcagggtcctagaagcaatcaaggcaaacttcaacgacaagtatgacgaaaacaggaagaagtggggaggtggagtcatgggttccaaatcacaagccaaaacaaaggccaaggaaaggcttattgccaaggaagctgcccagaggatgaattaggagttttgttatatgttgttgctttgtcctaccatttttgtgttactttttatgcaaattctattttacttgaatctaaagttttcccctagtttggcattacgaattatgaccaccaaaacgtttgttatttataatagccatagtatttctttaaaatatcctgcctttatctagctatttgattgattatatacaaggttgccacaggcgctctaattttggtagaatcataacatcaaatatcttattacaaataatagaatcaaatagttaaagatatactatgcatcaatacattccaatgc

SEQ ID NO: 4386 - DNA, 935 bp, Cirsium arvense
cctctacttccatcaatgggtccaaagaagggcggaaagccgattgcaacgaagaagaagacggagaaggtggtaaatccgttgttcgagaagaggccaaagcagtttgggatagggggagcattgccaccaaagaaggatgttcatagatttgtgagatggccgcaagttgttcgaattcagaggaagaggaggatcctcaagcagcgtttgaaggttccacctgctttgaatcagttcacaaagacacttgataagaatcttgcaaccactttgttcaagatgctgctcaagtaccgacccgaggataaagcagccaaaaaggaacgtctcttgaaaagggcacaggccgagtctgaagggaagacagcagaagccaagaagcctattgttgtcaagtatggtctgaaccacgtcacctacctcattgagcagaacaaggcgcaactagtcatcattgctcacgatgtggaccccattgagctggttgtgtggcttccggcattgtgcagaaagatggaaatcccttactgcatcgtgaagggaaaatctcgattgggaactattgttcaccaaaaaaccgcagcagctctgtgtctgactacagtaaaaaatgaagacaagatggagttcagcagaatcttggaagcaatcaaggccaactttaatgacaagtacgaagaataccgaaagaagtggggtggtggaataatgggttccaaatcccaggcgaaaacaaaagcgaaggagagggttcttgccaaggaggctgctcaaaggttgaattagagctcttcattatctaaaaaaaatatgcagttcagaaggctatgtttagtacctttgttacattggtcagtgttgattccttttaacttccagaaggctagttatcttgtgctttcttacatgtgctttgattgtgttacagttta

SEQ ID NO: 4387 - DNA, 952 bp, Cirsium arvense
aactttcagccatgggtccaaagaaaggtggaaaggcggtagcaaccaagaagaagacggagaaggttgttaatccgttgttcgagaagaggcctaagcagtttgggattgggggagctttacctcctaagaaggatgtgcataggttcgtgagatggccgcaagttgttcgcattcagaggaagaggaggatcctcaagcagcgtttgaaggtcccacctgcattgaaccagtttaccaagacccttgacaagaatcttgcaacgactttgttcaagatgctgctcaagtacaggccagaggacaaagctgcgaaaaaggaacgcctcctcaaaagagctcaagcagagtctgaaggaaagacagccgaagccaagaagcccattgttgtgaaatacggtctgaaccacgtcacctatctcattgagcagaacaaggcacaattagttatcattgctcatgatgtggatcccatcgagttggttgtctggcttcctgctttatgcagaaagatggaaatcccatactgcattgttaagggaaaatctcgtctaggaactatcgtccaccaaaaaaccgcagcagctttgtgcttgaccacggtcaagaacgaagataagatggagtttagccgaattttggaggccatcaaggctaacttcaatgacaagtatgaggagtataggaagaagtggggtggtggaataatgggttccaaatcccaggctaaaacaaaggctaaagagagggttttggccaaggaggctgctcagaggttgaattagattgagtgagaaagatccccttctttgatcatgtaatgtctgatgcatttgagtagttttgcatttagtaaacttttttgtttttgtttttagaacccttgttcaacttttggaagttaaaaatacttggcttatttcaatatcaaaaagaaaaagtaccgactgcg

SEQ ID NO: 4388 - DNA, 982 bp, Taraxacum officinale
cgggggccgttttcagaccttcaatctcaacgtccagagtccagacatggctccaaagaaaggtggaaaggcagtagcaacaaagaagaaaacggaaaaggtagcgaatccgttgtttgagaagaggaccaaacagttcggaataggaggagcattgcctcctaagaaggatgtccacaggttcgtaagatggccgcaagtcgttcgcattcagaggaagaggagaatcctcaagcaacgtttgaaagtaccacctgctttgaaccagttcaccaaaaccctagacaaaaatctcgccactactttgttcaagatgcttctcaagtacaggcccgaagacaaggccgctaagaaggaacgtcttattaaaagagctcaagctgaatctgaaggaaagacagctgaagcgaaaaagcctattgttgtcaagtacggtctgaatcacgtcacttatctcatcgagcagaacaaagctcaattagttgtgattgctcatgatgtggaccccattgagttggtcgtctggcttccagctttatgcagaaagatggaaatcccttactgcatcgtcaagggcaaatcccgtcttggaactattgttcaccagaaaaccgcagcagcattgtgcttgacaacagtcaagaacgaagataaaatggaattcagcagaatattggaggccatcaaggcaaactttaatgacaagtatgaagagtataggaagaagtggggaggtggaataatgggatcaaaatcacaggcgaaaacaaaggcaaaggagagggttttggccaaggaggctgctcagaggctgaattagaaaaaaaaccttttttgtaatggagagagttttgcatttagaaactttttattgtttttttagactttatttgggtgcttcaactttttaggacttaaaattgaatactttgctgttgacttatttctatattgcccaacttatcagttttggtcatttaag

SEQ ID NO: 4389 - DNA, 917 bp, Taraxacum officinale
gcacttcgtcgctgtattcgaacccgaagtctcaactttcatcaatggctccaaaaaagggtgggaaggcggcggcagcgaagaagaaaacggtggcggttgtaaacccactgttcgagaaaaggccgaaacagtttggcatcggaggagcattgccaccgaagaaggacgttcacagatttgtgcgatggccgcaagttgttcgtattcagaggaaaagaaggattctcaagcaacgtttgaaggttccacctgccctaaatcagttcaccaagaccctcgacaaaaatctagctaccactttgttcaagatgctcctcaagtacagacctgaggataaagcatcaaaaaaggaacgccttctgaaaagagctcaagcagaatctgaaggaaagacagctgaatccaagaagccaattgttgtcaaatatggtctcaaccatatcacctatcttattgagcagaacaaggctcaattggtgatcattgctcatgatgtggaccccattgagttagttgtgtggcttcctgcattatgcagaaagatggaaatcccttactgtattgtgaaggggaaatctcgattaggaactattgttcatcagaaaacagcagcagctttgtgcttgacaacagtcaagaatgaagacaagatggagtttagcagaatcttggaagccattaaggccaattttaatgataagtatgaggagtacagaaagaagtggggtggagggataatggggtcgaaatcacaggctaaaacaaaagccaaggagagggttcttgccaaggaagctgctcagagattgacataaatgccctttttcagtaactagaaaagttttgtgtttagaacattttgttaactttctcattggtgatttattatatttttctcaaaggcaaaatacatg

SEQ ID NO: 4390 - DNA, 1110 bp, Medicago truncatula
ggggagagttttcgtcaccgcacagcacagcacagacacagagcattagcaccagcagcaatggctcccaaaaaaggtgttaaagctccagttgcagcttcaaagaagaaacctgagaaggttacgaacccacttttcgagaagcgtcctaagcaatttggaattggaggtgcattgccacccaagagggatttgaccagattcgttaagtggccgaagaatgttcaggtgcagaggaagaagaggattttgaagcagagattgaaggttccaccagctttgaaccagttcactaagaccctcgacaaaaatctagccacaagcttgttcaagatacttctgaagtacaggcctgaggacaaggctgagaagaaggagaggcttttgaaaagggctcaggcagaagctgagggcaaaacagttgaaactaagaagcctattaatgtgaagtatggcctcaatcatgttacctacctcattgagcagaataaagcccagcttgtcgtgattgctcacgatgtcgaccccattgaattagttgtctggcttccagccttgtgcaggaagatggaaatcccatactgtattgttaagggcaaggcccgcctaggaactgttgtccataagaaaactgctgctgttttgtgcttgaccacggttaaaaatgaagacaaaatggagttcagcagggtcctagaggcgattaaggcaaatttcaatgacaagtatgaggagtacaggaagaagtggggtggtggaatcatgggttccaaatcccaagccaagaccaaggcaaaggaaaggcttattgccaaggaggctgcccagagaatgacctaggagttgtgtgttatattctgttgtttctttatgccaattttgtgttatttactcaaattgaagttttttttgtagtcttgatttcctaacaaaaacgtttgttatttacaatagccggagtattattttttcttcaagttatcctggattcatcataaacaatattacctctggcaacagaattttggtataatcatatgatcaaatgtttttattaaaatttaaattgtagaatcaaatagtcatagatctaacgtctcatttcaatcc

SEQ ID NO: 4391 - DNA, 1363 bp, Mimulus guttatus
aaaaaaaatggatttatcaagaagtcaaaattgaatgaggggtgtttgtcatatagcccctacaaaataattagattttattaggcggcccgataacaaataacataagttaggcccaatcggtcgggcccaatagtggaggcccaaatagtgggagtgataaccctagcctcactcaatatttagggtttcagctcattttcacatccagcattctcacaccttctcttccgttcaccaccgctcgcagcagagaaaatggctccaaagaagggtgcaaagctgccggttgccgccaagaagaagacggagaaagttgtaaatccactcttcgagaaaaggcccaaacagtttgggatcggcggtgctcttccccctaagaaggatcttcaccgatttgtgaaatggccgcaagttgtgagaattcagaggaagaagatgatcctcaagcagcgtttgaaggtcccgccgccaattcaccagttctccaaaaccctagacaagaacttggcaacaagtctcttcaaaatgcttctcaaatataggcctgaggacaaagctgagaagaaggatcgtcttctgaaaagagctcaggctgaggctgagggaaaatctcccgaaacaaaaaagcctattgtggtgaaatatggcctcaaccatgtgacatatctcatcgaacagaacaaagctcaactggttgtcattgctcatgatgtcgacccaattgagttggttgtgtggctccctgctctatgcaggaagatggagattccttactgtattgtgaaagggaaagctagattgggaactattgtccacaagaagactgcctctgttttatgcttgacctcagttaagaatgaagacaagatggacttcagtaagatcctggaggcaatcaaggccaatttcaatgataaatacgacgagaccaggaagaagtggggtggtggtgttatgggttcgaaatctcaggccaagactaaggccaaggagagagttcttgcaaaggaagctgcacagaggatgacctagagacattttgctaaatatgtctattagggttagaatcgaatatgagtatttctgatgtgcaacttgttttccccaggttcagattagacatgaattttgtttttattttgaaattgccccttttatttttaaatcgaatctgcttcaagtggactacatgaatcgagcttgttatttaaagtttttctggttttgttgaatttatctatgtaacttgatgtttgatctgtgctattcctctgctgtgtcctgatcattaaaattattagttatatattgaactacttttatttttcatttttaataatatttgcacgtgagtgttatt

SEQ ID NO: 4392 - DNA, 1082 bp, Nicotiana benthamiana
gggtttgttcctccggtcgccgtctgaagaaaatggctccaaagaagggtgtagcagtagcatcaaagaagaaaccggctcaggcgaaggtggtgaatccactgttcgagaagcggcccaagcagttcggaatcggtggtgcgttgccaccaaagaaggatctgactaggttcgtgaaatggccacaggtggttcgtatccaaaggaagaggaggattcttaagcagaggttgaaggtccctcctgctctcaaccagttctccaaaaccctggacaaaaacctcgcgacaaacctgttcaagatgcttctcaagtacaggcccgaggacaaagctgcaaagaaggagcgtcttgtgaaaagagctcaagctgaagctgaaggaaaaacacctgaaacaaagaaacctatcattgtgaagtatggtctcaagcacatcacataccttattgagcagaacaaagcacaactggtagtgattgctcatgatgtggacccaattgagttagttgtctggcttcctgctctatgcagaaagatggaaattccttactgcattgtgaaggggaaagcacgtttaggatcgattgtgcataagaaaactgcttcagctctgtgtttgacaacagtgaagaatgaagataaaatggagttcagcagaattttggaggcaatcaaggctaacttcaatgacaagtatgaggaaaacaggaagaagtggggtggcggtgtcatgggttccaaatcacaggccaggaccaaagcgaaagagagggttcttgccaaggaagctgcccaaagaatgaactaagagctttctgtgatatacactgcaattggatttagagagtttctcggccaaattttgtgtttggtccacatgcttgactatgctagagatgttagttttgataaagcttctttgtgtttgccttcttttgcagattattgatctgagggagaagcattaaattgtatcagaagtttttgttagatattttgttaaattgggtttttatgatagcgagatgggaagtcaatcaattaactacacttttattgcttagatatcactttgcttatt

SEQ ID NO: 4393 - DNA, 962 bp, Nicotiana benthamiana
ggctccgaagaagggcgtagcagtagcagcaaagaagaagccggtagcgaaagtggtgaacccattgttcgagaagcggccgaagcagttcggaatcggtggtgcattgccgccgaagaaggatctcacccggttcgtgaaatggcctcaggtggtcaggattcaaaggaaaaggaggatccttaagcagaggttgaaggtcccccctgctctcaatcagttctctaaaaccctagacaaaaatctcgctacaaacctattcaagatgcttctgaagtacaggcctgaggacaaggctgcaaagaaggagcgccttgttaaaagagctcaagccgaggcagaaggcaaaactcctgaaaccaaaaaacctattattgtaaagtatggtcttaagcacatcacctaccttatcgagcagaataaagcgcagttggtggttattgcacatgatgttgacccaatagaattggttgtctggctcccagcattgtgcagaaagatggaaattccatattgtatcgtgaagggaaaagcacgtttaggatcgattgtgcataagaaaactgcttcagcattatgcttgacaactgtgaagaatgaagataagatggagttcagtagaattttggaggcaatcaaggccaacttcaatgataagtacgaggagaacagaaagaaatggggtggtggtgtcatgggctccaaatcacaagccagaaccaaggctaaagagagagttctcgccaaggaagctgctcagagaatgaactagtgttttctggttcgaagttagagatcttacgtgctttagtctttttatctttgccttcttccgcagattatagctttatgcaagaaactttgaaaccatatcatttttttggactatgattcctgatttgagttggtcatgtatgagcggtgaaatatcgaggctttcattaactatgcttgttttctct

SEQ ID NO: 4394 - DNA, 912 bp, Nicotiana benthamiana
tcctcctccgctcgcctcgccgtctgaaaggaaaatggctccaaagaagggcgtagcagtagcagcaaagaagaagccagttgcgaaagtggtgaacccattgttcgagaagcggccgaagcagttcggaatcggtggtgcattgccgccgaagaaggatcttacacggttcgttaaatggccccaggtggtcaggattcaaaggaaaaggaggatccttaagcagaggttgaaggttccccctgctctcaatcagttctctaaaaccctcgataaaaatctcgctacaaacctattcaagatgcttctgaagtacaggcccgaggacaaggctgcaaagaaggagcgccttatcaaaaaagctcaagccgaggcagaaggcaaaactcctgaaaccaagaaacctattattgtaaagtatggtcttaagcacatcacctaccttatcgagcagaataaagcacagttagtggtgattgcacatgatgttgacccaatagaattggtcgtctggctcccagcattgtgcagaaagatggaaattccatattgtattgtgaagggaaaagcacgtttaggatcgattgtgcataagaaaactgcttcagcattatgcttgacaactgtgaagaatgaagacaagatggagttcagtagaattttggaggcaattaaggctaacttcaacgataagtacgaggagaacagaaagaaatggggtggtggtgtcatgggctccaaatcacaagccagaaccaaggctaaagagagagttctcgccaaggaagctgctcagagaatgaactagtgttttctggttcgaagttagacatcttacgtgctttagtctttttatctttgccttcttccgcagatttagctttatgcaagaaactttgaaaccatatcatt

SEQ ID NO: 4395 - DNA, 861 bp, Carthamus tinctorius
cattggcgggggcgtttcagaccttcatctcagctttcagacatgggtccaaagaaaggtggaaaggcggtagcaaccaagaagaagacggagaaggttgtgaatccgttgtttgaaaaaaggcctaagcagtttggaattgggggagctttgcctcctaagaaggatgttcataggttcgttagatggccgcaagttgttcggattcagaggaagaggaggatcctcaagcagcgtttgaaggtcccacctgccttgaaccagtttaccaagacccttgacaagaatcttgcaactactttgttcaagatgctgctcaagtacaggccagaggataaagctgcaaaaaaggaacgcctcctcaagagagctcaagccgagtctgaaggaaagacggccgaagcaaagaagcctattgttgtgaagtatggtttgaatcacgtcacctatctcattgagcagaataaggctcaattagttattattgctcatgacgtggatcccatcgagttggttgtgtggcttcctgcgttgtgcagaaagatggaaatcccatactgcatcgtgaagggaaaatctcgtctaggaactatcgtccatcagaaaaccgcagcagctttgtgcttgaccaccgtcaagaacgaagataagatggagtttagccgaattttggaggccatcaaggctaacttcaatgacaagtatgaggagtataggaagaagtggggtggtggaattatgggttccaagtcccaggctaaaacaaaggctaaagagagggttttggccaaggaggctgctcagaggttgaattagattgagtgagaaagatcccttctttgatcatgtaatgtctgatgc

SEQ ID NO: 4396 - DNA, 904 bp, Carthamus tinctorius
  misc_feature (876)..(876): n is a, c, g, or t
cgcggggagatctcgttgccatcctctcttcttatcgccgctttgaaccaggaacctctacttccatcaatgggtccaaagaagggtggaaagccgatcgcaacgaagaagaaaacggagaaggtagtaaatccgttgttcgagaagaggccgaagcagtttgggatagggggagcattgccaccaaagaaggatgttcatagatttgtgagatggccacaagttgttcgcattcagaggaagaggaggatcctcaagcagcgtttgaaggttccacctgctttgaatcagttcaccaagacactcgacaagaatcttgcaactactttgttcaagatgctgctcaagtaccggcctgaggataaagcagccaaaaaggaacgtctcttgaaaagggcacaggctgagtctgaagggaagacagccgaagccaagaagcctattgttgtcaagtatggtctgaaccacgtcacctatctcattgagcagaacaaggcgcaactagtcatcatcgcccacgatgtggaccccattgagctggttgtctggctacctgcattgtgcagaaagatggaaatcccttattgcattgtgaagggaaaatctcgattgggaactattgttcaccaaaaaaccgcagcagctctgtgtctgactacagtcaaaaatgaagacaagatggagttcagcagaatcttggaagcaatcaaggccaactttaatgacaagtacgaagaataccgaaagaagtggggtggtggaataatgggttccaaatctcaggcgaaaacaaaagcaaaggagagggttcttgccaaggaggctgctcaaaggttgaattagagctctccattatctattaaaaaagtatgcagntcagaaggctatgtttattaccttttgt

SEQ ID NO: 4397 - DNA, 983 bp, Salvia sclarea
gcacgaggcgcagcagcagcagcagcagaagaagaaaaatgcctccaaaaaagggtgcgaagcttccggccgccgccaagaagaaggcggagaaagttgttaaccccctcttcgagaagaggccgaagcaattcgggatcggcggcgccctcccgcccaagaaggaccttcacaggttcgtaagatggccgcaagttgtgcggattcagcggaagaagatgatcttgaagcagcggttgaaggtgccgcccccgattcaccagttctcgaaaacactggacaagaacttggcaacaagcctattcaaaatgttgctcaagtatagacctgaggatagagctcaaaagaaagatagactcttgaaaagagctcaagctgaagcagagggcaaaacgcctgagaccaagaaacccatcgtggtgaagtatggtctcaaccatgtgacatatctgattgagcagaacaaagcacaattggtcgtcatcgcccatgatgtcgatcctattgagttggttgtgtggctacctgctttgtgcaggaagatggagatcccatactgcattgtcaagggcaaagctagattgggaagcattgtccacaagaaaactgcctctgttctatgcttgacctcagtaaagaacgaggacaagatggagtttagcaaaatccttgaggctatcaaggccaacttcaacgacaaatatgacgagaccaggaagaagtggggaggtggtgtcatgggatcaaagtcacaggccaagaccaaggctaaggagagggttcttgccaaggaggctgctcagaggataatctaagtagtccattagttagtgtcaaatgagagagctcttattctgcaattgctttacccacatcaaacatgaattttgtttttgtttgaatgcaacgttttgtttctgtttggagtacccttggaatagactatctaaatggataaatctttgttcctcaaaaaaaaaaaa

SEQ ID NO: 4398 - DNA, 962 bp, Euphorbia esula
  misc_feature (8)..(11): n is a, c, g, or t
  misc_feature (21)..(21): n is a, c, g, or t
  misc_feature (293)..(293): n is a, c, g, or t
  misc_feature (314)..(314): n is a, c, g, or t
cggaaggnnnngttctcatcntctccggctaaccatcaatggctcctaaaaaaggtgtgaaggctccagtagcagcgaagaagaagactgaaaaggttgtgaatcctttgattgagaagaggcccaagcagttcggaatcggaggtgcattgccgccaaaaaaggatttgactagatttgtgaagtggcctcatgttgttcgtattcagaggcaaaggagaattttgaagcaacgtctcaaggttcctccagctgttaaccagttcactaagaccttggataagaaccttgcnacccagcttttcaagttactnctcaagtatagacctgaggacaaggcagccaagaaggaaaggcttctccagagggcacaagctgaggctgagggaaaaactgtggaatccaagaagcctattgtcgttaaatatgggcttaaccatgttacttaccttattgagcagaacaaggctcaattggttgtaattgcacatgacgttgacccaattgagctggtcgtatggttgcctgccttgtgccgcaaaatggaggtaccttatgcaattgtcaagggcaaatccaggcttggagcgattgtccacaagaaaactgctgcagctttgtgcatcacctccgtgaagaatgaagacaagatggaattctctaaaatcttggaggctgttaaggccaacttcaatgacaagtttgacgagcacagaaagaagtggggtggtggtattatgggatccaagtcgcaggctaagagcaaggccaaggaaagagtcttggcaaaggaggctgctcaaagaatgaactgagtttgtagcaattagttgatagtgaaatttcatatgttggtggtttgttttgttaaaaattttgcattgatggagtttatgcttagttttactgtgggataaatgacatttcttgtttcctattctattatccctggattttgcttt

SEQ ID NO: 4399 - DNA, 1033 bp, Helianthus annuus
gaacctaaacttaatcttggtcttcgttgtaaagcaacacacatacatttctgttagggttcttcattgtcgccgtatcgccgcttgaattcaaagttcaactaatggctccgaagaaaggcgtgaagactgttgcaactaagaagaaaacggagaaggtggtgaatccgttgtttgagaaacgtccaaagcagtttggaatcggtggagctttgcctcctaaaaaggatgtgcacagatttgtaagatggccacaagttgttcgaattcagaggaagaggaggatcctcaagcagcgtttgaaggttccaccagctttgaaccagtttaccaagacccttgacaaaaatcttgcaactacattgttcaagatgctactcaagtacaggccagaggataaagctgcaaagaaagaacgtcttttaaaaagagctcaggctgagtcagatgggaaaacggttgaagctaagaaaccaattgttgtcaagtatggtctgaaccatgtcacttacctaattgagcagaacaaggcgcaactggtaatcatcgcccatgatgttgatccaattgaattggttgtctggcttccggcactctgcagaaagatggaaatcccctactgtattgtgaaagggaaatcacgattaggagccattgttcaccagaaaaccgctgcagcactgtgcttgactacagtcaagaacgaagataaaatggaattcagccggattttggaggctgtcaaggcaaacttcaatgacaagtatgaagagtacaggaagaagtggggtggtggaataatgggatcaaaatcacaagcaaagaccaaggcaaaagagagagttcttgccaaagaggctgctcagagaatgaactaggctgaatttggtaatattttgagattttgaaacattttgttactttttaagaatcgtgttctcccattttcagtttttgggaggtcaatactcatgtatgcttcttattgtatgtgtttggtttttggttctgtgacagttgattcaattccaga

SEQ ID NO: 4400 - DNA, 925 bp, Helianthus annuus
gattctcgctgttcgataactgaatctcaacatccatcaatggcgccgaagaaaggtgtgaaggcagtcgcaaccaagaagaaaacggagaaggttgtgaaccctctgttcgagaaaagaccgaagcagttcgggatcggtggagcattgccgcctaagaaggatgttcataggtttgtgagatggccgcaagttgttcggattcagaggaagaggaggattttgaagcagcggttgaaggttccacctgctttgaatcagttcactaagactcttgataagaatcttgcaactactttgttcaagatgcttctgaaataccgaccggaggataaagcagctaaaagagagcgtcttcagaaaagggcacaagccgagtctgaaggaaagacagttgaagccaagaagcctattgttgtcaaatacggtctgaaccatatcacctatcttatcgagcagaacaaggcgcaattggtcatcattgctcatgatgtggaccccattgagttggttgtttggctccctgctttgtgcagaaagatggaaatcccttattgcattgtaaagggaaaatctcgattaggagctattgtccatcagaaaactgcagcagctctgtgtttgaccaccgtcaagaatgaagataagatggagttcagcagagtcttggaagcaattaaggccaacttcaacgataagtatgaggaatatagaaagaagtggggcggtgggattatgggatccaaatctcaggccaaaacaaaagcaaaggagagagtacttgcaaaggaggctgctcagaggatgacatagagcgctacactatcctttgttgcattctgcaattcaggaagctgtttttgtttacattttgcttgttcatgtattcaattttgttaaagttatattagcaagaccaatgcta

SEQ ID NO: 4401 - DNA, 905 bp, Helianthus annuus
gacatggctccgaagaagaagacggtagcaaccaagaagaaaacggagaaggtagtgaatccgttgtttgagaagaggccgaagcagtttggaataggtggagcattgccgcctaagaaggatgtgcacaggtttgtaagatggccacaagttgttcgtattcagaggaagaggaggatcctcaagcagcggttgaaggtgcctcctgctttgaaccagttcaccaaaaccctagacaaaaatctcgcaactactttgttcaagatgctgctcaagtacaggccagaggacaaggcagcaaaaaaagaacgcctcaaaaaacgagctgaggctgaggttgatggaaaaaccgtagaagcaaagaagcccattgttgtgaaatacggtctaaatcatgtcacttatctcattgagcagaacaaggcacaattggttatcattgctcatgatgtagacccgatcgagttggttgtttggctacctgcattgtgcagaaagatggagatcccttactgcattgtaaagggaaagtctcgactgggagctatcgttcatcagaaaaccgcatcagctctgtgtttgactacagtcaagaacgaagataaaatggaattcagcagaattctggaagctatcaaggctaacttcaacgacaagtatgaagagtacaggaagaaatggggtggtggcataatgggttccaaatctcaggcaaaaacaaaggcaaaggagagggttttggccaaagaagctgctcagaggatgaattagaccagtttttgatcatgtgttgtctgcatttgaattcatggaaagattttgtttttagagttttatttgcttgctataaacttttggaagttaaattacttgcttatcttaatatcaacttaattgagttttta

SEQ ID NO: 4402 - DNA, 1018 bp, Helianthus annuus
agggttcttcattgtagccgtatcgccgcttgaattcaaagttccactaatggctccgaagaaaggcgtgaagactgttgcaactaagaagaaaacggagaaggtggtgaatccgttgtttgagaaacgtccaaagcagtttggaatcggtggagctttgcctcctaaaaaggatgtgcatagatttgtaagatggccacaagttgttcgaattcagaggaagaggaggatcctcaagcagcgtttgaaggttccaccagctttgaaccagtttaccaagacccttgacaaaaatcttgcaactacattgttcaagatgctactcaagtacaggccagaggataaagctgcaaagaaagaacgtcttttaaaaagagctcaggctgagtcagatgggaaaacggttgaagctaagaaaccaattgttgtcaagtatggtctgaaccatgtcacttacctaattgagcagaacaaggcgcaactggtaatcatcgctcatgatgtcgacccaattgaattggttgtctggcttccggcactctgcagaaagatggaaatcccttactgtattgtgaaagggaaatcacgattaggagccattgttcaccagaaaaccgctgcagcactgtgtttgactacagtcaagaacgaagataaaatggaattcagccggattttggaggctgtcaaggcgaacttcaatgacaagtatgaagagtacaggaagaagtggggtggtggaataatgggatccaaatcacaagcaaagaccaaggcaaaagagagagttcttgccaaagaggctgctcagagaatgagctagactgaatttggtaatattttgagattttgaaacattttgttacttttaagaatcttgttcttccattttctagtttttgggtaggtcaatcaatactcatgtatgcttcttattgtatgtgtttggttttggttttggttctgtgacacagttgattcaattccagaaaaatttttaaccagttttaccttctgc

SEQ ID NO: 4403 - DNA, 1177 bp, Helianthus annuus
tgtgtatgaccgggcttagaccgagaattaaacgaagcccaaataagcccacaccaattggagatctgcgaaaccctaaaacttaaatcttcatcttcgttgtaaaagcaacacacatacatttctgttagggttcttcattgtcgccgtatcgccgcttgaattcaaagttccactaatggctccgaagaaaggcgtgaagactgttgcaactaagaagaaaacggagaaggtggtgaatccgttgtttgagaaacgtccaaagcagtttggaatcggtggagctttgcctcctaaaaaggatgtgcacagatttgtaagatggccacaagttgttcgaattcagaggaagaggaggatcctcaagcagcgtttgaaggttccaccagctttgaaccagtttaccaagacccttgacaaaaatcttgcaactacattgttcaagatgctactcaagtacaggccagaggataaagctgcaaagaaagaacgtcttttaaaaagagcgcaggctgagtcagatgggaaaacggttgaagctaagaaaccaattgttgtcaagtatggtctgaaccatgtcacttacctaattgagcagaacaaggcgcaactggtaataatcgcccatgatgttgatccaattgaattggttgtctggcttccggcactctgcagaaagatggaaatcccctactgtattgtgaaagggaaatcacgattaggagccattgttcaccagaaaaccgctgcagcactgtgcttgactacggtcaagaacgaagataaaatggaattcagccggattttggaggctgtcaaggcaaacttcaatgacaagtatgaagagtacaggaagaagtggggtggtggaataatgggatcaaaatcacaagcaaagaccaaggcaaaagagagagttcttgccaaagaggctgctcagagaatgaactaggctgaatttggtaatattttgagattttgaaacattttgttactttttaagaatcttgttctccctttgggaggtcaatactcatgtatgcttcttattgtatgtgtttggtttttggttctgtgacagttgattcaattccagaaaattttaaccagttttaccttctgtaatacttattgttttgaaatccggactagttagaacaacttcacagttaatata

SEQ ID NO: 4404 - DNA, 966 bp, Nicotiana tabacum
ggctccaaagaagggcgtagcagtagcagcaaagaagaagccagttgcgaaagtggttaacccattgttcgagaagcggccgaagcagttcggaatcggtggtgcattgccgccgaagaaggacctaacccggttcgtgaaatggcctcaggtggtcaggattcaaaggaaaaggaggatccttaagcagaggttgaaggttccccctgctctcaatcagttctctaaaaccctcgacaaaaatctcgctacaaacctattcaagatgcttctgaagtacaggcccgaggacaaggctgcaaagaaggagcgccttgtcaaaagagctcaagccgaggcagaaggcaaaactcctgaaaccaagaaacctattattgtaaagtatggtcttaagcacatcacctaccttatcgagcagaataaagcacagttagtggtgattgcacatgatgttgacccaatagaattggtcgtctggctcccagcattgtgcagaaagatggaaattccatattgtattgtgaagggaaaagcacgtttaggatcgattgtgcataagaaaactgcgtcagcgttatgcttgacaactgtgaagaatgaagacaagatggagttcagtagaattttggaggcaattaaggccaacttcaacgataagtacgaggagaacagaaagaaatggggtggtggtgtcatgggctccaaatcacaagccagaaccaaggctaaagagagagttcttgccaaggaagctgctcagagaatgaactagagttttctggttcgaagttagatatcttacttgccagaaccaagtcttttatctttgccttcttccgcagattatatctttatgcaagaaactttgaaaccatatcattttttggactagatgcctcatttgagttggttatgtatgagcagtgaaatgtcaagtctttcattaactatgcttgttttctctct

SEQ ID NO: 4405 - DNA, 944 bp, Vinca minor
gagttggttcttcttcgccgtttccagagaaaccctaatcacagacacagaaggaaaaatggctccgaagaaaggcgtaaagcttccagcttcagctgctaagaagaaaacggataaggtggtcaatcctttattcgaaaagcgtccaaaacagtttgggattggaggagctttgccacctaagaaagatcttactaggttcgtcaaatggcccaaagtcgtgcagcttcagagaaaacgcaggatcttgagacagcgcttgaaggtccctccggctatcaaccagttctccaagactctggacaagaacctcgctacaaatttgttcaagatgcttctcaaatacagacctgaggataaagctgctaagaaagagcgtctgctgaaaagagcgcaggctgagtcggaagggaaaacatctgaagtaaagaagcccattgttgtcaaatatggtttgaagcacgttacataccttgttgagcagaacaaggcccaattggttgttattgctcatgatgtcgacccaatagagttggttgtttggcttccgcatttgtgcaggaagatggaaattccttactgcattgtgaaggggaaagcaagactgggttctattgttcacaagaaaacagcttcagttctgtgcttgacatctgtcaagaacgaagataagatggaattcagcagggtccttgaggctattaaggcaaatttcaatgacaaatttgatgaaaatagaaagaagtggggaggaggcattatgggctcaaaatctcaagccaaaaccaaggcaaaggaaagggttcttgccaaggaacaagctcagaggatgtcttagtatgtctttttagaggggcatctgtagtatgttttgtggagagcagaaaaacatttttgttacatcactgtggttctctctagtcgagttttcctggattttacat

SEQ ID NO: 4406 - DNA, 1021 bp, Vinca minor
tttcagagaaaaaccctagtttcagtcacagaaggaaaatggctccgaagaaaggcgcaaagcttcctgcttcagctgctaagaagaaaacggataaggtggtgaatcctttatttgagaagcgtccaaaacagtttggaattggaggagctctgcctcctaagaaggatcttaccaggtttgtcaaatggcccaaagttgtgcagcttcagagaaagcgcaggatcttaagacaacgcttgaaggtccctccagctatcaaccagttctccaagacccttgacaagaaccttgccacaaatctgttcaagatgcttctgaagtacagacccgaggataaagctgctaagaaagagcgcctgcttaaaagagcccaggccgagtctgaagggaaaacatctgaagtaaagaagcccattgttgtcaaatatggtttgaagcatgttacatacctcgttgagcagaacaaggcccaattggtggttattgctcatgacgtggaccccattgagttagttgtttggcttccacatttgtgcaggaagatggaaattccttactgcattgtgaaggggaaagcaagactgggttctattgttcaccaaaaaacagcttcagttttgtgcttgacatcagttaagaacgaagataagatggaattcagcagggtcctcgaggctatcaaggcaaatttcaatgacaaatttgacgaaaacaggaagaagtggggtggaggcatcatgggttcaaaatctcaagccaaaaccaaggcaaaagaaagggtccttgccaaggaacaagctcagaggatgtcttagtatgtctttttggacgggcatatgtagtatgttttgtggggagcatgaaaatattttcgttatattgtggttctcactagttgagtttttgccttctgaatttaagacaatcttgcttccagtagttgacattcatgtgttttttagacttccatttcaggatggttatatcaaaatttattttgatcttatcaattatattt

SEQ ID NO: 4407 - DNA, 967 bp, Ambrosia trifida
tcccaatcacacatgaaacctaaccttcgttataaacagaaaaccctctttcttcaccgccgtctgcagaccttcaatctttagctttcagaaataggccccaaagaaaggaggaaagccagttgcaaccaagaagaaaacggagaaggttgtgaatccgttgtttgagaagaggccaagcagtttggaatcggcggagcgttgcctccaaagaaggatgtgcatcggttcgttagatggccgcaagttgttcggattcagaggaagagaaggatccttaagcagaggttgaaggttccacctgctttgaaccagttcactaagactcttgataagaatctagcaaccaatttgttcaagatgctgcttaagtacagacctgaagataaggcggcgaaaaaggagcgccttgtgaaaaaagctcaggctgagtctgaaggaaaaactattgaaacaaagaagcctattgttgtgaagtatggtctcaatcatgtcacatacctcattgagcagaacaaggcacaattggttatcattgctcacgatgttgaccctatcgagttggttgtctggcttcctgctttgtgcagaaagatggaaatcccttactgcattgttaagggaaaatctcgacttggagctattgtccaccagaaaaccgcagcggctctgtgcttgactacagttaaaaacgaagataaaatggagtttagcagaatcctagaagctataaaggccaactttaacgacaagtatgacgagtacaggaagaaatggggcggtggaataatgggttccaaatcccaagcgaaaacaaaggcgaaagagcgggttttggccaaggaggctgctcagaggatgaattagatatttggtaatgtattgtatgcatttgatgtcttggttggcttttcgtttagaaacttgtgtttttagaactctttttggttgcttgatactgttggaa

SEQ ID NO: 4408 - DNA, 935 bp, Zingiber officinale
  misc_feature (63)..(63): n is a, c, g, or t
  misc_feature (67)..(67): n is a, c, g, or t
  misc_feature (103)..(103): n is a, c, g, or t
  misc_feature (105)..(107): n is a, c, g, or t
  misc_feature (109)..(110): n is a, c, g, or t
  misc_feature (121)..(121): n is a, c, g, or t
  misc_feature (123)..(123): n is a, c, g, or t
aaaaagaggtgagaaggtgtctgttcctgcgaagaagaacatgagaaggttgtgaatcctctntttnagaagcgtccgaaacagtttggaatcggaggagcantnnnanngaagaaggatntnaaaaggttcgtgaaatggccgaaggttgtcaggatccagaggcagaaaaggatactgaagcagcggttgaaggttcctccggctctgaaccagttcacgcggactttggatagcaacctcgcgagaaatctttttaaattgcttttgaagtacaggcctgaagatcgagctgcaaagaaggaaaggcttcttatgagggcacaagctgaggcagagggaaagactgttgagtcgaagaaaccaattgtcgtgaagtatgggctcaatcatgtcacttaccttatcgaacagaacaaggcccagttggttgtgatcgcgcatgatgtggacccaattgagcttgttgtttggttgcctgccttgtgcaggaagatggaaattccctactgtattatcaaagggaaatcccgtcttggagcgatcgtccataagaaaactgcatcagttttgtgtctgactactgttaagaacgaagacaaattggaatttagcaaaatccttgaagctatcaaggccaacttcaacgacaaatttgatgagatcaggaggaagtggggtggtggagtcatgggctccaaatcccaggctaaagcaaaggccaaagagaagctgctagcaaaggaagctgttcagagaatgacctagtcttcttgactatctggtgttaccctagacatcatgtcgtaggctgtttcttaattctgtagttggagtgaggaatcatggaattttattggtacgtggagttcagtttcttggaactttggtgcttatctgataactaagtctctttccttatattctattgaaat

SEQ ID NO: 4409 - DNA, 845 bp, Guizotia abyssinica
acagccgatcttcaatctcaggtttcagaaatggctccgaagaaaggtggaaagccagttgcaacgaagaagaaaacggagaaagtagtgaatccgttgtttgagaagaggccaaagcaattcggaattggtggagctttaccaccaaagaaagatctgcataggtttgtaagatggccgcaagttgttcgcattcagaggaagaggagaatcctcaagcaaagattgaaggtcccacccgcattgaaccagttcagcaagacacttgataagaatctggcggccaatttgttcaagatgctgctcaagtacagacccgaggataaggcagctaaaaaggaaggcctccagaagaaagctctgctgaatcagaaggaaaatctgtggaagcaaagaagcctattgtcgtgaagtatggtctcaatcatgtcacgtatctcattgagcagaacaaggcacaattggttataattgcccatgatgttgatccaattgagttggttgtctggcttcctgcattgtgcagaaagatggaaattccttactgcattgttaagggaaaatctcgacttggagccattgtccatcagaaaacagcggcagctctgtgcttgactacagtgaaaaacgaagataaaatggagttcagcagaatcctagaagcaatcaaggccaactttaacgacaagtatgacgagtacaggaagaagtggggtggtgggataatgggttccaaatcccaggcgaaaaccaaggccaaagagagggttttggcaaaggaagctgctcagaggttgacttagataccttggtgatgtattttatgcgtttgagttcatggagag

SEQ ID NO: 4410 - DNA, 1051 bp, Epimedium sagittatum
ctgcccttctttgtaaatcccaaaaccatattctttctcttctagggttttaaacgccgcttctttcttcctttcctctagtcctccaagtcgagtaacagagagagagagaggccgagagcagcagcagcttttcgcagaaatggcaccaaagaaaggagtaaagctatcagcggttgcagctaagaagaagaaggaggcgacagtggtgaacccattgtttgagaagaggccaaagcagtttgggattggaggagctttgccaccaaagagggatcttcataggttcgtcaaatggcccaaggttgttcgtattcagaggcagaggaggattctcaagcagcgattgaaggttcctcctgctttgaaccagttcaccaagacccttgacaagaatctggcaactagcctattcaaaatgcttctcaagtacaggcctgaggacaaagcccaaaagaaggaacgccttctgaaaagagctcaggctgaggctgatgggaagacttctagttctgatgctaagaagcctgttgttgtgaagtatggtcttaaccatgtgacctacctcattgagcagaaaaaagctcaattggttgttattgctcatgatgtggaccccatcgagcttgttgtctggctaccagcactgtgcagaaagatggaaattccctactgcattgttaaggggaaagcacgccttggatcgattgtgcacatgaaaactgctgctgcattgtgctttaccagtgttaagaatgaagataacttggaattcagcaggatccttgaagctatcaaggccaacttcaatgacaagtatgacgaataccgtaagaagtggggaggtggaatcatgggatcgaaatcccaagcaaaaaccaaggccaaggatagggttctagctaaggaagctgctcaaagaatgaattaggttgtggtatctctgtttgatgttattgttagagaattttgtaaacttcaacttggtcgaagtttttcttctacatcttttcaggatttctgttatgacatctccttttgatatattatg

SEQ ID NO: 4411 - DNA, 1189 bp, Malus domestica
ttccgcttagttttagggtttcattcgccgtaaaccctagaaggccactgaagatctcaccaacccgaaaatggccccgaagagaggtgtgaaaccggcagcacttgccaaaaagaaaactgagaaggttgtgaacccactatttgagaagcgtactaagcagtttggtatcggtggggctttgcctcctaagagagatctgcaccgatttgtgaaatggcccaaggttgttcgtatccagaggaagaagaggatccttaagcaacgtttgaaggtcccaccagcacttaaccagttcaccaagactctggacaagaaccttgctacaagtctcttcaagttgcttctgaagtacaggcccgaagacaaagctgcaaagagggaacgtcttctgaaaagagctcaagaggaatctgaaggaaaaactgttgaggcaaagaagcctattgttctgaaatatggacttaaccatgtcacctacctgattgagcagaacaaggcccagcttgttgttattgctcacgatgtggaccctatcgagttggttgtatggcttcctgccttgtgtaggaagatggagatcccatactgcattgtgaagggaaaatcccgtcttggagcgcttctccacaagaaaactgccgctgcactttgtttgaccaccgttaagaatgaggataagcttgagttcagcaaaattctggaggctatcaaggccaacttcaacgataagtacgaggagttgagaaagaagtggggaggcggtatcatgggtgccaaatcacaggccaagaccaaggcgaaggagaagctcttagcaaaggaagccgcacagaggttgaactaagagtatcttccagcgtggagggtgctctttacttgcttgtcttttgttctttcgaaactagtctgttcgccccctattatcacttacaaatcaacgtcaactttgtatcactctggttagagtgtggatgtgtttttttgatagacgttgtagtatctattgtttgtgtgcctttgaatccttgaccaatagttatcggacttaatactctagcatccagagttggtgttatgcgacgggtgagaaagaacctgctgtacaatttaaagaaaattgtagcaatgttttcataaaaatccgtgatctttggttcattaatttaaattcataaaaaatgtgcaa

SEQ ID NO: 4412 - DNA, 959 bp, Artemisia annua
tcatttgcagacagacagacagacatggctccaaagaaaggtggaaagccagttgtaactaagaagaaaacggagaaggtggtgaacccgttgtttgagaaaaggccgaagttgtttgggattggtggagcattgccacctaagaaggacgtgcataggtttgtaagatggccgcaagttgttcgtattcaaaggaagaggaggatcctcaagcaacgtttgaaggtcccacctgctttgaaccagttcaccaagactcttgacaagaatcttgcaactactttgttcaagatgctcctcaagtacagacctgaagataaggcagcgaaaaaggaacgtcttgttaaaagagctcaagccgagtctgaaggaaagactgttgaagccaagaagcccatcgtcgtgaaatatggtttgaatcatatcacttatctcattgagcagaacaaggcacaactggttatcattgcccatgatgtggatcctatcgagttggttgtctggcttcctgcattgtgccgaaagatggaaatcccttactgcattgtcaagggaaaatctcgactgggaactatcgtccaccagaaaactgcagcggcattgtgcttgaccacagtcaagaatgaagataaaatggagttcagcagagtcctggaggctatcaaggccaacttcaatgacaagtatgaggagtacaggaagaagtggggaggtggaatcatgggttccaaatctcaggcaaaaacaagggcaaaggagaaggttttggccaaggaggctgctcaaagaatgaattagttttcgtgataatgtattgtctgaatctgatatcatggagagctttccatttagatacatttcttcttgttagaaaagttgttttggttgctataaacttttataagttaaaatacttatggctcgattttcttatatctattttatcccctcttaacttt

SEQ ID NO: 4413 - DNA, 952 bp, Bupleurum chinense
tctttcggccgttgctaataccctatagtctcagagctgatctacatttgcttctccaatggctccaaagaaaggtgttaagcttccagtggcagctaaaaagaagacggataaggtgatgaatccgttgtttgagaagcgccctaagcagtttggaataggaggggcaattcccccaaagagggatatgcacagatatgtaaaatggcccaaggtggttcaaattcaaaggaagagaatgattctcaagcagcgtttgaaggtcccacctgctttgaatcagttcactaagacccttgacaagaaccttgctacaaacgtgtttaagatgcttctcaagtacaggccagaagataaggctgcaaagaaagagcgccttctgaaaaaagctcaggctgaaactgaagggaagtctattgagtccaagaagcctattgttgtaaagtatggtctgaaccacgttacataccttattgagcagaataaagcacaattggtagttattgctcatgatgtggatccgattgagttggttgtttggcttcctgctctatgccgaaagatggaagtcccatattgcattgtgaagggtaaagcacgattaggaagtattgttcacaagaaaactgcatctgttttgtgcttgaccactgtgaaaaatgaggacaagatggaatttagcaaaattttggaagctattaaggccaacttcaatgacaaatatgaagagtaccgtaagaagtggggaggtggtattatgggttcaaaatctcaagccaaaacaagagctaaagagagggtacttgccaaagaagctgctcagaggatgaactagaagcttttgccatattctggccttttgcaaatctgttctactttctttttttatatgggtagattttctgtaagagatcatatttatgaggcaactatcatatatttcttcatgtta

SEQ ID NO: 4414 - DNA, 1168 bp, Cephalotaxus harringtonia
agcagctaggatttaaagtacatataattatatacatatatagttttttaaccctaactttgttgttttcattccgagcagagttgcggccattcagtttatgcagcggcaatggctccaaaaagaggcgtgaaagctccgtctgccaagaaaaaggtggagaaagttgttaaccctttatttgagaaacgaccaaaacagtttggaattggtggggccttgccaccaaagaaagatttgcataggttcgtgaaatggccaaaaccggttcgcattcaacggcagcgtaggatcctgaaacagcgcctgaaggttcctccggccctgaatcagtttaccaaaacattggacaagaatcttgcatccaatcttttcaagatgcttctcaagtatagaccagaggataaagcctcaaagaaggacaggcttttgaagagagctcaagctgaggcagagggtaaaactattgaagtaaaaaagcccattgctgtgaaatatggaataaaccatgtaacttatctaattgaacagagcaaggctcaattggtggttattgcacatgatgtggatcccatagagcttgtggtttggctgccagcactttgtagaaaaatgaacattccttatgcaatagttaaggggaagtcacgacttggagtgattgtgcacaaaaaaacagcaactgctttgtgcttgacatcagtgaaaaatgaagataagatggaatttagcagaattgtagaggctattaaggcgaatttcaatgacaagtttgatgaatataggcgacaatggggtggtggtatcatgggtagcaaatctcaggccaaaacaaaggctaaagaaaggctcttggccaaggaggcatcacaaagactgatataaagtattattttaggaaattttcttctctttaacaattagttgaaaggctctcttggccaaggaggcatcacaaagattgatacagagttatttgtgaaattttcttcacttttaagaactagccacaaattttgtttattgatattattttctgataggataggtatcagttaaggttgtcatatagtatactcacggaccatgactgatttggatggatgaggtattgctgttttagccagtttgctaggtcattacatgccaaactctccggacttacttt

SEQ ID NO: 4415 - DNA, 1036 bp, Cleome spinosa
tcggggtctacggattccgtctctgtttgaggtctagggtttacatctgggagccgcaggagaattggaagaagaagccaaatggccccgaagaaaggagtaaaagtggctgccaagaagaagccggagaaagttaccaaccccttgtttgagaagcgtcccaagcagtttggtattggtggggctttgcctcccaagaaagatctgtcccgatacatcaagtggccaaaggctatccgcctccaaaggcagaagcgtatcctcaagcagaggttgaaggtcccaccggcagtgaatcagtttaccaagaccctcgacaagaaccttgcaactagcctcttcaagcttcttctgaagtataggcccgaggacaaggctgccaagaaggagcggcttctcaagaaagcccagtctgaggctgaaggaaaaccagttgaatcaaagaagccaattgttgtgaagtatggacttaaccatgtgacatacctcattgagcagaacaaggcacagttggttgtgattgctcatgatgtggacccaattgagttggtcgtctggttgcctgctttgtgcaggaaaatggaagttccttactgcattgttaagggcaaatcacgcttaggagcgattgttcataagaaaactgcgtcttgcttgtgtctgactaccgtgaagaatgaggacaagttggaattcagcaaaatcctcgaggcaatcaaggcgaacttcaacgacaaatatgatgaataccgaaagaaatggggtggtggcatcatgggatcgaaatcgcaggccaagaccaaggctaaggagagggttcttgccaaggaggctgcacagaggatgagctagaggaggtacttacctggttgagttcttgttctttcttctgcgcctgactcggcttttgtttttggccaatcttttagcttttgagtaattggttgatggttttgttgtattgggattttggaacaccctttcactcttttgcttatattctaagaaaaagaaaaaccccaagctcaaacattac

SEQ ID NO: 4416 - DNA, 1200 bp, Cucumis sativus
tctcttcaccgccgcttatttatatttcatccttcttcccactctccctttcacaggctcgcggaaaaatggcaccaaagaaggctgttgggaaagccttggcaaaaaagaagcccgagaaggtggtgaatccactatttgagaagcgtccaaagcaatttggaattggtggggccattccaccaaagagggatttgacaaggtttgttaaatggccgaaagttgttcaaattcagagaaagaagcggattcttaaacagaggttgaaggttccaccagctttgaatcagttcaccaagaccctcgacaaaaatcttgctacaaacctgttcaagatgcttttgaagtataggccagaggacagatcacagaaaagggagcgtcttctaaaaagagctcaggaagaggctgatggcaagccacatgatgctaaaaagcctattgttgtgaaatatggtctcaaccacgtgacctaccttattgagcagaacaaggctcagcttgtcgtcattgcacatgatgtggacccgattgaattggttgtttggctcccagctctttgcaggaagatggaaatcccatactgcattgtgaagggaaaagcacgattgggatcgattgtccataaaaagactgcatctgttttgtgcttgacgactgtgaaaaatgaagacaagatggagttcagcaggattcttgaagccatcaaggccaatttcaacgacaagtacgatgagtatagaaagaaatggggaggaggaatcatggggtccaagtcccaggctaaaacaaaagcgaaggagaagctgcttgccaaagaagcagctcaaagaatgtcttagagatcgtagttgtccttttttaatttgcagattttggtttaatggaaaaaaaaaaccaccatggagacttggctattatcttcaacctcagaatttagaagttttgtttacttattggtgttttgctgcttattggctgatttcagatctaattttgatgttgcgcagacccttctactttgttctttatattatagtgtaattttctgcagatgaatttattcttgagtaaaattcgaacttaggttttttgtttttcagatgaagagagaacttggggcaactgaggttttcgaggcccctctctgttttagtcatctgagaataatctatctatttaagattttctttcatttca

SEQ ID NO: 4417 - DNA, 1020 bp, Euphorbia peplus
ctattagggtttttctagctgccgcatcatcgcctccctccatggctccaaaaagaggtgttaaggccgccgcaccggcaaagaagaaacctgagaaggatgtgaaccctttgattgagaagcgtccgaaacagtttgggattggtggtgcattgccaccaaagaaggacttgactagatttgtcaagtggcctcatgttgtccgtattcagaggcaaaggaggatcttgaagcaacggttgaaggttccacctgctgttaatcagttcacaaaaactctggacaagaaccttgcaacacaactcttcaagttgttgctcaaatatagacccgaggacaaggcagcaaagaaggaaaggcttctccagagggcacaagctgaagctgagggaaaaaccgtggagtctaagaagcccattgtcgttaagtacgggcttaaccatgttacttacctcattgagcagaataaggcccaattggtggttattgcacatgacgttgacccaattgagctggtcgtgtggttgcctgctttgtgccgcaagatggaggtcccatacgcaattgtgaagggcaagtcaaggctcggagcgattgtccaccagaaaactgctgcagctctgtgcatcacatcagtgaagaacgaagataagatggagttctccaaaatcttggaggcagttaaggccaactttaacgacaagttcgatgagcaccgaaagaagtggggaggtgggattatgggatccaaatctcaggcaaaaagcaaagcgaaggaaagagtgttagcaaaggaggctgcacagagaatgaactgaggtgagcttcttgcaattgatgggaagagagatgcctgttcaagacgcattgaaaatgagttttgcattgtgtttttataaatgtttttgcgtagaccggatttatgttagttttggttttaggataattgagattgagatttattgttttcagttctacagtctaatatatgacaatcaattttattttctcaagcaattg

SEQ ID NO: 4418 - DNA, 1234 bp, Fagopyrum esculentum
tcaatcatttaatcttttcaatattaccacaaactttgtcctcaaaactactcaataactacaaacaaaataataaacatttactaattttactaatacaacatttcgtattccaaaatttagctaaacaatgataccaaaaaacatgtcacgacgcgcgacgtagcgggcgtcctcgacctagtacataataaaaggcgatctgacaatcttcatccatctctgaatagggttttcgccgtttcacaggaagaggaagctcaaccctcaacaatggcaccaaaacgaggtgtaaagacagtgacaacaaccaagaagaaaacagagaaggctgtaaaccctctctatgagaaacgacccaagcagttcggaattggcggcgccttgcctcccaagaaggatatgcgcaggtttgttaagtggcctaaggttgttcagctccagaggaagaagagaattctcaagcagcgattgaaggttccaccagcattgaaccaatttactaagactcttgacaagaaccttgcaactagtctattcaagatgctccttaagtacaggccagaggacaaggctgccaaaaaggaacgccttttgaacaaggctcaagctgatgctgctggaaaggaagctgcagctgcaaagaagccaattgttgtgaagtatggtcttaagcatgtcacttaccttattgagcagaacaaggcacagttggtggttattgctcatgatgtagacccaattgagttggtcgtctggcttcccgcactatgcaggaagatggagattccttactgcattgtgaagggaaaggcacgattgggatcgatcgtacacaagaagaatgcatctgtgctctgcttgacaactgtgaagaacgaagacaagttggacttcagcaagattttggaagccatcaaggctaacttcaatgacaagtatgaggagtacaggaagaagtggggtggaggtatcatgggatctaaatctcaagcgaagaccaaggcaaaggaaagggtacttgccaaggaagctgcccagaggatgacatagaaacaaactatatagttttgtattgtgatcatccaattgttagttcattcagagagctgttggtttcttttagtcttcagaattatattgttgcaaaacagtttttacctttactaccccaaattttgtgatgagattttggattactttaattccattgttcctgatgtgttggtgtatt

SEQ ID NO: 4419 - DNA, 1069 bp, Linum usitatissimum
gagccttcaaaacctcagagctgccgcaggctcttcccgcttcttcttcttcttcatcttcatcgacctcttccgtcttctgacgccgacatggcccccaaaagaggtgttaaggctccagttgccactaagaagaagactgataaggttgtaaaccctctttttgagaagagaccaaagcaatttggaatcggcggtgccttgcctccaaagagggacttgactagatttgtcaagtggcctcatgttgtccgtattcagaggcagagaaggatactgaagcagcgtttgaaggttcctccagctgtgaaccagttcactaaggctctggacaagaacttagctacacaaatgttcaagctattgttgaaatatcgtcccgaggacaaggctgcaaagaaggagaggcttattaagaaagcacaggcagaggctgaagggaaaactgtagaatctaagaagcctattgttgttaagtatggacttaaccatgttacatatctcattgagcaaaacaaggctcaactggtgataattgctcatgatgttgatccaattgagcttgtcgtttggttgcctgccttgtgccgcaaaatggaggtcccttatgccattgtgaagggaaagtcacgacttggagcgattgtgcacaagaaaacagctgcagctctgtgtcttacatctgtgaagaatgaagataagatggagttcagcaagattttggaggcagtaaaggcaaacttcaatgacaagttcgacgagcacagaaagaggtggggaggaggaatcatgggatcgaaatctcaggcgaagaccaaagctaaggagaggctcttggcaaaggaggctgcacaaaggatgtcttaagggccggcataatattatttaccattcaagcttgcatgtttttgttagctttcttgcggttgttcttagtcagacaagtactcttctcgatgttgggtggatgttgaaattttatttactagtacccgatgcatgtttctaattttgaagaatgcaacctcatctcgtcttttatccctataattcaaaatgagttatttcg

SEQ ID NO: 4420 - DNA, 1019 bp, Fraxinus spp
gggtgtgaggcagagcagaacttaggtcagggttttaacattgcctgcgcctttctaattccagttaaccaatcggagaaaaatggctccaaagaagggcgcaaagcttccggcgaagaagaaggcagagaaggtggtgaatccgctgttcgaaaagcgaccgaagcagtttgggattggcggagctctaccgccgaagaaggatcttcaccgcttcgttaaatggccgcaggtggttcgaatccaaaggaagaagatgatattgaagcagcgcctcaaggtgcctccgccaatccaccagttctccaaaaccttggataagaaccttgcaacgagtctgttcaagatgcttctcaaatacaggcctgaggatagagctgaaaagaaagagcgccttctgaaaagagctcaggctgaggcagaaggcaaaactcctgaggttaagaagccgattattgtgaagtatggtctcaaccatatcacctatctgattgagcagaacaaagcacaactggtggtgattgctcatgatgtggaccccattgagttggttgtgtggctcccagcattgtgcaggaagatggaaatcccttattgcattgtgaagggaaaggcaagattgggaactattgtccataagaagacagcatcggccttgtgcttgacctcagtaaagaatgaagacaagttggagttcagcaagattttggaggctattaaggcgaacttcaatgataaatatgacgagactaggaagaagtggggaggtggagttatgggctcaaaatcccaagctaaggcgaaggcgaaagaaaagattcttgccaaggaggctgctcagaggatgtcttagggcttcgtcctataattttgttgccgggaatacttgcatttgagagatgagatttatttttctacatctaactgctgtaggctacatgcattgcatttcattatccaaattcttgtgttttttcatggttcattaacttccagttctaatatgttttagtttacac

SEQ ID NO: 4421 - DNA, 1026 bp, Nicotiana benthamiana
gttcctccggtcgccgtctgaagaaaatggctccaaagaagggtgtagcagtagcatctaagaagaaaccagctcaggcgaaggtggtgaatccactgttcgagaagcggcccaagcagttcggaatcggtggtgcgttgccaccaaagaaggatctgactaggttcgtgaaatggccacaggtggttcgtatccaaaggaagaggaggattctcaagcagaggttgaaggtacctcctgctctcaaccagttctccaaaactcttgacaaaaacctcgcgacaaaccttttcaagatgcttctcaagtacaggcccgaggacaaatctgcaaagaaggagcgtcttgtgaaaagggctgaagctgaagctgaaggaaaaactcctgaaacaaagaaacccattgtcgtgaagtatggtcttaagcacatcacataccttatcgagcagaacaaagcacaactggtagtgattgctcatgatgtggacccaattgagttagttgtctggcttcctgcgctatgcagaaagatggaaattccttactgcattgtgaaggggaaagcacgtttaggatcgattgtgcacaagaaaactgcttcagctctgtgtttgacaacagtgaagaatgaagataaaatggagttcagcagaattttggaggcaattaaggctaacttcaatgacaagtatgaggagaacaggaagaagtggggtggcggtgtcatgggttccaaatcacaggccagaaccaaagccaaagagagggttctcgccaaggaagctgcccagagaatgaactaatcgtttgcggtgatatacaccacaatttgattagggactttcttcgccaatttttgtgtttggttcacatgcttgacaatattagagatattagtttgataagtctctttatgtttgccttcttttgcagatcattgatctgtgggagaaactttaaattgcatctgaagttagatattttgttgaatttggtttttatgatagcgagatgggaggggttaat

SEQ ID NO: 4422 - DNA, 892 bp, Helianthus annuus
agctatcagacatggctccgaagaagaagacggtagcaaccaagaagaaaacggagaaggtagtgaatccattgtttgagaagaggccgaagcagtttggaataggtggagcattgccgcctaagaaggatgtgcacaggtttgtaagatggccacaagttgttcgtattcagaggaagaggaggatcctcaagcagcggttgaaggtgcctcctgctttgaaccagttcaccaaaaccctagacaaaaatctcgcaactactttgttcaagatgctgctcaagtacaggccagaggacaaggcagcaaaaaaagaacgcctcaaaaaacgagctgaggctgaggttgatggaaaaaccgtagaagcaaagaagcccattgttgtgaaatacggtctaaatcacgtcacttatctcattgagcagaacaaggcacaattggttatcattgctcatgatgtagacccgatcgagttggttgtttggcttccggcattgtgcagaaagatggagatcccttactgcattgtaaagggaaagtctcgactgggagctattgttcatcagaaaaccgcatcagctctgtgtttgacgacagtcaagaacgaagataaaatggaattcagcagaattcttgaagctatcaaggccaacttcattgacaagtatgaagagtacaggaagaaatggggtggcggaataatgggttccaaatctcaggcaaaaacaaaggcaaaggagagggttttggccaaagaagctgctcagaggatgaattagacagtttttgatcatgtgttgtctgcatttgattcatggaaagatttgtttttagagttttatttgcttgctataaactttttggaagttaaattacttgcttatcttaatat

SEQ ID NO: 4423 - DNA, 1053 bp, Taxus baccata
tagtcaggaggaggacgaagacgcagacgagagaggagaaggcgaggaagagcgacgatcgacagtaaaacgaaaaatggctccaaagagaggggttaagaccccggccgcttcaaagaaaaaggtagagaaggtggtgaatccgctgtttgagaaacggcctaaacagtttgggattggaggagcgttgccgcccaagaaggatttgcaccgattcgtgaaatggcccaagatcattcgcatccaacgccagcgtcgcattctcaagcagcgcttgaaggtcccccctgccctccaccagttcaccaaaaccctcgacaagaatctcgcatcaaaccttttcaagatgcttctgaaatacaggccggaagacaaggctgctaaaaaggagaggcttttaaagaaggctcaggcagaggcagaagcaaaacctattgaagtcaagaagcctgttgttgtgaaatatggtatcaatcacgttacttaccttattgaacagagtaaagcccagttggtggttattgcacacgatgttgatcccatagagcttgttgtgtggctccctgcactttgtaggaaaatgaacattccttattgcattgtcaaggggaaatcacgaattggagctatcgtgcacaagaaaactgccactgctttatgcttgacatctgtgaagaacgaagacaagatggaatttagcaggattgttgaggcaataaaggccaacttcaatgacaagtttgatgagtacagaaaacaatggggaggtggcgttatgggttccaagtcccaggcgaaaaccaaggccaaggaaaaactcttggccaaggaagctgctcaaaggctgacatagttttctcatcattatgatcatctatttcaaatttgttttggagttttattcttgaggacttttgtttcatagaaaacaaaacaacaattttgcatctggttaaagtgccagggaatttatatgttatctgcatttagttgtttctctggattggtattaatgtattttcctttgctatggtttacatatgggaaaatatg

SEQ ID NO: 4424 - DNA, 1118 bp, Taxus baccata
cagaggagcggtcattcattgcaagcatcggcaatggctccaaaaagaggtgtgaaagctccagctgccaagaagaaggtggagaaagttgttaacccattatttgagaaacgaccaaaacagtttggaattggtggggccttgccaccaaagaaggatttgcataggtttgtgaaatggccaaaagcagttcgcattcaaaggcagcgaaggatcctgaaacagcgtctgaaggttcctccagccttgaatcagtttaccaaaacattggacaagaatcttgcatccaaccttttcaagatgcttctcaagtatagaccagaggataaagctgcaaagaaggacaggcttttgaagaaagctcaagctgaggcagagggtaaaactattgaagcaaagaagcctattgctgtgaaatatggaataaaccatgtaacttatctaattgagcagagcaaggctcaattggtggttattgctcatgatgttgatcccatagagcttgtggtttggctgccgactctttgcagaaaaatgaacattccttatgcaatagttaaggggaagtcacgacttggagcgattgtgcacaaaaaaacagcaactgctttgtgcttaacttcagtgaaaaatgaagacaagatggaattcagcagaattgtagaggctattaaggcaaatttcaatgacaagtatgatgaatataggagacaatggggtggtggtataatgggtagcaaatctcaggcaaaaacaaaggctaaagagaggctcgtggccaaggaggcatcacaaagattgatatagcgtattttcttggaaattttcattgtttttaacaattagctacaatttttgtttagtgattaaaatgtgtgataggatggatatcagttaaggccttcatacggtacacacttatggaccatgaaggagtggattgatgaggtattgttttgtaaacaacgttgatgttgtaggtggtttggtttgctgtgtcattgcatgtcaaactctatcacacttcgctgatgttgattttacttacacatgaacatgatgttattttaaatgtgctaattgttcttttttaatctctgcacactatttaatgttat

SEQ ID NO: 4425 - DNA, 1035 bp, Citrullus lanatus
aaaaggcaccaaagaaggctgttggaaaagccttggcaaaaaagaagccggagaaggtggtgaacccactatttgagaagcgtccgaagcagtttggaattggtggtgcaattccaccaaagagggatttgacccgatttgttaaatggccaaaagttgttcaaattcagaggaagaagcgaattcttaaacagaggttgaaggttccaccagctttgaatcagttcactaagacccttgacaaaaaccttgcaacaaacctgttcaagatgcttttgaagtataggccagaggacaaatcacagaaaagggaacgccttctaaaaagagctcaggaagaggctgaaggcaagccacatgatgctaaaaaacctattgttgtgaaatacggtctcaaccatgtcacctaccttattgagcagaacaaagcacagctggttgtgattgcccatgatgtggatccgattgagttggttgtttggctcccagccctctgcaggaagatggaaatcccatattgcattgtgaagggaaaagcacgattgggagcgattgtccacaaaaagactgcatctgttttgtgcttgacgactgtcaagaatgaagataagttggagtgcagcaggattcttgaagccattaaggccaatttcaacgacaagtacgatgaatacagaaagaaatggggaggtggaatcatgggctccaagtcccaggctaaaacgaaagccaaggagaagctgctcgccaaagaagccgctcaaagaatgtcttagggatcatagttgtccttttataatttgcggatttttctttaatgggaaaaaaaccatggagacttggctataattttcaacctcagaatttagaagttctgtttacttatggttttggttatttgctgatttcagatctagttttgatgttgcgcagacccttctactttgttctttatattacaatgtaatttcatgggagatttttagcagatgaatttatttttgagtaaaatggaaacagaggtttttttttttt

SEQ ID NO: 4426 - DNA, 855 bp, Ambrosia trifida
tcgccgattgcatctgaagcttctctaatggctccgaagaaaggcgtgaagactgttgcaactaagaagaaaacggagaaggtggtgaatccgttgttcgagaaacgaccaaagcagttcgggattggtggagctttgcctcctaaaaggatgtacaccggtttgtcagatggccgcaagttgtccgaattcagaggaagaggaggatcctcaagcagcgtttgaaggttccgccagctttgaaccagttcaccaagacccttgacaaaaatcttgcaactactttgttcaagatgctactcaagtacagaccagaggacaaagccgagaagaaagagcgtcttttaaagagagcccaggctgagtcagatgggaaaacagttgaatctaagaaaccaattgttgtgaagtatggtctgaaccatgtcacttacctaattgagcagaacaaggcacaattggtaatcattgcccatgatgttgatccaattgaattggttgtctggcttcccgcactctgcagaaagatggaaattccctactgtattgtgaaagggaaatcaagattaggagctattgttcaccagaaaaccgctgcagcactgtgcttgactaccgtcaagaacgaagataaaatggaattcagccggattttggaggctgtcaaggcaaacttcaacgacaagtacgacgagtataggaagaagtggggtggtggaataatgggatcgaaatcacaggcaaagacaaaggcaaaagagagagttcttgccaaagaggctgctcagaggatgaactagacaagaatttggtaatattttgcgattttgaaacgttttgttactttttaagaat

SEQ ID NO: 4427 - DNA, 829 bp, Ambrosia trifida
ccgattgcatctgaagcttctctaatggctccgaagaaaggcgtgaaaactgttgcaactaagaagaaaacggagaaggtggtgaatccgttgttcgagaaacgaccaaagcagttcgggattggtggagctttgcctcctaaaaggatgtacaccggtttgtcagatggccgcaagttgtccgaattcagaggaagaggaggatcctcaagcagcgtttgaaggttccgccagctttgaaccagttcaccaagacccttgacaaaaatcttgcaactactttgttcaagatgctactcaagtacagaccagaggacaaagccgagaagaaagagcgtcttttaaagagagcccaggctgagtcagatgggaaaacagttgaatctaagaaaccaattgttgtgaagtatggtctgaaccatgtcacttacctaattgagcagaacaaggcacaattggtaatcattgcccatgatgttgatccaattgaattggttgtctggcttcccgcactctgcagaaagatggaaattccctactgtattgtgaaagggaaatcaagattaggagctattgttcaccagaaaaccgctgcagcactgtgcttgactaccgtcaagaacgaagataaaatggaattcagccggattttggaggctgtcaaggcaaacttcaacgacaagtacgacgagtataggaagaagtggggcggtggaataatgggatcgaaatcacaggcaaagacaaaggcaaaagagagagttcttgccaaagaggctgctcagaggatgaactagacaagaatttggtaatattttgagattttgaa

SEQ ID NO: 4428 - DNA, 1052 bp, Bruguiera gymnorhiza
  misc_feature (945)..(945): n is a, c, g, or t
aaatgtggagcgccttcatcccccagacaccacaaacagcaaggctacgatctgactgtcttctcccatacaatggctcccaaaagacctgttggcaaggcccccgtagcagcgaagaagaaacctgaaaaggttgtgaaccccttgtttgagaagcgaccaaagcaatttggaattggcggtgccctaccaccaaagaaggatctgaccagatttgtcaagtggccacatgttgttcgcatccaaaggcaaaggaggattctgaaacaacggttgaaggttcctccggctgttaaccagttcacaaaaacacttgacaagaaccttgcttcgcagctgttcaagttgttactcaaatatagaccagaggacaaggctgccaaaaaggaaaggcttctgaaaagagctcaagctgaagctgagggaaagagtgttgaatcgaagaagcccattgttgtcaaatatgggcttaaccatgtcacttatctcattgagcagaacaaggcccagctggtggttattgcacacgatgttgatcctattgagcttgttgtttggttgcctgccctgtgtcgtaagatggaggtaccttatgcaattgtgaagggaaagtcgaggctcggagcgattgtccacaagaagactgctgcagctctgtgtcttacatcagtgaagaatgaagataagtttgagttcagttaagtttgagttcagtaagattctggaggcagttaaggccaactttaacgacaagtttgacgagcaccggaaaaagtggggtggtggtatcatgggttcaaaatctcatgccaagaccaaagctaaggagaagctcctagctaaggaggctgcgcagaggatgtcttgagcatagtcaagggagtgaaggaagactacatagtttgagaggaaccttcgaatatttgttttcataatttttacctnttcgcttcattgttgtggtcaaggtttgcagtggctggatagttgagaaaatttccctgttatttaacactttggttggggcatgacaactgatagtttttctctcc

SEQ ID NO: 4429 - DNA, 1020 bp, Solanum melongena
ttcttctccttccaagaaaaaaatggctccaaagaagggtgttgcagtagcagcaaagaagaagccggagaaggcaaaagtggtgaatccacttttcgagaagcggccaaagcagtttggtatcggtggagcgctgccgccgaagaaagatgtaacaaggaacgtgagatggcctaagaatgttatccttcaaaggaagaagaggatcctcaagatgcgattgaaggtcccacctgctcttaaccagttcaccaaaacccttgacaagaacctcgctacaaaccttttcaagatgcttctcaagtatagacctgaggacaaagctgcaaagaaggagcgtcttgtcaaaagggctcaagctgaagctgaagggaaaactgctgaaacaaagaaacccattatcgtgaagtatgggcttaagcacatcacttaccttattgagcagaacaaagctcagttagtagtgattgctcatgatgtggacccaatagagttggttgtctggcttcctgcactatgcagaaagatggaaattccttactgcattgtgaagggaaaagcacgtttaggatcgattgtgcataagaaaactgcttcagccttgtgtttgacaactgtgaagaatgaagacaaaatggagttcagcagaattttggaggcaattaaggctaacttcaatgacaagtatgaagagaacaggaagaagtggggtggtggtatcatgggctccaagtcacaggcgaggaccaaggccaaagagagagttcttgccaaggaagctgcccagagattgacctaagagcttgctgtgatatatacactgcaatttgattagagagatgttctgccgagttttgtgtttggttcacatactttacaatgttaaagtattagttttgacaagtacctctatgttttccttaacaatgcctaatcagacatttttgttagatattttgttgaatttgtttttccatggcactgaattccgcagttattcaagttactacacttctttac

SEQ ID NO: 4430 - DNA, 1061 bp, Fagopyrum esculentum
tagggttttcgccgtttcacaggaagaggaagctcaaccctcatctacaatggcgccaaaacgaggtgtaaaggcagtgacaaccaagaagaaaacagaaaaggctgtaaaccctctctatgagaaacgacccaagcagttcggaatcggcggcgcattgcctcccaagaaggacatgcgcaggtttgttaagtggcctaaggttgttcagctccagaggaagaagaggattctcaagcagcgattgaaggttccaccagcattgaaccaatttactaagactcttgacaagaacctagcaactagtctattcaagatgctccttaagtacaggccagaggacaaggcagcgaaaaaggacgccttttgaataaggctcaagctgatgctgctggaaaggaagctgcagctgcaaagaagccaattgttgtgaagtatggtcttaagcatgtcacttaccttattgagcagaacaaggcacagctggtggttattgctcatgatgtagacccaattgagttggttgtctggctccctgcactctgcaggaagatggagattccttactgcattgtgaagggaaaggctcgattgggatcgatcgtacacaagaagaatgcttctgtgctctgcttgacaactgtgaagaacgaagacaagttggacttcagcaagattttggaagccatcaaggcaaacttcaatgacaagtatgaggagtacaggaagaagtggggtggaggtatcatgggatctaaatctcaagcaaagaccaaggcaaaggaaagggttcttgccaaggaagctgcccagaggatgacataaaaacaaaccagttttgtattgtgatcatccaattgttagtccaatcagagatctgttggtttctttttagtcttcagaattatattttccaaaacagtttttacctttactaccccaaattttgagatgagattttgtattacttcaattccattgtttctgatgtgtttgtgtattatgttcttgatgtgtttgtgatttggaattacatatgtgaaactaatgcagaacatatg

SEQ ID NO: 4431 - DNA, 953 bp, Arnica chamissonis
tcattgtcgccgtctccacgcctcgaatcagaacctctaccgatggctccgaggaaggttgtgaagactgctgcaactaagaagaaaacggagaaggtggtgaatccgttgtttgaaaaacggccaaagcagtttgggatcggtggagctttgcctcctaaaaaggatgtgcacagatttgtaagatggccacaagttgttcgaattcagaggaaaaggaggatcctcaagcagcgtttgaaggtcccaccagccctaaaccagttcaccaagacccttgacaaaaatcttgcaactactttgttcaagatgctactcaagtacagaccagaggataaagctgagaaaagagaacgtcttttaaaaagagctcaagctgagtcagatgggaaaacagttgaatctaagaaaccgatcgttgtgaagtatggtctgaaccatgtcacctacctaattgagcagaacaaagcacaattggtgatcattgctcatgatgttgatcctattgaattggttgtctggcttcctgcactctgcagaaagatggaaatcccctactgtattgtgaaagggaaatcacgattagggaccattgttcatcagaaaaccgcttcagcactgtgcttgactacagtcaagaacgaagataaaatggaatttagccggatattggaggccatcaaggcaaacttcaacgataagtatgatgagtataggaagaagtggggtggtgggattatgggatcaaagtcacaggcaaagaccaaggcaaaagagagagttctagctaaagaagctgctcagaggatgaactagagaaaatttggtaatattttgagatttgagtgttgtttttttttccaaatttttggaggtcaaatacttgtatgtgtttgatttttggaatcatgtatgcaatgttattctgtatgtttggattttgatcttgtgac

SEQ ID NO: 4432 - DNA, 1533 bp, Artemisia annua
agacatggctccaaagaaaggtggaaaaccaattgtaaccaagaagaaaacggaaaaagttgtgaacccgttgtttgagaaaaggccgaagttgtttgggattggtggagcattgccacctaagaaggacgtgcataggtttgttagatggccacaagttgttcgtattcaaaggaagaggaggatcctcaagcaacgtttgaaggtcccacctgctttgaaccagttcactaagacccttgacaagaatcttgcaactactttgttcaagatgttgctcaagtacagacctgaagataaggcggcgaaaaaggaacgtctcattaaaagagctcaggctgagtctgaaggaaagacagttgaagccaagaagcctatcgttgtgaagtatggtttgaaccatatcacctacctcattgagcagaacaaggctcaattggttatcattgctcatgatgtggatcctatcgagttggttgtctggcttcctgcattgtgtagaaagatggaaatcccttactgcattgttaagggcaaatcacggcttggaactattgtccaccaaaaaactgcagcagctttgtgcttgaccacagtcaagaatgaagataaaatggagttcagcagagtcttggaggctatcaaggccaacttcaatgacaagtatgaggagtacaggaagaagtggggaggtggaatcatgggctccaaatctcaggcaaaaacaagggcaaaggagaaggttttggccaaggaggccgctcaaagaatgaattagatttcttgataatgtattgtctgcttttgatgtcatggggagatttgcacttacaaacatttcttgtttttagatgtctatttggttgctttaaaattctgaaagttaaaatacttgcttattttaatatgagcttatctaatttttaccaaaacagcttgataatttcattaaagtaccaacagatctaaacataacaccaaattacaaaccctagcacatctaataccataaaccaaacactaaattcatgataaacaaccacacacattatccccaattacttaagccctctcgcctcgaatcctcctcgccagctgcatatctttcggcataatcgtaaccctcttagcatgaatcgcacacaaattagtatcctcaaacaacccaaccaaatacgcctcactcgcctcctgcaacgcagccacagccgaactctgaaacctcaaatccgtcttgaaatcctgcgcgatttccctcactaggcgctggaacgggagcttcctgatcaaaagctcggtactcttttggtacttcctgatctcacgcaatgcgactgttcctggcctgaacctgtgtggcttcttcactcctcctgttgctggtgctgacttacgagctgcttttgttgcgagctgcttccttggggcttttcctccggttgatttacgagcggtttgcttggtacgagccattgtgttaattgatcgggagtgtttggatattggaattgattgttttgagtgtccccgtcg

SEQ ID NO: 4433 - DNA, 1471 bp, Cannabis sativa
gttgttgtctgcctccaagagctaactccatttttagtttagggttttcttcgcacaagatctcaaccatcatcaaccatgcctccgaagaagaccggaaaggcctcggcactatcgaagaagaaacctgagaaggttgtgaacccactgtttgagaagcgtcctaaacagttcggtattggaggtgctttgccaccgaagagggatttgcacagatttgtcaaatggcctaaggctgttcaacttcagaggaagaagagaatccttaagcagaggttgaaggttccacctcagttgaaccagttcaccaagactttggacaaaaaccttgccacaagtctcttcaagttgcttcttaagtacaggcctgaggacaaagccgaaaagaaggaacgtcttgtgaaacgtgctcaagctgaggctgaaggaaaaactgccgagaccaagaagcccattgttgtgaaatacgggctcaaccacgtcacttaccttattgagcagaacaaagcacaattggtagtgattgcccatgatgtagacccaattgagttggttgtctggctccctgccttgtgcagaaagatggagatcccttactgcatcgtgaagggaaaatcccgtttgggatcgattgttcaccagaagacagctgctgcattgtgtttgaccaccgtgaagaatgaagataagatggagttcagcaaaatcctcgaggctattaaggccaactttaatgacaagtttgacgagttccgaaagaagtggggtggtggcatcatgggaagtaaatcacaagcaaaaacaaaagccaaggaaagagttttggccaaggaagccgcacagagaatgaattaagaagattgagcattttgtgttattgtgagttagtagtttttcttttttcttaaaaaagaccaaggaagagctgtttgaagcacattttgttatgggctgttatagaatatcctgataatctttatttttttttcttatttaccatttgaggaaggaaccttagctctctatgcttttaatctagatatgaattttggtttaatgattcttttctcaaagccataaccaatcgtattttattggtcaagttcttacatctacttttatatagatattgcttttaatagtcaatacattacattccctggaaaatgaaattacacacacaaaagatgtaattaagaaccatttaaaaccaagagaacgtaattgaaccatcctctaggcacagacgcttacaataatattcctggaattattgattttgaagctatgtttcaaactgatatttcgtacgatgcttctccaagtaaggatggcaaaaaaaaaaaaactgggggtctggagcaggttggggatgggccgccgtttttctttttcaaatttagagtttgagttactctggtaatttttatgtgagttgtaatatagattttagttgtgatttaagttactg

SEQ ID NO: 4434 - DNA, 940 bp, Cirsium arvense
tttgaaactcaacttcgatcaatggctccaaagaaaggtgggaagccgattacaactaagaagaaaacggagaaggtagtgaatccgttattcgagaaaaggccaaagcaatttgggatcggtggagcattgccaccgaagaaggatgttcatagatttgtgagatggccacaagttgttcgcattcagaggaagaggaggatccttaagcagcgtttgaaggttccacctgctttgaatcagttcaccaagaccctcgataagaatcttgcaacgactttgttcaagatgcttctcaagtacaggcctgaggataaagcagcaaaaaaggaaagacttatgaaaagggcgcaggctgagtctgaaggcaagacagctgaagccaagaagcctattgtcgtcaagtatggtctgaaccatatcacctaccttattgagcagaacaaggcgcaattagtcatcattgctcatgatgtggaccccattgagttggttgtctggcttcctgcattgtgcagaaagatggaaatcccttactgcattgtgaagggaaaatctcgattgggaactattgtccatcagaaaactgcagcagctctgtgcttgactacagtgaagaatgaagataagatggagttcagcagaatcttggaagcaatcaaggccaacttcaatgataagtatgaagaatacagaaagaagtggggtggtgggataatgggttccaaatctcaggctaaaacaaaggcaaaggagagagttcttgcaaaggaggctgctcaaaggttgaattagagcccttctatatctatatagtaagtctgcagagttcagaaggcttatgtttagtacctctgttacattcagtgttgattcctttttgacttcttgaaggcaagttattgtgtgctttcttactacatgtgtttgactcaattta

SEQ ID NO: 4435 - DNA, 1070 bp, Euonymus alatus
agagctgccgcttcgtcttcctcgcgctttcgacatcactgcgcaaagatggctcccaaaagaggcggaaaggccccagtaccagcaaaaaagaaaactgaaaaggttgtgaaccctttgtttgagaagcgaccaaagcaattcggaattggtggtgcactaccaccaaagaaggatttgactagatttgtcaagtggccacatgttgttcgtattcagaggaaaaggaggattttgaagcaacggttgaaggtgccacctgccatcaaccagttcacaaaggcgctggataagaaccttgctacaaatcttttcaagttgttgctcaaatatagacccgaggacaaggctgctaagagggaaaggcttcttaaaaaagcacaagctgaagctgagggcaagactgtggaatctaagaaacccattgttgttaaatatggccttaatcatgttacctatctcattgagcagaacaaacctcagttggtaattattgcgcatgatgttgatccaattgagcttgttgtttggttgcctgccttgtgccggaaaatggaggtcccttatgcaattgtgaagggcaagtcgaggcttggaacgattgtgcacaagaaaacagctgcagttctgtgcctcacatcagtgaagaacgaagataagatggaatttagcaggattgtggaggcagtcaaggctaactttaacgacaagtatgatgagcatcggaagaaatggggaggtggaatcatgggttccaaatctcaggctaagatgaaagcaaaggagagagtgttagccaaggaggctgcacaaagaatgtcctgatttgataaaaccaagaactgctgggaagaagtgataattggaacaagctacatggttctaaattttctgttgcgcatttatattttgtttagttgtcattttgaacaagttttgtatcgattggtagctggttttgttattgaggttattgtctaattactcaaatagacttttgatggaacttttctgcaaactgatcctcaaatgttacaaagattttactacttattcagccattcgatttt

SEQ ID NO: 4436 - DNA, 960 bp, Euphorbia peplus
agcagacagctaccttcatcgtttagggtttccatcgtctccggcgacagatcaatggctcctaagaaaggtgtgaaagctccagtagcagctaagaagaagactgacaaggttgtgaatccgttgattgagaagcggccgaagcagtttgggattggaggtgcattgccgccaaagaaggatttgactaggtttgtaaagtggcctcatgttgttcgtattcagaggcagaggaggattttgaagcagaggcttaaggttcctccggctgttaatcagtttaccaagaccttggataagaacctcgcaactcagcttttcaagttactgctgaagtatagacccgaggacaaggcagccaagaaggaaaggcttcttcagagggcacaagccgagactgagggaaaaactgtggaatcaaagaagcctattgttgttaaatacgggcttaaccatgtaacctaccttattgagcagaacaaggctcaattggttgtaattgcacatgatgttgacccaattgagctggtcgtatggttgcctgccttgtgccgcaaaatggaggtaccttatgcaattgtgaagggcaaatcaagacttggagcgattgtccaccagaaaactgctgcagctttatgcattacctctgtgaagaacgaagacaagatggaattttcgaaaatcttggaggctgttaaggccaacttcaacgacaagttcgatgagcacagaaagaagtggggtggtggcattatgggatccaaatcgcaggcaaagagcaaagccaaggaaagagttttggcaaaggaggctgcccagagaatgaactaagtttgtagcaattagtcaatagtgaatttcatgttggtttgtttctttaacaattttgcattgatggagtttgtgtttagagttacagtgggataattgacatttcttttttcgtattctattaccccc

SEQ ID NO: 4437 - DNA, 1041 bp, Humulus lupulus
agaactaactccatttttagtttagggttttcttcgaacaagatctcaaccatcaaccatgcctccgaagaaaaccggaaaggcctcggcactctcgaagaagaagcctgagaaggttgtgaacccattgtttgagaagcgtcccaaacagttcggtattggaggtgctttgccaccgaagagggatttgcacagatttgtcaaatggccaaaggctgttcagcttcagaggaagaagagaatccttaagcagcggttgaaggttccacctcagttgaaccagttcaccaagactttggacaaaaaccttgcaacaagtctgttcaagttgcttctcaagtacagacccgaggataaagctgaaaagaaggaacgtcttgtgaaacgtgctcaagctgaggctgaaggaaagaccgccgagaccaagaaacccattgttgtgaaatatgggctcaaccacgttacataccttattgagcagaacaaggcacaattggtagtgattgctcatgatgtggacccaattgaattggttgtctggcttcctgcattgtgcagaaagatggagatcccttactgcattgtgaaggggaaatcccgtttgggatcgattgtgcatcagaagacagcagctgcattgtgtttgactactgtgaagaatgaggataaaatggagttcagcaaaatccttgaggctattaaggccaacttcaatgacaaatttgatgagttccgaaagaagtggggcggtggcatcatgggcagtaaatcacaagcaaaaacaaaagccaaggaaagagttttggccaaggaagccgcccagagaatgaattaagactgagccttttttctttttgtgagttagtagtttttctcttttctttttcttgaaaaagaccatggaggagctgtttcaaggacttaagttatgggctgttatagaatatgctgataatctttattttttcttatttaccatttgtggacggaaccttagagctctttgcttttaatttagagtattatccatatgaattttgg

SEQ ID NO: 4438 - DNA, 1190 bp, Cucumis melo
tttcatccttcttcccactcttcctttcacaagctcgcgcaaaaatggcaccaaagaaggctgttgggaaagccttggcaaaaaagaagcccgagaaggtggtgaatccactatttgagaagcgtccaaagcaatttggaattggcggggccattccaccaaagagggatttgacaaggtttgttaaatggccaaaagttgttcaaattcagagaaagaagcggattcttaaacagaggttgaaggttccaccagctttaaatcagttcaccaagacccttgacaaaaatcttgctacaaacctgttcaagatgcttttgaagtataggccggaggacagatcacagaaaagggagcgtcttctaaaaagagctcaggaagaggctgatggcaagccacatgatgctaaaaagcctattgttgtgaaatatggtctcaaccacgtgacctaccttattgagcagaacaaggctcagctggttgtcattgcacatgatgtggacccgattgaattggttgtttggctcccagctctttgcaggaagatggaaatcccatactgcattgtgaagggaaaagcacgattgggatcgattgtccataaaaagactgcatctgttttgtgcttgacgactgtgaaaaatgaagacaagatggagttcagcaggattcttgaagccatcaaggccaatttcaacgacaagtacgaagagtatagaaagaaatggggaggaggaatcatgggctccaagtcccaggctaaaacaaaagcgaaggaaaagctgctcgccaaagaagcagctcaaagaatgtcttagggatcatagttgttctcttataatttgcggattttgctttaatggaaaaaaaacctccatggagacttggttattattttcaacctcagaatttagaagttttgtttactttatggttgttttgcttattggctgatttcagatctagatttgatgtttcgcacaatctactttgttctttatgttatagtgtaatttttagcagatgaatttattctagagtaaaattgaaacttggttttttattttttcagagaaagagagaacatgggggccactgaggtttgagacccctgttttgatcatctgagaacagtctatctatttcagattttctttcatatctacttttagctttattttttactttta

SEQ ID NO: 4439 - DNA, 1076 bp, Orobanche aegyptiaca
tagctcgttagggttccacagccgtctcccagaacaccctcattccatcccgcagcaaaagaagaagacgaaatggctccaaagaagggtgctaagccgccggcaaagaagaagccggagaaagttgtgaatccgctactcgagaagaggccaaaacaattcggtatcggaggagctctgccgccgaagagggatctgcatcggttcgtgaaatggcctcaagttgtcagaatccagaggaagaagatgatattgaagcagagattgaaggttccgccgccaattcatcagttctcgaagaccctcgacaaaaacttagcaaccagcttgttcaagatgcttctcaagtacagacctgaggatagagctcaaaagaaagagcgtcttttgaaaagagcccaagctgaggctgaaggaaaaactcctgaattcaaaaagcctatagtggtcaagtatggtctcaaccatgtgacctatctcatcgagcagaataaagcccaattggtggttattgctcatgatgtggatccgattgagttggttgtatggctccctgccctatgcaggaaaatggagatcccttattgtattgtcaagggaaaggctagactaggaactattgttcacaagaaaacttccgcagttctgtgcctcacatctgttaagaacgaagacaagctggatttcagcaagatcctggaggctattaaggccaatttcaatgataaatacgacgagacgaggaagaaatggggaggtggagttatgggatcaaaatcccaggctaaaacaaaggctaaagagagggttctagccaaggaagctgctcagaggatgacttaaaaatatgttgtattacattttttctgttacatagaagcaaagcaagagaatttatcatatgcacttgttatttcaagatgaacggactcgccttctgtttttcccaattttattatctgctattggaacatgtttcttgtgctttaatgtacttctttggaagatgtcatctaaggacatgccgaagatactgtttttggtcccattactgtgttgattgctggtgattcttc

SEQ ID NO: 4440 - DNA, 1001 bp, Secale cereale
cccgctgttcgagaagaggccgaagcagttcggcatcggcggagccctcccgcccaagaaggacctccaccggttcgtcaagtggcccaaggtcgtgcgcatccagcgccagcgccgcatcctcaagcagcgcctcaaggtgcccccggcctccaccagttcacccgcaccctcgacaagaacctcgccaccaacctgtttaagatgcttctcaagtaccgccctgaggacaaggtggctaagaaggagaggcttctgaagagggcccaggctgaggctgagggaaaccttgaggccaagagccaattgttgtgaagtatggtcttaaccatgtcacttacctcattgagcagagcaaggctcagcgtggttgtcatcgctcatgatgttgacccaattgagctggttgtgtggctcccagccctgtgcaggaagatggaggtcccatactgcattgttaagggaaaatcacgccttggatcgatcgttcacaagaagactgcctcagttctgtgcctcaccactgtgaagaacgaggacaagcttgagttcagcaagatcttggaggctatcaaggctaacttcaacgacaagttcgacgaggtcaggaagaagtggggcggtggcgtcatgggctccaagtcgcaggccaagaccaaggccagggaaaggctcatcgccaaggaggctgcgcagaggatgaactaagcctagccctataagtatgtcagagcatgtgccatgtagtttccctttcagtgtgtcctgattttgacgaggaactcgaacccttttagcagcactgtggaatcgtattgtggttttctgattctctgttccgttcgccagacttatgcaaagatcagatgaggtttacccatgtttggattcttatatagttttatgtcctttgagtgagagttggttgtgcgtttgttctgagatgtaggaattaaagatattgcaagcttatgtccagcatgaagggctttgatttcacc

SEQ ID NO: 4441 - DNA, 1022 bp, Senecio madagascariensis
aagcagtggtatcaacgcagagtacgcggggcagaaatggctccaaagaaaggtggaaagccagtagtaaccaagaagaaaacagtggagaaggttgttaatcctttatttgagaaaaggccaaagcaatttgggataggaggtgcattaccaccaaagaaggatttgcatcggttcgtaagatggccgcaagttgtccgcattcagaggaaacgcagaatccttaaacaacgtttgaaagtccctcctgctttgaaccagttcaccaaaacccttgacaaaaatcttgcaactactctgtttaagatgatgctcaagtacaggcctgaggataaagcggcgaaaaaggaacgtctcaaaacaagggcactagctgagtctgaagggaagactgttgaagccaagaagcccattgttgtgaagtatggtttgaaccatatcacttatctcattgagcagaacaaagcgcaattggttatcattgctcatgatgtggaccccattgagttggttgtctggcttccagctttgtgcagaaagatggaaattccttattgcattgttaagggaaaatctcgccttggagctattgttcaccagaaaaccgctgcagcgctttgtttgactacagtcaagaacgaagacaaaatggagtttagccgaatattggaggccatcaaggctaactttaacgacaagtacgaggagtacaggaagaagtggggtggtggaataatgggttccaaatcccaggcgaaaacaaaggcaaaggaaagagttctagccaaggaggctgctcagaggttgaattagatcttttgcttatgtatcgtctgcatttgtggtcgttgagagcactgccattagaaacttgtcctttttttagaactatattttgtcgcttaaaacttattggacctgcttatttcaatgtcagttattcaattttggttgtcactattttttttgcttatgaaagaaacattttcctatgtgttgaagatgaattaatttctgttcac

SEQ ID NO: 4442 - DNA, 1265 bp, Trigonella foenum-graecum
tagcaccagcagcaatggctcccaaaaaaggtgttaaagctccagttgcagcttcaaagaagaagcctgagaaggttacaaacccgcttttcgagaagcgtccaaagcaatttggaattggaggtgcattgccaccgaagagggatttgaccagattcgtgaagtggcctaagactgttcagattcagaggaagaagaggattttgaaacagaggttgaaggttcccccagctttgaatcagttcactaagaccctcgacaaaaacctagccacaagcttgttcaagatacttctgaagtacaggcctgaggataaggcggagaagaaggagaggctattgaaaagggctcaggcagaggctgacggtaaaactgtagaaactaagaagccaattaatgtcaagtatggtctcaatcatgttacctacctcatcgagcagaacaaagcccagcttgttgtgattgctcatgatgtcgatccaattgaattggttgtatggcttccagctttgtgcaggaaaatggaaattccttactgtattgttaagggcaaggcccgccttggaacagttgtccataagaaaactgcagctgtgttgtgcttgacaactgttaaaaatgaagataaaatggagttcagcagggtcctagaggcgatcaaggcaaacttcaatgacaagtatgaagagtacaggaagaagtggggtggtggaatcatgggttccaaatcccaagctaaaaccaaggcgaaggagaggcttattgccaaggaagccgcccagaggctgccttaggagttattatattctgttgtttccttatgccagttttgtgttatttacttaaattgaaggtttttttgtagcttgaatttccgaattatcacttccaaaacatttcttatttacaatagccagagtatttaagttatctgggtttcattataaacaacgtcattgcctttggctgcagaattttgtttcaatcatatcttcaaatgtttgttaaaatcttggaatcaaatggtatagatacaaatacctcatttcatttcaattctacattgcccttgttctggatacctgaatgtgatataattgtattatattgagcgaatagaccggcatatcaatcttcaagttgactggtctccaactggcagtggtgacggggtaatagttgttctacgtattctctaataacacttattacacatacggggttagaatgatttgcttctgttgcattctgttatagggtctata

SEQ ID NO: 4443 - DNA, 1028 bp, Triphysaria pusilla
taactcgttagggttccatagccgtctctgaggactccccattcactccgaacaagaaatggctccgaagaagggcgcaaagccggccgcaaagaagaaggttgagaaagtggtgaatccactattcgaaaagaggccaaagcagtttggcattggaggagctctgccgccgaagaaggatctgcatcggttcgtgaaatggccgcaggttgtcaggattcagaggaagaagatgatactcaagcagagattgaaggtcccacctccaattcaccagttctccaaaacactcgacaaaaacttggccacaagcctcttcaagatgcttctcaagtataggcctgaagacaaagctcaaaagaaagagcgtcttctcaaaagagcccaggctgagactgaaggaaaaacacccgaagtgaaaaagcctatcgtggtcaaatatggtctcaaccatgtaacctatctcatcgagcagaacaaagctcaattggtcgtcattgcccatgatgtggacccaattgagttggttgtatggcttcctgccctttgcaggaaaatggagatcccttactgcattgttaagggcaaggctagattgggcactattgtccataagaaaactgcatctgttttgtgcttgacatctgtgaagaacgaggacaagatggacttcagcaagatcctggaggctatcaaggccaacttcaatgataaatacgatgaaacgaggaagaaatggggaggtggagttatgggatcaaaatcacaggctaagacaaaggctaaggagagggttcttgccaaggaaactgcgcagagaatgaattaaatgttgttaaagtttttgttagtgagaatcaaaacaggatttttctatctcccctctggttttttgttactggataaaaaatgttgggacatgttttatgtttacatttattatctgctgctattgaaatatgtgtttcccatgctttgttttaaatattattatgtgctattatgaagtatgtcaattgttcaagctc

SEQ ID NO: 4444 - DNA, 1762 bp, Gnetum gnemon
aaattttgcatgaggtcttggcagcgacacttgtcgcacctgcattaaagaagaaattcaattttgccgattgccaaacatcaatatttcctatttaagctaacaagtgaagcagctcacagtgggttatttgctttgctgatccttcatcaatcatcatcatggcagcacttactacaggcctgcaatccgtgcatcccagatcagtgcccagattatgctcctcccacaggaaaatttttctgcattcgctgaccgttcgagccgagaaagctggagcttcagaaaagtcaatagagataatgcggaaattttctgaacaatatgctcgtcgctcgggaacttattttgtgttgataaatcagtgacatctgttgtaatcaagggtctggctgaacacaaggaaaccttaggtgcgccattatgtccctgcaggcactatgatgacaaagccactgaagttcagcaagggttctggaattgcccatgtgtgccaatgcgagaaaggagggagtgtcattgcatgcttttcctaactcctgagaatgattttgcaggaaaagagcaggaaatttcatgcgaagagatcaagaatctgacagctaattactaagtcccggaaatcactcctagagcgttgttgtattatatattaccaacttatttactactttttgatgcctacgtggctaatgtgtaaaataagggatctttgtggaaaggagggacgaagaaggcgacagaaaggccgcagggaggaggcagaggtttaggcagaagaaatggcgccgaagaaattcgttggaaagatcacaactcctgcgaagaagaaggcaccgaaggttgtgaatccgttgttcgagaagaggcccaagcaatttacgattggtggggatctgcctcccaagagggatttgcacaggtttgtgagatggcctagggttgttcgtctacagagacagaggaggatcttgaagcagagattgaaggttcccccggctctgaatcagttcaccaagacccttgataaaaatttggcatcgaatctgtttaagctgttgctgaaatacaggccagaagacaaagctgcaaagaaggaaaggcttttgaagaaggctgaggcggaagctgaaggaaaaacagttgaggctaagaagccgattgttgtgaaatatggaattaatcatatcacgtacctcattgagcagagcaaagcccaacttgttgttatagcacatgatgttgatccgatcgagcttgttgtgtggctgcctgccctctgcagaaaaatgaatgttccctatgccattgtcaaggggaaggcccggcttggatcgattgtgcacaagaaaacagcaactgcactgtgcctgacatctgtcaagaacgaagataaaatggaattcagtaagattgtagaagcaataaaggctaacttcaatgacaagtttgatgagtaccgaagacaatggggaggtggtatcatgggtagcaaatctcaggcccgaactaaagcgaaggaaaagctaatggccaaagaagcagcccagaggcttacttgaggaacatgattatccatatattctgttttggtttttttttggagactgcagaattttagttacttgaggaacgtgatggtccttatatttgtttcttttggaaaatttagaatttcaattaaatttcgtggattgatctgagctgtattttgctcactgtatcagctttgaggcttaccaataccttagtggtccttgtt

SEQ ID NO: 4445 - DNA, 1057 bp, Ambrosia trifida
ttataaacctacattttcatataaccaagaaaagaaaaataaccaccctttacttacttgacagccgtttccacaccttcaatctcaacctttcagacattatggccccaaagaagaagattgtagcaaccaagaagaaaacggagaaggtagtgaatccgttgttcgagaagaggccgaagcagtttgggatcggaggagcgttgccgccgaagaaggatgtgcataggtttgtgagatggccgcaagttgttcggattcagaggaagaggaggatccttaagcagcggttgaaggtgcctcctgctttgaaccagttcaccaaaacacttgacaaaaatcttgcaaccactttgttcaagatgcttctcaagtacaggccagaggacaaggccgcaaaaaaagaacgtcttcagaaacgagctgaggccgaggttgatggaaaaacagttgaaacaaagaagcctattgttgtgaagtatggtctaaatcatgtcacttatctcatcgagcagaacaaggcacaattggttatcattgctcatgatgtggacccgattgagttggttgtctggctacctgcattgtgcagaaagatggaaattccttactgcattgtgaagggaaagtctcgactgggagctattgttcatcaaaaaaccgcatccgctctgtgtttgaccacagtgaagaacgaagataaaatggaattcagcagaattttggaagccatcaaggccaacttcaatgacaagtatgacgagtacaggaagaaatggggtggtggaataatgggttcgaaatctcaggcaaaacaaaggcaaaggaaagggtattggcgaaagaagctgctcagaggatgaattagacagaccatttctgatcatgtattgtctgcagttgaattcatggagagattttgtttgggttatttttatttagtacttgttttatactttttgaagtttaaatttacctgtagttattcttaaatgtactaactataatacttctaagttttttatactaaaaaaagtaaaaaagttaaccgtaacta

SEQ ID NO: 4446 - DNA, 912 bp, Flaveria ramosissima
cgaagaagggtgtgaaggttgcaactaagaagaagacggagaaggtggtgaatccgttgtttgaaaaacggccgaagcagtttgggattggtggagctttgcctcctaaaaaggatctgcacagatttgtaagatggccacaagttgttcgaattcagaggaagaggaggatcctcaagcagcgtttgaaggtgccaccagcattgaaccagttcaccaagacccttgcaaaaatcttgcaactactttgttcaagatgctacttaagtacagaccagaggataaagctgcaaagaaagaacgtctttgaaaaaggcccaggcagagtcagaggggaaacagttgaagctaagaaacccattgttgtgaagtatggtctcaaccatgtcacctacctaattgagcagaacaaggcccagttggtaatcattgcccatgatgttgatccaattgagttggttgtctggcttcctgcactttgcagaaagatggaaattccctactgtattgtgaaaggcaaatcacgattaggagcaattgttcaccagaaaactgctgcagcactttgcttgactactgtcaagaacgaagataaaatggagttcagccgaatattggaggccatcaagacaaacttcaatgataagtatgatgagtataggaagaagtggggtggtggaatcatgggatcaaaatcacaagcaaagaccaaggcaaaagagagagttcttgctaaagaggctgctcagaggatgaattagagagtatttggtaattttttgagattttgagttttttttctaaacataaattattgtactctttagattgttcttccattttcacttttgggagttcaagtacttgtatctgtttgtttttggaatcatgtatgcaatgttttgtatgtgt

SEQ ID NO: 4447 - DNA, 949 bp, Lotus japonicus
atggctccaaaaaaaggtggcaaaccagtagcagcttcgaagaagaaaactgagaaggttacaaacccgttgttcgagaagcgtcccaagcagttcggaatcggaggggcattgcctcccaagagggaccttacccggtttgtgaaatggcctaaggttgttcagattcagaggaagaagaggatcctcaagcagaggttgaaggttcccccagctttgaaccagtttaccaaaaccctcgacaaaaacctcgctacaagcctgttcaagatacttctgaagtacaggcctgaagataaggcagaaaagaaagagcgtcttttgaaaagggctcaggctgaggctgaaaacaaaacggttaagactgagaagccaatcaatgtgaagtatgggctcaatcatgttacctaccttattgagcagaataaggcccagctggttgtgattgctcacgacgttgaccctattgaattggttgtctggcttccagccttgtgcaggaagatggaaattccttattgcattgtcaagggaaaggcacgcttgggatcgattgtccacaagaaaactgcttctgttttgtgcttgacaagtgtgaagaacgaagataaattggagttcagccgagtcttggaagctatcaaggctaacttcaacgacaaatatgaagagtacaggaagaagtggggtggtgggatcatgggttccaaatcccaagctaaaaccaaggccaaggaaagggttcttgccaaggaggctgctcaaaaggatgaattaggcgttcaacactgttttgttgccttgtgtttgtttttttggttgtttaatgtcctattaacttaaaatcaaggttacttttattagacatcttggtgaattctcaccacaaacatttgttcacatgagttagagtatttcatttaaaacaaattgctgctggcagtaaatt

SEQ ID NO: 4448 - DNA, 979 bp, Utricularia gibba
cggtcgtcgtgttttttggtcgtcgttggagggaaatggctccccaaaaggggtgttaagcctgcagccgccgccaagaagaaagcagagaaagttgtcaatcctctgtttgagaaaagacctaagcagtttggaatcggaggcgcgcttccgccgaagagggatcttcatcggttcgtaaaatggccgcaagttgttcagattcagaggaagaagatgatcttgaagcagaggttgaaggtcccccctccaatccatcagttctccaaaacccttgacaaaaacttagcgactagtctcttcaaggtgcttctgaagtatcggcctgaagacaaagctgagaaaaaagagcggcttctgaaaagggctcaagctgaggctgaagggaaaacaccagagctgaagaggcctattgtcgttaaatatggccttaaccatgtgacatacctgattgaacagaacaaagcccaacttgtggtgatcgctcatgatgtagatccaattgaactggtcgtatggctccctgctctttgcagaaaaatggagatcccctactgcattgtcaaggggaaggctaggcttggaactattgttcataagaagactgcatcagtgttatgcctcacctccgttaagaacgaagacaagatggagttcagcaaaattctggaagccataaaggccaatttcaacgataaattcgatgagacgaggaagaagtggggaggtggtgtcatgggctccaagtcccgggccaagactaaagccaaagagaggctcatggccaaggaagctgcccagagaatgacatgagaaaatgttgcatgacattccttccctttgcatgcccatgatcgcatcgtttacaactttggtcgttggatcttgtttctgtttctctttttctgttcagtcctcgtttctgaacataaccttttgttttgacaattattacaactgaggtatatgaatacacact

SEQ ID NO: 4449 - DNA, 1032 bp, Cleome spinosa
tctcgccgctgccgtcaagcgaacttgcctcggaaggagacgaaatggccccgaagaaaggagtgaaagtggctaccaagaagaagccggagaaagttacaaaccctttgtttgagaagcggcccaagcagttcggtattggtggtgccttgcctcccaagaaggatctttctcggtatatcaaatggccaaaggctatccgcctccagagacagaagcggatccttaagcagaggttgaaggtcccacccgcccttaaccaattcactaagactcttgacaagaacctagcaaccagcctctttaagctccttcttaagtacagaccagaagacaaggctgccaaaaaggagcgtcttctcaagaaggctcaatctgaggcagagggaaagccgtccgacgctaagaagcctattgttgtgaagtatggccttaaccatgtgacctacctcattgagcagaacaaggcccaacttgttgtgattgctcatgatgtggacccaattgagttggtcgtgtggttgcctgctctgtgcagaaagatggaagtcccatactgcattgtgaaggggaaatcacgtctgggagcggttgttcacaagaagactgcttcctgcttgtgtctgaccactgtcaagaacgaggacaagctagagttcagcaaaatcctcgaggccatcaaggctaacttcaacgacaagtacgatgaatacagaaagaagtggggaggtggcataatgggatccaaatctcaggccaagaccaaagccaaggagagggttcttgcaaaggaggctgcccagaggatgagctaaggctctttttgttattattatctactcttaaaatgtcattttccattgttctacctctcttattttacgttttggtttattgaatcctccagacaccctattagtccaatcactctgtttttgttcggactgttgatgatacgatgtcgttttaggtttcaaacctggggatgtgattctggattttgggtttaaattaggcttacagaccaaaaaa

SEQ ID NO: 4450 - DNA, 908 bp, Cleome spinosa
cgtctccgtttgaggtctagggttttcagctgggagctggaggaggagttgaagaatcgaaatggccccgaagaaaggaatgaaagtggctgccaagaagaagccggagaaagttaccaatcccttgtttgagaagcgcccaaaacagtttggtattggtggggctctgcctcccaagaaggatctgtcccgatacatcaagtggccaaaggctatccgcctccaaaggcagaagcgtatcctcaagcagaggttgaaggtccctccagctgtgaatcagtttaccaagacgctcgacaagaaccttgctactagcctcttcaagcttcttctgaaatataggcccgaggacaaggctgcaaagaaggagaggcttctcaagaaggcccaatctgagactgaaggaaaaaccgtcgagacaaagaagccaattgttgccaagtatggtcttaaccatgtgacatacctcatcgagcagaacaaggcgcaattggttgtgattgctcatgatgtggacccaatcgagttggtcgtctggttgcctgctttatgccggaaaatggaagtcccttactgcattgtcaagggcaaatcccgtttgggagcgattgttcacaagaaaactgcgtcatgcctgtgtctgacgactgtgaagaacgaggacaagatggaattcagcaaagtcctcgaggcgatcaaggcgaacttcaatgacaagttcgacgagaacagaaagaagtggggaggtggcatcatgggatcgaaatcgcaggccaagaccaaggccaaggagagggtcctcgccaaggaggctgctcagagaatgagctaagcttttcacatctttgtggccgttttgctatttggatcgttttttgtttggtgatttgggacgcgatgttagtgtc

SEQ ID NO: 4451 - DNA, 999 bp, Taraxacum officinale
gtaaaggaaaaccccatacatttgtgttagggttcttcgtcatcgccgtttcgaagctgcgaatcccagtctacactaatggctccgaagaagggtggaaaggcggttgcaaccaagaagaaaacggagaaggtcgcgaatccattgttcgaaaagcgaccaaagcagtttggtatcggcggagctttgcctcctaagaaggacgtacaccgattcgtcagatggccacaagtcgtcagacttcagagaaagaggaggatcctcaagcagcgtttgaaggtcccaccagccttgaaccagttcaccaaaacccttgacaagaatctcgcaaccaccttgttcaagatgctactcaagtacaggcccgaagacaaagcagccaaaaaggaacgcctattgaacagggctaaggctgaatcagagggcaagactgttgaagctaagaagcctattgttgtgaagtatggtcttaatcatgtcacctaccttattgagcagaacaaggcacagttggtgatcattgcccatgatgttgacccaattgaattggtcgtctggctcccagctctctgcagaaagatggaaatcccttactgcattgtaaagggaaaatcccgtctaggaactatcgtccaccaaaaaactgcagctgctctttgcttgactacagtcaagaacgaggacaaaatggaattcagccgagttcttgaagccatcaaggcgaacttcaatgataagtatgaggagtacaggaagaagtggggaggtggaattatgggttccaaatcacaagcaaaaaccaaggcaaaagagagggtttatgccaaggaggctgcccagaggttgaaatagagtgcttttcgtatggtattatgtacgttttggttttagaatttgaaattaaaaaatggtttgtggttttttgaagttttggaaagacaaatgtttactttgtatgggtattttatgtgtttggtttttggatttatgataattgat

SEQ ID NO: 4452 - DNA, 1098 bp, Olea europaea
tttttacacgttctaaatccctctgatctgatctgggagaaatggctccaaagaagggcgcgaaattgccggcgggagtggctaaaaagaaagcggaaaaggtagtgaatcctctattcgagaagcggccaaagcaatttggtattggtggagcgttgccgccgaagaaggatctccaccgatttgtgaaatggcctcaagtggtgaggattcaacgcaagaagatgattttgaagcaacgccttaaggtcccgccgccaattcatcagttctctaaaaccctcgacaagaacttggcaacaagcttgttcaagatgcttctcaaatacaggcctgaggataaagctcaaaagaaggagaggctactaaaaagagcacaggctgaggcggaaggaaaaacacctgagattaagaaaccaatcattgtgaaatatggtctcaaccatgttacctatctaattgagcagaacaaagctcaactagttatcattgcccatgatgtggaccccattgagttggtggtatggcttcctgcattgtgcaggaaaatggaaatcccttactgcatcgtgaagggaaaggctcgattgggaactatagtccataagaagacggcatctgtattgtgcttaacctcagttaagaatgaagacaagatggacttcagcaggatcttggaagctattaaggccaacttcaacgataaatacgatgagaccaggaagaagtggggtggtggagttatgggctcaaaatccctggccaagacaaaggccaaagagagactcatggccaaggaggctgcacagaggatgacttaggctcttagtcttgcatttttctatcaaggatggaaccatatgagcgaaccttttttaccttcctttgttgctacaattcatgctagacatttttgtttccatgtgatatttgatagacgaaatgctttatcgtgtctagtatatgacgatgtttggttttgtcaggtgtttatgtacttcaagtttttcgtagaatgaaatgcaacatttttaacgtgttgtgttgtcctacctctagaaattttgcaaatttgagcctcccttatcgatgtagaat

SEQ ID NO: 4453 - DNA, 1009 bp, Olea europaea
gagcagaacttagggttttaacattgcctgcgcctctctagttccagttcaccaatcgaagaaaaatggctccaaagaaaggtgccaagcttccggcgaagaagaaggtggagaaggtggtgaatccgctgttcgagaagcgaccgaagcagtttggaattggcggagctctaccgccgaagaaggatcttcaccgcttcgtgaaatggccgcaggtggttcgaatccaaaggaaaaagatgatattgaagcagcgcctcaaggtgcctccgccaatccaccagttctccaaaaccttggataagaaccttgcaacgagtctattcaagatgcttctcaaatacaggcctgaggatagagctgaaaagaaagagcgccttttgaaaagagctcaggctgaggctgaaggcaaaactcctgaggttaagaagcctattattgtgaagtatggtctcaaccatatcacctatctgattgagcagaacaaagcgcaactggtggtgatcgctcatgatgtggaccccattgaattggttgtgtggctcccagcattgtgcaggaagatggaaatcccttattgcattgtaaagggaaaggcaagattgggaactattgtccataagaagacagcatcagccttgtgcttgacctcagtaaagaatgaagacaagttggagttcagcaaaattttggaggctattaaggcaaacttcaatgataaatatgatgagactaggaagaagtggggtggtggagttatgggctcaaaatctcaagctaaggcgaaggcaaaagaaaggattcttgccaaggaggctgctcaaaggatgtcttagatcttcgtcctaaaattttgttgctgcgaataccatttttgtttgagagatgagatttgtttttccacatctaactgcatgcatcgcattttattacccaaattcttgtgtaccttttttctacgggttcgtactttaacctaactgttcttaataattgttttaaacttttt

SEQ ID NO: 4454 - DNA, 1074 bp, Olea europaea
acgttctaaatccctctgatctgatctgggagaaatggctccaaagaagggcgcgaaattgccggcgggagtggctaaaaagaaagcggaaaaggtagtgaatcctctattcgagaagcggccaaagcaatttggtattggtggagcgttgccgccaaagaaggatctccaccgatttgtgaaatggcctcaagtggtgaggattcagcgcaagaagatgattttgaagcaacgccttaaggtcccgccgccaattcatcagttctctaaaaccctcgacaagaacttggcaacgagcttgttcaagatgcttctcaaatacaggcccgaggataaagctcaaaagaaagagaggcttctgaaaagagcacaggctgaggctgaaggaaaaacacctgaggttaagaagccgatcattgtgaaatatggtctcaaccatgttacatatttaattgagcagaacaaagctcaacttgttatcattgcccatgatgtggaccccattgagttggtggtatggcttcctgcattgtgcaggaaaatggaaatcccttactgcatcgtgaagggaaaggctcgattgggaactatagtccataagaagacggcttctgtattgtgcttaacctcagttaagaatgaagacaagatggacttcagcaggatcttggaagctattaaggccaacttcaatgataaatacgatgagaccaggaagaagtggggtggtggagttatgggctcaaaatccctggccaagacaaaggccaaagagagactcatggccaaggaggctgcacagaggatgacttaggctcttagtctagcctttttctatcaaggatagaatctttttaccttcctttgttgctccaattcatgctagacatttttgtttccatgtgatattggatagacgaaatgctttatcatgactagtaaatgacaatgtttggttttgtcaggtgtttatgtactttcaagtttttcgtagaatgaaatgcaacatttttaacgtgttgtattgttcttcctctagaaattttgcaaatttgaggctcccttatcgttgtg

SEQ ID NO: 4455 - DNA, 1047 bp, Triphysaria pusilla
tttcacagccgtttctcagactcacactccattcctcgcagcaaatcaaaaaatggcaccgaagaagggcgcaagaccagtggccgctgccaagaagaagacagagaaagttgccaaccctctgttcgagaagagaccaaagcagtttggcatcggaggcgcgctaccgccgaagaaggatctccacaggtttgtgaaatggccccaagttgtgaggatccagaggaagaagatgattctcaagcagcgattgaaggtcccgccgccgattcatcagttctccaaaactctggacaaaaatttggcaactagcctatttaagatgcttcttaaatataggcctgaggataaagctcaaaagaaagagcgtctcttgaaaagagctcaagctgagactgaaggcaaaaccccagagttcaagaaaccgattgtggttaaatatggcctcaaccatgtgacctacctcattgaacagaacaaagcacagttggtggtgattgcacacgatgttgatcccattgagttggttgtttggctcccggcattgtgcaggaaaatggaaatcccgtactgtattgtgaagggaaaagctaggttgggaactattgtccacaagaagacagcctctgttttgtgcttgacctctgtaaagaacgaagacaagatggatttcagcaagattcttgaggccatcaaggcaaatttcaatgataagtatgatgagaccagaaagaagtggggaggtggtgtgatgggctccaagtcgcaggccaaaaccaaagccaaagagagggttattgcaaaggaagctgcacaaaggatgtgatctgaggagcttgtttttgctatatttattgtctattagtggataaaattgatgtgcacttgttttcttcagctttacaatagacaagagttttgttttcatacaagattgccttttggctttgttttgaatcttctgagtaggaaaactttgatatttaatcttgttaaaaacctttgttggtgttttgatcatattttggtaaccttctatatttgtct

SEQ ID NO: 4456 - DNA, 1075 bp, Triphysaria pusilla
aagtgaggtataacaattagggtttcacagccgtttctcagattcacactccattcctcacagcaaatcgaaaaatggctccgaagaagggcgcaaggccagtggccgcagccaagaagaagacggagaaagttgcaaaccctctgttcgagaaaagaccaaagcagtttggcatcggaggtgcgctaccgccgaagaaggacctccataggtttgtgaaatggccccaagttgtgaggatccagaggaagaagatgattctgaagcagcgattgaaggtcccgccgccgattcatcagttctccaaaactcttgacaagaatttggcaactagcctatttaagatgcttcttaaatataggcccgaggataaagctcagaagaaagagcgtctcttgaaaagagctcaagctgagaccgaaggcaaaacaccagaatttaagaagcccattgtggttaaatatggccttaaccatgtgacttatctcattgaacagaacaaagctcagctggtggtcattgctcatgatgttgatcctattgagttggttgtttggctcccggctttatgcaggaaaatggagatcccatactgtattgtaaagggaaaagccaggctgggaactattgttcacaagaaaacagcctctgttttgtgtttgacctctgtaaagaacgaagacaagatggacttcagcaagattcttgaggccatcaaggctaatttcaatgataagtatgacgagaccagaaagaagtggggaggcggtgtgatgggctccaagtcacaggccaaaacaaaagccaaagagagggttattgcaaaggaagctgcacaaaggatgtgatttgaggagcttgtttttgctatatttattgtctattaggggaaaccatttatgtgcacttacaatagacgagttttgttttcaatatgatgataactttttgtgtttttgctttgaaaccttctatgagtttgacaaactctatgataattaatcttcttgttgcaacttgtgtttggttagctagttgggattttggtaatttgatattttcttgtataatcttc

SEQ ID NO: 4457 - DNA, 1023 bp, Tripterygium wilfordii
aaaaccctcagagcagctgccgcttctcgtcttccctgcgctctcgacatcactgcgcagacatggctcccaaaagaggtggaaaggccccagtagcagcaaaaaagaaaactgaaaagatagtgaaccctttgtttgagaagcgaacaaagcaattcggaattggtggtgctctaccaccaaagaaggatttgactagatttgtcaagtggccacatgttgttcgtattcagaggaaaaggaggattttgaagcaaagattgaaggttccacctgccatcaaccagttcacaaaggcactggataagaaccttgctacaaatcttttcaagttgttgctcaaatatagacccgaggacaaggctgctaagagggaaaggcttcttaaaaaagcacaagctgaagctgaggggaagagtgtggaatctaagaaacctattgttgttaaatatggccttaatcatgttacctatctcattgagcagaacaaagcccagttggtacttattgcacatgatgttgatccgattgagcttgttgtttggttgcctgccttgtgccggaaaatggaggtcccttatgcaattgtgaagggcaagtcaaggcttggaacgattgtgcacaagaaaacagctgcagttctgtgccttacatcagtgaagaatgaagataagatggaatttagcaggattgtagaggcagtcaaggccaactttaacgacaagtatgatgagcaccgcaagaaatggggaggtggcatcatgggttccaaatctcaggccaagatgaaggcaaaggagagagtattagccaaggaggctgcacaaagaatgacttgatttgataactaagaactgctgggaagaattgaaaaattaattggaacgagctacacagggtttttattttctattgcgtatttatattttggtttgttgtcattgtggacaagtttggtatcgattagtagccgaatttttgtgatgctggttttgttattgaggttattgtctaattactcaa

SEQ ID NO: 4458 - DNA, 1238 bp, Fagopyrum esculentum
atatccctctagcgtgctcactcccccattgttgcactgtagccggtatcgaaagaaagcacagctgcaatggcgcctaagcgaggtggaaaggtctcttcaggcataacaaagaagaaaactgagaaggtcgttaaccccctatatgagaagcgtcctaagcagttcggaattggtggggcattgcctcccaaaaaggacatgcgccgttttgtgaagtggcctaaagttgttcaactccagaggaaaaagaggatcttgaagcagcggttgaaggttccaccagccttgaaccaatttacaaagacccttgacaagaatcttgcaacaagcctgttcaagatgcttctgaagtacaggcccgaagacaaggcagcaaagaaggaaagacttctgaacaaggctcaagctgacactgctggaaaagaagctgcagctgctaagaagccaattgttgtcaaatacggtcttaaacatgttacttatctcattgagcagaacaaggctcagttggtggtcattgctcatgatgtagacccgattgagttggttgtttggcttccagctctttgcaggaagatggaaattccttactgcattgttaagggcaaggcacgacttggatcgattgtgcacaagaaaaatgcatctgtgttatgcctcaccaccgtgaagaatgaagataagttggatttcagcaaaatcttggaagctattaaggccaacttcaatgacaaatacgaagagttcaggaaaaagtggggcggtggtatcatgggttcaaaatctcaagccaagaccaaggcaaaggagagagtccttgcaaaagaggctgcccagaggatgacctagaattgatatataaaattttgctgtgtcactgttttcccgatactagtttaatcagacattgttatggctatagctatttccattttggtgatgaattctattttgttcctcctataatcacttccttttccccttattagctcagagttggtatgtgttaatcttttctgcacaagttttcttttgattatcggtatacttgaagcaaccaagcaaagcaagatagttcttgcttctgtttctcgaggtctttaaaccccaaatgtgatggatttgagatttactcgacaattgttaaccttactgaaacaaaaaaacaaaaacgaaaaactaaactaactacgtgttcgtagtactaactactcttcgtcgtagtacgacgtacg

SEQ ID NO: 4459 - DNA, 1141 bp, Solanum lycopersicum
aactcatttatcatcagtttctgtataacagagtgttcttctcccttggggtttgttcatcagatcttgagaaaaaaaatggctccaaagaagggtgttgcagtagcagcaaagaagaagccggagaaggcgaaagcggtgaatccactgtttgagaagcggccaaagcagttcggtatcggtggggcgctgccgccgaagaaagatgtaacaaggaatgtaagatggcctcggaatgttgtcctgcaaaggaagaagaggattctcaaaatgcgattgaaggtccctcctgctcttaaccagttcaccaaaacccttgacaagaaccccgctacaacccttttcaagatgcttcttaagtacaggcctgaggacaaagctgcaaagaaggagcgtcttgtcaaaagggctcaagctgaagcagaaggaaaaactcctgaaacaaagaaacccattgttgtgaagtatgggcttaagcacatcacttaccttattgagcagaacaaagctcagttggtagtgattgctcatgacgtggacccaatagagttggttgtctggcttcctgcgctatgcagaaagatggaaattccttactgcattgtgaagggcaaagctcgtttaggatcgattgtgcataagaaaactgcttcagccttgtgtttgacaaccgtgaagaatgaagacaaaatggagttcagcagaattttggaggccattaaggctaacttcaatgacaagtatgaagagaacaggaagaagtggggtggtggtatcatgggctctaagtcacaggccagaaccaaggccaaggaaagagttcttgccaaggaagctgcccagagattgaactaggagcttgctgtgatactatacactgcaatttgattagtgagattctctgccaagttttgtatttggttcacatgcttcacaatgttaaagatattagtttgacaattaccccctttatgtttgccttgacaaatgctttatcagacatttttgttagatattttgttgagttgatttttttatggcaccgaattccgcagttattcagattattactacagtaaactacaacttctatcttcaattagtgcttactcttgtttattaatctcttcctgctaccttg

SEQ ID NO: 4460 - DNA, 1001 bp, Fagopyrum esculentum
accgtagccggtatcgaaagaaagcacagttgcaatggcacctaaacgaggtggaaaggtctcttcaggcccaacaaagaagaaaactgagaagactgttaacccactatatgagaagcgtcctaagcagttcggaattggtggggcattgcctcccaaaaaggacatgcgccgatttgtgaagtggcctaaagttgttcaactccagaggaaaaagagaatcttgaagcagaggttgaaggttccaccagctttgaaccaatttacaaagacccttgacaagaatcttgcaacaagcctgttcaagatgcttctgaagtataggcctgaagacaaggcagcaaagaaggaaagacttctgaacaaggctcaagccgacgctgctggaaaagaagctgcagctgctaagaagccaattgttgtcaaatacggtcttaaacatgttacttatctcattgagcagaacaaggctcagttggtggttattgcgcatgatgtagacccgattgagttggttgtttggcttccagctctttgcaggaagatggaaattccttactgcattgtcaagggcaaggcacgacttggatcgattgtgcacagaaaaatgcatctgtgttgtgtctcaccactgtgaagaatgaagataagttggatttcagcaaaatcttggaagctatcaaggccaacttcaatgacaagtacgaagagttcaggaaaaagtggggcggtggtattatgggttcgaaatcgcaagccaagaccaaggcgaaggagagggttcttgcaaaggaggctgcccagaggatgacctagagttgatatataaaattttgctgtgtcactgttttctcaatactagtttaatcagacattgttatggttatagctatttccattttggcgatgaattctattttgttcctcctataatcaccatccttttctccttattagctcaaagttggtatgggtttatcttttctgcaccaagtttcttt

SEQ ID NO: 4461 - DNA, 962 bp, Utricularia gibba
gtcgccaagaagaaaggtggagaaggttgtgaatcctctgttcgagaaaagaacctaagcagtttggtattggaggtgcccttccgccgaaaaaggatcttcaccggtttgttaggtggccgaaagttgtgaatctccaaaggaaaaagaggatactgaagcagcgtttgaaggttcctcctgcgattcaccagttctccaaaaccctcgacaagaacctagctaccagcctcttcaagattcttctcaagtatcggcctgaagataaggctgagaaaaaagagcgccttctgaagagggcccaggctgaggctgaaggaaaaaccccagaacttaagaagcctattgtggtgaagtatggtcttaaccatgtgacctaccttatagaacagaacaaggcccagctggttgttattgcccacgatgtggatccgattgaattggttgtgtggctccctgctctttgtaggaaaatggagattccgtactgcattgtcaaaggaaaggctaggctgggaacgatcgtgcacaagaagacagcgtcagtgctatgccttacctctgttaaaaatgaggacaagatggagtttagcaaggttctggaggcgattaaggctaatttcaatgacaagttcgatgagacgaggaagaaatggggtggtggtgtcatgggcaccaagtcacaagcaaagactaaagcaaaggagaggctcttggccaaggaagccgctcagagaatgacctaatgaaatggtgtcactcttgtgttcgttttgtgctctgctcgaaagattcttcatttttttccttttcgttgcatatcttaagcgacttcgttgtggaggatagcagtgctattcatctttgttgcccaatgatgtgctcttatcttttcctttgcatccacagtaaaccattcatttaaattctgcaaattaggttacaacatgaagtccttttat

SEQ ID NO: 4462 - DNA, 770 bp, Triticum aestivum
ctcctccccactgcctcgtgtggccgtcgtctcccgttcggaacgccaagccccccctccggcgaaatggcccccaagcgaggtggcagggcgccggtgccggccaagaagaagacggataaagtgacgaaccctctattcgagaagaggccgaagcagttcggcatcggcggcgcgttgccgcccaagaaggacctgcaccggttcgtcaagtggcccaaggtcgtgcgtatccagcggcagcgccgcatcctcaagcagcgcctcaaggtaccaccggcgctcaaccagttcacccgcaccctcgacaagaacctcgctacgaacctgtttaagatgcttctcaagtaccggcctgaagacaaggctgccaagaaggagagcttctgaagagggcccaagctgagaatgaaggaaaaactgttgaagccaagaaaccaattgttgtgaagtatggccttaaccatgtgacttacctcattgagcagaacaaggctcagcttgttgtcatcgctcacgacgtggatccgatcgaacttgttgtgtggcttccagccctgtgcaggaagatggaggtcccttactgcattgttaaaggaaaggctcgccttggatcgattgttcacaagaagaatgcatcagtcttgtgtctgaccactgtcaagaacgaggataagcttgagttcagcaagatcttggaggctattaaggcaaacttcaacgacaattcgatgaggtcaggaagaatggggaggtggcatcatgggatc

SEQ ID NO: 4463 - DNA, 1041 bp, Olea europaea
ttcggggggttttttacttacgtttctaaatctctctgagctgaactgggagaaatggctccaaagaagggcgcgaaattgccggcgggagtggctaaaaagaaagcggaaaaggtagtgaatcctctattcgagaagcggccgaagcaatttggaattggtggagcgttgccgccgaagaaggatctccaccggtttgtgaaatggcctcaagtggtgaggattcagcgcaagaagatgattttgaagcaacgccttaaggtcccgccgccaattcaccagttctctaaaaccctcgacaagaacttggcaacaagcttgttcaagatgcttctcaaatacaggcctgaggataaagctcaaaagaaagagaggcttctaaaaagagcacaggctgaggctgaaggaagaacacctgagattaagaaaccaatcattgtgaaatatggtctcaaccatgttacctatctaattgagcagaacaaagctcaacttgttatcattgcccatgatgtggaccccatagagttggtggtatggcttcctgcattgtgcaggaaaatggaaatcccttactgcatcgtgaagggaaaggctcgattgggaactatagtccataagaagacagcatctgtattgtgcttaacctcagttaagaatgaagacaagatggacttcagcaggatcttggaagctattaaggccaacttcaacgataaatacgatgagaccaggaagaagtggggtggtggagttatgggctcaaaatccctggccaagacaaaggccaaagagagactcatggccaaggaggctgcacagaggatgacttaggctcttagtcttgcatttttctatcaaggatggaaccatatgagagaaccttttttaccttcctttgttgctacaattcatgctagacatttttgtttccatgtgatacttgatagacgaaatgctttatcatgtctagtatatgacaatgtttggttttgtcaggtgtttatgtacttcaagttttttgtagaatgaaatgcaaca

SEQ ID NO: 4464 - DNA, 1081 bp, Orobanche aegyptiaca
ccgtgctcagtcccccacactcattcctctcagaaaaagtaaaaggaaaatggcacccaagaaaggcgttaagccggcggccgccgccaagaagaagactgagaaagttgtaaaccctctgttggagaaaaggccaaagcagttcggtatcggaggtgcgctgccgccgaagagagatcttcacaggtttgtgaaatggccgcaagttgtgaggatccagagaaagaagatgatcttgaagcagcgattgaaggtcccgccgccaattcatcaattttccaaaacacttgataagaatttggcgactagcctgtttaagatgcttctcaagtataggcctgaggatagagctcaaaagaaggagcgtcttttgaaaagagctcaagctgaggctgaagggaaaaccccagaattcaagaaacctattgtggttaaatatggccttaaccacgtgacctatctcatcgaacagaacaaagctcaattggtggttattgcccacgatgtggatcctattgagttggttgtgtggctcccggctttgtgcaggaaaatggaaatcccgtactgtattgtgaaggggaaggctaggttgggcactattgtccacaagaagacatccgctgttctgtgcttgacctcggtaaagaatgaagacaagttggacttcagcaagatccttgaggccatcaaggccaatttcaatgacaagtacgatgagacaaggaagaagtggggtggtggtgtcatgggatccaagtcccaggccaaaacaaaggctaaagaaagggttcttgccaaggaagctgcacaaaggatgacctgaaaaggacgtgttcctattttgttatctgttagctatagaacttaaatgagagaacttttgatttaccatctggttcacggaagacattgggcttgtgtttttttgttttaattttgaatcttatttgaatcgggattgaatattttgtttctaatgcaatttcattgtactcggtgatgggaatagcgaatcgaattttgcttctcctgctggtggtttcatatacatattacactaaatttattgatggtttta

SEQ ID NO: 4465 - DNA, 974 bp, Eutrema parvulum
ggcacccaaaaagggagtgaaagtggctaccaagaagaagccggagaaagttacgaatccattgtttgagagaaggccaaagcaattcggtatcggtggagctttgcctcctaagaaggatttgactcgttacatcaaatggccaaaatctatccgtcttcaaagacagaagcgtatccttaagcagaggttgaaggtcccaccggctttgaaccagttcaccaagactcttgacaagaacctcgcaaccaacctcttcaaggttcttctcaagtataggccagaggacacagccgcaaagaaagatcgccttttgaagaaggctcaagctgaggctgagggaaagccttctgaatccaagaagcccattgttgtcaagtatgggctcaaccacgtgacttacctcatcgagcagaacaaggcacagcttgtggtcatcgcacacgatgttgaccctatcgagttggtggtctggttacctgcactttgtaggaaaatggaagttccttactgcattgttaaaggaaaatctcgtcttggatcgattgttcaccagaagactgcttcttgcttgtgtttgaccactgtcaagaatgaggacaagctcgagttcagcaaaatccttgaagcgatcaaggcaaacttcaacgacaagtacgacgagtacaggaagaagtggggaggaggcataatgggatccaagtctcaagccaagaccaaagctaaggagagggttcttgctaaggaggctgcccagagaatgacctaagcagaagcagagcgtctctttttggttgtcgtttaagaaactttatgaagatcgtggttttgtttagcgatttcttgggatattttataaacttttatgctttcattatcgatgttgctcacttgagaattttatgcagttttgctatcaaatttactttcgcgttttagattatttgttgatctttgtttgcaaattaaaaagt

SEQ ID NO: 4466 - DNA, 1026 bp, Tripterygium wilfordii
cttctactcctcgcgctttcgacggcactgcgcaggcatggctcccaaaagaggtgggaaggccccagtaacagcaaaaaagaaaactgaaaaggtagtgaaccctttgtttgagaagcgaccaaagcaattcggaattggtggtgcactaccaccaaagaaggatttgactagatttgtcaagtggccacatgttgttcgtattcagaggaaaaggaggattttgaagcaacgattgaaggttccacctgccatcaaccagttcacaaaggcactggataagaaccttgctacgaatcttttcaagttgttgctcaaatacagacctgaggacaaggctgctaagagggaaagactttttaaaaaagcacaagctgaagctgaggggaagagtgtggaatctaagagacccattgttgttaaatatggccttaatcatgttacctatctcattgagcagaacaaagcccagttggtaattattgcacatgatgtcgatccaattgagcttgttgtttggttgcctgccttgtgccggaaaatggaggtcccctatgcaattgtgaagggcaagtcaaggcttggaacgattgtgcacaagaaaacagccgcagttttgtgccttacatcagtgaagaatgaagataagatggaatttagcaggattgtggaggcagtcaaggctaactttaatgacaagtatgatgagcaccgcaagaaatggggaggtggcatcatgggttccaaatctcaggctaagatgaaagcaaaggaaagactcttagccaaggaggctgcacaaaggatgtcttgatttgataaccaaaaactgctgggaagaagtgataattgcaacgagctacagggtttttatttttccgttgcgtctttgtattttgtttagttgtcattgtggacaagttttgtgttgattggtagccgaatttttgtgatgctggttttgttactaaaatagacttttgatgggatctctgggcaaactgagatgttataaagttcacttgc

SEQ ID NO: 4467 - DNA, 1107 bp, Fagopyrum esculentum
gggtcgccgttgacagtgacgagaacaacagcagctgcgatggcaccaaaacgaggtggaaagttggctgcttcagccccatcaaagaagaaaccggagaaggctgtgaacccgctttatgaaaagcgaccaaagcagtttggaattggtggggcattgcctcccaaaagagacatgaagcgatttgttaagtggcccaaggttgttcagctccagaggaagaagaggatcctgaagcagaggttgaaggttccaccagccttgaaccaatttaccaagacacttgacaagaatctcgcaacaagcctgttcaagatgcttctcaagtacaggcctgaagacaaagctgcaaagaaagaacgacttatcaacaaggctcaagctgatgctgctggaaaggaggctgcaactgctaagaagccaattgtgattaaatacggtctcaagcatgtgacatacctcattgaacagaataaagctcagttggtggttatagcccatgatgtggacccaattgagttggttgtgtggcttccagctctatgcaggaagatggagattccatactgcatcgtgaaggggaaagcacgattgggatcgattgtgcacaagaaaaatgcgtctgtgttgtgcctaactactgtcaagaatgaagacaagttggacttcagcaagatcttggaagccattaaggccaacttcaacgacaagtacgaagagttcaggaagaagtggggaggtggtatcatgggttcaaaatcacaagcaaagaccaaagcgaaggagagggtcctcgcaaaggaggctgcccagaggatgacctagagagaggcatgtaaaatttttctggttttttaatctctatttcaaatactagttcaatcagagagacggttatgtttttcagtcatgcgtatgacattttgtggtagtttacttcactgagcatttatgatgaaacacgggttgcaatcttggttagcttttggttttcccgtcgtgcaaaaatgagcacattctcattttcattttcctaacacgttgtgttgttgctacagctttccgcgtagcttgtgatatatacatatcagtggataaatttcaagt

SEQ ID NO: 4468 - DNA, 1110 bp, Fagopyrum esculentum
cgccgttgacagtgacgagaacaacagcagctgcgatggcaccaaaacgaggtggaaagttggctacttcagcctcagcaaagaagaaaccagagaagaccgtgaacccactttatgagaagcgacctaagcagtttggaattggtggggcattgcctcccaaaagagacatgaagaggtttgttaagtggcccaaggttgttcagctccagaggaagaagaggatcctgaagcagaggttgaaggttccaccagccttgaaccaatttaccaagacacttgacaagaatctcgcaacaagcctgttcaagatgcttctcaagtacaggcccgaagacaaagccgcaaagaaagaacgacttatcaacaaggctcaagccgatgctgctggaaaggaggctgcagctgctaagaagccaattgtggtcaaatacggtctcaagcatgtgacatacctcattgaacagaacaaagctcagttggtggttatagcccatgatgtggacccaattgagttggttgtgtggcttccagctctgtgcaggaagatggagattccatactgcattgtgaaggggaaagcacgattgggatcgattgtgcacaagaaaaatgcttctgtgttgtgcctaactactgtcaagaatgaagacaagctggatttcagcaagatcttggaagccattaaggccaacttcaacgacaagtacgaagagttcagaaagaagtggggaggtggtataatgggttcaaaatcacaagcaaagaccaaggccaaggagagggtccttgcaaaggaggctgcccagagaatgacctagaggcatgtacaatttttctggtttttcaatctttatttcaaatactagttcaatcagagggattgttatgtttttcagtcatgcgtatgacattttgtggtagtttacttcattgagcttttatgatgaaacacgagttgcaatcttggttagcttttcaatttcccggcttgcaaaaatgagcacattctcatttcttaactactgttgctacagctttccgcgtagcttgcaacacgatgcaaatcactttagctgtaacctttgtggtaaagatgttaaactgtag

SEQ ID NO: 4469 - DNA, 1015 bp, Adiantum capillus-veneris
ctcctacaaggatctgtaggagcaggaggggttaagcgctcgtccatcggccggagtctcactgtaagcgttcgccatggccccgaagagggggacaaagctcccggtacctgctgcagcggataagaaaaagaccccagagaaggtgcagaatcctttgtttgagaagaggccaaaacagtttggcattggaggagcattgcctccaaagaaggacctgcacagatttgtcaaatggcctaagtatgttcgccttcaaaggcaaaggagggtcttgaatcagcggctcaaagttccgcctgctttgaaccagtttaccaagactctggataagaacttggcatctagcctcttcaagatgcttatcaagtacaggccagaggacaaagctgccaagaaagagcgccttttgaagaaggctcaggcagaagccgaggggaaaacgattgaaagcaagaagcctattgttgtgaagtatggaattaaccatgtcacgtacttgatcgagcaggggaaagcgcaactcgtggttattgcacatgatgtggatcccattgagctggttatttggcttccagctctatgcaggaagatgggtattccttatgcaattgtgaaaggcaaagcccgccttggtcagattgtccactcaaaaacagccacagctctatgtctcacatcagttaaaaacgaggacaaattggagttcagcaaaattgtagaagctattaaggcgaacttcaatgaccggtttgatgaccttcgaaggcaatggggcggtggcatcatgggggtcaagtcacaggccaagactaaggcaaaggagaaagttcttgcgaaggaggctgcccaaaggatgtcctaagggctgagctcgctggaggcgggacacgtcgtagtcttcaaatttagtcttactaaatgagcccttttttgacaagagttgcagcatatctgctggcggaatttttgttttaaacctacagaatcaatgctcaacaatttctttctttag

SEQ ID NO: 4470 - DNA, 809 bp, Glycyrrhiza uralensis
gacaaagtattattagggtttttacattgcagagtcgttctctcccttcgccacctcaatcaacagcagcagcagcaatggcacccaagcgcggtggaaaagcaccagtggtggcagcgaagaagaagcagccggagaaagtggtgaacccgctgttcgagaagaggccgaagcagttcgggatcggtggcgcgttgcctcctaagagagacctcacgcgcttcgtcaagtggcccaagaccgttcaacttcagaggaagaagaggatcctcaagcagagactcaaggtcccacctgcactcaaccagttcaccaaaacactcgataaaaacctcgcaacaaaccttttcaagatgctccttaagtacaggcctgaggacaaagctgagaagaaagagcgtcttttgaaaagggctcaagcagaggctgatgggaagcccgttgaagcaaagaagcctattgttgtgaaatatggtctcaatcatgttacctaccttatcgagcagaacaaagcacagcttgttgtgattgctcatgatgtggacccaattgagctcgttgtctggcttccagcactgtgcagaaagatggaaattccctactgcattgtcaagggcaaagcacgcttgggaactattgttcacaagaaaactgcatcagttttgtgcttgacaactgtcaagaatgaagacaaactggagttcagtaggatcttagaggctattaaggccaacttcaatgacaagtatgatgaatacagaaagaagtggggtggtgggattatgggttccaaatcccaagccaaaacc

SEQ ID NO: 4471 - DNA, 1002 bp, Nicotiana benthamiana
gtgggaaattggttgcaggctccaaagaaaggtgtagcagtagcagcaaagaagaaaccagttcaagcgaaagtggtgaatccactgttcgagaagcggccaaagcagtttgggatcggtggtgcattgccgcccaagaaggatctgacccgtttcgtgagatggcctcaggttgttcgtatccaaaggaaaaggaggattcttaagcagcgtttgaaggttcctcctgctcttaaccaattctcaaaaacccttgacaagaatcttgctacgaacttgttcaagatgctattgaagtacaggcctgaagacaaagctgcaaagaaggagcgtctcgttaaacgagctcaagctgaaacagaagggaaaacacccgagactaagaaacctattattgtgaaatatggtcttaagcacataacctaccttattgagcagaacaaagcacagttggtggttattgctcatgatgtggacccaatagagttagtcgtgtggctgccagcattgtgcagaaagatggaaattccgtactgcattgtgaagggaaaagcacgtttaggatccatcgtgcacaagaaaactgcgtcggctctatgcttgacaactgtgaaaaatgaagataaaatggagttcagcagaattttggaggcaatcaaggcaaacttcaatgacaagtatgaggaaaacagaaagaaatggggcggtggtgtcatgggatccaaatcacaagccagaacaaaagcgaaagagagggttcttgccaaggaagcagcacagagaatgaactagagcttctattgtatgttgctgttggattaaacctctaccaattttgtgtttttggttcgcatacttgagcaatgatagagatcctacgtggattagacttttatatttactttgtgttacagattatgttatgcaaaaacactttcctactttgtcagttttctgagtagatggttggttgagttggttatgtacgaggatagtttgagt

SEQ ID NO: 4472 - DNA, 1147 bp, Solanum tuberosum
agataggctgtttctccgggtttagtcctccggtcgccgtctcaagcaaaaatggctccaaagaagggtgttgcagtagcagcaaagaagaagccagagaaggcgaaggtggtgaatccactgttcgagaagcggccaaagcagttcggtatcggtggagcgctgccgccgaagaaggatgtaacaaggaatgtaagatggcctcggaatgttaccctacaaaggaagaagaggattctcaagatgcgattgaaggttcctcctgctctaaaccagttcaccaaaacccttgataagaacctcgctacaaaccttttcaagatgcttcttaagtacaggcctgaggacaaagctgcaaagaaggagcgtcttgtcaaaagggctcaagctgaagccgaaggaaaaactcccgagacaaagaaacctattattgtgaagtatgggcttaagcacatcacttaccttattgagcagaacaaagctcagttagtagtgattgctcatgatgtggacccaatagagttggttgtctggcttcctgcactttgcagaaagatggaaattccgtactgcattgtgaaggggaaagcacgtttaggatcgattgtgcataagaaaaccgcttcagccttgtgtttgacaaccgtgaagaatgaagacaaaacggagtttagcagagttttggaggcaatcaaggctaacttcaatgacaagtatgaagagaacaggaagaagtggggtggtggtatcatgggctccaagtcacaggccaggaccaaggccaaggagagagttcttgccaaggaagcggcccagagattgaactaagaacttgctgtgatatttacactgcaattggattagagagctgctctgccaatttttgtgtttggttcacgtgcttgacaatgttagagacattagttcgatatgtacctttatgtttgccattagcagattattgcgctttaaactttatgagaagttattgttagatattttgtgagtgtctactacttattcttcgctaatctagtggttactgttgtctacgaaattctgctcttgtatgttggtttggttcatgattcatctctggcctttccatttatctgttacttcgatatggtgacttcgatgttacgaa

SEQ ID NO: 4473 - DNA, 1092 bp, Solanum tuberosum
ccttagggtttgttcatcagatcttgagaaaaatggctccaaagaagggtgttgcagtagcagcaaagaagaagccggagaaggcgaaagtggtgaatccactgttcgagaagcggccaaagcagttcggtatcggcggggcgctgccgccgaagaaggatgtaacaaggaatgtaagatggcctcggaatgttaccctccaaaggaagaagaggattctcaagatgcgattgaaggtccctcctgctcttaaccagttcaccaaaacccttgacaagaacctcgctacaaaccttttcaagatgcttcttaagtacaggcccgaggacaaagctgcaaagaaggagcgtcttgtcaaaagagctcaagctgaagcagaaggaaaaactcctgaaacaaagaaacctattattgtgaagtatgggcttaagcacatcacttaccttattgagcagaacaaagctcagttggtagtgattgctcatgatgtggacccaatagagttggttgtctggcttcctgcgctatgcagaaagatggaaattccttactgcattgtgaagggcaaagctcgtttaggatcgattgtgcatcagaaaactgcttcagccttgtgtttgacaaccgtgaagaatgaggacaaaatggagttcagcagaattttggaggccattaaggctaacttcaatgacaagtatgaagagaacaggaagaagtggggtggtggtatcatgggctccaagtcacaggccagaaccaaggccaaggagagagttcttgccaaggaagctgcccagagattgaactaggagcttgctgtgataatatacactgcaatttgattagtgagattctctgccaagttttgtatttggtaatggttcacatgcttcacaatgttaaagatattagtttgacacaagtacctttatgtttgccttgacaatgctttatcagatatttttgttagatattttgttgagttaattttttatggcaccgaattccgcagttattcagattattactacactgaaatataaaaacaataaatacacatattatacatataaagtaaaaacaacagcaaac

SEQ ID NO: 4474 - DNA, 1091 bp, Solanum phureja
atcatcagtttctgtataacagagtattcttctcccttagggtttgttcatcagatcttgagaaaaatggctccaaagaagggtgttgcagtagcagcaaagaagaagccggagaaggcgaaagtggtgaatccactgttcgagaagcggccaaagcagtttggtatcggtggggctctgccaccgaagaaggatgtaacaaggaacgtgagatggcctcggaatgttaccctccaaaggaagaagaggattctcaagatgcgattgaaggtccctcctgctcttaaccagttcaccaaaacccttgacaagaacctcgctacaaaccttttcaagatgcttcttaagtacaggcccgaggacaaagctgcaaagaaggagcgtcttgtcaaaagagctcaagctgaagcagaaggaaaaactcctgaaacaaagaaacctattattgtgaagtatgggcttaagcacatcacttaccttattgagcagaacaaagctcagttggtagtgattgctcatgatgtggacccaatagagttggttgtctggcttcctgcgctatgcagaaagatggaaattccttactgcattgtgaagggcaaagctcgtttaggatcgattgtgcatcagaaaactgcttcagccttgtgtttgacaaccgtgaagaatgaggacaaaatggagttcagcagaattttggaggccattaaggctaacttcaatgacaagtatgaagagaacaggaagaagtggggtggtggtatcatgggctccaagtcacaggccagaaccaaggccaaggagagagttcttgccaaggaagctgcccagagattgaactaggagcttgctgtgataatatacactgcaatttgattagtgagattctctgccaagttttgtatttggtaatggttcacatgcttcacaatgttaaagatattagtttgacacaagtacctttatgtttgccttgacaatgctttatcagatatttttgttagatattttgttgagttaattttttatggcaccgaattccgcagttattcagattattactacactaaactacaagttctatcttgaat

SEQ ID NO: 4475 - DNA, 1011 bp, Artemisia annua
atcgccgtttagaacttccaaatccaaatttcataccaatggctccaaagaaaggtgtgaagattgcaaccaagaagaagacggagaaggtggtgaacccgttgttcgagaagaggccgaagcagtttgggattggtggagctttgccaccaagaaggatgttcacagatttgtgagatggccacaagttgtgaggattcagaggaagaggaggatcctcaagcagcgtttgaaggtcccaccagcattgaaccagttcaccaagactcttgacaagaatcttgcaactacgttgttcaagatgcttcttaagtacaggccagaggacaaagcagccaagaaggaacgtcttatcaaaagggctcaggctgagtcggagggaaagacagttgaagctaagaagcctattgttgtgaagtatggtttgaaccatatcacttatcttattgaacagaacaaggcgcaactggtaatcattgcccacgatgttgatccaattgaattggtcgtctggcttccagcactttgcagaaagatggaaatcccatactgcattgtcaaagggaaatcccgattgggaactattgttcatcagaaaaccgcagctgctctttgtttgacaacagtcaagaacgaagacaaaatggaattcagccgagtcttggaggctattaaggctaacttcaatgacaagtacgaagagtacaggaagaagtggggtggtggtataatgggatcaaaatcacaggcgaaaacccgggctaaggagagagttctagctaaggaggctgcattagagagcatatttggtaatctgttgtctgcagttgaagttgtgattttcgattttgaaacttttgttaccttcttctagtatatttgtcttccgtttttgaactttgggagccagaatatttacttgctaagcttcttgtattggttttgttttcggactagtatgtctatcgtttttagtatgagcttcttcaatatgttgatctatcacgtatc

SEQ ID NO: 4476 - DNA, 1060 bp, Brassica rapa
gattgtcatctctttcgtcagcctcttagagtttcagttccttctctttttgccaaaacagctgctgcgaaaaaatctgaaaatggcaccaaagaaaggagttaaagcggttaccaagaagaagtcggagaaagtgacaaaccctctcttcgagaggcgtcccaagcagtttgggatcggaggagcactcccaccgaagaaggatctcaccagatacatcaaatggccaaagtctatccgcctccagaggcagaagcgtattctgaagcagaggttgaaggttccaccggcacttaaccagttcactaagacccttgacaagaacttagcgacttctctgttcaagatgatgctcaagtataggcctgaggacaaggcagccaagaaggagcgtcttcttaagaaggctcaggctgaggctgaaggaaagactgttgaatccaagaagccaattgttgtgaagtatggtcttaaccatgttacatacctcattgagcagaacaaggcgcaactggtggtgatagctcatgatgtggacccgattgagttggtcgtctggttgcctgcactgtgcaggaaaatggaagttccttactgcattgtcaaggggaaatcacgattgggagcgattgtccaccagaaaacagcagcttgtttgtgtttgaccacagtgaagaacgaggacaagatggagttcagcaaaatcctcgaggccattaaggcaaacttcaacgacaagtatgaagagtacaggaagaagtggggaggtggaattatgggatctaaatctcaggccaagaccaaggctaaggagagagttctagccaaggaagctgctcagaggatgaattagacctgccttcattttacttctttttggtggaatcttgttttaaaactcaaatgaaagtcttttcttctagctcatcatgggttctctctagatgctagcatttcttgcttgaataccttagatttcaacttgaggtttacataattactttttgataagaataaaaattgcgtagttgatggtaggtaagaaggaaaggaaaggaaa

SEQ ID NO: 4477 - DNA, 1032 bp, Brassica napus
agagtttcggttccttctctttttgccaaaacagctgctgcgaaaaaatctgaaaatggcaccaaagaaaggagttaaagcagttaccaagaagaagtcggagaaagtgacaaaccctctcttcgagaggcgtcccaagcagtttggaatcggaggagcactcccaccgaagaaggatctcaccagatacatcaaatggccgaagtccatccgcctccagagacagaagcgtattctgaagcagaggttgaaggttccaccggcacttaaccagttcactaagacccttgacaagaacttagcgacttctctgttcaagatgatgctcaagtataggcctgaggacaaggcagccaagaaggagcgtcttctcaagaaggctcaggctgagactgaaggaaagactgttgaatcgaagaagccaattgttgtgaagtatggtcttaaccatgtcacatacctcattgagcagagcaaggcgcaactggtggtgatagctcatgatgtggacccgattgagttggtcgtgtggttgcctgcattgtgcaggaaaatggaagttccttactgcattgtcaaggggaaatcacgattgggagcgattgtccaccagaaaacagcagcttgtttgtgtttgaccacagtgaagaacgaggacaagatggagttcagcaaaatcctcgaggccattaaggcaaacttcaacgacaagtatgaagagtacaggaagaagtggggaggtggaattatgggatctaaatctcaggccaagaccaaggctaaggagagagttctagccaaggaagctgctcagaggatgaattagacttgccttaactttacttctttttggtggaatctagtttcttaaacttaaatgaaagttttttgtctagctccttggatctctcttagcatttcctgcttgaatcccatataattcaacttgaagtaaactttaaaaaaaaaaaaaaacaaactgaatatagacaagtacacacgaggataggatacatacgtactacgtactac

SEQ ID NO: 4478 - DNA, 975 bp, Cleome spinosa
atttgcgtataaacactaaccctcatctctctcgccgctgccgtcaagcgaacttgcctcggaggaagacgaaatggcccccaagaaaggagttaaagtggctaccaagaagaagccggagaaagtgacaaacccattgtttgagaagcggcccaagcaattcggtattggtggtgccttgcctcccaagaaggatctttctcggtatatcaaatggccaaaagccatccgcctccagaggcagaaacgcatccttaagcagaggttgaaggtcccgcctgctgttaaccaattcactaagactcttgacaagaatctagcaaccagcgtcttcaagctcctcctcaagtataggccagaggacaaggcggccaagaaagagcgtcttctcaagaaggcccaagctgagactgagggaaagccttccgaggccaagaagcctattgttgtgaagtacggcctcaaccatgtgacctacctcattgagcagaacaaggcgcaacttgtggtgattgctcatgacgttgacccaattgagttggtcgtgtggttgcctgctctgtgcagaaagatggaagtcccttactgcattgtcaaggggaaatcgcgtcttggagcagttgttcacaagaagactgcttcttgcctgtgcctgaccactgtcaagaacgaggacaagatggagtttagcaaaatcctcgaggccatcaaggcaaacttcaacgacaagtacgatgagaatagaaagaagtggggaggtggcataatggggtccaaatctcaggcaaagaccaaagccaaggagagggttcttgcaaaggaggctgcccagaggatgagctaagtccctttgttatgtactcttcagtcactctgtttccccattttttgtcatttctttgttatagctctcggattttatttttatttttgaactctcgaatcaccatgttagttcaatctcagttctttcgg

SEQ ID NO: 4479 - DNA, 1061 bp, Humulus lupulus
actcaacccagccatctctcatccccgccgtcactctcctcgccggcaaggcagcgcgcagctcacagaaaaatgcctccaaagaaaaccggaaagtcctcggccctctcgaagaagaaacctgagaagattgtgaacccactgtttgagaagcgtcccaaacagtttggtattggaggagctttgccaccgaagagggatttgcacagatatgtcaaatggccaaaggctgttcagcttcagaggaagaagagaatccttaagcagcggttgaaggttccaccacagttgaatcagttcacgaagactttggacaaaaaccttgcaacaagtctgttcaagttgctcctcaagtacaggccagaggacaaagctgaaaagaaggaacgtcttgtgaaacgtgctcaggctgagactgaaggaaaaactgccgagaccaagaagcccattgttgtgaaatacgggctcaaccacgttacataccttattgagcagaacaaggcacaattggtagtgattgctcatgatgtggacccgattgaattggttgtttggcttcctgccttgtgcagaaagatggagatcccttactgcattgtgaaggggaaatcccgtttgggatcgattgtacaccagaagacagcagctgcattgtgtttgaccactgtgaagaacgaggataagatggaattcagcaaaatcctcgaggctattaaggccaactttaatgacaaatttgacgagttccgaaagaagtggggaggtggtatcatgggcagtaagtcacaagctaagacaaaagctaaggaaagagttttggccaaggaagccgcacagagaatgaattagagagcatttggtcttgttgtgacatttttcctcaactatattgttagcagtttttgatttctttgtgaaaaggaccatggagctgtttgaagtacttagtgcgggtagtcttttttcgtattcttcatttgaggaaggaacctttgcggtaattgcttttaatatcaagtatttacctaatgaattttggttaaatgatctgccgttttttt

SEQ ID NO: 4480 - DNA, 1199 bp, Mimulus guttatus
taccttctctctttctttctgtgtgtaacaactcgtttagcagccgtttctccattgtcacagcaaacgaagaagaaatggctccaaagaagggcgcaaagctgccgttgaagaaaaagagtgataaggttgtgaacccactgtttgagaaaagaccgaagcagtttggtatcggaggtgctcttcccccgaagaaagatcttcatcgattcgtgaaatggccccaagttgtcagaatccagaggaagaagatgatactcaagcagaggttgaaggttcccccacccattcaccagttctctaaaacccttgacaaaaacttggcaacgagcctgttcaagatgctgctgaaatacaggccagaggatagagctgaaaagaaggagcgtctattgaaaagagcacaggctgagtctgaaggcaaagctcccgagtacaagaagcctattgttgtcaaatatggtctcaaccacgtcacttatctcattgagcagaataaggctcagttggtggtgatagctcatgacgtcgatccaattgagctggttgtatggctccctgcactctgcaggaaaatggagatcccttactgtattgtcaagggcaaggctaggcttggaacaattgtccaccaaaagacagcatctgttttgtgcttgacctctgtgaagaatgaggacaagatggacttcagcaagattctagaagctatcaaggccaatttcaatgacaaatatgatgagacgaggaagaaatggggaggcggtgttatgggctcaaaatcccaggcaaagacaaaggcgaaagagagggttcttgccaaggaagctgctcagaggatgaattaaaactctttactgttagtcatagagaagcaaatgccagttttttttctttctttgtatgtcctcgattttattttgagattcagaatgaccttttctttttgctacactacatttattaccttctatctaaaaccgctgttttttttttttgtttgaagaagaaatatgttggttgaatttattgtgatgattgctggctagtcgaattcttttgattccttgttttcccatgttcgttcgtttatactttgatcttatattatgtttttagttacaccatgaaatggttcagagccaaattggaacaaataaaatttataaaatcagagaagtgtacttcctaatttagca

SEQ ID NO: 4481 - DNA, 1075 bp, Olea europaea
ttagggttttaacattgcctgcgcctatctagttccagatcactaatcggagaaaaatggctccaaagaagggaacgaagcttccggcgaagaagaaggtggagaaggtggtgaatccgctgttcgagaagcgaccgaaacagtttgggatcggcggagctctgccgccgaagaaggatcttcatcgcttcgtgaaatggccgcaggtggttcgaatccaaaggaaaaagatgatattgaagcagcgcctcaaggtgcctccgccaattcaccagttctccaaaactttggataagaaccttgcaacgagtctgtttaagatgcttctcaaatacaggcctgaggatagagctcaaaagaaagagcgccttttgaaaagagctcaggctgaggctgaaggcaaaactccagaggttaagaagcctattattgtgaagtatggtctcaaccatatcacctatctgattgagcagaataaagcacagctggtggttattgctcatgatgtggatcccattgagttggttgtgtggctcccagcattgtgcaggaagatggaaatcccttattgcattgtgaagggaaaggcaagattgggaactattgtccataagaagacagcatcagccttgtgcttgacctcagtaaagaatgaagataagttggagttcagcaagattttggaggctattaaggcaaacttcaatgataaatatgaagagactaggaagaagtggggaggtggagttatgggctcaaaatcccaagctaaggcgaaggcaaaagaaaggattcttgccaaggaggctgctcagaggatgtcttaggtcttcgtcctatgattttgttgttaacggatacttgtttttatttttatttgaggtttgtttcctacatctgactgctgtaggctacatgcagttcattatccaattacttgcgtacttattttcatggttcattaactatgttctaagatgatttagttatcctttcggttctatcagagttattttatcatctctaactggctcctgatggtgttaggccatagtcgaatatgcatttcatgtac

SEQ ID NO: 4482 - DNA, 1008 bp, Eutrema halophilum
cagtctttgccgtttttcctctctccgccgtctgcccccagagatcgacagacaacgatggcacccaaaaagggagtgaaagtggctaccaagaagaagccggagaaagttacgaatccattgtttgagagaaggcccaagcaattcggtatcggcggagctttgcctcctaagaaggatttgactcgctacattaaatggccaaaagcaatccgcctccagagacagaagcgtatccttaagcagaggttgaaggtgccaccagctctcaaccagttcaccaagactcttgacaagaatcttgcaacaagcctcttcaagatccttttgaagtataggccagaggacaaagccgcaaagaaagatcgccttttgaagaaggcccaagccgaggctgagggaaagacttctgaatccaagaagcccattgttgtcaagtatggactcaaccacgtgacctacctcattgagcagaacaaggcacaacttgtggtcattgcacacgatgttgacccgatcgagttggtggtctggttacctgcactctgtaggaaaatggaagtcccttactgcattgtaaagggaaaatctcgtcttggaacggtcgttaaccagaagactgctgcttgcttgtgcttgaccactgtcaagaacgaagacaagctcgagttcagcaaaatccttgaagccatcaaggcgaacttcaacgataagtacgacgagtacaggaagaaatggggaggaggcataatgggatccaagtctcaagccaagaccaaagctaaggaaagggttcttgctaaggaggctgcccagagaatgacctaagctgtctctttatttttgcttctcgttatcatggttttgtctagcaatttcttggaatattttaatttttatatgcttttaacgatgtttgcacactcgaggatttctatgcaagtttgttatccattttgctttcgaaatttatttactgctaatccctcgcaaattaaaaccatgttt

SEQ ID NO: 4483 - DNA, 1004 bp, Eutrema halophilum
ggccccaaagaaaggagtgaaggtagctgccaagaagaagacggaaaaagttacgaaccctctattcgagaggaggcctaagcaattcggtattggtggagctttgcctcccaagaaggatcttactcggtacatcaaatggccaaaggcaatccgtcttcaaagacaaaagaggatccttaagcagaggttgaaggttcctccagctcttaaccaattcaccaagactcttgacaagaatctcgcaactagcctcttcaagatccttctaaagtacaggccagaagacaaagctgccaagaaagagcgtcttgtaaagaaggctcaagctgaagccgagggaaagccttctgaatccaagaagcctattgttgtgaagtatggccttaaccatgtgacctacctcatcgagcagaacaaggcacagcttgttgtcattgctcatgatgtcgacccaatcgagctcgtcgtctggttgcctgctctctgcaggaagatggaagtcccttactgcattgtcaaagggaaatctcgtcttggagcggtcgttcaccaaaagactgccgcttgcttgtgtttgaccactgtcaagaacgaggacaagctagagttcagcaaaatccttgaggccatcaaggccaacttcaacgacaagtacgacgagtacagaaagaaatggggaggaggcataatgggatccaaatctcaagccaagacaaaggccaaggaaagggttcttgcaaaggaggctgcccagaggatgacttaagaaggatctctttgtgtgttttgctcaaaagccatatgctcggattcgtaaaacttcatagagagcttttttgtttagctgtttctttttagttgaaccccctcgtttatggatatttgcactttcttcagacggtttctatgttgtttaagctttttatccccttgctctctcaacttcttaaacttaacatttgataatgaaacttctgtatcatcgaggctaaattttgctt

SEQ ID NO: 4484 - DNA, 1142 bp, Arabidopsis thaliana
atcaatgtacatggtatatatataaaaggcaaaaccctagaaaacgatactcttcgactcagccgtcctttcgcagaaaccatttggagttggagctttggacgacgacaatggccccgaagaaaggagtgaaggtagctgctaagaagaagaccgcggagaaagtttcaaaccctctattcgagaggaggcctaagcaattcggtattggtggagctttacctcctaagaaggatctctctcgctacatcaaatggcccaaatccatccgtcttcaaaggcaaaagaggatcctgaagcagaggttgaaggtccctccagctcttaaccaattcaccaagactcttgacaagaatcttgctaccagcctcttcaaggtccttctgaagtacaggccagaagacaaagctgccaagaaggagcgtcttgtaaagaaggcccaagctgaagctgagggaaagccttctgagtctaagaagcccattgtagtcaaatacggcctcaaccatgtgacctacctcattgagcagaacaaggcccaacttgttgttattgctcatgatgtcgacccaattgagttggttgtctggttgcctgctctgtgcaggaagatggaagtcccgtactgcattgtcaagggcaaatctcgtcttggagcggttgttcaccagaagactgcttcttgcttgtgtttgaccactgtcaagaacgaggacaagctagagttcagcaaaatcctggaagctatcaaggccaacttcaatgacaagtacgaggagtacaggaagaaatggggaggaggcataatgggatctaagtctcaggcaaagaccaaggcaaaggaaagagttattgcaaaggaggctgcccaaaggatgaattaagaggctagcttcttttgtttgtggtttgctcggattcgtaaaacttaatagagctttttgtttagctggttcttgaagtacctcttttttagttgaaccctttattatggatgttttgcaatttcttgggacagtttcaatgttattcaagctgctggatcctctttggtctctcaaccacttaaaacttgacagtgtgaaattttagccaaatgcttattgcattctggaaagagttataagtttaattctcaaatt

SEQ ID NO: 4485 - DNA, 1001 bp, Brassica juncea
cttcagcctctagagtttcagtttcttctgtcttgcgaaagcagctgccgtgaaaaatctgaaaatggccccaaagaaaggagtcaaagcggttaccaagaagaagccggagaaagtaacaaacccactctttgagaggcgtccaaaacagtttgggatcgggggagcattgccaccgaaaaaagatctcacgagatacatcaaatggccaaagtccatccgtctccagaggcagaagcgtattctgaagcagaggttgaaggttccaccggcactcaaccagttcactaagacccttgacaagaacttagcgacttctctgttcaagatgatgctcaagtataggcccgaggacaaggcagccaagaaggagcgtcttctcaagaaggctcaggctgaggctgaaggaaaaactgttgagtcgaagaagccaattgttgtgaagtatggtcttaaccatgtgacatatctcattgagcagaacaaggcgcaactggtggtgattgctcatgatgtggacccgattgagttggtcgtatggctgcctgcactgtgcaggaagatggaagtaccttactgcattgtcaaggggaagtcacgattgggaacgattgttaaccagaaaaccgcagcttgcttgtgtttgaccacagtgaagaacgaggacaagatggaattcagcaaaatcctcgaggccattaaggcgaacttcaacgacaagtatgaagagtacaggaagaagtggggaggtggaattatgggatcaaaatctcaggccaagaccaaggctaaggagagagttctagccaaggaagctgctcagaggatgaattagacttgccttaactttacttccttttggtggaatcttgttttaaaacttaatgaaagtcttttgttctagctcatcatgggttctctctagatgctagcatttcctgcttgaataccttagatttcaacttgaggtttacataattactttttgataagaataaaat

SEQ ID NO: 4486 - DNA, 994 bp, Brassica napus
gagtttcagttcctactctcctgccagaacagctgctgcgaaaaaaaggagtgaaaatggcaccaaagaaaggagttaaagcggttaccaagaagaagtcggagaaagtgacaaaccctctctttgagaggcgtcccaagcagtttgggatcggaggagcattgccacccaaaaaggatctcaccagatacatcaaatggccaaagtctatacgcctccagaggcagaagcgtattcttaagcagaggttgaaggttccacccgcactgaaccagttcactaagacccttgacaagaacttagcgacttctctgttcaagatgatgctcaagtaccggcctgaggacaaggcagccaagaaggagcgtcttctcaagaaggctcaggctgagactgaaggaaagactgttgagtcgaagaagccaattgttgtgaagtatggtctaaaccatgttacatacctcattgagcagaacaaggcgcaactggtggtgattgctcatgatgtggacccaattgagttggtcgtctggttgcctgcactgtgcaggaaaatggaagttccttactgcattgtcaaggggaaatcacgattgggagcgattgtccaccagaaaacagcagcttgcttgtgtttgaccacagtgaagaacgaggacaagatggagttcagcaaaatcctcgaggccattaaggcaaacttcaacgacaagtatgaagagtacaggaagaagtggggaggtggaattatgggatctaaatctcaggccaagaccaaggctaaggagagagttctagccaaggaagctgctcagaggatgaattagacttgccttaattttacttctttttggtggaatcttgtttttaaaacttaaaatgaaagtcctttgtttaggctcctgggatctctctagatatagcatttcatgcttgtttaccttaagatttcaacttgatgtttgcagagttactttttgataagaataaaaat

SEQ ID NO: 4487 - DNA, 966 bp, Cleome gynandra
tcaagcgaacttgcctgcctcggaggaagacgaaatggccccgaagaagggagtgaaagtggctaccaagaagaagccggagaaagttacaaaccctttgtttgagaagcgggcaaagcaattcggtattggtggtgccttgcctcccaagaaggatctttctcgttatatcaaatggccaaaggctattcgcctccaaaggcagaagcgtatccttaagcagaggttgaaggtcccacccactgttaaccaattcactaagactcttgacaaaaatctggcaaccaacctcttcaagctcctccttaagtataggccagaggacaaggcggccaagaaagagcgtcttatcaagaaggctcaagctgaagctgagggaaagtcttctgaaactaagaagcctattgtcgtgaagtatggtctcaaccatgtgacttacctcattgagcagaacaaggcacaacttgtggtgattgctcatgacgttgacccgattgaattggtcgtttggctacctgctctatgcagaaagatggaagtcccgtactgcattgtaaagggaaaatcacgccttggagcgattgttcacaagaagaccgcatcttgtttgtgtctgaccactgtcaagaatgaagacaagatggaattcagcagagtccttgaagccattaaggcgaacttcaacgacaagtacgatgagtacaggaagaaatggggaggtgggataatgggatccaaatctcaggccaagactaaagccaaggagagagttcttgcaaaggaggctgcacagaggatgacctaagacaatgttctttgttcttcatgttttttcactctcatttcactcttccagctttcggattcttctttagaaaaaaaatgatatggatttttgtttgttgaattctctaaactccctgttagttcagttgctggatgtttctgttttggtcgttaatacga

SEQ ID NO: 4488 - DNA, 1000 bp, Solanum tuberosum
tctctgtatatcagtgtcttcttctccatctagggtttgttcatcagatcgtcgcagactcgagagaaaaaaatggctccaaagaagggtgttgcagtagcatcaaagaagaaaccggagaaggctaaggtggtgaatccactattcgagaagcggccaaagcagttcggtatcggtggagctctgccgccaaagaaggacgtaaccaggaatgtgagatggcctcggaatgttaccctacaaaggaagaagaggattctgaagatgcgattgaaggttcctccagctcttaaccagttcaccaaaacccttgacaagaacctcgctacaaaccttttcaagatgcttcttaagtacaggcctgaggacaaagctgcaaagaaggagcgtcttgtcaaaagggctcaagctgaagctgaaggaaaaactcccgaaacaaagaaacccattattgtgaagtatgggcttaagcacatcacttaccttattgagcagaacaaagctcagttagtagtgattgctcatgatgtggacccaatagagttggttgtctggcttcctgcactatgcagaaagatggaaattccatactgcattgtgaaggggaaagcacgtttaggatcgatcgtgcataagaaaactgcttcagccttgtgtttgacaaccgtgaagaatgaagacaaaatggagttcagcagagttttggaggcaattaaggctaacttcaacgacaagtacgaagagaacaggaagaagtggggcggtggtatcatgggctctaagtcacaggccaggaccaaggccaaagaaagagttctagccaaggaagctgcccagagattgaactaagagcttgctgtgatatatacactgcaatttaattagagagatgctctgccaagttttgtatttggttcacatgctttacattgttaaagatatcaagtacctttatgtttgccttgacaatgaattatcagacattttattaaaatttttg

SEQ ID NO: 4489 - DNA, 986 bp, Sarracenia psittacina
cccagaagcgaaccctagaaatggccccaaagaaaggtgtcaaaccagttgcagcagctaagaagaaaccggagaaggtagtgaacccactatttgagaagcggccgaagcagtttggcataggaggggcattgcctccaaagaaagatctacaccggtttgtgaagtggccaaaggttgttcaaattcagaggaagagaaggattctctgccagcgcttgaaggtcccaccagcattgaaccaatttacgaagaccctcgataagaacctcgcaacaaatctattcaagatgcttctcaagtacaggcctgaagataaagccgcaaaaaaagagcgtcttttgaaaacggctcaggctcaggctgaagggaaacctctcgagtctaaaaagcctattgttgtgaaatatggtctcaaccatgtcacctacctcattgagcagaataaagcacaattggttatcatcgcccacgatgtggacccaatagagctggttgtctggcttcccgcactgtgcaggaaaatggagatcccatactgcattgtgaaaggaaaagctcgattgggaacgatcgtccataagaaaacttcagcagttttgtgcttaaccactgtcaagaatgaagacaagttggaattcagcaaaatcttggaggctatcaaggccaacttcaatgacaagtatgatgagtacaggaagaagtggggtggtggtatcatgggttccaaatctcaagccaaaaccaggcaaaagagaggcttcttgcaaaggaagttgctcagaggatgagctaagagaccgccatatataatcttgtttgttaagataggaggttggttatttcaggaacgtatttgctgttgaattttttttttttctgaaaaagtatcgagaaaaatatccagaatttaacatgggtggttgagattcacttgaagtaggtcccacatcatattaaacatgaatttgcaccctacatatcac

SEQ ID NO: 4490 - DNA, 1056 bp, Solanum phureja
tctctgtatatcagtgtcttcttctccatctagggtttgttcatcagatcgtcgcagactcgagagaaaaaaatggctccaaagaagggtgttgcagtagcatcaaagaagaagccggagaaggctaaggtggtgaatccactattcgagaagcggccaaagcagttcggtatcggtggagctctgccgccaaagaaggacgtaaccaggaatgtgagatggcctcggaatgttaccctacaaaggaagaagaggattctgaagatgcgattgaaggttcctccagctcttaaccagttcaccaaaacccttgacaagaacctcgctacaaaccttttcaagatgcttctcaagtacaggcctgaggacaaagctgcaaagaaggagcgtcttgtcaaaagggctcaagctgaagctgaaggaaaaactcccgaaacaaagaaacccattattgtgaagtatgggcttaagcacatcacttaccttattgagcagaacaaagctcagttagtagtgattgctcatgatgtggacccaatagagttggttgtctggcttcctgcactatgcagaaagatggaaattccatactgcattgtgaaggggaaagcacgtttaggatcgatcgtgcataagaaaactgcttcagccttgtgtttgacaaccgtgaagaatgaagacaaaatggagttcagcagagttttggaggcaattaaggctaacttcaacgacaagtacgaagagaacaggaagaagtggggcggtggtatcatgggctctaagtcacaggccaggaccaaggccaaagaaagagttctagccaaggaagctgcccagagattgaactaagagcttgctgtgatatatacactgcaatttaattagagagatgctctgccaagttttgtatttggttcacatgctttacattgttaaagatatcaagtacctttatgtttgccttgacaatgaattatcagacattttattaaaaattttgttagtatgtgtttttatggctccgaaatggcgtttttatttaaattcctacacttc

SEQ ID NO: 4491 - DNA, 1311 bp, Fragaria vesca
aggtttgaacagtttcaatcgagaattgaagctttaaaccttacaaacgaaggcccagctcgtaagaaacgaaggcccagccagccgtgttcgttgatatatatacccgacggaggttttcatgtagggtttccagagcaaaactgaagtagccggtgcaaatgggtcccaaaaagggtgtaaaagctcccgttgccgcctcgaagaagaagccggagaaggtggtgaacccactgttcgagaagcggccgaagcaattcgggatcggaggggcgttgcctcccaagagggatctgacccgattcgttaaatggcccaaggctgttcagattcagaggaagaagagaatccttcagcagaggcttaaggttcctcctgctttgaaccagttcaccaagaccctcgacaagaacatcgctacaagcctgttcaagatgcttttgaagtatcggcctgaggacaaggcagagaagaaggagcgtctcttgacaagggcacaacaagaaactcaaggaataactgttgaaaacaagaagccaattgttgtgaaatatggtctcaaccatgtcacctacctcattgagcagaataaggctcaacttgtagttattgctcatgatgttgatccaatagagttggttgtctggctccctgccctgtgcaggaagatgcaaatcccctactgcattgtgaagggcaaagcacgcttgggagcaattgtccataaaaaaactgcttcggtattgtgcctgacaacgatcaagaatcaagataggatggatttcagcaaggtcttagaagcaataaatgccaactttaatgacaagtatgaggaatacaggaaaaagtggggtggtggcatcatgggttccaaatcccaggccaaaacgaaggccaaggaaaggctcctcgcgagagaggctgctcaaaggatgacctgatttttgttcttgtattttgtttcacttagattatggtactagagttttgtgattgctacaagtttattcatatcaacaacggagattttgtttcccttgaatgcagtcatttttatttgaaaggtgagttattaaaaagtgtgctgggcctctgctgaatgtgtttagactgatggaatatggtctggtcatgttggtactgagaattctgtatagctaaatattctccccaattcggttgcattaaattattatggtccaatttaggggcgtttcaaatagagctaatttagtttacctaccctctacgggcaatgcttttaacttggtgtaaatttaagcaacacgaagatgatgttatttatgagcg

SEQ ID NO: 4492 - DNA, 1046 bp, Eutrema halophilum
agggtttcagcttcttcttctctctttggaaaacagtagctgtggaaaagccgaaaatggccccaaagagaggagtcaaagttgctaccaagaagaagccggagaaagtaacaaaccctctctttgagagacgtccaaagcagtttgggatcggaggagcattgccaccaaagaaggatctcacgagatacatcaaatggccaaagtcgatccgcctgcagaggcagaagcgtatcctgaagcagaggttgaaggtcccaccagcacttaaccagttcactaagacccttgacaaaaacttagcaacgtctctgttcaagattctgctcaagtataggcctgaggacaaggcagccaagaaggagcgtcttctcaagaaggctcagtctgaggctgaaggcaaacctgctgaatcgaagaagccaattgttgtgaagtatggtcttaaccatgtgacttaccttattgaacagaacaaggcccaattggtggtgattgctcatgacgtggacccgattgagttggtcgtatggttgcccgcactgtgcaggaaaatggaagttccttactgcattgtcaaggggaaatcacgattgggagcggttgtccaccagaaaacagcgtcttgcttgtgtttgaccacagtgaagaacgaggacaagatggaattcagcaaagtcctcgaggccattaaggcaaacttcaatgacaagtttgatgagtaccggaagaagtggggaggtggtattatgggatccaaatctcaggccaagactaaggctaaggagagagttcttgccaaggaggctgctcagagaatgaattaggccattccaaatttcatttttggaagctaaatttaaaattttgaaactcatgtatttgttttaagcagtagggatctccctatatatcatatcatattgtagcttttttttgcgggaatcgatttcgacttttatggtttaacactacttgatgagaaggttgaaaaagcatatctgatgttaaaaaaaaaacacacagaaaagaaaggcataatttcg

SEQ ID NO: 4493 - DNA, 1094 bp, Triphysaria pusilla
gtgtcgcatttgcacactgtaattcgttagggttccacagctgtcttacagaacccccattaattcccaccgaagaagaaatggctccgaagaagggaacaaagccggtagcgaagaagaatgtggagaaagtagtgaattcgctattcgagaagaggccaaagcaatttggtatcggaggagctctgccgccgaagaaggatctgcatcggtttgtaaaatggccgcaagttgtcaggattcagaggaagaagatgatacttaagcagaggttgaaggtcccaccgccaattcatcagttctctaaaacactggacaaaaacttggcaacaagcctcttcaagatgctcctcaagtacaggcctgaagacaaagctcaaaagaaagagcgtcttctgaaaagggcccaggctgagacagaaggtaaaacacccgaagtgaaaaagcctattgtggtcaaatatggtctcaaccatgtgacataccttatagagcagaacaaagctcaattggtagtcattgctcatgatgttgatccgattgagttggttgtatggctccctgccctttgcaggaaagtggagatcccttactgtattgttaagggcaaggctagattgggcactattgtccataagaagactgcctcagttttgtgcttgacatctgtgaagaacgaggacaagttggacttcagcaagatcctggaggctatcaaggccaactttaatgataaatatgatgagactaggaagaaatggggaggtggagttatgggatcgaaatctcagtctaagacaaaggcgaaagagagggttcttgccaaggaaactgcgcagagaatgaactaaaattgttacagttttctcttagtgatagaagcaagcgagcatttttctttgtgcactctgattgtttgttgctagataaacgatttgacatgttttttgtttacattgattgtctgccgcttttaaaatatgatttcccctgctttgttttaatattatgtacttttttgaaggatgacaaactactgctggtgttttcaaattttgttttgtcgattctaatgcaaaaaaaaaaaaaaaaaa

SEQ ID NO: 4494 - DNA, 892 bp, Fraxinus spp
cggccgggggtacgtgtgggcgtgtgcgcgcgaggcagagcagaacataggttagggtttaacattgcctccgcctctctagtttgtagttccaggtcaccaaccggagaaaaatggctccaaagaagggcgcgaagcttccggcgaagaagaaggtggagaaggtagtgaatccgctgttcgagaagcgaccgaaacagtttggaattggcggagctctgccgccgaagaaggatcttcaccgcttcgtgaaatggccgcaggtggttcgaatacaaaggaaaaagatgatattgaagcagcgcctcaaggtgcctccgccaattcaccagttctccaaaactctggataagaaccttgcaacaagtctgtttaagatgcttctgaaatacaggcctgaggatagagctcaaaagaaagagcgccttttgaaaagagctcaggctgaggccgaaggcaaaactccagagattaagaagcctattattgtgaagtatggtctcaaccatatcacctatcttattgagcagaataaagcacagctagtggtgattgcacatgatgtggatcctgttgagttggttgtgtggctcccagcattgtgcaggaagatggaaatcccttattgcattgtgaagggaaaggcaagattgggaactattgtccataagaagactgcatcggccttgtgcttgacctctgtaaagaatgaagacaagttggagttcagcaagattttggaggctattaaggcaaacttcaatgataaatatgaagagactaggaagaagtggggaggtggagttatgggctcaaaatcccaagctaaggcgaaggcaaaagaaggattcttgccaaggaggctgctcagaggatgtcttaggtcttcatc

SEQ ID NO: 4495 - DNA, 1052 bp, Brassica juncea
tctttgccgctcttccgccgtcttaactccagaaattgacagcaatggcacccaaaaggggagtgaaagtagctgcgaagaagaagacggagaaggtgacgaatccgttgttcgagagaaggccaaagcaattcggtatcggtggtgctttgcctcctaagaaggacttgactcgttacatcaaatggcctaagtccatccgtctccaaaggcagaagcgtatccttaagcagaggctcaaggtccctcctgctttgaaccagttcaccaagactcttgacaagaaccttgcaacccagctattcaaggttcttatgaagtatagaccagaggacaaggccgcaaagaaggatcggcttttgaaaaaggcccaagccgaggctgagggaaagccttctgaatccaagaagcccattgtcgtcaagtatgggctcaaccacgtcacttacctcatcgagcagaacaaggcgcagcttgtggtcattgcacacgatgttgaccccatcgagttggtcgtctggttacctgctctttgcagaaagatggaggtgccttactgcattgtcaaaggcaaatctcgtcttggaacggtcgttcaccagaagactgctgcttgtttgtgtttgaccactgtcaagaacgaggacaagctcgagttcagcaaaatccttgaagccatcaaggcaaacttcaacgacaagtacgaggagtacaggaagaagtggggaggagggataatgggatccaagtctcaagccaagaccaaagctaaggaaagggttcttgccaaggaggctgcccagagaatgaactaagctgagcttctcgtttgagaaaacataatgatggttatggttttgtttagcgatttcatggaatattttgaaacgttttgctcttattatcgatgttgcacacttaaggatattattcagtttctgttaagacattttacttttgagattatttacttatttgctgatacttgtttgcaaattaaaacaatgaattaatactatgtttagagttataaaagtattaagtttgtgata

SEQ ID NO: 4496 - DNA, 833 bp, Brassica oleracea
  misc_feature (785)..(785): n is a, c, g, or t
ggaatgccagtcagtctttaccgctctctccgccgtctgcttccagaaatcgacaacacccaatggcaccaaaaaggggagtgaaagtggttgccaagaagaagacggagaaggttactaatccgttgtttgagagaaggccaaagcagtttggtatcggtggtgctttgcctcctaagaaggacttgactcgttacatcaaatggcctaagtccatccgtcttcaaagacagaagcgtatccttaagcagaggctcaaggtccctccggctttgaaccagttcaccaagactcttgacaagaaccttgcaacccagcttttcaaggttcttatgaagtacaggccagaggacaaagctgcaaagaaggatcgtcttttgaaaaaggctcaagccgaggctgagggaaagccttctgaatccaagaagcccattgtcgtcaagtatggactcaaccacgtgacttacctcatcgagcagaacaaggcacagcttgttgtcattgctcacgatgttgaccctatcgagctggtcgtctggttacctgcactttgcagaaagatggaagtgccttactgcattgttaaaggcaaatctcgtcttggaacagtcgttcatcagaagactgctgcttgtttgtgcttaaccactgtcaagaacgaggacaagctcgagttcagcaaaatccttgaagccatcaaggcaaactttaacgacaagtacgaggagtacaggaagaagtggggaggagggataatgggatccaagtctcaagccaagaccaangctaaggagagggttcttgccaaggaggctgcccagagaatgaactaa

SEQ ID NO: 4497 - DNA, 1068 bp, Brassica rapa
aaaggcaaaaccctaagaaacatttccttttgactcagccgtccgtttgagagaccacatcatttggagtgcagcacaggagagcgacgatggccccaaagagaggagtgaaggtagctgccaagaagaagactgagaaagtaaccaaccctctatttgagaggaggccgaagcaatttggtattggtggtgctttgcctcccaagaaggacttgactcgctacatcaaatggccaaagtctatccgtctccagaggcagaagcgcatcctcaagcagaggctcaaggtccctccggcattgaaccagttcaccaagacccttgacaagaaccttgcaacccagcttttcaaggttctgatgaagtacaggccagaggacaaggccgcaaagaaggatcgtcttctgaaaaaggctcaagccgaggctgagggaaagccttctgaatccaagaagcccattgtcgtcaagtatgggctcaaccacgtcacttacctcatcgagcagaacaaggcgcagcttgttgtcattgctcacgatgttgaccccatcgagctggtcgtctggctgcctgctctttgcagaaagatggaagtgccttactgcattgttaaaggcaaatctcgtcttggaacggtcgttcaccagaagactgctgcttgcttgtgtttgaccacggtcaagaacgaggacaagctagagttcagcaagatccttgaggccatcaaggcaaacttcaacgacaagtacgaggagtacaggaagaaatggggtggaggcatcatgggatccaaatctcaggcgaagacaaaggccaaggaaagggttcttgcaaaggaggctgcccagaggatgaactaagaagggatctattcttcttattgcgaagtttttttgtttagctgttggaactctttgttttcttttatggatgttttgcaatttcttcggaccgttcccatcttcttgaagcttaattatctttatggtgtgtctgccaattttaaacttgtttggtggttattttgacatcaaatcccttttgattaaaaaaaaaaactcaaatagc

SEQ ID NO: 4498 - DNA, 1038 bp, Brassica rapa
taaaaccctaattgtcagtcagtctccgccgctctctcctccgtctgcttccagaaatcgacaacacccaatggcaccgaaaaggggagtgaaagtggttgccaagaagaagacggagaaggttactaatccgttgtttgagagaaggccaaaacaattcggtatcggtggagctttgcctcctaagaaggacttgactcgttacatcaaatggcctaagtcaatccgtcttcaaaggcagaagcgtatccttaagcagaggctcaaggtccctccggctttgaaccagttcaccaagactcttgacaagaaccttgcaacccagcttttcaaggttcttatgaagtataggccagaggacaaagctgcaaagaaggatcgtcttttgaagaaagctcaagccgaggctgagggaaagccttctgaatccaagaagcccattgtcgtcaagtatgggctcaaccacgtgacttacctcatcgagcagaacaaggcgcagcttgttgtcattgctcacgatgttgaccctatcgagctggtcgtctggttacctgcactttgcagaaagatggaagttccttactgcattgtcaaaggcaaatctcgtcttggaacggtcgttcatcagaagactgctgcttgcttgtgtttgaccactgtcaagaacgaggacaagcttgagttcagcaaaatccttgaagccatcaaggcaaacttcaacgacaagtacgaggagtacaggaagaagtggggaggagggataatgggatccaagtctcaagccaagaccaaagctaaggagagggttcttgccaaggaggctgcccagagaatgaactaatcagagtttctctcggtcaagaaacacaatgatgatgatgatggttttgcttagccgtttcattgaatgttttaaaattctattctctcttattatctatgtttttgcacacttgaggataatatgcagttttgttatacattttgcttttgagtttacctatttatcgaaaattatttgcaaattaaaaccatttt

SEQ ID NO: 4499 - DNA, 977 bp, Brassica napus
agtctttaccgctctctccgccgtctgcttccagaaatcgacaacacccaatggcaccaaaaaggggagtgaaagtggttgccaagaagaagacggagaaggttactaatccgttgtttgagagaaggccaaagcagtttggtatcggtggtgctttgcctcctaagaaggacttgactcgttacatcaaatggcctaagtccatccgtcttcaaagacagaagcgtatccttaagcagaggctcaaggtccctccggctttgaaccagttcaccaagactcttgacaagaaccttgcaacccagcttttcaaggttcttatgaagtacaggccagaggacaaagctgcaaagaaggatcgtcttttgaaaaaggctcaagccgaggctgagggaaagccttctgaatccaagaagcccattgtcgtcaagtatggactcaaccacgtgacttacctcatcgagcagaacaaggcacagcttgttgtcattgctcacgatgttgaccctatcgagctggtcgtctggttacctgcactttgcagaaagatggaagtgccttactgcattgttaaaggcaaatctcgtcttggaacagtcgttcatcagaagactgctgcttgtttgtgcttaaccactgtcaagaacgaggacaagctcgagttcagcaaaatccttgaagccatcaaggcaaactttaacgacaagtacgaggagtacaggaagaagtggggaggagggataatgggatctaagtctcaagccaagaccaaagctaaggagagggttcttgccaaggaggctgcccagagaatgaactaatcagagagcgtctgtcttcacaatgatgatgatggttttgtttagcgatttcatggaatgttttaaaactctattctctcttactatctatgtttttgcacacttgaggataatatgcagttttgttatacattttgctttcgagtttacctattt

SEQ ID NO: 4500 - DNA, 954 bp, Raphanus sativus
aaatctgaaaatggccccaaagaaaggagttaaagcggttaccaagaaaaaatcggagaaagtgacaaaccctctctttgagaggcgtcccaagcagtttgggatcggaggagcattgccaccgaaaaaggatctcaccagatacatcaaatggccaaagtctattcgtctccagaggcagaagcgtattctgaagcagaggttgaaggttccaccggcactcaaccagttcactaagacccttgacaagaacttagcgacttctctgttcaagattctgctcaagtacaggcctgaggacaaggcagccaagaaggagcgtcttctcaagaaggctcaggctgaggctgaaggaaagactgttgaatcgaagaagccaattgtcgtgaagtatggtctcaaccatgtgacctacctcattgagcagaacaaggcgcaattggtggtgatagctcatgatgtggacccgattgagttggtcgtctggttgcctgcactatgcaggaaaatggaagttccttactgcattgtcaaggggaaatcacgattaggaacgattgttaaccagaaaacagcagcttgcttgtgtttgacgacagtgaagaacgaggacaatatggagtttagcaaaatccttgaggccattaaggcgaacttcaacgacaagtatgaagagtacaggaagaagtggggaggtggaattatgggatcgaaatctcaggccaagactaaggctaaggagagagttctagccaaggaagctgctcagaggatgaattagacttgtcctgatttcaccttcttttttttttgaggattctagtttttaaacttgaatgaaaatcttttgttttagctcctgtgatctctctagatgtaccatttcttacctgaatactttatatttcaccttgagatttacggagttattttttgataagaataaagtttgcg

SEQ ID NO: 4501 - DNA, 944 bp, Solanum phureja
ggctccaaagaggggtgttgcagtagcagcaaagaagacgtcgaaagtggtgaatccactgttcgagaagcggccaaagcagtttggtatcggtggggctctgccaccgaagaaggatgtaacaaggaacgtgagatggcctcggaatgttaccctccaaaggaagaagaggattctcaagatgcgattgaaggtccctcctgctctctaccagttcaccaaaaccctagataagaacctcgccaccaaccttttcaagatgcttcttaagtataggcctgaggacaaagctgcaaagaaggagcgtcttgttaaaagggctcaagctgaagctgaaggaaaaactcctgaaacaaagaagcccattattgtgaagtatggccttaagcatatcacttaccttattgagcagaacaaagctcaactagtagtgattgctcatgatgtggacccaatagagttggttgtctggcttcctgcactatgcagaaagatggaaattccttactgcattgtgaaggggaaagcacgtttaggatcgatcgtgcataagaaaactgcttcagccttgtgtttgacaaccgtgaagaatgaagacaaaatggagttcagcagagttttggaggcaattaaggccaacttcaatgataagtatgaagagaacaggaagaagtggggtggtggtatcatgggctccaagtcacaggccaggaccaaggccaaagagagaattcttgccaaggaagctgcccagaggttgaactaagagcttgctgtgatatataactgctattggattcgagagagcaactccaatttttgtgtttggttcacatgcttggcaatgttagagatattagttcgataagtacctttatgtttgccttttgcagattattgctttgtcgaagcttaaaattataactttatcagaagttcttgtt

SEQ ID NO: 4502 - DNA, 1023 bp, Solanum lycopersicum
attgacatccgtctctgtatatcagtgtgttcttctccatttagggtttgttcatcagatcgtggtagcagactcaacaggaaaaaatggctccaaagaagggtgttgcagtagcagcaaagaagaagccggagaagtctaaggtggtgaatccactattcgagaagcggccaaagcagttcggtatcggtggagctctgccgccaaagaaggatgtaacaaggaacgtaagatggcctcggaatgttacccttcaaaggaagaagaggattctcaagatgcgattgaaggttcctccagcacttaatcagttcaccaaaactcttgataagaatctcgctacaacccttttcaagatgcttcttaagtacagacctgaggacaaagctgcaaagaaggagcgtcttgtcaaaagggctcaagctgaggctgaaggaaaaactccggaaacaaagaaacccattattgtgaagtatgggcttaagcacatcacttatcttattgagcagaacaaagctcagttagtagtgattgctcatgatgtggacccaatagagttggttgtctggcttcctgcactatgcagaaagatggaaatcccttactgcattgtgaaggggaaagcacgtttaggatcgatcgtgcataagaaaactgcttcagccttgtgtttgacaaccgtgaagaatgaagacaaaatggagttcagcagagttttggaggcaattaaggctaacttcaacgacaagtatgaagagaacaggaagaagtggggtggtggtatcatgggctctaagtcacaggccagaaccaaggccaaagagagagtccttgccaaggaagctgcccagagattgaactaagagcttgctgtgatatatacactgcaatttaattagagagatgctctgccaagttttgtatttggttcacatgctttacattgttaaagatatcaagtacctttatgtttgccttgacaatgaattattaaaatttttgtttagtatgtgtttttatgcc

SEQ ID NO: 4503 - DNA, 872 bp, Brassica oleracea
  misc_feature (399)..(399): n is a, c, g, or t
gcctactctcctgccagaacagctgctgcgaaaaaaaaaagtgaaaatggcaccaaagaaaggagttaaagcggttaccaagaagaagtcggagaaagtgacaaaccctctctttgagaggcgtcccaagcagtttgggatcggaggagcattgccacccaaaaaggatctcaccagatacatcaaatggccaaagtctatccgcctccagaggcagaagcgtattcttaagcagaggttgaaggttccaccggcactcaaccagttcactaagacccttgacaagaacttagcgacttctctgttcaagatgatgctcaagtaccggcctgaggacaaggcagccaagaaggagcgtcttctcaagaaggctcaggctgaggctgaaggaaagactgntgaatcgaagaagccaatcgttgtgaagtatggtctaaaccatgttacatacctcattgagcagaacaaggcgcaactggtggtgattgctcatgatgtggacccgattgagttggtcgtctggttgcctgcactgtgcaggaaaatagaagttccttactgcattgtcaaggggaaatcacgattgggagcgattgtccaccagaaaacagcagcttgcttgtgtttgaccacagtgaagaacgaggacaagatggagttcagcaaaatcctcgaggccattaaggcaaacttcaacgacaagtatgaagagtacaggaaggaagtggggaggtggaattatgggatctaaatctcaggccaagaccaaggctaaggagagagttctagccaaggaagctgctcaaaggatgaataaacttgccttaattttacttcttttttggtggaacctggttttttaaacttaaatg

SEQ ID NO: 4504 - DNA, 1124 bp, Fraxinus spp
tccaaagaagggcgcaaaattgccgacaggagtggctaaaaggaaagcggaaaaggtagtgaatcctctattcgagaagcgaccaaagcaatttggtattggtggagcgttgccgccgaagaaggatctccaccgatttgtgaaatggcctcaagtggtgaggattcagcgcaagaagatgattttgaagcaacgccttaaggtcccgccgccaattcatcagttctcaaaaaccctcgacaagaacttggcaacgagcttgttcaagatgcttctcaaataccggcctgaggatagagctcaaaagaaagagaggcttcttaaaagagctcaggctgaggctgaaggaaaaacacctgaggttaagaagccaatcattgtgaaatatggtctcaaccatgtcacatatctaattgagcagaacaaagctcaacttgttgtcattgcccatgacgttgagccaattgagttggtcgtatggcttcctgcattgtgcaggaaaatggaaatcccttactgtatcgtgaagggaaaggcacggttgggaactatagtccataagaagacggcatctgtactgtgcttaacctcagttaagaatgaagacaagatggacttcagcaggatcttggaagctattaaggccaacttcaacgacaaatacgatgagaccaggaagaagtgggggtggtggagttatgggctcaaaatcccaggccaagtcaaaggccaaagagagactcatggccaaggaggctgcacagaggatgacttaggctcttagtcctgccttttctatcaaggatagaaccaaatgagtgaatcttttaccttcccttttatgcttcaagtcatactagacatttttgtttccgcttaatatttgatggacgacaaggcattcttcattatctcaagtatatgccagtctttggttttgtcgggtgtttatatacttctagtttttggtagaatgcaatgcgacatctttaaggtgttgtgttctttctctagaaattcttaaaatctgagcctcgatgtggaattctgggtatcgagcgtttgtcaccaaagccaatgaacttcacagctatgagatatcaagtaaaatagttatgaacttc

SEQ ID NO: 4505 - DNA, 953 bp, Fraxinus spp
cgcaaagcttccggcaaagaagaaggcagagaaggtggtgaatccgctgttcgagaagcgaccgaagcagtttggaattggcggagctctaccgccgaagaaggatcttcaccgcttcgttaaatggccgcaggttgttcgaatccaaaggagaagatgatattgaagcagcgcctcaaggtgcctccaccaatccaccagttctccaaaaccttggataagaaccttgcaacgagtctgttcaagatgcttctcaaatacaggcctgaggatagagctgaaaagaaagaacgccttctgaaaaagagctcaggctgaggcagaaggcaaaactcccgaggttaagaagcctataattgtgaagtatggtctcaaccatatcacctatctgattgagcagaacaaagcacaactggtggtgatcgctcatgatgtggaccccattgagttggttgtgtggcttccagcattgtgcaggaagatggaaatcccttattgcattgtaaagggaagggcaagattgggaactattgtccataagaagacagcatcggccttgtgcttgacctcagtaaagaatgaagacaagttggagttcagcaagattttggaggctattaaggcgaacttcaatgataaatatgacgagactaggaagaagtggggaggtggagttatgggctcaaaatcccaagctaaggcgaaggcgaaagaaaagattcttgccaaggaggctgctcagaggatgtcttagggctttgtcctataattttgttgctgcgaatacttacatttgagagatgagatttgtttttctacatctaactgctgcaggctacatgcatcgcatttcattatccaaatttcctcttcttaactaatactcgtctacttacttctcgtagtagtatttatttactcttagtgtactcgtcgtccttcgagtagttggt

SEQ ID NO: 4506 - DNA, 836 bp, Malus domestica
atggtgaggatttgctccctctccgtcatcctccgcctcccattccatctcggtcgcgcccccaaaagaggcgtaaaagctccagttgcagcttccaagaagaagacggacaaggttgtgaacccgctgtttgagaagcgcccgaagcagttcggtatcggtggggcattgccaccgaagagggatctgacccggttcgtgaaatggcccaaggtggttcagattcagaggaagaagaggatcctcaagcagaggttgaaggttcctccagctttgaaccagttcaccaagaccctcgataagaacctcgccaccagcctgttcaagatgcttctcaagtacaggcctgaggacaaagctgcaaagaaggagcgccttttgaaaagggcccaggccgagaccgaaggcaaatctgttgaggccaagaagcctattgttgtgaagtatggtctcaaccatgtgacctacctcatagagcagaacaaggcccagcttgttgttatcgcacacgatgttgacccaatagagttggttgtctggcttcctgctttatgcaggaagatggaagtcccatattgcattgtgaagggcaaagcacgcttgggatctattgtccacaagaaaactgcgtcagttttgtgcttgacaacagtcaagaatgaggataagttggagttcagcaaggtcttggaggcaatcaaggccaacttcaatgacaagtatgaggagtacaggaaaaagtggggtggcggcatcatgggttccaaatcccaggcaaaaactagggcgaaggagaagctccttgcgaaagaagctgcgcaaaggcttaattaaat

SEQ ID NO: 4507 - DNA, 1139 bp, Brassica juncea
agcaatggcaccaaagaagggagtgaaagtagttgccaagaagaagacggagaaggtgacgaacccgttgttcgagagaaggccaaagcagttcggaatcggtggtgctttgcctcctaagaaggacttgactcgttacatcaaatggcctaagtccatccgtctccaaaggcagaagcgtatccttaagcagaggctcaaggtccctcctgctttgaaccagttcaccgagactcttgacaagaaccttgcaacccagcttttcaaggttcttatgaagtacaggccagaggacaaggccgcaaagaaggatcgtcttctgaaaaaggcccaagccgaggctgagggaaagccttctgaatccaagaagcccattgtcgtcaagtatggtctcaaccacgtgacttacctcatcgagcagaacaaggcacagcttgtcgtcattgctcacgatgttgaccccatcgagcttgtcgtctggttacctgcgctttgcaggaaaatggaggtgccttactgcattgtcaaaggcaaatctcgtcttggaacggtggttcaccagaagactgctgcttgcttgtgtttgaccactgtcaagaacgaggacaagctagagttcagcaagatccttgaggccatcaaggcaaacttcaacgacaagtacgaggagtacaggaagaagtggggaggaggtataatgggatccaagtctcaagccaagaccaaagctaaggagagggttctcgccaaggaggctgcccagagaatgaactaagctgaaacttcattactgatgatggtggttttgtttagctatttcatggaatactctaagcctttatgctcttactatctcgatgttgcacacttgaggatattatgcagttttgctatacattttgctttctatttatttacctagttatcttgttttttgcaacctaaaacaatgaacttagccttatgaataagtggggtaatgttaactgtaactttagtctcagaaatggattcatgatgctttccatgtaagtggatcctgttattcaaaagcaagtgttatcaatttccagagagatgaaaggcttttcataatttaggatgtaatgattgtttgattgatatcttttggtaccaat

SEQ ID NO: 4508 - DNA, 947 bp, Brassica juncea
tctttgccgctcttccgccgtctaactccagaaattgacaagagaccatggcacccaaaaagggagtgaaagtagctgccaagaagaagacggataaggttacgaatccactgtttgagagaaggccaaagcaatttggcatcggtggtgccttgcctcctaagaaagacttgactcgttacatcaaatggcccaagtccatccgtcttcaaaggcagaagcgcatcctcaagcagaggctcaaggtccctccggctcttaaccagttcaccaagactctcgacaagaaccttgctacccagcttttcaaggttctgatgaagtacaggccagaggacaaggccgctaagaaggatcgtcttttgaaaaaggcccaagccgaggctgagggaaagccttctgaatccaagaagcccattgttgttaagtatgggctcaaccacgtgacttacctcatcgagcagaacaaggcgcagcttgttgtcattgcacacgatgttgaccccatcgagctggttgtctggttgcctgctctttgcagaaagatggaagtgccttactgcattgtcaaaggcaaatctcgtcttggaacggttgttcaccagaagactgctgcttgcttgtgtttgaccactgtcaagaacgaggacaagctcgagttcagcaaaatcctcgaagccatcaaggcaaacttcaacgacaagtacgaggagtacaggaagaagtggggaggaggcatcatgggatccaagtctcaagccaagaccaaagctaaggagagggttcttgccaaggaggctgcccagagaatgaactaagcggagcacctcgtttgagttatgtttttgtttagcgatttcttgggatactttaaaactttatgctcttactatcgatgttgcacacttgaggattttatgcagtttttgttaagacattttactttt

SEQ ID NO: 4509 - DNA, 924 bp, Brassica juncea
gagtctagtctccgccgctctctcctccgtctgcttccagaaatcgacaacacccaatggcaccgaaaaggggagtgaaagtggttgccaagaagaagacggagaaggttactaatccgttgtttgagagaaggccaaaacaattcggtatcggtggtgctttgcctcctaagaaggacttgactcgttacatcaaatggcctaagtcaatccgtcttcaaagacagaagcgtatccttaagcagaggctcaaggtccctcctgctttgaaccagttcaccaagactcttgacaagaacctcgcgacccagcttttcaagcttcttatgaagtacaggcctgaggacaaggctgcaaagaaggatcgtcttttgaaaaaggcccaagccgaggctgagggaaagccttctgaatccaagaagcccattgttgtcaagtatgggctcaaccacgtgacttacttgatcgagcagaacaaggcgcagcttgttgtcattgctcacgatgttgaccccattgagttggtcgtctggttacctgctctttgtaggaagatggaagtgccttactgcattattaaaggcaaatctcgtcttggaacggttgttcaccagaagactgctgcttgcttgtgtttgaccactgtcaagaacgaggataagctcgagttcagcaaaatccttgaagccatcaaggcaaacttcaacgacaagtacgaagagtacaggaagaaatggggaggaggcataatgggatccaagtctcaagccaagaccaaagctaaggagagggttcttgccaaggaggctgcccagagaatgaactaagctgaaacttaatgattgacggtggttttgtttagcgatttcatggaatgttttgaaactttatgctcttactatcaatgttgcacacttattataa

SEQ ID NO: 4510 - DNA, 983 bp, Brassica juncea
gtactctgtagcaatggcacccaaaagaggagtgaaggttgttgccaagaagaagacggagaaggtgacgaatccatcgtttgagagaaggccaaagcaattcggtatcggtggtgctttgcctcctaagaaggacttgactcgttacatcaaatggcctaagtcaatccgtcttcaaagacagaagcgtatccttaagcagaggctcaaggtccctccggctttgaaccagttcaccaagactcttgacaagaaccttgcaacccagcttttcaaggttcttatgaagtacaggccagaggacaaagctgcaaagaaggatcgtcttttgaagaaagctcaagccgaggctgagggaaagccttctgaatccaagaagcccattgttgttaagtatgggctcaaccacgtgacttacctcatcgagcagaacaaggcacagcttgttgtcattgctcacgatgttgaccctatcgagctggtcgtctggttacctgcactttgcagaaagatggaagttccttactgcattgtcaaaggcaaatctcgtcttggaacggtcgttcatcagaagacagctgcttgcttgtgtttgaccactgtcaagaacgaggacaagcttgagttcagcaaaatccttgaagccatcaaggcaaacttcaacgacaagtacgaggagtacaggaagaagtggggaggagggataatgggatccaagtctcaagccaagaccaaagctaaggagagggttcttgccaaggaggctgcccagagaatgaactaagcagagcgtctctgttctggaaacataatgatatcatggttttgtttagcgatttcgtggaacatttttaaatttatgtttcttattatcgttgttgcacacttgagaattttaagcagttttgttagacattttgctttcgagtttattatatatttgatccatgtttgcaaaatagagacgctctgctgcttagttc

SEQ ID NO: 4511 - DNA, 1014 bp, Brassica oleracea
cagtctgtgccgctcttccgccgtcttaactccagaaattgacaagagaccatggcacctaaaaggggagtgaaagtagctgcgaagaagaagacggagaaggttacgaatccattgtttgagagaaggccaaagcaatttggtatcggtggggccttgcctcctaagaaggacttgactcgttacatcaaatggcccaagtccatccgtcttcaaaggcagaagcgtatcctcaagcagaggcttaaggtccctccggctttgaaccagttcaccaagactcttgacaagaaccttgctacccagcttttcaagcttcttatgaagtacaggcccgaggacaaggccgcaaagaaggatcgtcttttgaaaaaggcccaagccgaggctgatggaaagccttctgaatccaagaagcccattgtcgtcaagtatgggctcaaccacgtgacctacctcatcgagcagaacaaggcacagcttgtcgtcattgctcacgatgttgaccccatcgagctggtcgtctggttacctgctctttgcagaaagatggaagtgccttactgcattgtcaaaggcaaatcccgtcttggaacggttgttcaccagaagactgctgcgtgcttgtgtttgaccactgttaagaacgaggacaagctcgagttcagcaaaatccttgaagccatcaaggcaaacttcaacgacaagtacgaggagtacaggaagaaatggggaggaggcatcatgggatccaaatctcaggcgaagacaaaggccaaggaaagggttcttgcaaaggaggctgcccagaggatgaactaagaagggatctattcttcttattgtgcgtgtctggtgaatctcatttgctgagattcctcgtaaaacttgatagaagtttttttgtttagctgttaggaactcttgttttcttttatggatgttttgcaatttcttcagaccgtttccatcttcttgaagcttaattatctttttggtctctctgccaatttt

SEQ ID NO: 4512 - DNA, 1088 bp, Brassica rapa
aaagaaaaacacatacctgtcttatattatataagtagagataacaaaagaaccctagttacagtctttgccgctcttccgccgtctaactccagaaattgacaagagaccatggcacccaaaaagggagtgaaagtagctgcgaagaagaagacggataaggttacgaatccactgtttgagagaaggccaaagcaatttggcatcggtggtgccttgcctcctaagaaagacttgactcgttacatcaaatggcccaagtccatccgtcttcaaaggcagaagcgtatcctcaagcagaggctcaaggtccctccggctcttaaccagttcaccaagactctcgacaagaaccttgctacccagcttttcaaggttctgatgaagtacaggccagaggacaaggccgctaagaaggatcgtcttttgaaaaaggcccaagccgaggctgagggaaagccttctgaatccaagaagcccattgttgttaagtatgggctcaaccacgtgacttacctcatcgagcagaacaaggcgcagcttgttgtcattgcacacgatgttgaccccatcgagctggttgtctggttgcctgctctttgcagaaagatggaagtgccttactgcattgtcaaaggcaaatctcgtcttggaacggttgttcaccagaagactgctgcttgcttgtgtttgaccactgtcaagaacgaggacaagctcgagttcagcaaaatcctcgaagccatcaaggcaaacttcaacgacaagtacgaggagtacaggaagaagtggggaggaggcatcatgggatccaagtctcaagccaagaccaaagctaatgagagggttcttgccaaggaggctgcccagagaatgaactaagcggagcatctcgtttgagttatgtttttgtttagcgatttcttgggatactttaaaactttatgctcttactatcgatgttgcacacttgaggattttatgcagtttttgttaagacattttacttttgagattattattttcttatttactgatccttttttgcatattaaaacaatgaacccgtgcttagagttataattttg

SEQ ID NO: 4513 - DNA, 978 bp, Brassica napus
tttgagagaccacatcatttggagtgcagcacaggagagcgacgatggcccccaagaaaggagtgaaggtagctgccaagaagaagacggagaaagtaaccaaccctctatttgagaggaggccaaagcaatttggtattggtggtgctttgcctcccaagaaggacttgactcgctacatcaaatggccaaagtctatccgtctccagaggcagaagcgcatcctcaagcagaggctcaaggtccctccggcattgaaccagttcaccaagacccttgacaagaaccttgcaacccagcttttcaaggttctgatgaagtacaggccagaggacaaggccgctaagaaggatcgtcttctgaaaaaggctcaagccgaggctgagggaaagccttctgaatccaagaagcccattgtcgtcaagtatgggctcaaccacgtcacttacctcatcgagcagaacaaggcgcagcttgttgtcattgctcacgatgttgaccccatcgagctggtcgtctggctgcctgctctttgcagaaagatggaagtgccttactgcattgttaaaggcaaatctcgtcttggaacggtcgttcaccagaagactgctgcttgcttgtgtttgaccacggtcaagaacgaggacaagctagagttcagcaagatccttgaggccatcaaggcaaacttcaacgacaagtacgaggagtacaggaagaaatggggtggaggcatcatgggatccaaatctcaggcgaagacaaaggccaaggaaagggttcttgcaaaggaggctgcccagaggatgaactaagaagggatctattcttcttattgcgtgtgtctggtgaatctcatttgctcgtaaaacttgatagaagtttttttgtttagctgttgaactctttgttttcttttatggatgttttgcaatttcttcggaccgttcccatcttcttgaagcttaattatcttta

SEQ ID NO: 4514 - DNA, 1088 bp, Brassica napus
tgaggtatcatagcttgattcaattctatcggcattactgcgggggactcagccgcccgtttgagagaccacatcatttggagttgcagcacaggaggacgacgatggcccccaagaaaggagtgaaggtagctgccaagaaaaagacggagaaagtaaccaaccctctatttgagaggaggcctaagcaatttggtatcggtggtgctttgcctcccaagaaggacttgactcgctacatcaaatggccaaagtcaatccgtctccaaaggcagaagcgtatccttaaacagaggctcaaggttcctccggctttgaaccagttcaccaagacccttgacaagaaccttgcaacccagcttttcaaggttctgatgaagtacaggccagaggacaaggctgcaaagaaggatcgtcttctgaaaaaggctcaagccgaggctgagggaaagccttctgaatccaagaagcccattgtcgtcaagtatggtctcaaccacgtcacttacctcatcgagcagaacaaggcgcagcttgttgtcattgctcacgatgttgaccccatcgagctggtcgtctggttgcctgctctttgcagaaagatggaagtgccttactgcattgtcaaaggcaaatctcgtcttggaacggtcgttcaccagaagactgctgcttgcttgtgtttgaccactgttaagaacgaggacaagctagagttcagcaagatccttgaggccatcaaggcaaacttcaacgacaagtacgaggagtacaggaagaaatggggaggaggcatcatgggatccaaatctcaggcgaagacaaaggccaaggaaagggttcttgcaaaggaggctgcccagaggatgaactaagaagggatctattcttcttattgtgcgtgtctggtgaatctcatttgctgagattcctcgtaaaacttgatagaagtttttttgtttagctgttaggaactcttgttttcttttatggatgttttgcaatttcttcagaccgtttccatcttcttgaagcttaattatctttttggtctctctgccaattttaaacttgtttggtggttattt

SEQ ID NO: 4515 - DNA, 953 bp, Brassica napus
gtgccgctcttccgccgtcttaactccagaaattgacaagagaccatggcacctaaaaggggagtgaaagtagctgcgaagaagaagacggagaaggttacgaatccattgtttgagagaaggccaaagcaatttggtatcggtggggccttgcctcctaagaaggacttgactcgttacatcaaatggcccaagtccatccgtcttcaaaggcagaagcgtatcctcaagcagaggcttaaggtccctccggctttgaaccagttcaccaagactcttgacaagaaccttgctacccagcttttcaagcttcttatgaagtacaggcccgaggacaaggccgcaaagaaggatcgtcttttgaaaaaggcccaagccgaggctgatggaaagccttctgaatccaagaagcccattgtcgtcaagtatgggctcaaccacgtgacctacctcatcgagcagaacaaggcacagcttgtcgtcattgctcacgatgttgaccccatcgagctggtcgtctggttacctgctctttgcagaaagatggaagtgccttactgcattgtcaaaggcaaatcccgtcttggaacggttgttcaccagaagactgctgcgtgcttgtgtttgaccactgttaagaacgaggacaagctcgagttcagcaaaatccttgaagccatcaaggcaaacttcaatgacaagtacgaggagtacaggaagaagtggggaggaggcatcatgggatccaagtctcaagccaagaccaaagctaaggagagggttcttgccaaggaggctgcccagagaatgaactaagcggagcatctcgtttgagttatggttttgtttagcgatttcatgggatatttcaaaactttatgctcttactatcgatgttgcacacttgaggattttatgcagtttttgttaagacattttacctttgagattat

SEQ ID NO: 4516 - DNA, 911 bp, Brassica napus
ctttgccactctccgccgtcccctctgtagcaatggcacccaagaagggagtgaaagttgttgccaagaaaaaaacggagaaggttacgaaccctttgtttgagagaaggccaaagcaattcggtatcggtggagctctccctcctaagaaggacttgactcgttacatcaaatggcctaagtccatccgtctccaaaggcagaagcgtatcctcaagcagaggctcaaggtccctcctgctttgaaccagttcaccaagactcttgacaagaacctcgcgacccagcttttcaagcttcttatgaagtacaggcctgaggacaaggctgcaaagaaggatcgtcttttgaaaaaggcccaagccgaggctgagggaaagccttctgaatccaagaagcccattgttgtcaagtatgggctcaaccacgtgacttacttgatcgagcagaacaaggcgcagcttgttgtcattgctcacgatgttgaccccattgagcttgtcgtctggttaccggctctttgtaggaagatggaagtgccttactgcattgttaaaggcaaatctcgtcttggaacggttgttcaccagaagaccgctgcttgcttgtgcttgaccactgtcaagaacgaggataagctcgagttcagcaaaatccttgaagctatcaaggcaaacttcaacgacaagtacgaggagtacaggaagaagtggggaggaggcataatgggatccaagtctcaagccaagaccaaagctaaggagagggttcttgccaaggaggctgcccagagaatgaactaagctgaaacttaatgattgacggtggttttgttttagcgatttcatggaatgttttgaaattttatgctcttactatcaatgttgcatacttgaggatattattattgc

SEQ ID NO: 4517 - DNA, 1029 bp, Brassica napus
gaaagaaaaacacatacctgtcttatattttatataagtagggataacaaaagaaccctagttacagtctttgccgctcttccgccgtctaactccagaaattgacaagagaccatggcacccaaaaagggagtgaaagtagctgccaagaagaagacggagaaggttacgaatccactgtttgagagaaggccaaagcaatttggtatcggtggtgccttgcctcctaagaaagacttgactcgttacatcaaatggcccaagtccatccgtcttcaaaggcagaagcgtatcctcaagcagaggctcaaggtccctccggctcttaaccagttcaccaagactcttgacaagaaccttgctacccagcttttcaaggttctgatgaagtacaggccagaggacaaggccgctaagaaggatcgtcttttgaaaaaggcccaagccgaggctgagggaaagccttctgaatccaagaagcccatcgttgttaagtatggtctcaaccacgtgacttacctcatcgagcagaacaaggcccagcttgtggtcattgcacacgatgttgaccccatcgagctggttgtctggttgcctgctctttgcagaaagatggaagtgccttactgcattgtcaaaggcaaatctcgtcttggaacggttgttcaccagaagactgctgcttgcttgtgtttgaccactgttaagaacgaggacaaactcgagttcagcaaaatccttgaagccatcaaggcaaacttcaacgacaagtacgaggagtacaggaagaagtggggaggaggcatcatgggatccaagtctcaagccaagaccaaagctaaggagagggttcttgccaaggaggctgcccagagaatgaactaagcggagcacctcgtttgagttatgtttttgtttagcgatttcttgggatactttaaaactttatgctcttactatcgatgttgcacacttgaggattttatgcagtttttgttaagacattttacttttgagattattattttc

SEQ ID NO: 4518 - DNA, 912 bp, Brassica napus
ggactcagccgtccgtttgagagaccacatcatttggagtgcagcacaggagagcgacgatggcccccaagaaaggagtgaaggtagctgccaagaagaagacggagaaagtaaccaaccctctatttgagaggaggccaaagcaatttggtattggtggtgctttgcctcccaagaaggacttgactcgttacatcaaatggcccaagtctatccgtctccagaggcagaagcgtatcctcaagcagaggctcaaggtccctccggcattgaaccagttcaccaagactcttgacaagaaccttgcaacccagcttttcaaggttctgatgaagtacaggccagaggacaaggccgcaaagaaggatcgtcttctgaaaaaggctcaagccgaggctgagggaaagccttctgaatccaagaagcccattgtcgtcaagtatggtctcaaccacgtcacttacctcatcgagcagaacaaggcgcagcttgtggtcattgcccacgatgttgaccccatcgagctggtcgtctggctgcctgctctttgcagaaagatggaagtgccttactgcattgttaaaggcaaatctcgtcttggaacggtcgttcaccagaagactgctgcttgcttgtgtttgaccacggtcaagaacgaggacaagctagagttcagcaagatccttgaggccatcaaggcaaacttcaacgacaagtacgaggagtacaggaagaaatggggtggaggcatcatgggatccaaatctcaggcgaagacaaaggccaaggaaagggttcttgcaaaggaggctgcccagaggatgaactaagaagggatctattcttcttattgcgtgtgtctggtgaatctcatttgctcgtaaaacttgatagtagttttttgttagctgt

SEQ ID NO: 4519 - DNA, 979 bp, Brassica napus
ggtactgtatataaagcaaaaccctagaaacactcatttttcgacttcagcgccgtccgtttggagaaaccacccatttggacgacgatggccccgaagaaaggagtcaaggttgctgccaagaagaagacggataaagtagcgaaccctctgtttgagagaaggcctaagcagtttggtataggtggagctcttcctccaaagaaggatctcactcgctacatcaaatggcccaagtccatccgtcttcaaaggcagaagaggatccttaagcagaggttgaaggtcccacctgcccttaaccagttcaccaagaccctcgacaagaatcttgcaaccagcctgttcaagatccttctcaagtacaggccagaggacaaagccgccaagaaagagcgccttgtcaagaaggctcaagctgaagctgagggaaagccttctgaatccaagaagcccattgttgtcaaatacggccttaaccatgtcacctacctcatcgagcagaacaaggcacagcttgttgtcattgctcatgatgtcgaccccatcgagttggtcgtctggttgcctgctctctgcaggaagatggaagtcccttactgcattgtcaaaggcaaatctcgtctcggagctgttgttcaccaaaagactgctgcttgcctgtgtttgaccactgtcaagaacgaggacaagcttgagtttagcaaagtccttgaagccatcaaggcaaacttcaacgacaagtacgaagagtacaggaagaaatggggaggaggcataatgggatccaaatctcaggccaagacaaaggccaaggaaagagttcttgcaaaggaggctgcccagaggaataactaattaaggaatctatcttttttgagtgtttagattgtctctcttttctttttagttggaactatcgtttgtttatggatatgttttgcacccgtcttcagacagttttcaagctttattatca

SEQ ID NO: 4520 - DNA, 988 bp, Brassica napus
agtctccgccgctctctcctccgtctgcttccagaaatcgacaacacccaatggcaccgaaaaggggagtgaaagtggttgccaagaagaagacggagaaggttactaatccgttgtttgagagaaggccaaagcaattcggtatcggtggagctttgcctcctaagaaggacttgactcgttacatcaaatggcctaagtcaatccgtcttcaaaggcagaagcgtatccttaagcagaggctcaaggtccctccggctttgaaccagttcaccaagactcttgacaagaaccttgcaacccagcttttcaaggttcttatgaagtacaggccagaggacaaagctgcaaagaaggatcgtcttttgaagaaagctcaagccgaggctgagggaaagccttctgaatccaagaagcccattgtcgtcaagtatggactcaaccacgtgacttacctcatcgagcagaacaaggcgcagcttgttgtcattgcacacgatgttgaccctatcgagctgatcgtctggttacctgcactttgcagaaagatggaagtgccttactgcattgtcaaaggcaaatctcgtcttggaacggtcgttcatcagaagactgctgcttgcttgtgtttgaccactgtcaagaacgaggacaagctcgagttcagcaaaatccttgaagccatcaaggcaaacttcaacgacaagtacgaggagtacaggaagaagtggggaggagggataatgggatccaagtctcaagccaaaaccaaagctaaggagagggttcttgccaaggaggctgcccagagaatgaactaatcagagtttctctcggtcaagaaacacaatgatgattatgatggttttgtttagccgtttcattgaatgttttaaaactctattctctcttattatctatgtttttgcacacttgaggatgatatgcagttttgttatacattttgcttttgagtttacctatttat

SEQ ID NO: 4521 - DNA, 912 bp, Brassica napus
gccgtctaactccagaaattgacaagagaccatggcacccaaaaagggagtgaaagtagctgcgaagaagaagacggagaaggttacgaatccactgtttgagagaaggccaaagcaatttggtatcggtggtgccttgcctcctaagaaagacttgactcgttacatcaaatggcccaagtccatccgtcttcaaaggcagaagcgtatcctcaagcagaggctcaaggtccctccggctcttaaccagttcaccaagactctcgacaagaaccttgctacccagcttttcaaggttctgatgaagtacaggccagaggacaaggccgctaagaaggatcgtcttttgaaaaaggcccaagccgaggctgagggaaagccttctgaatccaagaagcccattgttgttaagtatgggctcaaccacgtgacttacctcatcgagcagaacaaggcgcagcttgttgtcattgcacacgatgttgaccccatcgagctggttgtctggttgcctgctctttgcagaaagatggaagtgccttactgcattgtcaaaggcaaatctcgtcttggaacggttgttcaccagaagactgctgcttgcttgtgtttgaccactgtcaagaacgaggacaagctcgagttcagcaaaatcctcgaagccatcaaggcaaacttcaacgacaagtacgaggagtacaggaagaagtggggaggaggcatcatgggatccaagtctcaagccaagaccaaagctaaggagagggttcttgccaaggaggctgcccagagaatgaactaagcggagcatctcgtttgagttatggttttgcttagcgatttcttgggttacttaaaaactttatgctcttactatcgatgttgcacacttgaggattttatgctagtttt

SEQ ID NO: 4522 - DNA, 939 bp, Brassica napus
caatggcaccaaaaaggggagtgaaagtggttgccaagaagaagacggagaaggttactaatccgttgtttgagagaaggccaaagcagtttggtatcggtggtgctttgcctcctaagaaggacttgactcgttacatcaaatggcctaagtccatccgtcttcaaagacagaagcgtatccttaagcagaggctcaaggtccctccggctttgaaccagttcaccaagactcttgacaagaaccttgcaacccagcttttcaaggttcttatgaagtacaggccagaggacaaagctgcaaagaaggatcgtcttttgaaaaaggctcaagccgaggctgagggaaagccttctgaatccaagaagcccattgtcgtcaagtatggactcaaccacgtgacttacctcatcgagcagaacaaggcgcagcttgttgtcattgcacacgatgttgaccctatcgagctgatcgtctggttacctgcactttgcagaaagatggaagtgccttactgcattgtcaaaggcaaatctcgtcttggaacggtcgttcatcagaagacagctgcttgcttgtgtttgaccactgtcaagaacgaggacaagctcgagttcagcaaaatccttgaagccatcaaggcaaacttcaacgacaagtacgaggagtacaggaagaagtggggaggagggataatgggatccaagtctcaagccaagaccaaagctaaggagagggttcttgccaaggaggctgcccagagaatgaactaatcagagtttctctcggtcaagaaacacaatgatgatgatgatggttttgcttagccgtttcattgaatgttttaaaattctattctctcttattatctatgtttttgcacacttgaggatgatatgcagttttgttatacattttgcttttgagtttacctattta

SEQ ID NO: 4523 - DNA, 937 bp, Zingiber officinale
  misc_feature (118)..(118): n is a, c, g, or t
ttgtttgagaagcgcccgaagcaattcggcattggcggagcattgcctccgaagaaggatctgcgtcggttcgtcaaatggccgaaggttgtccggattcagaggcaaaaaaggattntaaagcagcggttgaaggttcctcctgctctgaatcagttcactcgaacactggacaagaaccttgcaacaaatctgttcaaattgcttctcaagtacagacctgaagaccgagctgctaagaaggagaggctccttaagagggcacagactgaggccgaggggaagactctcgaagttaagaaaccgattgttgtgaagtacggacttaatcatattacatacctaatcgagcagaacaaggcacagttggtggttatagctcacgatgtggatccggttgagcttgtagtttggctaccagctttgtgcaggaaaatggagattccctactgtatcgtcaaaggaaaatcccgtttgggagcgatcgtgcataagaaaactgcaactgcactatgtttgacaactgtgaagaacgaagacaaattggaattcagtaaaatcctcgaagccatcaaggccaacttcaacgacaagtttgacgagatcaggaggaagtggggcggcggcataatgggttctaagtctcaagcaaaggccaaggccaaggagaaattgctcgcaaaggaatctgctcagcggatgacttagctttttcgggttattgctgtgccatgtttatcgcatttttgcttctgttccatagccatcttagcgcttggtgcttttcgagtttcccttcaggacaatgtgtttttaatatctatcagacaacctttgcttctcacaagttaatgaaactaaaatgcttattactgaaagctcgagcttaagtttgtgctgttattctttttcaaaggattttgagtgtttgttggat

SEQ ID NO: 4524 - DNA, 1036 bp, Mesembryanthemum crystallinum
agcagctgcaccttcgctcttcttccttttctctctccacccgcgaaatggctcccaaaagaggtgtgaaggctcctgttgcctcaaaaaagaagaccgagaaggttgtgaaccctttgtatgaaaagcgtcccaagcaatttgggattggtggtgctcttccaccaaagaaggacttgactagatttatcaaatggccacgtgtggttcaaattcaaaggaaaagaagaattttgaagcagcgtttgaaggtcccccctgctgtcaatcaattcacaaaagcacttgacaagaatcttgcttcaaacctcttcaagttgttgctcaaatacagacctgaggacaaggctgccaagaaggaaaggcttttgaaagctgcacaagcagaggctgagggaaagaaaccagaggccaagaaacctgttgtagtgaaatatggccttaaccacgttacttacctgattgaacagggtaaggctcagttggtggtcattgcccacgatgttgacccaatcgagcttgtagtttggctgcctgccttgtgccgtaaaatggaggttccatactgcattgtgaagggaaaggcccgtcttggaacggttgtccacaacaagacagctactgctctttgcctgacctcagtgaaaaatgaggataagatggagttcagcagaattgtggaagctgtgaaggccaatttcaacgacaagtacgatgaacacaggaaaaagtggggtggtggaatcatgggttccaagtcccaggccaagatgaaggcaaaggaaagggttttggccaaggaggctgcccagaggttgaattagtttcacaaagtcgtctcgtttgagagtttctagatgttatgcttagccttttttgctgtactttatcgacatatgactattcagaaattgataatttagttcgtttggtggaagtgcttgtactgattgtttttgtagtggattttgagaacccttactgtggtcaaatgccttattatggttaagtttcaatattacttcttgatctagta

SEQ ID NO: 4525 - DNA, 955 bp, Raphanus sativus
  misc_feature (6)..(6): n is a, c, g, or t
cctttngactcagccgtccgtttcacatcatttggagttgcagcacaggaggacgacaatggccccgaagaaaggagtgaaggtagctgccaagaagaagacggagaaagtaacgaaccctctgttcgagaggaggcctaagcagtttggtatcggaggagctcttcctccaaagaaggatctgactcgctacatcaaatggcccaagtcaatccgtctccaaaggcagaagcgtatccttaagcagaggctcaaggtccctcctgctttgaaccagttcaccaagactcttgacaagaaccttgccacccagcttttcaaggttcttatgaagtacagaccagaggacaaggccgccaagaaggatcgtcttctcaaaaaggctcaagccgaggctgagggaaagccttctgaatccaagaagcccattgtcgtcaagtacggtctcaaccacgtcacttacctcatcgagcagaacaaggcccagcttgtcgtcattgcacacgatgttgaccccatcgagttggtcgtctggttgcctgctctttgcagaaagatggaagtgccttactgcattgttaaaggcaaatctcgtcttggaacggtcgttcaccagaagactgctgcttgcttgtgtttgacaactgtcaagaacgaggacaagctagagttcagcaagatccttgaagccatcaaggcaaacttcaacgacaagtacgaggagtacaggaagaaatggggaggaggtatcatgggatccaaatctcaggccaagacaaaggccaaggaaagggttcttgcaaaagaggctgcccaaagaatgaactaagatgcatatcttttcttattgtctgttatttgctgagatttgtcgtaaaacttgatagacctctttttttgtttagctgttggaactcttggttttttttttatgaatgttttgagcactttcttc

SEQ ID NO: 4526 - DNA, 1072 bp, Raphanus sativus
gggtactgtatatataaagcaaaaccctagaaacacttgttttttcgactccagcgccgtccgtttgcagaaaccacccatttggaaacgaaccatggccccgaagaaaggagtcaaggttgctgccaagaagaagacggagaaagtaacgaaccctctattcgagaggaggcctaagcaatttggtattggtggagctcttccacccaagaaggatcttacccgctacatcaaatggcctaagtctatccgtcttcaaaggcagaagaggatccttaagcagaggttgaaggtcccaccagcccttaatcagttcaccaagaccctcgacaagaatcttgcgaccagcctcttcaagatccttctcaagtataggccggaggacaaagccgccaagaaagagcgtcttgtcaagaaggctcaagctgaagctgagggaaagccttctgaatctaagaagcctattgttgtgaaatacggccttaaccatgtgacctacctcatcgagcagaacaaggcacagcttgttgtcattgctcatgatgtcgaccctatcgagttggttgtctggttgcctgctctctgcaggaagatggaagtcccttactgcattgtcaaaggcaaatctcgtcttggagctgtggttcaccaaaagactgctgcttgcttgtgtttgaccactgtcaagaatgaggacaagcttgagttcagcaaaatcctcgaagccatcaaggcaaacttcaacgacaagtacgaagagtacaggaagaaatggggaggaggcataatgggatccaaatctcaggccaagacaaaggccaaggaaagagtacttgcaaaggaggctgcccagaggaataattaataagggtctttttgagtgtttagattgtctcttcaatttgttgttcaaaaaaggattctctttttttttgttggaagttggaactatcttgtatggatatgttttgcaccctcttcagacagttttcaagctttatgatcgttttggtctcaggcacttcgactagtcttgaaagacaaacaagaatcagagatagttaacgttgga

SEQ ID NO: 4527 - DNA, 1026 bp, Raphanus sativus
gactactgtctttgccgctctccgccgtctaactccagaaattgaacaaccatggcacccaaaaggggagtgaaagcagtcacgaagaagaagacggagaaggttacgaaccctctatttgagaggaggccaaagcagttcggtatcggaggtgctttgcctccaaagaaggacttgactcgttacatcaaatggcccaagtccatccgtctccaaaggcagaagcgtatcctcaagcagaggctcaaggtccctcctgctttgaaccagttcaccaagactctcgacaagaaccttgcaacccagcttttcaaggttcttatgaagtacaggccagaggacaaggccgctaagaaggatcgtcttttgaaaaaggcccaagccgaggctgagggaaagccttctgagtccaagaagcccattgtcgtcaagtatggtctcaaccacgtgacttacctcatcgagcagaacaaggcccagcttgttgtcattgctcacgatgttgaccccatcgagctcgtcgtctggttacctgctctttgcagaaagatggaagtgccttactgcattgtcaaaggcaaatctcgtctcggaacggtggttcaccagaagactgctgcttgcttgtgcttgaccactgtcaagaacgaggacaagctcgagttcagcaagatccttgaagccatcaaggcaaacttcaacgacaagtacgaggagtacaggaagaagtggggaggaggtataatgggatccaagtctcaagccaagaccaaagctaaggagagggttcttgccaaggaggctgcccagaggatgaactaagcagagcgtcttcacaatgatgatgattatggttttgtttagctttttcatggaatgtttcgaaatgttttgctattattatccatgttgctcacttcaggatattattatgcagtttctgttaagactttttacttatgagattattttcttatttactgatccttgttttcaaattaaaacaattaattcaaaccattttta

SEQ ID NO: 4528 - DNA, 1008 bp, Raphanus sativus
gggcttccttttgactcagccgtccgtttcacatcatttggagttgcagcagaggaggacgacaatggccccgaagaaaggagtgaaggtagctgccaagaagaagacggagaaagtaacgaaccctctgttcgagaggaggcctaagcaattcggtatcggaggagctcttcctccaaagaaggatctgactcgctacatcaaatggcctaagtcaatccgtctccaaaggcagaagcgtatccttaagcagaggctcaaggtccccccggctttgaaccagttcaccaagactcttgacaagaaccttgccacccagctcttcaaggttcttatgaagtacagaccagaggacaaggccgccaagaaggatcgtcttctcaaaaaggctcaagccgaggccgagggaaagccttctgaatccaagaagcccattgtcgtcaagtacggactcaaccacgtcacttacctcatcgagcagaacaaggcacagcttgtcgtcattgcgcacgatgttgaccccatcgagttggtcgtctggttgcctgctctttgcagaaagatggaagtgccttactgcattgttaaaggcaaatctcgtcttggaacggtcgttcaccagaagactgctgcttgcttgtgtttgacaactgtcaagaacgaggacaagctagagttcagcaagatccttgaggccatcaaggcaaacttcaacgacaagtacgaggagtacaggaagaaatggggaggaggcatcatgggatccaaatcgcaggcgaagacaaaggccaaggaaagggttcttgcgaaagaggctgcccaaaggatgaactaagatgcatatcttttattattgtctgtcatttgctgggattatcgtaaaacttgatagacctcttttttgtttagctgttggaactcttgttttgtttttattatggatgttttgagcactttcttcatactgcttccatcttcttgaagcttaatcatcgttcagcccatttt

SEQ ID NO: 4529 - DNA, 836 bp, Carthamus tinctorius
  misc_feature (789)..(789): n is a, c, g, or t
aaaccctcgtaattttgtgtgttagggttcttcatcatcgccgtttcgaagccttgaatcgcaacaacttccaccaatgggtcccaagaaaggtggaaagccgattgcaacgaagaagaaaaccgagaaggtcgtgaatccgttgttcgagaaacggccaaagcagtttgggataggaggagctttgcctcccaagaaggatgtccacagattcgtaagatggccgcaagttgtcagaatccagaggaagaggaggatcctcaagcagcgtttgaaggttccacctgcattgaaccagttcaccaagacccttgacaagaatcttgcaactactttgttcaagatgctactcaagtacaggcccgaggataaggctgccaaaaaggaacgccttctgaaaagggctcaggctgagtcagaggggaaaacagctgaagctaagaagcctatagtcgtgaagtatggtctgaaccatgtcacctaccttattgaacagaacaaggcacaattggtaatcattgcccatgatgtggatccgattgagttggttgtatggcttcccgctctttgcagaaagatggaaatcccctactgcatcgtgaaggggaaatctcgattaggaaccattgtccatcagaaaaccgcagcagcactgtgcttgactacagtcaagaacgaagataaaatggaattcagccgaatcttggaggccatcaaggcgaacttcaacgacaagtacgaggagtatagaaagaagtggggtggtgggataatgggttcgaaatcgcnagcaaaaacaaaggcaaaagagagggtctttgcaaggaggctgccca

SEQ ID NO: 4530 - DNA, 1066 bp, Brassica juncea
ctaactccagaaattgacaagaaaacatggcacccaaaaagggagtgaaagtagctgccaagaaaaagacggagaaggttacgaatccactgtttgagaagaaggccaaagcaatttggtatcggtggtgccttgcctcctaagaaagacttgactcgttacatcaaatggcccaagtccatccgtcttcaaaggcagaagcgtatcctcaagcagaggctcaaggtccctccggctcttaaccagttcaccaagactcttgacaagaaccttgctacccagcttttcaaggttcttatgaagtataggccagaggacaaggctgcaaagaaggatcgtcttttgaaaaaggcccaagccgaggctgagggaaagccttctgaatccaagaagcccattgttgttaagtatggtctcaaccacgtcacttacctcatcgagcagaacaaggcgcagcttgtggtcattgctcacgatgttgaccccatcgagctggtcgtctggttgcctgctctttgcagaaagatggaagtgccttactgcattgttaaaggcaaatctcgtcttggaacggtcgttcaccagaagactgctgcttgcttgtgtttgaccacggtcaagaacgaggacaagctagagttcagcaagatccttgaggccatcaaggcaaacttcaacgacaagtacgaggagtacaggaagaaatggggtggaggcatcatgggatccaaatcacaggccaagacaaaggccaaggaaagggttcttgcaaaggaggctgcccagaggatgaactaagaagggatctattcttcttgttgcgtgtgtctggtgaatctcatttgctcgtaaaacttgatagaagtttttttttgtttagctgttggaactcttgttttcttttatggatgttttgcaatttcttcggaccgttcccatcttcttgaagcttaattatctttatggtgtgtctgccaattttaaacgccaaatattttatacacttgtaagatattttacaatccggatacagtgttaataattatttgagatacttgaagtcccg

SEQ ID NO: 4531 - DNA, 916 bp, Fraxinus spp
ctccaaagaagggcgcaaaaattgccggcgggagtggctaaaaagaaagcggataaggtagcgaatcctttattcgagaagcgcccgaagcaatttggaattggtggagcgttgccgccgaagaaggatctccaccgatttgtgaaatggccgcaagtggtgaggattcagcgcaagaagatgattttgaagcaacgccttaaagtccaccgccaattcaccagttctcgaaaaccctcgacaagaacctggcaacgagcttattcaagatgcttctcaagtacaggcctgaggatagagctcaaaaggaagagaggcttctaaaaagagctcaggccgaggctgaaggaaaaacacctgaggttaagaagccaatcatagtgaaatatggtctcaaccatgtcacctatctgattgagcagaataaagctcaattagtggtcattgcacatgatgtcgaccccattgagttggttgtatggcttcccgcattgtgcaggaaaatggaaatcccttactgcatagtgaagggaaaggcacgtttgggaactattgtccataagaagacggcctctgtattgtgcttaacttcagttaagaatgaagacaagatggacttcagcaggatcttggaagctattaaggccaacttcaatgacaaatatgatgagaccaggaagaagtggggtgtggtgtaatgggctcaaaatcccaagccaagacaaaggccaaagagagactcatggccaaggaggctgcacagaggatgacttaggctttagtcttgccttactctgtcgaggatagaactgaatgagtgaaccttttacctgcctttgtattgctccaattcataaacatttttgcttccatttgataattgattgacagatgacaggcttgattatctaagtat

SEQ ID NO: 4532 - DNA, 1076 bp, Ceratodon purpureus
tctttcgctgcgcaggcctgttgccatagctctgccccagctttgctcctcgcacaactcttcaacatggctcccaagaggggtaacatcaagactccggtcccggctcccgtggtgaagaaggcggctcccgtgaagacggtgaacccgctgttcgagaagaggccgaagcagttcggtattggtggggctctcccccccaagcgcgacctgcacaggttcgtgaaatggcccaagtatgtgcgcattcagcgccagcgccgtgttttgaaccagcgtttgaaggtgccccctgccctcaaccagttcacgaagactttggacaagaacctcgctactagcttgttcaagatgttgttgaagtaccgacctgaggacaaggctgccaagaaggaacgtcttctgaacaaggccaaggctgaggctgagggcaagactgtggagtccaagaagcccgtggttgtgaagtacggcatcaaccatattacgtacctcattgagcagggcaaggctcagctcgttgtcattgcccacgacgtcgacccaattgaattggtcgtgtggttgcccgcactttgccgcaagatgggtgtgccctacgctattgtcaagggcaaatcgcgcttgggacagattgtgcatgccaagactgcaacggccttgtgcttgacatcggtgaaaaacgaggacaagcatgagttctcgaagatcgtcgaggctgtcaaggctaacttcaacgagaagttcgacgagtacaggaggcaatggggtggaggtatcatgggtgtcaagtcccaggccaagaccaagatcagagagcgtatcattgccaaggaggctgcacagagagctgcctagattcttctgggtttgctgtcggtctgtcgatatggaacatgggagtgtttttgggacaagagctttgtcatcattccaaattcaacatgagtataccattcaatttgggcaatcaaactctctttttgtgaatgcgatgaccatgcagatctagttttctcctacttctatactgatgttactgtggcattgcttaatgattgattgttcttccttgt

SEQ ID NO: 4533 - DNA, 1042 bp, Pteridium aquilinum
cctgggagtcgcggaagctgctgttgcgagtcgccgagcttcccagaattccttcaatggcccccaaacggggtatcaaggtacctgtgcctgctccggtggagaagaaaaaggtgccagaaaaggttgtcaatcctctctttgagaagaggccgaagcagtttggcattggtggagctttgcgtccaacaaaggatctacaccgctttgtaaaatggcccaagtatgttcgcatccagaggcaacgaagagtgttgaaccaacggcttaaggttccccctgctttgaaccaatttaccaaaacgcttgacaagaatctggcttccagtctcttcaagatgctgctcaagtacaggccagaagataaagcagcgaagaaggacagacttctcaagaaggctcaggctgaatcagaaggcaagactattgaaagcaagaagcccattgttgtcaagtatgggatcaaccatgtgacttacctcattgagcagggcaaagcacagctggttgtaattgcccatgatgtggatcccattgaactggtcctatggcttccagctctttgccggaagatgggaattccatatgccattgtcaagggcaaagctcgtcttggccagattgtgcattcgaagactgccacagccctatgtgtgacctccgtgaagaatgaagataaacttgagttcagtaagattgtggaagcagtgaaggccaacttcaacgatcggtttgatgacctccgacgccaatggggtggtggtattatgggagtaaaatcacaagctaaagccaaagcaaaggaaaaggttattgccaaggaagctgctcagaggatgtcctaaggtttagtctgcattttttatcacaggaagaggcttcttgtggtacatctttgtatggctgttttgcatcatgcgggctttgtcactttggggctagcttggttaagcggcctgagattctagaatacagaacttttttggctcattatataattttatggctcaaaaattgtcgctgccatagttatagtgcaaaa

SEQ ID NO: 4534 - DNA, 1064 bp, Pteridium aquilinum
tgaaaaagaagccttgtagggttttcctgtcaagcttcttctaaaggatctgtaggcgcaggcaggcaggcaggagatcagcaggggatctgttgaatcgaaacgagaagcctttgccatggctcccaaaagggggtcgaagattgctgtgcctactccagctgagaagaagaagaccccagagaaggttgtgaatcctttatttgaaaaaagacctaaacagtttggtattggagggtccctaccttataagaagaacctgcaccgatttgtcaagtggcccaaatatgtacgtatccagaggcaaaggagggttttgaaccagaggttgaaagtcccgcctgcactcaatcagttcaccaagactctggataagaatttggcttccagcctattcaagatgcttctcaagtacaggccagaagataaagcagcaaagaaggaaaggcttttgaagaaggcccaggcagagtctgaaggaaagactatcgaaagtaagaagcctattgtggtcaagtacggaatcaaccacgtgacttaccttattgagcagggtaaagcacagctggttgttattgcccacgatgttgatccccttgagctagttatctggcttccagctttatgtagaaaaatgggtattccgtattgtattgtgaaagggaaagcacgccttggccagattgtacactctaaaactgccacagcattgtgtctaacctcagtgaagaacgaggacaagctagagttcagcaagattgtggaagcaatcaaggccaactttaatgaccggttcgatgatcttcggaggcaatggggtggaggcattatgggtgtcaaatcacaggccaagtccaaagctaaagagaaagtcgttgcaaaagaggcagcacaaaggatgtcttagtacacgtctgcaatgggggactgtggggctaaatgagcttctgttttcttgttagccatctgagtacaggaattctttttgttaagaggtttgcagccaagatgggtgtgcaaaagttttgttttgttagatttatggcaatgaatctccaagtttt

SEQ ID NO: 4535 - DNA, 1082 bp, Citrullus lanatus
atggagaaacgaaaaatggagaatgacaacgcaaatgatgctgcaccgaagaaggctgttggaaaagtttcggcaaaaaagaagccggagaaggtggtgaacccactattcgagaagcgtccgaagcagtttggaatcggtggggcattgccgcctaagagggacctcacccgcttcgtcaaatggcccaaagttgttcaaattcagaggaagaagaggattctgaagcagaggctcaaggttccaccagctttgaatcagttcaccaagaccctcgacaagaatcttgcaacaaacttgttcaagatgcttttgaagtataggccagaggataaaacacagaaaagggagcgtcttttgaaaagagcccaggaagaggccgaaggcaaatcacatgatgccaaaaagcctatcgttgttaaatatggtctcaaccatgttacctatctcatcgagcagaacaaggcacaactggttgtgattgcacacgatgtggatccaattgagttggttgtatggctcccagctctgtgcaggaagatggaaattccatattgcattgtgaagggaaaagcacgtttgggagcgattgtccacaaaaagactgcatcagttttgtgcctgacaacggtaaagaacgaagataagttggagttcagtagaatcctagaagctattaaggcgaacttcaatgacaagtacgacgagtacaggaagaaatggggtggcggaatcatgggttccaagtcacaggccaaaaccaaagcaaaggagaagctccttgccaaggaagctgctcaaaggatgtcttaggaattcagagatgaacactagagcaaaggacaaaggagaagcttctagctgagccagaggatgtcaaagtatggcttaggtatcggtaatgagctcttgtctaacttaagtaatttttctttgattataaagcagcagattcctaagagccttgtcatttttattttcagctttaagtttattggattgagaaattttattttgttctacgagttctacatattcaaagcaggacattttggagttattatttgcctgttctctcaatt

SEQ ID NO: 4536 - DNA, 1018 bp, Capsicum annuum
ggctccgaagaagggtgtagcagtagcagcaaagaagaaaaatgagaaggcgaaagtggtgaatccactttatgagaagaagccaaggcagttcggtatcggtggtgcgcttccaccgaagaaggatttgtcgaggttcgtcaaatggcctaggaatgttgtgcttcaaaggaagaagaggattctcaagatgcgtttgaaggttcccccagctcttaaccagttcaccaagacacttgataagaaccttgctacaacccttttcaagatgcttctgaagtacaggcctgaggacaaagctgcaaagaaggagcgtcttgtcaaaagggctcaagctgaagctgaaggaaagactcctgaaacaaagaaacccattatcgtgaaatatgggcttaagcacatcacgtaccttattgagcagaataaagctcagttagtagtgattgctcatgatgtggacccaattgagttggttgtctggcttccggccctatgcagaaagatggaaattccttactgcattgtgaaagggaaagcccgtttaggatcaatcgtgcataagaaaactgcttcagccctgtgtttgacaactgtgaagaatgaagacaagatggagttcagcagagttttggaggctattaaggctaacttcaatgacaagtatgaggagaacaggaagaagtggggtggtggtatcatgggctccaagtcacaggccaggactaaggccaaagagagggttcttgccaaggaagctgcccagagattgaactaagagcttgctgtgatctataagcttcgattggattagagttgctctgccaatttttgttttaggttcacaagcttgactgtgataaagatattagttcgatgataagtacttttatgtttgtcttttgcgaattatgcgaagaagcttaaaactttttcagaagattttgtcttgatatttttgtttgtgttttttttatggcattaaatttctcagttgaagtaaccacacttttcctgctta

SEQ ID NO: 4537 - DNA, 978 bp, Arabidopsis lyrata
cgctcttgctctccgccgtctgtctacctccagaaatcgacgactacaatggcacccaagaaaggagttaaagtagcttccaagaagaagccggagaaagttaccaacccattgtttgagagacgcccaaagcaattcggtatcggtggtgctttgcctcctaagaaggatctttctcgttacatcaaatggcctaagtcaatccgtcttcaaaggcagaagcgtatccttaagcagaggttgaaggttcctccagctcttaaccagtttaccaagactctcgataagaatctcgcaaccagcctcttcaagattcttttgaagtataggccagaggacaaagctgcaaagaaggatcgccttttgaagaaggctcaagctgaggctgaaggaaagcctgctgaatccaagaagcccattgttgttaagtatggtctcaaccacgtcacttacctcattgagcagaacaaggcgcagcttgtggtcattgcacacgatgttgaccctattgagttggtggtctggctacctgcactgtgcaggaaaatggaagtcccttactgcattgttaaggggaaatctcgtcttggagcggtcgttcaccagaagactgctgctgccttgtgcttgaccactgtcaagaacgaggacaagcttgagttcagcaaaatcctcgaggccatcaaggctaacttcaacgacaagtacgaggagtacaggaagaagtggggaggtggcataatgggatctaagtctcaagccaagaccaaagctaaggagagggttcttgctaaggaggctgcccagagattgaactaagcgatcctttagttctctgctatgaaacatatgataatgtttttgtttagcggtatttgaaaacctgtttcgtttttatttttaagctcttttggatgttacaacccgcttcaggattttatgcagttttgttatacatttcacttatcaacttttatt

SEQ ID NO: 4538 - DNA, 1048 bp, Arabidopsis thaliana
ataaatagtgaaaacacaaaaccctaagagtcgctcttgctctcagccgtctgtcttacctccagaagtcgacgacaacaatggcaccgaagaagggagttaaagtggcttcaaagaagaagccggagaaagttaccaacccattgtttgagagacgcccaaagcaattcggtattggtggcgctttgcctcctaagaaggatctttctcgttacatcaaatggcctaagtcaatccgtcttcaaaggcagaagcgtatccttaagcagaggttgaaggttcctccagctcttaaccagttcaccaagacccttgataagaatctcgccaccagcctcttcaagattcttctgaagtataggccagaggacaaagccgcaaagaaggaacgccttttgaacaaggctcaagctgaggcagaaggaaagcctgctgaatccaagaagcccattgttgttaagtatggtctcaaccatgtgacttacctcatcgagcagaacaaggcacagcttgtggtcattgcacacgatgttgaccctatcgagttggtggtctggttacctgcactctgcaggaaaatggaagtcccttactgcattgttaagggaaaatctcgtcttggagcggtcgttcaccagaagactgctgctgccttgtgcttgaccactgtcaagaacgaggacaagcttgagttcagcaaaatcctcgaggccatcaaggctaacttcaacgacaagtacgaggagtacaggaagaagtggggaggtggcataatgggatccaagtctcaagccaagaccaaagctaaggagagggttattgctaaggaggctgcccagagaatgaactaggcatcataccttatgttctctgctatgaaacatatgataatggttttgttgtttagcgatattttgaaaccttgttttattttaatttctatgctctttcggatgttaccaccctcttcagaattttatgcagttttgttatcaatttcacatataaacttttatttgcaaaataaatccttactttattgtggttt

SEQ ID NO: 4539 - DNA, 1027 bp, Brassica juncea
taacttcactcctttcttcggggactcagccgtccgtttccagagaccacgtcatttgggagtttgcagcacaggaagacgacgatggccccgaagaaaggagtgaagttagctgccaagaagaagacagagaaagtaacgaaccctctgttcgagaggaggcctaagcagtttggtattggaggagctcttcctccaaagaaggatcttactcgctacatcaaatggcctaagtccatccgtcttcagaggcagaagcgtatccttaagcagaggctcaaggtccctcctgctttgaaccagttcaccaagactcttgacaagaaccttgcaacccagcttttcaaggttcttatgaagtacaggccagaggacaaagccgcaaagaaggatcgtcttttgaaaaaggctcaagccgaggctgagggtaagccttctgaatccaagaagcccattgtcgtcaagtatggtctcaaccacgtgacttacctcatcgagcagaacaaggcacagcttgttgtcattgctcacgatgttgaccccattgagttggtcgtctggttacctgctctctgcagaaagatggaagttccttactgcattgttaaaggcaaatctcgtcttggaacggtggttcaccagaagactgctgcttgcttgtgtttgaccactgtcaagaacgaggacaagctagagttcagcaagatacttgaggccatcaaggcaaacttcaacgacaagtatgaggagtacaggaagaagtggggaggaggtataatgggatccaagtctcaagccaagaccaaagctaaggagagggttctcgccaaggaggctgcccagagaatgaactaagctgaaacttcattactgatgatggtggttttgtttagctatttcatggaatactctaagcctttatgctcttactatctcgatgttgcacacttgaggatattatgcagttttgctatacattttgctttctatttatttacctagttatcttttttaaaaggataactag

SEQ ID NO: 4540 - DNA, 965 bp, Brassica juncea
ctcccaagggtttcaatttcttctctctctcaggaacaaacatttgctgtggaaattgaaaatggccccaaagaaaggagtcaaagcggttaccaagaagaagccggagaaagtaacaaacccactctttgagaggcgtccaaagcagtttggaatcggaggagcattcccaccgaagaaggatctcaccagatacatcaaatggccgaagtcaatccgcctccagaggcagaagcgtattctgaagcagaggcttaaggtcccaccagcactcaaccagttcactaagacccttgacaagaacttagcgacttctctgttcaagattctgctcaagtataggcctgaggacaaggcagccaagaaggaacgtcttctcaagaaggctcagtctgaggctgagggaaagcctgttgaatcgaagaagccaattgttgtgaagtatggtcttaaccatgttacatacctcattgagcagaacaaggcgcaactggtggtaattgctcatgatgtggacccgattgagttggtcgtgtggttgcctgcgttgtgtaggaaaatggaagttccttactgcattgtcaagggaaagtcacggttgggaacgattgttaaccagaaaacagcagcttgcttgtgtttgacgacagtgaagaacgaggacaagatggaattcagcaaaatcctcgaggccattaaggcgaacttcaacgataagtatgaggagtacaggaagaagtggggaggtggaattatgggatccaagtctcaggccaagaccaaggctaaggagagagttctagccaaagaagctgctcagaggatgaattagacttgccttgattttacttctttggtggaatctagtttttcaacttaaaatgaaattttggtggaatctagtttttaaacttaaaatgaaattcttggatctctctagttctagcatttcctgcttgaatacc

SEQ ID NO: 4541 - DNA, 945 bp, Brassica oleracea
  misc_feature (724)..(724): n is a, c, g, or t
gaagttgagtcttcgccgtcagtctgtagcaatggcacccaaaaggggagtgaaggtggttacaaagaagaagacggagaaggttaccaacccgttgtttgagagaaggccaaagcaatttggtatcggtggtgctctccctcctaagaaggacttgactcgttacatcaaatggcccaagtccatccgtctccaaaggcagaagcgtatcctcaagcagaggctcaaggtccctcctgctttgaaccagttcaccaagactcttgacaagaaccttgcgacccagcttttcaagcttcttatgaagtacaggcctgaggacaaggccgcaaagaaggatcgtcttttgaaaaaggcccaagccgaggctgagggaaagccttctgaatccaagaagcccattgttgtcaagtacgggctcaaccacgtgacttacctcatcgagcagaacaaggcgcagcttgtcgtcattgctcacgatgttgaccccatcgagctggtcgtctggttacctgctctttgcagaaagatggaagtgccttactgcattgttaaaggcaaatctcgtcttggaacggttgttcaccagaagaccgctgcttgcttgtgcttgaccactgtcaagaacgaggacaagctcgagttcagcaaaatccttgaagccatcaaggcaaacttcaacgacaagtacgaggagtacaggaagaagtggggaggaggcatnatgggatccaagtctcaagccaagaccaaagctaaggagagggttcttgccaaggaggctgcccagagaatgaactaagcggagcatctcgtttgagttatggttttgtttagcgatttcatgggatatttcaaaactttatgctcttactatcgatgttgcacacttgaggattttatgcagtttttgttaagacattttacctttgagattatttactt

SEQ ID NO: 4542 - DNA, 1041 bp, Brassica rapa
aaacaccaaaccctaaattggagtctttctttgccactctccgccgtcccctctgtagcaatggcacccaagaagggagtgaaagttgttgccaagaaaaaaacggagaaggttacgaacccgttgtttgagagaaggccaaagcaattcggtatcggtggagctctccctcctaagaaggacttgactcgttacatcaaatggcctaagtccatccgtctccaaaggcagaagcgtatcctcaagcagaggctcaaggtccctcctgctttgaaccagttcaccaagactcttgacaagaacctcgcgacccagcttttcaagcttcttatgaagtacaggcctgaggacaaggctgcaaagaaggatcgtcttttgaaaaaggcccaagccgaggctgagggaaagccttctgaatccaagaagcccattgttgtcaagtatgggctcaaccacgtgacttacttgatcgagcagaacaaggcgcagcttgttgtcattgctcacgatgttgaccccattgagcttgtcgtctggttacctgctctttgcaggaagatggaagtgccttactgcattgttaaaggcaaatctcgtcttggaacggttgttcaccagaagaccgctgcttgcttgtgcttgaccactgtcaagaacgaggataagctcgagttcagcaaaatccttgaagctatcaaggcaaacttcaacgacaagtacgaggagtacaggaagaagtggggaggaggcataatgggatccaagtctcaagccaagaccaaagctaaggatagggttcttgccaaggaggctgcccagagaatgaactaagctgaaacttaatgattgacggtggttttgttttagcgatttcatggaatgttttgaaactttatgctcttactatcaatgttgcacacttattatattatgcagttttgttatacattccgctttctatttatttacgttgctatccttttttgcgacttaaaaccatgaattaaaaccataacatggcccgataaatataagttgtaa

SEQ ID NO: 4543 - DNA, 990 bp, Brassica rapa
attagcatctcagttctctctcaggaataaacagttgctgtggaaatcgaaaatggccccaaagaaaggagtcaaagcggttaccaagaagaaaccggagaaagtaacaaacccactctttgagaggcgtccaaagcagtttggaatcggaggagcattgccacccaagaaggatctcacgagatacatcaaatggccaaagtccatccgcctccagaggcagaagcgtattcttaagcagaggcttaaggtcccaccagcactcaaccagttcactaagacccttgacaagaacttagcaacttctctcttgaagattctcctcaagtataggcctgaggacaaagcagccaagaaggaacgtcttctcaaaaaggctcaggccgaggccgagggaaagcctgttgaatcgaagaagcctattgttgtgaagtatggtcttaaccatgttacatatctcattgagcagaacaaggcgcaactggtggtgattgctcatgatgtggatccgattgagttggttgtctggttgcctgctctgtgcaggaaaatggaggttccttactgcattatcaaggggaaatcaagattgggagcgattgttcaccagaaaacagcagcttgcttgtgtttgacaacagtgaagaacgaggacaagatggagttcagcaaagtccttgaggccattaaggcaaactttaatgacaaatatgaagagaaccggaagaagtggggaggagggataatgggatccaaatcacaggccaagacaaaggctaaagagagagttctagccaaggaagctgctcagaggatgaattaatctatagttttatattttgccttaaaaagtcttttgttttagctgttgggacctctatttacaccttatctttttcctttagtatcctatattacggaatataactttttgaaaagattcatattgcatatctaatgatctaaaagaagaaaagaaaagcatttttc

SEQ ID NO: 4544 - DNA, 1156 bp, Brassica rapa
ttttttgatcttattaaaataaaattatataacggaaaaataaagaagccctatcgattgtactgtatataaagcaaaaccctagaaacactcatttttcgacttgagcgccgtccgtttgcagaaaccacccatttggacgacgatggccccgaagaaaggagtcaaggttgctgccaagaagaagacggataaagtaacaaaccctctgtttgagagaaggcctaagcagtttggtataggtggagctcttcctcccaagaaggatcttactcgctacatcaaatggcccaagtctatccgtcttcaaaggcagaagaggatccttaagcagaggttgaaggtcccacctgcccttaaccagttcaccaagaccctcgacaagaatcttgcaaccagcctgttcaagatccttctcaagtacaggccagaggacaaagccgccaagaaagagcgacttgtcaagaaggctcaagctgaagctgagggaaagccttctgaatccaagaagcctattgttgtcaaatacggccttaaccatgtcacctacctcatcgagcagaacaaggcacagcttgttgtcattgctcatgatgtcgaccccatcgagttggtcgtttggttgcctgctctctgcaggaagatggaagtcccttactgcattgtcaaaggcaaatctcgtcttggagctgttgttcaccaaaagactgctgcttgcctgtgtttgactactgtcaagaacgaggacaagcttgagtttagcaaagtccttgaagccatcaaggcaaacttcaacgacaagtacgaagagtacaggaagaagtggggaggagggataatgggatccaaatcacaggccaagacaaaggccaaggaaagagttcttgcaaaggaggctgcccagaggaataactaattaaggaatctatcttttttgagtgtttagattgtctctcttttctttttagttggaactatcgttcgttatggatatgttttgcacccctgttcagacacttttcaagttttatcatcattttggtgtcggacacttcaacttgtgtgaaagcaaaattagcatcagagataattaacacaaaaaaatagattggtgtaaaatagaatacataaatgcttgaagatttaaaaaaagttt

SEQ ID NO: 4545 - DNA, 823 bp, Brassica napus
ggacttgagcgccgtccgtttgcagaaaccacccatttggacgacgatggccccgaagaaaggagtcaaggttgctgccaagaagaagacggataaagtaacaaaccctctctttgagagaaggcctaagcagtttggtataggtggagctcttcctcccaagaaggatctcactcgctacatcaaatggcccaagtccatccgtcttcaaaggcagaagcgcatccttaagcagaggttgaaggtcccacctgcccttaaccagttcaccaagaccctcgacaagaatcttgcaaccagcctgttcaagatccttctcaagtacaggccagaggacaaagccgccaagaaagagcgacttgtcaagaaggctcaagctgaagctgagggaaagccttctgaatccaagaagcctattgttgtcaaatacggccttaaccatgtcacctacctcatcgagcagaacaaggcacagcttgttgtcattgctcatgatgtcgaccccatcgagttggtcgtttggttgcctgctctctgcaggaagatggaagtcccttactgcattgtcaaaggcaaatctcgtcttggagctgttgttcaccaaaagactgctgcttgcctgtgtttgactactgtcaagaacgaggacaagcttgagtttagcaaagtccttgaagccatcaaggcaaacttcaacgacaagtacgaagagtacaggaagaagtggggaggagggataatgggatccaaatcacaggccaagacaaaggccaaggaaagagttcttgcaaaggaggctgcccagaggaataactaattaagg

SEQ ID NO: 4546 - DNA, 940 bp, Brassica napus
gacttcagcgccgtccgtttgcagaaaccactcatttggacgacgatggccccgaagaaaggagtcaaggttgctgccaagaagaagacggataaagtaacaaaccctctgtttgagagaaggcctaagcagtttggtataggtggagctcttcctcccaagaaggatctcactcgctacatcaaatggcccaagtctatccgtcttcaaaggcagaagcgcatccttaagcagaggttgaaggtcccacctgcccttaaccagttcaccaagaccctcgacaagaatcttgcaaccagcctcttcaagatccttctcaagtacaggccagaggacaaagccgccaagaaagagcgacttgtcaagaaggctcaagctgaagctgagggaaagccttctgaatccaagaagcctattgttgtcaaatacggccttaaccatgtcacctacctcatcgagcagaacaaggcacagcttgttgtcattgctcatgatgtcgaccccatcgagttggtcgtttggttgcctgctctctgcaggaagatggaagtcccttactgcattgtcaaaggcaaatctcgtcttggagctgttgttcaccaaaagactgctgcttgcctgtgtttgactactgtcaagaacgaggacaagcttgagtttagcaaagtccttgaagccatcaaggcaaacttcaacgacaagtacgaagagtacaggaagaagtggggaggagggataatgggatccaaatcacaggccaagacaaaggccaaggaaagagttcttgcaaaggaggctgcccagaggaataactaattaaggaatctatcttttttgattgtttagattgtctctcttttctttttagttggaactatcgttcgttatggatatgttttgtacccctcttcagacagttttcaagctttattatcatttt

SEQ ID NO: 4547 - DNA, 1931 bp, Brassica napus
aggtaatcatacaaacttcttcaggtttactgcagaaaccatcaaatagagaaagataaagagactccaaataaccctgagaaattcctcaacatcataatagataaacatagaacacaaacacacactcctctcaccattgcgctaaaactccgacttgaattgtgtaccaagatcccaagaagcgttaatcatctttgatgtgttcatgatgatgaggagcaacaccaataccatcttcatcaccatcatcatccccaccagtcttgacagtaacaacaggcccatcacgatgatcatcagggaatctaacaacaacaacagggcaaacacagtgatgaacacaataatcactaacagaccccaacctcccatcactccctttcttcttcttctcagcaccaaaccctctactccccataatcacagcgctgagccccagcctctcgatctccaaacacagcctctccctcatatcgtgatccttcactatatggatcttatacggaaacccactctccttcaagggtttcgccagatccgcgaccttggaggaagtgaaggcgtcgaagtcctcctggctaggctgaagggagggaggatcttgcggggctttgagggggagaggtccccagtcggcgccgtagaggacggaggttggggagacgtggaggaggacgacggcgtctccggggcggatgtagtggtccacggcccagcggacggcgaaggcgctttcgtaggataggtcgatcgcgacgccgattttgcggcgggcgccggcggtgggagttggggttgcggaggaggagtgtgtggttattctctgagcgtcttcatatgcactctgcaacttcttgttcccatgcaaagtagatgaccagacactgtacttgatgctcttgtggacatcatcttcactatacgatttaatcacaaaaaacttggcattggtgtaatcgagagcatctcagttctctctcaggaataaacagttgctgtggaaatcgaaaatggccccaaagaaaggagtcaaagcggttaccaagaagaaaccggagaaagtaacaaacccactctttgagaggcgtccaaagcagtttggaatcggaggagcattgccacccaagaaggatctcacgagatacatcaaatggccaaagtccatccgcctccagaggcagaagcgtattcttaagcagaggcttaaggtcccaccagcactcaaccagttcactaagacccttgacaagaacttagcaacttctctcttgaagattctcctcaagtataggcctgaggacaaagcagccaagaaggaacgtcttctcaaaaaggctcaggccgaggccgagggaaagcctgttgaatcgaagaagcctattgttgtgaagtatggtcttaaccatgttacatatctcattgagcagaacaaggcgcaactggtggtgattgctcatgatgtggatccgattgagttggttgtctggttgcctgctctgtgcaggaaaatggaggttccttactgcattatcaaggggaaatcaagattgggagcgattgttcaccagaaaacagcagcttgcttgtgtttgacaacagtgaagaacgaggacaagatggagttcagcaaagtccttgaggccattaaggcaaactttaatgacaaatatgaagagaaccggaagaagtggggaggagggataatgggatccaaatcacaggccaagactaaggctaaggagagagttctagccaaggaagctgctcagaggatgaattaatctagtttttaatattttgccttaaaaagtcttttgttttagctgttgggacctctctttacaccaccttgagtatcccatatttgacttgggctttacggaatataactttttgaaaagattcatattgcatagtctctgatggtc

SEQ ID NO: 4548 - DNA, 861 bp, Cynara scolymus
  misc_feature (57)..(57): n is a, c, g, or t
  misc_feature (85)..(85): n is a, c, g, or t
  misc_feature (211)..(211): n is a, c, g, or t
  misc_feature (243)..(243): n is a, c, g, or t
  misc_feature (250)..(250): n is a, c, g, or t
  misc_feature (382)..(382): n is a, c, g, or t
  misc_feature (403)..(403): n is a, c, g, or t
  misc_feature (680)..(680): n is a, c, g, or t
ctcgcggggatttgttttctcctcttcatcgccgctttgaaccggattctcacttcnatcaatgggtccaaagaaaggtggaaanccggttgcaactaagaagaaaacggagaaggtagtgaaccccttgttcgagaaaaggccgaagcaatttgggatcggtggagcattgccacctaagaaggatgttcatagatttgtgagatggccncaagttgttcgcattcagaggaagaggaggancctcaancagcgtttgaaggttccacctgctttgaatcagttcaccaagaccctcgacaagaatcttgcaacgactttgttcaagatgctgctcaagtacaggcctgaagataaagcagcaaaaaaggaacggctcctnaaaagggcacaggctgagtcngaagggaagacagcggaagccaagaagcctattgttgtcaagtatggtctgaaccatgtcacctacctcattgagcagaacaaggcacaattagtcatcattgcccatgatgtggaccccattgagttggttgtctggcttcctgcgttgtgcagaaagatggaaatcccttactgcattgtgaagggaaaatctcgattgggaactatcgtccatcagaaaactgcagcagctctgtgcttgactacagtcaagaatgaagacaagatggagttcngcagaatcttggaagcaatcaaggccaacttcaatgataagtatgaagaatacagaaagaagtggggtggtgggataatgggttcgaaatctcagggcgaaacaaaagcaaaggagagggttcttgccaggaggctgctcaaaggttgacataaagccctttcatatctatagtagtctgc

SEQ ID NO: 4549 - DNA, 844 bp, Flaveria ramosissima
gttgttcgagaagaggccgaagcagtttggaatcggtggagcattgcttccgaagaaggatctgcataggtttgtaagatggccccaagtggttcgtattcagaggaagaggaggattctcaagcagcggttgaaggtgcctcctgctttgaatcagttcaccaaaaccctagataaaaatctcgcaaccaacttgtttaagatgctgctcaagtaccgacccgaggataaggctgcaaagaaggaacgtcttcaaaaacgagctgctgcggaggacgaaggaaagacagtagaagcaaagaagcccattgttgtgaaatatggtctcaatcatgtcacatatctcattgagcagaacaaggcacagttggtcgtcattgctcatgatgtggacccaattgagttggttgtctggcttcctgctttgtgcaggaagatggagatcccttactgcattgtaaagggaaaatctcgacttggagctattgttcaccagaaaaccgcagcagctctgtgtttgactacagtcaagaacgaagataagatggagttcagccgaatcctggaagccattaaggccaacttcaatgacaagtatgatgagtacaggaagaagtggggtggtggaataatgggttccaaatctcaggcgaaaacaaaggccaaagagagggttttggcaaaggaggctgctcaaaggttgacttagatctcttagttatgtgtactgtatgcatttgaggtttttgagagctttgcctttagaaacctatgttttagaattctatttggttgcttgatacttttggaagttcaaatgtttgatgttagacttgctaatttc

SEQ ID NO: 4550 - DNA, 973 bp, Raphanus sativus
  misc_feature (52)..(52): n is a, c, g, or t
  misc_feature (177)..(177): n is a, c, g, or t
  misc_feature (312)..(312): n is a, c, g, or t
gactccagcgccgtccgtttgcagaaaccacccatttggacgaacatggccncgaagaaaggagtcaaggttcctaccaagaagaagacggaggaagtaacgaatcctctattcgaaaggaggcctaagcaatttggtattggtggagctcttcctcccaagaaggatcttacccgntacatcaaatggcccaagtctatccgtcttcaaaggcagaagaggatccttaagcagaggttgaaggtcccacctgcccttaatcagttcaccaagaccctcgacaagaatcttgcaaccagcctcttcaagatncttctcaagtataggccggaggacaaagccgccaagaaagagcgtcttgtcaagaaggctcaagctgaagctgagggaaagccttctgaatccaagaagcctattgttgtcaaatacggccttaaccatgtgacctacctcatcgagcagaacaaggcacagcttgttgtcattgctcatgatgtcgaccccatcgagttggtcgtctggttgcctgctctctgcaggaagatggaagtcccttactgcattgtcaaaggcaaatctcgtcttggagctgtggttcaccaaaagactgctgcttgcttgtgtttgaccactgtcaagaatgaggacaagcttgagttcagcaaaatcctcgaagccatcaaggcaaacttcaacgacaagtacgaagagtacaggaagaaatggggaggaggcataatgggatccaaatcacaggccaagacaaaggccaaggaaagagtacttgcaaaggaggctgcccagaggaataactaataaggatctttttgagtgtttagattgtctcttcaatttgttgttcaaaaaaggattctctttttttttgttggaagttggaactatcgtgtatggatgtgttttgcaccctcttcagacagtttttcaagctttatgatcattttggtctcaggca

SEQ ID NO: 4551 - DNA, 967 bp, Raphanus sativus
aggggaaatagagtcgtctttctttgccagctccccgccgtccctctgtagcaaaatggcacccaaaaagggagtgaaagctgttgccaagaagaaaacggagaaggtgacgaatccgttgtttgagagaaggccaaagcaattcggtatcggaggtgctttgcctcctaagaaggacttgacccgttacatcaaatggcccaagtccatccgtctccagaggcagaagcgtatccttaagcagaggctcaaggtccctcctgctttgaaccagttcaccaagactcttgacaagaaccttgcaacccagcttttcaaggttcttatgaagtacaggccagaggacaaggccgcaaagaaggatcgtcttttgaaaaaggctcaagccgaggctgagggaaagccttctgaatccaagaagcccattgtcgtcaagtatggtctcaaccacgtgacttacctcatcgagcagaacaaggcacagcttgttgtcattgctcacgatgttgaccccatcgagctcgtcgtctggttacctgctctttgcagaaagatggaagtgccttactgcattgtcaaaggcaaatctcgccttggaacggttgttcatcagaagactgctgcttgcttgtgcttgaccactgtcaagaatgaggacaagctcgagttcagcaaaatccttgaagccatcaaggcaaacttcaacgacaagtacgaggagtacaggaagaagtggggaggagggattatgggatccaagtctcaagccaagaccaaagctaaggagagggttcttgccaaggaggctgcccagagaatgaactaagcagaaactttattatgattgtggttttgtttagcggtttcatgaaatactctgaaactttatgctcttgctatcaatgttgcacacttgaggatattatatgcagttttgctatacattttgctttctacttatttatct

SEQ ID NO: 4552 - DNA, 971 bp, Raphanus sativus
  misc_feature (51)..(51): n is a, c, g, or t
  misc_feature (126)..(126): n is a, c, g, or t
  misc_feature (162)..(162): n is a, c, g, or t
ccgctctctccgccgtctgcttccaaaaatcgacaaacaccaatggcaccnaaaagaggagtgaaagtggttaccaagaagaagacggagaaggttacgaatccattgtttgagagaaggccaaancaattcggtatcggtggtgctttgcctcctaagaangacttgactcgttacatcaaatggcccaagtcaatccgtcttcaaaggcagaagcgtatccttaagcagaggctcaaggtcccaccggctttgaaccagttcaccaagactcttgacaagaaccttgcaacccagcttttcaaggtccttatgaagtatagaccagaggacaaagcggccaagaaggatcgtcttttgaagaaagctcaagccgaggctgagggaaagccatctgaatccaagaagcccattgtcgtcaagtacgggctcaaccacgtgacttacctcatcgagcagaacaaggcacagcttgttgtcattgcacacgatgttgaccccatcgagcttgttgtctggttacctgcactgtgcaggaagatggaagttccttactgcattgtcaaaggaaaatctcgtcttggaacggtcgttcaccagaagactgctgcttgcttgtgcttgactactgtcaagaacgaggacaagctcgagttcagcaaaatccttgaagccatcaaggcaaacttcaacgacaagtacgaggagtacaggaagaagtggggaggtgggataatgggatccaagtctcaagccaagaccaaagctaaggagagggttcttgccaaggaggctgcccagagaatgaactaagcagagcgtcttcacaacgatgatgatggttttgtttagcgatttaaatgaatgttttggaatttatgcttattatcgttgttgcacacttgagatatttaatcagttttgttagacattttgctttcgactttattaatatattgatccatgtttgc

SEQ ID NO: 4553 - DNA, 944 bp, Brassica juncea
cagccgtccgtttgagagaccacatcatttggagtgcagcacaggagagcgacgatggcccccaagaaaggagtgaaggtagctgccaagaagaagacggagaaagtaaccaaccctctatttgagaggaggccaaagcaatttggtattggtggtgctttgcctcctaagaaggacttgactcgttacatcaaatggcccaagtctatccgtctccagaggcagaagcgcatcctcaagcagaggctcaaggtccctccggcattgaaccagttcaccaagacccttgacaagaaccttgcaacccagcttttcaaggttctgatgaagtacaggccagaggacaaggccgctaagaaggatcgtcttctgaaaaaggctcaagccgaggctgagggggaagccttctgaatccaagaagcccattgtcgtcaagtatgggctcaaccacgtcacttacctcatcgagcagaacaaggcgcagcttgttgttattgcccacgatgttgaccccattgagttggtcgtctggttacctgctctttgcagaaagatggaagtgccttactgcattgttaaaggcaaatctcgtcttggaacggtcgttcaccagaagactgctgcttgcttgtgtttgaccactgtcaagaacgaggacaagctcgagttcagcaaaatccttgaagccatcaaggcaaacttcaatgacaagtacgaggagtacaggaagaagtggggaggcgggataatgggatccaagtctcaagccaagaccaaagctaaggagagggttcttgccaaggaggctgcccagagaatgaactaagcagagcttctctcgtttgagaaaacttcatgatgattatggttttgtttagcgatttcttgccatattttaaaactttatcctcttaccatctatgttgcacacttcaggtttttaa

SEQ ID NO: 4554 - DNA, 816 bp, Flaveria ramosissima
agaagaagacggagaaggtggtgaatccatgttcgaaaacggccgaagcagtttggaattggtggagctttgcctcctaaaaaggatctacacaggtttgtaagatggccacaagttgttcgaattcagaggaagaggaggatcctcaagcagcgtttgaaggtgccaccagcattgaaccagttcaccaagacccttgacaagaatcttgcaactactttgttcaagatgctactcaagtacaggccagaggataaagctgcaaaaaagacgtctttaaaaagggctcaggcagagtcagaggggaaaacaattgaagcgaagaaacccattgttgtgaagtatggtctcaaccatgtcacctatttaatcgagcagaacaaggcgcagttggtaatcattgcccatgatgttgatccaattgaattggttgtctggcttcccgccctctgcagaaagatggaaatcccctactgtattgtgaaaggcaaatcacgattaggagcaattgttcatcagaaaaccgctgcagcactatgcttgactacagtcaagaatgaagataaaatggaatttagccgaatattggaggccatcaaggcaaacttcaatgataagtatgatgagtataggaagaagtggggtggtggaatcatgggatcaaaatcacaggcaaagaccaaggcaaaagagagagttcttgctaaagaagctgctcagaggatgacttagggagtatttggtaatatttgagattttgagagttctttttttctaaacatgaaatattgtggtactctttagattgttgttctt

SEQ ID NO: 4555 - DNA, 1421 bp, Physcomitrella patens
tgtccactttcgctgctcaggtctgtagcagtttctcttccccagctccacttcccttcagacttcaatcatggctcctaagaggggtactcttaagactccggtcgcagcccccgcccaaaagaaacaggctccagtgaagactgtgaaccctctgttcgagaagaggccgaagcagtttggtattggaggagctctcccgcccaagcgggacctccaccggttcgtgaaatggcccaagtacgtgcgcattcagcgccagcgacgtgttttgaaccagcgtttgaaagtccctccggctctgaaccagttcacgaagactctggacaagaatcttgccacgagcttgttcaagttgttgttgaagtaccgacctgaggacaaggcggcgaagaaggagcggcttctgaacaaggcaaaggctgaggcagagggcaagagcgtggagtcgaagaagcctgtggtggtgaaatacggaatcaaccacatcacgtacctgatcgagcagaacaaggctcagctggtggtgatcgctcacgacgtggacccgatcgagctggtagtgtggctgccggcactttgccggaagatgggcgtgccgtactgcatcgtgaaggggaagtcgcggttgggacagattgtgcacgcgaagactgcaacagcgttgtgtttgacagcggtgaaaaacgaggacaagcacgagttttcgaagatcatcgaagcagtgaaggcgaacttcaatgagaagtacgacgagcatagaaggcattggggcggtggcatcatgggtgtcaagtcacaggccaagacgaagatcagagagcgaattcttgccaaggaggcagctcagagagcaacttaagttacatggcagcggcctgtgtagtttttttgatatggaatattgtgttcttcatgtgaagaattttgttaatataccatatcgaatctcagattcatccgtttcgggccatgaactgtgtgagctcctgtgtgaagctgatgaatttctgctttggattcagacaaatactccgaagttccgtttagtcttccgcaaatgccaaattcatattgatttcaaactccagcgggcttgtgtttcgtctccatggtcaccaccaatctaggaccactcacttctggagtaaatgaaatttattactatcggacttttacaggaatttggacagttgacaacgagagaaacatatatcggcatctcgacttcttggagtcattttttagtaacacacttctgcatttaataactagtcacacaaacacagttgacctgtacagagtcatgctttttggttacgtacgtatcggaagcgaggactctacgtgggagtggaatactgacgaactaaccacagaatgcgtacaagaactttctttaatcacaattcttctttgct

SEQ ID NO: 4556 - DNA, 1110 bp, Platanus occidentalis
cttgtttgtcatcgctttcgctcgctcatctttatttattagttcagatccataaattggtatcgaaatgtagtagcagtaattgatctgttttgttgatcatacacaaagtttgcttaaattataagagatggtgatgcttatattaatcattggagagtttttattggtattgactgatttttttgtttgtaattttattgtgctaaacttgcaggccccgaagagaggtggaaaagctcccgcagcaccagctaagaagaaaccggagaaggtcgtgaacccattgttcgagaagcgtccgaagcaatttggtattggaggggcattgcctccgaagagggatctgcaccggtttgtgaagtggcccaaggttgttcgcattcaaaggcagaggaggattctcaaacagaggttgaaggtccctccgaccttgaaccagttcacaaagacattggacaagaaccttgcaacaaacctattcaagatgcttctcaagtacagacctgaggacaaagctgcaaagaaggaacgtcttctgaaaagggctcaggccgaggcagaaggaaagactgttgaggttaagaagcctattgttgtgaaatatggactcaaccatgttacctacctgattgagcagaacaaggcacaattggtagttattgctcatgatgtggacccaatagagcttgttgtctggcttcctgccttgtgtaggaagatggaaatcccctactgcattgtgaagggaaaagcacgcttgggggcgattgttcacaagaaaactgctgctgtcttgtgtttgaccactgttaagaatgaggataagttcgagttcagcaaaatcttagaggcaatcaaggccaacttcaacgacaagtatgatgagtaccgaaagaagtggggaggcggtattatgggctccaaatcccaggccaaaactaaggccaaggagaggcttctcgccaaggaagctgctcagagaatgacctagcaggatttgtatcaccttttactctattattgtacttgaatcacagagggactttgcttcgtaagttctctttttgttgaagttccacctttttgtagctgcagtccaattagagc

SEQ ID NO: 4557 - DNA, 796 bp, Cirsium arvense
aactttcagccatgggtccaaagaaaggtggaaaggcggtaacaaccaagaagaagacggagaaggttgttaatccgttgttcgagaagaggcctaagcagtttgggattgggggagctttgcctcctaagaaggatgtgcataggttcgttagatggccgcaagttgttcgcattcagaggaagaggaggatcctcaagcagcgtttgaaggtcccacctgcattgaaccagtttaccaagaccctggacaagaatcttgcaactactttgttcaagatgctgctcaagtacaggccagaggacaaagctgcgaaaaaggaacgcctcctcaaaagagctcaagccgagtctgaaggaaagacagccgaagccaagaagcctattgttgtgaaatacggtctgaaccacgtcacctatctcattgagcagaacaaggcacaattagttatcattgctcatgatgtggatcccatcgagttggttgtctggcttcctgctttatgcagaaagatggaaatcccatactgcattgttaagggaaaatctcgtctaggaactatcgtccaccaaaaaaccgcagcagctttgtgcttgaccacggtcaagaacgaagataagatggagtttagccgaattttggaggccatcaaggctaacttcaatgacaagtatgaggagtataggaagaagtggggtggtggaataatgggttccaaatcccaggctaaaacaaaggctaaagagagggtttttggccaaggaggctgctcagaggttgaattagattgagtgag

SEQ ID NO: 4558 - DNA, 1122 bp, Arabidopsis lyrata
tatatatataaaaggcaaaaccctagcaaggcgatactcttcgactcagccgtcctttcgcataaaccatttggagttggaacttaggaggaggaggacgagccccgaagaaaggagttaaggtagctgcgaagaagaagacggagaaagttacaaaccctctattcgagaggaggcctaagcaattcggtattggtggagctttgcctcctaagaaggatctctctcgctacatcaaatggcccaaatccatccgtcttcaaaggcaaaagaggatccttaagcagaggttgaaggttcctccagctcttaaccaattcaccaagactcttgacaagaatcttgctaccagcctcttcaaggtccttctcaagtacaggccagaagacaaagctgccaagaaagagcgtcttgtcaaaaaggcccaagctgaagctgagggaaagccttccgagtctaagaagcccattgttgtcaaatacggcctcaaccatgtgacctacctcattgagcagaacaaggctcaacttgttgtcatcgctcatgatgttgacccaattgagttggttgtctggttgcctgctctgtgcaggaagatggaagtcccctactgcattgtcaagggcaaatctcgtcttggcgcggttgttcaccaaaagactgctgcttgcttgtgtttgaccactgtcaagaacgaggacaagctagagttcagcaaaatcctagaggctatcaaggctaacttcaatgacaagtacgaggagtacaggaagaaatggggaggaggcataatgggatcaaagtctcaggctaagaccaaggccaaggaaagagttcttgcaaaggaggctgcccaaaggctgaattaagagaggctagcttcttttgtttgtggtttgctcggattcttggaacttaatagagctttttgtttatctgtttcttgaagtactctttttagttgaacccttgtttttggatgtttgcactttcttcggacagtttcaatgttgttcaagctgctggatcctttttggtctctcaaccacttaaaactttacattatgaaattattgccaaaagcaaattgcattctgaggagagttataagtctaattctca

SEQ ID NO: 4559 - DNA, 721 bp, Flaveria ramosissima
ccgttgtttgagaaaaggccaaagcagtttggtattggtggagctttgccccctaaaaaggatcttcacaggtttgtaagatggcctcaagttgttcgaattcaaaggaagaggaggatcctcaagcagcgtttgaaggtcccaccagctttgaaccagtttaccaagacccttgacaagaatcttgcaactactttgttcaagatgctactcaaatacagacctgaggataaagcagcaaaaaaggaacgtcttttgaaaagagcacaggccgagtcagaggggaagacagttgaagcaaagaagccgattgttgtgaagtatggtctgaatcatgtcacttaccttattgagcagaataaggcacaattggtaatcattgctcatgatgttgatccaattgaattagttgtctggcttcctgcactttgcagaaagatggaaatcccctactgcattgtgaaagggaaatctcgattgggagctatcgttcaccagaaaaccgctgcagcactgtgcttgactacagtcaagaacgaagataaaatggaattcagcagaatattggaagccatcaaggcaaacttcaatgataagtatgatgagtataggaagaagtggggtggtgggataatgggatcgaaatcacaggccaagccaaggcaaaagcgagagttcttgccaaggcggctgctcagaggatgaattagcattgatcata

SEQ ID NO: 4560 - DNA, 1462 bp, Cannabis sativa
cacaattgagataggcttaatgggtttactatatatacactgatacaaaacctaacctatctcaagcactcatctcagccatcactcaaccccgccggcgtcctcagctcaaacaagaaaaaaaatgcctccaaagaagaccggaaaggcctcggccctctcgaagaagaagcctgagaaggttgtgaatccactgtttgagaagcgtcccaagcagttcggtattggaggagctttgccaccaaagagggatttacacagatttgtcaaatggccaaaggctgttcagctccagaggaagaagagaatccttaagcagaggttgaaggttccaccacagttgaatcagttcaccaagactttggacaaaaaccttggtatgatccagaacaacaggcctgaggacaaagccgaaaagaaggaacgtctagttaagcgtgctcaagctgaggctgaaggaaaaactgcagagaccaagaagcccatcgttgtgaaatacgggctaaaccacgtcacataccttattgagcagaacaaggcacaattggtagtgatcgctcacgatgtggacccaattgagttggttgtctggcttcctgccttgtgcagaaagatggagatcccatactgcattgtgaaggggaaatcccgtttgggatcgattgtccaccagaagacagcagctgcattgtgtttgaccactgtgaagaacgaggataagatggaattcagcaaaatccttgaggctattaaggccaacttcaatgacaaattcgacgagttccgaaagaagtggggcggtggcatcatgggtagtaaatcacaagcaaaaacaaaagccaaggaaagagttttggccaaggaagccgcacagagaatgaattaagactctgagcatttcttgttgtgacatttttcctcaaatatattgtcagtagtttttgatttctttgtgaaaaggaccatggagctgtttgaagtactacttagtgcgggtagttttttttggtattcttcatttgaggaaggaaccttagtggtatttacttttaatataaagtatttacctaatgaattttggttaaatgatttttcttttctttccatataattgccattagccactgattgatcattagacttcaagcgttattagtgttgttttatataagtcgtacttatcttacaaaggattattgccgagaaagagataatcagcatcatggtacttagagaagcagaggaacaactgataattgttatcataggaagggcatacaaatcttcttgcaaacatttcatatcagcgctcgtgtgtctcttaattaaaatattgcagtgtacctagaaatttgcctatcttttaccactgttctgttaccattgagtgttgtaatgactgaatatggttagatgagaaatgagacatgatcttgttactagatcaagttataacccacca

SEQ ID NO: 4561 - DNA, 971 bp, Brassica napus
agagtctccctttgaccctcttcgccgtcagtctgtagcaatggcacccaaaaagggagtgaaggtggttaccaagaagaagacggagaaggtaaccaacccgttgtttgagagaaggccaaagcaattcggtatcggtggagctctgcctcctaagaaggatctgactcgttacatcaaatggcccaagtccatccgtctccaaaggcagaagcgtatcctcaagcagaggctcaaggtccctcctgctttgaaccagttcaccaagactcttgacaagaaccttgcgacccagcttttcaaggttcttatgaagtacaggcctgaggacaaggccgcaaagaaggatcgtcttttgaaaaaggcccaagccgaggctgagggaaagccttctgaatccaagaagcctatcgttgtcaagtacgggctcaaccacgtgacttacctcatcgagcagaacaaggcgcagcttgtggtcattgctcacgatgttgaccccatcgagcttgtcgtctggttacctgctctttgcagaaagatggaagtgccttactgcattgttaaaggcaaatctcgtcttggaacggttgttcaccagaagaccgctgcttgcttgtgcttaaccactgtcaagaacgaggataagctcgagttcagcaaaatccttgaagccatcaaggcaaacttcaacgacaagtacgaggagtacaggaagaagtggggaggaggcataatgggatccaagtctcaagccaagaccaaagctaaggagagggttctcgccaaggaggctgcccagagaatgaactaagctgaaacttaatgattgacggtggttttgttttagcgatttcatggaatgttttgaaactttatgctcttactatcaatgttgcacacttgaggttgaggatattattattgcagttttgttatacattcccctttctatttatttggctagttatctt

SEQ ID NO: 4562 - DNA, 995 bp, Fraxinus spp
ctcaaaattgccggcgggagtggctaaaaagaaagcggataaggtagtgaatcctttattcgagaagcgcccgaagcaatttggaattggtggagcgttgccgccgaagaaggatctccaccgatttgtgaaatggccgcaagtggtgaggattcagcgcaagaagatgattttgaagcaacgccttaaagttccgccgccaattcaccagttctcgaaaaccctcgacaagaacctagcaacaagcttattcaagatgcttctcaagtacaggcctgaggatagagctcaaaagaaagagaggcttctaaaaagagctcaggctgaggctgaaggaaagacacctgaggttaagaagccaatcatagtgaaatatggtctcaaccatgtcacctatctgattgagcagaataaagctcaacttgttgtcattggtcatgatgtggagcccattgaattggttgtatggcttcctgcattgtgcaggaaaatggaaatcccttactgcatcgtgaagggaaaggcacgattgggaactattgtccataagaagacggcctctgtattgtgcttaacttcagtgaagaatgaagacaagatggacttcagcaggatcttggaagctattaaggccaacttcaatgacaaatatgatgagaccaggaagaagtggggtggtggagtaatgggctcaaaatcccaagccaagacaaaggccaaagagagactcatggccaaggaggctgcacagaggatgacttaggctttagtcttcccttactctgtcgaggatagaactgaatgagtgaaccttttacctgcctttgtataacatttttgtttccatttgatatttgattgacagatgacaggcttgattatctaagtatgctgatgttttggttttgtcaggtgtttagtcactaatttattattatgtatgttggacttggtgtggtgtataaggatatgctcgtcaattgtcttttgcaaaa

SEQ ID NO: 4563 - DNA, 913 bp, Fraxinus spp
cgcaaaattgccatcgggagtggctaaaaagaaggcggaaaaggtagtgaatcctctattcgagaagcggccgaagcaatttggaattggtggagcgttgccgccgaagaaggatctccaccgatttgtgaaatggcctcaagtggtgaggattcagcgcaagaagatgattttgaagcaacgccttaaggtcccgccgccaattcatcagttctcgaaaactctcgacaagaacttggcaacgagcttgttcaagatgcttctcaaatacaggcctgaggataaagctcaaaagaaagaaaggcttctgaaaagagctcaggctgaggctgaaggaaaaacacctgaggttaagaagccaatcattgtgaaatatggtctcaaccatgtcacatatctaattgagcagaacaaagctcaacttgttgtcattgcccatgacgttgagccgattgagttggtcgtatggcttcctgcattgtgcaggaaaatggaaatcccttactgcatcgtgaagggaaaggcacggttgggaactatagtccatcagaagacagcagctgtactgtgcttaacctcagttaagaatgaagacaagatggacttcagcaggatcttggaagctattaaggccaacttcaacgacaaatacgatgagaccaggaagaagtggggtggtggagttatgggctcaaaatcccaggccaagtcaaaggccaaagagagactcatggccaaggaagctgcacagaggatgacttaggctcttagtcctgccttttctatcaaggatagaaccaaatgagtgcttttaccttcccttttatgcttcaaatcatactagacatttttgtttccgcttaatatttgatagacgacaaggcattcttcattatctcaagtatatgccagt

SEQ ID NO: 4564 - DNA, 999 bp, Raphanus sativus
  misc_feature (422)..(422): n is a, c, g, or t
  misc_feature (437)..(437): n is a, c, g, or t
  misc_feature (497)..(497): n is a, c, g, or t
  misc_feature (543)..(543): n is a, c, g, or t
ctctctacggtttcagtttcttccctccctgtctcaggaacaaacagttgctgcggaaattgaaaatggccccaaagaaaggagtcaaagcggttaccaagaagaagccggagaaagtaacaaacccactttttgagaggcgtccaaaacagtttggaatcgggggagcattgccaccgaagaaggatctcacgagatacatcaaatggccaaagtccatccgcctccagaggcagaagcgtattcttaagcagaggcttaaggtcccaccagcactcaaccagttcaccaagacccttgacaagaacttagcaacttctctcttgaagattctcctcaagtataggcctgaggacaaggcagccaagaaggaacgtcttctcaagaaggctcagtctgaggccgagggaaagcctgttgantcgaagaagccaatngttgtgaagtatggtcttaaccatgttacatacctcattgagcagaacaaggcgcaactngtggtgattgctcatgatgtggacccgattgagttggttgtctggntgcctgcactctgcaggaaaatggaagttccttactgcattatcaaggggaaatcaagattgggagcgattgtccaccaaaaaacagcagcttgcttgtgtttgacaacagtgaagaacgaagacaagatggagttcagcaaagtccttgaggccattaaggcaaatttcaacgacaaatatgaagagaaccggaagaagtggggaggagggataatgggatccaaatcacaggccaagactaaggctaaagagagagttctagccaaagaagctgctcagaggatgaattagaccatcatcctaagatattcactttttttttcttttggatgaatctaatttttatgttttacatgaaagtttttgttttagcttatctttttgcttgaatgtttggactttactttttgagaagattgatatctaaaaaaaaagaaaagaagcatttctccga

SEQ ID NO: 4565 - DNA, 975 bp, Silene vulgaris
caacaatggccccgaaaagaggcgtcaaagcccctgttgtctccaaaaagaagcctgagaaagccgttaaccctctgtatgagaagcgtcccaagcagtttggtattggaggtgctatcccacccaagaaggatctcactagatttatcaaatggccaaaggtcgttcagcttcagagaaagaagagaattctcaagcagcgtttgaaggttccacctgccatcaatcaattcactaaggctcttgacaagaatcttgcctcaaaccttttcaagctgctgctcaagtacagacccgaagacaaggctgctaagaaggaaaggcttctgaaagctgctcaggctgaagctgaggggaaaaagcccgagatcaagaagcctgttgttgtgaaatacggccttaaccacattacttacttgattgagcagggtaaggctcagatggttgtgattgctcatgatgttgacccaatcgagctcgtggtttggctacctgctctttgccgcaaaatggaggtcccatactgcattgtcaagggaaaagcccgtctaggaactatcgttcacaagaagactgctgctgcattgtgcctgacatccgtgaaaaacgaagataagatggagttcagcagaattgttgaggcagtcaaggcaaacttcaacgacaagtatgatgagcacagaaagaaatggggaggtggaataatgggttcaaaatctcaggctaaaatgaaggctagggaaagagtcttggccaaggaagctgctcagaggttgaattaagtttaaatttgaatggtgttttgtgtctttgacgttcttcgtttgaccgtttttgtagtggattttgaaacacaactttcgcccatcactgaactactgcattttagctatgagattttcatcttttgcggatttatattactctttctaaggtacaccgggtgtaccagtacaccaagtgaccaaaccaatg

SEQ ID NO: 4566 - DNA, 1102 bp, Eutrema parvulum
ttgtcttctctttcgttagtctcttaaggtttcagtttcttctcttttgcgaaaaacagctgctgtggaaaatctgaaaatggccccaaagaaaggagtcaaagtggctaccaagaagaagccggagaaagtaacaaaccttctctttgagaggcgtccaaagcagtttgggatcggaggagcattaccaccgaaaaaggatctcacgagatacatcaaatggccaaagtccatccgcctccagaggcagaagcgtattctgaagcagaggttgaaggtcccaccagcactcaatcagtttactaagacccttgacaagaacttagcgacttctctgttcaaggttctccttaagtataggcctgaagacaaagcagccaagaaggaacgtcttctcaagaaggctcagtctgaggctgagggaaaacctgctgaatcgaagaagccaattgttgtgaagtatggtcttaaccacgtgacctacctcattgagcagaacaaggcacaattggtggtgattgctcatgatgtggacccgattgagttggtcgtttggttgcctgcattgtgcaggaaaatggaagttccttactgcattgtcaaggggaaatcacgcttgggagcgcttgtccaccagaaaacagcagcttgcttgtgtttgacgacagtgaagaacgaggacaagatggaattcagcaaactccttgaggccattaaggcgaactttaacgacaaatatgacgaataccggaagaagtggggaggtggaattatgggatccaaatctcaggccaagactaaggctaaggagagggtcctagccaaggaagctgctcagaggatgaattagactatcctgatttcaattttggaggaatctaatttgaagttttaatgaacgtctttgtcttagctgttgggatctctctatatattatcatatgtagcttttttttttgcttgaatatcgcatatttcgacttgggcttgacagtgttactttttgagaagattgaaaaattgaatatctgatgatccaaaagaagaaaagaaaatcatttctcagaacttgtgaagcttaatcgttgggggaagaatcttc

SEQ ID NO: 4567 - DNA, 1005 bp, Marchantia polymorpha
gacgccctccttgcgtttctgcacgacgatccgcaatggcacccaaaaggggtaacatcaagcccagtgtaccagcgcctgttgagaagaaaaaggtggtcgagaaagtcgccaaccctttgttcgagaagcgccccaagcaatttggtattggaggttctctcccgcctaagagggatcttcaccgattcgtgaagtggcccaagtatgtccgcattcaaagacaacgccgtgtcctgaaccagcgactgaaagtgcccccagccctcaaccagttcaccaaatgtttggacaagaatttggctgctggtctgtttaagatgcttttgaagtacaggcctgaggacaaggctgccaagaaggagcgtcttctgaagaaggctcaggctgaggctgagggaaagaccgtcgagaccaagaagcctattgttgtgaaatatggtctcaaccacgtcacttacctgattgaacagggtaaggcccagctcgttgttatcgctcacgatgtcgatcccattgagttggtggtgtggcttccagccttgtgtcgcaagatgggagtcccatatgctatcgtgaagggcaagtctagactcggtcaaattatccacagcaagactgcatccgctctttgcctaacctcagtaaagaatgaagacaaacatgacttcagcaagattgttgaggctgtgaaggctaacttcaacgaccgctatgatgagtaccgcaagcaatggggaggaggcatcatgggtgtcaagtcccaggctaagaccaagatcaaggagaaaattcttgccaaggaagctgctcaaagagcggcttagaggatgggttatagctttccctctagccgacagttttgcggaacatcatatgtatccgacatttttgaaccatccatatcacatgagtccagcgttttcatatccttgtgtccatctactcgcaatgaatgccgcagtttcaattcactgggacagtctattatcaacaatttgctgt

SEQ ID NO: 4568 - DNA, 3641 bp, Oryza sativa
caccctcaaatccccaaaaccccatagtagggtccaaaacgcaaaaaaaccccatccaccccttaccacctgccctaaactgccaaatccccaaaacccagggtgcaacacgcaaaaccgccacccccttcgcatttcgaaaaaagaaggccaccggccaccccaccaccacctccaccacgacgcacgcttcgagcgccgcttcgcctctccccgctccactctctctctctctccacagcgtttgtttttgctcgcgagaaaaaccctgcggaaaatcgaaaaatctcgcctcccctcttcgtcccctcccctcccctccccactcgccgccgaagcttccggtttttgttcctcctcctcgaaccctcgggagagatcgcgtggcttgagcagcgtttcttgctcggcggcggcggcggcggcggcggttgctagatctccggcgtgacaccggtcggaatgggctggatgtcgacggggacgacgttcgggcgttgatggcaggtgtggtgttcccatgattgatgatgtggagatactgggatggttcgagatgaagaaaatgcttgtgaggtgctctgttgagagaaaccttattacctgatgacttgttaattcgaagttattctagcacaccagttgctgctggttggatctttttctttcattgctgagtaggagcgtaggagttggttggttcaagaatttcgttcaagatgatgcagaggccgttccgtccggaggagtactccttgaaggagacttctcctcaccttggtggtggagctgctggtgacaagctcaccaccacctatgacttggttgagcagatgcagtatctttatgtccgggtagtaaaagctaaggaccttccaagcaaggacatcactggaagctgtgacccatatgttgaggtgaagcttgggaattataagggtacaactcggcatttcgagaagaagactaatcctgagtggaaccaggtctttgccttttctaaggagcgcattcagtcatcagtggttgagatcattgtcaaggataaggactttgtcaaggatgacttcatcgggcgggtgttgtttgacctgaatgaggtcccaaaacgagtgccacctgacagcccattggctccacagtggtatcggttggaagagcggaatggacacaaggtgaagggagagttgatgttggccgtttggatgggtactcaagcagatgaagcattccctgaagcttggcactctgatgcagcgtcgatcccaggagatggacttgcaagtattagatcaaaagtttaccttactccaaagctttggtatctgagagtcaatgtcattgaggcacaagatcttataccaaatgacaggaccaggttccctgatgtttatgtcaaagccatgctaggtaaccaagctcttagaacccgggtatcaccaagccggacgctgaatccaatgtggaatgaggatttaatgtttgttgctgctgaaccattcgaggaacacctgattctgagtgtagaagataggattgccccagggaaggatgatgtacttggaaggacaatcatttctctgcagcacgtacctcggaggctggatcacaagttgctgaacagccagtggtacaatcttgagaagcatgtaattgtggatggcgagcagaagaaagagaccaaattttcaagccggattcacttgagaatatgcctcgaaggtggatatcatgtcttggatgagtcaacacattacagcagtgatttgaggccaactgctaaacagttatggaagcacagcattggcattcttgagttgggtatcttgacagcacagggcctgttgccgatgaagaccaaggatgggcgtggaacaactgatgcttattgtgttgctaagtatgggcagaagtgggtgcggacaaggactattattgatagtttcacacccaagtggaatgaacaatacacttgggaggtgtatgatccctgcactgtgatcactattggtgtatttgacaattgccacttgaatggtggggaaaaagccaacggtgcccgggataccagaattgggaaggtccgcatccgcctctctacgctagaaactgatcgagtatatactcatgcttaccctctgattgttctgacacctgctggtgttaagaaaatgggggaggtgcagcttgctgtcaggttcacatgctcatcactgctgaacatgatgcatctgtattcacaaccattgctgcccaagatgcactatgtacacccattgtccgtgatgcaggtagacaatctaaggcgccaagccaccaacattgtatcaacaaggctgagccgtgcagaaccaccactgcggaaggaaattgtggagtacatgctggatgttgactctcatatgtggagcatgcggaagagcaaggcaaactttttccgtatcatgggtgtcctaagccctctgattgcggtggccaagtggtttgatcagatctgccattggagaaatccgctgaccaccatactgatccacattctctttgtgattttagtcttgtatcctgagctgatactgccaacaatcttcctctacctgttcctgattggagtgtggtactaccgctggcggccaaggcagccacctcacatggacactcgcctctcacatgcggagagtgctcatcctgatgagcttgatgaagagtttgacacattccctacttctcgtccgcctgacattgtgaggatgcgttatgaccggctacggagtgttgctgggaggatacagaccgtagtcggcgatctcgcgacacaaggagaaaggctgcagtccctgctaagctggagagacccaagagccacggcgctctttgtgaccttctgctttgttgctgccattgtcctctacgtgactccattccgtgttgtggtcttccttgcaggcctgtacaccttgagacacccaaggttccgccacaagatgccctctgttcctctgaacttcttcaggaggctccctgcaagaactgatagcatgttgtaagctcgactgcctcatgctatgctatcgagctgcccaggcgatggctgcaatgcataagaaattggagaaacctgaactcttatctattctcttttttgtagtctatcagttgcatggttatgtatgtcttcaggtggttttgaacctttcatgtaactgctgaacgcattatgtgactggatttgcatgtatggtgcgtgcgggaaatttgttcgtggtcatcacctgtcatcgggaggcttactgggcatgtcatctcatacatattgcattctgtataattccatcagatatgtgcccctgaatttaggctagttgtgttaaggatgatgactgacatttgggctgcaggaagaaatttgtgttaatctgtgctcggcaattctaagtgcaggcattaaccctgaccaatctgtggcccatcctgttgagtgatctgttgttttgtgatttgtgctgattgccttggagcctgaacaaattttttggcagcttcactatactatatgatgagcaggacaggacttcttgaacttcacattctgaggttctgagctgagtaaagttttatgtatccatttgcaatgaatatgctgt

SEQ ID NO: 4569 - DNA, 3057 bp, Hordeum vulgare
tgggctctccctcactcttccacactcttcccactctcacccgccccccaccctcgcttatccctctcagctctcgcctagggttcttgccgaggagaaaacccgagagatcgatccatgagggcggggaccgccggcggggagctgctccggcgtgcagatccggtggtcggccacctcaggatctgctgaaatccttcagcattgctcccttgctcctgttctccgactcccggccaacctctgcggattgcgagtatctccccctccgattccgtccttttcgggatcctcctcgtgaatcaggtcgcatgctggaatctggtggagaattttctcacgaaatgttcggttgaaagcgaccttgcctgaattgttgattgcaaagccattctggggaatcagtcattgttggctgtatctttcttcctttccgaccctgagtaggaattgtttggttcaagactgtcattcaagatgatgcagaggccattccgcccggaggagtactccttgaaggagactactcctcaccttggtggggcagctgcaggtgacaagctcaccaccacctatgacctggttgagcagatgcagtacctttatgttcgagtggtaaaagcgaaggaacttccaagtaaggacctcactggaagttgtgacccgtatgttgaggtgaagcttgggaattataagggcacaactcggcattttgaaaagaagaccaatcctgagtggaaccaggtgtttgccttctcaaaggagcgcattcaggcatcagtagtggagattatcgtcaaagataaagactttgttaaagatgactacattggacgggttatgtttgacctgaatgaggtcccaaagagagtgccacctgacagcccgttggctccacaatggtatcgcttggaagaacggaatgggcacaaggtcaaaggagagttgatgttagctgtttggatgggtactcaagcagatgaagcatttcctgaagcttggcactctgatgcggcatcaatccctggcgatggccttgcaagtattagatcaaaagtttatcttactcccaagctttggtatctgcgtgtcaatgtcattgaagcacaagatcttataccaaatgacaagaccagattccctgaggtttacgtcaaagcaatgttaggaaaccaggctcttagaacccgagtatcaccaggcaggactctgaatccaatgtggaatgaggacttgatgtttgttgcagctgagccgttcgaggagcacctgattttgagtgtagaagacaggattgctccaggcaaggatgatgtaattgggagaactgtcatttcactgcagcatgtagctcggaggctggaccacaagttgctgaacagccagtggtataatcttgagaagcatgtgatggtggatggcgaacagaggaaggagaccaagttctcaagcaggattcacttgagaatttgtcttgaaggtggatatcatgtcttggatgaatcgacgcattacagtagtgatctaaggccaactgccaaacagctgtggaagcataacattggggtccttgagctgggtatcttgactgcgcagggcctgttgcctatgaagacgaaggatggtcgaggcacgactgacccttattgtgttgctaagtatgggcagaaatgggtgcgtacaaggactatcattgatagtttcactcccaagtggaacgaacagtacacttgggaagttcatgatccatgcactgtgatcactattggtgtatttgacaactgccacttgaatggtggggaaaaggccaatggtgcacgggataccagaattgggaaggtccgcatccgcctctcaactctagaaactgatcgggtgtatacccactcataccctcttattgttttgacacctgctggcgttaagaaaatgggtgaggtacagcttgctgtccggttcacatgctcatcactgctcaacatgatgactctgtattcacagcccttgctgcccaagatgcactatgtacacccgttgtctgtgatccaggttgataacctaaggcgccaagcaaccaacattgtctcaacaaggctgagccgtgcagaaccaccactgcgaaaagaaattgtggagtacatgctggatgtggattctcacatgtggagcatgagaaagagcaaggcaaacttcttccgtatcatgggtgtcttgagccctctgattgcagttgctagatggtttgatcagatctgtcactggaggaacccactgacgactatactgatccatgtcctctttgtgatactggtcttgtatcctgagctgatactgcctacaatcttcctctacctattcctgattggagtgtggtattaccgctggcggtcgaggcagcctccgcacatggacactcgcctctcacatgcggagaccgcccatcctgatgagcttgatgaagagtttgacaccttccctacatctcgcccacctgacatcgtaaggatgcggtacgaccgcctccggagcgtcgctgggaggatccagactgttgttggtgatcttgcaacacaaggagagaggctgcagtctctgctgagctggagagacccgagggccaccgcactgtttgtgaccttctgcttcatcgctgcgatcgtcctgtacgtcacaccgttccgtgttgtggttttccttgcaggcctgtacaccctgaggcacccgaggttccgccacaagatgccgtctgttccgctgaacttcttcaggaggctgcctgcaaggaccgatagcatgctgtaaggtgcaaccgtctctctcgcttcgcgatccagcgccttacttgtttcggtggctcgatgcctagcatgttctatagctgcaactgagatgatgatggggtcgacgcgtggttgccgaaaaattgaactgaactatgtcgttgtttgtagccttttccgttgcctgtatgtctgtgttttaggatggttttgatcctttccagttaacgactgaaactcatgatgtgtgattagttattatgcatgtattgtgcca

SEQ ID NO: 4570 - DNA, 3321 bp, Hordeum vulgare
gctctccctcactcttccacactcttcccactctcacccgccccccaccctcgcttatccctctcagctctcgcctagggttcttgccgaggagaaaacccgagagatcgatccatgagggcggggaccgccggcggggagctgctccggcgtgcagatccggtggtcggccacctcaggatctgctgaaatccttcagcattgctcccttgctcctgttctccgactcccggccaacctctgcggattgcgagtatctccccctccgattccgtccttttcgggatcctcctcgtgaatcaggtcgcatgctggaatctggtggagaattttctcacgaaatgttcggttgaaagcgaccttgcctgaattgttgattgcaaagccattctggggaatcagtcattgttggctgtatctttcttcctttccgaccctgagtaggaattgtttggttcaagactgtcattcaagatgatgcagaggccattccgcccggaggagtactccttgaaggagactactcctcaccttggtggggcagctgcaggtgacaagctcaccaccacctatgacctggttgagcagatgcagtacctttatgttcgagtggtaaaagcgaaggaacttccaagtaaggacctcactggaagttgtgacccgtatgttgaggtgaagctcgggaattataagggcacaactcggcattttgaaaagaagaccaatcctgagtggaaccaggtgtttgccttctcaaaggagcgcattcaggcatcagtagtggagattatcgtcaaagataaagactttgttaaagatgactacattggacgggttatgtttgacctgaatgaggtcccaaagagagtgccacctgacagcccgttggctccacaatggtatcgcttggaagaacggaatgggcacaaggtcaaaggagagttgatgttagctgtttggatgggtactcaagcagatgaagcatttcctgaagcttggcactctgatgcggcatcaatccctggcgatggccttgcaagtattagatcaaaagtttatcttactcccaagctttggtatctgcgtgtcaatgtcattgaagcacaagatcttataccaaatgacaagaccagattccctgaggtttacgtcaaagcaatgttaggaaaccaggctcttagaacccgagtatcaccaggcaggactctgaatccaatgtggaatgaggacttgatgtttgttgcagctgagccgttcgaggagcacctgattttgagtgtagaagacaggattgctccaggcaaggatgatgtaattgggagaactgtcatttcactgcagcatgtagctcggaggctggaccacaagttgctgaacagccagtggtataatcttgagaagcatgtgatggtggatggcgaacagaggaaggagaccaagttctcaagcaggattcacttgagaatttgtcttgaaggtggatatcatgtcttggatgaatcgacgcattacagtagtgatctaaggccaactgccaaacagctgtggaagcataacattggggtccttgagctgggtatcttgactgcgcagggcctgttgcctatgaagacgaaggatggtcgaggcacgactgacccttattgtgttgctaagtatgggcagaaatgggtgcgtacaaggactatcattgatagtttcactcccaagtggaacgaacagtacacttgggaagttcatgatccatgcactgtgatcactattggtgtatttgacaactgccacttgaatggtggggaaaaggccaatggtgcacgggataccagaattgggaaggtccgcatccgcctctcaactctagaaactgatcgggtgtatacccactcataccctcttattgttttgacacctgctggcgttaagaaaatgggtgaggtacagcttgctgtccggttcacatgctcatcactgctcaacatgatgactctgtattcacagcccttgctgcccaagatgcactatgtacacccgttgtctgtgatccaggttgataacctaaggcgccaagcaaccaacattgtctcaacaaggctgagccgtgcagaaccaccactgcgaaaagaaattgtggagtacatgctggatgtggattctcacatgtggagcatgagaaagagcaaggcaaacttcttccgtatcatgggtgtcttgagccctctgattgcagttgctagatggtttgatcagatctgtcactggaggaacccactgacgactatactgatccatgtcctctttgtgatactggtcttgtatcctgagctgatactgcctacaatcttcctctacctattcctgattggagtgtggtattaccgctggcggtcgaggcagcctccgcacatggacactcgcctctcacatgcggagaccgcccatcctgatgagcttgatgaagagtttgacaccttccctacatctcgcccacctgacatcgtaaggatgcggtacgaccgcctccggagcgtcgctgggaggatccagactgttgttggtgatcttgcaacacaaggagagaggctgcagtctctgctgagctggagagacccgagggccaccgcactgtttgtgaccttctgcttcatcgctgcgatcgtcctgtacgtcacaccgttccgtgttgtggttttccttgcaggcctgtacaccctgaggcacccgaggttccgccacaagatgccgtctgttccgctgaacttcttcaggaggctgcctgcaaggaccgatagcatgctgtaaggtgcaaccgtctctctcgcttcgcgatccagcgccttacttgtttcggtggctcgatgcctagcatgttctatagctgcaactgagatgatgatggggtcgacgcgtggttgccgaaaaattgaactgaactatgtcgttgtttgtagccttttccgttgcctgtatgtctgtgttttaggatggttttgatcctttccagttaacgactgaaactcatgatgtgtgattagttattatgcatgtattgtgccatcacctgagcttctgctgtgccctatcatcttttgcatttgcatctcatgtctgcatgagaagattcagtgcgtgactgggaggctgggatactggattgattttttgctgaacgactgaagcgtgaactgaatccatgaggacattgtctgtcactgcatctgggttgggacaagtttcaggtcaagtatgtataagtagttgcgtgttgagtctttgcgcgctgcttatgtagcaaccacattcacagtttgtagccatcttcat

SEQ ID NO: 4571 - DNA, 3237 bp, Brachypodium distachyon
ccattgccgtttccttctgccaccccagtactccactccactccaccctctcttctctcttttctcttccacagcctcctttgtttttgctcgcaagaaaaaaccctgcgaaaatttgctggcttccaccaccgccgccgaggcttccaggtccttctccagccttccccagtccccgtgatggatcggatcggccaaccttgatgttcctcgaagatacgtgatgtagatgtttttccccacaggcaagatggagaaattgttcacaaaatgttctgccagtagcaatcttacctgacttgttgcaaagctattctggggtaacaatcgctgttgggggatttccttttcttttcctgttcctgactcctgagtattagttacttggtggagaattgtcattcaagatgatgcagaggccattccgtccagaggagtactccttgaaggagacttctcctcaccttggaggtgcagctgcaggtgacaaactcaccaccacctatgacctggtcgagcagatgcagtacctttatgttcgggtggtaaaagcaaaggaactgccaagtaaagacatcagtggaagctgtgacccatatgttgaggtgaagcttgggaactataagggcacaactcggcatttcgagaaaaagaccaatcctgagtggaaccaggtatttgccttctcaaaggagcgcattcaggcatcagtagtggaaatcatcgtcaaagataaagactttgtcaaggatgactacattggacgagttttatttgacctgaatgaagtcccgaagcgagtgccacctgacagcccgttggccccacaatggtataggttggaagaacggaatgggcacaaggtgaagggagagttgatgttagctgtttggatgggtactcaagcagacgaagcattccctgaagcatggcattctgatgcggcgtcaatccctggcgatggacttgcaagcattagatcaaaagtttatcttactcccaagctttggtatttgcgtgtcaatgtcattgaagcacaagatcttatgccaaatgataagaccaggttccctgaggtctacgtcaaagcaatgctaggcaatcaagctcttagaacaagggtatcaccaggcagaacactgaacccgatgtggaacgaggacttgatgtttgttgcagctgaaccatttgaagagcacctgattttgaatgtagaagacaggattgccccagggaaggatgatgtgattgggagaactgtcatttccctgcagcatgtagctcggaggctggattacaagttgctgaacagccaatggtataatcttgagaagcacgtgattgtggatggtgagcagaagaaggagaccaagttttcaagcaggattcacttgagaatttgccttgaaggtggatatcatgtcttggatgagtcgacacattacagtagtgatctaaggccaactgcaaaacagctgtggaagcataacattggtgtccttgagctgggtatcttgacagctcagggcctgttgcctatgaagacaaaggatgggcgtggcacaactgatccttactgtgtggctaagtatggacagaaatgggtccggacaaggactatcattgatagtttcacacccaagtggaatgaacagtacacttgggaggtgcatgatccatgcactgtgatcacaattggtgtatttgacaattgccacttgaatggtggggagaaagctaatggtgcccgggataccagaattgggaaggtccgcatccgcctctcaacacttgaaactgatcgagtatatacccactcataccctcttattgttttgacacccggtggcgttaagaaaatgggtgaggtacaacttgctgtccggttcacatgctcgtcgctgctaaacatgatgcatctttattcacaacccttgcttccaaagatgcactatatacaaccactgtctgtgattcaggtagacaatctaaggcgccaagccaccaacattgtctcaacaaggctgagccgtgcagaaccaccgctccgaaaagaaattgtggagtacatgctggatgtggattcccatatgtggagcatgagaaagagcaaggcaaactttttccgtatcatgggtgtcttgagccctctgattgcggtggctagatggtttgatcagatctgtcactggaggaacccactgaccactatactgatccatgtcctgtttgtgatattggtcttgtatcctgagttgatattgcctacaatcttcctgtacctgttcctgattggagtgtggtactaccggtggcggccgaggcagcctccgcacatggacactcgcctctcacatgcggagactgcgcatcctgatgagcttgatgaagagtttgacaccttcccaacatctcgtccacctgacattgtcagggtgcgttatgaccgcctccgcagtgttgctgggaggatacaaactgttgtcggtgatcttgcgacacaaggagaaaggctgcagtctttgctgagctggagagacccaagagccactgcactgtttgtgaccttctgcttcatcgctgcgattgtcctgtatgtcactccgttccgtgttgtggtcttccttgcagggctgtacaccttgagacacccgaggttccgccacaagatgccgtctgtcccgctgaacttcttcaggagactgccagcaagaactgatagcatgctctaatgtgacacctcttgctctgtgatgcggtttcttcctcgttttggcggatctatgctgcgcatgtactactagtagttgcagctcaggctgatgatcgattcgatgtccaacaatgaactgctacctgtcattttccgtagtatttcagttgcatggtttgtctgtgctttcggatggttttgaacctttcctgtaacaacggaaacgtatggtgtgtgactagttattatgtatggtgtgcctgaagaatagtgttctcaggtcaggtcttcagttgtgctccttagtatcatcttcattgcatttacagccattgacctgcatgaaatgattctagtttgtgcacttcagaccgctagtgttgaaggatgaacctgcgttgttttgctgttaatttgcccccgttctgcacaaattccaagtattgtgtcgtaacctgaagcctgcgtgcctggtgcagttgatgcttgaagttaattcttatccctgaagttactgtgacgtt

SEQ ID NO: 4572 - DNA, 3066 bp, Secale cereale
gctttccctcactcttccacactcttcctcagtcttcccactctcatcccctctcgcttatccctctcggctcccacctagggttcttgccgaggagaagacccaagagatcgatccatgagggtggcgaccgccggcggggagccgctccggcgtgtagatccggtgttcggccacctcaagatctgctgaaatcattcagcattgcccccttgctcgtgctctcgactcctggccaacctctgctgattgcgaatatctcctcctccgattccgtcctttccgagatccctcgttgttcagatcgcgtgagggaatctgatggagaattttctcacgaaatgtttggttgaaagcgaccttgcctgaattgctgattgtaaagctattctggggaatcagtcgctattggctgtatctttcttccttttccgatcctgagtagaaattgtttggttgaagactgtcattcaagatgatgcagaggccattccgcccggaggagtactccttgaaggagactactcctcaccttggtggagcagctgcaggtgacaagctcaccaccacctatgacctggttgagcagatgcagtacctttatgttcgagtggtaaaagcgaaggaacttccagctaaggacctcactggaagttgtgacccgtatgttgaggtgaagcttgggaattataagggcacaactcggcattttgagaagaagaccaatcctgagtggaaccaggtgtttgccttctcaaaggagcgcattcaggcatcagtagtggagattatcgtcaaagataaagactttgttaaagatgactacattggacgtgttatgtttgacctgaatgaggtcccaaagcgagttccacctgacagcccgttggctccacaatggtatcgcttggaagaacggaatgggcacaaggtcaaaggagagttgatgttagctgtttggatgggtactcaagcagatgaagcatttcctgaagcttggcactctgatgcggcgtcaatccctggcgatggccttgcaagtattagatcaaaagtttatcttactcccaagctttggtatctgcgtgtcaatgtcattgaagcacaagatcttataccaaatgacaagaccaggttccctgaggtttatgtcaaagcaatgttaggaaaccaggctcttagaacccgagtatcaccaggcaggactctgaatccaatgtggaatgaggacttgatgtttgttgcagctgagccgttcgaggagcacctgattttgagtgtagaagacaggattgctccaggaaaggatgatgtaattgggagaactgtcatttcactgcagcatgtagctcggaggctggaccacaagttgctgaacagccagtggtataatcttgagaagcatgtgatggtggatggtgagcagaggaaggagaccaagttctcaagcaggattcacttgagaatttgtcttgaaggtggatatcatgtcttggatgaatcgacacattacagtagtgatcttaggccaactgcaaaacagctgtggaagcataacatcggggtccttgagctgggtatcttgacagcgcagggcctgttgcctatgaagacgaaggatggacgcggcacgactgatccttactgtgtcgctaagtatgggcagaaatgggtgcgtacaaggactatcattgatagtttcactcccaaatggaacgaacagtacacttgggaagtgcatgatccatgcactgtgatcactattggtgtatttgacaattgccacttgaatggcggggaaaaggctaatggtgcacgggataccagaattgggaaggtccgcatccgtctctcaacactagaaactgatcgggtgtatacccactcataccctcttattgttttgacacctgctggcgttaagaaaatgggtgaggtacagcttgctgtccggttcacatgctcatcactgctcaacatgatgactctgtattcacagcccttgctgcccaagatgcactatgtacacccgctgtccgtgatccaggttgataacctaagacgtcaagcaaccaacattgtctcaacaaggctgagccgtgcagaaccgccactgcgaaaagaaattgtggagtacatgctggatgtggattctcacatgtggagcatgagaaagagcaaggcaaacttctttcgtatcatgggtgtcttgagtcctctgattgcagttgctaggtggtttgatcagatctgtcactggaggaacccactgacgactatactgatccatgtcctctttgtgatactggtcttgtatcctgagctgatactgcctacaatctttctctacctattcctgattggagtgtggtactaccggtggcggtcgaggcagcctccgcacatggacactcgcctctcacatgcggagaccgcccatcctgatgagcttgatgaagagtttgacaccttccctacatcacgcccacctgacatcgtaaggatgcggtacgaccgcctccggagcgtcgctgggaggatccagactgttgttggtgatcttgcaacacaaggagagaggctgcagtctctgctgagctggagagacccaagggccaccgcactgtttgtgaccttctgcttcatcgcggcgatcgtcctgtacgtcacaccgttccgcgttgtggtcttccttgcaggcctgtacaccctgaggcacccgaggttccgccacaagatgccgtctgtcccgctgaacttcttcaggaggctgccggcaaggactgatagcatgctgtaaggtgcaaccgtctctttcgctccgcggtccggcgccttccttgtttcggtggctcgatgctgagcatgttctatagctgcaactgagatgatgctggggtcgaagcgcggttgccaaaaaattgaactgaaccatgtcgttgtttgtagtcttttcagttacctgtgtgtctgttttgggacggttttgaacctttcctgttgacgactgaaacgcctgatgtgtgactagttattatgcatgtatgccgcctgaagaaattgtgc

SEQ ID NO: 4573 - DNA, 3099 bp, Secale cereale
tccccacgccgatgagaaaagccaccccggggcccaccctgtccgccgctttccctcactcttccacactcttcctcagtcttcccactctcatcccctctcgcttatccctctcggctcccacctagggttcttgccgaggagaagacccaagagatcgatccatgagggtggcgaccgccggcggggagccgctccggcgtgtagatccggtgttcggccacctcaagatctgctagaaatcattcagcattgcccccttgctcgtgctctcgactcctggccaacctctgctgattgcgaatatctcctcctccgattccgtcctttccgagatcccccgttgttcagatcgcgtgagggaatctgatagagaattttctcacgaaatgttcggttgaaagcgaccttgcctgaattgctgattgcaaagctattctggggaatcagtcgctgttggctgtatctttcttccttttccgatcctgagtagaaattgtttggttgaagactgtcattcaagatgatgcagaggccattccgcccggaggagtactccttgaaggagactactcctcaccttggtggagcagctgcaggtgacaagctcaccaccacctatgacctggttgagcagatgcagtacctttatgttcgagtggtaaaagcaaaggaacttccagctaaggacctcactggaagttgtgacccgtatgttgaggtgaagcttggcaattataagggcacaactcggcattttgagaagaagaccaatcctgagtggaaccaggtgtttgccttctcaaaggagcgcattcaggcatcagtagtggagattatcgtcaaagataaagactttgttaaagatgactacattggacgggttatgtttgacctgaatgaggtaccaaagcgagttccacctgacagcccgttggctccacaatggtatcgcttggaagaacggaatgggcacaaggtcaaaggagagttgatgttagctgtttggatgggtactcaagcagatgaagcatttcctgaagcttggcactctgatgcggcgtcaatccctggtgatggccttgcaagtattagatcaaaagtttatcttactcccaagctttggtatctgcgtgtcaatgtcattgaagcacaagatcttataccaaatgacaagaccaggttccctgaggtttacgtcaaagcaatgttaggaaaccaggctcttagaacccgagtatcaccaggcaggactctgaatccaatgtggaatgaggacttgatgtttgttgcagctgagccgttcgaggagcacctgattttgagtgtagaagacaggattgctccaggaaaggatgatgtaattgggagaaccgtcatttcactgcagcatgtagctcggaggctggaccacaagttgctgaacagccagtggtataatcttgagaagcatgtgatggtggatggtgagcagaggaaggagaccaagttctcaagcaggattcacttgagaatttgtcttgaaggtggatatcatgtcttggatgaatcgacacattacagtagtgatcttaggccaactgcaaaacagctgtggaagcataacatcggggtccttgagctgggtatcttgacagcgcagggcctgttgcctatgaagacgaaggatggacgcggcacgactgacccttactgtgtcgctaagtatgggcagaaatgggtgcgtacaaggactatcattgatagtttcactcccaaatggaacgaacagtacacttgggaagtgcatgatccatgcactgtgatcactattggtgtatttgacaattgccacttgaatggcggagaaaaggctaatggtgcacgggataccagaattgggaaggtccgcatccgcctctcaacgctagaaactgatcgggtgtatacccactcataccctcttattgttttgacacctgctggtgttaagaaaatgggtgaggtacagcttgctgtccggttcacatgctcatcactgctcaacatgatgactctgtattcacagcccttgctgcccaagatgcactatgtacacccgctgtccgtgatccaggttgataacctaagacgtcaagcaaccaacattgtctcaacaaggctgagccgtgcagaaccgccactgcgaaaagaaattgtggagtacatgctggatgtggattctcacatgtggagcatgagaaagagcaaggcaaacttcttccgtatcatgggtgtcttgagtcctctgattgcagttgctaggtggtttgatcagatctgtcactggaggaacccactgacgactatactgatccatgtcctgtttgtgatactggtcttgtatcctgagctgatactgcctacaatctttctctacttattcctgattggagtgtggtattaccggtggcggtcgaggcagcctccgcacatggacactcgcctctcacatgcggagaccgcccatcctgatgagcttgatgaagagtttgacaccttccctacatctcgcccacctgacatcgtaaggatgcggtatgaccgcctccggagcgtcgctgggaggatccagactgttgttggtgatcttgcaacacaaggagagaggctgcagtctcttctgagctggagagacccaagggccaccgcactgtttgtgaccttctgcttcatcgcggcgatcgtcctgtacgtcacaccgttccgtgttgtggtcttccttgcaggcctgtacaccctgaggcacccgaggttccgccacaagatgccgtctgtcccgctgaacttcttcaggaggctgccagcaaggaccgatagcatgctgtaaggtgcaaccgtctctcttgctccgcggtccggcgccttccttgtttcggtggctcgatgctgagcatgttctatagctgcaactgagatgatgctggggtcgaagcgcggttgccaaaaaattgaactgaaccatgtcgttgtttgtagtcttttcagttacctgtgtgtctgttttgggacggttttgaacctttcctgttgacgactgaaacgcctgatgtgtgactagttattatgcatgtatgccgc

SEQ ID NO: 4574 - DNA, 3080 bp, Triticum aestivum
ggttttccctcactcttccacactcttcctcagtcgtcccactctctcgcttatccctctcggctcccacctagggttcttgccgaggagaagacccaagagatcgatccatgcgagtgcctaccgccggcggggaaccgctccggcgtgcagatccggtggtcggccacctcaagatctgctgaaatctttcagcattgctcccttgctcctgttcccgactcctggccaacctctgctgattgcgaatatctcctcctccgattccgtcctttccgagatcccccgttgttcagatcgcgtgctggaatctgatggagaatttcctcacgaaatgttcggttgaaagcgaccttgcctgaattgttgattgcaaagctattctggggaatcagtcgctattggctgtatctttcttccttttccgacctgagtagagattgtttggttgaagactgtcattcaagatgatgcagaggccattccgcccggaggagtactccttgaaggagactactcctcaccttggtggagcagctgcaggtgacaagctcaccaccacctatgacctggttgagcagatgcagtacctttatgttcgagtggtaaaagcgaaggaacttccagctaaggacctcactggaagttgtgacccgtatgttgaggtgaagcttgggaattataagggcacaactcggcattttgagaagaagaccaatcctgagtggaaccaggtgtttgccttctcaaaggagcgcattcaggcatcagtagtggagattattgtcaaagataaagactttgttaaagatgactacattggacgggttatgtttgacctgaatgaggtcccaaagcgagttccacctgacagcccgttggctccacaatggtatcgcttggaagaacggaatgggcacaaggtcaaaggagagttgatgttagctgtttggatgggtactcaagcagatgaagcatttcctgaagcttggcactctgatgctgcgtcaatccctggcgatggccttgcaagtattagatcaaaagtttatcttactcccaagctttggtatctgcgtgtcaatgtcattgaagcacaagatcttataccaaatgacaagaccaggttccctgaggtttacgtcaaagcaatgttaggaaaccaggctcttagaacccgagtatcaccaggcaggactctgaatccaatgtggaatgaggatttgatgtttgttgcagctgagccattcgaggagcacctgattttgagtgtggaagacaggattgctccaggaaaggatgatgtaattgggagaactgtcatttcactgcagcatgtagctcggaggctggaccacaagttgctgaacagccagtggtataatcttgagaagcatgtgatggtggatggtgagcagaggaaggagaccaagttctcaagcaggattcacttgagaatttgtcttgaaggtgggtatcatgtcttggatgaatcgacacattacagtagtgatctaaggccaactgccaaacagctgtggaagcataacattggggtccttgagctgggtatcttgactgcacagggcctgttgcctatgaagacgaaggatggacgcggcacgactgacccttattgtgttgctaagtatgggcagaaatgggtgcgtacaaggactatcattgatagtttcactcccaagtggaatgaacagtacacttgggaagtgcatgatccatgcactgtgatcactattggtgtatttgacaactgccacttgaatggcggggaaaaggctaatggtgcacgggataccagaattggcaaggtccgcatccgcctctcaacgctagaaactgatcgggtgtatacccactcataccctcttattgttttgacacctgctggcgttaagaaaatgggtgaggtacagcttgctgtccggttcacatgctcatcactgctcaacatgatgactctgtattcacagcccttgctgcccaagatgcactatatacacccgttgtctgtgatccaggttgataacctaagacgccaagcaaccaacattgtctcaacaaggctgagccgtgcagaaccgccactgcgaaaagaaattgtggagtacatgctggatgtggattctcacatgtggagcatgagaaagagcaaggcaaacttcttccgtatcatgggtgtcttgagccctctgattgcagttgctaggtggttcgatcagatctgtcactggaggaacccactgacaactatactgatccatgtcctgtttgtgatactggtcttgtatcctgagctgatactgcctacaatctttctctacctattcctgattggagtgtggtactaccggtggcggtcgaggcagcctccgcacatggacactcgcctctcacatgcggagaccgcccatcctgacgagcttgatgaagagtttgacaccttccctacatctcgcccacctgacatcgtcaggatgcggtatgaccgcctccggagcgttgctgggaggatccagactgttgttggtgatcttgcaacacaaggagaaagactgcagtctctgctgagctggagagacccaagggccaccgcgctgtttgtgaccttctgcttcatcgctgcgatcgtcctgtacgtcacaccattccgcgttgtggtcttccttgcaggcctgtacaccctgaggcacccgaggttccgccacaagatgccgtctgtcccgctgaacttcttcaggaggctgccggcaaggactgatagcatgctgtaaggtgcaaccgtctctctcgctccgtgatccggcgccttccttgtttcggtggctcgatgctgagcatgttctatagctgcaactgagatgatgctggggtcgaagcgcggttgccaaaaaattgaactgaactatgtcgttgtttgtagtcttttcagttgcctgtgtgctgttttgggacggttttgaacctttcttgttaacgactgaaatgcttgatgtgtgactagttattatgcatgtatgccgcctgaagaaattgtgccatcacctgagcttctgctgtgc

SEQ ID NO: 4575 - DNA, 3365 bp, Triticum aestivum
tctccacgccgatgagaaaagccaccccggggcccaccttgtccgccgctttccctcactcttccacactcttcctcagtcgtcccactctctcgcttatccctctcggctcccacctagggttcttgccgaggagaagacccaagagatcgatccatgcgagtgcctaccgccggcggggaaccgctccggcgtgcagatccggtggtcggccacctcaagatctgctgaaatctttcagcattgctcccttgctcctgttcccgactcctggccaacctctgctgattgcgaatatctcctcctccgattccgtcctttccgagatcccccgttgttcagatcgcgtgctggaatctgatggagaatttcctcacgaaatgttcggttgaaagcgaccttgcctgaattgttgattgcaaagctattctggggaatcagtcgctattggctgtatctttcttccttttccgacctgagtagagattgtttggttgaagactgtcattcaagatgatgcagaggccattccgcccggaggagtactccttgaaggagactactcctcaccttggtggagcagctgcaggtgacaagctcaccaccacctatgacctggttgagcagatgcagtacctttatgttcgagtggtaaaagcgaaggaacttccagctaaggacctcactggaagttgtgacccgtatgttgaggtgaagcttgggaattataagggcacaactcggcattttgagaagaagaccaatcctgagtggaaccaggtgtttgccttctcaaaggagcgcattcaggcatcagtagtggagattattgtcaaagataaagactttgttaaagatgactacattggacgggttatgtttgacctgaatgaggtcccaaagcgagttccacctgacagcccgttggctccacaatggtatcgcttggaagaacggaatgggcacaaggtcaaaggagagttgatgttagctgtttggatgggtactcaagcagatgaagcatttcctgaagcttggcactctgatgctgcgtcaatccctggcgatggccttgcaagtattagatcaaaagtttatcttactcccaagctttggtatctgcgtgtcaatgtcattgaagcacaagatcttataccaaatgacaagaccaggttccctgaggtttacgtcaaagcaatgttaggaaaccaggctcttagaacccgagtatcaccaggcaggactctgaatccaatgtggaatgaggatttgatgtttgttgcagctgagccattcgaggagcacctgattttgagtgtggaagacaggattgctccaggaaaggatgatgtaattgggagaactgtcatttcactgcagcatgtagctcggaggctggaccacaagttgctgaacagccagtggtataatcttgagaagcatgtgatggtggatggtgagcagaggaaggagaccaagttctcaagcaggattcacttgagaatttgtcttgaaggtgggtatcatgtcttggatgaatcgacacattacagtagtgatctaaggccaactgccaaacagctgtggaagcataacattggggtccttgagctgggtatcttgactgcacagggcctgttgcctatgaagacgaaggatggacgcggcacgactgacccttattgtgttgctaagtatgggcagaaatgggtgcgtacaaggactatcattgatagtttcactcccaagtggaatgaacagtacacttgggaagtgcatgatccatgcactgtgatcaccattggtgtatttgacaactgccacttgaatggcggggaaaaggctaatggtgcacgggataccagaattgggaaggtccgcatccgcctctcaacgctagaaactgaccgggtgtatacccactcataccctcttattgttttgacacctgctggcgttaagaaaatgggtgaggtacagcttgctgtccggttcacatgctcatcactgctcaacatgatgactctgtattcacagcccttgctgcccaagatgcactatatacacccgttgtctgtgatccaggttgataacctaagacgccaagcaaccaacattgtctcaacaaggctgagccgtgcagaaccgccactgcgaaaagaaattgtggagtacatgctggatgtggattctcacatgtggagcatgagaaagagcaaggcaaacttcttccgtatcatgggtgtcttgagccctctgattgcagttgctaggtggttcgatcagatctgtcactggaggaacccactgacaactatactgatccatgtcctgtttgtgatactggtcttgtatcctgagctgatactgcccacaatctttctctacctattcctgattggagtgtggtattaccggtggcggtcgaggcagcctccgcacatggacactcgcctctcacatgcggagaccgcccatcctgatgagcttgatgaagagtttgacaccttccctacatcacgcccacctgacatcgtaaggatgcggtatgaccgcctccggagcgttgctgggaggatccagactgttgttggtgatcttgcaacacaaggagagaggctacagtctctgctgagctggagagacccgagggccaccgcgctgtttgtgaccttctgcttcatcgcggcaatcgtcctgtacgtcacaccattccgcgttgtggtcttccttgcaggcctgtacaccctgaggcacccgaggttccgccacaagatgccgtctgtcccgctgaacttcttcaggaggctgccggcaaggactgatagcatgctgtaaggtgcaaccgtctctcgctccgcggtccggcgccttccttgtttcggtggctcgatgctgagcatgttctatagctgcaactgagatgaagctggggtcgaagcgcggttgccaaaaaattgaactgaactatgtcgttgtttgtagtcttttcagttacctgtgtctgttttgggacggttttgaacctttcttgttaacgactgaaatgcttgatgtgtgactagttattatgcatgtatgccgcctgaagaaattgtgccatcacctgagcttctgctgtgccctatcatcttttgcctttgcatgtagtaatagtttgcatcagaagattcattgtgtgcctgggacactgttaatgattttttttttgctgaacggctggagcgtgaactgaatccatgacggcattttggtgtcactgaacctgggttggtatatgtgtgcacgtagtttcaggtcaagtatgtatgtacaagtagttggcgtgttgcgcacttgcgcctttgtacgccgcttcatgtatc

SEQ ID NO: 4576 - DNA, 3095 bp, Triticum aestivum
tccctctcggctcccacctagggttcttgtcgaggagaaaactcaagatcttccatggaggcggcgactgccggcgggtaacctctccggcgtgtagatccggtggtcggccaccacaagatctgctgaaatctttcagcattgcccccttgctcgtgttctcgactcctggccaacctctgctgattccgaatatctcctcctccgattccgtcctttccgagatcctccctgttcagatcgcgtgctggaatctgttacatggagaattctctcacgaaatgttcggttgaaagcgacctttcctgaattgttgattgcaaagctattctggggaatcagtcgctattggctgtatctttcttccttttccgatcctgagtagaaattgtttggttgaagactgtcattcaagatgatgcagaggccattccgcccggaggagtactccttgaaggagactactcctcaccttggtggagcagctgcaggtgacaagctcaccaccacctatgacctggttgagcagatgcagtacctttatgttcgagtggtaaaagcgaaggaacttccagctaaggacctcactggaagttgtgacccgtatgttgaggtgaagcttgggaattataagggcacaactcggcattttgagaagaagaccaatcctgagtggaaccaggtgtttgccttctcaaaggagcgcattcaggcatcagtagtggagattattgtcaaagataaagactttgttaaagatgactacattggacgggttatgtttgacctgaatgaggtcccaaagcgagttccacctgacagcccgttggctccacaatggtatcgcttggaagaacggaatgggcacaaggtcaaaggagagttgatgttagctgtttggatgggtactcaagcagatgaagcatttcctgaagcttggcactctgatgcggcgtcaatccctggcgatggccttgcaagtattagatcaaaagtttatcttactcccaagctttggtatctgcgtgtcaatgtcattgaagcacaagatcttataccaaatgacaagaccaggtaccctgaggtttacgtcaaagcaatgttaggaaaccaggctcttagaacccgagtatcaccaggcaggactctgaatccaatgtggaatgaggacttgatgtttgttgcagctgagccattcgaggagcacctgattttgagtgtagaagacaggattgctccaggaaaggatgatgtaattgggagaactgtcatttcactgcagcatgtagctcggaggctggaccacaagttgctgaacagccagtggtataatcttgagaagcatgtgatggtggatggcgagcagaggaaggagaccaagttctcaagcaggattcacttgagaatttgtcttgaaggtggatatcatgtcttggatgaatcgacacattacagtagtgatctaaggccaactgccaaacagctgtggaagcataacattggggtccttgagctgggtatcttgactgcgcagggcctgttgcctatgaagacgaaggatggacgcggcacgactgacccttattgtgttgctaagtatgggcagaaatgggtgcgtacaaggactatcattgatagtttcactcccaagtggaatgaacagtacacttgggaagtgcatgatccatgcactgtgatcactattggtgtatttgacaactgccacttgaatggcggggaaaaggctaatggtgcacgggataccagaattgggaaggtccgcatccgcctctcaacgctagagactgatcgggtgtatacccactcataccctcttattgttttgacacctgctggcgttaagaaaatgggtgaggtacagcttgctgtccggttcacatgctcatcactgctcaacatgatgactctgtattcacagcccttgctgcccaagatgcactatatacacccgttgtctgtgatccaggttgataacctaagacgccaagcaaccaacattgtctcaacaaggctgagccgtgcagaaccgccactgcgaaaagaaattgtggagtacatgctggatgtggattctcacatgtggagcatgagaaagagcaaggccaacttcttccgtatcatgggtgtcttgagccctctgattgcagttgctagatggttcgatcagatctgccactggaggaacccactgacgactatactgatccatgtcctctttgtgatactagtcttgtatcctgagctgatactgcctacaatctttctctacctattcctgattggagtgtggtactaccggtggcggtcaaggcagcccccgcacatggacactcgcctctcacatgcggagaccgcccatcctgatgagcttgatgaagagtttgacactttccctacatctcgtccacccgacatcgtgaggatgcggtatgaccgcctccggagtgtcgctgggaggatccagactgttgttggtgatcttgcaacacaaggagagaggctgcagtctctgctgagctggagagacccaagggccaccgcgctgtttgtgaccttctgcttcatcgccgcgatcgtcctgtacgtcacaccattccgcgttgtggtcttccttgcaggcctgtacaccctgaggcacccgaggttccgccacaagatgccgtctgtcccgctgaacttcttcaggaggctgccggcaaggactgatagcatgctgtaaggtgcaaccgtctcttatcgctccgtgatgcggcgccttcctcgtttcggtggctcgatgctgagcatgttctatagctgcaactgagatgatgctggggtcgaagcgcggttgccaaaaaattgaactgaactatgtcgttgtttgtagtcttttcagttgcccgcgtgtctgttttggaacagttttgaacctttcctgttgacgactgaaacgcctgatgtgtgagtagttattatgcatgtatgccgcctgaagaaattgtgctatcacctgagcttctgctgtgccccatcatcttttgcatttgctattcttaagttaagtttcgggttttccctttacccctttaaac

SEQ ID NO: 4577 - DNA, 3080 bp, Triticum aestivum
ttccccctcctcgcccccctctcgcttatccctctcggctcccacctagggttcttgccgaggagaaaagccaaagatcgatccatgagagtgcctaccgccggcggggagccactccggcgtgtagatccggtggtcggccacctcaagatctactgaaatctttcagcattgcccccttgctcctgttctcgactcccggccaatctctgctgattccgaatatctcctcctccggttccgtcctttccgagatccccgttgttcagatcgcgtgctggaatctgatggagaattttctcacgaaatgttcggttgaaagcgaccttggctgaattgttgattgcaaagctattctggggaatcagtcgctgttggctgtatctttttccttttctgatcctgagtagaaattgtttggttgaagactgtcattcaagatgatgcagaggccattccgcccggaggagtactccttgaaggagactactcctcaccttggtggagcagctgcaggtgacaagctcaccaccacctatgacctggttgagcagatgcagtacctttatgttcgagtggtaaaagcgaaggaacttccagctaaggacctcactggaagttgtgacccgtatgttgaggtgaagcttgggaattataagggcacaactcggcattttgagaagaagaccaatcctgagtggaaccaggtgtttgccttctcaaaggagcgcattcaggcatcagtagtggagattatcgtcaaagataaagactttgttaaagatgactacattggacgggttatgtttgaccttaatgaggtcccaaagcgagttccacctgacagcccgttggctccacaatggtatcgcttggaagaacggaatgggcacaaggtcaaaggagagttgatgttagctgtttggatgggtactcaagcagatgaagcatttcctgaagcttggcactctgatgctgcgtcaatccctggtgatggccttgcaagtattagatcaaaagtttatcttactcctaagctttggtatctgcgtgtcaatgtcattgaagcacaagatcttataccaaatgacaagaccaggttccctgaggtttatgtcaaagcaatgttaggaaaccaggctcttagaacccgagtatcaccaggcaggactctgaatccaatgtggaatgaggacttgatgtttgttgcagctgagccatttgaggagcacctgattttgagtgtagaagacaggattgctccaggaaaggatgatgtaattgggagaactgtcatttcactgcagcatgtagctcggaggctggaccacaagttgctgaacagccagtggtataatcttgagaagcatgtgatggtggatggtgagcagaggaaggagaccaagttctcaagcaggattcacttaagaatttgtcttgaaggtggatatcatgtcttggatgaatcgacacattacagtagtgatctaaggccaactgccaaacagctgtggaagcataacattggggtccttgagctgggtatcttgactgcgcagggcctgttgcctatgaagacgaaggatggacgcggcacgactgacccttattgtgttgctaagtatgggcagaaatgggtgcgtacaaggactatcattgatagtttcactcccaagtggaatgaacagtacacttgggaagtgcatgatccatgcactgtgatcactattggtgtatttgacaactgccacttgaatggcggggaaaaggctaatggtgcacgggataccagaattggcaaggtccgcatccgcctctcaacgctagaaactgatcgggtgtatacccactcataccctcttattgttttgacacctgctggcgttaagaaaatgggtgaggtacagcttgctgtccggttcacatgctcatcactgttcaacatgatgactctgtattcacagcccttgctgcccaagatgcactatatacacccgttgtctgtgatccaggttgataacctaagacgccaagcaaccaacattgtctcaaccaggctgagccgtgcagaaccgccactgcgaaaagaaattgtggagtacatgctggatgtggattctcacatgtggagcatgagaaagagcaaggcaaacttcttccgtatcatgggtgtcttgagccctctgattgcagttgctagatggtttgatcagatctgtcactggaggaacccactgacgactatactgatccatgtcctctttgtgatactggtcttgtatcctgagctgatactgcctacaatctttctctacctattcctgattggagtgtggtactaccggtggcggtcgaggcagcctccgcacatggacactcgcctctcacatgcggagaccgcccatcctgacgagcttgatgaagagtttgacaccttccctacatctcgcccacctgacatcgtcaggatgcggtatgaccgcctccggagcgttgctgggaggatccagactgttgttggtgatcttgcaacacaaggagaaagactgcagtctctgctgagctggagagacccaagggccaccgcgctgtttgtgaccttctgcttcatcgctgcgatcgtcctgtacgtcacaccattccgtgttgtggtcttccttgcaggcctgtacaccctgaggcacccgaggttccgccacaagatgccgtctgtcccgctgaacttcttcaggaggctgccggcaaggactgatagcatgctgtaaggtgcaaccgtctctctcgctccgtgatctggcgccttccttgtttcggtggctcgatgctgagcatgttctatagctgcaactgagatgatgctggggtcgaagcgcggttgccaaaaaattgaactgaactatgtcgttgtttgtagtcttttcagttgcttgtgtgtctgttttgggacggttttgaacctttcctgttgacgactgaaacgcctgatgtgtgactagttattatgcatgtatgccgcctgaagaaattgtgctatcacccgagcttctgctgtgtcctatcatcttttgcatttgcatcta

SEQ ID NO: 4578 - DNA, 2979 bp, Saccharum officinarum
ctctctgctccctccctcagtcctctccacaccactgccttcctcttgtttttgctcgcaagaaaaaggcgaaaaatcctacgcaaatccgccgtcctctccaccgccgaagcttctgggtcctcctcgccgccgctacgcgtgagatcagcccgccggcgtcggtctttttccctggctggtgatgtagagttcattctcttaagtcgaatggtttcctcccacaaagcgcgatgaggaaatgttcaaaatgctcgtagctgtgttgcctgacaaatttattgcagagctggtctaggacaagtggacagctgggatttcttggcactttgtcaagtcagtgagtagaagtttgggactttgtcaaatcagtgagtaaaagtttggtggaagatcgtctccgttcaagatgatgcagaggccacccttccgcccggaggagtactccttgaaggagacctcacctcaccttggtggtgcagctgctggtgacaagctcaccaccacctatgacctggttgagcagatgcagtacctttatgtaagagtggtaaaagcaaaggaacttccaaacaaggacatcactgggagctgtgacccatatgttgaggtgaagctaggaaattacaaaggccaaactcgacattttgagaagaagaacaacccagagtggaatcaggtctttgccttctcaaaggagcgcattcagtcatcagttgtggagattgtggtcaaggacaaggatcttgtcaaggatgacttcattgggcgtgttatatttgatctgaatgaggtcccaaagagagtgccacctgatagcccattggctccacaatggtatcggttggaagatcgaaatgggcacaaggtgaagggggagttgatgttggctgtttggatgggtactcaagcagatgaagcattccctgaagcatggcattctgatgcagcgtctgtccctggtgatggccttgcaagcattagatcgaaagtgtatcttactccaaagctttggtatctccgtgtcaatgtaattgaagctcaggatcttataccaaatgacaagaccaggttccctgaggtttatgtcaaagcaatgctaggcaaccaagtccttagaaccagggtattagcgagccggacattgaatccaatgtggaatgaagatttgatgtttgttgcagctgagccatttgaggagcacctaattttgagcgtagaggacagggtggccccaggaaaggatgaagtaattggaaggacaatcatttcactgcagcatgtaccccggagactggatcacaggttgctaaccagccagtggtataaccttgagaagcatgtgattattgatggtgagcagaagaaagagaccaagttttcaagccgaattcacctgagaatttgtcttgaaggtggatatcatgtcttggatgagtcaacacattacagtagtgatttaaggccaactgcaaaacctctgtggaagcctagcattggcattcttgagctgggtgttttgacagcacagggcctgttaccaatgaagaccaaggatggacgtggcacaactgatgcctattgtgttgcaaagtatggacagaaatgggtgcgtactaggactataatcgacagtttcactcccaaatggaatgaacagtacacctgggaggtgtatgacccatgcactgtgatcacaattggtgtatttgacaattgccacctgaatggcggtgaaaaggccaatggtgccagggataccagaattgggaaggtccgcatccgcctctcgacacttgaaactgatcgggtgtatacccactcataccctcttattgtcctgacacctggtggcgttaagaagatgggtgaggtgcagcttgctgtccgtttcacatgctcatcactgctcaacatgatgcatctgtactcacagcccttgctgcccaagatgcactatgtgcacccgttgtccgtgatacaggtggacaacctgaggcgccaagccacaaacattgtctcaacaaggctgggccgtgcagagccaccactgcggaaggaaatcgtggagtacatgcttgacgtggactcacacatgtggagcatgagaaagagcaaggcaaatttcttccgcatcatgggtgtcctgagccccttgattgcagtggcgaagtggttcgatcagatctgtctctggaggaacccgctgaccaccatactgatccatgtcctcttcgtgatactggttctatacccagagctgatactgcccacaatcttcctctacctgttcctgatcggggtgtggtactacaggtggcggccaaggcagccgccgcacatggacacccgcctctcccacgcagagactgcccaccctgacgagctcgacgaggagttcgacaccttccccacctcccgcccgccggacatcgtgcggatgcgctacgacaggctgcgcagcgttgcggggaggatccagaccgtggttggcgacctcgcgacgcagggcgagcggctgcagtcgctgctgagctggagggacccaagggccaccgcgctgttcgtggtcttctgcttcatcgccgccattgtcctgtacgtcaccccgttccgcgtcgtggtcttcctcgcaggcctgtacgtgctgaggcaccccaggttccgccacaggatgccatccgtcccgctcaacttcttcaggcgtctgccggcgaggaccgacagcatgctgtaggcgcagcaggtgcctggcttatggtttcacctgtcagttgcagctcgcagatgttcactcctcctaagtaagtgtatccgaaaacaaagaactgctagctatctttggtacttctgtagcatctctctgttgcatggttggttatgtattattcagatggttgtgaaccttaaatgtaacaaccgaacgcatgatgcgtgactgtggctaggtatgcatgcatttgtgatgcttgaatactc

SEQ ID NO: 4579 - DNA, 3547 bp, Sorghum bicolor
caagaccaaaaaacctcccacgctctggactccacttcgtcctcgtcgagcactccacgccgctctagtactctctgctcccttccccatctctctctcttctcactcctctcccattgcctttgtttttgctcgcaagaaaaaaggccgaaaaatcctacgcaaatccgccgtcctctccaccgccgaagcttctgggtcctcgccgccgccgccgccgccgctacgcgtgagatcagcccgccggcgtcggtatttcccccagactggtgatgtagagttcattctcttctttaagtcgaatggtttcctcccacagagcaagatgaggaaatgttcaaaatgctcgtagctgtgttgcctgacaagtttattgcagagttctagcttgtctaggacaagtggacagctgggatttcttggcactttgtcaagtcagtgagtagaagtttggtggaagattgtcttcgttcaagatgatgcagaggccaccactccgtccggaggagtactccttgaaggagacctcacctcaccttggtggtgcagctgctggtgacaaactcaccaccacctatgacctggttgagcagatgcagtacctttatgtaagagtggtaaaagcaaaggaacttccaaacaaggacatcactgggagctgtgacccatatgttgaggtgaagctaggaaattataagggccagactcggcatttcgagaagaagaacaacccagagtggaatcaggtctttgccttctcaaaggagcgcattcagtcatcggttgtggagattgtggtcaaggacaaggatcttgtcaaggatgacttcattgggcgtgttatgtttgatctgaatgaggtcccaaagagagtgccacctgatagtccattggctccacaatggtatcggttggaagaccgaaatggtcacaaggtgaagggggagttgatgttggctgtttggatgggtactcaagctgatgaagcattccctgaagcatggcattctgatgcagcgtctgtccctggtgatggtcttgcaagcattagatcgaaagtgtatcttactccaaagctttggtatctccgtgtcaatgtcattgaagctcaggatcttataccaaatgacaagaccaggttccctgaggtttatgtcaaagcaatgctaggcaaccaagtacttagaaccagggtattagcgagccggaccttgaatccaatgtggaatgaagatttgatgtttgtcgcagctgagccatttgaggagcacctaattttgagcgtagaggacagggtggccccaggaaaggatgaagtaattggaaggacaatcatttcactgcagcatgtaccccggaggttggatcacaggttgctaaccagccagtggtatccccttgagaagcatgtgattattgatggtgagcagaagaaagagaccaagttttcaagccggattcacttgagaatttgtcttgaaggtggatatcatgtcttggatgagtcaacacattacagtagtgatttaaggccaactgcaaaacctctgtggaaacctagcattggcattcttgagctgggtatcttgacagcacagggcctgttgccaatgaagaccaaggatgggcgtggcacgactgatgcctattgtgttgcaaagtatggacagaaatgggtgcgtactaggactataatcgacagtttcactcccaaatggaatgaacagtatacctgggaagtgtatgatccatgcactgtgatcacaattggtgtatttgacaattgccacctgaatggcggggaaaaggccaatggtgccagggataccagaattgggaaggtccgcatccgcctctcgacgcttgaaactgatcgggtgtatacccactcataccctcttattgttctgacacctggtggcgttaagaagatgggtgaggtgcagcttgctgtccgtttcacatgctcatcactgctcaacatgatgcatctgtactcacagcccttgctgcccaagatgcactatgtgcacccattgtccgtgatacaggtggacaacctgaggcgccaagccacaaacattgtctcgacaaggctgggccgtgcagagccaccactgcgaaaggaaatcgtggagtacatgcttgacgttgactcgcacatgtggagcatgagaaagagcaaggctaacttcttccgtatcatgggtgtcctgagccctctgattgcagtggccaagtggttcgatcagatctgtctctggaggaacccgctgaccaccattctgatccatgtcctcttcgtgatactggttctgtacccagagctgatactgcccacaatcttcctttacctgttcctgatcggggtgtggtactacaggtggcggccaaggcagccgccgcacatggacacccgcctctcccacgcggagactgcccaccccgatgagctcgatgaggagtttgacaccttccccacctcccgcccgccggacatcgtgcggatgcggtatgacaggctgcgcagcgttgcggggaggatccagacagtggtcggcgaccttgcgacgcagggcgagcggctgcagtcgctgctgagctggagggacccaagggccactgcgctgttcgtggtcttctgcttcatcgccgccatcgtcctgtatgtcaccccgttccgcgtcgtggtcttcctcgcaggcctgtacgtgctgaggcaccccaggttccgccacaggatgccatccgtcccgctcaacttcttcaggcgtctgccggcaaggaccgacagcatgctgtaggtgctgcaggtgcctggttccattgctggcttggtggtttcacctgtcgattgcagctcgcagatggtttctctctctcactctctgtcttgagtgtatctgaaaacgatgaactgctaggtaccttcggtacttttgtagcttctctctgttgcatggttggttatgtattcagatggttgtgaacctttcctgtaacaatcgaacgcatgatgtgtgactgtgatggctaggtatgcatgcatgtgtgatgcttggaaactccgggcgttagttgttgctttacctatttgttcagcggcagtgctgtcagctaacgtggttctctactgctgcatgtgcatcgtgtggtttggtttccagtccattttatcagtttgatgcttgattgatttcagtttttacttgggaaatactgatctgaattccaggcgatttatgaataggggagaccctgaatagggaagtaattgggtgccaatctaagctgaggcaggttgttgtacttctgaacttaggtgatgtcaaagttgaatttccacggtgcagcggcaatgccttcccgaacggagctgctgcacttttcttcagaacgctcattgaaggcctgcaggattgcaagtactccctccgtccatccctaagggtgtgtttagtttggaagggaaaatttttgtgattttatgacattgtagtatttttgtttgtttgtggtaattattgtggaattatagactaactag

SEQ ID NO: 4580 - DNA, 3137 bp, Panicum virgatum
ctcgagggcctccgcgcaagatcaccgaccagggtcgtccaggggatgggaggcgctccaaaaaaccccccactctggactccacttcgtcagttcgtccccatccacgccgctctagtgctctctgcagcctcgctccctctctctctctctcctctccctcgtctctgttggcaagaaaaagccggaaacccctgcgcaaatccgccggctcctccactgccgaagctcctgggtcctcctcgccgccgctccgctcgagatcagcttgccgccgtcggtgttcttccaagattggtgatgtagagtgctcttccgaaccccaatggtttcgttccacagcgcaagatgtggaaatgttcacaatgctcttagctgtgtttgctgacaagtaatcgcagagctcatctaggacatcatctgggatttctttgttctctctggagtctgtgagtacttgtttgtttgaagatcttcttcattcaagatgatgcagaggccgccgttccgtcccgaggagtactccttgaaggagaccaggcctcaccttggaggccatgctgctggtgataagctcacgagcacctatgatctggttgagcagatgcagtacctctatgtccgagtggtgaaagcaaaggaacttccaaacatggacatcactgggggctgtgacccatatgttgaggtgaagctagggaattataagggtacaacgaggtttttcgagaagaacaacaacccagagtggaatcaggtctttgccttttcaaaggagcgcattcagtcttcagttgtggagattgtggtcaaggacaaggatcttgttaaggatgacttcattgggcgtgttgtatttgacctgaatgaggtcccaaagagagtgccacctgatagcccattggctccacagtggtatcgcatggaagaccgacacgggcacaaggtgaagggggagttgatgttggctgtttggatgggtactcaagcagatgaagcattccctgaagcatggcattctgatgctgcctctgtcccaggagatggtcttgcaagtattagatcaaaggtgtatcttactccaaagctttggtatctacgtgtcaatgtcattgaagcccaggatctcataccaaatgataagaccaggttccctgaggtttatgtcaaagccatgctaggcaaccaagttcttcgaaccagggtatcagcaagccggactctgaacccgatgtggaatgaggatttgatgtttgttgctgctgagccatttgaggagcacctgatgttgagtgtagaggacagggtggcccctgggaaggatgaagtaattggaaggacaaccatttctctgcagcatgtaccccgaaggctggatcacaggctgctgaccagccagtggtataatcttgagaagcatgtgatgattgatggtgagcagaagaaagaaacaaagttttccagccggattcacttgagaatttgtcttgaaggtggatatcatgtcttggatgagtcaacacattacagtagtgatttaaggccaactgcaaaacctctgtggaaacctagcattggcattcttgagctgggtatcttgacagcacagggcctgttaccgatgaaaaccaaggatgggcgtggcacaactgatgcctactgtgttgcaaagtatggacagaaatgggtccggaccaggactataattgatagtttcacccccaaatggaacgaacagtatacctgggaggtgtatgacccatgcactgtgatcacaattggtgtatttgacaattgccaccttaatggtggggaaaaggctaatggtgcccgggacaccagaattgggaaggtccgcatccgcctctcaacactagaaactgatcgtgtctatacccactcataccctcttattgttttgacacctgctggtgttaagaagatgggtgaggtgcagcttgctgtccgtttcacatgttcatcactgctcaacatgatgcatctgtactcacagcccctgctgcccaagatgcactatgtgcacccactgtctgtgatgcaggtagacaacctgaggcgtcaagccacaaacattgtctcaacaaggctggggcgtgcagagcctccgctgcgaaaggaaattgtggagtatatgctggatgtggactctcacatgtggagcatgagaaagagcaaggcaaacttcttccgtatcatgggtgtcctgagccccctgattgcagtggcaaagtggtttgatcagatctgtcactggaggaacccgctgaccactatactgatccatgtcctctttgtgatactggtcctatacccagagctgatactgcccacaatcttcctctacctgtttctgatcggggtgtggtactacaggtggcgtccgaggcagccaccgcacatggacacccgcctctcgcacgccgagacagcccaccctgacgagctcgacgaggagttcgacacgttccccacctcccgcccgccggacattgtgcggatgcgttatgaccggctgcggagcgttgccgggaggatccagaccgtcgttggcgacctcgcgacgcagggtgagcggctgcagtccctgctgagctggagggaccccagggccacagcgctgtttgtggtcttctgcttcatcgccgccatcgtcctgtacgtcacgccgttccgcgtggtggtcttccttgccggcctgtacgtgctgaggcaccccaggttccgccacaagatgccatctgtcccgctcaacttcttcaggcggctcccggcgaggaccgacagcatgctctagttgcttctggtggtttggcttccatggctggttcagttcttcacctgctaattgcaactccaatggttgtcttaatgtgtccgaaaacaatgaactgctagctatctatgttattttgtagtgtttgtactccaggatgtgtggtcttgcttcggaagtggtattgaaccagaacttgtattatctaaaagtaggaagaagcaaaaccattcagagtgttgatgtggaagttgttgcttctgaaatggttttgcttccatttccaggtgaagttgctgccgaagttctattcaaaatctcagggtaagtgtgatgcgtcttt

SEQ ID NO: 4581 - DNA, 2732 bp, Panicum virgatum
ggtgttcttccaagattggtgatgtagagtgctcttccgaaccccaatggtttcgttccacagcgcaagatgtggaaatgttcacaatgctcttagctgtgtttgctgacaagtaatcgcagaggtatagtagtttattaatactgtttacttttggtgttgttccagctcatctaggacatcatctgggatttctttgttctctctggagtctgtgagtacttgtttgtttgaagatcttcttcattcaagatgatgcagaggccgccgttccgtcccgaggagtactccttgaaggagaccaggcctcaccttggaggccatgctgctggtgataagctcacgagcacctatgatctggttgagcagatgcagtacctctatgtccgagtggtgaaagcaaaggaacttccaaacatggacatcactgggggctgtgacccatatgttgaggtgaagctagggaattataagggtacaacgaggtttttcgagaagaacaacaacccagagtggaatcaggtctttgccttttcaaaggagcgcattcagtcttcagttgtggagattgtggtcaaggacaaggatcttgttaaggatgacttcattgggcgtgttgtatttgacctgaatgaggtcccaaagagagtgccacctgatagcccattggctccacagtggtatcgcatggaagaccgacacgggcacaaggtgaagggggagttgatgttggctgtttggatgggtactcaagcagatgaagcattccctgaagcatggcattctgatgctgcctctgtcccaggagatggtcttgcaagtattagatcaaaggtgtatcttactccaaagctttggtatctacgtgtcaatgtcattgaagcccaggatctcataccaaatgataagaccaggttccctgaggtttatgtcaaagccatgctaggcaaccaagttcttcgaaccagggtatcagcaagccggactctgaacccgatgtggaatgaggatttgatgtttgttgctgctgagccatttgaggagcacctgatgttgagtgtagaggacagggtggcccctgggaaggatgaagtaattggaaggacaaccatttctctgcagcatgtaccccgaaggctggatcacaggctgctgaccagccagtggtataatcttgagaagcatgtgatgattgatggtgagcagaagaaagaaacaaagttttccagccggattcacttgagaatttgtcttgaaggtggatatcatgtcttggatgagtcaacacattacagtagtgatttaaggccaactgcaaaacctctgtggaaacctagcattggcattcttgagctgggtatcttgacagcacagggcctgttaccgatgaaaaccaaggatgggcgtggcacaactgatgcctactgtgttgcaaagtatggacagaaatgggtccggaccaggactataattgatagtttcacccccaaatggaacgaacagtatacctgggaggtgtatgacccatgcactgtgatcacaattggtgtatttgacaattgccaccttaatggtggggaaaaggctaatggtgcccgggacaccagaattgggaaggtccgcatccgcctctcaacactagaaactgatcgtgtctatacccactcataccctcttattgttttgacacctgctggtgttaagaagatgggtgaggtgcagcttgctgtccgtttcacatgttcatcactgctcaacatgatgcatctgtactcacagcccctgctgcccaagatgcactatgtgcacccactgtctgtgatgcaggtagacaacctgaggcgtcaagccacaaacattgtctcaacaaggctggggcgtgcagagcctccgctgcgaaaggaaattgtggagtatatgctggatgtggactctcacatgtggagcatgagaaagagcaaggcaaacttcttccgtatcatgggtgtcctgagccccctgattgcagtggcaaagtggtttgatcagatctgtcactggaggaacccgctgaccactatactgatccatgtcctctttgtgatactggtcctatacccagagctgatactgcccacaatcttcctctacctgtttctgatcggggtgtggtactacaggtggcgtccgaggcagccaccgcacatggacacccgcctctcgcacgccgagacagcccaccctgacgagctcgacgaggagttcgacacgttccccacctcccgcccgccggacattgtgcggatgcgttatgaccggctgcggagcgttgccgggaggatccagaccgtcgttggcgacctcgcgacgcagggtgagcggctgcagtccctgctgagctggagggaccccagggccacagcgctgtttgtggtcttctgcttcatcgccgccatcgtcctgtacgtcacgccgttccgcgtggtggtcttccttgccggcctgtacgtgctgaggcaccccaggttccgccacaagatgccatctgtcccgctcaacttcttcaggcggctcccggcgaggaccgacagcatgctctagttgcttctggtggtttggcttccatggctggttcagttcttcacctgctaattgcaactccaatggttgtcttaatgtgtccgaaaacaatgaactgctagctatctatgttattttgtagtgtttgtactccaggatgtgtggtcttgctt

SEQ ID NO: 4582 - DNA, 3313 bp, Panicum virgatum
cggtgaaggtggagggtgaaggagaaggcagagagaaaacatggagaacatgcagttttccctttgttttttcattgacgactccacgagttctttccggagaggagggtcgaggaaacgacaatgtagatagagctggcacgggacccgaggctcacggccggtcctctcgcagaaattcgaaacgcttgagggcctccgcgcaagatcaccgaccagggtccaggggctgggagggggcttttgcgctccgaaaaccccccactctggactccacttcgtctccatcgagcactccacgccgctctatagtactcccctccccccctccctctctctcctctggcaagaaaaagccggaaatccctgcgcaaacccgccggctcctccaccgccgaagctcctgggtcctcctcgccgccgctccgcgagagatcagcccgccgccgccgattggtgatgtagagtgctcttccgaactccaatggtttcctcccacagtgcaagatgtggaaatgttcacaatgctcttatagctgagtttcctgacaagtaatgaagtaattgcagagctcatctagggcatcatctgggatttcttggttctttctggagtgagtacttgtttgtttgaagatcttcttcattcaagatgatgcagaggccgctgttccgtcccgaggagtactccttgaaggagaccagacctcaccttggaggccatgctgccggtgacaagctcaccagcacctatgacctggttgagcagatgcagtacctctatgtccgagtggtgaaagcaaaggaacttccaaacatggacatcactgggggctgtgacccatatgttgaggtgaagctagggaattataagggcacaactaggtttttcgagaagaacaacaacccagagtggaatcaggtttttgccttttcaaaggagcgcattcagtcatcagttgtggagattgtggtcaaggacaaggatcttgttaaggatgacttcattgggcgcgttgtatttgacctgaatgaggtcccaaagagagtgccacctgatagcccattggctccacagtggtatcgcttggaagaccgacacgggcacaaggtgaagggggagttgatgttggctgtttggatgggtactcaagcagatgaagcattccctgaagcatggcattctgatgctgcctctgtccctggagatgggcttgcaagtattagatcaaaggtgtatctcactccaaagctttggtatctgcgtgtcaatgtcattgaagcccaggatctcataccaaatgataagaccaggttccctgaggtttatgtcaaagccatgctaggcaaccaagttcttaggaccagggtatcagcaagccgcactctgaacccaatgtggaatgaggatttgatgtttgttgctgctgagccattcgaggagcacctgatgttgagcatagaggacagggtggcccctgggaaggatgaagtaattggaaggacaaccatttctctgcagcatgtaccccgaaggttggatcacaggctgctgaccagccagtggtataatcttgagaagcatgtgatgattgatggtgagcagaagaaagagacaaagttttccagccggattcacttgagaatttgtcttgaaggtggatatcatgtcttggatgagtcgacacattatagtagtgatttaaggccaactgcaaaacctctgtggaaacctagcattggcattcttgagctgggtatcttgacagcacagggcctgttaccgatgaaaaccaaggatggacgtggcacaactgatgcttactgtgttgcaaagtatggacaaaaatgggtccggaccaggactataattgacagtttcacccccaaatggaatgaacagtatacctgggaggtgtatgacccatgcactgtgatcacaattggtgtatttgacaattgccaccttaatggcggggaaaaggctaatggtgctcgggacaccagaattgggaaggtccgcatccgcctctcgacactagaaactgatcgtgtctatacccactcataccctcttattgttctgacacctgctggtgttaagaagatgggtgaggtgcagcttgccatccgtttcacatgttcatcactgctcaatatgatgcatctgtattcacagcccctactgcccaagatgcactatgtgcacccactgtctgtgatgcaagtagacaacctgaggcgtcaagccacaaacattgtctcaacaaggctggggcgtgcagagcctccgctgagaaaggaaattgtggagtacatgctggatgtggactctcacatgtggagcatgagaaagagcaaggcaaacttcttccgtatcatgggtgtcctgagccccctgattgctgtggcaaagtggtttgatcagatctgtcactggaggaacccgctgaccactatactgatccatgtcctctttgtgatactggtcctatacccagagctgatactgcccacaatcttcctctacctgtttctgattggggtgtggtactacaggtggcgtccgaggcagccaccgcacatggacacccgcctctcgcatgccgagacagcccaccctgatgagctcgacgaggagttcgacacattccccacctcccgcccgccagacattgtgcggatgcgttatgacaggctgcggagcgtcgctgggaggatccagactgtcgtcggcgacctcgcgacgcagggtgagcggctgcagtccctgctgagctggagggaccccagggccacagcgctgttcgtggtcttctgcttcatcgccgccattgttctgtacgtcacgccgttccgtgtggtggtcttcctcgccggcctgtacgtgctgaggcaccccaggttccgccacaggatgccctccgtcccgctcaacttcttcaggcggctcccggcaaggaccgacagcatgctgtagtcgcatctggttgttaggctttcatggttggttcagttcttcacctgctaattgcaactccaatggttatgtcttaagtgcatccgaaaacaatgaactgctagctatctatgttaatttagtgtttgtattccaagatgtgtggttttgcttctgaagtgatattgaaccagaacttgtattatctaaaagtagaaagaagcaaaaaccattcagagtgttgatgtcgaagttgttgcttctgaaatggttttgcttccatttccaggtgaagttgttgttgttgccgaagttttattcagaaatctcaggggaagtgtgatgcgtcttcta

SEQ ID NO: 4583 - DNA, 2964 bp, Setaria italica
gtcgagcactccacgccgctctagcaccctctgcagcctcccaccgccctctctctcctctgcctttgtccttcgctcgcgagaaaacgccgaaaacccctgcgcaaatccgccgccccttcaccgccgaagtcctcctccccgccgctccgcgtgagatcggccctgccgccgtcggtgtcgttccaagattggtgatgtagagttcattcttttcagaaattcaatggtttcctcccatagcgcaatatgaggaagtgttcacaatgcccttagctgtgtggcttgactagtaattgctgagctcatctaggacatcaactgggatatcttggttctttctgtagtctgtgagtagttgtttggttgaagatcttcttcattcaagatgatgcagaggccgccgttccgtcctgaggagtactccttgaaggagaccaaacctcatcttggtggccatgccgctggtgacaagctcaccagcacctatgatcttgttgagcagatgcagtatctctatgtccgagtggtgaaagcaaaggaacttccaaacatggacatcactgggagctgtgacccatatgttgaggtgaagctagggaattataagggcacaactcggtttttcgagaaaaccagcaacccagagtggaatcaggtctttgccttttcaaaggagcgcattcagtcatcagttgtggagatcgtggtcaaggataaggatcttgttaaggatgacttcattgggcgtgttatatttgaccttaatgaggtcccaaagagagtgccacctgatagcccattggctccacagtggtataggttggaggaccgtaatgggcacaaggtgaagggggagttgatgttggctgtttggatgggtactcaagcagatgaagcattccctgacgcatggcattctgatgcggcctcggtccctggagatgggctttcaagtattagatcaaaagtgtatcttactccaaagctttggtatctgcgtgtcaatgtcatcgaagcccaggatcttataccaaatgataagaccaggttccctgatgtttatgtcaaagccattctaggcaaccaagttcttagaacccgggtatcaccagcccggactctgaacccgatgtggaatgaggacttgttgtttgtcgctgctgagccattcgaggagcacctgattttgagcgtagaggacagggtggccccaggaaaggatgaagtaattggaagaacagtcatttcgctgcagcatgtaccccggaggctggatcacaggttgctgaccagccagtggtataatcttgagaagcatgtgatgattgatggtgagcagaagaaagagaccaagttttcaagccggattcacttgaggatttgtcttgaaggtggatatcatgtcctggatgagtcaacacattacagtagtgatttaaggccaactgcgaaacctctgtggaaacctagcattggtgttcttgagctgggtatcttgacagcacaaggcctgttaccaatgaagaccaaggatgggcgtggcacaactgatgcctactgtgttgcaaagtatggacagaaatgggtgaggactaggactataattgacagtttcacccccaaatggaatgaacagtacacatgggaggtgtatgacccatgcactgtgatcacgattggtgtatttgacaactgccatctgaatggtggggacaaggctaatggtgcccgggacacccgaattggcaaggtccgcatccgtctctccacacttgaaactgatcgagtgtatacccactcgtaccctcttattgttctgacacctgctggcgttaagaagatgggtgaggtgcagcttgctgtccggttcacatgctcatcgctgctcaacatgatgcatctgtactcacagcccctgctgcccaagatgcactatgtgcacccattgtccgtgatgcaggtagacaatctgaggcgccaagccacaaacattgtctcaacaaggctgggccgtgcagagccaccgctgcgaaaggaaattgtggagtacatgctggacgtggattcacacatgtggagcatgagaaagagcaaggcaaacttcttccgcatcatgggtgtcctgggccccctgattgctgtggcaaagtggtttgatcagatctgtcactggaggaacccgctgaccactatactgatccacgtcctcttcatgatactggtcctatacccggagctgatactgcccacaatcttcctctacttgttcctgatcggggtgtggtactacaggtggcggccgaggcagccacctcacatggacacccgcctctcgcacgctgagactgcccaccccgatgagctcgacgaggagtttgacaccttccccacctcgcgcccgcccgatgttgtgcggatgcggtatgaccggctgcggagcgtcgccgggaggatccagactgtcgtcggcgacctcgcgacgcagggcgagcggctgcagtccctgctgagctggagggaccccagggccacagcgctgttcgtcgtcttctgcttcatcgccgccatcgtcctgtatgtgacgccgttccgcgtggtggtcttcctcgccggcctgtacgtgctgaggcaccccaggttccgccacaagatgccgtccgtcccgctcaacttcttcaggcggctccctgcgaggaccgacagcatgctgtaggcgcattcggctgctgttacctgtttaggctccatgtctggttcggttgttaaactgctagttgtaactcgaatggttatgtcttaagtgcatccgagaacaatgaactgcttgctatctatgttattttgtagtgtttgttgtaagatgggtggttttgcttctgaagtgatatcaaaccagaacttgtatctgaaagagaaagaagcgggacttccatttccaggcgaggttgctgccgatgtttt

SEQ ID NO: 4584 - DNA, 2747 bp, Setaria italica
ggtgtcgttccaagattggtgatgtagagttcattcttttcagaaattcaatggtttcctcccatagcgcaatatgaggaagtgttcacaatgcccttagctgtgtggcttgactagtaattgctgaggtatagcagtttattaacagtgtttacttttggtgttgttccagctcatctaggacatcaactgggatatcttggttctttctgtagtctgtgagtagttgtttggttgaagatcttcttcattcaagatgatgcagaggccgccgttccgtcctgaggagtactccttgaaggagaccaaacctcatcttggtggccatgccgctggtgacaagctcaccagcacctatgatcttgttgagcagatgcagtatctctatgtccgagtggtgaaagcaaaggaacttccaaacatggacatcactgggagctgtgacccatatgttgaggtgaagctagggaattataagggcacaactcggtttttcgagaaaaccagcaacccagagtggaatcaggtctttgccttttcaaaggagcgcattcagtcatcagttgtggagatcgtggtcaaggataaggatcttgttaaggatgacttcattgggcgtgttatatttgaccttaatgaggtcccaaagagagtgccacctgatagcccattggctccacagtggtataggttggaggaccgtaatgggcacaaggtgaagggggagttgatgttggctgtttggatgggtactcaagcagatgaagcattccctgacgcatggcattctgatgcggcctcggtccctggagatgggctttcaagtattagatcaaaagtgtatcttactccaaagctttggtatctgcgtgtcaatgtcatcgaagcccaggatcttataccaaatgataagaccaggttccctgatgtttatgtcaaagccattctaggcaaccaagttcttagaacccgggtatcaccagcccggactctgaacccgatgtggaatgaggacttgttgtttgtcgctgctgagccattcgaggagcacctgattttgagcgtagaggacagggtggccccaggaaaggatgaagtaattggaagaacagtcatttcgctgcagcatgtaccccggaggctggatcacaggttgctgaccagccagtggtataatcttgagaagcatgtgatgattgatggtgagcagaagaaagagaccaagttttcaagccggattcacttgaggatttgtcttgaaggtggatatcatgtcctggatgagtcaacacattacagtagtgatttaaggccaactgcgaaacctctgtggaaacctagcattggtgttcttgagctgggtatcttgacagcacaaggcctgttaccaatgaagaccaaggatgggcgtggcacaactgatgcctactgtgttgcaaagtatggacagaaatgggtgaggactaggactataattgacagtttcacccccaaatggaatgaacagtacacatgggaggtgtatgacccatgcactgtgatcacgattggtgtatttgacaactgccatctgaatggtggggacaaggctaatggtgcccgggacacccgaattggcaaggtccgcatccgtctctccacacttgaaactgatcgagtgtatacccactcgtaccctcttattgttctgacacctgctggcgttaagaagatgggtgaggtgcagcttgctgtccggttcacatgctcatcgctgctcaacatgatgcatctgtactcacagcccctgctgcccaagatgcactatgtgcacccattgtccgtgatgcaggtagacaatctgaggcgccaagccacaaacattgtctcaacaaggctgggccgtgcagagccaccgctgcgaaaggaaattgtggagtacatgctggacgtggattcacacatgtggagcatgagaaagagcaaggcaaacttcttccgcatcatgggtgtcctgggccccctgattgctgtggcaaagtggtttgatcagatctgtcactggaggaacccgctgaccactatactgatccacgtcctcttcatgatactggtcctatacccggagctgatactgcccacaatcttcctctacttgttcctgatcggggtgtggtactacaggtggcggccgaggcagccacctcacatggacacccgcctctcgcacgctgagactgcccaccccgatgagctcgacgaggagtttgacaccttccccacctcgcgcccgcccgatgttgtgcggatgcggtatgaccggctgcggagcgtcgccgggaggatccagactgtcgtcggcgacctcgcgacgcagggcgagcggctgcagtccctgctgagctggagggaccccagggccacagcgctgttcgtcgtcttctgcttcatcgccgccatcgtcctgtatgtgacgccgttccgcgtggtggtcttcctcgccggcctgtacgtgctgaggcaccccaggttccgccacaagatgccgtccgtcccgctcaacttcttcaggcggctccctgcgaggaccgacagcatgctgtaggcgcattcggctgctgttacctgtttaggctccatgtctggttcggttgttaaactgctagttgtaactcgaatggttatgtcttaagtgcatccgagaacaatgaactgcttgctatctatgttattttgtagtgtttgttgtaagatgggtggttttgctt

SEQ ID NO: 4585 - DNA, 2824 bp, Panicum virgatum
gattggtgatgtagagtgctcttccgaactccaatggtttcctcccacagtgcaagatgtggaaatgttcacaatgctcttatagctgagtttcctgacaagtaatgaagtaattgcagagctcatctagggcatcatctgggatttcttggttctttctggagtgagtacttgtttgtttgaagatcttcttcattcaagatgatgcagaggccgctgttccgtcccgaggagtactccttgaaggagaccagacctcactttggaggccatgctgccggtgacaagctcaccagcacctatgacctggttgagcagatgcagtacctctatgtccgagtggtgaaagcaaaggaacttccaaacatggacatcactgggggctgtgacccatatgttgaggtgaagctagggaattataagggcacaactaggtttttcgagaagaacaacaacccagagtggaatcaggtttttgccttttcaaaggagcgcattcagtcatcagttgtggagattgtggtcaaggacaaggatcttgttaaggatgacttcattgggcgcgttgtatttgacctgaatgaggtcccaaagagagtgccacctgatagcccattggctccacagtggtatcgcttggaagaccgacacgggcacaaggtgaagggggagttgatgttggctgtttggatgggtactcaagcagatgaagcattccctgaaacatggcattctgatgctgcctctgtcccaggagatggtcttgcaagtattagatcaaaggtgtatcttactccaaagctttggtatctacgtgtcaatgtcattgaagcccaggatctaataccaaatgataagaccaggttccctgaggtttatgtcaaagccatgctaggcaaccaagttcttcgaaccagggtatcagcaagccggactctgaacccgttgtggaatgaggatttgatgtttgttgctgctgagccatttgaggagcacctgatgttgagtgtagaggacagggtggcccctgggaaggatgaagtaattggaaggacaaccatttctctgcagcatgtaccccgaaggctggatcacaggctgctgaccagccagtggtataatcttgagaagcatgtgatgattgatggtgagcagaagaaagagacaaagttttccagccggattcacttgagaatttgtcttgaaggtggatatcatgtcttggatgagtcgacacattacagtagtgatttaaggccaactgcaaaacctctgtggaaacctagcattggcattcttgagctgggtatcttgacagcacagggcctgttaccgatgaaaaccaaggatgggcgtggcacaactgatgcctactgtgttgcaaagtatggacagaaatgggtccggaccaggactataattgatagtttcacccccaaatggaatgaacagtatacctgggaggtgtatgacccatgcactgtgatcacaattggtgtatttgacaattgccaccttaatggtggggaaaaggctaatggtgcccgggacaccagaattgggaaggtccgcatccgcctctcaacactagaaactgatcgtgtctatacccactcataccctcttattgttttgacacctgctggtgttaagaagatgggtgaggtgcagcttgccatccgtttcacatgttcatcactgctcaatatgatgcatctgtattcacagcccctactgcccaagatgcactatgtgcacccactgtctgtgatgcaagtagacaacctgaggcgtcaagccacaaacattgtctcaacaaggctggggcgtgcagagcctccgctgagaaaggaaattgtggagtacatgctggatgtggactctcacatgtggagcatgagaaagagcaaggcaaacttcttccgtatcatgggtgtcctgagccccctgattgctgtggcaaagtggtttgatcagatctgtcactggaggaacccgctgaccactatactgatccatgtcctctttgtgatactggtcctatacccagagctgatactgcccacaatcttcctctacctgtttctgattggggtgtggtactacaggtggcgtccgaggcagccaccgcacatggacacccgcctctcgcatgccgagacagcccaccctgatgagctcgacgaggagttcgacacattccccacctcccgcccgccagacattgtgcggatgcgttatgacaggctgcggagcgtcgctgggaggatccagactgtcgtcggcgacctcgcgacgcagggtgagcggctgcagtccctgctgagctggagggaccccagggccacagcgctgttcgtggtcttctgcttcatcgccgccattgttctgtacgtcacgccgttccgtgtggtggtcttcctcgccggcctgtacgtgctgaggcaccccaggttccgccacaggatgccctccgtcccgctcaacttcttcaggcggctcccggcaaggaccgacagcatgctgtagtcgcatctggttgttaggctttcatggttggttcagttcttcacctgctaattgcaactccaatggttatgtcttaagtgcatccgaaaacaatgaactgctagctatctatgttaatttagtgtttgtattccaagatgtgtggttttgcttctgaagtgatattgaaccagaacttgtattatctaaaagtagaaagaagcaaaaaccattcagagtgttgatgtcgaagttgttgcttctgaaatggttttgcttccatttccaggtgaagttgttgccgaagttttattca

SEQ ID NO: 4586 - DNA, 2485 bp, Pennisetum glaucum
ttcaagatgatgcagaggccgccgttccgtcctgaggagtactccttgaaggagacgagacctcatcttggtggcaatgccactggtgacaaactcaccagcacctatgatcttgttgaacagatgcagtatctctatgtccgagtggtgaaagcaaaggaacttccaaacatggacatcactgggagctgtgacccatatgttgaggtgaagctaggaaattataagggcacaactcgtttttttgagaaaaacagcaacccagagtggaatcaggtcttttccttttcgaaggagcgcattcagtcatcagttgtggagatagtggtcaaggataaggatcttgttaaggatgacttcattgggcgtgttatatttgaccttaatgaggtcccaaagagggtgccgcctgatagcccattggctccacagtggtataggttggaggaccataatggccacaaggtgaagggggagttgatgttggctgtttggatgggtactcaagcagatgaagcattccctgaagcatggcattctgacgcggcctcagtcgctggagatgggcttgcaagtattagatcaaaagtgtatcttactccaaagctttggtatttgcgtgtcaatgtcatcgaagcccaggatcttataccaaatgataagaccaggttccctgatgtttatgtcaaagccattctaggcaaccaggttcttagaacccgggtatcaccagcccggactctgaacccaatgtggaatgaggacttgttgtttgtcgctgctgagccatttgaggaacacctgattttgagtgtcgaggacagagtggccccaggtaaggatgatgtaattggaagaacagtcatttcgctgcagcatgtaccccggaggctggatcacaggttgctgaccagccagtggtataatcttgagaagcatgtgatgattgatggtgagcagaagaaggagaccaagttttcaagccggattcacttgaggatttgtcttgaaggtggatatcatgtcctggatgagtcaacacattacagtagtgatttaaggccaactgcgaaacctctgtggaaacctagcattggcgttcttgagctgggtatcttgacagcacagggcctgttaccaatgaagaccaaggatgggcgtggcacaactgatgcctactgtgttgcaaagtatggacaaaaatgggtcaggactaggactataattgacagtttcacccccaaatggaatgaacagtacacatgggaggtgtatgatccatgcactgtgatcacaattggtgtgtttgacaattgccatctgaatggtggggacaagggtaatggagctcgggacacccgaattggcaaggtccgcatccgcctctccacactcgaaactgatcgagtgtatacccactcgtatcctcttattgttctgacacctgctggcgtcaagaagatgggtgaggtgcagcttgctgttcggttcacatgctcatcgctgctcaacatgatgcatctatactcacagcccttgctgcccaagatgcactatgtgcacccattgtccgtgatgcaggtagacaatctgagacgccaagccacaaacattgtctcaacaaggctgagccgtgcagagccaccgctgcgaaaggaaattgtggagtacatgctagacgtggattcacacatgtggagcatgagaaagagcaaggcaaacttcttccgtatcatgggtgtcttgggccccttgattgctgtggcaaagtggtttgatcagatctgtcactggaggaacccgctgaccactatactgatccacgtcctcttcatgatactggtcctgtacccggagctgatactgcccacaatcttcctctacttgttcctgatcggtgtgtggtactacaggtggcggccgaggcagccacctcacatggacactcgcctctcacatgcagagactgcccaccccgacgagcttgacgaggagttcgacaccttccctacctcgcgccagcccgacatcgtgcggatgcgttacgaccggctgcggagcgtcgccgggaggatccagacagttgtcggcgatctcgcgacgcagggcgagcggctgcagtccctgctgagctggagggaccccagggcgacggcgctgtttgtggtcttctgcttcatcgccgccatcgtcctgtacgtgacgccattccgcgtggtggtcttcctcgccggcctgtatgtgctgaggcaccccaggttccgctacaagatgccatctgtcccgctcaacttcttcaggcggctcccggcgaggaccgacagcatgctgtagtaggcgcattctgctgctgttacctgtttaggcagcattcggctgctgttacctgtttaggctccatgtcttgttaagttgttgaactgctagttgtaactcgaatgggtcatgtcttagtgcatccgagaacaatgaactgcttgctatc

SEQ ID NO: 4587 - DNA, 3138 bp, Zea mays
gacttcacttcgtccccgtcgaacactccacgccgctctagcactctctgcgctctcccatcctcctcgctagccgtactcttcaccgccgaagcttctggttcctcatcgccgccgctacgcgtgagatcgacccgccgccgtcggtctttttccctgactggtaatctagtgttcattctcttaattcaaatggtttcctcccacggagcaagatgaggaaatattcaaactgctcttagccgtgtagcacgacaagtttgttgcagagctggtctacgacaggtggacagctgggatttcttggcactttgtcaagtccacgagtagaagtgtggtggaagattgtcttcgttcaagatgatgcagaggccactgctccgtccggaggagtactccttgaaggagacctcacctcaccttggtggtgcagctgctggtgacaagctcaccaccacctatgacctggttgagcagatgcagtacctttatgtaagagttgtaaaagcaaaggaacttccaaacatggacatcactgggagctgtgacccgtatgttgaggtgaagctaggaaattataaggggcaaactcagcatttcgagaagaagaacaacccagagtggaatcaggtctttgccttctcaaaggagcgtattcagtcatcagttgtggagattgtagtcaaggacaaggatcttgtcaaggatgacttcattggccgtgttatatttgatctgaatgaggtcccaaagagagtgccacctgatagcccgttggctccacagtggtatcggttggaagaccgaaatgggcacaaggtgaagggggagttgatgttggctgtttggatgggcactcaagctgatgaagcattccctgaagcatggcattctgacgcagcctcggtccctggtgatggccttgcaagcattagatcgaaagtgtatcttactccaaagctttggtatctccgtgtcaatgtcattgaagcccaggatcttataccaaatgacagggccaggttccctgaagtttatgtcaaagcaatgctaggcaatcaagtcctcagaaccagggcaccgagccggaccttgaatccaatgtggaatgaagacttgatgtttgtcgcagctgagccatttgaagaacacctaattttgagtgtagaggacagggtggccccaggaaaggatgaagtaattggaaggacaatgatttcactgcaccatgtaccccggaggctggatcacaggttgctaaccagccagtggtataaccttgagaagcatgtgattattgatggtgagcagaagaaagagaccaagttttcaagtcggattcacttgagaatatgcctcgaaggtggatatcatgtcttggatgagtcaacacattacagtagtgatttaaggccaactgcgaagcctctgtggaaacctagcataggcatgcttgagcttggtatcttgacagcacaaggcctgttgccaatgaagaccaaggatgggcgtggcacaactgatgcgtactgtgttgcaaagtatggacagaaatgggtgcgtactaggactataatcgacagcttcactcccaaatggaatgaacagtacacctgggaggtgtatgatccatgcactgtggtcacaattggtgtatttgacaactgccacctgaacggcggggaaaaggtcaatggtgccagggataccagaatcgggagggtccgcatccgtctctcgacgcttgaaactgatcgggtgtatacccactcataccctcttattgtcctgacacctggtggcgttaagaagatgggcgaggtgcagcttgctgtccgtttcacgtgttcgtcactgctcaacatgatgcatctgtacacacagcccttgctgcccaagatgcactacgtgcacccgctgtccgtgatgcaggtggacaacctcaggcgccaagccacgaacattgtctcgacaaggctgggccgcgcagagccaccgctgcgaaaggaaatcgtggagtacatgctcgacgtggactcgcacatgtggagcatgaggaagagcaaggcgaatttcttccgcatcatgagcgtcttgagccccttggtcgcggtgacaaagtggttcgatcagatctgccgctggaggaacccactgaccaccatactgatccatgtcctcttcatgatactggttctttacccagagctgatactgcccacagtcttcctctacctgttcctgataggggtgtggtactaccggtggcgtctgaggcagccgccacacatggacacccgcctctcccacgcggagactgcccaccccgacgagctggacgaggagtttgacaccttccccacttcccgcccgccagacgtcgtgcggatgcggtacgacaggctgcgcagcgtcgcggggaggatccagaccgtggtcggcgaccttgcgacgcagggcgagcggttgcagtcgctgctgagctggagggacccgagggccaccgccctgttcgttgtcttctgcttcgttgccgccatcgtgctgtacgtcacaccgttccgggtcgtggtcttcctcgcgggcctgtacatgctgaggcaccccaggttccgccacaagatgccgtccgtcccgctcaacttcttcaggcgtctgccggcgaggactgacagcatgctgtaggttgtgggcttgtggcagatgcctggctccattgctggttcagtggtttcacccgtcagttgcagctcacagatggtcactctcctaaggtagtgtatccgaaaacaatgaactgccagctatcttcgtgacttttgtagcttctctctgtcgcatggttggttatgtattcagatggttgtgaacctttcctgtagctaggtatgcgtgatgcatgatgcttgaaaactccgggcgttggttaagttattgctttacctacttgctcagcagcagtggtctgctaacgtggtcctctgctgctgcatgtgcatcgtgttgtttggtttccagctcaatttgtcagtttgccacgtgattggtttcagtttttacttgggtaataccgacctgaattccaggcgaattatgaacaggagaccctgcgagttttctactccgcagactggaact

SEQ ID NO: 4588 - DNA, 3340 bp, Zea mays
gtcgatcgagcactccacgcccctctagtaccctcctctgcacctccctctctctctcctctctactgcctttgtttttgctcgcaagaaaaacccgaaaaagaccttgcgcaaatccgtcgtcctgtccaccgacgaagcttctgagtcctcctcgccgcgcgcctctacgcgtgatatcggtcttttcccctgaatggtgatgtggaggtcattctcttcaattcaaatggtccccccccgcagagcaagatgaggaaatgttcaaaatactcttaagccgtgtagcacgacaagtttgttgcagaggacaagcgacgactgggttttcttggcactttgtcaagtccgtgagtagaagtttggtgtaagcttgtcttcgaacaagatgatgcagaggccaccgctccgtccggaggagtactccttgaaggaaaccacacctcaccttggtggtgcagctgctggtgacaagctcacaaccacatatgacctggttgagcagatgcagtacctttatgtaagagtggtaaaagcaaaggaacttccgaacaaggacatcactgggagttgtgatccttatgttgaggtgaaactaggaaattataagggccaaactgggcatttcgagaagaagaacaacccggagtggaatcaggtctttgcctttgcaaaggagcgcatccagtcatcagttgtggagattctggtcaaggacaaggatcttgtcaaggatgacttcattggacgtgttatatttgatttgaatgaggtcccaaagagagtgccacctgatagcccattggctccacaatggtatcggttggaagaccgcaatgggcacaaggtgaagggggagttgatgctggctgtttggatgggtactcaagctgatgaagcgttccctgaagcatggcattctgatgcagcctccgtccctggtgatggccttgcaagcattaggtcgaaagtgtatctaactccaaagctttggtatctccgtctaaatgtcattgaagcccaggatcttataccaaatgacaagactaggttccctgaagtttatgtcaaagcaatgctaggcaaccaagtccaaagaaccagggcattggcaagccggactttgaatccattgtggaatgaggacttgatgtttgttgcagctgagccatttgaagagcacctagttttgagtgtagaggacagggtggccccaggaaaggatgaagtaattggaaggacaatcattgcactgcagcatgtaccccggaggctggatcacaggttgctaaccagccagtggtataaccttgagaagcatgtgattattgatggtgagcagaagaaagagaccaagttttcaagccggatccacttgagaatatgtcttgaaggtggatatcatgtcttggatgagtcaacacattacagtagtgatttaaggccaactgcaaagcccctgtggaaacctagcattggcattcttgaactgggtatattgacagcacagggcctgttgccaatgaagaccaaggatgggcgtggcacaactgatgcatattgtgttgcaaagtacggacaaaaatgggtgcgtaccaggactataatcgacagtttcactcccaaatggaatgaacagtacacctgggaggtgtatgatccatgcactgtggtcacaattggtgtattcgacaattgccacctgaatggcggggaaaaggccaatggtgcgagggacaccagaattgggaaggtccgcatccgcctctcgacactcgaaactgatcgggtgtatacccactcataccctcttattgttctgacacctggtggtgttaagaagatgggtgaggtgcagctcgctgtccgtttcacgtgttcatcactgctgaacatgatgcatctgtactcacagcccttgctgcccaagatgcactatgtgcacccgctgtctgtgatacaggtggacaacctgaggcgccaagccacaagcattgtctccacaaggctgggccgtgcagagccaccgctgcggaaggaaatcgtggaatacatgcttgacgtggactcgcacatgtggagcatgagaaagagcaaggcaaatttcttccgtatcacgggtgtcctgagccccctgtttgccgtggcgaggtggttcgatcagatctgtcactggaagaacccgctgaccaccgtactgatccatgtactctttatgatactggttctatacccagagctgatactgcccacaatcttcctctacctgttcctgatcggggtgtggtactacaggtggcggccgaggcagccaccgcacatggacacccgcctctcccacgcagagaccgcccacccggacgagcttgacgaggagttcgacaccttccccacctcccgcccaccggacttggtgcggatgcggtatgacaagctgcgcagcgtcgccgggaggatccagaccgtggtcggcgaccttgccacgcaaggcgagcggctgcagtcgctgctgagctggagggacccaagggcgaccgcgctgttcgtggtcttctgcttcgtcgccgccatcgtcctgtatgtcactccgttccgcgtcgtggtcttcctcgcaggcctgtacgtgctgaggcaccccaggttccgccacaagatgccatctgtcccgctcaacttcttcaggcgtctgccggcgaggaccgacagcatgctgtaggcgcggcaggtgcatggccccatcgctggcgggtggtttcgcctctcagttgcagctcacagatggttgttgctctctcttaagtaagtgtatcaaaaaaaaaaaggggctgctagctatcttcgtttactttttgagcttctctgtgttgcatggttggttatgtattcatatggttgtgaacctttcctgtaacaactggacgcatgatgcgtgactgtgtctaggtatgcatgcatgtgtgtgatgcttgaaaactccgagctttagtgtttattgctttacctacttgttcagcggcagtgctgtcagctaacaaggctctctactgctgcatgtgcatcgtgtttggtttgcagctcaatttaccgacttgccagttgtaattgggaaatactgatctgaattttgcctagccgagagcccgagagttctcttctacgcagactggaactatttgggtgccaatctgagcagaggcgagctgttgtacttgtgaacttaatagtgatgtcatggttgaatttccttccaaacggagctgatgcttgtcttcaaaacgctcatggttagggatgtaataaatggcacggatattatctatttgtatttatatccgttcat

SEQ ID NO: 4589 - DNA, 2760 bp, Musa acuminata
cttctatccatggtgcataatggtgaccttactggtgttgttttgatttctttctactagtccgttttagtttccatgttcgcgggcggatttcatgtgaatgcgtgagggtgctgcctcttcccaattgaacaggaaatttttccccaagttgtttactccgctcgctacagttttagatgatgcagaggcctttgcgtcccgaggagtactctttaaaggagacttctcctcaccttggtggtggtggagtttctggtgacaagctcaccaccacctatgatctcgttgagcagatgcagtacctctacgtgcgtgtggtgaaagccaaggaccttccaccaaaagatgtaaccggaagctgtgacccctatgttgaggtgaaacttgggaactacaaaggtacaacccgtcattttgagaagaagactaatcctgaatggaaccaggtctttgccttttccaaggaccgcatccaagcctcagttcttgaagtcattgtaaaggacaaggatttcatcaaggatgatttcatcggaagagtcctgtttgatcttactgaggtaccgaagcgggttcctcctgacagtccattggctccgcagtggtacagattggaggatcggaaaggcgacaaaggtaagggggagctgatgttggctgtctggatgggtactcaagctgatgaagcattccctgattcttggcattcggatgctgccactatccccagcgatggacttgctaacataaggtcaaaggtttaccttacacccaagctttggtatttaagggttaatgtcattgaagcccaggatttaataccttatgaaaagaataggttccctgaggtctttgttaaagttatgcttgggaaccaggctctgagaactagaatatcacaaagcaggaccctaaatcctatgtggaatgaggatttgatgtttgtagcagcagaaccatttgaggagcacttggtcttgagtgtcgaagaccgagtggcacccaacaaagatgaggtattagggaaaacagtaattcccttacagaagatagacagaaggttggactacaagccagtcaatagcagatggtataaccttgagaaacatgtgattgttgagggtgaccagaagaaaaaggaggtgaagttctctagtcggattcatttgaggatatgtctggaaggaggttaccatgttttagacgagtcaacacactacagcagtgatctcaggccaacagcgaaacaattgtggaagccgagcataggggttttggaacttggtatcttgagtgctcaggggctgttgccaatgaagaccaaggatggccggggaacgacagatgcatactgcgtcgctaaatatggacagaaatgggtccgtacaaggactatcatagatagttttgctccaaagtggaatgagcagtacacttgggaggtatatgacccatgtactgtcattacaataggtgtgtttgacaactgtcacttgcaaggaggggagaaagcagctggtacaagggatacaaggattgggaaggtgcggatccgcctgtctacgcttgaaactgacagagtttacacccactcttatcctcttattgttttgcttccttcgggagtaaagaaaatgggtgaagtccagctggctgtccgatttacatgttcttctcttcttaatattttgcatatgtattcccagccgttgctgccaaagatgcattacctccatccattgtctgtcatgcagcttgataatttgcgacatcaggccacacagatagtatcaatgagattgagccgtgcagagccacccttgaggaaggaggttgttgaatatatgttggatgtggattctcacatgtggagtatgcgaaagagcaaagcgaattttttcagaatcatgggcgtcttaagtcctctggttgctgtgggaaagtggtttgatcagatttgccattggaagaatcctttgactacaattttgatccatgtcctctttgtcatcttgatcttatacccagaattgatactcccaacaattttcctgtacctgttcttgattggagtctggtactttcgttggcgaccacggcagcctccttacatggacactcggttgtcacatgcagacactgcacaccctgacgagcttgatgaggagtttgatacttttcccacatcccgtccgcctgacattgtgaggatgagatatgatcgtttaaggagcgttgcaggtagaatacaaactgttgttggtgacctggcgacacaaggggaaaggttacaatctctgttgagctggcgggaccctagagcaactgctttgtttgtgacattctgcttggttgctgctgttgttctctatgttacaccattccgtgttgttgcttttttaacaggtttgtacgtgttgaggcacccaaggttccggcataagcttccatcagtgcctctaaactttttcagaagattgcctgctagaacagatagcatgttatgagagttggttgcccatatgaagatgtctgttttctgataggctgttccagttcggtctcaagatgctgcaggttaattctgatgaaattcaatcagctatcattcaatggacaactggagtatgatgtgaatctttgtgtgtatgctggtcttagttatctaccttacgtatttcatgtttttgttatatttttctttacaatgtgcgacttatcttagatgttttcgctgttaatccaatgtttttctta

SEQ ID NO: 4590 - DNA, 3173 bp, Elaeis guineensis
gaacccggctggtttctgggggcctctacggcgcgctcctcctcggcggcgattgataggtcgagggtatcacgcttgttccgttgcttggtagtgggttttgggggaaatgtgttacgtatttacctcttcgaaggggtattctaaggtctttggcttctgacttggggctttcgttgttgttgctgaaattttttggtgcgatcgagtctggtgctctgagatctccaccgtttccttcttttctcactcagagtgctggatttcttcttttctatcttcctttttgttttctcctgtggagatctaggtattgcggactctgttaaggtttttctctccatttcaagaaagttcagattttgtgtaccttttgagaatttcttacacctctgagatctgaaactgtgctcttttgcttctccgatcgttcgaattggagttgtgtcttctcctttcctgtcaagtgtcgatagtcttagaagatgcagagaccccttcagccccaggagtactccttaaaggagacatctccccaccttggtggtggtggagttgccggcgacaagctcaccacaacttatgacctcgtggagcagatgcagtatctctatgtccgtgtcgtgaaggctagagacctgccgaccaaggatgtaactggaagctgtgacccttatgttgaggtgaagctggggaactacaagggcacaacccgccattttgagaaaacgaccaatcctgaatggaaccaagtctttgccttctcaaaagagcggatacaagcttcctcagtggaagtcattgtcaaagacaaggattttgtgaaggatgatttcattggtcgggtttcatttgatctaaatgagattccgaagcgagttccaccggatagtccattggctccgcagtggtataggctggaagaccggaagggagacaaggtgaagggagaactgatgttagcagtttggatgggcactcaagcagatgaagcgtttccagaagcttggcattcagatgctgcaactgttccaagtgatggccttgcaagtataaggtcgaaggtatacctcacgcctaagctttggtatgtgagggtgaatgttattgaagcccaggacttgcaacctagcgataagagcaggtttgaattctatgttaaagttatgcttggtaatcaagctctcagaactagaatatctcagatcaggaccattaatcctatgtggaatgaagatttgatgtttgtagcagctgaaccatttgaggagcacttggttctgagtgttgaagatcgggtggcacccaacaaggatgaggtattggggaagactgtcatttccctgcagaatgtggacaggaggctggactacaagcctgtcaatagcaggtggtataatctcgagaagcatgtgattgtggagggtgaacagaagaagaaggaggtgaagttctctagtcggattcatctgagaatttgtttagatggtggataccatgttttggatgagtcgacccactatagcagtgatctgaggccaacagcaaaacagttgtggaagcagagcattggagttttggaactgggcatcttgaatgctcaggggttgttgcctatgaagactaaggatggtcgtgggactacggatgcttactgtgttgctaagtatggacagaaatgggtccgtacaaggactattatagatagctttactccaaagtggaatgaacaatacacctgggaggtatatgatccgtgtacggttattacaattggtgtatttgataactgtcacttgcaaggaggggagaaggcagctgctacaagggataccaggattggcaaggtgagaatccgtctttctacacttgaaactgatcgggtttacacccactactaccctcttattgtgttgcttccttctggggtgaagaagatgggagaagttcagctggctgtccgctttacatgttcctctttgattaatatgttgcacctgtattcacaaccattacttccaaagatgcattacctttacccattgtctgttgttcagcttgataacctgaggcaccaggccactcagatagtatcaatgaggttgagccgcgcagagccacctttgagaaaggaggttgtggagtatatgttggatgtggattctcacatgtggagcatgcggaagagcaaggctaactttttcaggatcatgggtgtcctcagccctttgatttcagttggaaaatggtttgatcaggtttgcagttggaggaaccctctgactacaatacttattcacattctctttgtgatattggttttgtacccggaattgatactcccaacgattttcctctacctgtttttgatcggtgtctggtacttccgttggaggcccaggcagcctcctcacatggacacccggctttcacatgcggaatctgcccatcctgatgagctagatgaagaatttgatactttccctacatctcgtccacccgatattgtgaggatgaggtatgaccggttaaggagtgtagcagggagagtacagactgtggttggtgacctggcgacacaaggggagaggttgcaatccctgttgagctggagagacccaagagcaactgccttgtttgtgaccttctgtctgattgctgccattgtgctttatgttacgccgttccgtgttgtggccttactgaccggtttgtatgtgttgagacacccaagattccgccataggcttccgtcggtgccccttaacttctttaggaggttgcctgctagaacggatagcatgttgtgagctgtggaaggccttctcttttgtctgtaccaaaatgatcctggttggaacctgagttgcagctgagtggtgtgacgaagatattcagcggttactttctcaatgaacagctggtgttggatgtctgtgtgatctgtaattttcacctggtatgttggtcttgttggaattgtagcttttttctttatgtttctccttaatttcactttttgatgtgtttttgtttttttcgatgaagcacttcttgatgtgttgctttcttttatatgtttctctgtcaaattcatggagcttctttagtctctgaacctattaattcttataagttgatttgatatctgttgtgcaaacaaaaaaaaaaaa

SEQ ID NO: 4591 - DNA, 3059 bp, Aristolochia fimbriata
ttccgaactcggagggttgacgatttcaagtattcaagttttggagccgttcaacttgacgcttcaattgctccaagttaaaacttgctcaactgtccggtgtgtgaactcctgtctcatttagcttctgagaaaaatgcagcgccctcttccgccggaagactaccgtctgaaggagacctcaccccaccttggtggcggtggagtcgccggagacaagcttaccagcacatatgacctcgttgagcagatgcaatacctctatgtgcgtgttgtaaaagcccgagacctccctgcgaaagatgtgactggaagctgtgatccttatgtggaagtgaagctcggtaattacaaaggcactacgcggcattttgaaaagaagactaatcctgaatggaatcaggtatttgccttctctaaggaccgactgcagtcatccatgatcgaagtaatggtgaaggataaggacttggtcaaggacgatatcatagggcgtgtgatctttgatcttaatgaagtgccaaaaagggtgccccctgacagccctctagcccctcaatggtatagattggaagatagaaaaggggataaggttaaaggagagctgatgttggctgtttggatgggtacccaggctgatgaagcttttccagaagcatggcattcagatgctgcagcagttcacagtgaaggtcttgcaaatatccgatcaaaggtatatctctcaccaaagctttggtatgtaagagttaatgttatagaagctcaggacttgcaacctagtgataaaggaagatatccagaagttttcgttaaggccatccttgggaatcaagccttgagaactagaatttccccaagtagaaatattaatcctatgtggaatgaggatctcatgtttgtggctgctgaaccttttgaagagcatttgatattgagtgtggaagatagggttggaccaaacaaggatgaagttttgggtaaatgtgtgattcccctgcagcatgtggagaggaggttggattataagcctgtgaatacaaggtggtacaatctcgagaaacatattgttgtagagggtgagaaaaagaaggatacgaagtttgcaagcagaattcatttgaggatctgtctggatggtgggtaccatgtgttggatgagtcgacccactatagcagtgatcttaggcctactgcaaaacagctgtggaagcccagtataggggtactggagttaggtattttgaacgcacaggggatcttacccatgaagacaaaggatgggcggggaaccacagatgcctactgtgttgcaaaatatgggcagaaatgggtccggacaaggacgattattgatagcttcataccaaagtggaatgagcaatatacttgggaggtttttgatccatgtactgttatcacaattggagtgtttgataactgccatttactgggtgacaaggcttcgggggctagggatgctaggattggtaaagtgaggattcggctttcaacactcgaaactgatagggtctatacccactcatatcccctcttggttttgcatccatctggggttaagaagatgggggagctccagctggctgtgagattcacctgttcctctttgcttaatatgatgcatatttattctcagccattgcttcccaaaatgcattacctacatcctttatctgttactcagcttgatagtttgaggcaccaagcgacccagatagtttccatgaggttgaacagagcggagccatcattgaggaaagaggttgtggagtatatgttggatatggattcccatatgtggagtatgcggagaagcaaggcaaattttttcagaattatgagtgtgttgagtggtttgattgctgtggggagatggtttgatcaaatttgtctttggaagaaccctttgacgaccattctgattcacattctctttttgattctggtcttgtacccagaattgattctaccgactatttttctctatctgtttttgattgggatctggtacttccggtggagaccaagacaacctccccacatggataccaggctttctcatgcagaaactgttcatcctgatgaactggacgaggaatttgacacattcccaacatctcgaccctctgacattgtaaggatgagatatgatcgattgagaagtgtagccgggaggatacaaactgtcgttggtgacttggcaacacaaggggagaggctgcagaatctgctaagttggcgggaccctagggccacagcactgtttgtgacattttgcctgattgctgctattgttctgtatgtaacaccatttcgggtggtggctctgctgtctggattctatgttttgcggcatccaagattccgccacaaactgccatccgttcctttgaatttcttcagaaggctgcctgccagaacagatagcttgttgtgaggggtccgttggtggggggttgtgttggaaagactctttggggtcccgattagccgaacatcaagatggcaaatgttgcatcaagaggatatagcgacgggttggtttaatttttattttttttaattggctcacagttttgggcaactggtctcatgtataattcgataccgtacgctcctagattctatgaatatgtggtgctttctgtgctcttattgcatctgtgccttgggaaggtccccctgcctgctcccatttattctctggtgtttctttgtttttcattgttatgttatccgtcaatgtacgttggttttaaaatttttaactggagtctggtgttcgaatgcctttccatgattctctctgcggagcaaaggttggatgatttactgctgaaatggaatggagtggatctcgatttactgctgaaatggaatggagtggatctcgatttactgctgaaatggaatggagtggatctcgatttactgctgaaatggaatggagtggatctcgatttactgctgaaatggaatggagtggatctccataagtgcgaatgactgatgaagttctgttgaggaacggaaagtgt

SEQ ID NO: 4592 - DNA, 3267 bp, Citrus clementina
agtgtgtattctctcgcagattcatcagatcccaacccctccgaaaaagcaaaagcaaaagcagatgaataaaaagcaaagccaaaccaggacaccgcccactctttctctctctctcgctgagtctctttgttgttcttatctcttctctcttctctttctaaagtattttcattttttctattttaaatctatgtgaaccttcattttcctcgtttatagtacgaatgaatgaatgagaaagctagggtttccttttcaagcctccgttttgttttcctcctctacatgtcgcccttcaaaggattgaaggtagcagatctgaagctttaaggaagctgctgttgttagggtcttgtggactttcgaatttaaaagaggaaaattatcacttgccgtcttctgtgacgcttttaagtgttctgtttcagcttgaaagtttacaacaacttgggtgtcctttcatttgaaactgtaagccaagatgagaccaccactggaagagttttctttgaaagagacgaaaccccacttgggtgggggaaagataaccggtgacaagctcactagcacctatgacctcgttgagcaaatgcagtacctttatgtccgggttgtaaaggccaaggacttgcccccgaaggatgtcactggtagttgtgatccttatgtcgaagttaagatggggaattataagggtacaactcggcattttgaaaagaaaacaaatcctgagtggaaccaggtgtttgctttctcgaaggatcgtattcagtcttctgtgcttgaggttactgtgaaggataaggattttgttaaggatgattttatgggtagggttttgtttgatttgaatgagattccaaaacgagttccacctgatagtccattggcaccacagtggtataggttggaggatagaaagggggataaggttaggggagaattgatgttggctgtgtggatgggcactcaagcagatgaggcatttcctgaggcgtggcattccgatgcggctactgtcactggaattgagggtcttgcgaacatacggtcaaaggtttatctctcgcctaagctttggtatttgagggttaatgtgattgaagctcaggatctgcaacccaccgacaagggtagattcccagaagtttatgtgaaggcccaactgggaaatcaggctttgagaacaagagtttctgctagcaggaccattaatccaatgtggaatgaggatctgatgtttgtggcagctgaaccatttgaagagcacttgattttgactgtggaagatagagttgcacctaacaaggatgaagttctggggaaatgtatgatcccattgcagtatgtggacaagaggcttgatcataaaccagtgaacactaggtggtataatcttgaaaagcatatcgttgtagaaggggagaagaagaaagatacaaagtttgctagcaggatccacatgaggatttgtttggaaggtggttatcatgttttagatgaatcaacacactacagcagtgatcttaggccaacggcaaagcagttatggaagtccagcataggggtcttagaattggggattttgaatgctcaagggttaatgccaatgaagactaaagatggtcgaggaactacagatgcgtattgtgtggcaaagtatggccagaaatgggttcgaaccaggacaatcattgatagccctactcccaagtggaatgagcagtatacatgggaagtttttgatccgtgtactgttataaccattggggtatttgataattgtcacttgcatggaggagataaagctggtggggcaagggattcaaggattggaaaggtaaggatccgtctttctacccttgaaacagatcgggtttacactcattcgtatccactgctggtgctatacccaaatggtgtcaagaagatgggtgaaattcatttggctgtgaggtttacatgctcttcattgcttaatatgatgcacatgtactcgcagccactgttaccaaagatgcactatctgcatccattgactgtcagccagctcgatagcttgagacaccaggccactcagattgtgtccatgagacttagccgagctgagccgccgttgaggaaagaagtagtcgagtacatgttggatgtgggctctcatatgtggagcatgagaagaagcaaagctaactttttcaggattatgggagttttgagtgggataattgctgttggaaaatggtttgatcagatctgcaattggaaaaaccccattacgacagtgttgattcacatcttgttcatcatactggtgctgtatccagagcttatcttaccaacagtgttcctctatctcttcttgattggtgtttggtattatagatggagaccaagacatcctcctcacatggacacccgtctctcacatgcagattctgctcatcctgatgaacttgatgaagaatttgatacatttccaacttctaggccttctgatattgtaaggatgagatatgatcgactgagaagtattgctggaagaattcagactgtggttggtgatttagctactcaaggggagaggctgcagtctttactgagctggagagacccaagagccacagctctgtttgtaattttctgtctgattgcagccattgttctttatgttacaccattccaagttgtggctcttctaacgggattttatgtgttaagacatccaaggttccgtcacaagcttccttccgtaccgctcaatttcttcaggaggttgccagcaagaactgattgcatgctatgagtgaggccatatatactccaactgccttttaagttatatggcatttaattttatctgtttcttgtcaactcagcgacgaatttatggaaacaaaattgagcttgtttgcctactatattatgcaagatgggtgtcaggttctggtatgacatgtaaccttcccctaaaggtggtagattttgtggatttgtggttctttttatgttattttataggattctatgttttaaactcaagtctacggtgatcaatcgatgttaatttgtaattttgtaggcttctgagtgcaattaacccatcctgaacaccctcttgcttaattttatccagtagatattcatctgatggaaaatttgattttcaatatttgacgctttttcttgggatggcacgagttcgaatgtctttatgttcatatttcaattgcatgcttcaccatgttagcttgaatctttaattca

SEQ ID NO: 4593 - DNA, 3278 bp, Citrus sinensis
agtgtgtattctctcgcagattcatcagatcccaacccctccgaaaaagcaaaagcaaaagcagatgaataaaaagcaaagccaaaccaggacaccgcccactctttctctctctctcgctgagtctctttgttgttcttatctcttctctcttctcttttctctttctaaagtattttcattttttctattttaaatctatgtgaaccttcattttccttgtttatagtacgaatgaatgaatgaatgagcaagctagggtttcctttttaagcctccgttttgttttcctcctctacacgtcgcccttcaaaggattgaaggtagcagatctgaagctttaaggaagctgctgctgttagggtcttgtggactttcgaatttaaaagaggaaaattatcacttgccgtcttctgtgacgcttttaagtgttctgtttcagcttgaaagtttacaacaacttgggtgtcctttcatttgaaactgtaagccaagatgagaccaccactggaagagttttctttgaaagagacgaaaccccacttgggtgggggaaagataaccggtgacaagctcactagcacctatgacctcgttgagcaaatgcagtacctttatgtccgggttgtaaaggccaaggacttgcccccgaaggatgtcactggtagttgtgatccttatgtcgaagttaagatgggcaattataagggtacaactcggcattttgaaaagaaaacaaatcctgagtggaaccaggtgtttgctttctcgaaggatcgtattcagtcttctgtgcttgaggttactgtgaaggataaggattttgttaaggatgattttatgggtagggttttgtttgatttgaatgagattccaaaacgagttccacctgatagtccattggcaccacagtggtataggttggaggatagaaagggggataaggttaggggagaattgatgttggctgtgtggatgggcactcaagcagatgaggcatttcctgaggcgtggcattccgatgcggctactgtcactggaattgagggtcttgcgaacatacggtcaaaggtttatctctcgcctaagctttggtatttgagggttaatgtgattgaagctcaggatctgcaacccaccgacaagggtagattcccagaagtttatgtgaaggcccaactgggaaatcaggctttgagaacaagagtttctgctagcaggaccattaatccaatgtggaatgaggatctgatgtttgtggcagcagaaccatttgaggagcacttgattttgactgtggaagatagagttgcacctaacaaggatgaagttctggggaaatgtatgatcccattgcagtatgtggacaagaggcttgatcataaaccagtgaacactaggtggtataatcttgaaaagcatatcgttgtagaaggggagaagaagaaagatacaaagtttgctagcaggatccacatgaggatttgtttggaaggtggttatcatgttttagatgaatcaacacactacagcagtgatcttaggccaacggcaaagcagttatggaagtccagcataggggtcttagaattggggattttgaatgctcaagggttaatgccaatgaagactaaagatggtcgaggaactacagatgcgtattgtgtggcaaagtatggccagaaatgggttcgaaccaggacaatcattgatagccctactcccaagtggaatgagcagtatacatgggaagtttttgatccatgtactgttataaccattggggtatttgataattgtcacttgcatggaggagataaagctggtggggcaagggattcaaggattggaaaggtaaggatccgtctttctacccttgaaaccgatcgggtttacactcattcatatccactgctggtgctatacccaaatggtgtcaagaagatgggtgaaattcatttggctgtgaggtttacatgctcttcattgcttaatatgatgcacatgtactcgcagccactgttaccaaagatgcactatctgcatccattgactgtcagccagctcgatagcttgagacaccaggccactcagattgtgtccatgagacttagccgagctgagccaccgttgaggaaagaagtagttgagtacatgttggatgtgggctctcatatgtggagtatgagaagaagcaaagctaactttttcaggattatgggagttttgagtgggataattgctgttggaaaatggtttgatcagatctgcaattggaaaaaccccattacgacagtgttgattcacatcttgttcatcatactggtgctgtatccagagcttatcttaccaacagtgttcctctatctcttcttgattggtgtttggtattatagatggagaccaagacatcctcctcacatggacacccgtctctcacatgcagattctgctcatcctgatgaacttgatgaagaatttgatacatttccaacttctaggccttctgatattgtaaggatgagatatgatcgactgagaagtattgctggaagaattcagacagtggttggtgatttagctactcaaggggagaggctgcagtctttactgagctggagagacccaagagccacagctctgtttgtaattttctgtctgattgcagccattgttctttatgttacaccattccaagttgtggctcttctaacgggattttatgtgttaagacatccaaggttccgtcacaagcttccttccgtaccgctcaatttcttcaggaggttgccagcaagaactgattgcatgctatgagtgaggccatatatactccaactgccttttaagttatatggcatttaattttatctgtttcttgtcaactcagcgacgaatttatggaaacaaaattgagcttgtttgcctactatattatgcaagatgggtgtcaggttctggtatgacatgtaaccttcccctaaaggtggtagattttgtggatttgtggttctttttatgttattttataggattctatgttttaaactcaagtctacggtgatcaatcgatgttaatttgtaattttgtaggcttctgagtgcaattaacccatcctgaacaccctcttgcttaattttatccagtagatattcatctgatggaaaatttgattttcaatatttgacgctttttcttgggatggcatgagttcgaatgtctttatgttcatatttcaattgcatgcttcaccatgttagcttgaatctttaattca

SEQ ID NO: 4594 - DNA, 2776 bp, Populus trichocarpa
caagcaagacagaacatttcacatttcagtatagaaaagaacaaggaaaaaaagtcattccattgcatgaatttaacaaggttgagatcagaaatccccaacgggtaatatctactagatgtagtcaagcatagagaaggttctcaccaaaggtaaaattccaatcacatcctacaaaattacaaatgaacatggattgattaccataaagctcagaagtttgaaacaggaatcctattaaaacaacttaaaataacccgcaaatccacaaaatctactaccttcggaggaaacagaaccgccaatcttcttcactgacttgaaaaggagggcaagacaaatgctaaatgcaattgcggataaaactggctttgctcacagcatgcaatcggttcttgctggcaaccgccggaagaaattgagtggaactgatggaagtttgtggcggaacctaggatgtctcagcacataaaacccagtgagaagtgccacaacttggaaaggagtaacatagagaacaatggcagcaatcagacaaaaaagcacaaacagggctgtggcccttgggtctcgccagctcagcagagattgcagcctctccccttgagtagctaaatcaccaacaacagtctgaatcctccccgcaatacttctcaagcgatcatatctcatccttacaatatcaggtggccgcgaagtagggaacgtgtcaaattcctcatccaattcatcaggatgtgcagactctgcatgagagagacgagtgtccatgtgaggaggatgccttggcctccatctataataccaaacaccgatcaggaagagatacaggaagattgtgggcaagataagttctggaaaaagaaccaggattataaacaatatgtggatcagcacagtcgtgattgggtttttccaattgcatatctgatcaaaccattttcctacagcaattagcccaccaaaaacgttcatgattctaaaaaagttggctttacttcttctcatgctccacatgtgagaccccacatccagcatatattcaacaatctccttccttaatggtggctctgccctgctcagcctcattgacacaatctgagtggcctgatgccttaagctatctagctggctgacagtcagtggatggatataatgcatctttggcagcaaaggttgtgaatacatgtgcatcatattaagcaaggatgagcatgtaaaacggactgccaaatgaatttctcccatcttcttgacaccattaggatgcaggaccaacagtgggtaggagtgtgtgtaaaccctatcagtttcaagtgtggaaagacggattcgtacctttccgatccttgaatcccttgcccctccaggcttgtcccctccatgcaaatgacaattatcaaagaccccgattgttatgacagtacagggatcgaaaacctcccaagtatattgctcattccacttgggtgtgaaactgtcgataatggtccttgtacgaacccacttctgcccatattttgccacacagtatgcatcagttgttccccgactatcctttgtcttcatgggcatcaatccctgagcattgagaatacccacttccagtacccctatgctgttcttccacagctgtttagctgtcggacgaagatcactactatagtgtgttgattcatccaaaacatgataaccaccctccaagcagatcctcgtgtgaatcctgctggaaaactttgtttctttcttcttttccccttctacaataacatgtctctccagattaaaccacctagtgttcacaggcttatggtccaaccttctgtccacataatgcattggaatcgcacatttccccaatacttcatccttgttgggcgcaatcctatcttccacactcaaaatcaagggctcctcaaaaggttctgctgccacaaacataaggtcctcgttccacataggattaatactcctgctaggagaaactcttgttctcaagacttgatttcccagggtagctttaacatatacttctggatacctgcctttgtcacttggttgcaggtcctgagcttcaatcacattgacccttaaataccataattttggggagagatataccttggaacgaatattagcaagaccatccgtcccagtaacagtagctgcatctgaatgccatgcttctggaaaagcttcatctgcctgtgtccccatccacaccgctaacatcaactcccccttaaatttatctcccttcctatcctccaatcgataccactgtggtgccaaaggactatcaggaggaacccgttttggtacctcattcaaatcaaacaaaacccgacccatgaaatcatccttcacaaaatccttatccttaacagtaacctcaagcatcgaggcctgcatacgatccttcgagaatgcaaacacctggttccactccggattcgacttcttctcaaaatgccgagtcgtacccttatagtttccaagtttaacttccacataaggatcacaactacccgtaacatccttcgcaggcaattccttggccttaacgacccggacataaagatattgcatctgctccacaagatcataggtgcttgtaagcttgtcaccggtgatcttcccccctcccagatggggattggtctctttcaatagaaaatcctcatgtagaggcctctgcatcttgtcggctcaaaggagagacactcaatcttcaagttgaagttgaagagtttgtcttctattgcaccaaaataaa

SEQ ID NO: 4595 - DNA, 2892 bp, Phalaenopsis aphrodite
catcacatgctctctctgcttcagtgggagtgctctttcatcccaagaagcttttggtttctgtcggagtctacctccgaccctgcttccttctgcggcacgtggttttcgatcgacctatcaagtgtttctggtttcagtagccattttaattcgaacacctaagttctgtttcattaggagattttgtgggagtttgggactcaatatttgaactttaaacgttctctgcaatttaactactggttgaaagggtcaaatctccatactgccttaggatatcgccacatttgctgcttacttgtgtttccttgctagttcaagatgatgcagaggcctcttcgccctgaagattactctctgaagcagacttctcctcaccttggtggcggaggagctgcaggtgataagcttaccaccacttatgaccttgtcgagcagatgcagtatctctatgtccgtgttgtcaaagctaaggacctccctgcaaaggatattacaggcagtcttgatccatatgtggaggtcaagctgggtaattacaagggaactacccgtcattttgagaagaagactaatcctgaatggaaccaggtctttgccttctccaaagatcggatccaagcttccattcttgaggttctagtcaaggacaaagattttgtgaaggatgattttgtcgggagggttactttcgatttgagtgagatcccgaaaagggttcctcctgatagccctttagctcctcagtggtacagattggaaaataagaacggtgataagattaagggggagctgatgttggcagtgtggatgggcactcaagcagatgaggcattctcaaatgcttggcattctgatgctgcgacggttcctagtgatggccttgctaatataagatcaaaggtttatctgacacctaagctttggtatgttagggttaatgtcattgaagctcaggatttgcagcttagtgacaagggcaggtttcccgaagtatttgtgaaggcatcgcttgggaaccaagccctcaggacaaggatatctgcaatcaggaacattaatccaatgtggaatgaggatttgatgtttgtagctgcggagccatttgaggagcacttggtcataagtgctgaagatagggttgggccgaacaaggaggaggtccttgggaagactattattccgctccagaatgttgatagaaggttggactacaagcccgtgccgagccgatggtatactattgagaaacatgtggtcattacagaaggtgacaagaaaaaggaattgaagttttctagcaggattcatcttaggatatgtttggatggtgggtaccatgtattagatgaatccacacattacagcagtgatttcagaccaacagcgaagcaactgtggaagccaagtattggagttcttgaattagggatcttgaatgctcaaggtctgtcgccaatgaagaacaaggatggaaagggaactgttgatgcgtattgtattgcaaaatatggacagaaatgggttcgaacgaggactataattgacagttttgctccaaaatggaatgagcagtacacttgggaggtatatgatccgtgtacggttgtgacaattggtgtgtttgataactgtcacttacaaggtggtgagaaggctgcaggaacccgggattccaggattggtaaggttcgaatccgactttcaaccctcgaaacggataaagtttacacccatgcatatcctttacttgttttgctaccttcgggagtgaagaagatgggagaggtgcaacttgccgtccgatttacttgttcttcgctgcttaacatgatgcacatgtattcgctgccattgcttccgaaaatgcactacctttttcccctttctgtgactcaacttgataacctgaggtaccaagctactcagattgtttcaatgagacttagccgcgcagaaccgccattgaggaaagaagttgttgagtatatgcttgatgtggactctcacatgtggagtatgagaaagagcaaagctaatttcttcagactcatgggtgtatttagtggtgttattgcagttggaaaatggtttaatcaaatatgcaattggagaaatcctttgactacagtgctcattcatgtcctgtttgtgattcttgttctgtatcctgaacttatacttccaacaatattcttgtatctgttcctaattggagtatggtactatcgacggaggccgaggcatcctcctcacatggacaccagactctcccatgcagaaactgctcatcctgatgagttggacgaagaattcgatacttttcctacttctcgaccccctgatatcgtcaggatgcgatatgatcgattgaggagtgttgctggtcggattcagacggttgttggagatctcgcgacccaaggggagagattgctatcactgttgagttggcgggatccaagggcaactgcactttttgtgatattttgtctgattgctgctattgtgctatatgttactccatttcggttggtggcttttttggctggaatatatgtgctaaggcatccaaggttcagacacaagatgccatctgttcctcttaacttcttcaggaggttgcctgctaggacggatagcatgttatgagaaggtcagatctgtcttgtatggctgttttttaaacagaccttgaattgctagcttcctagttgtagctggagatttgtcagccttatcattttaaaatgatctgtagcatgttcttctttctttgtttccttgctgtctgttttgttgtgttttctcaagatgtgaacttatctgttttttgtttaatgctttatcatatcctgtaatatcatttcgcatgttcttcttccccat

SEQ ID NO: 4596 - DNA, 2961 bp, Populus trichocarpa
ctctcccccagattcattaaagtgaaaaacacaaacactaataaacacaaatattagaaataaacactaaaaaaaaaaaaagcgaaaagcaaaagcaccgctactccccccgtcttgattctacctgtctatgtagttgtaggagcgctggggttctttctttggatcttcttcctcatgttctctaagggtttttgaattgaaagactctgaattcaacgcttttttttattttggtgcaatagaagacaaactcttcaacttcaacttgaagattgagtgtctctcctttgagccgacaagatgcagaggcctctacatgaggattttctattgaaagagaccaatccccatctgggaggggggaagatcaccggtgacaagcttacaagcacctatgatcttgtggagcagatgcaatatctttatgtccgggtcgttaaggccaaggaattgcctgcgaaggatgttacaggtagttgtgatccttatgtggaagttaaacttggaaactataagggtacgactcggcattttgagaagaagtcgaatccggagtggaaccaggtgtttgcattctcgaaggatcgtatgcaggcctcgatgcttgaggttactgttaaggataaggattttgtgaaggatgatttcatgggtcgggttttgtttgatttgaatgaggtaccaaaacgggttcctcctgatagtcctttggcaccacagtggtatcgattggaggataggaagggagataaatttaagggggagttgatgttagcggtgtggatggggacacaggcagatgaagcttttccagaagcatggcattcagatgcagctactgttactgggacggatggtcttgctaatattcgttccaaggtatatctctccccaaaattatggtatttaagggtcaatgtgattgaagctcaggacctgcaaccaagtgacaaaggcaggtatccagaagtatatgttaaagctaccctgggaaatcaagtcttgagaacaagagtttctcctagcaggagtattaatcctatgtggaacgaggaccttatgtttgtggcagcagaaccttttgaggagcccttgattttgagtgtggaagataggattgcgcccaacaaggatgaagtattggggaaatgtgcgattccaatgcattatgtggacagaaggttggaccataagcctgtgaacactaggtggtttaatctggagagacatgttattgtagaaggggaaaagaagaaagaaacaaagttttccagcaggattcacacgaggatctgcttggagggtggttatcatgttttggatgaatcaacacactatagtagtgatcttcgtccgacagctaaacagctgtggaagaacagcataggggtactggaagtgggtattctcaatgctcagggattgatgcccatgaagacaaaggatagtcggggaacaactgatgcatactgtgtggcaaaatatgggcagaagtgggttcgtacaaggaccattatcgacagtttcacacccaagtggaatgagcaatatacttgggaggttttcgatccctgtactgtcataacaatcggggtctttgataattgtcatttgcatggaggggacaagcctggaggggcaagggattcaaggatcggaaaggtacgaatccgtctttccacacttgaaactgatagggtttacacacactcctacccactgttggtcctgcatcctaatggtgtcaagaagatgggagaaattcatttggcagtccgttttacatgctcatccttgcttaatatgatgcacatgtattcacaacctttgctgccaaagatgcattatatccatccactgactgtcagccagctagatagcttaaggcatcaggccactcagattgtgtcaatgaggctgagcagggcagagccaccattaaggaaggagattgttgaatatatgctggatgtggggtctcacatgtggagcatgagaagaagtaaagccaacttttttagaatcatgaacgtttttggtgggctaattgctgtaggaaaatggtttgatcagatatgcaattggaaaaacccaatcacgactgtgctgatccacatattgtttataatcctggttctttttccagaacttatcttgcccacaatcttcctgtatctcttcctgatcggtgtttggtattatagatggaggccaaggcatcctcctcacatggacactcgtctctctcatgcagagtctgcacatcctgatgaattggatgaggaatttgacacgttccctacttcgcggccacctgatattgtaaggatgagatatgatcgcttgagaagtattgcggggaggattcagactgttgttggtgatttagctactcaaggggagaggctgcaatctctgctgagctggcgagacccaagggccacagccctgtttgtgcttttttgtctgattgctgccattgttctctatgttactcctttccaagttgtggcacttctcactgggttttatgtgctgagacatcctaggttccgccacaaacttccatcagttccactcaatttcttccggcggttgccagcaagaaccgattgcatgctgtgagcaaagccagttttatccgcaattgcatttagcatttgtcttgccctccttttcaagtcagtgaagaagattggcggttctggtataatgaaggtagtagattttgtggatttgcgggttattttaagttgttttaataggattcctgtttcaaacttctgagctttatggtaatcaatccatgttcatttgtaattttgtaggatgtgattggaattttacctttggtgagaaccttctctatgcttgactacatctagtagatattacccgttggggatttctgatctcaaccttgttaaattcatgcaatggaatgactttttttccctc

SEQ ID NO: 4597 - DNA, 3327 bp, Populus trichocarpa
aaagcaaaagtgggagaaagagtatgttctgtgtgtattctctcccccagattcattaaagtgaaaaacacaaacactaataaacacaaatattagaaataaacactaaaaaaaaaaaaagcgaaaagcaaaagcaccgctactccccccgtcttgattctacctgtctatgtagttgtaggagcgctggggttctttctttggatcttcttcctcatgttctctaagcgttgaagcgtttcagatctgaagatttgaagggtttttgaattgaaagactctgaattcaacgcttttttttattttggtgcaatagaagacaaactcttcaacttcaacttgaagattgagtgtctctcctttgagccgacaagatgcagaggcctctacatgaggattttctattgaaagagaccaatccccatctgggaggggggaagatcaccggtgacaagcttacaagcacctatgatcttgtggagcagatgcaatatctttatgtccgggtcgttaaggccaaggaattgcctgcgaaggatgttacaggtagttgtgatccttatgtggaagttaaacttggaaactataagggtacgactcggcattttgagaagaagtcgaatccggagtggaaccaggtgtttgcattctcgaaggatcgtatgcaggcctcgatgcttgaggttactgttaaggataaggattttgtgaaggatgatttcatgggtcgggttttgtttgatttgaatgaggtaccaaaacgggttcctcctgatagtcctttggcaccacagtggtatcgattggaggataggaagggagataaatttaagggggagttgatgttagcggtgtggatggggacacaggcagatgaagcttttccagaagcatggcattcagatgcagctactgttactgggacggatggtcttgctaatattcgttccaaggtatatctctccccaaaattatggtatttaagggtcaatgtgattgaagctcaggacctgcaaccaagtgacaaaggcaggtatccagaagtatatgttaaagctaccctgggaaatcaagtcttgagaacaagagtttctcctagcaggagtattaatcctatgtggaacgaggaccttatgtttgtggcagcagaaccttttgaggagcccttgattttgagtgtggaagataggattgcgcccaacaaggatgaagtattggggaaatgtgcgattccaatgcattatgtggacagaaggttggaccataagcctgtgaacactaggtggtttaatctggagagacatgttattgtagaaggggaaaagaagaaagaaacaaagttttccagcaggattcacacgaggatctgcttggagggtggttatcatgttttggatgaatcaacacactatagtagtgatcttcgtccgacagctaaacagctgtggaagaacagcataggggtactggaagtgggtattctcaatgctcagggattgatgcccatgaagacaaaggatagtcggggaacaactgatgcatactgtgtggcaaaatatgggcagaagtgggttcgtacaaggaccattatcgacagtttcacacccaagtggaatgagcaatatacttgggaggttttcgatccctgtactgtcataacaatcggggtctttgataattgtcatttgcatggaggggacaagcctggaggggcaagggattcaaggatcggaaaggtacgaatccgtctttccacacttgaaactgatagggtttacacacactcctacccactgttggtcctgcatcctaatggtgtcaagaagatgggagaaattcatttggcagtccgttttacatgctcatccttgcttaatatgatgcacatgtattcacaacctttgctgccaaagatgcattatatccatccactgactgtcagccagctagatagcttaaggcatcaggccactcagattgtgtcaatgaggctgagcagggcagagccaccattaaggaaggagattgttgaatatatgctggatgtggggtctcacatgtggagcatgagaagaagtaaagccaacttttttagaatcatgaacgtttttggtgggctaattgctgtaggaaaatggtttgatcagatatgcaattggaaaaacccaatcacgactgtgctgatccacatattgtttataatcctggttctttttccagaacttatcttgcccacaatcttcctgtatctcttcctgatcggtgtttggtattatagatggaggccaaggcatcctcctcacatggacactcgtctctctcatgcagagtctgcacatcctgatgaattggatgaggaatttgacacgttccctacttcgcggccacctgatattgtaaggatgagatatgatcgcttgagaagtattgcggggaggattcagactgttgttggtgatttagctactcaaggggagaggctgcaatctctgctgagctggcgagacccaagggccacagccctgtttgtgcttttttgtctgattgctgccattgttctctatgttactcctttccaagttgtggcacttctcactgggttttatgtgctgagacatcctaggttccgccacaaacttccatcagttccactcaatttcttccggcggttgccagcaagaaccgattgcatgctgtgagcaaagccagttttatccgcaattgcatttagcatttgtcttgccctccttttcaagtcagtgaagaagattggcggttctggtataatgaaggtagtagattttgtggatttgcgggttattttaagttgttttaataggattcctgtttcaaacttctgagctttatggtaatcaatccatgttcatttgtaattttgtaggatgtgattggaattttacctttggtgagaaccttctctatgcttgactacatctagtagatattacccgttggggatttctgatctcaaccttgttaaattcatgcaatggaatgactttttttccctcacttgcgcttattcctactaaaacattgcctctttaagctgttctggtctcattcttaccatccgaagttttggatctcacttgcatgtctgacggactgaatgagggagtaaaaaggggatctcgagagtacctgccctacctggttgattactttaaatgaaaacctgattagattgatgtctcaacttgttcttttctatactgaaatgtgaaatgttctgtcttgcttgtttggtatctctatcattccaggacatcctgtcttatcagtgagagaaatatatatatatat

SEQ ID NO: 4598 - DNA, 2760 bp, Amorphophallus konjac
tcccgcgactcgatgatctagggtttgcgttctcttggctcggggattccttcttgactcacactttccaaggtaacgagttttttttttcctctaaatcttcggtggaaacttcaaaagtccaaagattaccatgatgcagaagcttctcccgaggagtactccctgaggggagaccatctctcaccttggtggctaccggattgtgggagacaagatgaccagcacatatgacctcgttgagcagatgcagtatctctatgtccgagttgtcaaagccaaggatctaccccccaaggatgttactggaagttgtgacccctatgtcgaagtcaagcttgggaactacaagggcactactcgccattttgagaagaagaccaatcctgaatggaaccaggtctttgccttctcaaaggaccgcatacaggcttctgtggtcgaggttgttgtgaaggacaaggatttcgtgaaggatgatttcatggggagggtggtgttcgacctcaatgaggtccccaagcgggttcccctgatagcccactggcccctcagtggtatagattggaagatcggaaaggggataaggttaaaggagagataatgcttgctgtttggatgggcacccaggcagatgaggcattcccagaggcatggcattctgatgcagccactgttccgagtgatggccttgcaaatataaggtcaaaggtgtatctctcacccagactttggtacgtgcgtgttaatgttattgaggcacaggacttacaacccagtgataagggcaggtatcctgaagtttttgttaaggcgattcttggaaatcaagccctgaggaccagggtctctcaaagcaggagcattaatcctatgtggaatgaggatctgatgtttgtagctgcagagccatttgaagagcacctgattttgactgtggaggatagagtggggcctaataaggatgaagtattgggtaaaactgtgattcctctgcaaaacatcgagaggaggttagacaacaaggctgtaaacagcaggtggtataatctggagaagcatgtggaggttgtggaaggtgagaagaagaaggagacaaagttctccagtcggattcatttgaggatatgtttggatggtggctaccatgtcctcgatgagtcgacacactacagtagtgatcttaggcctacagccaagcaattgtggaaaccaagcattggtgttttggagctaggtgttttgagcgctcaaggtttgttaccaatgaagacgaaggatggccgaggcaccactgatgcctactgtgttgcaaaatatgggcagaagtgggtccgcactaggaccatcatcgacagctttactccaaagtggaatgaacagtaccactgggaggtgtatgatccttgcactgttatcaccgttggggtctttgataactgtcacttacaaggaggggacaaggcaagcagggactcgaagaatagggaaggtaagaattcgactttccacacttgagacagatcgagtttatacacattcctatccactctagtcctgcatccacaggagtgaaaaagatgggagaaatccagctagccatccgctttgcttgtgcatccttgattaatatgatgcatatttactcccagccattgcttccaaaaatgcattacctacatcccttgtctgtggcacagcttgacagtttgaggcatcaggctactcagatagtgtctatgaggttaagccgtgcagagccaccactgaggaaggaggttgtggaatatatgttggatgtggattcccacatgtggagcatgcggaggagcaaggccaactttttcagaatcatgggtgtcttaagtggtctgattgcagttgggagatggtttgatcagatctgcaattggaagaaccctttgaccacaatactaatccatgtcctcttcatgacactggtgttgtacccagagttgatacttcctacagttttttatacctgttcttgattggggtatggtacttcagatggaggccaaggcaacctcctcacatggacacacgactatctcaggcagagagctgtcacccagatgagctggatgaggagtttgatacctttcctactagtcgcccacctgacattgtccggatgaggtatgatcgtctgaggagcattgcgggaagggtgcagacagtggtcggtgacttggcaacacagggagagagattacagtctttactgagttggcgagacccaagggcgacggccctttttgtgaccttctgtctaattgctgccattgtgctctatgtgacacctttccgcatggtggccctttttacaggtttctatgtgttgagacacccgaggttccgtcacaagcttccctcagtgccactcaacttcttcagaaggttgcctgctagaacagacagcatgttgtgagcaccatccccgtcacttcttcatcacctctcttccgtttatcgctatgtatttttgttttggtcttggtcggatccatgcccaatgtctctgtcaatgtgatatccctgcaaaagatgtaggagctgttggtatcagcctattagaattccattgcatcgatcatgttgtttatgatgtgtaatttcacctgtactgtatgctgaattgctgatacctaatccaagctaggtgtctatgttgagttttagaactgccttctcatacttttggtggctttttcatttgttatcaatcttatgatagtt

SEQ ID NO: 4599 - DNA, 2515 bp, Vinca minor
caggagaaaatagaatttcttgttaaacacagagaacagagaaaatgcagaggcctccgcaggatgattttcagctcaaggagactaaaccccatctcgggggaatgaaggtgacgggggataaactaacgagcacctatgatctcgttgagcaaatgcagtacctttatgttcgggttgtgaaggcgaaagaattacctgggaaggatgtaacaggtagttgtgatccttatgttgaggttaggatggggaactacaagggtacgactcgtcattttgaaaagaagtcgaaccccgagtggagtcaggtgtttgctttctcaaaggaccgtattcaagcttcagtgcttgaggtcacagtgaaagacaaggatatggtgaaggatgatttcattggtcgagttctatttgatttgaatgagattccgaaaagggttcctccagatagtcctctggctccacagtggtacaggttggaggataggaaaggggataaggttaagggggagctgatgttggctgtttggatgggtactcaggcagatgaagcatttccggaggcatggcattcagatgctgcagctgtaagtggtgccgatggccttgcaaacatcaggtcgaaggtgtatctgtcgcctaagttgtggtatctcagggttaatgtaattgaagctcaggacctaatacccaatgataagagtaggttccctgaagtgttcgtcaaggccattctcgggaatcaggctttgaggactagagtgtcgatgaacaaaagtatcaatcccatgtggaatgaggatctgatgtttgtggcagcggaaccttttgaggagcctctgattttaagtgtggaagatagagtggcacctaataaagatgaagtattgggaaggtgtgccattcctctacaaatggtcgatagaagattggaccacaaacctataaaacacaaagtggtataaccttgagaaacacataattgttgaagggggagaagaggagggacgtcaagtttgccagcaggatccacatgaggatctgtctggaaggaggttaccatgtactggatgaatcaacccattacagtagtgatcttcgaccgacagcaaaacagttatggaagtcgagcatcggggttcttgaattaggtattttgaatgctcaagggctgcagcctatgaaaacaaaagatggaagggctacaactgatgcgtattgtgtggctaaatatggacaaaaatgggtccggacaaggacaattattgatagctttgctcccaagtggaatgagcaatacacttgggaggtttctgatccttgcactgtcataaccattggtgtttttgataattgtcatctccaaggtggcgacaaagctggaggggctagggactcgagaattggaaaggttaggattcgtctttctactttggaaactgatcgtgtctatacacattcatatccacttttagttttacatccttctggggtgaagaagatgggcgaaatccatttggccgtgagattcacttgctcgtcgttgttgaatatgatgtatttgtactcacaaccacttttgccaaaaatgcactatatccatccactcactgtgagtcagctcgataacttgaggcaccaggctactcagatcgtctccatgagacttagtcgtgctgagcctcctttaaggaaagagattgtggaatatatgctcgatgtcggttctcacatgtggagcatgaggagaagtaaagccaacttttttagaataatgggggttctaagtggattgatttctgttggaaaatggtttgaccaaatctgcaattggaagaatcccattaccacggttctaattcacattttgttcctaatactggttctgtatcccgagctgattctgccgaccatcttcctgtatcttttcctgattggagtttggtactacagatggaggccaaggaatccaccccatatggatactcggctctcttgtgctgataacgcccatccggatgaactggatgaagaattcgatacttttccaacttcacgccccgctgatattgttaggatgaggtatgacaggttaagaagcattgcaggaaggatccagactgtggttggcgacctggcaactcaaggagaacgtctccagtctttgttgagctggagagacccaagagctaccgctctgtttgtgatattctgtctggttgctgctattgtcctctatgttacgccttttcaagtggtggcccttctttcgggcttttatgtcttgagacatccaagattccgtcacaaacttccatcagtgccgctcaatttctttaggaggttacctgctagaacggactgcatgctttgagcagttcgcgttttagcaaccatttccatattttcttttgcaggtgaaggaagccgatctctacaatcaagtgaaagaatgttgctttgtgcgtgataacatgtaagatcccatctgatgtaattggtgtttatggtttttttt

SEQ ID NO: 4600 - DNA, 2484 bp, Ricinus communis
atgcagaggcctccacctgaggaatttgtattgaaggagaccaatccccatcttggagggggaaaggttactggagacaagctcaccactacttatgacctcgttgagcagatgcagtatctctatgtccgggttgttaaggccaaggacttgcctggaaaagatgttacaggtagctgtgatccttatgtggaagttaagcttggcaattataagggtaccactcggcatttcgagaagaaatcaaatcctgagtggagccaggtgtttgcattctcaaaggatcgaattcaggcttctgttcttgaggttactgtgaaggataaggatgttgtgaaggatgatttcatgggtcgagttttgtttgacttgaacgaggtaccaaaacgtgtaccgcctgatagtccattagcaccgcaatggtatagattggaggataggaaaggggataaagttaagggggaattgatgttagccgtatggatgggtacacaggcggatgaagcatttcctgaagcttggcattctgatgcagcttctgtcagtggaatggatagtctggccaatattcggtcaaaggtatatctctctccaaaactatggtatttgagggtcaatgtcattgaagctcaagacttgcaaccaaatgataaaggtcgatatcctgaagtctttgtgaaggctatcctgggaaatcaagccttgagaacaagaatttctcttagcaggagtattaatcctttgtggaatgaagaccttatgtttgtggctgcagaaccatttgaggagcctttgattttaagtgtggaagatagagttgcacctaacaaggaagaagtattggggagatgtgcaattcctttgcagtatgttgacagaaggcttgaccacagacctgttaatactaggtggtttaatctggagaaacatgttattgtagaaggggaaaaaaagaaggaaactaagtttgccagcaggattcacatgagaatctgtctggagggtggctatcatgttctggatgaatcaacacactacagcagcgatcttcggcctacagccaaacagttgtggaagcaaagcataggggtgcttgaattaggtattctcagtgcacaaggattgatgcccatgaagacaaaggatggtcggggaacaactgatgcatactgtgtggcgaagtatggtcagaaatgggttcggacacgaactataattgaaagttttacacccaagtggaatgagcaatatacctgggaggtttttgatccctgcactgtgataaccattggggtatttgataattgtcatctgcatggaggggacaagtctggagcagcaaaagattcgaggatcggtaaggtgagaatccgtctttccactctcgaaactgaccgggtttacacacattcatatcctcttttggttctgcatggtaatggtgttaagaagatgggagaaattcatttagcagttcgtttcacatgctcatccttgctcaatatgatgcacatgtactcgcatcctctgttgccaaagatgcattatcttcatccactcacagtgagccagcttgatagtttgagacaccaggccactcaaattgtgtcaatgaggttgagcagagccgagccaccattaaggaaggaagttgttgaatacatgctagatgtggggtctcacatgtggagtatgagaagaagcaaagccaacttcttcagaattatgggggttttgagcgggctaattgcagttggcaaatggtttgatcagatatgcaattggaagaaccccatcactacagtgctcattcacatattgtttataatactagtgctctacccagagcttatcttgcctacaatctttctgtatctcttcttgattggtgtttggtactatagatggaggccaaggcatcctcctcacatggacacccgtctatcacatgcggagtctgcacatcctgatgaactagatgaggagtttgataccttcccaacttcgcgaccttctgatattgtaaggatgagatatgatcgatgagaagtatgctgagaattcagactgtggtcggagatttagctactcaaggggagagactgcaatctttgctaagctggcgagacccaagggccacagctttgtttgtgattttttgtttggtagctgccattgttctgtatgttactcctttccaagttgtggcacttcttagtggattttatgtgttgagacatccaaggttccgccacaggctaccttcagtgccactcaatttcttccgacggttgccagcaagaactgattgtatgttgtgagcagaaagtggtcttatctggaacgctgttttgtatttttatttttgccttcttgttgagtcagtgaacaagatgcagaaaggaatggagctgtttactttctatgtataccagcggatgttggttctggtatgacgtgtaaccttcctctgaaggtagtaga

SEQ ID NO: 4601 - DNA, 3136 bp, Malus domestica
ttctctctctaccccttcagcagttctctctctagaatggaagagattgcttcttctacttcttcatccttatctcttttgatctctcactctcaccaaacccaatgaaaccctcctccgtcgcttccatctgagaagcattgcatttttatatttattttccattttttttgtttttgaaagatgaatgcttttgggtttcgggttttttctgtgaagccttgctgattcatctttttccttctcaagagatctgaagcttgaatttctccgctgcttcggaaggtttctgggaacatttgaattaattcaaaactagttccttaacctcatttaatccaaccgttcaacttcagcttcatttttgcctgggcacctctggtatcgaacccgaaagatgcagagacctcccccggaagactttgctttgaaggagaccaaaccccacctcggtggggggaggatctccggtgacaagctaacgagcacgtatgatctcgttgagcagatgcagtacctctatgtccgggttgttaaggcgaaggacttgcccgcgaaagatgttactggtagctgtgacccttatgtcgaagttaagcttgggaattacaaaggcgcgactcgacattttgagaagaagtcaaatccggagtggaaccaggttttcgcattctcgaaagatcgtattcaggcgacggttcttgaggtcattgtgaaggacaaggatcttatgaaggatgatttcatgggccgtgtttcttttgatctgaacgaggttccaaaacgtgttcctcccgatagtcctctggcaccacagtggtatagattggaagatcataaggggaacaaggcaaggggagagctgatgttggctgtatggatgggcacccaagctgatgaagcttttcctgaagcatggcattccgatgctgccacaattagcggagctgacagtcttgcaaatatccgatcaaaggtgtatctctctcctaagctttggtatttgagggttaatgtgattgaagctcaggatttgataccgagtgataagggtcggtatcctgaagtttatgtgaaagctatacttggaaatcaagctttgagaactaggatttctccaagcaggagcataaatcctatgtggaacgaagatttaatgtttgttgcatcagaaccatttgaggagcccttgattttgagtgtggaggacagaattgcacctaacaaagatgaagttttggggagatgtgcaattcctctgcagtatgtgccccgaaggtatgatcataaacctgttaacactagctggcacaatcttgaaaagcatgttattgtagaaggggaaaagaagaaggaaatcaagtttgcaagcaggattcatatgaggatctgtctggaaggtggttaccatgtccttgatgaatcaacacactatagtagtgatcttcgaccgacagcaaaaccgttgtggaagtccagcattgggatccttgaagtgggaattctgaatgctcaggggttgatgccaatgaagaccaaagatgggaggggtacgacagatgcgtattgtgtggcgaaatatgggcagaaatgggttcgaacaagaaccattattgatagctttatgcccaggtggaatgagcagtacacttgggaagtgtttgatccttgtactgtcataacaattggggtatttgataactgccatctgcatgggggagaaaaggctggaggggccaaggatgcaagaattgggaaggtaaggattcgtctctccaccctcgagactgatcgggtttacacacactcgtacccgcttttggttctgcacccaaatggtgtaaagaagatgggtgaaattcatatggccgtgaggttcacttgctcttctctgcttaacatgatgcacatgtactcacagcccctgctgccaaaaatgcactacattcatccattgactgtaagtcagcttgatagcttgaggcaccaggccactcagattgtatcaataaggctgagccgtgctgagccaccgttgaggaaagaggtggtcgaatatatgctggatgtgggctcccacatgtggagtatgagaagaagcaaagctaactttttcaggattatgaatgttttgggtgggataattgctgttggaaaatggtttgatcagatctgcaactggaaaaaccccattactaccgtactcattcacatcctctttattattctggtcatgtacccggagctcatattgcctacaattttcctctacctcttcttgattggagtttggtactatagatggaggccaaggcaccctcctcacatggacactcgtctgtctcatgcagattctgcacatcccgatgaacttgatgaagaatttgatacattccctacttcgcggccttctgacatagtgaggatgagatatgataggttgaggagtattgcagggagaatccagacagtggttggcgacttggctactcaaggggagaggctgcaatctttgctgagctggagagacccgagagctactgcactgtttgtgcttttctgtctgattgcagcgattgttctgtatgttactccgttccaggttgtggctcttcttgctggattttacgtgctgagacacccaagattccgtcataagcttccttctgtgccgctgaatttcttcaggaggttgccggctagaactgactgcatgctgtgaggaggaccgttttatttattttgagttgcctttgagtggcagggcattctactttctgccatttcgtgtttagttaatgaagaagatgcggtacctcgttgagctgttccattctgaatgcgtagctgcaacgaagaccacggagaacgtgaggttcccagtatgctgtatttagacctcgtcttcaaggtagtagttttttgaaaaattttcagttaattatgtcgtcaaatggaaaaaactttatctaaggtgactagtttatgttcatttgtaattttgtaggctgtgattggaatgctgaaccgttatgtgcttaattacatctttagtatttttgttaactcatcttttgtgaagttcttctggtcgaacgtattgctttcgatgtttacacatgacatgtgggaatga

SEQ ID NO: 4602 - DNA, 2499 bp, Aquilegia formosa
cttggtcaaaatgcaaaggcctcacccacctgaagatttctccttgaaggagacctcaccacatcttggtggtggtggtttgactggtgacaagcacacctccacctatgacttggttgagcagatgcagtatctctatgttagggttgttaaagctaaagatttaccaacgaaagatgttactggtagctgtgacccttatgtagaagtgaagcttggaaactacaaggggacgactccacattttgaaaagaagacaaaccctgaatggaatcgtgtttttgcgttttcaaaagatcggcttcaagcatctgtacttgaagtccttgtgaaagataaggatttagttaaggatgatattattggccggattatgtttgatctcaatgaagtgcccaagcgcgttccacctgatagccctttagcacctcagtggtatagactggatgatcgaaagggggataaggttaaaggggagcttatgctggctgtttggatgggaacccaagctgatgaagcatttccagaagcatggcattcagatgcggcagctgttagcagcagtgatggccttgctaatattcgatcgaaggtatatctttctcccaagctttggtatcttagggttaatgtgattgaagctcaagacttgctaccaagtgacaagggcaggtatccagaagtttatgtcaaagctatccttggaaaccaggctttgagaactaggatttcaccaagcaagaatattaatccactgtggaacgaggacttgttgtttgtagcttctgaacctttcgaggaacacttgatcttaagcgtggaagaccgagtgggacccaacaaagatgaagttttggggaagtgcgtgattccgttactcagtgtgcaaaggaggttggatcatagacctgtaaatacaaagtggtataatcttgagaagcatgtcattgttgatggagagaagaaagagatcaaatttgccagtaaaattcatttgaggatctgtctggatggaggttatcatgttttggatgagtcaacacactacagtagtgatcttaggcccactgcaaaacaaatgtggaagcaaagcattggtgttttggaactgggaatactgactgcccagggattgctgccgactaagacaaaagacgggcgaggaacaacagatgcttattgcgtggccaaatatggacagaagtggatcaggacaagaacaatcatcgataactctactccaaagtggaatgagcagtatacctgggaggtgtttgatccatgtactgtaattacaattggggtctttgacaattttcatttacacggaggagataaagctggaggggccaaggatacgaggattggaaaggtgagaattcgactttctacgctcgaaacagaccgtgtgtacactcattcgtatccacttctggttttgcatcctgcaggggtgaagaagatgggtgaaattcagctagctgtgaggtttacatgctcatctctgcttaatatgatgcatatctactcacagcctctgttgccaaaaatgcactatattcatccactgtctgttactcagcttgatagcttgaggcaccaagccactcaaattgtctcaatgaagctgagccgtgctgagccacctttgaggaaggagatagttgagtatatgttagatgtggattcacacatgtggagtatgagaaggagcagagcaaatttctttagaatcatgggagtcctgagtggtcttatcaaggttgccaaatggtttgatcagatatacaattggaaaaacccagtaaccacagttctgatccagatcctgtttttaatactcgttctatatcctgagttaatactacccacaatatttctctaccttttcttgattggtgtctggcattacagatggaggcctagacacccacctcacatggataccagattgtcttatgctgatagtgtacatccagatgaattggatgaggagtttgataccttccctacttctcgacctcctgacattgtgagaatgagatatgatcgtctaagaagtgttgcagggaggatacagactgtggttggtgacttggcaactcagggagagaggttgcagtctttgctaagctggagagacccaagagcttcagctctttttgttactttttgcttgatcgctgccatagtgctgtacgttacaccatttcaagtggttgccattctcatgagcttttatacattaaggcacccgaggttccgacacaagcttccttcagttccactcaacttcttcaggagattgcctgcaagaactgacagcatgctatgaggagagatcattttgaatttgatgtgatttccgcacttcaccctggtatcttcttatgcagacagcagacattgatgtgtagatgtagcaactttaagacattgtttggcggatccttcatgataggcgttgtaattttccctgctacactgtcatgaattagt

SEQ ID NO: 4603 - DNA, 3056 bp, Sesamum indicum
cttctctcagttgtttcaatctctccgcagaagaaccttatcatgaacctccaaggttttatgcgctcagatctgaagctttgatttaggttctgggcttagcagattcttcttcataaggttttgggcactcaaaactgaagctttcgattaaggtgttgagcttacacgattttcttcaccaggttttacaggtttaaaggaagtcgaggaaatgcagaggcccccgcaagaagatttttcattgaaggagactaacccccacctcggtggagggaaggtcaccggagataagctcacgagcacctatgacctcgtggagcaaatgcaatacctttatgtccgggttgtgaaggcgaaagatctacctggaaaggatgtgactggtagttgtgacccttatgttgaagttaggcttggaaactataagggcacaacccgccattttgagaagaagtcaaaccctgaatggaatcaggtctttgcattctctaaggagcggattcaggcctcggtgcttgaggttactgtgaaagataaggatgttgtgaaggatgattttattggtagagtattgtttgatttgaatgagattccaaaacgggttcccccagatagtcccctggccccacagtggtacagattggaggacagaaagaatgagaaggcaaaaggagagctaatgttggctgtttggatgggtactcaagctgacgaggcatttccagaggcatggcattcggacgctgcagcagtcagtggtgctgatggtcttgcaaatatccggtcaaaggtctatctttcccctaagctttggtatctaagagtaaatgtaattgaagctcaggacttgcagccaagtgataagagtcggtttccagaagtttttgtgaaggccatcctgggaaatcaggcattaaggacaagggtatctatgagcaaaagtatcaatcctatgtggaatgaggatttgatgtttgtggctgctgacccatttgaggagccgctaattttgagtgtagaagaccgtgttgctcccaacaaagatgaagttctgggaagatgtgctattcctctgcagtacgtagaccggagattggatcataaacctgtgagcactaggtggtataatcttgagaaacatgttatagttgaaggtgaaaagaaaaaggaagtgaagtttgccagcaagattcatatgagaatttgtttggaaggtggttaccatgttctggatgaatcaactcactacagcagcgatcttagaccgacagcaaagcaattgtggaagtcaagcattggggtcctggagttgggtattttaaatgctcaagggctttctcctatgaaaacgaaagatggccgggccacaactgatgcttattgtgttgccaaatatggtcagaagtgggtcaggacaaggacaatcatcgacagttttgctcctaaatggaatgagcagtatacttgggaagtttttgatccttgcactgttgtcaccattggtgtattcgataattgtcatctgcaaggtggagataaagctggaagggattcaagaattgggaaggtaagaattcgcctttcaactctggaaacagaccgtgtgtacactcattcttatcctcttctagttttgcatccttccggggtaaaaaagatgggtgaaattcatttagccgtgcggtttacctgttcatccttggtaaatatgatgcatatgtactcccaaccgttgttgcccaaaatgcactacattcatcccttaactgtcagccagctggacagccttaggcatcaggccactcagattgtctccataaggctgagtcgtgccgagccacctctgagaaaggaggtggtggaatatatgctggacgtgggttctcacatgtggagcatgaggagaagcaaagcaaacttcttcagaatcatgggggttttgagtggtctaattgctgttggaaaatggtttgatcaaatttgcaattggaagaaccccatcaccacagttctcattcacatcttgttcttgatactggttatgtatccggaacttattttgccgactattttcctgtacttgttcttgattggagtatggtactatagatggaggccaagacatccaccccacatggatactcgtctttcttgtgctgacaatgctcatccggatgaactggatgaggagttcgatacgttcccaacttctcgtcctgcagatattgtaagaatgaggtatgatcgtctaagaagcattgccgggaggattcaaactgtggttggcgacttggcaacacaaggggagaggctacagtctctactaagctggcgagaccctagagctacagctctctttgttattttctgtttggtagccgccattgttctctacgtaacaccttttcaagtggtggctcttcttacaggattttatgtgttgagacatcctaggttccggtacaagcttccatcggtgccactgaacttcttcagaaggttgcctgcaagaacagactgtatgttgtaagaaactagagttttgactgtttcaaccctgtttccttccagtcagtgcagaatatgccgacaaaatcttgtttgctatgtctcaccaagtggtgaggtggagttcgtgttgtggttatgtaagctaagctgtctcatgaaacttgcatatcttgtggatttttaggttctttatttgttaggatctattttggagttggttctgtaaagacagatatgtggtaatctgtacttttgtaggttgtcatttaattcaatcttgtctggaccatccttatctttcatctttactggtagtttatctacatcaattcaagtgatataatgtgtcttttacaagggacgatacttgtagtgaattaccatgctaagttgttaattattccttgtttctgtgagctatattcatataatttgtgcttccagatagctttgtttcccttttgcttcttatcttgctggtttaggttggtctatgagatgtaacagttggttactaaatgaaggaaacatgttttcagacg

SEQ ID NO: 4604 - DNA, 2786 bp, Tabernaemontana elegans
aacattgatttaccttcaacttcaggagaaaagggaggttttagatttttagttttctactgtaattagtaaaacatagaaaacagaaaatgcagaggcctctccaggacgattttcagctcaaggagaccaaaccccatctcgggggattgaaggtcacaggggataaactaactagcacctatgatcttgttgagcaaatgcagtacctttatgttcgggttgtgaaagcgaaagatttacctgggaaggatgtcactggtagttgtgatccttatgttgaagttaagctggggaactataagggtacaacacgtcattttgaaaaaaaatcaaaccctgaatggaatcaggtgtttgcattttcaaaggaccgtattcaagcttcagtgcttgatgtcacggttaaagacaaggattttgtgaaggatgatttcatgggtaaagtttcgtttgatttgaatgagattccgaaaagggtgcctccagatagtcctttggctccacagtggtataggttggaggataggagcgggaataaggttagaggtgagctgatgttggctgtctggatgggtactcaggcagatgaagcatttccagaggcatggcattcagatgctgcagctgttagtggtgccgatgcccttgcaaacatcaggtcaaaggtgtatctgtcgcctaagctttggtatctgagggttaatgtgattgaagctcaggacttgatacctagtgataagagtaggttccctgaagtgtttgtgaaggccattctcgggaatcaggccttgaggactagagtatcgatgagcaaaacaatcaatcccatgtggaacgaggatttgatgtttgtggcggcagaaccttttgaggagcctttgattttgagcgtggaggatagagttgcacctaataaagatgaagtattaggaaggtgtgccattcctctacatatggtggacagaagattggaccataaacctataaactcaaagtggtataaccttgagaaacatgtcattgttgagggggaaaagaagaaggatgtcaagtttgccagcaggattcacatgaggatctgtctggaaggaggttaccatgttctggatgaatcaacccattacagtagtgatctccgaccgacagcaaaacagttatggaaatcaagcattggggttcttgaattaggtattctgaatgctcaagggctgtcacctatgaaaacaaaggatgccagggcaacaactgatgcttattgtgtggctaaatatgggcagaaatgggtccgaacgaggacaattattgacagctttgctcccaagtggaatgaacagtacacttgggaagtttttgatccttgcactgtcataaccattggtgtttttgataattgtcatctccaaggtggtgacaaatctggaggggctagggactcaaggattggaaaggttaggatccgtctttctactttggaaactgatcgtgtctatacacattcatatccacttttggttttgcatccttctggggtgaagaagatgggtgaaattcatttggctgtgagatttacttgctcttcattgttgaatatgatgcatttgtactcgcaaccactgttgccaaaaatgcactatatttatcctttaactgtcagtcagcttgataacctgaggcaccaggctactcagattgtctccatgcgacttagtcgtgctgagcctcctttgaggaaggaggttgtggagtatatgttagatgttggttcccacatgtggagcatgaggagaagtaaagcgaactttttcagaataatgggggttttgggtggattaattgctgttggaaaatggtttgaccagatctgcaattggaagaacccaattacaactgttctaattcacattttattcctaatactggttctgtatcctgagctgattctgccgactattttcctataccttttcttgattggggtttggtactacagatggaggccaaggaatccaccccatatggacactcggctctcttgtgctgataatgcccatcctgatgaactggatgaagaatttgacacatttccaactacacggcctgctgatattgtccggatgaggtatgaccgcctaaggagcattgcaggaaggatccagactgtggttggtgacttggcaactcaaggggagaggcttcaatctttgttgagctggagagacccaagagctacagcgctgtttgtgattttttgtctggttgccgctgtggttctctatgttacaccttttcaagtagtggcccttctcacgggtttttatgtcttaagacatccaagattccgacacaaacttccatcggtgccgcttaatttctttagaaggttacctgctagaacagactgcatgttgtgagcagtgcatgttttgactatcatttccatcatctttgcagtgaaggttgcggatgtagaatcaagtcgaggttgctttctctctttcaccaagtggtgaacattgctttctacaatgtttaagatcccatctgatgtaataggttttatggctttgttgttcatttataggatctctatcatgaaggtggctataatttctgatctgtgttgattcatggtccttaaggttgtgatttgatctaattttccctgagaatatctatccataattgttaccagaggtaccattcttgttttcaattgctgaagccatcatgaatatatttgttttatccagttatgagtaaatcccggttttgttcccaaattg

SEQ ID NO: 4605 - DNA, 2945 bp, Gossypium hirsutum
gtttttcttgggtctctttgtttgtttccaaagatgatgccccgtcctccacctgaagatttcgccctcaaagagaccaatccccaccttggtggtggaaaggtcagtggtgacaagcttactagtacttatgacttggtagagcagatgcaatacttgtatgtacgggttgtaaaggcgaaggatttgccagggaaagatgttacaggtagttgcgatccttatgttgaggttaagcttggaaactacttgggtaaaactcgcttttttgtgaaaaagtcgaatcctgagtggaatcaggtgtttgcattttcgaaagataggcttcaggcttcattgcttgaggttacagttaaagacaaggattttgtgaaggatgacttcattgggaaggttttctttgatctcaatgagattcccaaaagggttccaccagatagtccactggcaccgcagtggtataggttggaggataggcagggacataaggttaagggggagttgatgttggctgtttggatgggaactcaagctgatgaagcatttcctgaagcgtggcattctgatgctgcttttgttagcggagctgatggtctggccaatattcgatctaaagtatatctctctccaaagctttggtatttgagggtcaatgtgattgaggctcaggatttgcagccaggtgacaagggtcggtatcctgaagtttttgtgaaggctattttgggaaatcaggctttaaggactaggatttctcaggccaggggtattaatccaatgtggaatgaggatctaatgttcgtggcagcagaaccttttgaggagcctctaattttgagtgtagaagacagggttgctcctaataaggatgaagttttgggtaagtgtgcaattcctttacaatatgtagacaggaggcttgatcataaagccgtgaatagtaggtggtttaatcttgagaagcatgttattgtagaaggagagaagaagaaagagaccaagtttgctagcagaattcatatgaggatttgtttggaaggtggctatcatgttctggatgagtctacccattacagtagtgatcttaggccaactgcaaaacagttgtggaagtctagcatcggggttctggaattggggattcttaatgcacatggcctaatgccaatgaagaataaagacggaagaggtacaactgatgcttattgtgttgcaaaatatggtcaaaaatgggtacgaacaaggacaatcatcgatagctttgcacccaagtggaatgagcagtatacatgggaggtttttgatccttgtactgtcataactattggggtgtttgataattgtcatttacatggaggagataaggctgcaggagcaaaggatactaagatcgggaaggtgagaattcgactctccactcttgaaactgatcgggtttatactcactcatatccacttctggtgctacatccaaatggggtaaaaaagatgggtgaaattcacttggctgtgaggttctcttgctcttccttgcttaatatgatgcatatgtactcgcatcctctcttgccaaaaatgcattacctacatccattgactgttagccagctcgatagcttgaggcaccaggccacacagattgtgtcaatgaggctaggacgagcagagccgccattgagaaaagaggtggtggagtatatgctagatgttggttctcacatgtggagcatgaggagaagcaaagccaactttttcagaattatgaatgttttgggcgggttaattgctgttggaaaatggtttgatcagatctgtaattggaaaaacccaattacgacagtattgattcacatcttgtttatcatactggtcctctatccagagcttattttgcctacaattttcctctacctgttcttgattggggtttggtattatagatggcgaccaagacatcctcctcacatggacacacgcctttctcatgcagattcggcacatcctgatgaactggatgaagagtttgacacatttcctacttcccgcccatcagatattgtcaggatgagatatgatcgactgagaagtattgctgggagaattcagacggtggttggtgatttagccacacagggtgagaggctgcaatctcttttaagctggagagacccaagagccactgctttattcgtaattttctgtttggttgctgctatagttttgtatgtcacacctttccaggttgtggctcttctagcaggattttacattttgaggcatccaaggttccgccataagcttccttcagtgcctctcaatttcttcaggaggttgcctgcaagaactgattccatgctatgaacaagaatgatatcatgtgcagtttcccggaggtggtatggagttgggattttccccatgttgattcagaaaagaagattgagaaacaaaaggagcttgtttctcctctaatgttcagcaacaggtgttgtgttctggaatgatgtgtaaccttcccctgaaggtagtagattttgtggatttgtgttcatttatgttatctatatgatttctgttttaaaactgagtttatcgtgattaatcaatgttcattgtaattttttaggttgtgattggaatttaggcaatgctaaaatgaatcttcactattttgcatctagaagatactaaaaatgatgggattttctaactccaagccttggtacatctttcatgtatgctttttgttttgtttagtggtgcttagagcttaccacgtcgacaccaagcatgtgaattttaatttatagatgttcaaagctattaatgtattgtatattaagcatctctttaccggtttggtatcatttctggaaaagtagattaactgcattactggtttggtactgtggaattcggtgccagcgatttatttaatcattttt

SEQ ID NO: 4606 - DNA, 2698 bp, Euphorbia peplus
agagagtgtgttttgcttggttttaatggtgttagggttgttttcgtctctttaaaactcacttttggatcttcttcttcttcttcaagtagttattttatctgggttttgttcaggattcaaccgtccagatctgaggattctcgaagttaaccttctgggtttctgaaaatctgttaagttattgcaactgttggggtttccgttaaccacccggaaacatgatgccgcggccgccccccgaggattatgtattgaaggagacgaatccccatctcggtgggggaaaggtgacgggtgataagcttactagcacctatgacttggtggaacaaatgcagtatctttacgtccgggttgtgaaggcgaaggagttgcccgggaaagatgtcacgggaagttgtgatccttatgttgaagttaagcttgggaactacaagggtaccacacggcattttgagaagaagagcaatcccgagtggagccaggtgtttgcgttttctaaggatagaattcaggcctcggtgcttgaggtgacggtgaaagataaggactttgttaaggatgatttcatgggccgtgtgttttttgatttgaatgaggtaccgaaacgggtgccaccggatagtcccttggcgccgcagtggtataggttggaggataggaagggagataaagttaagggtgagttgatgttggcggtatggatgggtacgcaggcggatgaggcttttcctgaagcgtggcattctgatgcggcttctgttagtggaatggatagtcttgctaatatgcgatcgaaggtgtatctgtccccgaaactgtggtatttgagggttaacgtcattgaagctcaagatttgcaaccgacggataaaggccggtatcctgaagtgtttgtgaaggctatcctgggaaatcaagcgttgagaacgaggatttctgctagtagaagtattaatccgatgtggaatgaggaccttatgtttgtggctgcagaaccattcgaggagcatttgatcttgagtgtggaagatagagttgcacccaacaaggatgaagtattggggcgatgtgcaattcatttgcagcatctggacaggaggctcgatcacagacctgttaatactaggtggtttaatctggagaaacatgttattgtagacggggagaaaaagaaggaaatcaagtttgctagcaggattcacatgagagtctgtctggagggtggttatcatgttttggatgaatctacgcactatagcagcgatcttcgccctacagccaaacagctgtggaagcagagcataggggtacttgaattgggaattctcaatgcaacgggattgatgcccatgaagacaaaggatggtcggggaacaactgatgcctactgtgtggcgaagtatggtcaaaagtggattcgtacgcgtacaattattgacagcttcactcccaaatggaatgagcaatatacttgggaagttttcgatccctgtactgtactaaccattggggtgtatgataattgtcatttgcatggaggggacaaggctgcagcagctaaagatgcaaggattgggaaggtcaggattcgtctttccaccctggaaacagatcgagtttacactcactcttatccgctcctagtcctgcatcctaatggtgtcaagaagatgggagaaattcatttggcagttcgttttaattgctcttccttgttgaacatgatgcacatgtactcgcagcctttattgccaaagatgcactatcttcatccacttactgtcagccagctcgatagtctaagacaccaggccactcagattgtgtcaatgaggctgagccgtgcagagccaccattaagaaaggaggttgtcgaatacatgctagatgtggggtctcacatgtggagcatgagaagaagcaaagctaacttctttagaatcatgggggtgttgagtgggttgatcgcagttggaaaatggtttgatcagatttgcaattggaaaaaccccatcacgacagtgctgattcacatactgtttattatacttgtgctgtacccagaacttatcttgcccacaatcttcttatatcttttcctgattggtgtgtggtactatagatggagaccaagacatcctcctcacatggatacccgcttatcacatgcagagaatgcccatccagatgaactggacgaggagttcgatacattcccaacttcacggccttcagatatagtaagaatgagatatgatcggttgagaagcattgcagggaggattcagactgtagttggggatttagcaactcaaggggagaggttgcagtctctgctgagctggcgagacccaagggccacagctctgtttgtcatattctgtttgctagctgctgttatcctgtatgttactcctttccaagttgtggctcttctgtctggaatttacgtgttgagacaccccaggtttcgtcacaggcttccttcggtgcctctgaatttcttccgacggttgccagcaagaactgattgcatgttgtaaacaaaaaggcgggtttatctgcgattctgcttatgtctctagtaggcaaacaagataggtaatggagtttgttttctatatttatcagcagttgttgggtctctgctatgtgtaaccttcctctgaaggtagtagattttgtggatttt

SEQ ID NO: 4607 - DNA, 2719 bp, Vinca minor
ttattttcagcatttccatttacaggtttaaaagatttttgtcaagcattaccttcaacatcaggagaaaatagagtttcttgtaaaacatagaaaacagagaaaatgcagaggcctccgcaggatgattttcagctgaaggagactaaaccccatcttgggggattgaaggtgacgggggataaactaacgagcacctatgatctcgttgagcaaatgcagtacctttatgttcgggttgtgaaggcgagagatttacctgggaaggatgtaacaggtagttgtgatccttatgttgaggttaggatggggaactacaggggtacaactcgtcatttcgaaaagaagtcaaacccggagtggagtcaggtgtttgcattctcaaaggaccgtattcaggcttcagtgcttgaggtcacagtgaaagacaaggatatggtgaaggatgatttcataggtcgagttctattcgatttgaatgagattccaaaaagggtgcctcctgatagtcctttggctccacagtggtataggttggaggataggaaaggggataaggttaagggggagttgatgttggctgtttggatgggtactcaggcagatgaagcgtttcccgaggcatggcattcggatgctgcagctgtcagtgggcacgatagccttgcaaacatcaggtcgaaggtgtatctgtcacccaagctgtggtacctcagggttaatgtgattgaagctcaggacttaattcctaatgataggagtaggttccctgaagtgtttgttaaggccattcttgggaatcaggctttgaggactagagtgtcgatgaacaagagtatcaatcccatgtggaatgaggatttgatgtttgtggcagcagaaccttttgaggagcctttgattttaagcgtggaagatagagttgcacctaacaaagatgaagttttaggaaggtgtgccattcctctacatatggttgatagaagattggaccacaagcctataaacacaaagtggtataaccttgagaaacatataattgttgagggggagaagaagagggatgtcaagtttgcgagccgaattcacatgaggatctgtctggaaggaggctaccatgttctggatgaatcaacccattacagtagtgacctccggcctacagcaaaacagttgtggaagtcgagcatcggggttcttgaattaggtattctgaatgctcaagggctgcaacctatgaaaacaaaagatggaagggctacaactgatgcgtattgtgtggctaaatatgggcaaaagtggatccggacgaggacaattattgatagctttgctcccaagtggaacgagcaatacacttgggaggttttcgatccttgtactgtcataaccctcggtgtttttgataattgtcatctccacggtggtgacaaagcggtaggatctagggactcgagaattggaaaggttagaatccgtctttctactttggaaactgatcgtgtctatacacattcatatccactgttagttttacatccttctggggtcaagaagatgggcgaaattcatttggctgtgagattcacttgctcgtccttgttgaatatgatgcatttgtactcacatccgcttttgccgaaaatgcactatatccatccattgactgtgagtcagctcgataacttgaggcaccaggctactctgatcgtctccatgagacttagtcgtgctgagcctcctttaaggaaagagattgtggaatacatgctcgatgtcggttctcacatgtggagcatgaggagaagcaaagccaactttttcagaataatgggggttttaagtggattgatttctgttggaaaatggttcgaccagatctgcaattggaagaaccccattaccacggttctaattcacattttgttcctaatactggttctgtatcccgagctgattctgccaaccatttttctgtatcttttcctgattggagtttggtactacagatggaggccaaggaatccaccccatatggacactcggctctcttgtgctgataacgcccatcctgatgaactggacgaagaattcgacacttttccaacttcacgtcctgcagatatcgtcaggatgaggtacgaccggttaagaagcattgcaggaaggatccagactgtggttggcgatctggcaactcaaggagaacgcctccaatctttgttaagctggagagatccaagagctacggcgctgtttgtgatattttgtctggttgctgctattgttctctatgttacaccttttcaagtggtggcccttcttgctggtttttacgtcttaagacatccaagattccgacacaaacttccatcagtgccgctcaatttcttcaggaggttacccgctagaacagactgcatgctgtgagcagttcatgtgttggctaccatttccattgtcttttgcaggcgaaggacgcggatctagaatcaagtcaaggtgaatgttggtttctccgataatctgtaataggtttaatggttttgttgtttatttatatgatttctatcatgatggttgattcctagtcccttagtttgcgatttgatctacttttcttccgtcttttattgttgctaaaagtgattttgatttttttcctctcaattgcttataagctatcatgaattatattttcattctccagacgtgaaat

SEQ ID NO: 4608 - DNA, 3303 bp, Gossypium hirsutum
tttctcttatcactagcccttgttttggacatccactttacagttttggtctccatttctccaaaaaaagaaaaagaaaaactagatatttctaaatttacaacttaagcccgaaacttaaaggccggccgtcgtctaccgttggatcatccctaaatttcagaatcaaagttggcagatctgaaagcttaaagggagtcagtctgtttacgcttctcacttaaaaaaactggtgtttttcttgggtctctttgtttgtttccaaagatgatgccccgtcctccacctgaagatttcgccctcaaagagaccaatccccaccttggtggtggaaaggtcagtggcgacaagcttactagtacttatgacttggtagagcagatgcaatacttgtatgtacgggttgtaaaggcgaaggatttgccagggaaagatgttacaggtagttgcgatccttatgttgaggttaagcttggaaactacttgggtaaaactcgcttttttgagaaaaagtcgaatcctgagtggaatcaggtgtttgcattttcgaaagataggcttcaggcttcattgcttgaggttacagttaaagacaaggattttgtgaaggatgacttcattgggaaggttttctttgatctcaatgagattcccaaaagggttccaccagatagtccactggcaccgcagtggtataggttggaggataggcagggaaataaggttaagggggagttgatgttggctgtttggatgggaactcaagctgatgaagcatttcctgaagcgtggcattctgatgctgcttttgttagcggagctgatggtctggccaatattcgatctaaagtgtatctctctccaaagctttggtatttgagggtcaatgtgattgaggctcaggatttgcagccaggtgacaagggtcggtatcctgaagtttttgtgaaggctattttgggaaatcaggctttaaggactaggatttctcaggccaggggtattaatccaatgtggaatgaggatctaatgttcgtggcagcagaaccttttgaggagcctctaattttgagtgtagaagacagggttgctcctaataaggatgaagttttgggtaagtgtgcaattcctttacaatatgtagacaggaggcttgatcataaacctgtgaatggtaggtggtttaatcttgagaagcatgttattatagaaggagagaagaagaaagagaccaagtttgctagcagaattcatatgaggatttgtttggaaggtggctatcatgttctggatgagtctacccattacagtagtgatcttaggccaactgcaaaacagttgtggaagtctagcatcggggttctggaattggggattcttaatgcacatggcctaatgccaatgaagaataaagacggaagagggacgactgatgcttattgtgttgcaaaatatggtcaaaaatgggtacgaacaaggacaatcatagatagctttgcacccaagtggaatgaacagtatacatgggaggttttcgatccttgtactgtcataactattggggtgtttgataattgccatttacatggaggagataaggctgcaggagcaaaggatactaagatcgggaaggtgagaattcgactctccactcttgaaactgatcgggtttatactcactcatatccacttctggtgctacatccaaacggggtaaaaaagatgggtgaaattcacttggctgtgaggttctcatgctcttccttgcttaatatgatgcatatgtactcacatcctctcttgccaaaaatgcattaccttcatccattgactgttagccagctcgatagcttgaggcaccaggccacacagattgtgtcaatgaggctaggacgagcagagccgccattgagaaaagaggtggtggagtatatgctagatgttggttctcacatgtggagcatgaggagaagcaaagccaactttttcagaattatgaatgttttgggtgggttaattgctgttggaaaatggtttgatcagatctgtaattggaaaacccaattacaacagtattgattcacatcttgtttatcatactggtcctctatccagagcttattttgcctacaattttcctctacctgttcttgattggggtttggtattatagatggcgaccaagacatcctcctcacatggacacacgcctttctcatgcagattcggcacatcctgatgaactggatgaagagtttgacacatttcctacttcccgcccatcagatattgtcaggatgagatatgatcgactgagaagtattgctgggagaattcagacagtggttggtgatttagccacacagggtgagaggctgcaatctcttttaagctggagagacccaagagccaccgctttatttgtaattttctgtctggttgctgctatagttttgtatgtcacacctttccaggttgtggctcttctagcaggattttacattttgaggcatccaaggttccgccataagcttccttcagtgcctctcaatttcttcaggaggttgcctgcaagaactgattccatgctatgaacaagaatgatatcatgtgcagtttcccggaggtggtatggagttgggattttccccatgttgattcagaaaagaagattgagaaacaaaaggagcttgtttctcctctaatgttcagcaacaggtgttgtgttctggaatgatgtgtaaccttcccctgaaggtagtagattttgtggatttgtgttcatttatgttatctatatgatttctgttttaaaactgagtttatcgtgattaatcaatgttcattgtaattttttaggttgtgattggaatctaggcaatgctaaaatgaatcttcactattttgcatctagaagatactaaaaatgatgggattttctagctccaagccttggtacatccttcatgcatgctatttgttttgtttagtggtgcttagagcttaccacgtcgacaccaagcatgagaatcttaatttacagatgttcaaagctattaatgtattgtatattaagcatctctttaccggtttggtatcatttctggaaaagtagattaactgcattactggtttggtactgtggaattcggtgccagcgatttatttaatcatttttgtatggtgtatctaccattgtggatgtggatggggggcgggtgaaacggacatctcttggcttgcctttttattttatttcaactttgatgatagaaaattcagcctgagacttccaaggcacac

SEQ ID NO: 4609 - DNA, 2876 bp, Phaseolus coccineus
atgatttttttattttattttatgattttttttatggtttcacaagattaaacaatcggatctaacatcttctgggaaagtggttggtgtttttccgatattggagtcgtagaacactttgtgcaatctgagatctaggctcttgggaacggttgtgtataatccgagttgttgaaggctttggatatttgggttagaaattttgaatttgtggttcactgaagtgagagaaaatgcagaggcctccacctgaagattttctgttgaaggagaccaaaccccacctcggagggggaaaggtctccggtgataagcttaccagtacctatgatctggttgagcaaatgcagtacctttatgtgagggttgtgaaggccaaggagttgcctgccaaagatgtcactgggagttgtgatccttatgctgaagtcaagcttgggaactacaagggtactaccaggcatttcgagaagaaaaccaatcctgagtggaaccaggtttttgccttctcgaaggaccggcttcaggcgtctgtgctggaggttactgtgaaggataaggatgttgtgaaggatgacttcatcggtcgtgtctggtttgacctgaacgaggtcccgaaaagggtgcctccagatagtcctttggcaccccaatggtatagattagaggatagaaagggcgacaaggtgaagggagagctgatgttggctgtttggatgggtacccaggctgatgaagcttttccggaagcttggcactcggatgctgctacagttggtggaagtgatgctcttgccaacattagatcgaaagtgtatctgtctcctaagctttggtatttgagggttaatgtgattgaggcacaagacttacagccaactgataagggtagataccctgaggttttcgtgaaggctattctggggaatcaggccttgaggaccagaatctctcatagtaggagtattaatccaatgtggaatgaggatttgatgtttgtggcagccgaacagttcgaggaaccgctgatattgagtgtggaggatagagttgcccctaacaaggatgaagtgttggggaggtgtgctattcctctgcagtatgtggaaaggagactagaccacaaaccagtgaatacaaggtggttcaatctggaaaggcatattgttgttgaaggggagaagaagaaggataccaaattttcaagcaggattcacatgagggtttgtctagaaggtggctatcatgttttagacgaatctactcactacagcagtgatcttcgcccaacagcgaaacagctgtggaagtctggcattggtgttcttgaactggggatattgaatgctcatggtttggtgccgatgaaaacgaaagatgggagagggacaacagatgcttattgtgtagcgaaatatgggcagaagtgggtcagaacaaggacaatcattgacagctttgcaccaagatggaatgagcaatatacttgggaggtttttgatccttgtactgtcattacaattggtgtatttgataactgtcatctgcatggtggagacaaggctggtggagcaaaagattcaaagattggaaaggtaaggattcgtctttccacccttgagactgatcgggtctatacacattcctatccacttcttgttcttcacccgaatggggtgaagaagatgggtgagattcacttggcagtgaggttcacttgttcatctctgctcaatatgatgcacatgtattcacaacccttgttaccaaaaatgcactatatacaccccctgactgtcagtcagctcgacagtctgaggcatcaagctactcagattgtttcaatgagactgagtcgtgctgagccaccgctgagaaaagaagtagtggaatatatgctggatgtgggttcccacatgtggagtatgagaagaagcaaagccaacttcttcaggattatgggggttttgggtggtctaattgctgtaggaaaatggtttgatcagatttgcaattggagaagtcctgtcactacaattctgatccatatcttgttcataatattagttatgtatccagagcttatcttgccaacaattttcctttacctcttcttgattggaatttggtactatagatggaggcctagacaacctcctcacatggacactcgtctctctcatgcagactctgcacatcctgatgaacttgatgaagagtttgacacattcccgacctcccggccaaatgacattgtgaggatgagatatgatcgacttagaagcattgctgggaggattcaaactgtggttggggacttggccactcagggtgaaaggctgcaatctttgctaagctggcgtgatcccagagctacatcactgtttgtgcttttctgcctgattgctgctattgtactgtacgtcactccattccaagttgtggccctcttggcaggaatttatgtgttgagacatcccaggtttcgccataagcttccttcggtgccgcttaatttcttcaggaggctgcctgcaagaactgattgcatgctttgaagccactacagtgcagaatggaccttgccttctcctgaaggcagtagattttgtgcatttattgttcgttatcctgtcacaggattttctgttttcacttttgaacttcatggtagtcttgttaatttgtaattttgtaggtttgagttgaaattcacttcagcttaattactttcatgcttaatcagatgtggtagtgtttctcaatggggagttattagtttgtattgtgatggcagtggaggttatttgtgtttttctcccctccattattttttaagatggtgcatttcttttaaaataggcgtttaatgctca

SEQ ID NO: 4610 - DNA, 2891 bp, Prunus mume
tgaagcttgggtttctccgcccctacgaaggttcctggaacttttgaattaattcaaaaacagttaatcttattctatccaaccgttcaacttcaacttcaatctttgccatttgggtctctctgtttttgaacccacaagatgcagagaccacccccagaagactttgctttgaaggagaccaaaccccacctcggtggggggaggatctccggtgataagctcacgagcacctatgatcttgttgagcagatgcagtatctctatgtccgggttgtcaaggcgaaggacttgcctgcgaaagatgttactggtagttgtgacccttatgttgaagttaggcttggaaattataagggtgccactcgacatttcgagaagaagtcgaatccggagtggaaccaggtttttgcattctcgaaagatcggattcaggcttcggttcttgaggtcattgtgaaggacaaggatgttgtgaaggatgatttcatgggtcgtgtttcttttgacctgaatgagattccaaaacgggtacctcctgatagtcctttagcaccgcaatggtatagattggaggataggaagggggacaaggttaggggagagctaatgttggctgtttggatgggcacccaagcagatgaagcttttcctgaagcatggcattcagatgctgctacagttagtggggctgacagtctctcaaatattcggtcaaaggtgtatctctctcctaagctttggtatttgagggttaatgtgattgaagctcaggatttgcaaccaagtgataaaggtaggtatcctgaagtttatgtgaaggctatcctgggaaatcaggctttgagaactaggatttctccaagcaggagtataaatcctatgtggaatgaagatttaatgttcgtagcatcagaaccatttgaggagcccctgattttgagtgtggaggacagagtagcacctaataaagatgaagttctaggaaggtgtgcaattcccctgcagtatgtgaaccgaaggtatgatcataaacctgtgaacactagttggcacaatcttgagaaacatgttattgtagaaggggaaaagaagaaagaaattaagtttgcaagcagaattcatatgaggatctgtctggaaggtggttaccatgtccttgatgaatcaacacactatagtagtgatcttcgaccaacagcaaaaccgctgtggaagtccagcattggggttcttgaagtgggaattctgaatgctcaggggttgatgccaatgaagacgaaagatgggaggggtacaacagatgcttattgtgtggcgaaatacgggcagaagtgggttcgaacaagaaccattattgatagctttactcccaggtggaatgagcaatatacatgggaggtttttgatccttgtactgtcataactattggggtatttgataactgtcatttgcatgggggagataaggctggaggggccagggatgcaagaattgggaaggtaaggattcgtctctccacccttgaaactgatcgggtgtacacacactcgtacccacttttagttctgcacccaaatggtgtaaagaagatgggtgaaattcatatggctgtgaggttcacttgctcttctttgcttaacatgatgcacatgtactcccagccactgttgccaaaaatgcactatattcatccattaactgtaagccagctcgatagcttgaggcaccaggccactcagattgtatcaatgaggctgagccgtgctgaaccaccattgaggaaagaagtggtagagtatatgctggatgtgggctctcacatgtggagtatgcgaagaagcaaagctaactttttcaggattatgaatgttttgggtggggtaattgcagttggaaaatggtttgatcagatctgtacttggaaaaaccccattacaactgtactcatccacatcttgtttataattctggtcatgtacccagagctcatattacctacaattttcctctacctcttcttgattggagtttggtattatagatggagaccaaggcatcctcctcacatggacactcgtctgtctcatgcagattctgcacatcctgatgaacttgatgaagaatttgatacattccctacttcacggccttctgacatagtaaggatgagatatgataggttgaggagtattgctgggagaatccagacagtggttggtgacttggctactcaaggggagagactgcaatctttgctaagttggagagacccgagagcaacatcactgtttgtgcttttctgtctgattgctgccattgttttgtatgttacaccattccaggttgtggctcttctcgctggattctatgtgttgaggcacccaagattccgtcataagcttccttctgtgccgctgaatttcttcaggaggttgccggctagaactgactgcatgttgtgaggaagacttttatcttcagttgcctttgagtggcacaacattctattttccgccatttcgtgttaagttaatgaagaagatgctgtacctcattgagccgttttgttttgaatgctcagcagcaagcaatgaacatggagaacatgttctggtatgatgtatgtatgaccttgtcttgaaggtggtagttttttaaaattgtcagttgattatgccatcaataggatttctgtttaaaactttaatttaaggcgactagctcatgttcatttgtaattttgtaggctgtgattggaatgctgaaccattatgtgcttatttacatctgtagtatttttctttcaactcatcttttggtttaagttcatcaggttgagcttttacttttggtgcctttcttgtgatagcttgatgggttacatctt

SEQ ID NO: 4611 - DNA, 3910 bp, Theobroma cacao
taggaatccaatggggtaaaagagcaagagagagaaccttcgaaatgacatcactcttggctatgtcccaccccccaagggttgtttccgacatttcaccttttaacagagacacaaaacggtcgcccacacgtgcgaaacccccgaccacagtctcctcacaggcgtgacatactcgggtccccacattcactgtaagccaacagagaaaaaagcaaagcaaagagggtgagccccaaagaaagaaaaagagagtattctctcgcagattcatcagatcccaaccaaagagaaaaaagcaaaagcaaaagcaaacctgcaccgtctctctctccctctatagactagacctttttttgttgggctttcttgttcttatctttttctttgatttgttttttgtttttcactcacttgaaagaagagaagttttctttttcctcttggctagggaagttcttttacttgtccttttgggttccatcatctgctgataggtctttcgttgatgtaatcgggcttgggtttttcggttccaaacgcttcattctttattaaccgatcttcaaggtattaaagtccgcagatctgaaagtttgaaggaagtctctctttacgtttctcacttgaaaaaccttgtttttggttttttgggtctctttgtctgaatccaaagatgatgcatcggcctccaccaccggatgattttgcccttaaggagaccaatccccaccttggtggtggaaaggtcagtggggacaagcttacgagcacttatgacttggtagagcagatgcagtacttatatgttcgggttgtaaaggcaaaggatttgccagggaaagatgttacaggtagttgtgatccttatgttgaggttaagcttggaaactatttgggtaaaactcgggtttttgagaagaagactaatcccgagtggaatcaggtgtttgctttttcaaaagataggcttcaggcttcagtgcttgaagttactgtcaaggacaaggatgttgtgaaggatgactttattgggaaggttttctttgatctcaatgaggttccaaaaagggttccaccggatagtccactggcaccgcagtggtataggttggaggataggcaggggaataaggctaagggagagttgatgttggctgtttggatgggaactcaagctgatgaagcatttcctgaagcatggcattcggatgcagctgtagttagtggggctgatggtcttgcgaatattcgatcaaaagtatacctctctcctaagctttggtatttgagggtcaatgtgattgaggctcaggacttgctaccaggtgataagggtcggtatcctgaagtttttgtcagggctatcttgggaaatcaggctttaaggactagggtctccgtggctaggggtattaatccaatgtggaatgaggatctgatgtttgtggcggcagaaccttttgaggagcccttaattctgagtgtagaagacagggttgctcctaacaaggatgaagttttgggaaagtgtgcaattcctttacaatatgttgacaggagactcgatcataaacctgtgaatagtaggtggtttaatcttgagaagcatgttattgtagaaggagagaagaagaaggagaccaagttttccagcaggattcatatgaggatctgtttggaaggtggttatcacgttctggatgagtcaacccattacagtagtgatctgaggccgacagcaaagcagttgtggaagtctagcattggggttctggaattggggattctaaatgcacagggcttaatgccaatgaagacaaaagatggacgggggacaactgatgcttattgtgttgcaaaatatggccaaaaatgggttcgaacgaggacaatcattgatagctttgcacccaagtggaatgagcagtatacatgggaagttttcgatccttgtactgtcataactattggggtatttgacaactggcatttgcatggaggagacaaggcttcaggtgcaaaggattctaagatcgggaaggtaagaattcgtctctcaacacttgaaaccgatcgggtttacactcactcatatccacttctggtgctacattcaaatggagtcaagaagatgggtgaaattcatttggctgtgaggtttacttgctcttccttgcttaatatgatgcacatgtactcgcatcctcttttgccaaaaatgcattatcttcatccgttgactgttagccagcttgatagcttgaggcaccaggccacacagattgtgtcaatgaggctaggacgggctgaaccaccattgagaaaagaggtggttgagtatatgctagatgtgggttcacacatgtggagcatgagaagaagcaaagctaattttttcagaattatgaatgttttgagtggattaatcgctgttggaaaatggtttgatcagatttgtaattggaaaaaccctattacgacagtattgattcacatcttgtttatcatactagtcctctatcctgagcttattttgccgacaattttcctctacctcttcttgattggggtttggtattatagatggaggccaaggcatcctcctcacatggacactcggctttctcatgcagattcttcacatcctgatgaactggatgaagaatttgacacatttccaacttctaggccatctgatgttgtcaggatgagatatgatcgactgagaagtattgctgggagaattcagacagtggttggtgatttagcaacacagggtgagaggctgcaatctcttttaagctggagagacccaagagccacagctttgttcgtaattttctgtctggttgctgccattgttttatatgtcaccccattccaggttgtggcgcttctcacaggattttacatcttgagacatccaaggtttcgccataagcttccttcagtgcctctgaatttcttcaggaggttgcctgcaagaactgattccatgttatgaagaagactattttgtcatgtgcgatgtcccctaggtggtatggagttgggatttttccccttgtttatccagacaagaagatgcggaaacaaatggagcttgtttcttttgtatgttcagcggcgggatgttgggttctggtatgatgtgtaaccttcatctgaaggtagtagattttgtggatttgtgttcatttatgttatctataggatttctgttttaaaaattgagtttatgggcaatgttcattgtaattttttaggttgtgattggaatttaaccaatgctgaggcttccctatcctttatttgcgtctagcagatacttaaaatgatggggccttgtaacgccaagcctagtgcatctttcatgacatgttgttcgttttgtccagtggtgatcagagcataccatgtcggcgtgaagcgtgtgaatattaaatcttggttaatgtatgtatgtgaatgtcgttgggaatatgggactgcacaagcattctttactagattaaccccattgctaattcataacagataaaacagacaataattttttatttcatttttaagtatctgtcactggtttggtgtcattcctccaaaagtagcattatttattgcattggtcctctggaatatcgtgacagcgatttgtttatgtatgctatatctaccgtagctaacgcgaatcagatgttgatgtgtttggagggtgacaaggacgtatatcttctgccttgctgtcttgccctttttactattttatttcaagttgatagaaaattcaagtaatagggacgggcagatcgcctcggacttacgagttgtctcacgtttcatttggaattataataaatgctggtaaaacgcttgtttcgttcttcgataaaacaatttggttaca

SEQ ID NO: 4612 - DNA, 2394 bp, Cucumis sativus
atgcagaggccaccaccagaagattttctattgaaggagaccaatccccatcttggtggggggaaggtcactggagataagctcacgagcacgtatgatctcgttgagcaaatgcagtatctctatgtccgtgttgtcaaagcgaaagacttgcctggaaaggatgttactggcagctgtgacccttatgtagaggtgaagcttgggaactacaagggtacaactcgacattttgagaagaagtcgaatcctgagtggagccaggtttttgccttctcaaaagaccggattcagtcttcagtgcttgaggttactgtaaaggataaagattttgtgaaggatgattttatgggtcgtgtgttgtttgacatgaatgagattccaaagcgtgttccacccgacagtccattggctcctcaatggtatagacttgaagataagaaaggcgataaactgaaaggagagctaatgttggccgtttggatgggaactcaagctgatgaagcatttcctgaagcatggcattcagatgctgcaactgtcagtggaactgatggtctagcaaatattcgatcgaaggtgtatctttcacctaagctctggtatttaagggttaatgttattgaagctcaggacttacagcctactgataagggtcgataccctgaagtttttgtgaaggctgtcctgggaaatcaagctttgagaacaaggatttcccagaacagaacaatcaatccattgtggaatgaggatttgatgtttgtagctgctgaaccatttgaggaacccttgattttgagcgttgaggaccgagttgctccgaataaggatgaaacccttggtaggtgtgcgattcctttgcaatatgtggaccggagattggatcataaacctgtgaacagcaaatggtacaatctggagaagcatattatccttgaaggagaaaagaagaaagaaatcaagttcgctagcagaattcatatgaggatctgtttggaaggtggttatcatgttttggacgaatcaacacactacagcagtgatcttcgtcctactgccaaagtattgtggaagcagagcattggagtgttggaattaggtatcctcaatgctcagggattgatgcctatgaagactaaagatggtcgtgggacaacagatgcatattgtgtggcgaaatacgggcagaagtgggttcgaactaggacgatcattgatagcttcacacccaagtggaatgagcagtatacttgggaagttttcgatccatgcacagtggttacgatcggtgtttttgataattgccatttgcttgggggagataaaggtggagggacaaaggattcacgaattgggaaggtgaggatacgtctttcaactctcgaaacagaccgagtttacacacactcgtatcctcttctggttttgcatccaaatggagtgaagaagatgggtgagatacacttggctgtgaggttcacttgctcttccttgctgaacatgatgcacatgtacacacatcccctgcttcccaaaatgcattatattcatcctttgacggtcagccagcttgatagcttaaggcatcaggcgactcagattgtatcaatgaggctgacccgggccgagccaccactgaggaaggaagttgttgaatatatgctggatgtcggttcccacatgtggagtatgcgaagaagcaaagcaaatttcttcaggattatgggagttttaagtggattaatagcagtaggaaaatggtttgatcaaatttgcaactggaaaaaccccattaccactgtactgatacacatcttgttcataatcctggtcatgtacccagagctaatcctgcccaccattttcctctacctcttcttgattggtgtttggtattaccgttggagaccgaggcatccgccacacatggacactcgtttgtcacatgcagactctgcacaccccgatgaacttgacgaagaattcgacacattcccaacatcaaggggtggtgacatagtgaggatgaggtatgaccgacttagaagcattgctgggaggattcagactgttgtgggggacttagcgactcaaggagagaggttgcagtctttgcttagctggagagacccaagagccactgccctgtttgttttgttctgtcttgttgctgccattgtcttatacgtcacaccattccaagttgtggccctgcttactggattttatgttttgagacaccccagattccgccataagcttccttctgtgccactgaatttcttcaggaggctgcctgcaaggactgattgtatgttgtgatgagagcctgaccaatgtctgcatctcccctccaattctcttggactgaccgacaacgatgatgacatt

SEQ ID NO: 4613 - DNA, 5209 bp, Gossypium raimondii
tctctctctctctctctctctcttgctttcttgttcttatcccttttttctttctttctttgttttttttagctttaaaatgttttgaaagaagagattttttttttaatttcaatcatccgctgatgagactatcgtcgatgtaattgagctcgatttgctttttttttcccgaatagtttaaacgcttccatttagattcattacgaaagcgatcttcaaagataaatcagatgaattatatgttgtattggtggttttggaatatgccatggtgatagcgatttgttcttctatggtatatttcccatttgctaatgagattgtagatgtggatgtgttcggggagcgagtgacaaggacatcagttggagtcgtagtggtggtcgcaacttcattgccaatgctgctgcctgtgggagccctttccatttatttgtttttttaaattgaattttaaagaaaaataaatttctttctttcgtatcaaaattttatttaaaacccaccaaaatttttaccgctcattcacgtctttagaagagtagaattttgacgtttgtttttttcccatgtagccctttttcttttcgctaccttccctgtctcttctctctttcttgctgttacatatggacccgggtctcgggtcgtttttcctcgggttcgccatcaagtttgctgccttttttttttttttaaacctaactataaaatcaaaaaatatttttttgttgtcctgtattttcatttttctctttctaactctccttttttctctatacccttctaactgaaaaaatcagtagctcagaactctccaaattccagcgctgttatttactaccgtcagccaccgcgcgtaccgtcggtcgccgcccaatctttttctcttatcactagcccttgttttggacatccactttacagttttggtctccatttctccaaaaaaagaaaaaaaaactagatatttctaaatttacaacttaagcccgaaacttaaaggccggccgtcgtctaccgttggatcatccctaaatttcagtatgtttttcttctccgattaaactttgttttcatcgtaggtatctttttaaaaaataaaatcctcaagccgaatatgcgaatcttttcttttttggtgtttgttttttcttgttttgattttgttggtgagtgtggtctattcttaaggggagtgtctttgtagttgtgcaagggtcgatgtaagaagtaaatgatgattgctttgttgttatagacacaaatatggaacaaggtttggttatggaagtggagatcagatccatgacttaggatggttgttttaacctgttagtttagagtaaaaaacaagttagacatctacatattttccatgcattttttcactaaccaaacagggattagttgtagttgctctgtttttaacatctcttggtagttggatctaaaagcttcatttctcatattttcatgctttttctggaatcaaagttggcagatctgaaagcttaaagggagtcagtctgtttacgcttctcacttaaaaaaactggtgtaagtttcgtgcatgtctgtcttccatgcttaccttctatgactggtttttgcgtcttatgtataatctattgtcgttttgagttcatataattaattggatgtaacttcatttataatatttggtgtcgctttaaatgttgaatctttggatattctctttcttttttacttcttttttagtttccatggcatttagggaaactcagggttttcccccctttttttaatgacgattttgttccgatcttttaggttctttcaaaacatttgaatttttgaactgatttttccttctttcgttatttaacgggtgatattgaacttttatttgggggggatatgtagttaaccatcggactttatttccaggtttttcttgggtctctttgtttgtttccaaagatgatgccccgtcctccacctgaagatttcgccctcaaagagaccaatccccaccttggtggtggaaaggtcagtggtgacaagcttactagtacttatgacttggtagagcagatgcaatacttgtatgtacgggttgtaaaggcgaaggatttgccagggaaagatgttacaggtagttgcgatccttatgttgaggttaagcttggaaactacttgggtaaaactcgcttttttgagaaaaagtcgaatcctgagtggaatcaggtgtttgcattttcgaaagataggcttcaggcttcattgcttgaggttacagttaaagacaaggattttgtgaaggatgacttcattgggaaggttttctttgatctcaatgagattcccaaaagggttccaccagatagtccactggcaccgcagtggtataggttggaggataggcagggaaataaggttaagggggagttgatgttggctgtttggatgggaactcaagctgatgaagcatttcctgaagcgtggcattctgatgctgcttttgttagcggagctgatggtctggccaatattcgatctaaagtatatctctctccaaagctttggtatttgagggtcaatgtgattgaggctcaggatttgcagccaggtgacaagggtcggtatcctgaagtttttgtgaaggctattttgggaaatcaggctttaaggactaggatttctcaggccaggggtattaatccaatgtggaatgaggatctaatgttcgtggcagcagaaccttttgaggagcctctaattttgagtgtagaagacagggttgctcctaataaggatgaagttttgggtaagtgtgcaattcctttacaatatgtagacaggaggcttgatcataaagccgtgaatagtaggtggtttaatcttgagaagcatgttattatagaaggagagaagaagaaagagaccaagtttgctagcagaattcatatgaggatttgtttggaaggtggctatcatgttctggatgagtctacccattacagtagtgatcttaggccaactgcaaaacagttgtggaagtctagcatcggggttctggaattggggattcttaatgcacatggcctaatgccaatgaagaataaagacggaagaggtacgactgatgcttattgtgttgcaaaatatggtcaaaaatgggtacgaacaaggacaatcatcgatagctttgcacccaagtggaatgaacagtatacatgggaggttttcgatccttgtactgtcataactattggggtgtttgataattgccatttacatggaggagataaggctgcaggagcaaaggatactaagatcgggaaggtgagaattcgactctccactcttgaaactgatcgggtttatactcactcatatccacttctggtgctacatccaaacggggtaaaaaagatgggtgaaattcacttggctgtgaggttctcatgctcttccttgcttaatatgatgcatatgtactcacatcctctcttgccaaaaatgcattaccttcatccattgactgttagccagctcgatagcttgaggcaccaggccacacagattgtgtcaatgaggctaggacgagcagagccgccattgagaaaagaggtggtggagtatatgctagatgttggttctcacatgtggagcatgaggagaagcaaagccaactttttcagaattatgaatgttttgggtgggttaattgctgttggaaaatggtttgatcagatctgtaattggaaaaacccaattacaacagtattgattcacatcttgtttatcatactggtcctctatccagagcttattttgcctacaattttcctctacctgttcttgattggggtttggtattatagatggcgaccaagacatcctcctcacatggacacacgcctttctcatgcagattcggcacatcctgatgaactggatgaagagtttgacacatttcctacttcccgcccatcagatattgtcaggatgagatatgatcgactgagaagtattgctgggagaattcagacggtggttggtgatttagccacacagggtgagaggctgcaatctcttttaagctggagagacccaagagccaccgctttattcgtaattttctgtttggttgctgctatagttttgtatgtcacacctttccaggttgtggctcttctagcaggattttacattttgaggcatccaaggttccgccataagcttccttcagtgcctctcaatttcttcaggaggttgcctgcaagaactgattccatgctatgaacaagaatgatatcatgtgcagtttcccggaggtggtatggagttgggattttccccatgttgattcagaaaagaagattgagaaacaaaaggagcttgtttctcctctaatgttcagcaacaggtgttgtgttctggaatgatgtgtaaccttcccctgaaggtagtagattttgtggatttgtgttcatttatgttatctatatgatttctgttttaaaactgagtttatcgtgattaatcaatgttcattgtaattttttaggttgtgattggaatttaggcaatgctaaaatgaatcttcactattttgcatctagaagatactaaaaatgatgggattttctagctccaagccttggtacatccttcatgcatgctatttgttttgtttagtggtgcttagagcttaccacgtcgacaccaagcatgagaatcttaatttacagatgttcaaagctattaatgtattgtatattaagcatctctttaccggtttggtatcatttctggaaaagtagattaactgcattactggtttggtactgtggaattcggtgccagcgatttatttaatcatttttgtatggtgtatctaccattgtggatgtggatggggggcgggtgaaacggacatctcttggcttgcctttttattttatttcaacttgatgatagaaaattcagtggatagataatgttctaatttgcttttactaatttattgaatgaaagctcgtttccgtctgagacaaaggagattgagcattggcatatttttcctctcatttcattatttcatgttaaattaatttttatgatcattgaacacttttaaaagggttaatgtaaaagaggtaagtggtgaattgtgggaaataaaatggggtggagatgaagaaagaagagaagt

SEQ ID NO: 4614 - DNA, 2682 bp, Vitis vinifera
ttcaagttctccccttgagaatcagaaaatgcacagaccaccacctgacgatttttctctgaaggagacctctccccacctcggtgggggaaaggtcaccggggataagctcacaagcacatatgacctcgttgagcaaatgcaatatctatatgttcgtgttgttaaagcaaaagatttaccatcaaaggacgttacaggaagctgtgacccgtatgttgaagttaagcttggaaactataagggcaccacaccacattttgagaagaaaactaatccagaatggaaccgggtgtttgctttctcaaaagatcggatgcaggcttcaatgctggaggttatagtgaaagataaggattttgtgaaggatgactacataggtcgggttgtatttgatctcaatgaggttccaaagcgggttcccccggacagtcctctggcacctcagtggtataggttggaggacagaaagggggacaaggttaaaggaggagagctgatgttggccgtttggatgggtactcaagcagatgaagcatttccggatgcatggcattctgatgctgcagcggtcagtggtagtgatggtcttgcaaatatgagatcaaaggtgtatctctcgcctaagctatggtatctgagggttaatgtgattgaagctcaggacctgcaaccaactgatagaggtcggtatcctgaagtttttgtgaaggctattctaggaaatcaggctctgagaactagaatttctcagatcaaatccatcaatccaatgtggaatgaggatttgatgtttgtggcatctgagccatttgaggagcccttgattttgagtgtggaagatagggttggaaacaacaaagatgaggtcttggggaggtgtgcaattcctttacagtatgtggatagaaggtttgatcataaaattatgaactcgaggtggtttaatcttgagaaacatattgttgtggatggggagcaaaagaagaaggagatcaagtttgcaagcaggattcatttgaggatctgtttggagggtggttatcatgttctggatgagtcaacacactacagtagtgatcttagaccaacagaaaaacggttgtggaagtctagcattggcgttctggaattggggattttgaatgctcaggggttgttgccgatgaagacgaaagatgggcggggaacgactgatgcttattgtgtggccaaatatggtcaaaagtgggttaggacgaggacaatcatagatagctctactcccaagtggaatgagcaatacacatgggaggtttatgacccatgtactgtcataactattggggtgtttgacaactgtcacttgcatggaggtgataaggctggaggagcgaccaaggactcgaggattggaaaggtaagaattcgcctttcaacccttgagactgatcgtgtttatacacactcatacccacttcttgtcttacatccaactggggtgaagaagatgggtgaaattcatttggctgtgaggtttacttgctcatctttgcttaatatgatgcatatgtactcacaaccactgttgccaaaaatgcactaccttcatccgttaactgttaatcagctagatagcttgaggcatcaggccacccagattgtctcaatgaggctgagccgtgccgagccaccactgagaaaagaagtggtggagtatatgctggatgtgggttcccacatgtggagtatgagaagaagcaaagccaactttttcaggatcatgggggttttgggtgggctaattgctgtgggaaaatggtttgatcagatatgcaattggaagaactccattacaaccgtcctgattcacatattgttctttatactggtcatgtatcctgagctcattttacccacaattttcctctatcttttcttgattggagtttggtacttcagatggaggccaaggcatcctccacacatggacactcgtctctcccatgctgattctgcacatcctgatgaactggatgaagaattcgatacatttccaacttcccggccttctgatgttgtaaggatgagatatgatcgattgagaagtattgcagggaggattcagactgtggttggtgacttggcaactcaaggggagaggctgcaatctttgctgagctggcgagacccgagagctacagctctgtttgtgcttttctgtttggttgctgccatagttctgtatgttacaccttttcaggttgtggctcttttgacaggattttatgtgttgagacatcccaggttccgtcataagcttccttcagtgcccctgaatttcttcaggaggttgccagccagaactgactgcatgttatgagcaagcaaactggcattatgcaattcatgtgatgcggtattgcattggatttgcccgttatgttttcttcttttcccttttccagtcagtgaagaagatgtagaaacaaatggagcttgtttgttttctttccattagctgcgaatgttgggacctggtatgatatgtaacctctcccttgaagcttagtaggttttgtggatttgtgttttatttatgtcatttataggatttctgtttcaaactttgtgtcttgactccatggtaatcaatccatgttgatttgtaattttgtaggccgtgatttgagtttctctgtg

SEQ ID NO: 4615 - DNA, 3188 bp, Vitis vinifera
ttcagatcccaccgaagccctctctctctagagtttcattttccctctggaaaactctttttctctctctttctcttttcattatctatttgatttcactctcacaaacccttctctctacatcgcctctaacgctcagcatcctgcttctggggttttgctaaatcctttcctcgtgggttccagcattcggatcggaacgttttgaagcagctttgttgatagtccagttcaatgcttcttcacgtatcggagatctagggtttcaagtgtatagggattaaggggttttcgaaattttgaaccccgtttcggcttctataatactcgaccgttgcttcaagttctccccttgagaatcagaaaatgcacagaccaccacctgacgatttttctctgaaggagacctctccccacctcggtgggggaaaggtcaccggggataagctcacaagcacatatgacctcgttgagcaaatgcaatatctatatgttcgtgttgttaaagcaaaagatttaccatcaaaggacgttacaggaagctgtgacccgtatgttgaagttaagcttggaaactataagggcaccacaccacattttgagaagaaaactaatccagaatggaaccgggtgtttgctttctcaaaagatcggatgcaggcttcaatgctggaggttatagtgaaagataaggattttgtgaaggatgactacataggtcgggttgtatttgatctcaatgaggttccaaagcgggttcccccggacagtcctctggcacctcagtggtataggttggaggacagaaagggggacaaggttaaaggaggagagctgatgttggccgtttggatgggtactcaagcagatgaagcatttccggatgcatggcattctgatgctgcagcggtcagtggtagtgatggtcttgcaaatatgagatcaaaggtgtatctctcgcctaagctatggtatctgagggttaatgtgattgaagctcaggacctgcaaccaactgatagaggtcggtatcctgaagtttttgtgaaggctattctaggaaatcaggctctgagaactagaatttctcagatcaaatccatcaatccaatgtggaatgaggatttgatgtttgtggcatctgagccatttgaggagcccttgattttgagtgtggaagatagggttggaaacaacaaagatgaggtcttggggaggtgtgcaattcctttacagtatgtggatagaaggtttgatcataaaattatgaactcgaggtggtttaatcttgagaaacatattgttgtggatggggagcaaaagaagaaggagatcaagtttgcaagcaggattcatttgaggatctgtttggagggtggttatcatgttctggatgagtcaacacactacagtagtgatcttagaccaacagaaaaacggttgtggaagtctagcattggcgttctggaattggggattttgaatgctcaggggttgttgccgatgaagacgaaagatgggcggggaacgactgatgcttattgtgtggccaaatatggtcaaaagtgggttaggacgaggacaatcatagatagctctactcccaagtggaatgagcaatacacatgggaggtttatgacccatgtactgtcataactattggggtgtttgacaactgtcacttgcatggaggtgataaggctggaggagcgaccaaggactcgaggattggaaaggtaagaattcgcctttcaacccttgagactgatcgtgtttatacacactcatacccacttcttgtcttacatccaactggggtgaagaagatgggtgaaattcatttggctgtgaggtttacttgctcatctttgcttaatatgatgcatatgtactcacaaccactgttgccaaaaatgcactaccttcatccgttaactgttaatcagctagatagcttgaggcatcaggccacccagattgtctcaatgaggctgagccgtgccgagccaccactgagaaaagaagtggtggagtatatgctggatgtgggttcccacatgtggagtatgagaagaagcaaagccaactttttcaggatcatgggggttttgggtgggctaattgctgtgggaaaatggtttgatcagatatgcaattggaagaactccattacaaccgtcctgattcacatattgttctttatactggtcatgtatcctgagctcattttacccacaattttcctctatcttttcttgattggagtttggtacttcagatggaggccaaggcatcctccacacatggacactcgtctctcccatgctgattctgcacatcctgatgaactggatgaagaattcgatacatttccaacttcccggccttctgatgttgtaaggatgagatatgatcgattgagaagtattgcagggaggattcagactgtggttggtgacttggcaactcaaggggagaggctgcaatctttgctgagctggcgagacccgagagctacagctctgtttgtgcttttctgtttggttgctgccatagttctgtatgttacaccttttcaggttgtggctcttttgacaggattttatgtgttgagacatcccaggttccgtcataagcttccttcagtgcccctgaatttcttcaggaggttgccagccagaactgactgcatgttatgagcaagcaaactggcattatgcaattcatgtgatgcggtattgcattggatttgcccgttatgttttcttcttttcccttttccagtcagtgaagaagatgtagaaacaaatggagcttgtttgttttctttccattagctgcgaatgttgggacctggtatgatatgtaacctctcccttgaagcttagtaggttttgtggatttgtgttttatttatgtcatttataggatttctgtttcaaactttgtgtcttgactccatggtaatcaatccatgttgatttgtaattttgtaggccgtgatttgagtttctctgtgctatatccttaattactagctggtttctttaatggcacatctgctcccatcccagtaaatcttgtttctgattgtatcttggttgatttgtctgtcatcatccattcattgtggctgcattttctatgctgagcttgttttgattaaacaaagctagattctttttct

SEQ ID NO: 4616 - DNA, 2929 bp, Solanum lycopersicum
tgtactttgttacctttttcacttttgattttggctcactacaccatttcttctacactttggttcaagaaagagcaaaaccccaaaccccttttgctttttttcctccttaagactccattcttgataaccttgtcagtaaaaatccaatctttcctcttcagattctatgaaacctcaagtaacataatttgggagttctctttgtcggtaactggttgtctgtgctgaggtcttccttctgttgatcactgggtcacattctggtggagaactagaggggttttgtggtgattgtgcttttgacaaaggttttgtgtcaagtgttgttgcgtcaacctcgaaaatgcagaggccccatcaagaagatttctcactcaaggagaccaaaccccaccttggtggagggaagatcactggtgataagctcactagcacatatgaccttgttgagcaaatgcagtatctttatgtccgggttgtgaaagctaaggatttacctgcaaaggatgtaacaggtagtcttgatccttatgttgaggttaagctcgggaattataagggtacgactcgtcattttgagaagaagtcgaatcctgagtggagtcaggtgtttgctttctcaaaagataggattcaggcttctgtacttgaagtaattgtgaaagataaggattttgttaaggatgactttgtgggtcgtgtcctgtttgatttgaatgatatcccaaaaagggttcccccagacagtcctctcgctccacagtggtataggttggaggagaggaatggtaccaaagtcaaaggggagttgatgttggctgtttggatgggaaatcaagctgatgaagcctttcctgaagcttggcattcagatgctgcagctgttagtggggctgatggccttgcaaatataaggtctaaggtgtacctctcgccaaaattgtggtacctaagagttaacgtgatcgaggctcaagacttgattccaaatgacaaaagcaggtttccagaagtttacgtcaaggccatgcttggaaatcaagcattgaggaccagagtttccatgagcaagactatcaatcccttgtggaatgaggatctgatgtttgtagcagcggaaccgtttgaggagccattgattttgagtgtggaagatagagttgcaaacaaggatgaagtccttgggaggtgtgcaattcctttgcagtacgtggataggaggttggaccatagacctgtgaacacgagatggtttaatcttgagaagcatgttattgttgagggtgaaaagaaggaaatcaagtttgctagccggattcatatgagagtatgtttggaaggaggctaccatgtgctggatgagtcaacccattacagtagtgatcttaggccaactgcaaaacagctgtggaaatctagcatcggtgttcttgaagtaggtgttctgagcgctcagggcctgtcaccaatgaaaacgaaggatgggcgggcaacgacagatgcctattgtgtagcaaagtatgggcagaagtgggtgcggacaaggacaattatagatagctttgctcccagatggaatgagcaatacacgtgggaagtatttgatccttgcactgttataactattggtgtatttgataattgccatctgcaaggaggagataaatctggaggggcaagggactcaaggattggaaaggtcaggatccgtctttcgactcttgaaactgatcgtgtctacacgcattcatacccattgctggtcttgcatcctactggggtgaagaagatgggtgaaattcatttggctgtgagatttacttgctcgtcgttggtgaatatgatgcatatgtactcgcagccattgttaccgaaaatgcactatcttcatccgttaactgttacgcagctggacaacttgaggcaccaagccactcagattgtgtccttgaggctgagtcgtgctgagccacctttgaggaaagagatagtagagtatatgttggatgttacttctcatatgtggagcatgaggagaagcaaggctaactttttcaggattatgggtgttttaggtgtggtaatttcagtcggaaaatggtttgatcaaatatgcaattggaaaaatcccattacgactgttctgatccatatcctgttcttgatactggttctttatccagagcttattctacctaccattttcctctatctgttcctgattggaatttggtactacagatggaggccaaggcatcctcctcacatggatactcgcctttcttgtgctgatactgctcatcccgatgagctggatgaggaatttgatactttccctacttcacgttctcctgatattatcaggatgaggtatgaccgcataagaagtattgcagggaggattcagaccgtggttggcgacttggctactcaaggagagaggctgcagtctttgctgagctggagggaccctagagcaacagcattgttcgtaattttctgcttggttgctgctgttgttctctatgtcactccattccaagccgtggggctcttgaccggattttatgtattaagacatccaaggttccgctacaagcttccatctgtgccgcttaacttcttcagaaggttgcctgctagaacagactgcatgctataacccatgcccttaaacaactatcctaccttctgtttttttgcattgaatcgtcgaaaatgatgctgaaattgtggggctctcctactattttgcataagatcctggtgaaactgttagtttagtgagtttgctttctatttgctctatgtttttcaaaaaaaaaattggctgctgatgcaaatctatgtatgtaatcatgtagcttgcaagttattttgttttgaacaagcccccaatactcaattcaaaagtttcaatttggga

SEQ ID NO: 4617 - DNA, 3494 bp, Populus trichocarpa
agagacaaagcaacagagagcccgaaaagagagagggcaaaagtgagagagagagagagagagtatgttctgtgtgtattctcacagattcattaaagagaaaaacaaacactcctgctaaaattaaaactaaaataaaataaaacaaaaggcaaaacactattgcgactcctcccctctctctagactctagagttatcttctcttctcttctcatctcttctgttcccttctcttctcttcttcattcttatctcctccctgtttatgtagatgaaggagcgctagggttctttttctagatcttcttcctcatgtttttcgagggttttcgaattgaaggactttgaattcaaagcctgttttgattttggttccttagaagacaagctcttcaacttcaacttgaaaaggactattggggttgttttttcgggtgtctcccgtttgagccaacatgatgcagaagccaccgcaggatgattttctattgaaagagaccaatccccatcttggagggggaaagatcactggcgacaagcttacgagcacctatgatcttgtggagcagatgcagtatctttatgtccgggtcgttaaggccaaggacttgcctgcgaaggatgttacaggtagttgtgatccttacgtggaagttaaacttggaaactataagggcactactcggcattttgagaagaagacgaacccggagtggaaccaggtgtttgcattttcaaaggagcggattcaggcgtcgatgcttgaggttactgttaaggataaggatcttgtgaaggatgatttcattggccgggttttatttgatatgaatgagataccaaagcgtgttcctcctgatagtcctctggcaccacagtggtatcggttggaggataggaaaggagataaatttaagggggaattgatgctagcggtatggatgggaacacaggcagatgaagcttttccagaagcatggcattcagatgctgctactgttagtggaacagatagtcttgctaatattcggtccaaggtatatctctccccaaaattatggtatttgagggtcaatgtgattgaagcacaggacctggtaccgagtgataaaggcaggtatccagaagtatatgttaaagctatcctgggaaatcaagtcctgagaacaagagtttctcctagcaggagtattaatcctatgtggaatgaggaccttatgtttgtggcatcagaaccttttgaggaggccttgattttgagtgtggaagatagaatcgcgcccaacaaggatgaagtgttggggagatgcgcaattccaatgcatcatgtagacagaaggttggaccataaccctgtgaacactaggtggtttaatctggagaaacatgttattgtagaaggggaaaagaagaaagaaataaagtttgccagcaggattcacatgaggatctgcttggagggtggttatcatgttctggatgaatcaacacactatagtagtgatcttcgtccgacagctaaacagctgtggaagcacagcataggggtacttgaattgggtattctcaatgctcagggattgatgcccatgaaagcaaaggatggtcggggaacaactgatgcatactgtgtggcaaaatatggacagaagtgggttcgaaccagaaccatcattgacagtttcacgcccaagtggaacgagcaatatacttgggaggttttcgatccctgtactgtcataacaattggggtctttgataattgtcatttgcatggaggggacaagcccggtgggtcaagggattcaaggatcgggaaggtacgaatccgtctttccacacttgaaactgacagggtttacacacactcctatccactgttggtcctgcatcgtaatggtgtcaaaaagatgggagaaattcatttggcagttcgttttacatgctcatcattgctcaatatgatgcacatgtactcacatcctttgctgccaaagatgcactatatccatccactgactgtcagccagctagatagcttgaggcatcaggccactgtgattgtgtcattgaggctgagccggtcagagccaccattaagaaaggagattgttgaatatatgctggatgtggggtctcacatgtggagtatgagaagaagtaaagccaactttttcagaatcatgaacgttttcggtgggctaattgctctagggaaatggtttgatcagatatgcaattggaaaaacccaatcaccactgtgctgattcacattttgtttataatcctagtcctctatccagaacttatcttgcccacaatcttcctgtatctcttcctgattggtgtctggtattatagacggaggccaaggcatcctcctcacatggacactcgtctctctcatgcggagtctgctcatcccgatgaattggatgaggaatttgacacgttcccaacttctcagtctgctgatattgtaaggatgagatatgatcgtttgagaagtattgcagggaggattcagactgttgttggtgatttagctactcaaggggagaggctgcaatctttactgagctggcgagacccaagggccacagctctgtttgtgctcttttgtctgattgctgccattgttctatatattactcctttccaagttgtggcagttctcattggattgtatgtgctgagacatcccaggttccgccacaaacttccttcagttccactcaatttcttccggcggttgccagcaagaaccgattccatgctgtgagcaaagccagttttatctgcaattgcattttgcatctgatcttgtcaagtcagagaagaagatggtggttctggcacaacgtgtaaccttcctctgaaggtagtagattttgtggatttgcgggttatttaaagatattttaataggatttctgtttcaactttcgagctttatggtaatcaatccatcttcatttgtaattttgtaggttttggttggaatttaacctttggtgaaccttctctgtgcttcactacatctagtagatattgttgtccactgggatttctgatctcaaccttgttatattcctgcaatggaatggcttctttttccttggtcattttttactaaaacacagcctatttcacctgtcctgctcttttcttttttctatcaaaaaagaattgcccgtttagattatattaatgagcaccagcttgttcttttctatattgtattgttctcttgcttgtttggtattctatcattcccaggacatcctgtatggccagcgagaagaatttatatccacttcctgccttcttgtctagcttacagcagactctgttcatgttaacctgtgtttattttacttgataaattattcaaagtcacggggaaggacaaagattgcctccctaattattgggtatttctattgaacaaaagcatattataaatgctattactgagcaaagactagatc

SEQ ID NO: 4618 - DNA, 3106 bp, Arabidopsis thaliana
accgagttaaaaaaagaaggaaactgtagaaaaaagcagaagaagaagacgacgacaataaaacacaagagagagagcacacacaaatcccttcttcaatgtttatttactctctccagaactttcttttcccagtacttctcctctgctttttattacttgtcttcttctctctttaattttttataaatttaattttgggttgaaaaaaacgaggaagaagagaggagaggagactctttcttttagtatttatttatggaggaggagaggagactgtcttaatcgtttccgggtctcttattctgatccattcttctctcaagatctaagatttactgattttgaagtggagaagaaattagttgtctcgacaaaccccactagaaactttgtttagtgtgtcttcttaaagcctgcaagatgcagagaccacctcctgaagatttctccttgaaggagacgagacctcatctaggtggaggaaaactctctggagataagcttaccagtacttatgaccttgttgagcaaatgcagtatctctatgttcgtgtggttaaggcaaaggagttacctggcaaggatatgactggtagttgtgacccttatgttgaggttaagcttggaaactacaaaggcaccactaggcatttcgagaagaaatctaatcctgagtggaaccaagttttcgccttttctaaagataggattcaagcttctttccttgaagctactgtcaaggacaaggattttgtcaaagatgatttgattggtcgggttgtctttgatttgaatgaggtacctaagagagttcctcctgatagtcccttggctccgcaatggtataggctcgaggataggaaaggtgataaagtcaagggagagcttatgttggctgtttggtttggtactcaagctgatgaagctttccctgaagcttggcactctgatgctgcaactgttagtggtactgatgctcttgccaacatccgttccaaggtttatctttctcctaagctttggtacctcagggttaatgtaattgaagctcaagatttgataccaactgataagcaaagatatcccgaggtttatgtgaaggctatagtgggaaaccaggcgttgaggactagagtatcgcagagcaggactattaatcccatgtggaatgaggatttgatgtttgtcgcagcagagccatttgaggaacctttgatcctcagcgtggaagatagagttgctccaaacaaagatgaagtcttggggagatgtgcgatcccgttgcagtatttggacagaagatttgaccataaaccggtgaacagcaggtggtacaatctcgagaagcatattatggtcgatggagagaagaaggagaccaaattcgctagcaggattcacatgagaatatgtttggaaggagggtatcacgttctcgatgagtctacgcattacagcagtgatcttagaccaacagcgaagcaactatggaagcctaatatcggtgtactggagttggggatactgaatgctacaggtctgatgcctatgaaaaccaaagacggccggggaaccacagatgcatattgtgtggcgaagtacggacagaaatggattcgaactcggacaatcattgacagctttacaccaagatggaatgagcaatatacttgggaggtttttgatccgtgcaccgttgttactgttggagtttttgataactgccatctccatggaggtgagaagattggaggagcaaaagattcaagaatcgggaaggtaagaatcaggctttctactctcgagactgatcgagtttatacacattcataccctcttttggtgctccatcctaacggagtcaagaaaatgggagaaattcacttagctgtgagattcacttgctcttcattgctcaacatgatgtatatgtactcacagcctctcttaccgaagatgcattatatccatccactgacggttagccagcttgataacttgaggcatcaagcgactcagattgtatcgatgaggctgacccgagcagaaccacctctaaggaaagaagtagttgagtatatgcttgatgtgggttctcacatgtggagtatgcggagaagcaaagcaaactttttcaggattatgggagttttgagtgggttaatcgcagtaggaaaatggtttgaacaaatctgcaactggaagaatccaatcacaacagtcttgatccatctcttgttcatcatccttgtgctctatcccgaactaatcttgcccaccatcttcctctacctcttcctcatcggtatctggtactaccgttggagaccgaggcatcctcctcacatggacacacgtctctctcacgctgactcagcccaccccgacgagctagatgaagagttcgacacttttcctacttcccgaccatctgacatagtcaggatgaggtatgacaggttgaggagtattgctggtaggattcagacagtggtaggtgatctagcaactcaaggagaaaggcttcagtctctgctaagctggcgtgatccgcgtgcaacagcgctcttcgtcttgttctgcttgattgccgcagtcattctctatgtgacacctttccaggttgtggctctttgtattggaatctatgctctgagacatccgaggttcagatacaaactaccatccgttcctctcaatttcttcagaaggcttcctgcaagaactgattgcatgctctgacctgcaaaaactgcttccaataccgaagaaaacttctataagacttgtagtttgttcttgttaaaaatatcatgatgactctttttagtttgttcattgttaaaaatgtcatgatgactcttttcttggtgatggtgatgatgtatccgtctgtcttttaacattattaagacttttgtttgaaagtagtaaagaagtatcttgtgtggttttgatgttcttgtcactggttagtaagtcataatctatgcctctctggtttttgtgttttatcactggagctttaggagtttggtgccattgggttggttgctgttgagattagaggttgtcacagtttggtctaatggtcaaatacaag

SEQ ID NO: 4619 - DNA, 2685 bp, Plantago ovata
gtatctctcacccacaaaaaaaccacagctttaattcattctagtctcttctcaaggctggtggggaatactgaaagatgcagaggccccctccggaagatttctccttgaaggagaccaagccccacctcggtggggggaaggtcactggagataaactaacgagcacctatgacctcgtcgagcagatgcagtatctttacgtccgggtggtaaaggcgaaggatttacctgcaaaggatgtgactggaagctgcgacccttatgttgaggtcaggctgggaaactataagggcacgacccgtcattttgagaagaagtcgaacccggagtggaatcaggtgtttgctttctccaaggatcgtatccaggcttctgtgctcgaagttaccgtcaaggataaggatttcgtcaaggatgattttattggtcgggttctgtttgatctgaatgaggtcccgaaaagggttcccccggatagtcctcttgccccgcagtggtatcggttggatgatagaaagaatgacaaggttaaaggagagttgatgttggctgtttggatgggtactcaggctgatgaggcatttcctgaagcgtggcactctgatgctgcaacagttgccggtggggagggtgttgcaagtatcaggtccaaagtgtatctgtcacctaagctttggtatctgagagtaaacgtaattgaggctcaggacttgattccgggtgataaaagccgcttccctgaagtatatgtgaaggctattttgggtaatcaggcattgaggactagagtttccatgagtaaaagcatcaatccaatgtggaatgaagatttaatgtttgtggcagctgaaccattcgaggagcctcttattttgagcgtagaagaccgagttgcaccaaacaaagatgaagtcctaggaaggtgtgctattcctctacagtatgttgacagaagattggatcacagaccagtgcacacgagatggcataatctcgagaagcatgtgattgtcgaaggtgaaaagaagaaagaaatgaagtttgccagcaagattcatatgagggtttgcttggaaggtggttaccatgtccttgatgagtcgacccactacagcagtgatctcaggccaacagcaaagcagttgtggaagtctagcattggagttttggagttggggattttgaatgctcacggtctctcacctatgaaatcgaaagacgggcgagcaactacagatgcttattgtgttgcaaagtacgggcagaagtgggtgaggacgaggactataattgatagctttacccccaaatggaatgagcagtacacttgggaagttttcgatccttgcactgttgtaaccattggtgtatttgataactgccacttgcacggtggagataaggcaagagactcaagaattgggaaggtcaggatccgtctgtctactctagaaactgaccgtgtgtacacacattcatatcctcttctggtgttgcatccttccggtgtgaaaaagatgggtgaaattcatttggcagtaaggttcacttgctcgtccctgttaaacatgatgcacatgtactcccaaccacttttgcccaaaatgcactacatccatccattgaccgtgagtcagctcgacagtttgaggcaccaggcgactcagattgtttcgatgaggcttagccgtgctgagccacctctgaggaaggaagttgtggaatatatgctagatgttggttctcacatgtggagcatgaggaggagcaaagctaacttcttccgtatcatgaatgtgtttagtgggttaattgctgttggaaagtggttcgatcaaatatgcaattggaagaaccccatcaccacagtcctcattcacatcctgttcttaatcctggttctctatcctgaacttatcttaccaacaattttcctttacttgttcttgattggtgtatggtactatagatggagaccgaggaagccctctcacatggatactcggatatcttgtgctgacaatgctcatccagatgagctggatgaggagttcgatacattcccaacttcccgtcctccagacattgtgcgtatgaggtatgatcgtctgagaagcatcgctggaaggatacagacagtggttggtgacttggcaacgcaaggtgaaaggctgcaatccctgctgagctggcgagaccctagagcaacggctttgtttgtcatcttctgtctgcttgctgccattattctctatgtgacaccgtttcaagtggtagcgcttcttacaggtttttacgtgctcagacatccgaggttccggtacaagctaccttctgtgccgctgaatttcttcagaaggttaccagcaagaaccgactgcatgctatgagcaatgagatggggaggtaagttgaatttcgcctggcgatggagctcgttttgcggcctaatttctgagttatgccttgtgaatctggcctacttggaaggaccaggttctttatttactaggttgtgttgttaagttttatttaatttgtcctggacagaccatgttcatgttttctgttattattttgttcctgaagtgatgcttgagagagacctcttaaatgaatggatgaatgtttgttctaagtgctaatattacttcaagtcattatatagtagtatatggtttt

SEQ ID NO: 4620 - DNA, 3038 bp, Citrullus lanatus
tctactccacaccacaccccttctaaccacttctgtatatttctcgcagattcatcagatcccaacccataaagcaattctgcaaaaagcaaaagcacttctgctctgcaaacccctctttcctttgctttccctttttcctcgttttccctctttatcctcacccccccttccttctcttctcttccttatctctttgcaacttcaccatttttcttttcctcaactgggtttctgttggcgattattccttttccctcaataatcgctctcatcaatcgccttcaccccattttagggttctggcacttagatctgaaaccgtccgacaggcactgtttggatttctatgtactgcttttgaggcttcagagagctgtttgacataatttggatttggcttcagcttctgtgaagaaatctggccgtgttggactgctaattattttggatttgtttccttatcaccaagaagatgcagaggccaccaccagaagattttctattgaaggagactaatccccatcttggtggggggaaggtcacaggagataagctcacgagcacgtatgatctcgttgagcaaatgcagtatctctatgtccgtgttgtcaaagcaaaagaattgcctggaaaggatgttactggcagctgtgacccttatgtggaagtgaagcttggaaactacaagggtacaactcgacattttgagaagaagtccaatcctgagtggaaccaggtttttgccttctcaaaagaccggattcagtcttcagtgcttgaagttactgtgaaggataaagattttgtgaaggatgatttcatgggtcgtgttttgtttgacatgaatgagattccaaaacgtgttccgccagacagtccattggctcctcaatggtatagactggaggacaagaaaggcgaaaaactgaaaggagagctaatgttggctgtttggatgggcactcaagctgatgaagcatttcctgaagcatggcattcagatgctgcaactgtcagtggaactgatggtctagcaaatattcgatcaaaggtgtatctttcacccaagctctggtatttaagggttaatgttatcgaagctcaggacttacagcctacagacaagggtcaataccctgaagtttttgtgaaggctatcctgggaaatcaagctttgagaacaaggatttctcagaacaggacaatcaatccattgtggaatgaggatttgatgtttgtagctgcagaaccatttgaagaaccgttgattttgagtgttgaggaccgagttgctccgaataaggatgaaaccctaggtagatgtgcgatccctttgcaatatgtggaccggagattggaccataaacctgtgaacagcaaatggtacaatctggagaagcacattgtccttgaaggagaaaagaaaaaagaaatcaaattcgctagcagaattcatatgaggatctgtttggaaggtggttatcatgttttggacgaatcgacacactacagcagtgatcttcgtcctactgccaaagtattgtggaagcagagcattggggtgttggaattaggtatcctcaatgctcagggattgatgcctatgaagacgaaagatgggcgtgggacgacggatgcatactgtgtggcaaaatacgggcagaagtgggttcgaactaggacaatcattgatagcttcacacccaagtggaatgagcagtacacttgggaagttttcgatccgtgcacggtggttacgattggtgtttttgataattgtcatttgcttgggggagataaaggtggagggacaaaagactcacggattgggaaggtgaggatacgtctttcaactctcgaaacagatcgagtttacacacattcgtatcctcttctggttttgcacccaaatggagtgaagaagatgggtgagatacacttggctgtgaggttcacttgctcttccttgctaaacatgatgcacatgtacacacatcccctgcttccaaaaatgcattatattcatcctttgacggtcagccagcttgatagcttaaggcatcaggcgactcagatcgtatcaatgaggctgtcccgggccgagccaccattgaggaaggaagtagtcgaatatatgctggatgtgggttcccacatgtggagtatgcgaagaagcaaagctaatttcttcaggattatgggagttttaagtggattaatagcagtaggaaaatggtttgatcagatttgcaattggaaaaaccccattaccactgtactgatacacgtcctgttcataatactcgtcatgtacccagagctaatcctgcccaccattttcctctacctcttcttgattggagtttggtactaccggtggaggccgaggcatccgccacacatggacactcgtctgtcacatgcagactctgcacaccccgatgaactcgacgaagaattcgacacattcccgacatccaggcctggtgacatagtgaggatgaggtacgaccgactcaggagcattgctgggaggattcagactgttgtgggcgatttggcgactcaaggagagaggttgcagtctttgcttagctggagagatccaagagccactgccctgtttgttctgttctgtcttgttgctgccattgtcttatatgtcacaccattccaagttgtggccctgctcactggattttatgttttgagacaccccagattccgccataagcttccttctgtgccactgaacttcttcaggaggctgcctgcaaggactgattgtatgttgtgatgagagcctgaccaatgtctgcatctccccccttccgattctcttggactgaccgacgacgatgatgacattgccacggtattgcagttttttctgcatttgtcttttcagttagataatgaagacagggaagaaagaaagcaaaagcagtcttgtttgcttcttgctgcatcttgagtggctgattttttgttcttttatgtgatgtgtatgacctttttttttttttttttttttt

SEQ ID NO: 4621 - DNA, 3008 bp, Arabidopsis lyrata
aaaaaaaggaaactgtagaaaaagcgacggaaagaagaaaaagacgacaacaaaacgagagagagagagagcacacaaaaactttgtcttcttctcttttttaaaaaatgaaatttaatttgggttgaaaaaacgaggaagaagagaggagagtacttgactcttttcttatttaattatggaggagaagactgtctaatcggtctcttattctgatccatgcttcttctgtataatagttttttcttgatttgaagtggagaagaaagtagctgtgttctcaaatccaccaaagaactttgtttagtgtcttcttaaagcctgcaagatgcagagaccacctcctgaagatttctccttgaaggagacgagacctcatctcggtggaggaaaaatctctggagataagctgaccagcacttatgacctcgtggagcagatgcagtatctttatgtccgagtggttaaggcaaaggagttacctgggaaggatatgactggtagttgtgacccttatgttgaggttaagcttggaaactacaaaggtaccactaggcatttcgagaagaaatctaatcctgagtggaaccaagttttcgccttttctaaagataggattcaagcttctttccttgaagctactgtcaaggacaaggatgttgtgaaagatgatttgattggtcgggttgtgtttgatttgaatgaggtacctaagagagttcctcctgatagtcccttggccccgcaatggtataggctcgaggataggaaaggtgataaagtcaagggagagcttatgctggctgtttggtttggtactcaagctgatgaagccttccctgaagcttggcactctgatgctgcaactgttagtggtactgatgctcttgccaacatccgttccaaggtttatctgtctcctaagctttggtacctcagggttaatgtaattgaagctcaagatttgataccaagtgataagcaaagatatcctgaggtttatgtgaaggctatagtgggaaaccaggcgttgaggactagagtatcacagagcaggactattaatccgatgtggaatgaggatttgatgtttgtagcagcagagccatttgaggaacctttgatcctcagcgtggaagacagagttgctcctaacaaagatgaagtcttggggagatgtgcgatcccgttgcagtatttggacagaagatttgaccacaaaccggtgaacagcaggtggtataacctcgagaagcatattatggtcgatggagagaagaaggagaccaaattcgctagcaggattcacatgagaatctgtttagaaggagggtatcacgttcttgatgagtctacgcattacagtagtgatcttagaccaacagcgaaacaactatggaagcctaatatcggtgtgctggagttggggatactaaatgcgacaggtctgatgcctatgaaaactaaagacggtaggggaaccacagatgcatattgtgtggcaaagtatggacagaaatggattcgaactcggacaatcattgacagctttaccccaagatggaacgagcaatatacttgggaggtttttgatccatgtactgttgttactgttggagtttttgataactgccatctccatggaggtgagaagaatggaggagcaaaagattcaagaattgggaaggtaagaatcaggctttctactctcgagactgatcgagtttacacacattcataccctcttttggtgctccatcctaacggagtcaagaaaatgggagaaattcacttggctgtgaggttcacttgctcttcattgctcaacatgatgtatatgtactcactgcctctcttaccgaagatgcattacatccatcctctaactgttagccagcttgataacttgaggcatcaagcgactcagattgtatcgatgaggttgacccgagcagaaccgcctctaaggaaagaagtagttgagtatatgcttgatgtgggttctcacatgtggagtatgcggagaagcaaagcaaactttttcaggattatgggagttttgagtgggttaatcgcagtaggaaaatggttcgaacagatctgcaactggaagaatccgatcacaacagtcttgatccatctcttgttcatcatccttgtgctctatcccgaactaatcttgcccaccatcttcctctacctcttcctcatcggtgtctggtattaccgttggagaccgaggcatcctcctcacatggacacacgtctctctcacgctgactcagcccaccccgacgagctagatgaagagttcgacacttttcctacttcccgaccatctgacatcgtcaggatgaggtatgacaggttgaggagtattgctgggaggattcaaacagtggtaggtgatcttgcaacacaaggagaaaggcttcagtctctgctaagctggcgtgatccgcgtgcgacagcactcttcgtcttgttctgcttgattgccgcagttattctctatgtgacacctttccaggttgtggctctttgtattggaatctatgttctgagacatccgaggttcagatacaaactaccatctgttcctctcaatttcttcaggaggcttcctgcaagaactgattgcatgctctgatgagctcaaagaaaaactgctacctctctctctctccctcggatcttccttctcatcttgaagaaacttcctctagaattgttaatttgttttttgttgaagtgtcatgtcatgaatttttatcctggtggttactatcatgtctcatttcgtttataacattattaagacttttgtttgaaagtagtaaagaagtatcttgtgtggttttgatgttctcgtctctggttagtaagtcataatctctgcctctctggtttttgtgtttatcactggagctttaggagtttggtgccactggttggttgctggtgagattagaggttgacaatggtttggtcttttggtcaaatacaag

SEQ ID NO: 4622 - DNA, 3210 bp, Eucalyptus grandis
gagagagagaaggagagaggaagggggagacacagagagagagagagagagagagactcctgtgtgttattcctgcagatccctcagatcccacctccacccacaccaaaagcaaaagagcccctctatcccttcaaagctcttcactttctctctctagcattccgtttttatctccctaaagggagaagaaaaagagaaaaaaaaaaaaaaaggagaggagaagaagaagaagaagaagaagaagtagaagacgggaaccacttccattgcagcagttcctgcgttgcgtaactcggtccgggagtctgcggctctccgtctgcggcttctgggtttttgggagcttttcgaattcgaactcagtcattgctcactgactgccatctgggtaccttataagttcacgctgtccggctgactgtgttttctcccatttgagccaaaatgatgcacaggcctcctcatcttgaggacttcgctctgaaggagaccaagccccatctcggtggagggaaggtctccggcgacaagctcacgagcacctatgacctcgttgagcaaatgcagtacctctatgtccgcgttgttaaggccaaggagttgcctgcgaaagatgtcaccgggagtttggatccttatgttgaagtcaagcttgggaactacaagggcacgacccggcactttgagaagaaatcaaatcctgagtggaatcaggttttcgctttctcaaaggatcggcttcaggcctcgatgctggagatcattgtcaaggataaggatctcgcgaaagatgatttcgtgggtcgagttgtgtttgacttgaacgaggtcccgaagcgggttccgccggatagtcctctagcgccgcagtggtacaggctggaggacagaaagggggataaggtgaggggagaggtaatgttggctgtttggatgggcactcaagctgatgaagcgttcccagaagcgtggcattctgatgcagctacagttagcgggaccgatgcccttgcgaatatccgttcaaaggtatatctttctcctaagctttggtatttgagggtcaatgttatcgaagctcaggatctccagcctagtgacaagggtcgatacccggaggtttatgtcaaggctaagcttggaaatcaggttttgagaactagagtttctcagagcaggagtattaacccattgtggaatgaggatttgatgtttgttgcggccgaaccattcgaggaacctctgattttgagtgtggaagatcgagttgctcccaacaaggatgaggtgttgggacactgtggaatcccgctgcagtatgtggaccggagattggatcacaaacctgtgaacacaaggtggcataatctcgagaggtatatcattgtagagggagagcagaaaaagaaagacactaagttcgcaagcaggatccacctgaggatatgcttggagggtggttatcatgttttggatgagtcgacgcattacagtagtgatcttcgacccactgcgaaacagctgtggaagtcgagcattgggatattggagctaggaattctgagtgctcaggggctgttgccgatgaagaccaaagatggacggggaacgactgatgcttattgtgtggcaaaatacgggcagaagtgggtcaggacgaggaccatcatagacagctttatgcctaggtggaatgagcaatacacttgggaagtttttgatccttgcactgtcatcacaattggcgtatttgataactgccatttgcatggaggggataagaatgggcctgcaagggattcgaagatcggcaaggtgaggattcgtctctctacccttgagactgatagagtctatacccattcgtatccgctccttgttctgcacccaaatggagtgaagaagatgggcgaaatccatctagccgtgaggttcacttgctcttctttgctcaacatgatgcacatgtattcacacccactgttgcccaaaatgcactatattcatccattaactgtgagtcagctagatagcttgaggcaccaggccactctgattgtgtcaatgaggctgagccgggcggagccgccactgaggaaggaggttgtggaatacatgcttgatgtgggttcacacatgtggagcatgaggcgaagcaaggccaactttttcagaatcatgggggtcttgagcggtctaattgctgtgggaaaatggtttgatcagatatgccattggaaaaaccccataacaaccgtgctgattcacatcctgttcatcatactggttatatatcctgagctcatcctgcccacgattttcctctatcttttcatgattggagtgtggtactacagatggaggccgaggcatccacctcacatggacacccgcctctcgcatgcagattctgcacatcctgatgagcttgatgaagaatttgacactttccccacttcccgaccaactgacattgtgaggatgagatatgatcgcctgaggagcattgctgggaggatccagacagtcgttggggacttggctactcagggggagaggcttcaatccttgctcagctggcgcgacccaagggcgactgctctgtttgtcatattctgtttggtcgctgccattgttctgtatgtcactcctttccaagtcgtggcactcctcacaggattctacgtgttgaggcacccgaggttccggcacaagcttccttccgtgccactcaacttcttcaggaggctaccggcaagaaccgactgtatgttgtgaggatgtctctgggtggccgaccttcttgtgatgcggcaggaggagtttcgacttgcgggttaaagctttcttgctttccttctttggcagctgaatgtggtaatgtcataaatgggtgaccttctcctgaaggtggttagattttgcggatttttctttctaaatttatgttattttcatggaaagaaccgactgtcccgttgatagatttcatgttctctcgtctgtaatttagtaggttttcctggttgttaaatctcttagatcgttttggttcgaaatctcttccattttggtacaggaggccccactgacccaagtcccaaacgcatgttatgttaaagataaaggtcggggtggcctgacatgaactgatgaatcccgttgacctgaaacctcaaattctccgaaacgtttgtgaccctcgca

SEQ ID NO: 4623 - DNA, 2579 bp, Flaveria ramosissima
tgatgcacagacctcctcctgatgatttctccctcaaggagacgaaaccgcatctgggcggtgggaaaattacaggggataagctcaccagcacgtatgacctcgtggaacaaatgcagtacttgtatgtccgtgtggtgaaagcaagagatttaccgtctaaagatgttactggtagttgtgacccgtatgttgaggttcggatggggaactataagggaacaactcgtcattttgagaagaaaacaaaccctgaatggaaccaagtgtttgctttttctagagacaggatccagtcgactatgcttgaggtctctgttaaggataaggatatgatgaaagatgatttcatgggttgggtgttatttgatcttactgaggttccaaagagggtcccgccggatagtcctctagctcctcaatggtatagattggaagataggaaagggatgaagctgaaaggagaggtaatgttggccgtgtggtggggtactcaagcggatgaagcgtttcctgaagcatggcattcagatgctgcaactgttggtggggctgatgctcttgctaatatccgttcaaaagtgtatctttctcctaagctttggtatctcagagttaatgtgattgaagcacaggatttgatacctagtgatcggacgaggtttcctgaagtttttgtgaaggctgttctcgggcatcaagctttaaggactagagtatctatgaacaagtctattaatcctatgtggaatgaagacttgatgtttgtagctgcagaaccatttgaagagcacttggttttgagtgtggaagataggattgcacctaataaagacgaggttcttggaatgtgcgcgattcccttacagtatgtggatcggaggttggatcataaagctataaactcaaggtggtttaatcttgaaaaacatgtgatagttgatggtgaaaagaagaaggaagtgaaatttgctagcaggattcatatgaggatctgtttagaaggcggttatcatgttcttgatgaatctactcactacagtagcgatcttagaccaacagctaaacagttgtggaagagcagcattggtgttcttgaagtggggatcttgagtgctcatgggttatcaccaatgaagacaaaagatggaagggcaacaactgatgcatattgtgtggctaagtatgggacaaagtgggtcagaacaagaacaataatagacagttttatgccaaaatggaacgagcaatatacttgggaagtttttgatccatgcactgttataaccattggtgtgtttgataactgccatctgcaaggtggggataagggtaacggggcaagggattcaagaattggtaaggttaggattcgtctttcaacccttgaaactgatcgtgtgtacacccatgcgtatcctcttttagttttacatccatctggggtgaaaaagatgggtgagattcagttagcagtgaggtttacatgttcatcattgttaaacatgatgcacatgtactcacaaccactattgccaaaaatgcactacattcatccgctaactgtctcccagcttgacagcttgaggcaccaggccactcagattgtgtctatgaggcttagccgggctgagccacctttaaggaaagagatagtggagtatatgctggatgtggggtcacacatgtggagcatgagacgaagtaaagctaatttcttcagaatcatgggtgtttttggtggtttgattgctgttggaaaatggtttgatcagatatgtaattggaagaatccgatcactactgttctaattcacattcttttcttgatattggttttgtatccagagcttattctgcccactatctttctctatcttttcctaattggagtttggtactaccgatggagaccaaagaacccaccccacatggacactcgcctctcgtgtgcagataatgcacaccctgatgagcttgatgaggaattcgacacatttccaacttcccgccctgctgacatcatcagaatgagatatgaccgcttaaggagtatttcaggaaggattcaaacagtggttggtgatttagcaacacaaggagaaagacttcaatctttactcagctggagagacccgagagctacagcactgtttgtcatattctgtttaattgctgctattgttttgtatgtcacgccctttcaagtcgtggcccttctcacaggcttctacgtgctacgacacccaaggttccgccacaagctgccatctgtcccgctcaacttctttagaagactgcccgcgagaactgactgcatgctttgagaaaaccgatacctgtgcgacgttggcttcatgtaccaaatcatcctggtaagatgcatacaatttttctggaacaatgttttgtacatcttgtggttctgcaacccttttacacagggtcttcctcaacctgaaacttgaatgtgtcaccttttggtttgtagttttttaggttatgatcttcatttgaatctatcaatagttgttattagtagcaacggtatcttgtacttgcagtagacttccatctga

SEQ ID NO: 4624 - DNA, 3493 bp, Populus trichocarpa
agagacaaagcaacagagagcccgaaaagagagagagggcaaaagtgtgagagagagagagagagtatgttctgtgtgtattctcacagattcattaaagagaaaaacaaacactcctgctaaaattaaaactaaaataaaataaaacaaaaggcaaaacactattgcgactcctcccctctctctagactctagagttatcttctcttctcttctcatctcttctgttcccttctcttctcttcttcattcttatctcctccctgtttatgtagatgaaggagcgctagggttctttttctagatcttcttcctcatgtttttcgagggttttcgaattgaaggactttgaattcaaagcctgttttgattttggttccttagaagacaagctcttcaacttcaacttgaaaaggactattggggttgttttttcgggtgtctctcgtttgagccaacatgatgcagaagccaccgcaggatgattttctattgaaagagaccaatccccatcttggagggggaaagatcactggcgacaagcttacgagcacctatgatcttgtggagcagatgcagtatctttatgtccgggtcgttaaggccaaggacttgcctgcgaaggatgttacaggtagttgtgatccttacgtggaagttaaacttggaaactataagggcactactcggcattttgagaagaagacgaacccggagtggaaccaggtgtttgcattttcaaaggagcggattcaggcgtcgatgcttgaggttactgttaaggataaggatcttgtgaaggatgatttcattggccgggttttatttgatatgaatgagataccaaagcgtgttcctcctgatagtcctctggcaccacagtggtatcggttggaggataggaaaggagataaatttaagggggaattgatgctagcggtatggatgggaacacaggcagatgaagcttttccagaagcatggcattcagatgctgctactgttagtggaacagatagtcttgctaatattcggtccaaggtatatctctccccaaaattatggtatttgagggtcaatgtgattgaagcacaggacctggtaccgagtgatcaaggcaggtatccagaagtatatgttaaagctatcctgggaaatcaagtcctgagaacaagagtttctcctagcaggagtattaatcctatgtggaatgaggaccttatgtttgtggcatcagaaccttttgaggagcccttgattttgagtgtggaagatagaattgcgcccaacaaggatgaagtgttggggagatgtgcaattccaatgcatcatgtagacagaaggttggaccataaccctgtgaacactaggtggtttaatctggagaaacatgttattgtagaaggggaaaagaagaaagaaataaagtttgccagcaggattcacatgaggatctgcttggagggtggttatcatgttctggatgaatcaacacactatagtagtgatcttcgtccgacagctaaacagctgtggaagcacagcataggggtacttgaattgggtattctcaatgctcagggattgatgcccatgaaaccaaaggatggtcggggaacaactgatgcatactgtgtggcaaaatatggacagaagtgggttcgaaccagaaccatcattgacagtttcacgcccaagtggaacgagcaatatacttgggaggttttcgatccctgtactgtcataacaattggggtctttgataattgtcatttgcatggaggggacaagcccggtgggtcaagggattcaaggatcggaaaggtgcgaatccgtctttccacacttgaaactgacagggtttacacacactcctatccactgttggtcctgcatcgtaatggtgtcaaaaagatgggagaaattcatttggcggttcgttttacatgctcatcattgctcaatatgatgcacatgtactcacatcctttgctgccaaagatgcactatatccatccactgactgtcagccagctagatagcttgaggcatcaggccactgtgattgtgtcagtgaggctgagccggtcagagccaccattaagaaaggagattgttgaatatatgctggatgtggggtctcacatgtggagtatgagaagaagtaaagccaactttttcagaatcatgaacgttttcggtgggctaattgctctagggaaatggtttgatcagatatgcaattggaaaaacccaatcaccactgtgctgattcacattttgtttataatcctagtcctctatccagaacttatcttgcccacaatcttcctgtatctcttcctgattggtgtctggcattatagacggaggtcaaggcatcctcctcacatggacactcgtctctctcatgcggagtctgctcatcccgatgaattggatgaggaatttgacacgttcccaacttctcagtctgctgatattgtaaggatgagatatgatcgtttgagaagtattgcagggaggattcagactgttgttggtgatttagctactcaaggggagaggctgcaatctttactgagctggcgagacccaagggccacagctctgtttgtgctcttttgtctgattgctgccattgttctatatattactcctttccaagttgtggcagttctcattggattgtatgtgctgagacatcccaggttccgccacaaacttccttcagttccactcaatttcttccggcggttgccagcaagaaccgattccatgctgtgagcaaagccagtttgatctgcaattgcattttgcatctgatcttgtcaagtcagagaagaagatggtggttctggcacgtgtaaccttcctctgaaggtagtagattttgtggatttgcgggttatttaaagatattttaataggatttctgtttcaactttcgagctttatggtaatcaatccatcttcatttgtaattttgtaggttttggttggaatttaacctttggtgaaccttctctgtgcttcactacatctagtagatattgttgtccactgggatttctgatctcaaccttgttatatccctgcaatggaatggcttctttttccttggtcattttttactaaaatacagcctatttcacctgtcctgctcttttcttttttctatcaaaaaagaattgcccgtttagattatattaatgagcaccagcttgttcttttctatattgtattgttctcttgcttgtttggtattctatcattcccaggacatcctgtatggccagcgagaagaatttatatccacttcctgccttcttgtctagcttacagcagactctgttcatgttaacctgtgtttattttacttgataaattattcaaagtcacggggaaggacaaagattgcctccctaattattgggtatttctattgaacaaaagcatattataaatgctattactgagcaaagactagatc

SEQ ID NO: 4625 - DNA, 2598 bp, Solanum phureja
ttgttgcatcaacctcaaaaatgcagaggccccatcaagaagatttctcactcaaggagaccaaaccccaccttggtggagggaagatcactggtgataagctcactagcacatatgaccttgttgagcaaatgcagtatctttatgtccgggttgtgaaagctaaggatttacctgcgaaagatgttacaggtagtcttgatccgtatgttgaggttaagcttgggaattataagggtacgactcgtcattttgagaagaagtctaatcctgagtggagtcaggtgtttgctttctcaaaagataggattcaggcttctgtacttgaagtgactgtgaaagataaggattttgttaaggatgactttgtgggtcgtgttctgtttgatttgaatgatatcccaaaaagggttcctccagacagtcctctcgctccacagtggtatagattggaggagaggaatggtaacaaagtcaaaggagagttgatgttggctgtttggatgggaaatcaagctgatgaagcctttcctgaagcttggcattcagatgctgcagctgttagtggggctgatggccttgcaaatataaggtctaaggtgtacctctcgccaaaattgtggtacctaagagttaacgtgatcgaggctcaagacttgattccaaatgacaaaagcaggtttccagaagtgtatgtcaaggctatccttggaaatcaagcattgaggaccagagtttccatgagcaagactatcaatcccttgtggaatgaggatctgatgtttgtagcagcggaaccatttgaggagccattgattttgagtgtggaagatagagttgcaccaaacaaggatgaagtccttgggaggtgtgctattcctttgcagtatgtggataggaggttggaccatagacctgtgaacacgaggtggtttaatcttgagaagcatgttattgttgagggagaaaagaaggaaatcaagtttgctagccggattcacatgagagtatgtttggaaggaggctaccatgttctggatgagtcaacccattacagtagtgatcttaggccaactgcaaaacagctgtggaaatctagcatcggtgttcttgaagtaggtgttctgagcgctcagggcctgtcaccaatgaaaacgaaggatgggcgggcaacgacagatgcctattgtgtagcaaagtatgggcagaagtgggtgcggacaaggacaattatagatagctttgctcccagatggaacgagcaatacacctgggaagtatttgatccttgcactgttataactattggtgtatttgataattgccatctgcaaggaggagataaatctggaggggcaagggactcaaggattggaaaggtcaggatccgtctttcgactcttgaaactgatcgtgtttacacacattcatacccactgctggtcttgcatcctactggggtgaagaagatgggtgaaattcatttggctgtgagatttacttgctcgtcattggtgaatatgatgcatatgtactcacagccattgttacctaaaatgcactatcttcatccgttaactgttactcagctggacaacttgaggcaccaagccactcagattgtctccttgaggctgagtcgtgctgagccacctttgaggaaagagatagtagagtatatgttggatgttacttctcatatgtggagcatgaggagaagcaaggcaaactttttcaggattatgggtgttttaggtgtggtaatatctgtcggaaaatggtttgatcaaatatgcaattggaaaaatcccattacgactgttctgatccatatcctgttcttgatactggttctttatccagagcttattctacctaccattttcctctacctcttcttgatcggaatttggtactatagatggaggccaagacatcctcctcacatggatactcgactttcttgtgctgatactgctcatcccgatgagctggatgaggaatttgatactttccctacttcacgttctcctgatattatcaggatgaggtatgaccgcataagaagtattgcagggaggattcagaccgtggttggcgacttggctactcaaggagagaggctgcagtctttgctgagctggagggaccctagagcaacagcattgttcgtgattttctgcttggctgctgctgttgttctctatgtcactccattccaagccgtaggtctcttgacaggattttatgtattaagacatccaaggttccgctacaagcttccatctgtgccgcttaacttcttcagaaggttgcctgctagaacagactgcatgctatgagccatgccttcaacaactatcatctctatcctaccttatgttttttccattgaatcgtcgaaaatgatgtagaaattgtggggctctcctagtattttgcataagatcctggtgaaactgttaggtctagtgagtttgctttctatttgttctatgtttttcaaaaaatttggctgctgttgcaaatctatgtatgtaatcatgtagcttgcaagttattttattttgaacaagccccaatgctcaattcaaaagt

SEQ ID NO: 4626 - DNA, 2836 bp, Tripterygium wilfordii
ggtttaaacccgtaacgtttaattaattaagttaacggtcttatttgtaattaattcttctcttgtattttcttgggtaccttttgtaattctaaactctagtttccttattctgtaaggtgcaaccgttcaacttcaagcatttgggtgttagtcctttgaacccagaagatgcagaggcctccaccagaagattttctcttgaaggagaccaaacctcatctaggaggtggaaaggtcacaggcgacaagctcaccggcacatatgacctcgttgagcagatgcagtatctctatgtcagagttgtaaaagctaaggacctaccggcaaaagatgtcacaggtagtcttgatccctatgtcgaagttaagctgggaaactataagggtaccactcggcattttgagaagaaaacaaatcctgaatggaaccaggtttttgcattctccaaagatcggatgcaagcctccacgcttgaggttagtgtcaaggacaaggatgttgtaaaggatgactttgttggttgggttttgtttgacttgaatgagattccgaagcgggtacctccagatagtccattggcacctcagtggtatagattggaggacaagaaaagggataagggtagaggagaactgatgttggctgtctggatgggcactcaggctgatgaggcatttccagaagcatggcattcagatgctgctactgttcgcggaactgatggtttggcaaatatgcgatcaaaggtgtatctctctcctaagctgtggtatttgagggttaatgtcattgaagctcaagacctgatgccaagtgataagggtaggtatccagacgtttatgtgaaggctatcttgggaaatcaggctttgagaactaaaagttctcaaagcaggagtatcaatcccatgtggaatgaagatttgatgtttgtagcagcagaaccatttgaggagcccttgattttgagcgtggaagatagagtggcacctaacaaagatgaagtacttgggaggtgtgcgattcctttgcagtatgttgacaggagattggatcataagcctgtgaataccaggtgggtcaatcttgaaaaacatgttgttctggaaggtgaaaagaagaaggaaattaagtttgccagcaggatccacttgagaatttgtttggaaggtggttatcatgttctggatgaatcaacacattacagcagcgatcttcgacccacagcaaaacagctatggaaacacagcataggtgttctagaattgggtgttcttaatgctcagggtttgatgcctatgaagaaaacagatggtcggggaacaacggatgcatattgtgtggccaaatatgggcagaagtgggttcgaacaagaaccataattgatagcttcacgcccaagtggaatgagcaatatacatgggaagtttttgacccttgtactgtcataaccattggggtttttgataattgtcatctacaaggaggtgataaggctggagggccaagagattcgaggattgggaaggtaagaattcgcctttcaaccctggaaacagatcgagtttacacccactcgtatccacttctagttctacacccaaatggggtgaggaagatgggtgaaattcatttagcggtgaggtttacttgctcctcattactcaacatgatgcacatgtactcgatgcctctgctgccaaagatgcattatattcacccgctaactgtcagccaacttgatagcttaaggcaccaggccactcagattgtgtcagtgaggctgagcagggcggagccaccattaagaagagaggtggttgagtatatgctggatgtgggttctcatatgtggagcatgagaagaagcaaagctaatttcttcagaatcatgaacgttttaggtggtataattgctgtaggaaaatggttcgatcagatttgcaattggaaaaatccaatcacaacagtactgattcacatcttgtttatcatactggtcctctaccctgagcttatcctacctacaattttcctttaccttttcttgattggagtttggtattacagatggaggccaaggcatcctcctcatatggacacccgcctctcccatgctgagtctgcacatcctgatgaactagatgaagaatttgacacctttccaacttcccgacctgctgatattgttaggatgagatatgatcgattgagaagtattgctgggaggattcagactgtggttggtgatttggctacccaaggggagaggctgcagtctttgctgagctggcgagacccaagggccacagccctctttgtgattttctgtttgattgctgcaattgttctgtatgttacgcccttccaggttgtggcactcctcgctggattttatgttttgaggcacccaaggtttcgtcataagcttccatcggtgcccctcaatttcttcaggcggttgccggcaagaactgattgcatgctatgagctaaaccagtttccacatctgtcatagccttcaaatggcaacttgtttttccagtcttgtttttaagttaatggagaagatgcagataccggtggagcttctcagatttctatggttcttggatctgtgtgtgactttagcttttttcccctaaagaaggtagtagatttttgtggattttcagtgaagttattactaagatttctgtttcaaacaagaccctatggtaatcaacctgtgtttgtttgtaattttgtaggtagtcgtcggaatttaagcttgtgctgaactctctgttgcttaattgcatttaagtatatattttctaatggggaatta

SEQ ID NO: 4627 - DNA, 3002 bp, Solanum lycopersicum
atctagacctcactataccattctccatcactttgatacccaaaagcaaccaaaccccttttgctttttctcctcaaaattccaatctttagaaccttatcagcaaaattcccatctttcactctcatctcacatgaacccttcaagggttaagcattcaggtgaaccagatctgaggttgtgaatgattttgggagtttttggggttgtccttcatgaggttctttttaaaccttaagttagaattagggtaaaacaaacttagattgtgttgtatatgaagtttcttgagtagtagtgtagttttgagttgtttctgagagatattacttaggacatttggcttaattgtggtggagaagtggaaaggtttgaaaatgcagagaccacctcaagaagatttttcattaaaggagaccaaaccccaccttggtggagggaaggttacgggtgataagcttactagcacctatgacttggttgagcaaatgcagtatctttatgttcgggtggttaaagcaaaggatttaccagggaaggatgttacgggtagtcttgatccttatgttgaggttaggctgggaaactatcggggtacaactcgtcatttcgagaagaaatcgaatcctgaatggaatcaggtgtttgctttttccaaggagcggattcaggcttctgtacttgaggtgaatgtgaaagataaggattttattaaggatgattttgttggtcgtgttatgtttgatttgaatgagatccctaaaagagttcccccggacagtcctcttgctccgcagtggtataggttggaggatagaagtggtaacaaagtgaaaggagagttgatgttggctgtttggatgggtactcaagctgatgaagcctttcctgaatcttggcattcggatgcggctactgttagtggtgctgatgctcttgcaaatataaggtctaaggtgtacctctcaccaaagctgtggtaccttagagttaatgtgattgaggctcaggacttgattcccagtgacagaagtaggtttccagaggtttacgtgaaggccatcctgggaaatcaggcattgagaaccagagtttccatgagcaagactattaatcccatgtggaatgaggatctgatgtttgtagcagcagaaccattcgaggagccattaattttgagtgtggaagatagagttactgcagcaaacaaggatgaagtacttggaagatgtgttattcctttgcagtatattgataggaggtttgaccacagacctattaacagtaggtggtataatcttgaaaagcacattattgttgagggagaaaagaagaaagaaatcaaatttgctagcaggattcacatgaggctttatttagaaggagggtaccatgtactggatgaatcaacacactacagcagtgatcttagaccaactgcaaagcagctgtggaagtccagtataggtgtcctagaattgggtattctgaatgctcagggcctttcgccgatgaaaacaaaggataatcgggcaacgacagatgcctattgtgttgcgaaatatgggcagaagtgggtccgaacgaggaccattatagatagctttgctcccaagtggaacgagcaatacacttgggaagtatttgatccctgcactgtcataactattggtgtatttgataattgtcatctgcatggaggagataaacctggagggtctagggactcgaggattggaaaggtcagaatccgtctttcaactctcgaaacagatcgtgtttacacacattcttatccactgctggtcttgcatcctactggggtaaagaagatgggtgaaattcacttggcagtaagatttacttgctcatcgttaatgaatatgatgcatatgtactctcagccactgttacccaaaatgcactatattcatcctttaactgttactcagctggacagcttgaggcatcaggccactcagattgtctctatgaggctgagtcgtgctgagccacctttgaggaaagagatagtggagtatatgttagatgttggttctcacatgtggagtatgaggagaagcaaagctaatttttttaggattatgggtgttttaggtggattaatagctattggaagatggtttgatcaaatatgcaactggaaaaatcccatcacaactgttcttatccatatcttgttcttgatactggttctatatccggagcttattctgccaaccattttcctatatctcttcctaattggagtttggtactacagatggaggcctaggcatcctcctcacatggatactcgtctttcttgtgctgataatgctcatcctgatgaactggatgaggaatttgacactttccctacttcacgtcctcctgatattgttcgtatgaggtatgaccgtttgagaagcattgctggaaggattcagactgtggttggtgatttggctactcaaggggagaggctgcagtctttgttgagctggagagaccctagagcaaccgcgctgtttgtcattttctgcttgattgctgccattgtgctctatgtgacacccttccaagttgtggcactcttgtcaggattttatgtactgagacatccaaggttccgtcacaagctaccatctgcgccacttaatttcttcagaagactgcctgcgagaacagactgtatgctatgagaaccatacctttgccttatgttatcgttatcatcctatgtgcttttctctctgtgtctcgaattgatgtaaatgagttgggctctttttgtcctgcacctactggtgaatgttaggtcctgcttttgtgtgtaagatctccttgaactgtttagatctagtagatttactgtttattcattctaagtttgttggaagtttgctgctttgatgcaaatctatatttgttgtcttgtggatgttttcattttgaaaaacatgctccatgattaattcattcaaaatatctatttttat

SEQ ID NO: 4628 - DNA, 2779 bp, Fagus grandifolia
aggttgattgtactgttcatggtttgtgactctgtttgtttcaagcatttagatctgacggtctgaggacgctgtttggtttctctgacaacagtttcataaggttctttccattccatttggtgtctctgctttgaaaccaaaagatgcagaggcctccaccacaagaagagtttttgttgaaggagaccaatccccatcttggtgggggaaaggtcaccggagacaaacacacgagcacctatgacctcgttgagcagatgcagtatctctatgtccgtgttgtcaaggccaaggaattgcccgcaaaagatgtcacgggtagttgtgacccttatgttgaagttaagctcggaaactacaagggtgcgactcggcattttgagaagaagtcgaatcctgagtggaaccaggtgtttgctttctcgaaagatcggcttcaggcttcagtgcttgaggttactgtgaaggataaggatcttgtcaaggatgatttcataggtcgggttctgtttgatctgaatgaggttccgaaacgggttcccccagacagtccattggcgccacagtggtataggttggaggataggaagggagacaagcatcataataggggagagctgatgttggctgtttgagggtactcaagctgatgaagcgtttcctgaagcatggaattcagattcagctggagttactagtgatggtcttgccagtattcgttcaaaggtatacctctctcctaagctttggtatttgagggtcaatgtaattgaagctcaggacttgcaaccgaccgataagggtaggttccctgatgtgtttgtgaaggctatcctgggaaatcaggctctaagaaccagaatttctcctagcaggaatattaatcctttgtggaatgaggatttaatgtttgtagcagcggaaccatttgaggaccccttgattttaagtgtagaagacagggttgcacctaacaaggaagaagttcttgggaggtgtgcaattcacttgcagcatgttgataggaggttggatcacaaaggtgtgaacactagatggtttaatcttgagagacatgttcttgtagaaggggagaagaagaaggaagtcaagtttgccagcaggattcatatgaggatctgcctggaaggtggttatcatgtcctggacgaatcaacacactatagcagcgaccttcgaccaacagcaaaaccattgtggaagaccagcattggagtactggaattggggattttaaatgctcaggggcttatgccgatgaagacaaaagatgggcgtggaacgacagacgcttattgtgtggcaaaatatggtcagaaatgggttcgaacaaggacaattatggatagctttatacccaagtggaatgagcaatatacttgggaggtgtttgatccttgtactgtcattacaattggggtctttgataactgtcatttgcatggaggtgacaagtctgcagggacaagagatcaaagaattgggaaggtaaggattcgtctttccacccttgaaactgatcgggtttacacacactcgtatccacttctggttctacaccccaatggggtgaaaaagatgggtgaaattcatttggctgtgaggttcacttgctcctctttgcttaatatgatgcacatgtactcacagccacttttgccaaaaatgcactatattcatccgttaactgttagccagcttgacagcttgaggcaccaggcaactcaaattgtatcaatgaggttgagccgggctgagccaccactgaggaaagaggtggtggagtatatgttggatgtgggctcccacatgtggagtatgagaaggagtaaagcaaattttttcaggattatgggagttttgggtgggttaattgctgtaggaaaatggtttgatcagatttgccactggaaaaaccccatcacaaccgtattgattcacatactgtttgtaatactggtcatgtaccctgagctcatcttacccacaattttcctgtaccttttcttgattggggtctggtattatagatggaggccaaggcaccctcctcacatggacactcgcctttctcatgctgattctgcacatcctgatgaacttgatgaggaatttgatacattcccaacttcccggccttctgacattataaggatgagatatgatcggttaagaagtattgctgggaggattcaaacagtggttggtgacttggctactcaaggggagaggctgcaatccttgctgagctggcgagacccaagagcaacagctctgtttgtgattttctgtctgattgctgctattgttctctatgttacaccattccaagttgtggcccttctcacgggattttatgtgttgagacatccaaggttccgtcataagcttccttcggtaccattgaatttcttcaggaggttgccagcaagaacagattgcatgctatgagcaatccagttttatctgcaatttcttttgaacttcccctcgttcatgttaagttagtggagaagatgcagaaacaaatggagctgttcaatgtttggcggctgataattgggttctgtgtgtaaaccttcctgtgaaggtagtagattttgtggatttgcagcttaattaattccatttgatactatttctatttgaagcttggctttatggtaatcagtgattgttcatctgtatttttgtaggttgtgaattatcctttcctgaaccatctttatgcttaatcatatcttctagatttgct

SEQ ID NO: 4629 - DNA, 2681 bp, Cajanus cajan
ttagtttttattttgaattgggtttctcgttctttgaactgaaggaagaagatgcagaggcctccacctgaagattttctgttgaaggagaccaagccccacctcggaggggggaaggtttctggtgataaacttacgagtacctatgatcttgttgagcaaatgcagtacctctatgtgagggttgtgaaggcgaaggagttgcctgcgaaggatgttactgggagctgtgatccttatgtggaagtcaagcttgggaactacaagggcaccacccggcactttgagaagaaaaccaaccctgagtggaaccaggttttcgccttctcgaaggaccggcttcaggcctctgtgctggaggttactgtgaaagacaaggatgttgtgaaggatgacttcattggccgggtgtggtttgacctgaatgagatccccaaaagggtgcctccggatagccctctggcgccgcagtggtacagattggaggataggaagggtgataaggttaagggagagttgatgctggctgtttggatgggtacacaggctgatgaagcttttccggaagcttggcattcggatgctgccacggttggtgggagtgatgctcttgctaacattagatccaaagtttatctgtctcctaagctttggtatttgagggttaatgtgattgaggcacaggacttgcagccaactgataagggtagataccctgaggtttttgtgaaggctattcttggaaatcaggcgttgaggactagaacctctcatagtaggagtattaatccaatgtggaatgaggatttgatgtttgtggccgcggagcagtttgaggagccgttgattttgagtgtggaggatagggttgcccctaacaaggatgaagtgttggggaggtgtgcgattcctttgcagcttgtggaaaggagactagattataaacctgtgaacactaggtggttcaatctggagaggcatattgtggtggaaggggagaagaagaaggataccaaatttgcaagcaggattcacttgagggtttgtctagaaggtggctatcacgttttagatgaatcaactcactacagcagtgatcttcgcccaaccgcgaaacagctgtggaagtctggcattggtattcttgaagtgggaatattgaatgctcaaggtttgatgccgatgaaaacaaaagatgggaggggaaccacagatgcgtactgtgtagcaaaatatgggcagaagtgggtcaggacgaggacaatcatcgatagctttgcaccgaggtggaatgagcaatatacttgggaggtttttgatccttgtactgtcattacaattggtgtgtttgataactgtcatttgcatggtggtgacaaggctggaggggcaaaagatttaaagatcggaaaggtaaggattcgtctttctacccttgagactgatcgggtctatacacattcctatccacttcttgtactttacccgaatggggtgaagaagatgggtgagattcacttggctgtgaggttcacctgttcatccttgctcaatatgatgcacatgtattcacagcccttgttgccaaaaatgcactatatacacccattgactgttacccagcttgacagtttgaggcatcaagctactcagattgtttcaatgagactgagccgtgccgagccgccactgagaaaagaggtagtggaatatatgctggatgtaggttcccacatgtggagtatgagaagaagcaaagctaacttcttcaggattatggcggttttgagtggcctaattgctgtaggaagatggtttgatcagatttgcaattggaaaagtccaatcacaacaattctgatccatatcttgtttataatactggttatgtatccagagcttatcttacccacaattttcctttacctcttcttgattggaatttggtactatagatggaggccaaggcaccctcctcacatggacactcgcctctcacacgcagattcggcgcaccctgatgaacttgatgaagaattcgacacattcccgacctcccgaccaaacgacattgtgaggatgagatatgatcgacttaggagcattgctgggaggattcaaactgtagttggggacttggccactcaaggtgaaaggcttcaatccttgctgagctggcgagatccgagagcaacatcattgtttgtgattttctgtctggttgctgccattgtactgtatgtgactccatttcaagttgtggcccttctgtctggaatttatgtgttgagacatccgaggtttcgccataagctgccgtcggtgccgctgaatttcttcaggaggctgcctgcaagaactgattgcatgctttgagtccaggacagtgcagaatggagcttgctgaagaaggcacagtagattttgttttctggtttgatgatggatgatgatgtccttctcctgaaggcagtagattttgtggatttattgttaattattctgtcacaggattttctgtatttacttttgaacttcatggtagtccttgttaattttgtaggtttgagttgaaattgacttcagcttaattactttcatgcctaatcagatgcagtagtgtttctcaatggggagttagtttgaattgtgatgccagtggtggtaatttctgattcccc

SEQ ID NO: 4630 - DNA, 2881 bp, Phaseolus coccineus
ttttttaggctcctcggaaccgttgtgcttttatttcttttaaagcacaactgttcctacgagtggaagtgtggaacattgaagatttgaaatagttgtgccacagcttcccttattatttggaaaaagggtattttggttctttgaagccagaagatgcagaggcctccacctgaagattttcttttgaaggagaccaagccccaccttggtgggggaaaagtctctggtgataaacttactagcacttatgaccttgttgagcaaatgcagtacctctatgtgagggttgtgaaggctaaggacttgcctgcaaaggatgtcactggcagttgtgacccttatactgaagtgaagttggggaactacaaaggcaccactcggcacttcgagaagaagagtaatcctgaatggaaccaggtttttgctttctctaaagaccgtattcaggcatccattctggaggtcactgtgaaggataaggatgttgtgagagatgatttcatcggtcgggtcttgttcgacctcaacgaggtcccaaagcgtgttccaccggatagtcctcttgccccgcagtggtatagattggaggataggaagggtgataaggcgaagggggagctaatgctggctgtttggatgggtacacaagctgatgaagcatttcccgaagcatggcactcggatgctgcaacggttagtgggactgatgctcttgccaacattagatcaaaggtgtatctgtctcctaagctttggtatttgagggttaatgtgatagaggctcaagacttgcagccgagtgacaagggtagataccctgaagtttttgtgaaggctactctgggaaatcagaccttgaggactagaatctctcaaagcagaactatcaatccaatgtggaatgaagatatgatgtttgtggctgctgaaccattcgaggagcctctgattttgagtgtggaagacagagttgcctctaacaaagaggaatcacttgggaggtgtgcaattcctttacaaatggtggaccggagactggatcacaaacctgtgaatactaagtggtataatattgaaaaacacgttgttattatggaaggagaaaagaagaaggaaatcaagttttcaagcaagattcatatgaggatctgtttggaaggtggttatcatgttttggatgaatcaactcactacagcagtgatcttcgcccaacagcgaaacagctgtggaagtccagtattggagttcttgaattggggatattgaatgctcagggtttgatgccaatgaaaacaaaagatggtaagggaacaacagatgcctattgtgtagcaaaatatgggcagaagtgggtgcggacaaggacaataattgatagctttgcgccccggtggaatgagcaatatacttgggaggtttttgatccttgcactgtcattacaattggtgtctttgataactgtcatttgcatggtggtgataagcctggaggggcaaaagattccaaaattgggaaggtaagaatccgtctttctacccttgagaccgaccgtgtctatacacattcctatcctcttctagttcttcatccaaatggggtgaagaaaatgggtgaaatccacttggctgtaaggtttacttgttcttctttgcttaatatgatgcacatgtattcactgcctttgttgcctaagatgcattatattcacccactaactgttagccagcttgacaatttgaggcatcaagctactcagattgtttcaatgagactgagtcgtgccgagccacccttgagaaaggagattgtggaatatatgctggatgtgggttcccacatgtggagcatgagaagaagcaaggccaactttttcaggatcatgggagttttgagtggactaattgctgtaggaaaatggtttgaccaaatctgtaattggaaaaatccaatcacaacagttctgatccatatcctgttcataatattggtcatgtaccctgagcttatcttacctacaatattcctttacctcttcttgattggagtttggtactatagatggaggccaagacaccctcctcacatggacactcgtctctcccatgcagattctgcacaccctgatgaacttgatgaagagtttgacacattcccaaccaccagacattcggacatcgtcaggatgagatacgaccggcttagaagcattgctgggaggatacagacagtggttggtgatttggccactcaaggggagagactgcagtctttgctcagctggagggatccaagagcaactgccctctttgtgattttctgtcttgttgctgccattgtactctatgtcactccattccaggttgtggcacttctctctggaatctatgtattgagacaccccaggttccgccacaagcttccttcagtgcctctgaatttcttcagaaggcttcctgcaagaactgattgcatgctttgagtcatggacagcgcacaaactacaaatggaacctgctttcctttcattgttcagcaccagattttgtggatttgcatttcattatgtcataggattttctgtttttgaacttcgtggtagtagtcctggttaaatttgtaattttgtaggctgtgagttgaaattaacttgtgttcaatcaacttggtgtttaatcagatgcagtaaagtttctgaaatgggagtttgaacctacccgctcaaatggctatagatattgaggtgaagtgattaatgatttatgttccccttatctcccctcctgtaattgatattgataaacaggaaaacacacctactactacttctttcgtttgtttattcatagagagaccttgttctgtgcttttctcagcat

SEQ ID NO: 4631 - DNA, 2764 bp, Nicotiana benthamiana
tcacattctggtggtggatataggggatttgttttagtgttaattttgggaacaagttatataaaaaatgcagagacccccacaagaagatttctcactcaaggagaccaaaccccaccttggtggagggaaggtcagtggtgataagctcactagcacatatgatcttgttgagcaaatgctatatctttatgtccgagtagtgaaagccagggatttacctggtaaggatgttactggtagtcttgatccttatgttgaggttaagctggggaactataagggtacgactcgtcattttgagaagaagtcgaatcctgagtggagtcaggtgtttgctttttcaaaggataggattcaggcttctgtacttgaagtgactgtgaaagataaggatgttgttaaggatgactttgtgggtcgtgttctgtttgatttgaatgatatacctaaaagggttcccccggatagtcctctcgctccgcagtggtataggttggaggagaggaatggtagtaaagtcaaaggagaattgatgttggctgtttggatgggaaatcaagctgatgaagcctttcctgaagcttggcattcagatgctgctgctgttagtggcgctgatggtcttgcaaatataaggtctaaggtatacctctcaccaaaattgtggtaccttagagttaatgtgattgaggctcaagacttgattccgagtgacaaaagcaggtttccagaagtttttgtcaaggccatccttgggaatcaagcgttgaggaccagagtttccatgagtaagaccattaatcccatgtggaacgaggatctgatgtttgtagcagctgaaccgtttgaggagccattgattttgagtgtggaagatagggttgcaccaaacaaagatgaggtcatcggaagatgtgctattcctttgcagtatgtggataggaggttggaccataaacctgtgaacactaggtggtttaatcttgagaagcatattattgtcgagggagaaaagaaggaaatcaagtttgctagccggattcacttgagagtatgtttggaaggaggctaccatgttctggatgagtcaacccattacagtagtgatcttaggccaactgcaaaacagctgtggaaatctaacatcggtgtccttgaagtaggtgttctgagcgctcagggcctatcaccaatgaaaacaaaggatggacgagcaacgacagatgcctattgtgtggccaaatatgggcagaagtgggtgcggacaaggacaattatcgatagctttgctcccaagtggaacgagcaatacacctgggaagtgtttgatccttgcactgttataactattggtgtatttgataattgccatctgcaaggaggagataaatccggaggggcaagggactcaaggattggaaaggtcaggatccgtctttcgactcttgaaactgatcgtgtctacacacattcatatccattgctggtcttgcatcctactggggtgaagaagatgggtgaaatacacttggctgtaagattcacttgctcatcgttggtgaatatgatgcatatgtactctcagccgttgttacccaaaatgcactatcttcatccattaactgttagtcagctggacaacttgaggcaccaagccactcagattgtctcgttgaggctgagtcgtgctgagccacctttgaggaaagagatagtagagtatatgttggatgttggttctcatatgtggagcatgaggagaagcaaggctaactttttcaggattatgggtgttctaggtgtggtaatttctgttggaaaatggtttgatcagatatgtaattggaaaaaccccattacgactgtcctaatccatatcttgttcttgatactgatactatatccggagcttattctacctaccattttcctctatctcttcctaattggtatttggtactacagatggaggccaaggcatcctcctcacatggacactcgcctttcttgtgctgatgctgctcatcctgatgagttggatgaggaatttgatactttccctacttcacgtcctcctgatattattaggatgaggtatgaccgcataagaagtattgcagggaggattcagactgtcgttggcgacttggctactcaaggggagaggctgcagtctttgctgagctggagggaccctagagcgacagcgctgtttgtgattttctgcttggttgctgccattgtgctctatgttacgccattccaagctgtggcactcttgactggattttatgtattaagacatcctaggttccggtataaacttccatctgtgccgcttaatttcttcagaaggttacctgctagaacagactgcatgctctgagctgtgcttttggcagctatcatctctatcctaccttatgtggttttccctcttgaatcgacgaaaatgatatagaaatttgtgaggctgtccttttccttttcctcttcacctagtggtgaaaattgtgtccttgtttttggatgaagatcttcatgagaaacttgctttctatttgttctaactttgtcaaaagttggctatctgatgcaaatttatgtctgtaatcatgtagcctgtaagttcttttgtagtacattaaacaagctccatgctcaattctaagtactccatattcaaatggaatttatttgttttttgttctttcattgacatggtcaggtttgcatattgctatccaaatgtgagttttcg

SEQ ID NO: 4632 - DNA, 2886 bp, Phaseolus coccineus
tttatgttttttaggctcctcggaaccgttgtgcttttatttcttttaaagcacaactgttcctacgagtggaagtgtggaacattgaagatttgaaatagttgtgccacagcttcccttattatttggaaaaagggtattttggttctttgaagccagaagatgcagaggcctccacctgaagattttcttttgaaggagaccaagccccaccttggtgggggaaaagtctctggtgataaacttactagcacttatgaccttgttgagcaaatgcagtacctctatgtgagggttgtgaaggctaaggacttgcctgcaaaggatgtcactggcagttgtgacccttatactgaagtgaagttggggaactacaaaggcaccactcggcacttcgagaagaagagtaatcctgaatggaaccaggtttttgctttctctaaagaccgtattcaggcatccattctggaggtcactgtgaaggataaggatgttgtgagagatgatttcatcggtcgggtcttgttcgacctcaacgaggtcccaaagcgtgttccaccggatagtcctcttgccccgcagtggtatagattggaggataggaagggtgataaggcgaagggggagctaatgctggctgtttggatgggtacacaagctgatgaagcatttcccgaagcatggcactcggatgctgcaacggttagtgggactgatgctcttgccaacattagatcaaaggtgtatctgtctcctaagctttggtatttgagggttaatgtgatagaggctcaagacttgcagccgagtgacaagggtagataccctgaagtttttgtgaaggctactctgggaaatcagaccttgaggactagaatctctcaaagcagaactatcaatccaatgtggaatgaagatatgatgtttgtggctgctgaaccattcgaggagcctctgattttgagtgtggaagacagagttgcctctaacaaagaggaatcacttgggaggtgtgcaattcctttacaaatggtggaccggagactggatcacaaacctgtgaatactaagtggtataatattgaaaaacacgttgttattatggaaggagaaaagaagaaggaaatcaagttttcaagcaagattcatatgaggatctgtttggaaggtggttatcatgttttggatgaatcaactcactacagcagtgatcttcgcccaacagcgaaacagctgtggaagtccagtattggagttcttgaattggggatattgaatgctcagggtttgatgccaatgaaaacaaaagatggtaagggaacaacagatgcctattgtgtagcaaaatatgggcagaagtgggtgcggacaaggacaataattgatagctttgcgccccggtggaatgagcaatatacttgggaggtttttgatccttgcactgtcattacaattggtgtctttgataactgtcatttgcatggtggtgataagcctggaggggcaaaagattccaaaattgggaaggtaagaatccgtctttctacccttgagaccgaccgtgtctatacacattcctatcctcttctagttcttcatccaaatggggtgaagaaaatgggtgaaatccacttggctgtaaggtttacttgttcttctttgcttaatatgatgcacatgtattcactgcctttgttgcctaagatgcattatattcacccactaactgttagccagcttgacaatttgaggcatcaagctactcagattgtttcaatgagactgagtcgtgccgagccacccttgagaaaggagattgtggaatatatgctggatgtgggttcccacatgtggagcatgagaagaagcaaggccaactttttcaggatcatgggagttttgagtggactaattgctgtaggaaaatggtttgaccaaatctgtaattggaaaaatccaatcacaacagttctgatccatatcctgttcataatattggtcatgtaccctgagcttatcttacctacaatattcctttacctcttcttgattggagtttggtactatagatggaggccaagacaccctcctcacatggacactcgtctctcccatgcagattctgcacaccctgatgaacttgatgaagagtttgacacattcccaaccaccagacattcggacatcgtcaggatgagatacgaccggcttagaagcattgctgggaggatacagacagtggttggtgatttggccactcaaggggagagactgcagtctttgctcagctggagggatccaagagcaactgccctctttgtgattttctgtcttgttgctgccattgtactctatgtcactccattccaggttgtggcacttctctctggaatctatgtattgagacaccccaggttccgccacaagcttccttcagtgcctctgaatttcttcagaaggcttcctgcaagaactgattgcatgctttgagtcatggacagcgcacaaactacaaatggaacctgctttcctttcattgttcagcaccagattttgtggatttgcatttcattatgtcataggattttctgtttttgaacttcgtggtagtagtcctggttaaatttgtaattttgtaggctgtgagttgaaattaacttgtgttcaatcaacttggtgtttaatcagatgcagtaaagtttctgaaatgggagtttgaacctacccgctcaaatggctatagatattgaggtgaagtgattaatgatttatgttccccttatctcccctcctgtaattgatattgataaacaggaaaacacacctactactacttctttcgtttgtttattcatagagagaccttgttctgtgcttttctcagca

SEQ ID NO: 4633 - DNA, 2339 bp, Cucumis sativus
atgatgcaaaagcctccaccagaggatttcttactgaaagagaccaatccccaccttggtggggggaaggtcgctggtgacaaactagcaagcacctatgaccttgtggagcaaatgtattacctctacgttcgggtcgtcaaagcgaaggatttgccagggaaagatgtcactggtagctgcgatccgtatgtggaggtcaagcttggaaactacaaaggtacgactcggcattttgaaaagaagtcgaatcctgaatggaatcaggtgtttgccttttcgaaggatcggattcaggcttcggtgcttgaggtgagtgtgaaggataaggattttgtgaaggatgatttcatggggagagttctttttgacttgaatgaggttccaagaagggtaccaccggacagtcctttggccccacaatggtatcggttggatgatcggaaaggggacaaggtgaaaggagagctgatgttggctgtttggatgggaacacaagcagatgaagcatttcctgaggcttggaattcggatgctgcaactgtaagtggagccgatgggcttgcgaatattcggtctaaagtgtatctttctcccaagctttggtatttgagggtgaatatcattgaagctcaagatctgcagccaaccgataaaggtcggtatccagaggtttttgtcaaggctatacttggaaatcaggcgttgaggactagaatatctcagtctagaactatcaacccaatgtggaatgaggatttgatgtttgtagcagctgaaccatttgaagagcctttgattttaagtgtggaagaccgagttgcgccgaacaaggatgaggtcttgggacggtgtgcaattcagctgcaatatatagataggagattggaccatagagctgtgaacacaagatggttcaatcttgagaaacatgttgttgttgttgaaggggagaagaagaaggagatcaagttttctagtaggattcatatgaggatatgtttggaaggtggctaccatgtcctggatgaatcaacacattatagtagtgatcttcgaccgactgcgaaacaactctggaagaacagcattggagttttagaattggggattctgaatgctcaggggttaatgccaatgaagacaaaagacggtcgtggaacgacagatgcatactgtgtggctaagtatgggcagaagtggattagaacgaggacaatcatcgacagcttcatacccaagtggaacgagcagtacacttgggaggtttttgatccctgtactgtcattacaattggagttttcgacaactgccatttgcatggtggagagaaggcaggagtatcaaaagatgctcggatagggaaggtaagaattcgtctttccacgctcgagacagatcgagtgtatactcattcatatcctctgctggttcttcacccaaatggggtgaagaaaatgggtgagattcatttggctgtgaggtttacatgctcttctttgttaaacatgctgcatatgtactcacatccactccttcccaaaatgcactatattcatccgttaacggtgagccagctcgatagccttcgccatcaggcaacacaaattgtctcaatgaggctgagccgtgctgagccaccactgcgaaaagaggttgtcgagtatatgcttgatgtaggctcccacatgtggagcatgagaagaagcaaggctaatttcttcagaatcatgggagtttttagtggcctgattgcagttggaaaatggtttgatcagatttgcaattggagaaaccccattacaactgttcttatacatatcttgttcataatccttgtcatgtaccctgagctcattcttcccacaattttcctctatctcttcctaattggagtttggcattatagatggaggccaaggcaccctcctcacatggacacccgtctctctcatgccgattcctctcaccccgatgaactcgatgaggagtttgacacttttccaacttctcgccctgctgacattgtgaggatgaggtacgatcggttgaggagcattgcggggagaatccaaactgttgttggggacctagcaacacaaggagaaaggctgcaatctctactcagttggcgcgacccgagagcgtcggcattgtttgtgatcttctgcttggtctctgccatagttctgtacgttacaccattccaagttgtggcacttctttctgggatttatgtgcttagacatccgaggtttcggtacaagctcccgtctgtgcctctcaacttcttccgaaggctgccggccagaacagactgtatgctatgatggattta

SEQ ID NO: 4634 - DNA, 2765 bp, Cajanus cajan
gctccttggaaccgttgtgttttttttatttctaaaaagcaccactgttcctactagtggaagtgtggaacattgaagatttgaaatagttgagcaacagcttccattatttggaatagggtcttttgattctttgaagccagaagatgcagaggcctccaccagaagattttttgttgaaggagaccaatccccaccttggagggggaaaggtctctggtgacaagcttactagcacttatgaccttgttgagcaaatgcagtacctctatgtgagggttgtgaaggctaaggacttacctgcgaaggatgtcactggcagttgtgacccttatgttgaagtcaagctggggaactacaaaggcaccactcggcacttcgagaagaagactaaccctgaatggagccaggtttttgctttctccaaagaccgcattcaggcttccatgctagaggttactgtgaaggataaggatgttgtgaaggatgacttcatcggtcgtgtctggtttgacctcaatgagatcccgaagcgtgttcctccggatagccctcttgcccctcagtggtataggctcgaggacagaaagggtgataaggtgaagggggagctaatgctggctgtttggatgggtacacaagctgatgaagcgtttcctgaagcgtggcactcagatgctgcaacggttagtgggactgatgctcttgcaaacattagatcgaaggtgtatctatctccaaagctttggtatttgagggttaatgtgattgaggcacaagacttgcagccaactgacaagggtagataccctgaagttttagtgaaggctagtctgggaaaccagaccatgaggactagaatctctcaaagcaggactatcaatccaatgtggaatgaggatttgatgtttgtggctgcagaaccatttgaggagcctctgattttgagtgtggaagacagagttgcccctaacaaagaggaatcactggggaggtgcgcaattcccttacagatggtggagcggagactggatcacaaacctgtgaatactaagtggtataacattgaaaaacatgttgttattatggaaggggaaaagaagaaggagttcaagttttctagcaagattcatatgaggatttgtctggaaggtggatatcacgttttggatgaatcaactcactacagcagtgatctccgcccaactgcaaaacagctgtggaagtcaggtattggagttcttgaattggggatattgagtgctcagggtttaatgccaatgaaaacaggggatgataaggggaaaacagatgcttattgtgtagcaaaatatgggcagaagtgggtgcggacaaggacaataattgatagctttgcacccaagtggaatgagcaatatacttgggaggtttttgatccttgcactgtcattacaatcggtgtatttgataactgtcatttgcatggtggtgataaggctggaggggcaaaggattccaaaattggaaaggtacgaatccgtctttccacccttgagactgaccgtgtctatacacattactatccacttctagttcttcatccgtctggggtgaagaaaatgggtgaaattcacttggctgtaaggtttacctgttcttccttgcttaatatgatgcacatgtattcactacctttgctacctaagatgcactatattcacccgctaactgtcagccagcttgacaatttgaggcatcaagctactcagattgtttcaatgagactgagtcgtgctgagccaccattaagaaaggagatagttgaatatatgctggatgtgggttcccacatgtggagtatgagaagaagcaaggccaactttttcagaattatgggagttttgagtggattaatttctgtaggaaaatggtttgaccagatttgtaactggaaaaaccccatcacaacggttctgatccatatcctgttcataatattggtcatgtaccctgagcttatcttacccacaatattcctttacctcttcttgattggagtttggtactatagatggaggccaaggcaccctcctcacatggacactcgtctatctcatgcagactctgcgcacccggatgaactcgatgaagagttcgacacattcccaaccaccaggccttcagacattgttaggatgcgatatgaccgacttaggagcattgctgggaggatacagactgtggttggtgatttggccactcaaggggagaggctgcagtctttgctcagctggagagatccaagagctactgccctctttgtgattttctgtctggttgctgccattgtactctatgtgactcccttccaagttgtggcccttctaaccggaatttatgtgttgagacaccccaggttccgccacaagcttccttcagtgcctctgaatttcttcaggaggctccctgcaagaactgattgcatgctctgagtcatggaaagtgcacaaactgcaaatggagcttgctttgctttcattgttcagcaccagattttgtggatttgcatttcattatgtcataggattttctgttttgaacttttcatggtagtcttggttaaatttgtaattttgtaggctgtgagttgaaattaacttatgatgcttaatcaacttcatgtttaattagatctagtaaagtttctcaatggaagtttgaacttaccacctcaaatggctattgatatataattgactttgaggttaggtgatttttgtttt

SEQ ID NO: 4635 - DNA, 2843 bp, Cajanus cajan
ttttctgttttttaggctccttggaaccgttgtgttttttttatttctaaaaagcaccactgttcctactagtggaagtgtggaacattgaagatttgaaatagttgagcaacagcttccattatttggaatagggtcttttgattctttgaagccagaagatgcagaggcctccaccagaagattttttgttgaaggagaccaatccccaccttggagggggaaaggtctctggtgacaagcttactagcacttatgaccttgttgagcaaatgcagtacctctatgtgagggttgtgaaggctaaggacttacctgcgaaggatgtcactggcagttgtgacccttatgttgaagtcaagctggggaactacaaaggcaccactcggcacttcgagaagaagactaaccctgaatggagccaggtttttgctttctccaaagaccgcattcaggcttccatgctagaggttactgtgaaggataaggatgttgtgaaggatgacttcatcggtcgtgtctggtttgacctcaatgagatcccgaagcgtgttcctccggatagccctcttgcccctcagtggtataggctcgaggacagaaagggtgataaggtgaagggggagctaatgctggctgtttggatgggtacacaagctgatgaagcgtttcctgaagcgtggcactcagatgctgcaacggttagtgggactgatgctcttgcaaacattagatcgaaggtgtatctatctccaaagctttggtatttgagggttaatgtgattgaggcacaagacttgcagccaactgacaagggtagataccctgaagttttagtgaaggctagtctgggaaaccagaccatgaggactagaatctctcaaagcaggactatcaatccaatgtggaatgaggatttgatgtttgtggctgcagaaccatttgaggagcctctgattttgagtgtggaagacagagttgcccctaacaaagaggaatcactggggaggtgcgcaattcccttacagatggtggagcggagactggatcacaaacctgtgaatactaagtggtataacattgaaaaacatgttgttattatggaaggggaaaagaagaaggagttcaagttttctagcaagattcatatgaggatttgtctggaaggtggatatcacgttttggatgaatcaactcactacagcagtgatctccgcccaactgcaaaacagctgtggaagtcaggtattggagttcttgaattggggatattgagtgctcagggtttaatgccaatgaaaacaggggatgataaggggaaaacagatgcttattgtgtagcaaaatatgggcagaagtgggtgcggacaaggacaataattgatagctttgcacccaagtggaatgagcaatatacttgggaggtttttgatccttgcactgtcattacaatcggtgtatttgataactgtcatttgcatggtggtgataaggctggaggggcaaaggattccaaaattggaaaggtacgaatccgtctttccacccttgagactgaccgtgtctatacacattactatccacttctagttcttcatccgtctggggtgaagaaaatgggtgaaattcacttggctgtaaggtttacctgttcttccttgcttaatatgatgcacatgtattcactacctttgctacctaagatgcactatattcacccgctaactgtcagccagcttgacaatttgaggcatcaagctactcagattgtttcaatgagactgagtcgtgctgagccaccattaagaaaggagatagttgaatatatgctggatgtgggttcccacatgtggagtatgagaagaagcaaggccaactttttcagaattatgggagttttgagtggattaatttctgtaggaaaatggtttgaccagatttgtaactggaaaaaccccatcacaacggttctgatccatatcctgttcataatattggtcatgtaccctgagcttatcttacccacaatattcctttacctcttcttgattggagtttggtactatagatggaggccaaggcaccctcctcacatggacactcgtctatctcatgcagactctgcgcacccggatgaactcgatgaagagttcgacacattcccaaccaccaggccttcagacattgttaggatgcgatatgaccgacttaggagcattgctgggaggatacagactgtggttggtgatttggccactcaaggggagaggctgcagtctttgctcagctggagagatccaagagctactgccctctttgtgattttctgtctggttgctgccattgtactctatgtgactcccttccaagttgtggcccttctaaccggaatttatgtgttgagacaccccaggttccgccacaagcttccttcagtgcctctgaatttcttcaggaggctccctgcaagaactgattgcatgctctgagtcatggaaagtgcacaaactgcaaatggagcttgctttgctttcattgttcagcaccagattttgtggatttgcatttcattatgtcataggattttctgttttgaacttttcatggtagtcttggttaaatttgtaattttgtaggctgtgagttgaaattaacttatgatgcttaatcaacttcatgtttaattagatctagtaaagtttctcaatggaagtttgaacttaccacctcaaatggctattgatatataattgactttgaggttaggtgatttttgtttttcctcctcctcttcccttcctataagatttttgaagatgctgattagtataaggtaaaacaaa

SEQ ID NO: 4636 - DNA, 2858 bp, Eutrema halophilum
attgggttgaaacaaacgacgaacaagagaggagtttctaacttatgaaggatggagattttcaaaacctgcgtaaatcatttctagaactgttcttctcatcggtggttttgtatagttttttttttgaagatctaagatctggtgatttgaagtatagaagtagctgaaacccatccgtatccataatctgtggtcttctcaagcttacaagatgcagagaccacctcctgaagatttctccttgaaggagacaagacctcatctcggtggaggcaaagtctctggggataagcttacaagcacttatgaccttgtggagcaaatgcagtatctctatgttcgtgtggtgaaggcaaaggagttgcctgggaaggacatgactggtagttgtgacccttatgttgaggttaagcttggaaactacaaaggaaccacacggcatttcgagaagaagtcgaatcccgagtggaaccaagtcttcgccttttccaaagataggattcaagcttctttccttgaagttactgtcaaggacaaggattttgtgaaagatgatttgattggtcgtgttgtgtttgatttgaacgaggtacctaagagagttcctcctgacagtcccttggcgcctcaatggtataggctcgaggataggaaagataataaagtcaaaggggagcttatgttggctgtttggtttggtactcaagctgatgaagctttccctgaagcttggcactcagatgctgcaacagttagtggaactgatgctcttgccaacatccggtccaaggtttatttatcgcctaagctttggtacctcagggttaatgtcattgaagctcaagatttgataccaagcgataaggggagatatcccgaggtttatgttaaagctattgtgggaaaccaggcgttgaggactagagtctcgcaaagcaggactattaaccctatgtggaatgaggatttgatgtttgtagcagctgagccatttgaggaacctttgattctcagcgtggaagacagagttgctcctaacaaagatgaagttttagggagatgtgcaatcccgttgcagtatctggacagaaggtttgaccacagaccggtgaacagcaggtggtataacctcgagaagcatatcatggtcgatggagagaagaaggagaccaaattcgctagcaggattcacatgaggatttgtttggaaggtgggtatcacgttcttgatgagtctacacattacagcagtgatcttagaccaacagcgaagcaactatggaagcctaacatcggtgtgctagaattggggatcttgaatgctactggtctgatgcctatgaaagctaaagaaggtcgaggaaccacagatgcatattgtgtggcaaagtacggacagaaatggattcgaacaaggacaatcattgacagctttaccccaagatggaacgagcaatatacttgggaggtttttgatccgtgtacggttcttactgttggagtttttgataactgccatctccatggagggggtgagaagaacggaggagcaaaagattcaagaatcgggaaggtaaggatccggctttctactctcgagactgatcgagtctacacacactcataccctcttttggttcttcatcccaatggagtcaagaagatgggagaaattcatttggctgtgagattcacgtgctcttcattgctcaacatgatgtatttgtactcagtgcctctcttaccgaagatgcattacattcatcctctaactgttagccagctagataacttgaggcatcaagcgactcagattgtctcgatgaggctaacccgagcagagccacctctaagaaaagaagtagttgagtatatgcttgatgtgggttctcacatgtggagtatgcggagaagcaaagcaaactttttcaggatcatgggagttttgagcgggttaatcgcagtaggaaaatggtttgaacagatctgcaactggaagaatccgatcacaacagtcttgatccatctcttgttcatcatccttgtgctctatcccgaactgatcttgcccaccatcttcctctacctcttcctcatcggtgtctggtactaccgttggagaccgaggcatccgcctcacatggacacacgtctctctcacgctgactcagcccacccggacgagctagatgaagagttcgacacttttcctacttcccgaccatctgacattgtcaggatgaggtatgacaggttgaggagtattgctgggaggattcagacagttgttggtgatcttgcaactcaaggagaaaggcttcagtctctgctgagctggcgtgatccgcgtgcaaccgcaatcttcgtcttgttctgcttgattgctgctattgttctctatgtgacacctttccaggtcgtggctcttctaattggaatctatgttctgagacatccgaggttcagatacaggctaccatcagttcctctcaatttcttcaggaggcttcctgcaagaactgattgcatgctctgacctgaaaagaaaactggctttcgatctctcagatattccttgccatcttcaaagaaaattcctccaggctgttagtttgtcttgttaaagtcatgactattttcttggtgttattattatgatgatgtattcgtttggttttaacattattaagaccttttggaaaaactttcgtttttgaagtagtaaagaagtttctgtgtggttttgatgttctctgttttggttagtttgtcatagtctctttgtttgattgagttaggagcttggttgcgatggtgagatgtgaggttagataatggtatggtcatttcttcaa

SEQ ID NO: 4637 - DNA, 2576 bp, Eutrema halophilum
gtcttctcaagcttacaagatgcagagaccacctcctgaagatttctccttgaaggagacaagacctcatctcggtggaggcaaagtctctggggataagcttacaagcacttatgaccttgtggagcaaatgcagtatctctatgttcgtgtggtgaaggcaaaggagttgcctgggaaggacatgactggtagttgtgacccttatgttgaggttaagcttggaaactacaaaggaaccacacggcatttcgagaagaagtcgaatcccgagtggaaccaagtcttcgccttttccaaagataggattcaagcttctttccttgaagttactgtcaaggacaaggattttgtgaaagatgatttgattggtcgtgttgtgtttgatttgaacgaggtacctaagagagttcctcctgacagtcccttggcgcctcaatggtataggctcgaggataggaaagataataaagtcaaaggggagcttatgttggctgtttggtttggtactcaagctgatgaagctttccctgaagcttggcactcagatgctgcaacagttagtggaactgatgctcttgccaacatccggtccaaggtttatttatcgcctaagctttggtacctcagggttaatgtcattgaagctcaagatttgataccaagcgataaggggagatatcccgaggtttatgttaaagctattgtgggaaaccaggcgttgaggactagagtctcgcaaagcaggactattaaccctatgtggaatgaggatttgatgtttgtagcagctgagccatttgaggaacctttgattctcagcgtggaagacagagttgctcctaacaaagatgaagttttagggagatgtgcaatcccgttgcagtatctggacagaaggtttgaccacagaccggtgaacagcaggtggtataacctcgagaagcatatcatggtcgatggagagaagaaggagaccaaattcgctagcaggattcacatgaggatttgtttggaaggtgggtatcacgttcttgatgagtctacacattacagcagtgatcttagaccaacagcgaagcaactatggaagcctaacatcggtgtgctagaattggggatcttgaatgctactggtctgatgcctatgaaagctaaagaaggtcgaggaaccacagatgcatattgtgtggcaaagtacggacagaaatggattcgaacaaggacaatcattgacagctttaccccaagatggaacgagcaatatacttgggaggtttttgatccgtgtacggttcttactgttggagtttttgataactgccatctccatggagggggtgagaagaacggaggagcaaaagattcaagaatcgggaaggtaaggatccggctttctactctcgagactgatcgagtctacacacactcataccctcttttggttcttcatcccaatggagtcaagaagatgggagaaattcatttggctgtgagattcacgtgctcttcattgctcaacatgatgtatttgtactcagtgcctctcttaccgaagatgcattacattcatcctctaactgttagccagctagataacttgaggcatcaagcgactcagattgtctcgatgaggctaacccgagcagagccacctctaagaaaagaagtagttgagtatatgcttgatgtgggttctcacatgtggagtatgcggagaagcaaagcaaactttttcaggatcatgggagttttgagcgggttaatcgcagtaggaaaatggtttgaacagatctgcaactggaagaatccgatcacaacagtcttgatccatctcttgttcatcatccttgtgctctatcccgaactgatcttgcccaccatcttcctctacctcttcctcatcggtgtctggtactaccgttggagaccgaggcatccgcctcacatggacacacgtctctctcacgctgactcagcccacccggacgagctagatgaagagttcgacacttttcctacttcccgaccatctgacattgtcaggatgaggtatgacaggttgaggagtattgctgggaggattcagacagttgttggtgatcttgcaactcaaggagaaaggcttcagtctctgctgagctggcgtgatccgcgtgcaaccgcaatcttcgtcttgttctgcttgattgctgctattgttctctatgtgacacctttccaggtcgtggctcttctaattggaatctatgttctgagacatccgaggttcagatacaggctaccatcagttcctctcaatttcttcaggaggcttcctgcaagaactgattgcatgctctgacctgaaaagaaaactggctttcgatctctcagatattccttgccatcttcaaagaaaattcctccaggctgttagtttgtcttgttaaagtcatgactattttcttggtgttattattatgatgatgtattcgtttggttttaacattattaagaccttttggaaaaactttcgtttttgaagtagtaaagaagtttctgtgtggttttgatgttctctgttttggttagtt

SEQ ID NO: 4638 - DNA, 3010 bp, Vaccinium corymbosum
ttttacagctttgatgaattcctctgaatctccatcacttcatcaggcctcaaacattcagatctgaagctgtgaaatatggtcattgttcatgcggtcattttacatttttgaccttcaggcttctgttatttactaaagatctaggattttactgcccttcagttgttatctattcgcattttgagtttgagtgttttacggctaagtaaaaatccaactccgatccctcagggtatttggttagtttatgctagttggttaaactgctacttgatccctgtgtattgggtcggtcttgtttaaaacccacaaaatgcagagacctccaatggaagatttttccttaaaggagaccagaccccaccttggtggtgggaaggccaccggcgataagctcacgagcacctatgacctcgtggagcagatgcaatacctctatgttcgtgtcgtaaaagcaaaagatttacctggaaaagatgttacgggtagttgtgacccttatgttgaagttaaacttgggaactataagggtacaactcgtcatttcgagaaaaaatcaaaccccgaatggaatcaggtatttgctttttcaaaggatcggcttcaagcttctacgcttgaggttacggtcaaggataaggatgttgtcaaagatgatttcataggtcgggtcatgttcgatctcaatgagatcccccaaacgtgtcccaccggatagtccattggcgccacagtggtataggttggaagatagaaatacgaataaggttaaaggtgagctcatgttggctgtttggatgggtactcaagctgatgaagccttccctgaggcttggcattcagatgctgcagcagttagtggtgctgatggtcttgcaaacattcggtctaaggtgtatctatctcctaagttatggtacttaagggtaaatgtgattgaagctcaggatttaatgccgagcgacaagacaaggttcccggaagtctttgtgagggctattttggggaatcaggttatgagaactagaccttctatgagcaagactattaatccaatgtggaacgaggatttgatgtttgttgctgcggaaccatttgaagagcccttgattttgagtgtggaagatagagttgccccaaacaaggaagaagttctggggaggtgtgggattcccttacagtatgttgaaaggaggttagatcacaaacctattaacgctaggtggttaaatcttgagaagcacattattgttgaaggggagaagaagaaggaaattaaatttgccagcaggattcatgtgagggtctgtttggaaggtgggtatcatgttcttgacgaatcaactcactacagcagtgatctcagacctacagccaaacagttgtggaaatccagcattggggttttggaactgggtattctcaatgctcatgggctgtcacccatgaaaacgaaagacggacgggcgacaactgatgcttattgtgtggccaaatatgggcagaagtgggtccggacaaggacaattattgatagctttgctcccaaatggaatgagcaatacacttgggaggttttcgatccatgcactgtcatcacgattggggtatttgacaactgtcacttgcatgggggtggtgataaggcgggaggagcaaaggattcaaggattggaaaggtcagaatccgtctttctacgcttgaaactgatcgggtttatacacactcttatcctcttttggtcttgcttcctacgggagtgaagaagatgggtgaaatccatttggccgtgaggtttacttgctcttctctgctcaatatgatgcatatgtactctcaaccacttttgccgaaaatgcactacattcatccactgactgtgactcagcttgagaccttgaggcaccaggccactcagattgtgtccatgaggctgactcgtgcggagccaccgttgcgaaaagaggtggtggagttcatgctggatgttgggtcccacatgtggagcatgaggagaagcaaggccaattttttccgaatcatgggagttctgagtggtttaattgctgtgggaaagtggtttgatcagatatgcaactggaaaaacccgatcaccacagttctgattcacatcctgttcttgattctggttttgtatccagagctgattctgcccaccattttcctctaccttttcttgattggagtgtggtattatagatggaggccacgccatcccccacacatggacactcgtctctcttgtgctgacaatgctcttcccgatgagctggatgaagaattcgatacgttcccaacttcccgtcagaacgatatggtgcggatgaggtatgatcgcctgagaagcattgcggggaagattcagactgtggtgggcgatctcgctacccaaggggagaggctgcagtcattgctgagctggagggacccaagggctactgctctgtttgttattttctgcttggttgcagcgatagttctgtatgttacaccgttccaagttgtggctcttcttgcagggttttatgtgctgagacaccccaggttccgtcataggctgccttctgtgccgctcaattttttcaggaggctgccggcaagaactgattgcatgttgtgagcacgagcaagtttttgcttccgaatggtctcacacatgggtttctcttcctctttccaattggagaagacgacacagagactactggagattgcttgcttcttttcacctaccggtgaatgttgggtcctggtatgatttgtagtatcgtcgtccatttggctagtattatgtgttctttattcgctgttttatgtcttctgtagggtttctgttttgatgttgactatgtggtaaaatctcatgaatgttgttttgttaattttgtaggttgtgatttagagttgtttatgtggtggacaatttaaatgcttatgttgtacttggttgcttgctttgatgggttgaattgcaaagtcgagtct

SEQ ID NO: 4639 - DNA, 3253 bp, Fragaria vesca
ctctctctctctctctctctctctctagaatggcctagagggtttcctcctccatccttatctccttgatgagttctcactctcaccaaacccaatgaaacccacttccaccgcttctctctgaggagcgttttctctctttctcttccatttttctcttttattattctacaatgatagttctgtgggttctctctgacctctgcttctgaatcttcttcttcttctttgttcatcaagaggtttataaacattcagatctgaagcttgggtttttccgccagttaccaaggtgtccgggaatctttgaattagttcaaaatcagttgaaactgttacttcaattttgtccctctgggcctctctagttttgaacccaaaagatgcagaggcctccacctgaagactttgctttgaaggagaccaaaccccatcttggtggggggaggatctccggcgacaagcacacgagcacctatgacctcgttgagcagatgcagtatctctatgtccgagttgtgaaggccaaggacttaccttccaaggatgttaccggtagctgtgacccttatgttgaagttaagctggggaactacaagggtgcaactcggcattttgagaagaagtccaatccggagtggaatcaggtgtttgcattctcgaaggaccggatccaggcttcagctcttgaggtgattgtgaaggataaggatcttatgaaggatgacctcattggatatgttatatttgacctgaacgaggttccgaaaagggttcctcctgatagtcccctggcgccacaatggtatagattggaggataggaagggggacaaggctaggggtgagttgatgttggctgtttggatgggtactcaagctgatgaagcatttcctgaagcatggcattcggatgctgccacagttagtggagctgatagtctgtcaaatattcggtcgaaggtgtatctctctcccaaactatggtatttgagggttaatgtgattgaggctcaggacttgatgccaagtgataaaggcaggtatcccgaagtttatgtgaaggctatcctgggaaatcaggctttgagaactcgaatttcacaaagcaggagtataaatcccatgtggaatgaagatctaatgtttgtagcatcagagccgtttgaggagccgttgattttaagtgtggaagatagaatcgcgccaaacaaggatgaagttctggggaggtgtgccattcctttgcagtatgtgccccgaaggtatgatcataaacctgtgaacactagctggcacaatcttgagaagcatattattgtagaaggtgaaaagaagaaggatgttaagtttgccagtaggattcatatgaggatctgtctagaaggtggttaccatgtgcttgatgagtcaacacactatagcagtgatcttagaccaacagccaaaccattgtggaagtccagcataggggttctggaagtgggaatcctgaatgctcaggggttgatgccaatgaagacaaaagatgggaggggaacaacagatgcctactgtgttgcaaaatatgggcagaagtgggttcgtacaagaaccattatcgatagccttgctcccaggtggaatgagcaatacacttgggaggtttttgatccttgcaccgtcatcacaattggggtatttgataactgtcatttgcatggaggagacaaggctgccggggcaaaggattcacgaattgggaaggtcaggattcgtctctctacccttgaaactgatcgggtgtacacgcactcttatcctcttctggttctgcacccaaatggtgtgaagaagatgggtgaaatacatatggctgtgaggttcacctgctcttcgttgctgaacatgatgcatatgtactcccaaccactgttacccaaaatgcattatcttcatccactaactgtaagccagcttgatagcttgaggcaccaggccactcagattgtatcagtgaggctgagccgtgctgaaccgcccttgagaaaggaggtggtcgagtacatgctggatgtgggctcgcacatgtggagtatgagaagaagcaaagctaatttctttcgaattatgaatgttctgggtggattaattgctgttggaaaatggtttgatcagatctgtaactggaagaaccccatcactactgtgcttatccatatcttgttcataattctggttatgtacccagagctgatactgcctactatttttctgtacctgtttctgattggagtctggtactacagatggaggcccaggcatcctcctcacatggacactcgtctctcacatgcagattctgcacatcctgatgaacttgatgaagaatttgatactttcccgacttcacgtccttctgacatagtgagaatgagatatgacagattgaggagtattgctgggagaattcagacagtggttggtgacttggctactcaaggggagaggctgcaatcattgttgagctggcgtgacccgagagctacagctctgtttgtgcttttctgtctgattgctgctattgttctgtatgttacgccattccagattgtggctcttcttgctggattctatgtgttgaggcacccaagattccgccataagcttccatcagtgccactgaactttttcaggaggttgccagctaggaccgactgcatgctatgaggaaatgactgttgtattttcaattgcctttgagttgtaatgtgttaagttaatggagatcgatgatggaggccagcatagagcaagctatttgttttggaggtcttgcagccatgaacatgaaggtggtgagggtcttcttttctttcagtgttctgcagcagcgttctggtacgatgtatttatggccttgtcctgaaggtagtttttaaaaaatttcagttgttaattatgtccaatctaggatttctgtcaaaagaaccttcacttttaaggttactagttgttgtcatttatagtttcgtaggctgtgattggaatgctgaaccattatatggcgtctttagtgtatttagatttttctaaattcaccttatgtaaagttcatcggttgaactgcatcttatttccttgcccatcatcaaacagataggtagatgcttggttctctagtctaaatttgcagcctaattgttacatgctcgttatcaaactatatgacatgttatgttgtcacttgctagtcatatttttggtgctatatg

SEQ ID NO: 4640 - DNA, 2886 bp, Citrullus lanatus
aaaaaatccactccctaaaaaccgcttttttctctctcttctcaaacccacctgcatttccctttcttctgtaatggggtttcgtttttgctcctcttttgaagaatgccattgaacttgaaggggttgaagacttttcagatctgaagcttttgaagacttgactaaaatcttcttcttttcttcaagggttttgctttctcaggtttgtttgaaaatcaattgaactgtgaagatgatgcaaaagcctccaccagaggatttcttactgaaagagaccaatccccaccttggtggggggaaggtcactggtgacaaactagcaagcacctatgatcttgttgagcaaatgtattacctctatgttcgggttgtcaaagcgaaagacttgcccgggaaagatgtcaccggtagctgtgatccgtatgtggaggtcaagcttggaaactacaaaggtacaactcggcatttcgagaagaagtcaaatcccgaatggaatcaagtgtttgccttctcaaaggatcggattcaggcttccgtgcttgaggtgactgtgaaggataaggattttgtgaaggatgatttcatggggagagttctttttgacttgaatgaggttccgagaagggtaccgccagacagccctttggcgccgcaatggtatcggttggatgatcggaaaggggacaaggtgaaaggagagctgatgttggctgtttggatgggaacacaagcagatgaagcatttccagaggcttggaattcggatgctgcaactgtgagcggagccgatggtcttgcaaatattcggtcaaaggtgtatctttctcccaagctttggtatttgagggtgaatatcattgaagctcaggatctgcagccaactgataagggtcggtatccggaggtttttgttaaggctatacttggaaatcaggcgttgaggactagaatatctcagtctagaactatcaatccaatgtggaatgaggatttgatgtttgtggcagctgaaccatttgaagagcctttgattttaagcgtggaagaccgagttgcaccaaacaaggatgaggtcttgggaaggtgtgcgattccgctgcagtatatagataggagattggaccatagagctgtgaacacaagatggttcaatcttgagaaacatgttgttgttgtggaaggagagaagaagaaggaaatcaagttttctagtaggattcacatgaggatatgtttggaaggtggctaccatgttctggatgaatcaacacattatagtagcgatcttcgaccgacggcgaaacagctctggaagaacagcattggggttttagaattggggattctgaatgctcaaggtttaatgccaatgaaaacgaaagacgggcgtggaacaaccgatgcatactgtgtggctaagtatgggcagaagtggattcgaacgaggacgatcatagacagcttcatacccaagtggaatgagcagtacacttgggaggttttcgatccctgtactgtcattacaattggggttttcgacaactgccatttgcacagtggggagaaggctggaggatcaaaagatgcacgaatagggaaggtaagaattcgcctttccacgctcgagacagatcgagtgtatactcattcatatcctctactggttcttcacccaaatggggtgaagaagatgggtgagattcatttggctgtgaggtttacgtgctcttctttgttaaacatgctgcatatgtactcacatcccctcctccccaaaatgcactatattcatccgttaacggtgagccagctcgatagccttcggcaccaggcaactcaaatcgtttcgatgaggctgagccgtgctgagccaccattgcgaaaagaggtcgtcgagtatatgctcgatgtaggctcccacatgtggagtatgagaaggagcaaagctaatttcttcagaatcatgggagtttttagtggcctgattgcagttggaaaatggtttgatcagatttgcaattggagaaacccaattacaactgttctcatacacatcttgttcataatccttgtgatgtaccctgagctcattcttcccacaattttcctctacctcttcctaattggagtttggcattacagatggaggccaaggcaccctcctcacatggacacccgcctctcccatgccgactcctctcatcccgacgaactcgacgaggagtttgacaccttcccgacttctcgtcctgctgacattgtgaggatgaggtatgatcggctgaggagcattgcagggaggatccaaactgtcgtcggagacctagcaacgcaaggcgaaaggctgcaatctctactcagttggcgcgacccgagagcatcggcattgtttgtgatcttctgcttggtttctgccatagttctgtatgttacaccattccaagttgtggcgcttctttctgggatttatgtgctcagacatccgaggtttcggtacaagctcccgtccgttccgctcaacttcttccggaggctgccagccagaacagactgcatgctatgatggacttttctttcttttcttgctctattggtaaaatgatgggggaaagcaaacatgaagcttttgtatgctgtttatcatatcttgtttaggggcatttttttgggcattcaagagttaaaatgtatggatggccttccccagaaggtgaaggcagtttttatttatggatttgtgttatgttaattatcttttcaatagaatttcttggcattaactgtttctgaacctctcttcttctttagtttagattgtgattacaattccattgagacagaccattttttgtgggatctatactctttgttattgtttggaca

SEQ ID NO: 4641 - DNA, 2859 bp, Beta vulgaris
aaaaaagaatataagggttgtttgttaagaatttatatagttggtgggttgaactctgttccgataattaagtgttagaagtaacaaagttttaaaatttcaaatattgggagtatagtttgaaacccagaaaatgcacaagcctcctcatgaatatttctctctcaaagagacaaatcctcaccttggtggtggaaaagtcacaggggataagcttactagcacttatgatcttgttgagcaaatgcaatacctctatgtgagggttgttaaggcaaaagatttgcctagtatggatgttacaggtgggtgtgacccgtatgtcgaagtaaggcttgggaactataagggtacgacgcggcattttgagaagaagtctaatcctgaatggagtcaggtctttgccttctccaaggaaaggattcaggcatcagttcttgaggtcaatgtgaaggataaggatgctattaaggatgatttcattggtcgcgttttgtttgatcttaacgaagtcccgaagagagtgccacctgatagtcctttggcaccacagtggtataggcttgaagataggaagagtgataaggctagaggagagttgatgttagctgtgtggtggggtacccaagctgatgaagcatttccagaggcatggcactcagatgctgcgactgttagtgggactgatgctcttgcaaatattcgttcaaaggtgtatttatctcctaagctttggtatctgagggtcaatgtgattgaggctcaggacttggttccaagtgacaagagtcgctttcctgaagtctatgtaaaggctgttcttggaagtcaggctcttagaactagagtatctcagagccggaccatcaatcctatgtggaatgaggatcttatgtttgtagcagcagagccttttgaagatgccttgattttgagtgtggaggatagagttgggcctaacaaggatgaagtgcttggtaggtgtgcaattcccctgcaatatcttgacaggcggctggatcataaaccgataaatactaggtggttcaatcttgagaagcatgttgtaatagatggtgagaaaaagaaggaaaccaagttctccagtcggttacatatgagggtctgtttggaaggtggttatcatgttttagatgagtcaacacattatagtagtgatctcaggccgactgctaaacagctgtggaagcacagcatcggagttctggaactgggtatcttaactgcacagggtttgatgcctatgaaggtgaaggatagccgtcagaccacagatgcttactgtgttgccaaatatggtcaaaaatgggtgagaacaagaactatcattgacagtttcagcccgaagtggaacgagcaatatacatgggaggtgtttgatccttgcactgtcctcactgtcggagtatttgacaactgtcatttacatggaggaggagataaaggtggcgctgcaagagactcgagaattggtaaagtgaggattcgtctttccaccctcgaaactgatcgtgtatatactcatgcatacccgcttttggtgttgcatccttctggtgtgaagaagatgggtgaaatccaactggctgttaggttcacatgttcgtctttgctcaatatgatgcatatgtactctcatccattgctgccaaagatgcattaccttcatcccttgactgtgagtcagcttgataacttgaggcaccaagccactcagattgtgtctatgaggttgagtcgtgctgagccacctttgaggaaggaagtggtcgagttcatgttggatgtgagttctcatatgtggagtatgaggcggagcaaggcaaatttcttcagaatcatgaatgtcttgggtgggattattgctgttggaagatggtttgatcaaatatgcaactggaaaaaccccatcaccacagttcttatccacatcttgttctttattttggtcatgtacccagaactgattttgccgacaatattcttgtatctgttcctgattggagtgtggtactatagatggaggccaaggcatccaccccacatggatacccgcctttctcatgcagattctgcacaccccgatgaattggatgaagaatttgatacatttccaacttctaagccagctgatattgtgaggatgaggtatgatcgtttgaggagtatcgctgggaggatccagactgttgttggtgacttggcaactcagggtgagaggctccagtctttgctgagctggcgagacccaagagccaccgcattgttcgttatattctgcctgattgctgccattgttctgtatgtgacaccattccaggtcgtggctcttctaactgggttttacgtcctgagacacccaaggttccgtcataagctcccttctgttccgcttaatttcttcagaaggttgcctgctcgtacagactcgatgctgtaagaccttgatggatttgttttccaatctttagctggattcattttggatggcacctgttttcccccttgtcataaagaagctgctgacgctctggtgcccattctctttcggttagtggctaatgttagatatgggtatgatgttttaccccttttctgcaaactggtgaatttgtgattcgatgttttgtgtaccttgtagaatcccttggcctgtatgtcgactatatgagaaccaaatttatgtctttgagtcttagtctagtatctattttgccgccttttgatgcttactattgcttaaaatagtgaatagagtcacaatattcaatagttttccaagtatatccttttccccttaacttctgtggtaattggtgggtaaccatttataaaaaa

SEQ ID NO: 4642 - DNA, 3044 bp, Mimulus guttatus
cacccttttcctttaaatctttttctctgaagaaagaaaagaattttcaaaaaaaaaaaaaaaaacacctctgtatttagatttagctctctccggtttgtgtttccgcttttttatttattttattttatttttaatttgattcaaaaaaggcaacaagaacaaaaacccttctctctactttaatattggctctctctctctctctcttcttttgctcagttgtttgtatcaatctatctgcaggaacaaaaaccttatcgtgaaccttcaaggttttttgttttcagatctgaagctttgaactaatgttttggagttaccaggttcttcttcataaggttttaatcactcagatctgaagccttgaattgacatttcaggcttacaccgttttctttcatcgggttcgaaagaagtcaacaaaatgcagaggcctccgcatgaagacttctccttaaaggagaccaaaccccaccttggtggtggcaaaatcactggagacaagctcacgagtacctatgacctcgtcgagcaaatgcagtacctgtacgtacgtgtcgtaaaagccaaagacttaccaggaaaagacgtagcaggtagttgcgacccttacgtagaggtcaggctcggaaactacaagggtacaactcgtcatttcgagaaaaagtcaaaccccgaatggaaccaggtcttcgccttctccaaggaccgtatccaagcctccgttctcgaagtcaacataaaagacaaggattttgtcaaggacgattttatcggacgggttgtgttcgatttgaacgaggttcctaagcgggtccctccagacagtccactggccccacagtggtacaggctggaggatcggaaaaatgaaaaggcgaaaggggagcttatgctggctgtttggatgggtacacaagctgacgaggcgtttcccgaggcatggcattctgatgctgcagcggtgagtggggctgacggtctttcgaatatacgttcaaaagtgtatctatcgcccaagctttggtatttgagggtgaatgttatcgaagctcaagatttgcagccgagtgacaaaagtaggtttccggaagtttacgttaaagctattcttggaaatcaggctttacggacgagggtttcaatgaacaagagcatcaatcctatgtggaatgaggatttgatgttcgttgctgcagagccgttcgaggagccactaatcttgagcgtcgaagaccgtgttgcccctaataaagacgaagtactaggaagatgcggtgtgcctttgcagtacgtggacaggcgattggaccataagccggttaatacgaggtggtacaaccttgaaaaacacgtcatggtcgagggcgaaaagaagaaggaagtgaaattcgctagcaagattcacatgcgaatttgcttagaaggtggctaccatgttctagatgaatccactcactacagcagtgatttacgaccgacagcaaagcagctgtggaaatcgagcattggtgttttggagctcggagtattaaatgcacaggggctttcaccgatgaaaacgaaagacgggcgtgcaactacagacgcttactgcgttgcgaaatacggacagaaatgggttaggacaaggacaatcatagacagcttttctccgaaatggaacgagcagtacacgtgggaggtcttcgatccatgcactgtagtaaccatcggtgtattcgacaactgtcacacacaaggcggggacaaaaatggaagagatgcaagaatcggtaaagtacgaattcgcctttcaaccctcgagactgaccgtgtctacacccactcgtaccctctcctagttttgcatccgtcgggtgtgaagaagatgggcgaaattcatttagccgttcgatttacgtgctcgtctttagtgaacatgatgcatatgtactcgcagccgttgcttccgaaaatgcactacatacatccattgacagttagccagctcgacagcttgaggcaccaagcaactcagatagtctcgttgaggctgactcgagccgagccgcctttgagaaaggaggtggttgagttcatgctcgacgtcgggtcccacatgtggagtatgaggagaagcaaagctaacttctttcggattatgggtgttttgagcggtttaattgcggttggaaaatggttcgatcagatatgcaattggaagaacccaattacgacagtgcttatccacatactcttcttgatattggtcatgtacccagagctaatcttacccacggtatttttataccttttcttgattggcgtgtggtactatagatggaggccgaggcacccgccccacatggacacgcgtctctcttgtgccgacaacgcgcaccctgatgagctggacgaggagttcgacactttcccgacttctaggcccgcggatattgtccgaatgaggtacgatcgtctgaggagcattgctggcaggattcaaacggtggttggtgacctggcaactcagggggagaggctgcagtcattgctgagctggcgggacccaagggccacggctttgtttgtcatcttctgtttgattgctgcgattgttctgtatgttacgcctttccaggtggtggcgcttctgacggggttctacgttttgaggcatcctaggtttcggtacaagctgccttctgtgccgctcaatttcttcaggagattaccagcaaggacggactgtatgctgtgagtggaaaacaaaggtgtttttttttttcccggtggcgtttatgtaagattgtctctgaaactttttttgcatattttggttggtttttaaggttttcttttatttgtttaggatgttggtttttgtgttcgagacagatttggtggtcgttttaattcaatccggactatccctttttctttattaaatcatctaatatgaattttaatggtataaataatgtcggtaaaaagttgttagctttttacgacgggcgcgatacttggccgtgaattgccaagctaagttgttatgtctt

SEQ ID NO: 4643 - DNA, 3402 bp, Mimulus guttatus
aaaaaaaaaggaaaaaaaaatacacacacacacagtacacacagttggggttgggtgcattgataaagcagattcatcagatctctctgcgtgtcccccaccacccttttcctttaaatctttttctctgaagaaagaaaagaattttcaaaaaaaaaaaaaaaaacacctctgtatttagatttagctctctccggtttgtgtttccgcttttttatttattttattttatttttaatttgattcaaaaaaggcaacaagaacaaaaacccttctctctactttaatattggctctctctctctctctcttcttttgctcagttgtttgtatcaatctatctgcaggaacaaaaaccttatcgtgaaccttcaaggtttttgttttcagatctgaagctttgaactaatgttttggagttaccaggttcttcttcataaggttttaatcactcagatctgaagccttgaattgacatttcaggcttacaccgttttctttcatcgggttcgaaagaagtcaacaaaatgcagaggcctccgcatgaagacttctccttaaaggagaccaaaccccaccttggtggtggcaaaatcactggagacaagctcacgagtacctatgacctcgtcgagcaaatgcagtacctgtacgtacgtgtcgtaaaagccaaagacttaccaggaaaagacgtagcaggtagttgcgacccttacgtagaggtcaggctcggaaactacaagggtacaactcgtcatttcgagaaaaagtcaaaccccgaatggaaccaggtcttcgccttctccaaggaccgtatccaagcctccgttctcgaagtcaacataaaagacaaggattttgtcaaggacgattttatcggacgggttgtgttcgatttgaacgaggttcctaagcgggtccctccagacagtccactggccccacagtggtacaggctggaggatcggaaaaatgaaaaggcgaaaggggagcttatgctggctgtttggatgggtacacaagctgacgaggcgtttcccgaggcatggcattctgatgctgcagcggtgagtggggctgacggtctttcgaatatacgttcaaaagtgtatctatcgcccaagctttggtatttgagggtgaatgttatcgaagctcaagatttgcagccgagtgacaaaagtaggtttccggaagtttacgttaaagctattcttggaaatcaggctttacggacgagggtttcaatgaacaagagcatcaatcctatgtggaatgaggatttgatgttcgttgctgcagagccgttcgaggagccactaatcttgagcgtcgaagaccgtgttgcccctaataaagacgaagtactaggaagatgcggtgtgcctttgcagtacgtggacaggcgattggaccataagccggttaatacgaggtggtacaaccttgaaaaacacgtcatggtcgagggcgaaaagaagaaggaagtgaaattcgctagcaagattcacatgcgaatttgcttagaaggtggctaccatgttctagatgaatccactcactacagcagtgatttacgaccgacagcaaagcagctgtggaaatcgagcattggtgttttggagctcggagtattaaatgcacaggggctttcaccgatgaaaacgaaagacgggcgtgcaactacagacgcttactgcgttgcgaaatacggacagaaatgggttaggacaaggacaatcatagacagcttttctccgaaatggaacgagcagtacacgtgggaggtcttcgatccatgcactgtagtaaccatcggtgtattcgacaactgtcacacacaaggcggggacaaaaatggaagagatgcaagaatcggtaaagtacgaattcgcctttcaaccctcgagactgaccgtgtctacacccactcgtaccctctcctagttttgcatccgtcgggtgtgaagaagatgggcgaaattcatttagccgttcgatttacgtgctcgtctttagtgaacatgatgcatatgtactcgcagccgttgcttccgaaaatgcactacatacatccattgacagttagccagctcgacagcttgaggcaccaagcaactcagatagtctcgttgaggctgactcgagccgagccgcctttgagaaaggaggtggttgagttcatgctcgacgtcgggtcccacatgtggagtatgaggagaagcaaagctaacttctttcggattatgggtgttttgagcggtttaattgcggttggaaaatggttcgatcagatatgcaattggaagaacccaattacgacagtgcttatccacatactcttcttgatattggtcatgtacccagagctaatcttacccacggtatttttataccttttcttgattggcgtgtggtactatagatggaggccgaggcacccgccccacatggacacgcgtctctcttgtgccgacaacgcgcaccctgatgagctggacgaggagttcgacactttcccgacttctaggcccgcggatattgtccgaatgaggtacgatcgtctgaggagcattgctggcaggattcaaacggtggttggtgacctggcaactcagggggagaggctgcagtcattgctgagctggcgggacccaagggccacggctttgtttgtcatcttctgtttgattgctgcgattgttctgtatgttacgcctttccaggtggtggcgcttctgacggggttctacgttttgaggcatcctaggtttcggtacaagctgccttctgtgccgctcaatttcttcaggagattaccagcaaggacggactgtatgctgtgagtggaaaacaaaggtgtttttttttttcccggtggcgtttatgtaagattgtctctgaaactttttttgcatattttggttggtttttaaggttttcttttatttgtttaggatgttggtttttgtgttcgagacagatttggtggtcgttttaattcaatccggactatccctttttctttattaaatcatctaatatgaattttaatggtataaataatgtcggtaaaaagttgttagctttttacgacgggcgcgatacttggccgtgaattgccaagctaagttgttatgtcttttatctgtgttattaccatttaatttgctgtttagatttgatccttttcaaatgtaaaactaaatgaaggagcatttgtttaacagtgtgagttgtaataatacaagtggacaatagtttatttgctaaggattaaaaaaaacaggggcagaaatgacattattcctggaatcatggcaccaaaagcttttatcaagaagcatgttctatttttcattatttaattctcaaacattccttcaaaatcaactgctccag

SEQ ID NO: 4644 - DNA, 2921 bp, Valeriana officinalis
cgttcttttcttccagattcccaccacgctcaccaccttcactttctctctctaaagctaccccctttttcctccatctctctctaaccttacttcatctcttcaccttcttccttattctcatccataaatacaaaacaccacctgcagcacaaaatcctcaactattcccccaccatttccaccgaatctctcagttttaaggtcggaaatattcagatctgatgagttgagcggagatttttgatgtggttggtgcgttacattactgagcatcgggctgtttgtgtggctgggatctagggtttggttttcatatctggtcttttctctctctttacttttccgtttttgctaaggaagtaaaaaggttgaaaatgcagagacctcctcatgaagatttctccctcaaggagaccaaacctcacctcggtggtggaaagatcaccggtgacaagcttacaagcacttatgatctcgttgagcagatgcagtatctctatgttcgcgtagttaaagctagagatttgccggcaaaggatgtcaccggcagttgtgatccttatgttgaagtcaaactaggaaattacaaaggcacgactcgccatttcgagaagaaatccaatcctgaatggaatcaagtctttgcattctcaaaagaccgaatccaggccactgttcttgaagctacggttaaagataaagatttcgtgaaagatgatttcatgggcagggttttgtttgatcttaatgaggttcctaaacgtgtcccgccggacagtccacttgctccacagtggtatagaattgaagataggaaaggcgataaagttaaaggtgagctcatgttagctgtttggtggggcacacaagccgatgaagcatttccagaagcttggcattcagatgctgcaagcgtaagcggttctgatggacttgcaaacatcagatcaaaggtatatctctcacctaagctctggtaccttagggttaatgtaatcgaagcgcaagacttgcaaccaggagataaaactaggtttccagaagtttttgtaaaggcaattctcggaaatcaggctcttagaacaagaatttcgatgaacaagtcaatcaacccaatgtggaacgaggatttgatgtttgtagctgcagaaccatttgaggagcacttgatgttgagcgtggaggatagagttgctcctaataaagatgaagtgattggacggtgtgtaattcctctaaattatgttgacaggaggcttgatcacaaacccataaactctagatggtataatcttgaaaagcacgttgttattatggaaggcgataagaaaaaagaagtcaaatttgcaagcaggattcatatgaggatctgtttggaaggtgggtatcacgttctcgacgaatcaactcactacagtagtgatctgagaccaactgctaaacagttatggaaatcaagcatcggagttcttgaagttggtatcttgaatgctcagggtttatctccaatgaaaactaaagatgggcgagcatcaacagacgcttattgtgtagccaaatatggccaaaagtgggtccgcaccagaactatcatagacagctttgcaccaaaatggaatgaacagtacacttgggaagttttcgatccgtgcacggtcataacagttggtgtttttgacaactgtcatctacatggcggcggtgacaaagctggcggctcacgtgattcaagaattgggaaagtcagaattcgtctgtcaaccctagaaactgacagagtctatactcacacatacccgcttctggtcttacacccctccggcgtgaaaaaaatgggcgaaattcatctggcagtgaggttcacatgttcgtctttactaaacatgatgcacatgtactctatgccacttttaccgaaaatgcattacattcatccactaacggttagccagcttgacagtttaaggcaccaggcaactcaaattgtgtctatgcggctaagccgagccgagccgccgctcagaaaagagattgtggaatacatgcttgatgtcggctcacacatgtggagtatgaggagaagcaaagcaaacttctttcgaataatgggggttttgggtggaataatcgctgttggaaaatggttcgatcaaatctgcaactggaagaatccgatcacaaccgttcttatccacattttgttcttgattcttgttttgtaccccgagctgatcttaccgactatttttctttaccttttcttgattggagtttggtactatagatggagaccaaggcatccgcctcatatggatacccgtctctcctgcgctgacaacgcgtttcctgacgagctcgacgaggagttcgacacttttccaacatcgagacaggccgatatggtgaggatgaggtacgatcgccttcgcagcatcgccggccgcatccagacggtggtcggcgacctggcgactcaaggcgagcgtcttcagtcgctactcagctggcgggacccgcgtgccaccgcccttttcgttatcttctgtttgattgctgccatagttctctacgtcacgccgtttcaggtggtggctcttcttactggattctacgttttgagacacccgaggttccgccacaaactgccgtcagtgccgctcaacttcttccgcaggttaccggcaagaaccgattgcatgctgtgagccggaaaaaaatcatgtgtaagatctttttgctttaaaaacttggaattattattagatttattattatgtggatttgttggttaatttttctgtttcttcttcattatgctttcgacaaaaaaaaaaacttggtagggttgtgatttggattctaatgtctttttcaagcatatctcatgtgtttattattattgttattatccaaaaaaa

SEQ ID NO: 4645 - DNA, 2514 bp, Silene vulgaris
gtagcattgagatctgtagaaggttttgagttgagcgtttatttgttttcgaaaaatatcgaaaatgcagaagccgcctcaagaggatttctctctaaaagagacaaatccgcatcttggtggcggaaaagccaccggagataagcttactagcacctatgaccttgttgagcaaatgcaatacctctatgtgagggttgtaaaggttaaagatttgcctagtatggatcttacgggttcatgcgacccgtatgtggaagtaaaactcggaaactataagggtacaactaggcattatgagaagaggacttctgctgagtggaatcaagtgtttgccttttctaaggatcggattcaggcctctgtgcttgaggttagtgttaaggataaggatgttgttaaggatgatttcattggtcgggttttgtttgatcttaatgaggttcctaagagagttccgcctgatagtccgttagcgcctcagtggtataggcttgaggataggaagagtgataaggctaggggagagttgatgttggctgtgtggtggggtactcaggctgatgaggcgtttcctgaagcgtggcattctgatgctgcggctgttagtgggagtgatgcactggctagttttcggtccaaggtgtatttgtctcctaagctttggtatttgagggtgaatgtgattgaggctcaggacttgattcctagtgataaaggtcggtttcctgaagtttatgtgaaagctattcttggtagtcaggctcttagaactagggtttctcaaagccggaccatcaatcctatgtggaatgaggatcttatgtttgttgcggccgaaccctttgaagagccgctgattttaagtgtggaggatagagttggaccaaataaggatgaagtattggggaggtctctcattcctctacaatacgttgataggcggttggatcatagaccgatgaattcaaagtggtataatcttgagaagcatgttgttgtcgagggtgagaaaaagaaggataacaaattctctagcaggattcacatgaggatatgtttggaaggtggttaccatgttttggatgagtcgacccactatagtagtgatcttaggccgactgctaagcaactatggaagcctagtattggagttctcgaacttggtattttgactgctcaagggttgatgccaatgaaggtgaaggataaccgccagaccaccgatgcttattgtgttgccaaatatggtcagaaatggattagaacgagaacaatcattgatagcttcagcccgaaatggaacgagcaatatacatgggaggtgtttgacccatgcaccgttatcactgttggcgtgtttgacaattgtcatctacatggaggcgataaggggggcaacagagactctaggatcgggaaggtgagaatccgactttcttcgttggaaactgatcgggtatacacgcatgcatacccccttctggtattgcaccctactggagtgaagaaaatgggtgaaatccaacttgctgtgcggttcacctgctcgtctttgcttaatatgatgcatatgtattctcaccctttgctgcccaagatgcattatttgcatccattaactgtaagccagctggataacctgaggcatcaggccactcagattgtgtctatgaggttgagtcgcgccgagccacctttaaggaaggaagtggttgagtttatgcttgatgtgggttctcacatgtggagtatgaggcgaagcaaagcaaatttcttcagaatcatgaatgtcttgggcgggataattgctgttggaagatggtttgatcaaatatgcaactggaaaaacccgatcacaaccgttcttattcacatattgttctttatcttggtcatgtaccctgaactcattttgccaaccatattcctgtaccttttcttgattggagtttggtactatagatggagaccaagacacccgccccacatggatacccgtatatcgcatgcagattctgcccaccctgatgaactggatgaggaatttgatacattcccgacttccaagccagctgatatcgtgcgaatgaggtatgatcgcttaaggagcatagccggacgaatccagactgttgttggtgacttggcaactcagggtgaaagggttcagtccttgctgagttggcgagacccgagagccactgcattgtttgttatattctgcctgattgccgctatcgttctgtatgtcacacctttccaggtggtggcccttctgactgggttttatgtgcttagacacccgaggttccgtcataggctcccttcggtcccgctgaatttcttccggaggttgcctgctcgtaccgactccatgttatgaggagttattcatgggtttgtcttatggactcgatgctcttgttcttattttagtttgtttagtcgtacttatggttatatatgtttgtgtaacctgtagaatctttgtccggatttgtttgctggttt

SEQ ID NO: 4646 - DNA, 2526 bp, Zostera marina
gtaggtcaaaatgatgcatcggcctcctataccacgggacgactatgcattgaagaaaaccacaccccatctgggtggaggaggtttgggtggtgataagccttccagcacatatgatctcgtcgagcaaatgcaatatctttatgtccgagttgtcaaagctaaagatctaccagccaaggacataacaggaagctgtgatccttacgttgaagtgaagcttggaaactacaagggaacaacacggtatttcgagaagaagaccaatcctgaatggagccaggtgtttgcattttctaaagatcggatccaggcaacggttgttgagattttagttaaggacaaagatctgttgaaagatgatttcatcggaagggttggattcgatctcagtgagatccctaaacgtgtacctcccgacagtccattggccccacaatggtatcgattagaagataggaagggagacaaacagaaaggagagctcatgcttgctgtatggatggggacacaggctgatgaggcttttcctgaagcttggcattcagatgctgctactattcctagtgatgggctaacaaatattagatcgaaggtatacctctcgccaaagctttggtatgttagagttaatattatcgaagcacaggatctgcaaccttctgataagggtagataccctgaggtttatgtgaaggttatgcttgggaaccaggctttgagaactcgtatatctcccagtcgaaacacgaatccaatgtggaatgaggatcttatgtttgttgcagcagagccttttgaagatcctttgattctaagtgtagaagacagagtggcgccgggaaaggatgatgtgttgggtaaaactgttatcagtttgcagaacgttgataggaggttggattacagagccgttggtagcaggtggtatacaattgagaggcatgttgttgtgatggagggtgagaagaagaaagagttaaagttctcaagtcggattcacttgaggatatgccttgatggtgggtaccatgttttggatgagtcgacacattacagtagtgatcttaggccaactgcaaagcagctatggaagccgagtatcggtgttcttgaattgggtattctgaccgctcaaggccttttgccgatgaagaccaaggatggacggggcacagctgatgcttactgcgttgctaaatatgggcagaagtgggtgcgtacaaggactatcatcgatagtttcacaccaaaatggaacgagcagtatacatgggaggtatacgatccatgcactgtagtgacagttggggtttttgataattgccatttacaaggtggtggcgataagtcagtcgtcgttgctagggattctagaatcggcaaggttaggatcagactttccacgctcgaaactgataaagtttacacacattcttacccattattggttctacatccctccggcgttaagaagatgggagaagtacaacttgccatcagatttacatgttcatctttgctaaacatgatgcaaatttattcacaacctttgcttccgaaaatgcactatctccaccctttgacggttacccaacttgatagcctcaggcatcaggccactcagattgtgtcaatgaggatgaaccgagcagagcctccattgagaaaggaggtggttgaatacatgttggacgtagattctcacatgtggagcatgcgaagaagcaaagcaaatttcttccgaatcatgggtctgattggtggaatgattgcagtgagcaaatggtttagtcagatatgcaactggaaaaatcccttgacaacaatactcatccacgttctatacgtgattctagtattgtacccggagttgatccttccaactctcttcttatacctgttcttgattggaatctggtacttccgatggagaccaagacagcctcctcacatggacacccgactttcacatgcagaaaatgtccatcctgacgaacttgatgaagaattcgatacctttccaacatcaagacctcctgaaatagtgagagacaggtacaaccgtctgagaaacgttgcaggcagaatacagactgttgtcggagatctagcaacgcaaggtgagagatttcagtctttgttaagctggagagatccaagagcaacatccttgttcgtcaccttctgtttggtggcagccattgttctctatgtcacacctttccgtgttgttgctcttctcttgggtttgtacacactgagacaccctagattccgaatgaagcttccttcggttccactcaacttcttccgaagattgcctgcaagaaccgacagcatgctgtaagttaactcctcctgtcgctcatcttttcaacgaacctcgttagttgtttcattgtgtatgtcttttatcatccatctatcatttatttgtttccaaactctgtctaggccactcattatccactactacttatttgatctgaattaatgctacactattctatatattaattatgc

SEQ ID NO: 4647 - DNA, 2597 bp, Zostera marina
aggtcaaaatgatgcatcggcctcctataccacgggacgactatgcattgaagaaaaccacaccccatctgggtggaggaggtttgggtggtgataagccttccagcacatatgatctcgtcgagcaaatgcaatatctttatgtccgagttgtcaaagctaaagatctaccagccaaggacataacaggaagctgtgatccttacgttgaagtgaagcttggaaactacaagggaacaacacggtatttcgagaagaagaccaatcctgaatggagccaggtgtttgcattttctaaagatcggatccaggcaacggttgttgagattttagttaaggacaaagatctgttgaaagatgatttcatcggaagggttggattcgatctcagtgagatccctaaacgtgtacctcccgacagtccattggccccacaatggtatcgattagaagataggaagggagacaaacagaaaggagagctcatgcttgctgtatggatggggacacaggctgatgaggcttttcctgaagcttggcattcagatgctgctactattcctagtgatgggctaacaaatattagatcgaaggtatacctctcgccaaagctttggtatgttagagttaatattatcgaagcacaggatctgcaaccttctgataagggtagataccctgaggtttatgtgaaggttatgcttgggaaccaggctttgagaactcgtatatctcccagtcgaaacacgaatccaatgtggaatgaggatcttatgtttgttgcagcagagccttttgaagatcctttgattctaagtgtagaagacagagtggcgccgggaaaggatgatgtgttgggtaaaactgttatcagtttgcagaacgttgataggaggttggattacagagccgttggtagcaggtggtatacaattgagaggcatgttgttgtgatggagggtgagaagaagaaagagttaaagttctcaagtcggattcacttgaggatatgccttgatggtgggtaccatgttttggatgagtcgacacattacagtagtgatcttaggccaactgcaaagcagctatggaagccgagtatcggtgttcttgaattgggtattctgaccgctcaaggccttttgccgatgaagaccaaggatggacggggcacagctgatgcttactgcgttgctaaatatgggcagaagtgggtgcgtacaaggactatcatcgatagtttcacaccaaaatggaacgagcagtatacatgggaggtatacgatccatgcactgtagtgacagttggggtttttgataattgccatttacaaggtggtggcgataagtcagtcgtcgttgctagggattctagaatcggcaaggttaggatcagactttccacgctcgaaactgataaagtttacacacattcttacccattattggttctacatccctccggcgttaagaagatgggagaagtacaacttgccatcagatttacatgttcatctttgctaaacatgatgcaaatttattcacaacctttgcttccgaaaatgcactatctccaccctttgacggttacccaacttgatagcctcaggcatcaggccactcagattgtgtcaatgaggatgaaccgagcagagcctccattgagaaaggaggtggttgaatacatgttggacgtagattctcacatgtggagcatgcgaagaagcaaagcaaatttcttccgaatcatgggtctgattggtggaatgattgcagtgagcaaatggtttagtcagatatgcaactggaaaaatcccttgacaacaatactcatccacgttctatacgtgattctagtattgtacccggagttgatccttccaactctcttcttatacctgttcttgattggaatctggtacttccgatggagaccaagacagcctcctcacatggacacccgactttcacatgcagaaaatgtccatcctgacgaacttgatgaagaattcgatacctttccaacatcaagacctcctgaaatagtgagagacaggtacaaccgtctgagaaacgttgcaggcagaatacagactgttgtcggagatctagcaacgcaaggtgagagatttcagtctttgttaagctggagagatccaagagcaacatccttgttcgtcaccttctgtttggtggcagccattgttctctatgtcacacctttccgtgttgttgctcttctcttgggtttgtacacactgagacaccctagattccgaatgaagcttccttcggttccactcaacttcttccgaagattgcctgcaagaaccgacagcatgctgtaagttaactcctcctgtcgctcatcttttcaacgaacctcgttagttgtttcattgtgtatgtcttttatcatccatctatcatttatttgtttccaaactctgtctaggccactcattatccactactacttatttgatctgaattaatgctacactattctatatattaattatgctttaaaacttgttctgcgaacaatcatttttaattttttttacatctaatttcaaattgaattgtttaaaatc

SEQ ID NO: 4648 - DNA, 2617 bp, Aquilegia formosa
gaaaaaatgcagaggcctcatccacctgaagatttttccttgaaggaaacctcccctcaccttggtgggggagggattagtggcgacaagttaacgagtacttatgatcttgttgagcaaatgcaatatttatatattcgtgttgttaaagcaaaagatttgccggcgaaagatgttacaggaagttgtgacccttatgtggaagtgaaacttggaaattataaaggaactactcgacattttgagaagaagactaatccggaatggaatcaggtttttgcattttcaaaagaaaggattcagtcatcatttattgaggttgtggtgaaagataaggatttagtgaaagatgattttattggtcgggttatgtttgacttgaatgagattcctaagcgtgttccaccagatagtcctttagccccgcagtggtatagattggaagatcgaaaaggggataagattaaaggagaactcatgttggcagtttggatgggaacacaagctgatgaggcttttcctgaagcatggcactcagatgctgcggcagttagcagtgatggtgtgtcaaacattcgctccaaggtttatctctcccccaagctctggtatgttagagtcaatggaagatacccagaagtatatgttaaagccatacatgggaaccaggctttgaggacaagaatatctcagagcaggagcatcaacccaatgtggaacgaggacttaatgtttgtagctgcagagccgtttgaggagcacttggttttgagtgttgaagatagagtcgcaccaaacaaggatgaagtcttggggaggtgtgtgattcccctgcagaatatgaatagaaggctagaccacaaagcggtcaatactaggtggttcaacctagagaagcatatagttgtagacggggagaagaaaaaagacactaaatttgctagtaggatacatttgagaatctgtctggatggtggatatcatgtacttgacgaatcaacacactacagcagtgatcttaggccaacagccaagcagttgtggaggtcaagcattggggttttggaattgggggttttgagtgctcaagggttgatgccgatgaagacgaaagatgggcgggggacaacagatgcatattgtgtagctaaatatgggcagaagtgggtcaggacgaggacaataattgatagctttgcgccaaaatggaacgaacaatacacttgggaggtgtatgatccgtgtactgtcattaccattggggtgtttgataactgccatctacatggtgcagataagaatggaggttcaaaggatgcaaggataggaaaggtgagaattcggttgtcgacactggaaactgatagggtttatacacattcgtatccgcttctggtgttacattcttcaggggtgaagaagatgggtgaaatacagttagctgtgcgctttacttgctcctctttgattaatatgttgcatatatattctcacccactgttgcctaaaatgcactaccttcatcctttgtctgtaactcaacttgatagcttgaggcatcaagccactcagattgtctcaatgaggctaagcagggctgaaccaccattgaggaaagaggttgtagaatacatgttagatgtggattctcatatgtggagtatgaggaggagcaaagcaaattttttcaggatcatgggagtcctgagtggtatgattgctgtttgcaagtggttcgatcagatatgccattggaaaaaccctcttacaacagttttgattcatgttttgtttttaatacttgtgctgtatccagagctgatattgccgacaatatttctttaccttttcttgattggagtttggtactatcggtggaggccaaggcaccctcctcacatggatactcagctgtcccatgctgataaagtacatccagatgaattggatgaagagtttgatacctttcctacctctcgtccatctgatatagtgaggatgagatacgatcgtctcaggagtgttgcaggaaggatacaaacagtggtaggtgacttagctacacaaggggagaggttgcagtctcttttgagctggcgtgatcctagggctactgctctgtttgtaatcttctgtttgattactgctattgtcctgtatgttacaccattccaagttgtggcacttctaactggattttatgtgttgaggcatccaaggttccgccacaaactcccttcggttccactaaatttcttcaggaggctgccagcaagaacagacagcatgttgtaggcagatagtctagagaaggttcatccggggatttctatgagcacaaaatagcctctgtaatctaataccaagatctctttactccccctgcaaaaatactgctgtgcaaacattacaaaagagggcggagcttgttttattctctcatgtttttattttaccatctattggtggctgatgttgggtcctgctgttcagatctgcctgcacaggtagaaattctcaatccatcgtatctctttatttcggaaatttctcttctaaagtttggttcctaccatcaattatgtttaattaatgtaaggtaatttcttggattttt

SEQ ID NO: 4649 - DNA, 3465 bp, Amborella trichopoda
tttttttttgttttggggttggttggctctcctaatggttttgtattctaaagcattcctctctgttgttgcaggtttgatgatctgagaaaatgcagggtttcctttaaattacctttggtgagtgaaacagagatctacggttgaaacttaaacttgtgaagcttttacccattttcaacctagggtttaccttcatccagtttttgtttcaggagtctagggtctttctccagtcactacgttgtcttctccgttctaggtttccttcaacctataaactacacggaaccgctcttttccactactctgtatctggaaactaggtttgaactttcaatcagttgcaccctgtaatcaaagttcacagttctctggaggctattctttttctggttactgctcagaaactgtaaacttttcgatatagcgaaaatgcagaggccgcttcaatcagaggactattccttaaaggagacatcaccccatctcggaggaggtggcgttcatggagataagctcacgagcacttatgatcttgtcgagcaaatgcagtacctctatgtcagggttgtaaaagccaaagacctccctacagatgttacaggaagttgtgatccctatgtggaggtgaagcttggaaactacaagggaacaaccaggcattttgaaaagaagacaaaccctgaatggaaccaggtatttgcattctctaaagaacgaatccaattctctgtgatcgaagtcactgtgaaagataaggacctggtaaaagatgattttattgggagagttacgtttgatctcaatgaaatccctaaaagagtcccccctgatagtccattggctccacagtggtataggcttgaggaccgaaagggagataaggctaaaggcgagcttatgctcgccgtttggatgggtacacaggctgacgaagcttttcctgaagcttggcactctgatgcagcaaccatacatggtgaaggtcttagtaatataagatcgaaggtttatttgtcacccaagctctggtatcttagagttaatgttatcgaagcccaagatttggtgcctagtgataaggctcggttccctgaagttcatgtcaaggttatgcttgggagccagggtatgaaaactagggtttctcagagcaggagcttgagcccactttggaatgaggatttgatgtttgttgctgctgaaccctttgaggaacacctggttattagtgttgaagataggattggacccaataaagatgagctaatgggtaagtgtgtgattccattgcaaagtgtagagaaaaggttcgatcataagcctgtcaattcgaggtggtataatctggagaagcatgccattacggagggggagaagaagaaggaggtcaagttcgcaagtaggattcatctgaggatctgtttggatggtggctatcatgttttggacgagtccactcattatagtagtgatttgaggcccactgctaagcaactttggaaacccagtattggggttcttgaattgggtattttgaatgctcaaggcctcttgcccatgaaaacaaaggatgggaggaacactactgatgcttattgtgttgccaaatatggctcaaagtggattcgaaccagaacgatcatagacagtttcactcccaaatggaatgagcaatacacatgggaagtttatgatccgtgtactgtggttacagttggggtttttgataattgccatttagctggggacaaagctaatggaaccaaggactcgagaattggtaaagttaggattcgactctctactctcgaaactgatcgggtttacacccattcttacccccttttggttttgcattcttctggggttaagaaaatgggtgaggttcaattagcagttcggtttgctcgctcgtctctgcttaatatgctgcatatctattcccaacctttgcttcctaaaatgcattatcttcaccccttatcagtgacgcagcttgatagcctgaggcaccaagctacccaaattgtttcgatgaggctgagtagggccgaaccctctttgaggaaagaggttgttgagtatatgctagattatgattctcatatgtggagtatgaggagaagcaaagcgaatttctttagaatcatgtcggttatgagtgggatgattgctgtagggaaatggttggacaaaatttgtaattggaagaatcccctaacaactatattggtacacatcctcttcctcattctggttctctaccctgaactcatactcccgaccatcttcctctacatgtttttgattggtatatggcactatcgatggaggccaaggcagcctccttacatggatactcgactctctcatgctgaaaatgttcaccctgatgaattggatgaggaatttgatacttttcccacttcgaggcattctgatatagtgaggatgaggtatgatagactgagaagtgtggctggaagaatacaaactgtagtgggggatatggccactcagggtgaaagattgcagtccttattgagctggagggacccaagggccactgccctgttcgttaccttctgttttctggcagcaattgttctttatgtgactccttttagagtggtggccattttaacagccttttatgtgttgaggcacccgagatttcgccacaagctcccctctgtgcctctgaacttctttaggaggctccctgcaaagactgatagcatgctatgagcatcacaagcatttggttggtcttggttctagtatacacctctttgacgcgagatctatttttcttctctctctcgaatttttagcgggttcttgtgaaagtttggaaggtgggtttcttcttactcgtttggatatggaggaggtttatatagtgacctgatggacttgtttactttgttagtctgtgttggtctcttgcttgctattgtgttcactcaattgggttgctgcttcagttgctggttataggaaaggaaacgggcagctgagcttttgtgtcctttgcagaccaatggttgatgctttgtcttgatctactgtataattgccccatcttatgttggtaggatattaactttgcagctttctttctttctttctctctttcttttttttccattcttaagactccttttctcaattgctcctgtttcttctgtctttgataatcaatggatgttgattccttggttttcctagctgttgctttgtcttgatcttctgtataattgccccctattatgttggtaggatatttactttgcagctttctctttttttccgtttttcgttcttagattccttttctcaattgctcatgtttcttctgtctttgataatcaatggatgttgattccttggttgtcctagctgtgtttcttcctcttttgatgcaaaaggtacgtcttaattcagtttatgcactgt

SEQ ID NO: 4650 - DNA, 2891 bp, Brassica rapa
aagtgagcacaaaagcttcctctttttctctctcactcctcttcaatgtctctctctctctctagaagaagttgccctttcctggtggtgcctatcctctgcctttactagtcgtctctctctagtcttttgcttattcaagatggagatttcatcgcctgcgtaaaatcgtttatagttaactcttcttctcatcccagagatctttctccgaagatctaagatctagtgtttttgaagtggagtagtagtagtagctgaaacacttaatctcttgtgttctggagcaagcatgatgcagagaccacctcctgaagatttctccttgaaggagacgagaccacatctcggcggtgggaaagtaactggggacaagctcaccagcacttatgacctcgttgagcagatgcagtatctctacgtccgcgtggtcaaagccaaggagttacccggtaaagacttaaccggtagctgcgacccttacgtggaggttaagctaggaaactacaaaggaaccacgcggcatttcgagaagaagtcaaaccctgagtggaaccaagtcttcgctttctccaaagacaggatccaagcttctttccttgaagctgctgttaaagacaaggacgttgtgaaagacgatttgattggtcgggtggtgtttgatctgaacgaggtgcctaagagagttcctcccgacagtcccttggcgcctcagtggtacaggcttgaagacaggaaaggagagaaagtcaagggagagctgatgcttgctgtttggttcggtacacaagctgatgaagctttccctgaagcttggcattcagacgctgcgacggttagtggaaccgacgctcttgccaacatccgctccaaggtttacctctctcccaaactttggtacctaagggttaacgtaatcgaagctcaagatctgataccgagtgacaaagggagataccctgaggtttacgtcaaagctatagtggggaaccaagcgcagaggacgagagtgtcacaaagcaggactattaaccccatgtggaatgaagacttgatgtttgtagcagctgagcccttcgaggagcctttgattttaagtgttgaagacagagttgctccgaacaaagacgaagtcttggggagatgcgcgatcccgttgcagtatctagacaggaggtttgaccacaggcctgtgaacaccaagtggtataacctcgagaagcatatcatggtcgatggagagaagaaagagatcaagttcgctagcaagattcacatgaggatatgtttggaaggaggataccacgttcttgatgagtctacgcattacagcagtgatcttagaccgacggctaagcagctctggaagcctaacatcggtgtgttggagctggggatacttaacgcgactggtctgatgcctatgaaggctaaagacggtcgtggaactacagatgcgtactgtgtggcgaagtatggacagaagtggattcgaacaaggactatcatcgacagctttacaccgaggtggaatgagcaatacacttgggaggtttttgatccgtgcacagttgttaccgttggggtctttgataactgccatctccatggaggtgagaagaacggtggaggaaaggattcaagagttggtaaggtgagaatccggctctctactctggaaactgatcgtgtctacacgcactcataccctctcttggtgcttcatcctaacggagtcaagaagatgggagagatccacttagctgtgaggttcacttgctcttcattactcaacatgatgcatatgtactcactccctctcttacctaagatgcattacatccatccattgacggttagccagcttgataacctgaggcaccaagcgactcagattgtgtcaatgaggcttacaagagcagagccgcctctaaggaaagaagtggttgagtacatgcttgatgttggctctcacatgtggagcatgaggagaagcaaagcgaacttcttcaggatcatgggggtgttgagcgggttgatagcagtggggaagtggtttgaacagatctgcaactggaagaatccaatcacaacggtgttgatccatctcctgttcatcatccttgtcctctaccctgagctcatcttgccgaccatcttcctctacctcttccttatcggtgtttggtactaccgttggagaccgaggcatcctccgcacatggacacgcgtctctctcacgctgactcagctcaccctgacgagctggacgaagagtttgatactttccctacttcgagaccctctgatattgtcaggatgaggtatgataggctgaggagtatcgctgggaggattcagactgtggttggtgatcttgcaactcaaggagaaaggcttcagtctctgctgagctggcgtgatccgcgtgcaactgcgctgtttgttctgttctgtttgattgctgcagttgttctctatgtgactccgtttcaggttgtggctcttttggttgggatctatgtgctgagacatccaaggtttaggtacaggctaccgtcagttcctctcaatttcttcaggaggcttcctgcaagaactgattgcatgctctgatgagctcaaagataaactgccacctctctctctctctctctctcccttggatcttccttctcatcttgaagaaacttcctctagaattgttaatttgttttttgttgaagtgtcatgaatctttatcttggtggttattatcatgtttcatttcgtttataacattatcaagacttttgtttgattgtagtaaatcaatatctgtgtgattttgatgttctttgttttggttagttagactatgcctctgtttgacaaaaaaaaagactgcctc

SEQ ID NO: 4651 - DNA, 3087 bp, Glycine max
tatcacacgtgtgagtaccgaccgaagtccttcacacgcgtgaggcgggtccaccgccactccaactccctgtacagcaaaagaggctcagccagcactgtgcaaaaagcaaagggagcaccttctctgtatattttgcatagattcattagatcctatccccacaccaccaacaccaacaaagaaagggaaaaagaaataccaaaacacaaaaagcaccctcctctcttctccttcccctttttctctcttcttcactctcacccttatctttttcttcaaatccagaaacaaaccatccccatttcatttcagaagaaacccttttctctccaaggctcctcggaaccgttgtgcttttttatttcttttaaagcacaactgttcctgcggtggaacattgaccatttgaaaatagttgtacaatagcttccattatttggaaaaaaaaaaaaaggggtcttctgattctttgaagcgagaagatgcagaggcctccaccagaagattttctgttaaaggagaccaaaccccaccttggagggggaaaggtctctggggacaagctcactagcacttatgacctagttgagcaaatgcagtatctctatgtgagggttgtgaaggctaaggacttgccagcaaaggatgtcactggcagttgtgacccttatactgaagtcaagctggggaactacaaaggcactactcggcacttcgagaagaagtctaatcctgaatggaatcaggtttttgctttctccaaagaccgcattcaggcctccatactggaagtcactgtgaaggacaaggatgtcgtgaaggatgacttcattggtcgtgtcttgtttgacctcaatgagatcccgaagcgtgttccaccggacagtcctttggcaccgcagtggtataggctggaagacagaaagggtgacaaagcgaagggggagctaatgctggctgtttggatgggtacacaagctgatgaggcgtttcccgaagcgtggcactcagatgctgcaacagttagcgggactgatgctcttgcaaacattagatcaaaggtatatctatctcctaagctttggtatttgagggttaatataatagaggcacaagacttgcagccaagtgataagggtagataccctgaagtttttgtgaaggctactctgggaaatcagaccttgaggactagaatctctcagagcaggaccatcaatccaatgtggaacgaggatttgatgtttgtggctgctgaaccatttgaggagcctctgattctgagtgtggaagacagagttgcacctaacaaagaggagtcgctggggaggtgtgcaattcctttgcagatggtggatcggagactggatcaaaagcctgttaatactaagtggtataatattgaaaagcacattgttattatggaaggggaaaagaagaaggaaatcaagttctcaagcaagattcatatgaggatctgtctggaaggcggttatcatgttttagacgaatcaactcattacagcagtgatcttcgcccaactgcgaaacagctgtggaagtccagtattggagttcttgaactgggtatattgagtgctcatggtttgatgccgatgaaaacaaaagatggtaaggggacaactgatgcttattgtgtagcgaaatatgggcagaagtgggtgcggacaaggacaatcattgacagctttgcaccccggtggaatgagcagtatacttgggaggtttttgatccttgcactgtcattacaattggtgtatttgataactgtcatttgcatggtggtgataagcctggaggctcaaaagattccaaaattgggaaggtaagaattcgtctttccacccttgagactgatcgtgtttatacacattcctatccacttctagttcttaatccaaatggggtgaagaaaatgggtgaaatccacttggctgtaaggtttacatgttcttctttgcttaatatgatgcacatgtattcactacctttgttgcctaagatgcattatattcacccactaactgttagccagcttgacaatttgaggcatcaagctactcagattgtttcgatgagactgagtcgtgctgagccacccttgagaaaggagatagtggaatatatgctggatgtgggttcccacatgtggagtatgagaagaagcaaggccaactttttcaggattatgggggttttgggtggattaattgctgtaggaaaatggtttgaccagatttgcaactggaaaaatccaatcacgacggtgctgatccatatcctgttcataatattggtcatgtaccctgagcttatcttacccacaatcttcctttacctctttttgattggagtttggtactacagatggagaccaaggcacccccctcacatggacactcgcctctctcatgcggattctgcgcaccctgatgaactagatgaagagttcgacacattcccaaccaccagggcttcggacattgtgaggatgcgatatgaccgacttagaagcattgctgggaggatacagactgtggttggtgatttggccactcaaggggagaggctgcagtctttgctcagctggagagatccaagagccactgccctctttgtgattttctgtctggttgctgcaattgtactgtatgtcaccccattccaaattgtggcccttttcactggaatttatgtgttgagacacccgaggttccgccacaagcttccttcagtgcctctgaatttcttccggaggctgcctgcaagaactgattgcatgctctgagtcatggatagtgcacaaactactgagggagcagcttgctttgctttcattgttcagcaccagattttgtggatttgcatttcattatgtcataggattttctgttttgaacttcatggttaaatttgtaattttgtaggctgagttgaaattaacttatgtttaatcgatttcatgtttaattagatgtagtaaagtttctcaatgggagtttgaactttaccccctcaaatggctattgattttgagcttaagtgattactgatttctgttc

SEQ ID NO: 4652 - DNA, 3121 bp, Glycine max
ccttcacacgcgtgaggcgggtccaccgccactccaactccctgtacagcaaaagaggctcagccagcactgtgcaaaaagcaaagggagcaccttctctgtatattttgcatagattcattagatcctatccccacaccaccaacaccaacaaagaaagggaaaaagaaataccaaaacacaaaaagcaccctcctctcttctccttcccctttttctctcttcttcactctcacccttatctttttcttcaaatccagaaacaaaccatccccatttcatttcagaagaaacccttttctctccaaggctcctcggaaccgttgtgcttttttatttcttttaaagcacaactgttcctgcggtggaacattgaccatttgaaaatagttgtacaatagcttccattatttggaaaaaaaaaaaaaggggtcttctgattctttgaagcgagaagatgcagaggcctccaccagaagattttctgttaaaggagaccaaaccccaccttggagggggaaaggtctctggggacaagctcactagcacttatgacctagttgagcaaatgcagtatctctatgtgagggttgtgaaggctaaggacttgccagcaaaggatgtcactggcagttgtgacccttatactgaagtcaagctggggaactacaaaggcactactcggcacttcgagaagaagtctaatcctgaatggaatcaggtttttgctttctccaaagaccgcattcaggcctccatactggaagtcactgtgaaggacaaggatgtcgtgaaggatgacttcattggtcgtgtcttgtttgacctcaatgagatcccgaagcgtgttccaccggacagtcctttggcaccgcagtggtataggctggaagacagaaagggtgacaaagcgaagggggagctaatgctggctgtttggatgggtacacaagctgatgaggcgtttcccgaagcgtggcactcagatgctgcaacagttagcgggactgatgctcttgcaaacattagatcaaaggtatatctatctcctaagctttggtatttgagggttaatataatagaggcacaagacttgcagccaagtgataagggtagataccctgaagtttttgtgaaggctactctgggaaatcagaccttgaggactagaatctctcagagcaggaccatcaatccaatgtggaacgaggatttgatgtttgtggctgctgaaccatttgaggagcctctgattctgagtgtggaagacagagttgcacctaacaaagaggagtcgctggggaggtgtgcaattcctttgcagatggtggatcggagactggatcaaaagcctgttaatactaagtggtataatattgaaaagcacattgttattatggaaggggaaaagaagaaggaaatcaagttctcaagcaagattcatatgaggatctgtctggaaggcggttatcatgttttagacgaatcaactcattacagcagtgatcttcgcccaactgcgaaacagctgtggaagtccagtattggagttcttgaactgggtatattgagtgctcatggtttgatgccgatgaaaacaaaagatggtaaggggacaactgatgcttattgtgtagcgaaatatgggcagaagtgggtgcggacaaggacaatcattgacagctttgcaccccggtggaatgagcagtatacttgggaggtttttgatccttgcactgtcattacaattggtgtatttgataactgtcatttgcatggtggtgataagcctggaggctcaaaagattccaaaattgggaaggtaagaattcgtctttccacccttgagactgatcgtgtttatacacattcctatccacttctagttcttaatccaaatggggtgaagaaaatgggtgaaatccacttggctgtaaggtttacatgttcttctttgcttaatatgatgcacatgtattcactacctttgttgcctaagatgcattatattcacccactaactgttagccagcttgacaatttgaggcatcaagctactcagattgtttcgatgagactgagtcgtgctgagccacccttgagaaaggagatagtggaatatatgctggatgtgggttcccacatgtggagtatgagaagaagcaaggccaactttttcaggattatgggggttttgggtggattaattgctgtaggaaaatggtttgaccagatttgcaactggaaaaatccaatcacgacggtgctgatccatatcctgttcataatattggtcatgtaccctgagcttatcttacccacaatcttcctttacctctttttgattggagtttggtactacagatggagaccaaggcacccccctcacatggacactcgcctctctcatgcggattctgcgcaccctgatgaactagatgaagagttcgacacattcccaaccaccagggcttcggacattgtgaggatgcgatatgaccgacttagaagcattgctgggaggatacagactgtggttggtgatttggccactcaaggggagaggctgcagtctttgctcagctggagagatccaagagccactgccctctttgtgattttctgtctggttgctgcaattgtactgtatgtcaccccattccaaattgtggcccttttcactggaatttatgtgttgagacacccgaggttccgccacaagcttccttcagtgcctctgaatttcttccggaggctgcctgcaagaactgattgcatgctctgagtcatggatagtgcacaaactactgagggagcagcttgctttgctttcattgttcagcaccagattttgtggatttgcatttcattatgtcataggattttctgttttgaacttcatggttaaatttgtaattttgtaggctgagttgaaattaacttatgtttaatcgatttcatgtttaattagatgtagtaaagtttctcaatgggagtttgaactttaccccctcaaatggctattgattttgagcttaagtgattactgatttctgttccccttcgccttttctccctccccttaactaagttttctgaagttgctgattcataaaaggta

SEQ ID NO: 4653 - DNA, 2680 bp, Eutrema parvulum
taggaactttgtgtagtgtcttctcaagctagcaagatgcagagaccacctcctgaagatttctccttgaaggagacaagacctcatctcggtgggggaaaagtcactggggataagcttaccagcacttatgaccttgttgagcaaatgcagtatctgtatgttcgtgtggtgaaggcaaaggagttgcctgggaaggacttgactggtagttgtgacccttatgttgaggtgaagcttggaaactacagaggaaccacaagacatttcgagaagaaatcgaatcccgagtggaaccaagttttcgccttctcgaaagataggattcaagcttctttccttgaagctactgtgaaggataaggatgttgtgaaagacgatttgattggtcgggttgtgtttgatttgaatgaggtacctaagagagttcctcctgacagtcccttggcgcctcagtggtatagactcgaggatcggaaaggagagaaagtcaggggggagctgatgctggctgtttggtttggcactcaagctgatgaagctttccctgaagcttggcactcagatgctgcaacagtcagtggaactgatgctcttgccaacattcggtctaaggtgtatctctctcctaagctttggtacctaagggttaatgtaatcgaagcacaagatttgataccgagcgacaaagggagatatcctgaggtttatgtgaaagctatagtgggaaatcaagcgttgaggactagagtatcacaaagcaggactattaatccgatgtggaatgaagatttgatgtttgtagcggctgagccgtttgaggaacctttgattctcagtgtggaagacaaagttgctccaaacaaagatgaagtcttgggtagatgtgcaatcccgttgcagtatttggatagaaggtttgaccacaaaccggtgaacagcaggtggcataacctcgagaagcatatcatggtcgatggagagaagaaggagaccaaattcgctagcaagattcacatgaggatttgtctggaaggcgggtatcatgttcttgatgagtctacacattacagtagtgatcttagaccaacagctaagcaactatggaagcctaacatcggtgtgttggaactgggaatactaagtgctaacggtctaatgcctatgaaagctaaagatggtcggggaaccacagatgcatattgtgtagcaaagtacggacagaaatggattcgaactcggacaatcattgacagctttacccctagatggaacgagcaatacacttgggaggttttcgatccatgtacggttgttactgttggagtttttgataactgccatctccatggaggtgagaagaacgggggagcaaaagattcaagagttgggaaggtgaggatccggctctctactctcgagactgatcgagtctacacacattcgtacccgcttttggtcctacatcctaatggagtcaagaaaatgggagaaattcatttggctgtgagattcacttgctcgtcattgctcaacatgatgtatatgtactcactgccgctgttaccaaagatgcattacatccatcctctaacggttagccagcttgataatttgaggcatcaagcgactcagattgtgtcaatgaggcttacccgagcagagccacctctgaggaaagaagtagttgagtatatgcttgatgtgggttctcacatgtggagtatgcggagaagcaaagcaaactttttcaggattatgggagttttgagcgggttgatcgcagtgggaaaatggtttgaacagatctgtgtctggaagaatccaatcacaacaatcttgatccatctcttgttcatcatccttgtgctctatcctgagctaatcttgcccaccatctttctctacctcttccttatcggtgtatggtattaccgttggagaccgaggcatcctccacacatggacacacgtctctctcacgcagactcagcccaccctgatgagctggacgaagagttcgacacttttcctacttcccgaccgtctgacattatcaggatgaggtatgacaggttgaggagtattgctgggaggattcagacagtggttggggatcttgcaactcaaggagagaggctgcagtctttgctaagctggcgtgatccgcgtgcaaccgcgctctttgtcttgttctgcttgattgctgcagttgttctctatgtgacaccttttcaggttgtggctcttctcgttggaatctatgttctgagacatccgaggtttagatacaggctaccatcagttcctctcaatttcttcaggagacttccagcaagaactgattgcatgctttgagctcaaacaaaaacaaaaatgtctgtactctctttccctcggatcttccttcccatctcaaagaaatttctccagacttgttaatttgttcttagttgactctttttcttggtgatgattatgatgtcttcgtttggtttttaacattatcaagactttttgtttgaaaagagcaaagcagtatcatctgtgtggtttagttgtcgtcgtctctgactctgttttttcttgttaacactgaacagtctttgaagtttggttgcgatggtgacctgtgtggttgttaatggtttggtcctttggtcaacatagtaattacaag

SEQ ID NO: 4654 - DNA, 3113 bp, Musa acuminata
ggggtgcgccagcctctgctgcgcttgtcccttcctttttcgtgtctcccaccaccctctcttgtggattcagatctctttcttggtctcacccactgagccactgaaaagagattagacaccgagggagtgagcgagagagtgtgatcagtaaatgtaatggagccgaaccttccatttacatcatcgagatgaggaggatcggcgagtcggtctcttctacgccttctggttgcatctgaggtcctccaacctcctcctcctcctcctcctctgtcttcccctcccttgtattttccgtcagttttagaagatgcagaggccattcccgctgcctcaggaggacttctccttgaaggagacagccccccgccttggtggcggaggacttggtggcggcgataagctcaccaacacgtatgacctcgttgagcagatgcagtacctctatgttcgtgttgtgaaagccaaggatctaccagctaaggatgttacgggaagctgtgatccctatgtggaggtaaaacttggtaactacaaaggcaccactcgccatttcgagaagaagacgaatcctgaatggaaccaagtgtttgctttctcaaaagatcggatccaagcttctgtggtggaggtcgtggtcaaggacaaggatttcgtgaaggatgatttcatgggaatggttttgtttgatctgaatgagattccgaaaagagttccgccagatagcccgttggcaccacagtggtacagattggaagatcgcaagggggagaaggtaaagggagagctgatgctagctgtttggatgggtacacaggcggatgaggcgttcccggatgcgtggcactctgatgctgcaacagttcccggtgatggccttgcaaacatcagatcgaaggtatacctctctcccaagctttggtatgtgagagttaacatcatcgaagcccaagatttgctgctcaatgcaaagccaggattcccagaagtctttgttaaagctactattggcaatcaaacacttaggaccaggatttcaccaagcaggtgcccgaaccctttgtggaatgaggatttgatgtttgttgtagcagaaccattcgaagaacatttgatcctaagtgtagaagagagaatcgggcctaacaaggacgaggtgttggggaaggctgttattcatctgcagaaggtggagcggaggtttgactgtaggataatcaattcaaggtggtatcacctggagaagcatgtggcagctgatggtgagcagaagaaggaggtgaaatttgctagtcgaattcatctaaggttatgtttggatggtggataccatgttttggatgagtccacccactatagcagtgatcttaggcccactgcgaaacaactgtggaagccaagcattggtatcctagagctaggtatattgactgcccagggattgctcccgatgaagactaaggatgggcgtggaactactgatgcgtattgtgtagctaaatatgggcagaaatgggttcgtactagaacgatcattgacagttttagtccgaaatggaatgagcaatacacttgggaggtatatgacccatgtactgtaatcacagttggtgtgttcgacaactgccacttacagggtggagacaaggcaaatggtgcaaaagataacagaattggcaaggtacgaattcgactttctacgctagagactgataaagtctacacacattcgtacccccttctggttttgcatacaacaggggttaagaagatgggagaagttcacttggctgttcgattctcctgttcctctctgcttaatatgctgcatacttattctaggccactgctgccaaagatgcattacctacatcctttgactgttacccagcttgactacttgaggcaccagtccactcagatagtgtcaaccaggttgggtcgtgcagagccgccgctgagaaaggaggttgtggagtatatgttggatgtcggctcccatatgtggagcatgaggaggagcaaagctaatttctttcgaattattaatgttttgagtggtttgattgcgaccggaagatggtttggccagatatgcctttggaagaaccccataacgaccgtacttatacatgttctctacgtaatactggttctatatccggaactgatacttccaacaatgttcctctacttgtttctgattggagtatggtactaccgatggcggccaaggaagcctcctcacatggacactcgactatcacatgcagacactgcccatcctgatgagcttgacgaggaattcgatacatttcctacatcgagaccacctgaaattgtgaggatgaggtacgatcgattaaggagcgttgctggaagggtgcaaactgtggttggagacctggctacacagggggagagatttcagtccctgttgagctggcgagatccaagagcgactgctctctttttgatcttttgccttgctgctgccattgtgctctatgtaacgccattccaggttgtcgccctcctcacaggcttttacgtgctgaggcacccaaggttccggcacaggcttccctcagtaccgctcaacttcttcaggaggttgccagcaaggaccgatagcatgttatgagaagctttttgtttggagaacttgttcgcccctgagacaatgtagtggcaaagctattgaaacccgagtcttcatcagaaagcaagagcgaggatcagtattttggtcgatcgtcaactcatgctatggtgttcctccaactctacctgtgtcgatcagtcttcatgttatgcatttctttcttctcttatttgttttctattgctttgtgagatctagttatggtttgaactggtcgctaatgatgtattgttaccgtgattagaagctgttgagtcactgattaaggcctcaaatcctattgtgtctgaacgagttttttgtctttcatggtctcttatcttcttggtgatggttaggataaatccttccaggtcgtttgtaatcttgttcaaatcgttgtttattggacaacatctgcttgctgtagagtgcattgttatcgacagaaagatgtgagcctcaa

SEQ ID NO: 4655 - DNA, 2764 bp, Medicago truncatula
aggccccttggaacggttcatttttaattcaaaaacacattttcaagctccaaccaccagtgaagaaaaaaaaaattcaatatttgagattgttgcttctgtgattctttgaaacaacaagatgcagaggcctccacctgaagattttctgttgaaagagaccaaaccccaccttggtggtaaggtctctggagacaagcttacaagtacctatgaccttgttgagcaaatgcagtatctttatgttagggttgtgaaggctaaggagctaccttcgaaagatgttactggaagttgtgacccttatgttgaagtcaagcttggtaactacaaaggaaccacgaggcattttgagaagaagactaatcctgaatggaatcaggttttcgctttttcgaaggatcggattcaggcttcggttcttgaggtttttgtgaaagataaggattttgtaaaagatgattttattggtcgtgtttggtttgatctcaatgagattccaaagagggttcctcctgatagtcctctggcgccacagtggtatagattggaggataggaagagtgataaggtgaaaggggagttgatgctggctgtttggatgggtactcaagctgatgaagcttttcctgaggcgtggcactcagatgcggcgacggttagtgggactgatgctcttgcaaatattaggtctaaggtgtatctatctcctaagctttggtatttgagggttaatgtgatcgaggcacaggacttacagccgtctgacaagggaagattcccagaggtttatgtgaaggctattttgggaaatcagaccttgaggacaagaatttctcagagcaggagtatcaatccgatgtggaatgaagatttgatgtttgtagctgcggaaccgtttgaggagccgctgattttgagtgtggaagacagggttgcgcctaacaaagaggaactgctagggaagtgtgttattcccttacagatgatggaccggagactcgatcacaaacctgtgaacactaggtggttcaacattgaaaagcatgttgttatcatggaaggggacaagaagaaggaaatcaagtttgcaagcaggattcatatgagggtctgtctagaaggtggttatcatgttttggatgaatcaactcactacagtagtgatcttcgccctacggcgaaacagctgtggaagtcaagtattggagttcttgaagttgggatattgaatgcttcgggtttgatgccgatgaaatcaaataatgggagggggactaccgatgcttattgtgtagcaaaatatggacagaaatgggtgcgtacaagaaccatcatcgatagctttgcaccgaggtggaatgagcagtatacttgggaggtttttgatccgtgcactgtcattacaattggtgtattcgataactgtcacttgcaccatggtggtgataagcctggaggacaaagagattctaaaatcggcaaggtaagaatccgtctttccacactcgagactgatcgagtctacacacattcctatccacttctagttcttcatccaactggggtgaagaaaatgggagaaattcaactggctgtaaggtttacttgctcttctttgctcaacatgatgcacatgtattcaaatccattgctgcccaagatgcattacattcacccattaaccgtcagccagctcgacagtctgaggcatcaagctactcagattgtttccatgagacttagccgtgctgagccgccactgagaaaggaggtagtggaatatatgctagatgtcggttcccacatgtggagtatgagaagaagcaaagccaattttttcagaatcatgggggttttgagtggattaattgctgttggaaagtggtttgaccaaatctgcaattggaaaaaccctatcacaacagttctaattcatatcttatttataatacttgtcatgtaccctgaacttatcttaccaacaattttcctttacctctttttgattggagtttggtactatagatggaggccaaggcacccacctcacatggacacacgtctctcccatgctgattccgcacaccctgacgaactagatgaagagttcgacacatttccaaccacaagaccttctgacatcgtgaggatgcgatacgatcgtcttagaagtatcgccggtaggatacaaactgttgttggggatttggcgactcaaggagaaagactgcagtctttgctgagctggagagatccaagagctactgcactttttgtgctattctgtttgattgctgctattgtactttatgtgactccatttcaagttgtggctcttctcagtggaatttatgtgttgagacatccaaggtttcgtcacaagcttccttctgtgccgctcaatttcttcaggaggttgcctgcaagaactgattgcatgctttgaacaaagttggacttgcttggattggaatgtgcattaaaacacaagtggagcttttggttgttttgttttcattattcattcacccaccagattttgtggatttttagtttcaattatgtcttagaatatttatattttcgaacttatggtagtccttgttaaaatttgtaattttgtagggtgagttaaaattatttgtctttagtcaacttcctgtttaatttaattagatgcagttaagaactttcccaatggaaatctgggtcaaaggtaattttctttattatattactatgaacatcatatcattgtttc

SEQ ID NO: 4656 - DNA, 2960 bp, Glycine max
aaagaaagaaaaggaaaaagaaataccaaaacacaaaaagcaccctctccttcctctcctccccctttctttttctctcttcactctcacccttatctcctccattgcagcttctgctttttcttcaaatcaacaaacaaacaaaaccatccccatttcatttcagaagaaacccttttctttcccaaggctcctgaaccgttgtgctttttttttttttttaatttcttttaaagcacaactgtttcttcctacggtggaacattgaccatttgaaatagttgtgcaacagcttccattatttggaagaaaaaaaaagggtcttttgattctttgaagcgagaagatgcagaggcctccaccagaagattttctgttgaaggagaccaaaccccaccttggagggggaaaagtctctggcgacaagctcactagcacttatgacctagtcgagcaaatgcagtatctctatgtgagggttgtgaaagctaaggacttacctgcaaaggatgtcactggcagttgtgacccttatactgaagtcaagctggggaactacaaaggcaccactcggcacttcgacaagaagtctaatcccgaatggaaccaggtttttgctttctccaaagaccgcattcaggcttccatactggaggtcactgtgaaggacaaggatgtcgtgaaagatgacttcattggtcgtgtcttatttgacctcaatgagatcccaaagcgtgttccaccagacagtcccttggcaccgcagtggtataggctggaggacagaaagggtgacaaggcgaagggggagctgatgctggctgtttggatgggtacacaagctgatgaggcgtttcccgaagcgtggcactcggatgctgcaaccgttagcgggactgatgctcttgcaaacattagatcaaaggtatatctatctcctaagctttggtatttgagggttaatataatagaggcgcaagacttgcagccaagtgataagggtagataccctgaagtttttgtgaaggctgctctgggaaatcagaccttgaggactagaatctctcagagcaggactatcaatccaatgtggaatgaggatttgatgtttgtggctgctgagccgtttgaagagcctctgactctgagtgtggaagacagagttgcacctaacaaagaggagtcgctggggaagtgtgcaattcctttgcagatggtggatcggagactggatcaaaagcctgtgaatactaagtggtataatattgaaaagtacattgttattatggaaggggaaaagaagaaggaaatcaagttttcaagcaagattcatatgaggatctgtctggaaggcggttatcatgttttggacgaatcaactcactacagcagtgatcttcgtccaactgcgaagcagctgtggaagtccagtattggagtccttgaattgggtatattgaatgctcagggtttgatgccaatgaaaacaaaagatggtaaggggactactgatgcttattgtgtagcgaaatatgggcagaaatgggtgcgaacaaggacaatcattgatagctttgcaccccggtggaatgaacagtatacttgggaggtttttgatccttgcactgtcattacaattggtgtatttgataactgtcatttgcatggtggtgataagcctggaggggcaaaagattccaaaattgggaaggtaagaattcgtctttctaccctcgagactgaccgtgtctatacacattcctatccacttctagttcttcatccaaatggtgtgaagaaaatgggtgaaatccacttggctgttaggtttacttgttcttctttgcttaatatgatgcacatgtattcactacctttgttgccaaagatgcattatattcacccactaactgtcagccagcttgataatctgaggcatcaagctactcagattgtttcaatgagactgagtcgtgccgagccaccgctgagaaaggagatagtggaatatatgctagatgtgggttcccacatgtggagtatgagaagaagcaaggcgaactttttcaggattatgggagttttgggtggattaattgctgtaggaaaatggtttgaccagatttgcaactggaaaaatccaatcacaacagttctgatccatatcctgttcataatattggtcatgtaccctgagcttatcttaccaacaatcttcctttacctcttcttgatcggagtttggtactacagatggaggccaaggcacccacctcacatggacactcgcctctcccatgcagattctgcgcatcctgatgaactggatgaagagtttgacacattcccaaccaccaggccttcagacatcgtgaggatgcgatacgaccgacttagaagcattgctgggaggatacagactgtggttggtgatttggccactcaaggggagaggctgcagtctttgctcagctggagagatccaagagccactgccctctttgtgattttctgtctggttgctgccattgtactctatgtcactcctttccaaattgtcgcacttttcactggaatctatgtgttgagacacccgaggttccgccacaagcttccttcggtgcctctgaatttcttcaggaggctgcctgcaagaactgattgcatgctttgagtcatggatagtgcacaaactacaaaaggagcagcttgctttgctttcattgttcagcaccagattttgtggatttgcattttcattatgtcataggattttctgttttgaatttcatggtttaatttgtaattttgtaggctgtgagttgaaattaagttatgttttaatcaatttcatctttaattagatgtagtaaagtttctcaatgggagtttgaactttaccccccaacaatggctattgatattgagcttaagtgattactgaattctgattttttctg

SEQ ID NO: 4657 - DNA, 3096 bp, Glycine max
aaggggcaccttctctgtatattttgcatagattcattagatcctagccccacaccaccaacaccaacaaagaaagaaaaggaaaaagaaataccaaaacacaaaaagcaccctctccttcctctcctccccctttctttttctctcttcactctcacccttatctcctccattgcagcttctgctttttcttcaaatcaacaaacaaacaaaaccatccccatttcatttcagaagaaacccttttctttcccaaggctcctgaaccgttgtgctttttttttttttttaatttcttttaaagcacaactgtttcttcctacggtggaacattgaccatttgaaatagttgtgcaacagcttccattatttggaagaaaaaaaaagggtcttttgattctttgaagcgagaagatgcagaggcctccaccagaagattttctgttgaaggagaccaaaccccaccttggagggggaaaagtctctggcgacaagctcactagcacttatgacctagtcgagcaaatgcagtatctctatgtgagggttgtgaaagctaaggacttacctgcaaaggatgtcactggcagttgtgacccttatactgaagtcaagctggggaactacaaaggcaccactcggcacttcgacaagaagtctaatcccgaatggaaccaggtttttgctttctccaaagaccgcattcaggcttccatactggaggtcactgtgaaggacaaggatgtcgtgaaagatgacttcattggtcgtgtcttatttgacctcaatgagatcccaaagcgtgttccaccagacagtcccttggcaccgcagtggtataggctggaggacagaaagggtgacaaggcgaagggggagctgatgctggctgtttggatgggtacacaagctgatgaggcgtttcccgaagcgtggcactcggatgctgcaaccgttagcgggactgatgctcttgcaaacattagatcaaaggtatatctatctcctaagctttggtatttgagggttaatataatagaggcgcaagacttgcagccaagtgataagggtagataccctgaagtttttgtgaaggctgctctgggaaatcagaccttgaggactagaatctctcagagcaggactatcaatccaatgtggaatgaggatttgatgtttgtggctgctgagccgtttgaagagcctctgactctgagtgtggaagacagagttgcacctaacaaagaggagtcgctggggaagtgtgcaattcctttgcagatggtggatcggagactggatcaaaagcctgtgaatactaagtggtataatattgaaaagtacattgttattatggaaggggaaaagaagaaggaaatcaagttttcaagcaagattcatatgaggatctgtctggaaggcggttatcatgttttggacgaatcaactcactacagcagtgatcttcgtccaactgcgaagcagctgtggaagtccagtattggagtccttgaattgggtatattgaatgctcagggtttgatgccaatgaaaacaaaagatggtaaggggactactgatgcttattgtgtagcgaaatatgggcagaaatgggtgcgaacaaggacaatcattgatagctttgcaccccggtggaatgaacagtatacttgggaggtttttgatccttgcactgtcattacaattggtgtatttgataactgtcatttgcatggtggtgataagcctggaggggcaaaagattccaaaattgggaaggtaagaattcgtctttctaccctcgagactgaccgtgtctatacacattcctatccacttctagttcttcatccaaatggtgtgaagaaaatgggtgaaatccacttggctgttaggtttacttgttcttctttgcttaatatgatgcacatgtattcactacctttgttgccaaagatgcattatattcacccactaactgtcagccagcttgataatctgaggcatcaagctactcagattgtttcaatgagactgagtcgtgccgagccaccgctgagaaaggagatagtggaatatatgctagatgtgggttcccacatgtggagtatgagaagaagcaaggcgaactttttcaggattatgggagttttgggtggattaattgctgtaggaaaatggtttgaccagatttgcaactggaaaaatccaatcacaacagttctgatccatatcctgttcataatattggtcatgtaccctgagcttatcttaccaacaatcttcctttacctcttcttgatcggagtttggtactacagatggaggccaaggcacccacctcacatggacactcgcctctcccatgcagattctgcgcatcctgatgaactggatgaagagtttgacacattcccaaccaccaggccttcagacatcgtgaggatgcgatacgaccgacttagaagcattgctgggaggatacagactgtggttggtgatttggccactcaaggggagaggctgcagtctttgctcagctggagagatccaagagccactgccctctttgtgattttctgtctggttgctgccattgtactctatgtcactcctttccaaattgtcgcacttttcactggaatctatgtgttgagacacccgaggttccgccacaagcttccttcggtgcctctgaatttcttcaggaggctgcctgcaagaactgattgcatgctttgagtcatggatagtgcacaaactacaaaaggagcagcttgctttgctttcattgttcagcaccagattttgtggatttgcattttcattatgtcataggattttctgttttgaatttcatggtttaatttgtaattttgtaggctgtgagttgaaattaagttatgttttaatcaatttcatctttaattagatgtagtaaagtttctcaatgggagtttgaactttaccccccaacaatggctattgatattgagcttaagtgattactgaattctgattttttctgtttcccttccccttttctcctccccctccactaagctttttgaagttgctgattcataaaaggggaag

SEQ ID NO: 4658 - DNA, 2866 bp, Cicer arietinum
cagcactatgcaaaaaggaaaagtagaaaccttctttgtatattttccatagattcatcagatcccaccaacttaaccaaaactactcctactacttacactcttcttttccttcttcatcattctctacctcccttccttcttctaaagattaaacattcccatttcactccaaggctccttggaaccgttccttttttattcataacaaacactctttcaagttccttccacttgtgaacaaacattcaatatttgaaattgttccttccacttgtgaacaaaacattcttattacttggaactcttttgagtctttgaaccgagaagatgcagaggccaccgccagaagattttctgttgaaagagacaaaaccccaccttggaggtggtaaggtctctggtgacaagcttacgagtacatatgaccttgttgagcaaatgcagtatctttatgtgagggttgtgaaagctaaggaacttccttcgaaggatgttaccggaagttgtgacccttacgttgaagtcaagcttggaaactacaaaggtaccactaggcattttgagaagaaaactaatccggaatggagtcaggtttttgctttctcgaaagacaggattcaggcttcggtgcttgaggttactgtgaaagataaggatgttgtgaaggacgattttattggtcgtgtttggtttgacctcaacgaggttccgaagagggttcctccagatagtcctcttgcaccgcagtggtatagattggaggacagaaagggtgataaggcgaaaggggagcttatgctggctgtttggatgggtacgcaagctgatgaagcgttccctgaggcgtggcactcggatgcggcgacggttagtgggactgatgctcttgctaacattaggtcgaaggtgtatttgtctcctaagctttggtatttgagggttaatgttatagaggcacaggacttgcagccatcggataagggaaggttcccggaggtttatgtgaaggctattttgggaattcagaccttgaggactagaatctctcagagcaggagtatcaatccaatgtggaacgaggatttgatgtttgttgctgcggaaccgtttgaggagccgctcattttgagtgtggaagatagggttgctcctaacaaagaggaactactggggaagtgtgttattcctttacagataatggataggagactagatcacaagcctgtgaacactcggtggttcaatattgaaaagcatgttgttattatggaaggtgataagaagaaggaaataaagtttgctagccggattcatatgagggtctgtttggaaggtggttatcatgttttggatgaatcgactcaccacagcagtgatcttcgcccaacagcaaaacagctctggaagtccagtattggagttcttgaagtggggatattgagtgctcagggtttgatgcccatgaaaacaagtaacgggagggggacaacggatgcgtattgtgtagctaagtacgggcagaagtgggtgcggacgagaaccatcatcgatagctttgcgccgaggtggaatgagcagtatacttgggaggtttttgatccatgcaccgtcattacaataggtgtatttgataattgtcatttgcacggtggcggtgataagcctggaggacaaaaagattcgaaaattggaaaggtaagaatccgtctttcaacacttgagacagatcgagtctatacacattcgtatccacttctagttcttcatccaactggggtgaagaaaatgggagaaattcaattggctgtaaggtttacttgctcttctttgctaaacatgatgcacatgtattcaaatccattgttgcctaagatgcattacattcacccgttaactgtcagccagcttgacaatctgaggcatcaagccactcagattgtttcaatgaggctgagtcgcgctgagccgccgctgagaaaggaggttgttgaatatatgctggatgttggttcccacatgtggagtatgagaagaagcaaagccaactttttcagaatcatgggagttttgagtggaatagttgcggttggaaaatggtttgaccagatttgccattggaaaaaccctatcacaacaattctgattcatatcttgtttgtaatacttgttatgtatcctgagcttatcttaccaactattttcctttacctctttttgattggaatttggtactatagatggaggccaaggcaccctcctcacatggacacacgactctcccacgcggattccgctcaccctgatgaactagacgaagaattcgacacatttccaactacaagaccttctgatattgtgaggatgcgatacgatcggcttagaagtattgctgggaggatacaaactgtggtgggtgatttggcaactcaaggtgaaaggctgcagtctttgctgagctggagagatccaagagctactgccttgtttgtgcttttctgtttgattgctgctattgtactttatgtaactccattccaagttgtggcgcttctcaccggaatttatgtgttgcgacatccgaggtttcgtcacaagcttccttcagtgccgctaaatttcttccggaggttgcctgcaagaactgattgcatgctttgagaatcgaactcttttgcattttgatggaaggcttgagtggaatgtgcagaaaagaaaacaaatggagcttggtttgttatttttatatcattgttcaccaccatattttgtggatttgtagtttcacttattattatgtcatagtagaattttctgttttgaacttatggtagtccattgttaaaatttgtaattttgtagggtg

SEQ ID NO: 4659 - DNA, 3146 bp, Cicer arietinum
cgtgtgagtagcgaccgaagaagagttcacacgcgtgaagtgggtccacatctccattcctccgctccaccaccctgtacagcaacagaggtccagtccagcactatgcaaaaaggaaaagtagaaaccttctttgtatattttccatagattcatcagatcccaccaacttaaccaaaactactcctactacttacactcttcttttccttcttcatcattctctacctcccttccttcttctaaagattaaacattcccatttcactccaaggctccttggaaccgttccttttttattcataacaaacactctttcaagttccttccacttgtgaacaaacattcaatatttgaaattgttccttccacttgtgaacaaaacattcttattacttggaactcttttgagtctttgaaccgagaagatgcagaggccaccgccagaagattttctgttgaaagagacaaaaccccaccttggaggtggtaaggtctctggtgacaagcttacgagtacatatgaccttgttgagcaaatgcagtatctttatgtgagggttgtgaaagctaaggaacttccttcgaaggatgttaccggaagttgtgacccttacgttgaagtcaagcttggaaactacaaaggtaccactaggcattttgagaagaaaactaatccggaatggagtcaggtttttgctttctcgaaagacaggattcaggcttcggtgcttgaggttactgtgaaagataaggatgttgtgaaggacgattttattggtcgtgtttggtttgacctcaacgaggttccgaagagggttcctccagatagtcctcttgcaccgcagtggtatagattggaggacagaaagggtgataaggcgaaaggggagcttatgctggctgtttggatgggtacgcaagctgatgaagcgttccctgaggcgtggcactcggatgcggcgacggttagtgggactgatgctcttgctaacattaggtcgaaggtgtatttgtctcctaagctttggtatttgagggttaatgttatagaggcacaggacttgcagccatcggataagggaaggttcccggaggtttatgtgaaggctattttgggaattcagaccttgaggactagaatctctcagagcaggagtatcaatccaatgtggaacgaggatttgatgtttgttgctgcggaaccgtttgaggagccgctcattttgagtgtggaagatagggttgctcctaacaaagaggaactactggggaagtgtgttattcctttacagataatggataggagactagatcacaagcctgtgaacactcggtggttcaatattgaaaagcatgttgttattatggaaggtgataagaagaaggaaataaagtttgctagccggattcatatgagggtctgtttggaaggtggttatcatgttttggatgaatcgactcaccacagcagtgatcttcgcccaacagcaaaacagctctggaagtccagtattggagttcttgaagtggggatattgagtgctcagggtttgatgcccatgaaaacaagtaacgggagggggacaacggatgcgtattgtgtagctaagtacgggcagaagtgggtgcggacgagaaccatcatcgatagctttgcgccgaggtggaatgagcagtatacttgggaggtttttgatccatgcaccgtcattacaataggtgtatttgataattgtcatttgcacggtggcggtgataagcctggaggacaaaaagattcgaaaattggaaaggtaagaatccgtctttcaacacttgagacagatcgagtctatacacattcgtatccacttctagttcttcatccaactggggtgaagaaaatgggagaaattcaattggctgtaaggtttacttgctcttctttgctaaacatgatgcacatgtattcaaatccattgttgcctaagatgcattacattcacccgttaactgtcagccagcttgacaatctgaggcatcaagccactcagattgtttcaatgaggctgagtcgcgctgagccgccgctgagaaaggaggttgttgaatatatgctggatgttggttcccacatgtggagtatgagaagaagcaaagccaactttttcagaatcatgggagttttgagtggaatagttgcggttggaaaatggtttgaccagatttgccattggaaaaaccctatcacaacaattctgattcatatcttgtttgtaatacttgttatgtatcctgagcttatcttaccaactattttcctttacctctttttgattggaatttggtactatagatggaggccaaggcaccctcctcacatggacacacgactctcccacgcggattccgctcaccctgatgaactagacgaagaattcgacacatttccaactacaagaccttctgatattgtgaggatgcgatacgatcggcttagaagtattgctgggaggatacaaactgtggtgggtgatttggcaactcaaggtgaaaggctgcagtctttgctgagctggagagatccaagagctactgccttgtttgtgcttttctgtttgattgctgctattgtactttatgtaactccattccaagttgtggcgcttctcaccggaatttatgtgttgcgacatccgaggtttcgtcacaagcttccttcagtgccgctaaatttcttccggaggttgcctgcaagaactgattgcatgctttgagaatcgaactcttttgcattttgatggaaggcttgagtggaatgtgcagaaaagaaaaacaaatggagcttggtttgttatttttatatcattgttcaccaccatattttgtggatttgtagtttcacttattattatgtcatagtagaattttctgttttgaacttatggtagtccattgttaaaatttgtaattttgtagggtgagttgaaattaatttgtctttaatcaacttcatgtttaattagatgctgcaaattttctcaattggaaatctgagtcaaaggtaattttcttttattattaagcttttttgagatgccatgtgtcttttgaaatcagtgacaagcctaatagtatattttggtgtacttacaaaatcatcc

SEQ ID NO: 4660 - DNA, 2544 bp, Helianthus annuus
gcttcggcgggggaaaaaactagataaactgtcggtgaattagcttataaatcttatcaagaatccactcagatctatgatgggatctctctttcattattgttctcagtaaggctagaagcactcagatctgaagccctctgttcaactttttaaagttcatcagttgagatagaatcaagatgatgcacagaccacctcctgatgatttctccctcaaggagacgaaaccgcatcttggcggtggaaaaatcacaggggataagctcactagcacatatgaccttgtggaacaaatgcaatacttatacgttcgtgtggtgaaagcgagagatttacccgctaaggatgttacgggaagctgtgacccgtatgctgaagttcggttaggaaactataagggaacaactcgacatttcgagaagaagtcgaacccggaatggaaccaagtgtttgctttttctcgagataggattcagtcgacgatgctcgaggttgccgtgaaggataaagatcttatgaaagacgatttcatgggttgggtgttgtttgatctttccgaggttccgaagcgggtcccgccggatagtcctctagctccgcaatggtatcggttggaagatcgaaaagggatgaagctgaaaggagagataatgttagccgtgtggtggggtactcaagcggatgaagcttttccggaagcgtggcattcggatgctgcaactgtcggtgggtcggatgcacttgctaatatccgatcgaaagtttatctttcgccgaaactttggtatcttagagttaacgtgatcgaagcacaggatttgataccgagtgatcggactcggtttccggaagttttcgtgaaggcacagcttggacaccaggcgttacggactagagtatcgatgggcaagtcgataaatcctatgtggaatgaagacttgatgtttgtagccgcagaaccgttcgaagaacacttgattttgagcgtcgaagatagggttgcgcctaataaagacgagagtctcggaatgactatgattccgttacagtacgtcgatcgaaggctagatcataaacctattcactccaagtgggttaatctcgaaaaacacattatgatcgacggggaaaagaagaaagaagtgaaatttgctagcaggcttcatttacggatctgtttagaaggcggttatcacgttcttgatgaatctactcactacagtagcgatcttagacctacggctaaacagttatggaagaacagcatcggtgttcttgaagtgggaatcttgagtgctcatgggttaacaccgatgaagacaaaagacggaagggcaacaacagatgcgtattgtgtggctaagtacggtacaaagtgggtccgaacaagaacgataatcgacagttttactccgaaatggaacgagcagtatacttgggaagtttttgatccgtgcacagttataaccattggtgtgttcgataactgccatctgcaaggcggggataagggtaacggggcacgggattcaagaattggtaaggtcaggatccgtttatcaactctcgaaactgaccgtgtgtacacccattcgtacccgcttttagttttgcatccgtctggggtgaaaaagatgggcgagattcatttagccgtgaggtttacatgttcgtcgttgctaaacatgatgcacatgtactcgcaaccgctgctgccgaaaatgcactacatttatccgttaaccgtcagccaactcgacagcttaaggcaccaagccactcagatcgtgtcgatgcggcttagccgagccgagccgcctttacggaaagagatcgtggaatatatgctcgatgtcgggtcacacatgtggagtatgagaagaagtaaagcaaatttcttcagaatcatgggggttttcggtggtttgattgcggttggaaaatggtttgatcagatatgcaattggaagaatccgatcactacggttctgattcacattcttttcttgatattggttttgtatccggagcttattttgccgacgatttttctctatcttttcttgattggcgtttggtactaccgatggagaccgaagaacccgccccacatggacactcgcctctcgtgtgcagacggtgctcaccctgacgaactcgatgaagaattcgacacgtttccgacttctcgccctgctgacatcatcagaatgagatacgatcgtttacggagtatatccggaaggatccaaaccgtggttggtgatttagcgacacaaggagaacgacttcagtcgttactcagctggagagacccgagagctaccgcactgttcgtcattttctgtttaatcgctgctattgttttgtacgtcacgccttttcaagtcgtggctctgttaacaggcttctatgtgctaagacacccgaggttccgccacaagctgccatctgtcccgctcaacttcttcagaagattacccgcaagaaccgactgcatgctttgagaaaactatcctggtaagatgcatacaattttct

SEQ ID NO: 4661 - DNA, 2705 bp, Papaver somniferum
tcacaaagtctatgttcatcaatcaaaagaacaaactctgaattattgaaacctccatttttcttcttcagcgtttttgacggtttcaagaatcattactgtgtttttctgtcggttccttccttttaatctaaaaaatgcagcgtccaaatccagatttctcattaaaagagactgcaccacatcttggtggtggaggtctgaccggtgataaactcaccagtacttatgacttagttgaacaaatgcagtatctgtatgttagagttgttaaagctaaggatttaccaggaaaggattctactggttgttgtgatccttatgttgaagttaaacttggtaattataagggaatgactcgccattttgaaaagaggtccaaccctgaatggaatcaggtttttgctttttcgaaagatcggattcaatcttctgtcattgaggttttggtgaaagataaggatttagtaaaagatgatattattggaagggttatgtttgatctcaatgatgtgccaaagagggttccacctgatagtcctttggctccgcaatggtatagacttgaagatcgaaagagtgacaaggttagaggtgaactcatgttggctgtttggatgggtactcaagccgacgaagcattcccagaagcatggcattcagatgcagcgactgtaggcggcgaaggcgtcactaatattcgatccaaggtatatctttctcccaagctttggtatcttagggttaatgtgattgaagctcaagatttgctagttactgataagactagatttccagaagtttatgtgaaagcagtacttggaaatcaggcgttgagaactaaaatttctcagagtcggaatataaatccaatgtggaatgaggatatgatgtttgtagcagctgaaccatttgaggaacatttggttctgagtgtggaagatagagtggcaccaaacaaggatgaggttttgggtaagtgtgtaattcctttgcagaatgtggctaggaggttggatcataaaccagtgctgacaaagtggtttaatcttgagaaacatattcttgttgatggggagaagaagaaggacaataaatttgccagtaggcttcatttgaggatctgcttagatggtggttatcatgttcttgatgaatcaactcactacagtagtgatcttaggcccacagcaaaacctttgtggaagcagagcattggggtacttgagttgggaatcttgactgcaaatggattgttgccaatgaagacgaaagatgggcgagggacaacagatgcttactgtgttgccaagtatgggcagaagtggattaggaccagaacaattatagattgccctaccccaaagtggaatgagcaatacacttgggaggtttttgacccatgtactgtgattacaattggagtgtttgataactgccatttacaaggaggagataaatctgtgggtgcaaaagattcaaggattggaaaagtgcgtattcgactttctacacttgaaactgaccgggtctacactcactcgtatccgcttctggttttacaaccttctggactcaagaagatgggtgaaattcaactggctgtacggttcacatgctcctctttgcttaatatgatgcatatttactcgcagccactcttaccaaaaatgcattatcttcatccattatcggttactcagctcgagaacttgaggcaccaggcatgtcaaatcgtctctataagacttagtcgtgctgagcctccattgaggaaggaggttgttgagtatatgttggatgtggattcacatatgtggagtatgagaaggagcagagctaatttcttcagaattatgggagtgttaagcagcttagtggcagtggtaaaatggtttagtcagatatgcaattggaagaaccctctgacgacagttctgattcacatcctgtttataatacttgtcctttatcctgagctaatcctcccgacaatctttctctatcttttcttgattggtgtttggtacttccggtggagacctaggaatccctctcacatggatacgcggctttcacatgcagagaatgtacaccctgatgaactggatgaggagttcgacacatttcctacttcccggccttctgacatggtgaggatgagatacgaccgtttaagaagtgttgctgggagaatacaaacagttgtgggtgacttggcaactcaaggggagagattccagtctctacttagctggagggaccctagggcttcgactttgttcatcactttctgtttgattgcagccattgtgctttacgttactccatttcgagtagtggctcttcttacaggtttttatgtattaaggcatcctcgattccgccacaagcttccttcagcgccgcttaacttcttccgcagattgcctgcgagaacagatagcatgatatgaacaccattacaaatgcccattgtgatggcggagtcatcttttgcctctgaccctcaaaatagatggttaaattctgaagcatcaatctatgaagcatcgtttattcttttttagctggcaatgggtgatcatatcattatggcatgtaatttttcttcccctaaacttgtagtcgctgtcgtaaatctgcactttgtttattttatttcttagagtgtgtgaagtcatcttcctgttattaatcaatat

SEQ ID NO: 4662 - DNA, 2750 bp, Brassica napus
gtagtgcataccctctctgcttttactagtcttatcttcgtttgttccttttatttattagactttgattaaaacgaggacgaaccaacaagagagaagacataactctccttactcatcaaggacggagattttctcgctcttcttctcatccatgaactgcttctgagtgttgcttttttgaagatctaagatctagtgttttgaagtggagcaatagtctcttgtctttctcgaagcaaacatgatgcagagaccacctcccgaagacttctccttgaaggagacaagaccccacctcggcggcggcaaactcaccggcgacaaactcaccagcacctacgacctcgtcgagcaaatgcagtacctctacgtccgcgtcgtcaaggccaaggagctccccgggaaagaccttaccggaagctgcgacccttacgtcgaagtcaagctcggtaactacaaaggcaccacgcgtcacttcgagaagaagtcaaacccggagtggaaccaagtcttcgccttctccaaagacaggatccaagcctcgttcctcgaagccacggttaaagacaaggacgttgtgaaagacgatttgatcggtcgcgttgtctttgatttgaacgaggtgcctaagagagtccctcccgacagccccttggctcctcagtggtatagactcgaaggcactaaaggtgagaaagtgagaggagagcttatgcttgctgtttggttcggtactcaagctgatgaagcttttcccgaggcttggcactcggatgcagccacagtgagcggaacagacgctctcgctaacatacgctcaaaagtctatctctcccccaagctatggtacttgagagttaacgtcatcgaggctcaagatctgatacctagcgataaagggaggtaccctgaggtctacgtgaaggctatagtgggaaaccaagcgttacggactagagtctctcaaagcaggactattaaccccatgtggaacgaggatctgatgtttgtagcagctgagcctttcgaggagccgttgattttaagcgttgaagacagagttgctcctaacaaggacgaagtcttagggagatgcgcgatcccgttgcagcatttggacaggaggtttgaccacaggccggttaacagcaggtggtttaacttggagaagcatatcatggtggacggtgagaagaaggagatcaagttcgcgagcaggatacacatgaggatatgtttggaaggagggtaccatgttcttgatgagtctacgcattacagtagcgaccttagaccgacggctaagcagctctggaagccgagcatcggcgtgttggaggtcgggatacttaatgccaccggcttgatgcctatgaagaataaagatggacgagggacgacggatgcgtactgtgtggcgaagtatggtcagaagtggattcgaacgaggactattatagacagctttactccgaggtggaacgagcagtacacgtgggaggtttttgatccgtgtactgtcgtcaccgttggggtttttgataactgtcatctccatggaggtggtgagaagaacggtggaggaggaggaggagggaaagattcaagaatcgggaaggtgaggatcaggctctctactttagagacggatcgtgtctacacgcactcgtatcctcttcttgtgctgcatcccaacggagtcaagaagatgggagagattcatttagctgtgaggttcacttgctcctcgttactcaacatgatgtatatgtactcggtgcctctcttgcctaagatgcattacattcatcctctgacggttagccagcttgataacctgaggcaccaagcgactcagattgtgtcgatgaggctgacaagagcggagccgccgctgaggaaggaagtggttgagtacatgcttgatgttggctcccacatgtggagtatgaggagaagcaaagcgaattttttcaggatcatgggtgttttgagcgggttgatagctgttgggaagtggtttgagcagatatgtaactggaagaatccgatcacaacggtgttgatccatctcttgttcatcatccttgttgtctaccctgagctgatcttgccgactatctttctttacctttttcttatcggtgtatggtactaccgttggagaccgaggcatcctccgcacatggacacgcgtctctcacacgctgactcagctcacccggacgagcttgacgaggagtttgatactttccctacttcacgaccctctgatattgtcaggatgaggtatgataggttgaggagtatcgctgggaggattcagacggtggttggtgatcttgcgacgcaaggagagaggcttcagtctctgctgagctggcgtgatcctcgtgcgacggcgctgtttgtcttgttctgtttgattgctgcggttgttctctatgtgacgccgtttcaggttgtggcgcttctggttggaatctatgttctgagacatccgaggtttaggtacaggctgccgtcggttcctctcaatttcttcaggaggcttcctgcaagaactgattgcatgctctgagctcaaagaaacagttgcactctctttagttcggattgtccctttcggacttgttagtttgttttaaaaagtcatggtgactcctttgcttgttgatgatgattacgatgtttgttttgacattatcaagacttttgtttgaaattagtaaattagtatttgtgtg

SEQ ID NO: 4663 - DNA, 2330 bp, Solanum phureja
tcttgaaaatgcagagacccccacaagaagattttttactaaaggagaccaaaccccaccttggtggagggaaggtcacgggtgataagcttactagcacctatgacttggttgagcaaatgcagtatctttatgtgagggtggtgaaagcaaaggatttgccagggaaggatgttacgggtagtcttgatccttatgttgaggttaggcttggaaactataagggtacaactcgtcatttcgagaagaaatcgaatccggaatggagtcaggtgtttgctttttccaaggataggattcaggcttctgtacttgaggtgaatgtgaaagataaggattttattaaggatgattttgttggttgtgttatgtttgatttgaatgatatccctaaaagggttcccccggatagtcctcttgctccacagtggtataggttggaggatagacatggtaataaagttaaaggagagttgatgttggctgtttggatgggtactcaagctgatgaagcctttcctgaatcttggcattcagattctgcagctgttactggtgccgatgctcttgcaactataaggtctaaggtgtacctctcaccaaagctgtggtaccttagagttaatgtgattgaggctcaggacttgattcccggtgacagaagtaggtttccagaagtttacgtgaaggccatcctcggaaatcaggcattgagaaccagagtttccatgagcaagactattaatcccatgtggaatgaggatctgatgtttgtagcagcagaaccatttgaggagccattgattttgagtgtagaagatagagttgcaccaaacaaggatgaagtacttggaagatgtgctattcctttgcaatatatagataggaggttggaccacagacctattaatagtaagtggtataatcttgaaaagcacattatcgtcgagggagaaaagaaggaaatcaaatttgcaagcaggattcacatgaggctgtatttggaaggaggctaccacgtgctggatgaatcaacacactacagcagtgatctaagaccaactgcaaagcaattgtggaagtccagtattggtgtcctagagttgggtatactaaatgctcacggcatttcgccgatgaaaacaaaagatggacgggctacaacagatgcctattgtgttgccaagtatgggcagaagtgggttagaacaaggacaattattgatagctttgctcccaagtggaacgaacaatacacttgggaagtatttgatccctgcactgtcataaatattggtgtttttgataattgccatctgcaaggaggagataagtctggtggggctaaggactcgaggattgggaaggtcaggatccgtctttcaactctagaaacgggttgtgtctacacgcattcttatccacttctggttttgcatcctactggggtgaagaagatgggtgaaattcacttggctgtaagatttacttgctcatcattattgaatatgatgcatatgtactctcagccactgctgcccaaaatgcactatatttatcctttaactgttagtcagctggacaacttgaggcatcaagccactcagattgtctctatgaggctgagtcgtgctgagccgcctttgaggaaagagatagtggagtatatgttagatgtcggttctcacatgtggagtatgaggagaagcaaagctaacatttttagaatcatgggtgttttaggtggattaattgctattgggaaatggtttgatcaaatttgcaattggaaaaatcccattacgactgttctgatccatatcttgttcttgatactagttctatatccggagcttattctgccaaccattttcctctatctcttcttaatcggagtttggtactacagatggaggcctagacatcctccccacatggacacacgtctttcttgtgctgataatgcccatcctgatgaattagacgaagagtttgatacttttcctacttcacgtcctcctgatattgttcggatgaggtatgaccgtatgagaagtattgctggaaggatacagactgtggttggtgacttggctactcaaggggagaggctgcagtctttgttgagctggagagaccctagagcaaccgcgctgtttgttattttctgcttgattgctgccattgcgctgtatgtcacgcccttccaagttgtggctctcgtgactggattttacgtgctgagacatccgcgatttcgccataagctaccatctactccagtgaatttcttcagaagattgcctgccagaacagactgtatgctatga

SEQ ID NO: 4664 - DNA, 2417 bp, Solanum lycopersicum
tattgaaaatgcagagaccaccacaagaagattttttactaaaagagaccaaaccccaccttggtggagggaaggtcatgggtgataagcttactagtacctatgacttggttgagcaaatgcagtatctttatgtgagggtggtgaaagcaaaggatttgccagggaaggatgttacgggtagtcttgatccttatgttgaggttaggctgggaaactataggggtacaactcgtcatttcgagaagaaatcgaatcctgaatggagtcaggtgtttgctttttctaaggatcggattcaggcttctgtgctggaggtgaatgtgaaagataaggatttcattaaggatgattttgttggtcgtgttatgtttgatttgaatgagatccctaaaagggttcctccggacagtcctcttgctccacagtggtatagattggaggatagacatggtaataaagtcaaaggagagttgatgttggctgtttggatgggtacacaagctgatgaagcctttcctgaatcttggcattcagattctgcagctgttactggtgccgatgctcttgcgactataaggtctaaggtgtacctctcaccaaagctgtggtaccttagagttaatgtgattgaggctcaggacttgattcccggtgacagaagtaggtttccagaggtttacgtgaaggccatcctcggaaatcaggcgttgagaactagagtttccatgagcaagacaattaatcccatgtggaatgaggatctcatgtttgtagcagcagaaccatttgaggagccattaattttgagtgtggaagatagaattgcaccaaataatgatgtagtacttggaagatgtgctattcctttgcagtacattgaaaggaggttggaccacagacctgttaccagtaagtggtataatcttgaaaagcacattatcattgagggagaaaagaagaaggaaatcaaattcgcaagcaggattcacatgaggctatatttggaaggagggtaccatgtgctggatgaatcaacacactacagcagtgatctaagaccaactgcaaagcagttgtggaagtccagcattggtgttctagaattgggtattctgaatgctcacggcatttcgccgatgaaaacaaaagatggacgggctacaacagatgcctattgtgttgccaagtatgggcagaagtgggtcagaactaggacaattattgatagctttgctcccaagtggaacgagcaatacacttgggaagtatttgatccctgcactgtcataactattggtgtttttgataattgccatctgcaagttggagataagtctggtggggctaaggactcgaggattgggaaggtcagggtccgtctttcaactctagaaacgggtcgtgtctacacacattcttatccacttctggtcttacatcctaccggggtgaagaagatgggtgaaattcatttggctgtaagatttacttgctcatcattattgaatatgatgcatatgtactctcagccactgctacccaaaatgcactacatttatcctttaactgttagtcagcttgacaacttgaggcatcaagccactcagattgtctctctgaggctaagtcgtgctgagccgcctttgaggaaagagatagtggagtatatgttagatgtcggttctcacatgtggagtatgaggagaagcaaagctaatgtttttagaatcatgggtgttttaggtggattaattgctattgggaaatggtttgatcaaatttgcaattggaaaaatcccattacgactgttctgatccatatcctgttcttgatactagttctatatccggagcttattctgccaaccattttcctctatctcttcttaatcggagtttggtactacagatggaggcctagacatcctcctcacatggacacacgtctttcttgtgctgataatgcccatcctgatgaactagacgaggagtttgatacttttcctacttcacgtcctcctgatattgttcggatgaggtatgaccgtttgagaagtattgctggaaggatacagactgtggttggtgacttggctactcaaggggagaggctgcagtctttgttgagctggagagaccctagagcaaccgcgctctttgttattttctgcttgattgctgccattgcgctgtatgtcacgcccttccaagttgtggctctcgtgaatggattttacgttctgagacatccacgatttcgccataagctaccatctactccagtaaacttcttcagaagattacctgccagaacagactgtatgctatgagctgtactgttagctgctgttatccattttccctttgtgtctcttagttgatgaaattgatgtagaaataagcaaggctttggg

SEQ ID NO: 4665 - DNA, 2978 bp, Lactuca sativa
actagtcataacattaggggtgaagatgcattttaccaaaagttaaattgttgttgcactcttccttaaagagacagcaatacacagacatactcacatactcatcaccacctcctccgcttttctctctctaaaaccctctttctctctctaaaacccctgttaccatcgcacctttttcgtctcaaatcctctatattcttatgaatctgatcccagacgattaaaaaagcaactccattaatttcttcttgaaacaactcaataatgctatcgcgaatccatacagatctcccatgagatctctctttcattatcgctcttagtaagctgtgacgaaatccagatgatgcacagacctcctccgcacgatgatttctcactcaaggagaccaaaccccacctgggtggaggaaaggtcaccggagataagctcaccagcacttatgaccttgtggaacaaatgcaatacctgtatgtccgtgtggtgaaagctagggatttacctgcaaaagatgttactggtagttgtgacccttatgctgaagttcgtcttggaaactacaagggtacaactcgtcattttgaaaagaaatctaaccctgaatggaaccaagtgtttgccttctccagagagaggattcaagccactatgcttgaagtcactgtaaaagataaagactttgtgaaggatgatttcatggggtgggttctatttgatcttactgaggttccaaaaagagttccaccagatagtcctctagctcctcaatggtatagattagaagacaggaaatcaaacaagctgaaaggagagcttatgttagccgtatggtggggtactcaagctgatgaagctttccctgaagcatggcattcagatgctgcttctgttggtggagctgatgctcttgctaatatccgttcaaaagtgtatctttctcctaagctgtggtatctcagagtcaatgtgattgaagcccaagacttaataccaagtgacagaactagattccctgaagtttttgtgaaagctgcacttggtcatcaagttttaaggactcgaatctccatgagcaaatccatcaatcctatgtggaatgaagacttaatgtttgtagctgcagagccattcgaagaacacttggttttaagtgtggaagatagactcgcacccaataaagatgaaatccttggaatgtgtgcgattcctttacagtatgtggatcgacggctagaccacaaagctatcaacacaagatggtttaatcttgaaaagcatgttataatcgatggtgaaaagaaaaaagaagtcaaatttgctagcaggcttcatatgagaatctgcttggaaggtggttatcatgttcttgatgaatctactcactacagcagtgatcttaggccaacagctaaacagttatggaagaacagcatcggtgttcttgaagttggagtcttgagtgctcagggattatcaccaatgaaaacaaaagacggacgtgcaacaacagacgcgtattgtgtcgccaaatacgggacaaaatgggtcagaacaagaacaataattgacagttttacccctaaatggaacgaacaatacacatgggaagttttcgatccatgtactgttataacaatcggtgtattcgacaactgtcatctccaaggcggtgataaaggtggtgggggtggggcccgcgattcaagaatcgggaaagtcagaatccgtctttccactcttgaaacagatcgtgtctacactcattcataccctcttcttgttttacatccatctggagttaaaaaaatgggtgagattcatttagctgtgaggtttacatgttcttcattgctaaacatgatgcatatgtactcacagcctttgttacccaaaatgcactacatccatccgttgacagtgagtcaactcgatagtttaaggcaccaggcgactcagattgtgtccatgcggttgtcccgggctgagccgccattgagaaaagaggtggtggagtatatgctggatgtggggtcccacatgtggagcatgagaagaagtaaagctaatttcttcagaatcatgggtgtgttaggtggtttgattgcagttggaaaatggtttgaccagatttgtaactggaagaatccgatcacaaccgttttgattcacatccttttcttgattttggttttataccctgagcttattctcccaactattttcctatatctttttctgattggagtttggtactatagatggagaccaaagaacccaccccacatggacacccgtctttcttgtgctgacaatgcacaccctgatgaacttgatgaagaattcgatacctttccaacttctcgccctgctgacatcatcagaatgagatatgaccgattaaggagtatttctggaaggattcagacggttgttggtgatttggctacacaaggagagaggcttcagtctttgctgagctggcgagatcccagagcaactgcattgtttgtgattttctgtttgattgctgctattgttctttatgtcacacctttccaagttgtggcacttctgactggattctatgtgttgagacacccgaggtttcgccagaagcttccttctgtccctctcaacttctttagaagattgccagccagaactgactgcatgctatgagatgatcaacaccagaatggaatcatcaattccagagaaggttactctataatcaaaaaaagccattcctttcttcaattcctggtatgatgcatacaactatcttggaacaatgtttttgtatatcttgtggttctgtagtcctttcttacatttcaaatttcatggtctgtgttttatttaggttgtgtttttttatttgattgttattagtagattatgacaatcatctttggtgataatattcgataaatatcttggattggcagtaatttttatcaaatgtttctttaag

SEQ ID NO: 4666 - DNA, 2913 bp, Brassica rapa
taaaaaataagtagcaaaggaaagaaggagacaacagaatacaacaagaagagaccaataaaactctctctctctctctgtcggactctccttcctcttcaatgttatttctttctctctctagaaatttccctttcccagtagtgcataccctctctgcttttactagtcttatcttcgtttgttccttttatttatttagactttgattaaaacgaggacgaaccaacaagagggaagacataactctccttactcatcaaggacgtagattttctcgctcttcttctcatccatgaactgcttctgagtgttacttttttgaagatctaagatctagtgttttgaagtggagcaatagtctcttgtctttctcgaagcaaacatgatgcagagaccacctcccgaagacttctccttgaaggagacaagaccccacctcggcggcggcaaactcaccggcgacaaactcaccagcacctacgatctcgtcgagcaaatgcagtacctctacgtccgcgtcgtcaaggccaaggagctccccgggaaagacctaaccggaagctgcgacccttacgtcgaggtcaagctcggaaactacaaaggcaccacgcgtcacttcgagaagaagtcaaacccggagtggaaccaagtcttcgccttctccaaagacaggatccaagcctcgttcctcgaagccacggttaaagacaaggacgttgtgaaagacgatttgatcggtcgcgttgtctttgatttgaacgaggtgcctaagagagtccctcccgacagccccttggctcctcagtggtatagactcgaaggcactaaaggagagaaagtgagaggagagcttatgcttgctgtttggttcggtactcaagctgatgaagctttccccgaggcttggcactcggatgcagcgacagtgagcggaacagacgctctcgctaacatccgctcgaaagtctatctctcccccaagctttggtacttgagagttaacgtcatcgaggctcaagatctgatacctagcgataaagggaggtaccctgaggtctacgtgaaggccatagtgggaaaccaagcgttacggactagagtctctcaaagcaggactattaaccccatgtggaacgaggatctgatgtttgtagcagctgagcctttcgaggagccgttgattttaagcgttgaagacagagttgctccgaacaaggacgaggttttagggagatgcgcgatcccgttgcagcatttggacaggaggtttgaccacaggccggtgaacagcaggtggtttaacttggagaagcatatcatggtggacggtgagaagaaggagatcaagttcgcgagcaggatacacatgaggatatgtttggaaggagggtaccatgttcttgatgagtctacgcattacagtagcgaccttagaccgacggctaagcagctctggaagccgaacatcggcgtgttggaggtcgggatacttaacgccaccggcttgatgcctatgaagaataaagatggacgtgggacgacggatgcgtactgtgtggcgaagtatggtcagaagtggattcgaacgaggactattatagacagctttaccccgaggtggaacgagcagtacacgtgggaggtttttgatccgtgtactgtcgtcaccgttggggtttttgataactgtcatctccatggaggtggtgagaagaacggtggaggaggaggagggaaagattcaagaatcgggaaggtgaggatcaggctctctactttagagacggatcgtgtctacacgcattcgtatcctctccttgtgctgcatcccaacggagtcaagaagatgggagagattcatttggctgtgaggttcacttgctcctcgttactcaacatgatgtatatgtactcggtgcctctcttgcctaagatgcattacattcatcctctgacggttagccagcttgataacttgaggcaccaagcgactcagattgtgtcgatgaggctgacaagagcggagccgccgctgaggaaggaggtggttgagtacatgcttgatgttggctcccacatgtggagtatgaggagaagcaaagcgaattttttcaggatcatgggtgttttgagcgggttgatagcggttgggaagtggtttgagcagatatgtaactggaagaatccgatcacaacggtgttgatccatctcttgttcatcatccttgttgtctaccctgagctgatcttgccgactatcttcctttacctttttcttattggtgtatggtactaccgttggaggccgaggcatcctccgcacatggacacgcgtctctcacacgctgactcagctcacccggacgagcttgacgaggagtttgatactttccctacttcacgaccctctgatattgtcaggatgaggtatgataggttgaggagtatcgctgggaggattcagacggtggttggtgatcttgcgacgcaaggagagaggcttcagtctttgctgagctggcgtgatcctcgtgcgacggcgctgtttgtgttgttctgtttgattgctgcggttgttctctatgtgacgccgtttcaggttgtggcgcttttggttggaatctatgttctgagacatccgaggtttaggtacaggctgccgtcggttcctctcaatttcttcaggaggcttcctgcaagaactgattgcatgctctgaggttaaagaatcgtccctttcggacttgttagtttgtttcttattttgaaaaagtcatgatgactcctttgcttgttgatgattatgatgtcctttgtttttttttaacgttatcaagacttttgtttgaaattagtaaattagtatctgtgtggatttgatgttctcctcttatgttatttctttgttct

SEQ ID NO: 4667 - DNA, 2550 bp, Amorphophallus konjac
aaggagacctctcctcaccttggtgggattgccggggacaaggtgaccagtacatatgacctcgttgagcagatgcagtacctctatgtccgcgtcgtcaaagccaaggacctcccgcccaaggatgtcactggaagttgcgacccctatgtggaggtgaagctcggcaactacaagggcgcgactcgccacttcgagaagaagtcgaatcctgagtggaaccaggtgtttgctttttcaaaggagcgcatacaggcttcttatgtcgagattgtggtgaaagacaaggattttgtgaaggatgatttcatgggaaggctgacgtttgacctccacgagataccaaaacgtgtccctccggatagcccgttggctccccagtggtatagattggaagataggaagggggagaaggtcaagggtgagattatgcttgctgtttggatgggcacccaggctgatgaggctttcccagaggcatggcattcagatgcagccactgtcccaggtgatggcctcacaaatataagatcaaaagtatatctctcacccaaactttggtatgtgcgggttaatgttattgaagcacaggacttacaactcagtgataagggcaggtttcctgaagtttttgtcaaggttattcttgggaatcaagctctgaggactagggtctctcagagcaggagcgttaatcccatgtggaatgaggatttgatgttcgtagctgcagagccattcgaagagcatcttattttaactgtggaggatagagtggggcccaataaggatgaagtgttgggtaaagctgtgattcctctgcaacaggttgataggagattggactacaggcctgtgcatagcaaatggtatactattgaaaagcatgtgaccatcatggagggtgagaagaagaaggagatgaagttctccagccgggttcatttgagaatatgtctggatggtggttaccatgttctagatgagtcaacccattacagtagtgaccttaggccaacagccaagcaattgtggaagccaagcattggggtcttggaattaggtatcttgtctgctcaaggcttattgccaatgaagacaaaagatggtaaaggcaccactgatgcctactgcattgccaaatatgggcagaagtgggtccgcacaaggaccattattgacagttttgctccaaaatggaatgagcagtatcactgggaggtttttgatccttgtactgttatcactgttggggtttttgataactgtcacttacaggggggagagaaggcaagtaaggactcgaggataggcaaggtgagaattcggctttccacacttgaaactgacagggtttacacccattcttatccacttctagttttgcatccctctggggtgaagaagatgggggaagttcagcttgctatacgctttgcatgttcatcgttgcttaatatgatgcacatatactctcaaccgttgcttccaaaaatgcattatcttcatcctttgtctgtggcacagcttgatagtttgaggcatcaggccactctgacagtctccatgaggttaagtcgcgcagagccaccattgagaaaggaggttgtggagtatatgttggatgtggattcccatatgtggagcatgagaaggagcaaggctaacttcttcaggatcatgagtgtctttagtggtctgattgcagttgggaaatggcttgatcagatttgcaattggaagaacccattgactacagttttaatccatatcctcttcataattttggtgttgtacccagagttgattctccctacagtttttctgtacttgttcttgattggcatatggtacttcagatggaggccaaggcatcctcctcacatggatacaaaattatctcatgctgaaaatgtgcacccggatgagttggatgaagagtttgatacatttcccactagtcggccgcctgattttgtccggatgaggtacgatcgtctgaggagcatcgcagggaggatacaaacagtggttggtgacttggcaacccaaggggaaagattgcagtcgttgttgagctggcgagacccaagggccactgccctctttgtgaccttctgttttcttgctgccattgtgatctatgtgacacctttccgcattgtggcacttgtcacaggtctgtacacgttgaggcacccaaggttccgtcacaagcttccctctgcccctctcaactatttcagaaggttgcctgcaaggacggacagcatgttgtgaatatcagccctgcccctgtcgagttctatttgttcctgcttactgttcagactccagttggttctatctggtttcacatagtattactgtatcccagcaaacggttggggctatgcccatcgctctattaattttctgtttcatggagattataatctcacccgcatgttatctgctgtgaatttagggtgtgtgatcttcggtatctctggtttttgataattatttcaatcagtgcatatggattactcttttaaaattgtatatatg

SEQ ID NO: 4668 - DNA, 2775 bp, Cicer arietinum
tgaacaatcggatctagtggctttaaagaaagcttttggttttctccgacctttaagctttgtaactctgtgtgaaatcagagatctaggcttcttaattggttgacttgtgcaacagcatcttggtttattttgaattgggtttgaaatttgaatagagaaaatgcagaggcctccgccggacgattttctgttgaaagagaccaaacctcatcttggaggtggaaagatctctggtgataaactaaccagcacctatgatcttgttgagcaaatgcaatacctttatgtgagggttgttaaggctaaggaattaccttcaaaggatgtcaccggaagttgcgatccttatgccgaagttaagctcgggaactataaaggaactacccggcatttcgagaagaaaaccaatcctgaatggaatcaggttttcgctttctcaaaggaccggcttcaggcatcggtgttggaggttactgtgaaagataaggatatggtgaaggatgatttcatcggtcgtgtgtggtttgatttgaatgaggttccgaaacgggtgcctccggatagcccgttggcaccacagtggtataggttggaggataggaaaggcgataaggctaagggagagctaatgctggctgtttggatgggtacacaggctgatgaagcgtttccagaagcttggcactcggatgccgcatctgttagtggggctgatgctgttgcaaatattagatcgaaagtttatttgtctcctaagctttggtacttgagggtcaatgtgatagaggcgcaagatctgcaaccaactgataagggacgatatccagaagtttttgtgaaggctattttggggaatcaggctttgaggactagaatctcgcagagcaggagtatcaatccgttgtggaatgaggatttgatgtttgtggcagccgaaccatttgaggagccattgattttgagcgtggaagacagagttgctcctaacaaagacgaagtgttggggaggtgtgctattcctttgcagtttgtcgataggagacttgatcacaaacctgttaatactaggtggtttaatcttgaaaagcacattgttgtagaaggggagaagaagaaagaaatcaaatttgcgagtaggattcacatgagggtttgtctagaaggtggctatcatgttttggatgaatcgactcactacagcagcgatcttcgcccgacagcgaaacagctttggaaatctggaattggtgttcttgaggttgggatattgaacgcccacggtttgatgccgatgaaaaatataaatgggagggggacaacagatgcttattgtgtagctaaatacgggcaaaagtgggtccgaacaaggactattatcgatagctttatgccaaggtggaatgagcaatatacttgggaggttttcgatccttgcactgtcattacaatcggtgtattcgataattgtcatttgcatagtcctgacaaaactggaggggcaaaagatgcaagaattggtaaggtgaggattcgtctttcgacccttgagactgatcgtgtgtatacgcattcctatccgcttctagttcttcacaacagtggggtgaagaaaacgggcgaaattcaattggctgtgaggttcacttgttcttctttgctcaatatgatgcacatgtattcacaacctttgttgccaaagatgcactacatacacccattgacggttagccagctcgacagtttgaggcatcaagctactcagatagtttcaatgaggctgagtcgtgccgagccaccactgagaaaggaggtggtcgagtatatgcttgatgtcggttctcacatgtggagtatgagaagaagcaaagctaacttcttcaggatcatgggagtattgagtgcattaattgctgtaggaaaatggtttgattcgatttgtaattggaaaaatccaattacaacagtgctgattcacttcttgttcgtaatattagtcatgtatccggagcttatcttaccaacggttttcctttacctcttcctgattggaatttggcactatagatggagaccaagacaccctcctcacatggatactcgactctctcacgcggattcgtctcatccggacgaactcgatgaagaattcgacacattcccgacctcgcggccttctgacattgtgcggatgcgatacgatcggcttagaagcattgctggcaggatacagactgtggttggagacttggccactcaaggggaaaggctgcagtctttgcttagctggcgcgacccgagagcgacagctctctttgtgattttctgtctggttgttgctactgtactttatgtaactccattccaaatggtggcaatcttgactggaatttatgtgttgagacatccgaggttccgtcataagcttccgtccgtgccgcttaatttcttccggaggctgcctgccagaactgactgcatgctttgaatccttagcaaaggaaagtgcagactttggagatttactgttcagctccagattttgatttctggtttggtgcattaccttcttttagattttatggatttatttattttccatcattatgtaataggaatttatattttgaacttcatagtataagtagtgtctggttaatatgtaattttgtaggtttgagctgaaattaacttctgctgaattactttcatgcttaatttgatctagtagtttttctcgatagggaattaatttgattgtaatggtggtggtgg

SEQ ID NO: 4669 - DNA, 3112 bp, Cicer arietinum
atgaattagtacgctctcagctcagttgcaaagttgcaatagcgaagaagagtttcttttcgtttcttttctctctctctgtttctcttcacttttctcggattatttctctctctctctccctctctctctcaataactcagaaactcatctccattgtttctacttttcaatacaaaaaatcattcacgcttcaaaagagcttcattctgacaaggttgaacaatcggatctagtggctttaaagaaagcttttggttttctccgacctttaagctttgtaactctgtgtgaaatcagagatctaggcttcttaattggttgacttgtgcaacagcatcttggtttattttgaattgggtttgaaatttgaatagagaaaatgcagaggcctccgccggacgattttctgttgaaagagaccaaacctcatcttggaggtggaaagatctctggtgataaactaaccagcacctatgatcttgttgagcaaatgcaatacctttatgtgagggttgttaaggctaaggaattaccttcaaaggatgtcaccggaagttgcgatccttatgccgaagttaagctcgggaactataaaggaactacccggcatttcgagaagaaaaccaatcctgaatggaatcaggttttcgctttctcaaaggaccggcttcaggcatcggtgttggaggttactgtgaaagataaggatatggtgaaggatgatttcatcggtcgtgtgtggtttgatttgaatgaggttccgaaacgggtgcctccggatagcccgttggcaccacagtggtataggttggaggataggaaaggcgataaggctaagggagagctaatgctggctgtttggatgggtacacaggctgatgaagcgtttccagaagcttggcactcggatgccgcatctgttagtggggctgatgctgttgcaaatattagatcgaaagtttatttgtctcctaagctttggtacttgagggtcaatgtgatagaggcgcaagatctgcaaccaactgataagggacgatatccagaagtttttgtgaaggctattttggggaatcaggctttgaggactagaatctcgcagagcaggagtatcaatccgttgtggaatgaggatttgatgtttgtggcagccgaaccatttgaggagccattgattttgagcgtggaagacagagttgctcctaacaaagacgaagtgttggggaggtgtgctattcctttgcagtttgtcgataggagacttgatcacaaacctgttaatactaggtggtttaatcttgaaaagcacattgttgtagaaggggagaagaagaaagaaatcaaatttgcgagtaggattcacatgagggtttgtctagaaggtggctatcatgttttggatgaatcgactcactacagcagcgatcttcgcccgacagcgaaacagctttggaaatctggaattggtgttcttgaggttgggatattgaacgcccacggtttgatgccgatgaaaaatataaatgggagggggacaacagatgcttattgtgtagctaaatacgggcaaaagtgggtccgaacaaggactattatcgatagctttatgccaaggtggaatgagcaatatacttgggaggttttcgatccttgcactgtcattacaatcggtgtattcgataattgtcatttgcatagtcctgacaaaactggaggggcaaaagatgcaagaattggtaaggtgaggattcgtctttcgacccttgagactgatcgtgtgtatacgcattcctatccgcttctagttcttcacaacagtggggtgaagaaaacgggcgaaattcaattggctgtgaggttcacttgttcttctttgctcaatatgatgcacatgtattcacaacctttgttgccaaagatgcactacatacacccattgacggttagccagctcgacagtttgaggcatcaagctactcagatagtttcaatgaggctgagtcgtgccgagccaccactgagaaaggaggtggtcgagtatatgcttgatgtcggttctcacatgtggagtatgagaagaagcaaagctaacttcttcaggatcatgggagtattgagtgcattaattgctgtaggaaaatggtttgattcgatttgtaattggaaaaatccaattacaacagtgctgattcacttcttgttcgtaatattagtcatgtatccggagcttatcttaccaacggttttcctttacctcttcctgattggaatttggcactatagatggagaccaagacaccctcctcacatggatactcgactctctcacgcggattcgtctcatccggacgaactcgatgaagaattcgacacattcccgacctcgcggccttctgacattgtgcggatgcgatacgatcggcttagaagcattgctggcaggatacagactgtggttggagacttggccactcaaggggaaaggctgcagtctttgcttagctggcgcgacccgagagcgacagctctctttgtgattttctgtctggttgttgctactgtactttatgtaactccattccaaatggtggcaatcttgactggaatttatgtgttgagacatccgaggttccgtcataagcttccgtccgtgccgcttaatttcttccggaggctgcctgccagaactgactgcatgctttgaatccttagcaaaggaaagtgcagactttggagatttactgttcagctccagattttgatttctggtttggtgcattaccttcttttagattttatggatttatttattttccatcattatgtaataggaatttatattttgaacttcatagtataagtagtgtctggttaatatgtaattttgtaggtttgagctgaaattaacttctgctgaattactttcatgcttaatttgatctagtagtttttctcgatagggaattaatttgaattgtaatggtggtggtggtggtaatttctgtttcttatattttattaagtcttttttgttgttgttgaagttgctggttgatgcatttttttcttctctgtttataatgatgtatttcttttaggcaaaactcca

SEQ ID NO: 4670 - DNA, 3056 bp, Tropaeolum majus
cccttttacgtcttcactataataaactacatttttttattcattatgttttttcataaaaattgcttctttatttcccatttctgaagaacttctaagctctggtgttcttcaaaccaagccgtaaaaaggttatggatatggaaaaagtgcttattttagtagtttgattacttattaacaagtttgaagtttggttttatctgcaaattcttaatattagtacaaaaatggagttgggtttcagttttgagatcccataagtcgatttactatctatcgagacaaaatctggcttaaaaattccagctttttgggttgcgtttacgttgaaatttagagagagagaaaaaaatgatgaagcctccgcagaatgtagagtttgctttgaaggaaaccaatcctcgaattggtgccggagcaatatcgggcgataagctgtcgtctacgtatgaccttgttgagcaaatgcagtatctttacgttcgggttgtcaaggctaaggatttacccgcgaaagacgtaacgggaagttgcgacccttacgtcgaggttaaactcggcaactataagggaacaaccaagcatttcgagaagaaatctaaccccgaatggaatcaaatatttgctttctcaaaggaacggattcaagcttcggttttggaagcgacgataaaagataaggatgtggttgtggatgatttcataggtaggattttgttcgatcttaacgagatcccgaaacgggtccctccggatagtcccttagcacctcagtggtatagattggaagatagacatgggaacaaagctaaaggagagcttatgctggctgtttggatgggaactcaagcggacgaggctttttccgaggcgtggcattcggatgcggcaacggttgggtctgatggtgtcgcaaatattcggtcgaaagtttatctttcttccaagctttggtatgttagagtcaatgtgatcgaagcacaggatttgatacctaccgataaaactaggtttcctgatgtttatgtgaaagttgttctcggaaaccaagcgttgaggactcgaacatctcaaagccggactataaacccgatgtggaatgaggatttaatgtttgtagcggctgaacctttcgaggaacctttggttctctcggttgaagatagggtggcaccgaataaagatgaagtcttgggcaggtgtgtgattcctttacagcatttgcaacgaaggttagaccataaaccggtgaacactcgatggtttaatctcgagaaacatataatcgttgacggggaaaagaaagagaccaagttcgcgagtcggattcatttacgaatctgtttggatggtgggtaccatgtcctcgatgaatcgacacactacagcagcgatcttaggccgacagcaaaacagttatggaaaccgccgattgggattctggaagtgggtgttcttagtgctcaagggttaatgccgatgaagacgagagatggtcgtgggaccaccgatgcgtactgtgtggcgaaatacgggcagaaatgggtccgaacaaggacaatagtagacagctttatgccgaaatggaatgaacagtacacatgggaggttttcgacccgtgtacggttattacgattggggtttttgataatggtcatatccatggtggaaatgcggggcctaaagatgcgagaatcgggaaagttaggattcggttatcgacacttgagacggatagggtttacactcattcctatcctttactagtccttcatccttctggtgtgaaaaagatgggtgaaattcatctggcggttagatttacgtgttcctcgctgattaacatgttacatatgtattcacatcctttgttgccaaaaatgcattatatccacccgttatcggtggttcagcttgatagcttgaggcatcaggcgatgcagattgtgtcgatgaggttaagccgagctgagccaccgctgaggaaagaggttgttgagtacatgctcgacgttgattctcatatgtggagcatgagaaggagcaaagcaaactttttccgaatcatgggtgttttaagcgggttgatcgccgtcggaaaatggttcgatcaaatctgtaactggagaaacccgatcacaaccgttttaatccacatcctgttcataatcttagttctttatcccgaactaatactacccacggttttcctctacttattcttgatcgggatttggaactaccggtggagaccacgacacccacctcacatggacacacgactttctcatgctgatgctgttcatcccgatgaactagacgaggagttcgatacgtttccgacatcacgtcctgctgatattgttcgaatgagatacgatcgtcttaggagtattgctggtcgagttcagacagtgatcggtgatctggctacacaaggggaaaggtttcagtcgttgcttagctggagagatccgagagcaacgacgctgtttgttacgttttgtcttattgctgctgttgttctgtatgttacgccttttcaagttgtggctcttcttacagggttttatatgttgaggcatcccaggttcagacacaaactaccttctgttccgcttaacttctttaggaggctaccggcgagatcagacagcatgctgtaagttctcgatgttgtcgcaagtaagaagattgtgttgagtagcttttatgttttcttttatgttttaatttgttggaatgtaacctttttttatttttctttttttctgttgtgaaaacttttggtgtatgcaattgtagtttttggtgttctagtttggttttggttttgtgttttgtctctcgggttttgggaatggtagtacaattgatgcttaatgttaggggtgacagtgagggttaggaaaaaccgcccattcgacccgacttttgttggtcggacttgggttatacttaaattctgaagtcggtcggatttaatctaaagtcgggttacccgaacttggaaacatataatttttaatttttatgtatactaaaaaaaaaa

SEQ ID NO: 4671 - DNA, 2764 bp, Orobanche aegyptiaca
taaccaatccccacttaggtggcggcaaaataaccggagataagctcacaagcacctatgaccttgtcgagcaaatgcagtacctttacgtccgtgtcgtaaaagctaaagacttgcccgggaaggatgtaaccggtagttgtgacccttatgttgaggtccgtctcggaaactacaagggtacgacccgtcattttgagaaaaagtcgaaccccgagtggaaccaagtatttgccttctccaaggatcggattcaggcctcagtcctcgaggtcaacgtgaaagacaaagatttcgtgaaggacgattttatgggacgtgttatattcgatctgaacgaaatcccgaaacgagtcccgccggatagtccactggccccacagtggtataggttggaggataggaaaaatgagaaggctaaaggggagttaatgttggccgtttggatgggtactcaggccgatgaggcttttcccgaagcttggcattcggatgccgcgactgttagtggggccgacgggctcgcaaatataaggtcaaaggtttatctttcgcctaagctttggtatttgagagttaatgtaatcgaggctcaggatttgcagccaagtgataaaagccggtttccggaggtttacgtgaaagctattttgggtaatcaggctttgagaacacgggtttcgatgaacaagagtataaatccaatgtggaacgaagatttgatgtttgtggccgctgaaccatttgaggagccgttaatcttgagcgtggaagatcgtgtggctccgaataaagacgaggttttgggaaggtgtgctatcccattgcagtacgtggacaggaggcttgatcataagcccgtgaacacaaggtggcacaatctcgagaagcacgttatgatagaaggggaaaagaaaaaggaagtaaaatttgccagcaagattcacatgaggatatgcttggaaggagggtaccacgtgctcgacgaatcaactcactatagcagcgatcttcggccgacggcgaaacaattatggaaatccagcattggggttttggaattagggattttgaacgcgcaagggctttcgcctatgaaaacgaaagacggacgtgcaaccaccgatgcttattgtgtggctaaatatggacagaaatgggttcggacgaggacattaattgacagcttttcgcctaagtggaacgagcagtatacttgggaggtattcgatccgtgcacggttgtaactataggtgtgttcgataattgtcatttgcaaagcggtgataaatctggaagggattcaagaattgggaaagtaagaatccgactctcgactctcgagaccgatcgcgtgtacactcattcttaccctcttttagttttgcatccctcaggtgttaaaaaaatgggcgaaatccatctggccgtgagattcacttgttcgtccttggtaaacatgatgcacatgtattctcaacccttgttgccgaaaatgcactacatccaccccctaactgttagccagcttgacagcttgaggcaccaagctactcagatcgtctccatgcggctgagccgagccgagccgccattgagaaaagaagtcgttgagtacatgctcgacgtcgggtcccacatgtggagcatgagacggagcaaggcgaatttcttccggatcatgggtgttctgagcggcttgatcgctatcgggaaatggtttgaccagatatgcaattggaagaacccgatcaccaccgttttgatccatatcttgtttttgatactcgtcatgtatcccgaacttattttaccaaccattttcctctatctcttcttgatcggggtttggtattatagatggaggcctagacatcccccgcacatggacactcgtttgtcgtgtgccgataacgctcatccggatgagctggacgaggagtttgataccttcccgacctcacgaccagcagatattgtaagaatgaggtacgatcgtctgaggagcatcgcgggaaggatacaaacggtagtcggtgacctggcgacgcagggggagaggctgcagtctttgctgagctggcgtgatccgcgggctacggcgctttttgtgattttctgcttgattgcggcggttgtgctgtacgtgacgccttttcaggtggtggcgcttgtttcgggtttttatgttttgaggcaccctaggtttcggtacaagcttccgtctgtgccgcttaatttcttcaggaggctgccagctaggacggattgcatgttgtgagagcattgtgtcggtgtagaatatgccggcggaagctcgactgcgctatcatggtgattgtaagatgggtttacggaagtttggatattttctgggtgttttttaggtttctttaattgttagatatttctgtatggtgttatgtgtacttctgtagaatattttgtggatgtttatggttcgtggttatgctgagtgctgaattcttgttctggagtcctattgatatgaagattgagtgaggtcattaatttcagtggggtcttatggtttcatgatgatactgctcatgttggtagattattctttgtttcttggttgttttttatttgatgttttatttggtccagtgatgtccatgtgattagattctttatttgtgctatggaagtgaaaatatatttgattgcttctagtgttcgaaaattcttggggcacaatggcatgcctcctggaatcatgataccaaaactttgctttta

SEQ ID NO: 4672 - DNA, 2389 bp, Nicotiana benthamiana
attaaaatgcagcgaccaccgcaagaagatttttcgctcaaagagaccaaaccccaccttggtggagggaaggtcacaggtgataagcttactagcacctatgacttggttgagcaaatgcaatatctttttgtccgggtggtgaaagcaaaggacttacctgggaaggatcttacgggtagtcttgatccttatgttgaagttaggctcggaaactataggggtaccacccgtcactttgagaagaagtcaaatcctgaatggagtcaggtgtttgctttttccaaggatcggattcaagcgtctgtacttgaggtgactgtgaaagataaggatcttgttaaggatgactttgttggtcgcgttatgtttgatttgaatgagatcccaaaaagagtacccccagatagtcctcttgctccgcagtggtataggttggaggacagaaatggtaacaaagttaaaggagagctgatgttggctgtttggatgggtactcaagctgatgaagcctttcctgaatcttggcattccgatgctgcgactgttagtggtgctgatgctcttgcaaatataaggtctaaggtgtacctctcaccaaagctgtggtaccttagagttaatgtgattgaggctcaggacttaattcccggtgacagaagcaggtttccagaagtttacgtgaaggccatccttggaaatcaggcattgcgaaccagagtttccatgagcaagactatcaatccgatgtggaatgaggatctgatgttcgtagcggcagaaccatttgaggagccattgattttgagcgtggaagatagagttgcaccaaacaaggatgaagttctcggaaggtgtggtattcctttgcagtatattgataggaggttggaccaccgacctattaacagtaagtggtataatcttgaaaagcatataatggttgagggagaaaagaagaaggaaatcaagtttgcaagcaggcttcacatgagactatatttggaaggaggctaccatgttctggacgagtcaacccattacagtagtgatcttcgaccaactgcaaaacagttgtggaagtccagcattggtgtccttgaattgggtattctgaatgctcagggtctctcgccaatgaaatcaaaagatggtcgggcaacaattctgaatgctcagggcctctcgccaatgaaaacaaaagatgggcgggcaacaacagatgcttattgtgttgccaaatatgggcaaaaatgggttcgaacaaggacaattatagatagctttgctcccaagtggaacgagcaatacacttgggaagtatttgatccatgcactgtcataactattggtgtatttgataactgtcatctgcacggaggagataaatccggaggggcaagggactcgaggattgggaaggtcaggatccggctttcaactcttgaaacagatcgtgtctacacacattcttatccactattggtcttgcatcctactggggtgaagaagatgggtgaaattcacttggctgtaagatttacttgctcatcattaatgaatatgatgcatatgtattctcagccactgctacctaaaatgcactatattcatcctttaactgtcagccagctcgacagcttaaggcatcaagccactcagattgtctcaatgaggctgactcgtgctgagccacctttgaggaaagagatagtggagtatatgttggatgttggttcgcacatgtggagcatgagaagaagcaaagctaactttttcaggattatgggtgttttaggtggattaattgctattggaagatggttcgatcagatatgccattggaaaaaccccattacgactgttctgatccatatcttgttcttgatactggttctatatccggagcttattctgcctaccattttcctttatctcttcttaatcggagtttggtactacagatggaggcctagaaatcctccccacatggatactcgtctttcttgtgctgataatgtgcatcctgatgaactagacgaagaatttgatactttccctacttcacgtcctcctgatattgttcggatgaggtacgaccgtttgagaagtattgctggacggattcagactgtggttggtgatttggctactcaaggggagaggctgcagtctttactgagttggagagaccctagagcaaccgcattgtttgttattttctgcttgattgctgccattgtgctctatgtcaccccttttcaagttgtggcactcttgactggattttatgtgttaagacatccgcggtttcgtcacaagctaccatctgcgccgcttaatttcttcagaagattgcccgcaagaacagactgcatgctatgagcta

SEQ ID NO: 4673 - DNA, 2447 bp, Prunus persica
atgcagagaccacccccagaagactttgctttgaaggagaccaaaccccacctcggtggggggaggatctctggtgataagctcacgagcacctatgaccttgttgagcagatgcagtatctctatgtccgggttgtcaaggcgaaggacttgcctgcgaaagatgttactggtagttgtgacccttatgttgaagttaggcttggaaattataagggtgccactcgacatttcgagaagaagtcgaatccggagtggaaccaggtttttgcattctcgaaagatcgtattcaggcttcggttcttgaggtcattgtgaaggacaaggatgttgtgaaggatgatttcatgggtcgtgtttcttttgacctgaatgagattccaaaacgggtacctcctgatagtcctctagcaccgcaatggtatagattggaggataggaagggggacaaggttaggggagagctaatgttggctgtttggatgggcacccaagcagatgaagcttttcctgaagcatggcattcagatgctgctacagttagtggggctgacagtctttcaaatattcggtcaaaggatttgcaaccgagtgataaaggtaggtatcctgaagtttttgtgaaggctatactgggaaatcaggctttgagaactaggatttctccaagcaggagtataaatcctatgtggaatgaagatttaatgttcgtagcatcagaaccatttgaggagcccctgattttgagtgtggaggacagagtagcgcctaataaagatgaagttctaggaaggtgtgcaattcccctgcagtatgtgacccgaaggtatgatcataaacctgtgaacactagttggcacaatcttgagaaacatgttattgtagaaggggaaaagaagaaggaaattaagtttgcaagcagaattcatatgaggatctgtctggaaggtggttaccatgtccttgatgaatcaacacactatagtagtgatcttcgaccaacagcaaaaccgctgtggaagtccagcattggggttcttgaagtgggaattctgaatgctcaggggttgatgccaatgaagacgaaagatgggaggggtacaacagatgcttattgtgtggcgaaatacgggcagaagtgggttcgaacaagaaccattattgatagctttactcccaggtggaatgagcaatatacatgggaagtttttgatccttgtactgtcataactattggggtatttgataactgtcatttgcatgggggagataaggctggaggggccagggatgcaagaattggaaaggtaaggattcgtctctccacccttgaaactgatcgggtgtacacacactcttacccacttttagttctgcacccaaatggtgtaaagaagatgggtgaaattcatatggctgtgaggttcacttgctcttctttgcttaacatgatgcacatgtactcccagccactgttgccaaaaatgcactatattcatccattaactgtaagccagctcgatagcttgaggcaccaggccactcagattgtatcaatgaggctgagccgtgctgaaccaccactgaggaaagaagtggtagagtatatgctggatgtgggctctcacatgtggagtatgcgaagaagcaaagctaactttttcaggattatgaatgttttgggtggggtaattgctgttggaaaatggtttgatcagatctgtacttggaaaaaccccattacaactgtactcatccacatcttgtttataattctggtcatgtacccagagctcatattacctacaattttcctctacctcttcttgattggagtttggtattatagatggagaccaaggcatcctcctcacatggacactcgtctgtctcacgcagattctgcacatcctgatgaacttgatgaagaatttgatacattccctacttcacggccttctgacatagtaaggatgagatatgatagattgaggagcattgctgggagaatccagacagtggttggtgacttggctactcaaggggagaggctgcaatctttgctaagttggagagacccgagagcaacatcactgtttgtgcttttctgtctgattgctgccattgttttgtatgttacaccattccaggttgtggctcttctcgctggattctatgtgttgaggcacccaagattccgtcataagcttccttctgtgccgctgaatttcttcaggaggttgccggctagaactgactgcatgttgtgaggaagacttttatcttcagttgcctttgagtggcacgacattctattttccgccatttcgtgttaagttaatgaagaagatgctgtacctcattgagccattttgttttgaatgctcagcagcaatgaacatggagaacatgttctggtatgatgtatgtatgaccttgccttgaa

SEQ ID NO: 4674 - DNA, 3034 bp, Nicotiana benthamiana
ttctctatcactttgataccaaaagcgaccaaaaccccttttgctttttctcctcaaggttccactcttgagaaccttatcagcagaaaatcctatctttcatcatcagctaacatgaacccttgcagggttgaagaattcagatgaatcggatctaaggttgtgaatggttttggcattttcaggttatctttaatgaggtcttttctatcctttcttaacccttaagtttttcaactgataaagatttagggttaaacatacttaagactctggtgtatttgaggtttcttgagcattactgtagctggagttatttctgagagaagttgaagggttttggttcagtgtttatttcttgagtgagaactagtagccttaaaaatgcagagaccaccacaagaagatttttcacttaaggagaccaaaccccaccttggtggagggaaggtcacaggcgataagcttactagcacctatgacttggttgagcaaatgcattatctttatgttcgggtggtgaaagcaaaggacttacctgggaaggatgtaacgggtagtcttgatccttatgttgaggttaggctcgggaactataggggtacgacccgtcattttgagaagaagtcaaatcccgaatggaatcaggtatttgctttttccaatgatcggattcaagcttctgtacttgaggtgaccgtgaaagataaggatcttgttaaggatgattttgttggtcgctatatgtttgatttgaatgagatcccaaaaagagtgcccccagatagtcctcttgctccgcagtggtataggttggaggacagaaatggtaacaaagttaaaggagagctgatgttggctgtttggatgggtactcaagctgatgaagcctttcctgaatcttggcattccgatgctgcgactgttagtggtgctgatgctcttgcaaatataaggtctaaggtgtacctctcaccaaagctgtggtaccttagagttaatgtgattgaggctcaagacttgattcccggtgacagaagtagatttccagaagtttacgtgaaggccatccttggaaatcaggcattgagaaccagagtttccatgagcaagactataaatccaatgtggaatgaagatctgatgtttgtagcggcagaaccatttgaggagccattgattttaagtgtggaagacagagttgcaccaaacaaggatgaagttctcggaaggtgtgctattcctttgcagtatattgataggagattggatcacagacctattaatagtaagtggtataatcttgaaaagcatataatggttgagggagaaaagaagaaggaaatcaagtttgcaagcaggcttcacatgagactatatttggaaggaggctaccatgttctggacgagtcaacccattacagtagtgatcttagaccaactgcaaaacagttgtggaagtccagcattggtgtcctagaattgggtattctgaatgctcagggcctctcgccaatgaaaacaaaagatgggcgggcaacaacagatgcttattgtgttgccaaatatgggcaaaaatgggttcgaacaaggacaattatagatagctttgctcccaagtggaacgagcaatacacttgggaagtatttgatccatgcactgtcataactattggtgtatttgataactgtcatctgcacggaggagataaatccggaggggcaagggactcgaggattgggaaggtcagaatccggctttcaactcttgaaactgatcgtgtctacacacattcttatccactactggtcttgcatcctacgggggtgaagaagatgggtgaaattcacttggctgtaagatttacttgctcatcattaatgaatatgatgcatatgtattctcagccactgctgcctaaaatgcactacattcatcctttaactgtcagccagctcgacagcttaaggcatcaagcgactcagattgtctcaatcaggctgagtcgtgctgagccacctttgaggaaagagatagtggagtatatgttggatgttggttcccacatgtggagtatgaggagaagcaaagccaattttttcaggattatgggtgttttagggggattaattgctattggaaaatggttcgatcaaatatgcaattggaaaaaccccattacaaccgttctgatccatatcttgttcttgatacttgtcctatatccagagcttattctgcctaccattttcctctatctattcttaatcggagtttggtattacagatggaggcctagaaatcctccccacatggatactcgtctttcttgtgctgataatgctcatcctgatgagttagacgaagaatttgatactttccctacttcacgttcccctgatctagtggatcctgatgagttagacgaagaatttgatactttccctacttcacgtcctcctgatattgttaggatgaggtatgaccgattgagaagtattgcaggacggattcagactgtggttggtgatttggctactcaaggggagaggcttcagtctttgcttagctggagagaccctagagcaaccgcactgtttgtgattttctgcttgattgctgccattgtgctctatgtcacgccctttcaagtcgtggcactcttgactggattttatgtgttaagacatccgcggttccgtcacaagctaccatctgcaccgctcaatttcttcagaagattgcctgcaagaacagactgcatgctatgaactctacattttgcttctgttatctttatcatcctgtgttttcctcctttccttttctctcgaatcaatgaaaatgatgtaaaaaagttgggcttttctttcaccaagtggtgaatgttagatcctactccatgtgtaagatctccctgaagtgttagttctagtgaatttactgtttgttgaaagatggttgcttgatgcaaatctatgttactatattgtggggttctttcttcttgaacacacttccttgattaattca

SEQ ID NO: 4675 - DNA, 3287 bp, Lactuca sativa
aggtcttgtataataaaagagaaagagacaaacacacgctctgacacacaccccgattcttcaacaacacacgcacaaacatccccgttaccgcctttgtctttgccttttcactttcctctctccaaattctaaaaccctccttctttctctctccctctctctctaaaaaccaaaccccccctccattgattccgcaaaacaacaaacaaaccccgtttaaattccttcaacattcctgcaaatcgtcccaagaatctacttcatcaaatctctgtgtcattttcactcctcataaggacaagagttttcagatctgtagctttcaaatatacctttttttatttaatttcatcagatgatgaacatgaacagacctccaaatgaagatttctcgctcaaagagacgaaaccccacctcggtggaggtaaggtcaccggagataagctcacaagcacctacgacctcgtcgaacaaatgcaatacttatacgttcgtgtcgttaaagccaaagatttacccacaaaagatgtcaccggaagctgtgacccatacgtcgaggttcgaatggggaactacaaaggaacaactcgtcatttcgagaagaaaaccaatccggaatggaaccaggtcttctccttctccaaagatcgaattcaagccacaatgctcgaagtcacagtaaaagataaagatcttatgaaagacgatatcatgggtggggttctattcgatctcaacgaggttcccaaacgagtcccaccggattctcctcttgctccacagtggtatcgattatccgatcgaaaaggagacaaactgaaaggcgagttaatgttagcagtctggtggggtacgcaagcagatgaagcgttccccgaagcctggcattccgacgccgctgccgttagcgccgatggtctcgctagtatccggtcaaaggtttatctttccccgaaactttggtatcttagagtgaatgtgatcgaagctcaagatttgatcccaaacgatcgtaccagatttcccgaagtttacgtaaaagccgtcctcggaaaccaggctttaagaaccagaatctcaacgagcaagacgataaacccattatggaatgaagatttaatgttcgtggctgctgaaccatttgaagagccattgattttgagtgtagaagacagagtcgcgcctaacaaagacgaagtcctcggaagatgtgcaatcccgttacagtatgttgaccggaggttagaccataaagcgatcaacacccggtggtttaatctcgaaaaacatgtcatcatcgaaggtgaaaaaaagaaggaagtgaaattcgctagcaggattcacatgcgtgtctgtttggaaggtgggtatcacgttcttgacgaatccacacattacagttccgatcttagacccactgctaaacagctatggaagaacagcatcggagttcttgaagttggaattttgagcgctaatggattatcaccaatgaaaacgaaagacggacgtgcaacaactgacgcatattgtgtggctaaatatggaacaaaatgggtaagaacacgaaccataatcgacagttttgttcccaaatggaatgaacagtatacatgggaagttttcgatccatgtactgtgataaccattggagttttcgataactgccacctccaaggcggaggagacaaggcggcaggtggcgggggtaaccgggattctcggatcggaaaggtccggatccgcttatcaacacttgaaacggatcgggtttacacccattcgtatccgcttcttgttttacacccatctggagtgaaaaaaatgggggagatccatttagctgttcgattcacatgttcttctttactcaacatgatgcatatgtattctcaaccacttttacccaaaatgcattacattcatccattaacagttgctcaattggaaagcttgcgacaccaggcgacccagattgtttccatgcggctgagcagggctgagccaccgttgaggaaggagatagtggagtacatgctggatgtgggttctcacatgtggagtatgagacgaagcaaagctaatttcttaagaatgatgggggttttaggtggaatgattgctatcgggaaatggttcgatcagatttgcaattggaaaaacccaatcaccactgttcttatccattttcttttcttgattctcgtgttataccctgaactgattttacccactatttttctctacctttttctaattggactttggtattaccgatggagacctagaaacccacctcacatggacacccgactttcatgtgctgataatcttcatcccgatgaacttgatgaagaatttgatacgttcccaacttcacgtcaaccagatattgtgaggatgagatatgatcggcttagaagcattgctggaaggatgcagacagtggttggagatttagcgacacaaggagaaaggtttcagtcgctgattagttggagagacccaagagctacttcactgtttgtgatattctgtttgattgctgctgttgttctttacgtgacgccttttcaagttgttgcaatttttgctgggttttatgtgttgcgacacccgaggtttcgtcgcaggttgccttctgtgccccttaacttctttagaaggttacctgccagaactgactgtatgctgtgagccaaaagatcctggattttattgccaagatcaccccttatgttagtttctagtttttttttgtaagttgtggagtttgatctggatctatcgatggttttgtcatatgtgtatgaactatgaaggattttggattctgttttgtttgatgcgaatctgatgcagatttggatctttgtatgttatggttagttaaaccatttggttttattctcttcctttttcttatttaatcgcattcatgctttacactttgggttggttttctacatattagtctcctcatccaaaagcccagcccggttaccagttaaggtccatagggtttgggctcaagttctgacgacatgacctgactcgacttaagcctgtataggcccgcaaaaaccctgtgagattgtttgaagtccgcaagcctagctgatgggacggttagttattcaaatcccgatcaatcctgctcgcaagccgggccatgaaggctggcctttttgtgcacctctacataagtctttcgtaggcttgtaagaaatagttaaaacatttttactgattagatacttgtacttttattaggatatttaag

SEQ ID NO: 4676 - DNA, 2606 bp, Gossypium hirsutum
aagttcaaagtctttctcacaagtaataatctttaaaacctattttttaaattatttttagtctaatatatttgtattatttgtagcaggaaattgctgaatctgtcttgtgtgctgtttagtactgtttttgattattaagatgcagaagccaccacagtctatagatttcgctttgaaggagacttcaccgaagatcggtgccggagctgtgacgggcgataagctatcgagcacgtatgatctggtggagcaaatgcaatacctttacgttcgtgtggtaaaggcgaaagatttaccggggaaagatgtaactggtggctgtgatccttatgttgaagttaagctagggaactataaaggagttactaagcatttcgagaagaagaacaatcccgaatggaatcaagtgtttgcgttctcgaaagaacggattcaagcttcggttttagaagtatatgtgaaagataaagatgtggtggccgatgatttaatcgggagggcattgttcgatcttaatgagattccgaaaagaattccaccagatagtccgttggcaccgcaatggtatcggttggaggatcggaagggggataaagctaaaggagagttaatgcttgctgtttggatggggacacaagccgacgaagcatttcctgaggcttggcactcggatgctgcatcggttggtccggatgctgttgcgagtatccggtcgaaagtttatctttcgcctaagctttggtatgtgagagtgaatgtgatcaaagctcaagatttggtacctaatgacaaaagccggttccccgaggttttcgtgaaagcaatgctcggaaatcaagctttgaggactcggatatctcaaagtaagactattaatccgatgtggaatgaggacttaatgtttgtggttgccgagccgtttgaagagccgttggtgctaagtgttgaagatagggtcggggggaacaaagacgaaacgttggggaaatgtgtgattcctttacatatcgtgcagcgaaggttggaccatagaccggtgaatagtcaatggcttaatctcgagaaacatgtgattgtcgatggagagaaaaaagagattaaatttgctagtaggattcatttgaggatttgtttagaaggtggatatcatgttttggatgaatcgactcattatagtagtgatcttaggccgacagctaaacagttatggagacctagtatcgggattttggaactcggtattttaagtgctcatggacttatgccaatgaaaacaaaagatggacgaggaactacggatgcttattgtgtagctaagtatgggcagaaatggatccggacgaggacgattgtcgataactttatgccaaggtggaacgagcaatacacttgggaggttttcgatacctgtactgttatcacagtgggtgttttcgataacggacatgtacatggaggagccggaggggctagagacgcgagaatcggaaaggtacgaattcggctttctacgcttgaagctgatagggtgtatacacactcgtatcctttacttgtgctgcatccatcaggcgtgaaaaaaacgggcgaaatccaattggcattgagattcacttgttcgagtttgattaacatgttgcatatgtactcgcatccgttactaccaaaaatgcattacattcatccattatcggtgattcaactcgatgttttaaggcatcaagctatgcagattgtttcaacgagactcagtcgagccgagccaccgttgaggaaagaagttgtcgagtacatgctcgatgtcgattcgcatatgtggagtatgaggagaagtaaagctaattttttccgaatcatgggtgttttaagtggattaattgctgtcggaaaatggttcgatcaaatctgtaactggagaaacccgcttacgacgattttaatccatatcctttttatcatcttagtcctttatcccgagctgatacttccaacaatctttctttaccttttcttaattggaatatggaactatcggtggagaccacgacaccctcctcatatggatactcggctttcacatgctgatgcagctcatcctgatgaactagacgaagagttcgatactttcccgacttctcgaccttccgatatcgtacggatgaggtacgatcgtttaagaagtatagctgggagagttcaaactgtgatcggtgacctcgcaactcaaggggaacgatttcagtccttgctaagctggagagacccgagagcaaccacattatttgtgacattctgtttgatcgctgccttggttctttacgttacgccattccaagtcgttgctcttcttgcaggaatttacattttacgacacccgaggttccgtcacaagcttccatcgacacctcttaacttctttaggaggttgcctgcaagatcagacagcatgttatgagcaccccaagcagccattatatgttttccgatgttcgcggcaatcggagctatggagttggtgggaaattcatggtttttgttataaattatgtaatgtgtgtaattttcgacttgtttagtaaatttcatgctaactgtagcccttt

SEQ ID NO: 4677 - DNA, 2576 bp, Gossypium hirsutum
gaaattgctgaatctgtcttgcgtgttgtttagtactgtttttgattatcaagatgcagaagccaccacagtctatagatttcgctttgaaggagacttcaccgaagatcggtgccggagcggtgacgggcgataagctatcgagcacgtatgatctggtggagcaaatgcaatacctttacgttcgcgtggtaaaggcgaaagatttaccggggaaagatgtaactggtggatgtgatccttatgtcgaagttaagctagggaactataaaggagttactaagcatttcgaaaagaagaacaatcccgaatggaatcaagtgtttgcgttctcgaaagaacggattcaagcttcggttttagaagtatatgtgaaagataaagatgtggtggccgatgatttaatcggaagggcattgttcgatcttaatgagattccgaaaagaattccaccagatagtccgttggcaccgcaatggtatcggttggaggaccggaagggggataaagctaaaggagagttaatgcttgctgtttggatggggacacaagccgacgaagcatttcctgaggcttggcactcggatgctgcatcagttggtccagatgctgttgcgagtatccggtcgaaagtttatctttcgcctaagctttggtatgtgagagtgaatgtgatcgaagctcaagatttggtacctaatgacaaaagccggttccccgaggttttcgtgaaagcaatgctcggaaatcaagctttgaggactcggatatctcaaagtaaaactattaatccgatgtggaatgaggacttgatgtttgtggttgccgagccgtttgaagagccgttggtgctaagtgttgaagatagggtcggggggaacaaagacgaaacgttggggaaatgtgtgattcctttacatatcgtgcagcgaaggttggaccatagaccggtgaatagtcgatggcttaatctcgagaaacatgtgattgtcgatggagagaaaaaagagattaaatttgctagtaggattcatttgaggatttgtttagaaggtggatatcatgttttggatgaatcaactcattatagtagtgatcttaggccgacagctaaacagttatggagaccgagtatcgggattttggaacttggtattctaagtgctcatggacttatgccgatgaaaacaaaagatggacgaggaactacggatgcttattgtgtagctaagtatgggcagaaatggatccggacgaggacgattgtcgataactttatgccaaggtggaacgagcaatacacttgggaggttttcgatacttgtactgttatcacagtgggtgtttttgataacggacatgtacatggcggagccggaggggctagagacgcgagaatcgggaaggtacgaattcggctttctacgcttgaagccgatagggtgtatacacactcgtatcctttacttgtgctgcatccatcaggcgtgaaaaaaacgggcgaaatccaattggcgttgagattcacttgttcgagtttgattaacatgttgcatatgtactcgcatccgttattaccaaagatgcattacattcatccattatcggtgattcaactcgatgttttaaggcatcaagctatgcagattgtttcgacgagactcagtcgagccgagccaccattgaggaaagaagttgtcgagtacatgctcgatgtcgattcgcatatgtggagtatgaggagaagcaaagcgaattttttccgaatcatgggtgttttaagtggattaattgctgtcggaaaatggttcgatcaaatctgtaactggagaaaccctcttacgacgattttaatccatatcctttttatcatcttagtcctttatcccgagctgatacttccaacgatctttctttaccttttcttaattggaatatggaattatcggtggagaccacgacaccctcctcatatggatactcggctttcacatgctgatgcagctcatcctgatgaactagacgaagagttcgatacttttccgacttctcgaccttccgatattgttcggatgaggtacgatcgtttaagaagtatagctgggagagttcaaactgtgatcggtgacctcgcaactcaaggggaacgatttcagtccttgctaagctggagagacccaagagcaaccacattattcgtgacgttctgtttgatcgctgccttggttctttacgttacaccattccaagtcgttgctcttcttgcaggaatttacgttttacgacacccgaggttccgtcacaagcttccatcgacacctcttaacttctttaggaggttgcctgcaagatcagacagcatgttatgagcacccgaagcagccattatatgttttccgatgttcgcggcaatcggagctctggagttggtgggaaaatcatggtttttgttataaattatgtaatgtgtgtaattctcgacttgtttagtaaatttcatgctaactgtagccctttatttttatgttttctttcttcagacaatctgttagcactatgttgtcaattttctattt

SEQ ID NO: 4678 - DNA, 2937 bp, Gossypium raimondii
aataaataaataaacattgaaaagtaaaaaaaaaaaaaaaggtcggtttggttggtacccagtagtagattcagtctttcttctttatctgtttttaaaaaacagatctttcagtgtcacaactcacatgtcccccattcctaatcttcaaactcccttttacttcaaaaatatttataatttcttttccattcttcatcaaagtttcattctttttcttacattcctacaaaggttcaagttcaaagctttctcacaagaaattgctgaatctgtcttgcgtgttgtttagtactgtttttgattatcaagatgcagaagccaccacagtctatagatttcgctttgaaggagacttcaccgaagatcggtgccggagcggtgacgggcgataagctatcgagcacgtatgatctggtggagcaaatgcaatacctttacgttcgtgtggtaaaggcgaaagatttaccggggaaagatgtaactggtggctgtgatccttatgtcgaagttaagctagggaactataaaggagttactaagcatttcgaaaagaagaacaatcccgaatggaatcaagtgtttgcgttctcgaaagaacggattcaagcttcggttttagaagtatatgtgaaagataaagatgtggtggccgatgatttaatcggaagggcattgttcgatcttaatgagattccgaaaagaattccaccagatagtccgttggcaccgcaatggtatcggttggaggaccggaagggggataaagctaaaggagagttaatgcttgctgtttggatggggacacaagccgacgaagcatttcctgaggcttggcactcggatgctgcatcggttggtccggatgctgttgcgagtatccggtcgaaagtttatctttcgcctaagctttggtatgtgagagtgaatgtgatcgaagctcaagatttggtacctaatgacaaaagccggttccccgaggttttcgtgaaagcaatgctcggaaatcaagctttgaggactcggatatctcaaagtaagactattaatccgatgtggaatgaggacttgatgtttgtggttgccgagccgtttgaagagccgttggtgctaagtgttgaagatagggtcggggggaacaaagacgaaacgttggggaaatgtgtgattcctttacatatcgtgcagcgaaggttggaccatagaccggtgaatagtcgatggcttaatctcgagaaacatgtgattgtcgatggagagaaaaaagagattaaattcgctagtaggattcatttgaggatttgtttagaaggtggatatcatgttttggatgaatcaactcattatagtagtgatcttaggccgacagctaaacagttatggagaccgagtatcgggattttggaacttggtattctaagtgctcatggacttatgccgatgaaaacaaaagatggacgaggaactacggatgcttattgtgtagctaagtatgggcagaaatggatccggacgaggacgattgtcgataactttatgccaaggtggaacgagcaatacacttgggaggttttcgatacttgtactgttatcacagtgggtgttttcgataacggacatgtacatggcggagccggaggggctagagacgcgagaatcgggaaggtacgaattcggctttctacgcttgaagccgatagggtgtatacacactcgtatcctttacttgtgctgcatccatcaggcgtgaaaaaaacgggcgaaatccaattggcgttgagattcacttgttcgagtttgattaacatgttgcatatgtactcgcatccgttattaccaaagatgcattacattcatccattatcggtgattcaactcgatgttttaaggcatcaagctatgcagattgtttcgacgagactcagtcgagccgagccaccattgaggaaagaagttgtcgagtacatgctcgatgtcgattcgcatatgtggagtatgaggagaagcaaagcgaattttttccgaatcatgggtgttttaagtggattaattgctgtcggaaaatggttcgatcaaatctgtaactggagaaacccgcttacgacgattttaatccatatcctttttatcatcttagtcctttatcccgagctgatacttccaacgatctttctttaccttttcttaattggaatatggaactatcggtggagaccacgacaccctcctcatatggatactcggctttcacatgctgatgcagctcatcctgatgaactagacgaagagttcgatactttcccgacttctcgaccttccgatatcgttcggatgaggtacgatcgtttaagaagtatagctgggagagttcaaactgtgatcggtgacctcgcaactcaaggggaacgatttcagtccttgctaagctggagagacccaagagcaaccacattatttgtgacgttctgtttgatcgctgccttggttctttacgttacgccattccaagtcgttgctcttcttgcaggaatttacgttttacgacacccgaggttccgtcacaagcttccatcgacacctcttaacttctttaggaggttgcctgcaagatcagacagcatgttatgagcacccgaagcagccattatatgttttccgatgttcgcggcaatcggagctctggagttggtgggaaattcatggtttttgttataaattatgtaatgtgtgtaattctcgacttgtttagtaaatttcatgctaactgtagccctttattttatgtttttcttttcttcagacaatctgttagcactatgttgtcaattttctattttcagtttttaccataattccatctctcttttttatttcacatatgaaccctaaaccgagtaacgagtagtttaataacttttaaataaagtctcgaattta

SEQ ID NO: 4679 - DNA, 2781 bp, Arabidopsis lyrata
tttacttttctctcactacagtcctttctctctctctctttctaaaaatctctcaatgcttatcttctgattttacgaggaagaagaagaaagaaagtttttttcttttcacttctttctttttttgagtgttttatgtttagcagattctgagatttttggtgttcatctttttctggggttgtttgttttgaagatctaacttatagatctactgttttgaaacccactcactgaaaaaaatccaaactttactagtttcaaagatgcagagaccacctcctgaagatttctccttaaaggagactaaacctcatctcggtggaggcaaagtcaccggagataagctcacgaccacatatgacctcgtcgagcaaatgcagtatctctatgttcgtgtcgtaaaggctaaagatttaccaggtaaagacttaactggtagttgtgatccttacgttgaagttaagcttggtaactacagaggaaccactagacattttgagaagaaatctaatcctgagtggaaccaagttttcgccttttcgaaagatagggtacaagcttcttatcttgaagctactgtcaaggataaagatttagttaaagatgatttgattggtcgtgttgtgtttgatttgaatgagatacctaagagagttccacctgatagtcctttagctccacaatggtatagattagaagatgggaaaggccagaaagttaaaggagagcttatgttagctgtttggtttggtactcaagctgatgaagcttttcctgaagcttggcactctgatgctgcaactgttagtggaactgacgctttagctaacatcaggtctaaggtttatctgtctcctaagctttggtatcttagggttaatgtgattgaagctcaggatttgataccgagcgataaagggagatatcctgaagtttttgtgaaagtgataatgggaaatcaggcattgaggactagagtgtcacaaagcaggagtattaatccgatgtggaatgaggatttgatgtttgttgtagctgagccgtttgaggagcctttgattctaagtgtggaagatagagttgcaccgaataaagatgaagtcttggggagatgcgcggttccgttgcagtatttggacaaaaggtttgactatagaccggtgaacagcaggtggtttaacctcgagaagcatgttataatggaaggaggagagaagaaagagatcaaattcgccagcaagattcacatgaggatctgtttggaaggaggttatcatgtgcttgatgaatctacacattacagtagtgaccttagaccaactgcaaagcaactatggaagcctaacatcggtgtgcttgagcttggagtcttaaatgcgacgggtttaatgcctatgaaagctaaagaaggtggtaggggaactacggatgcgtattgtgtggcaaagtatgggcagaaatggatcagaactcggacaatcattgacagctttaccccaagatggaacgagcaatatacttgggaagtttttgatccgtgtactgttgttactgttggtgtgttcgataactgccatctacacggtggtgacaaaaacaacggaggaggaaaagattcaagaattgggaaggtgaggataaggctttctactctcgaggctgatcgagtctacacacattcatatcctcttttggtgctacatcctaatggagtcaagaaaatgggagagattcacttagctgtaaggtttacttgctcttcattgctcaacatgatgtatatgtattctttgcctctcttaccgaagatgcactacctccatcctctcacggttagccagcttgataacttgaggcatcaagcgactcagattgtgtcgacaaggctaacacgtgcagagccgcctttgaggaaagaagttgttgagtatatgcttgatgtgggatctcacatgtggagtatgcgtagaagcaaggcgaatttcttcaggataatgggagttttgagtgggataattgcggtagggaaatggtttgaacagatctgcgtatggaaaaatccgataacaacggtcttaatccacattctgttcattatccttgttatctatcccgagctcatcttacccaccattttcctctaccttttcttgattggagtttggtactatcgttggaggccgagacatcctcctcacatggacacacgtctctcacacgcagactcagcacaccctgatgagctcgacgaagagttcgacacttttcctacttcccgaccatcagacatcgtcaggatgagatatgacagactcagaagcattgctggtaggattcaaacagttgttggtgatcttgcaactcaaggagagagattccagtcgttgctaagttggcgtgaccctcgtgccactgctctattcgtcttgttctgtctgatagctgcagtggttttgtatgtaactccctttcaggttgtggcttttcttattggcttgtatgtgcttagacacccgaggctcagatacaagctcccatcagttcctcttaacttcttcaggagacttccagcaagaactgattgcatgctctgagttacttaagatttatccatttcaagaaagactcctctgttttagtttgttatcatttaagtctctatcttcttctttgtgatgttggatgattatgttttcttctgtttgacattattaagtccttattaaaactttgttttgaaagttgtaagataagtttatgtttggtttctagcttcgc

SEQ ID NO: 4680 - DNA, 2313 bp, Eschscholzia californica
ttttgtagaacttctaagaaagaaggagtttcttctaaagggtttctgcaagtttcttcctcctacatttgtatcccctgctttttgttcttgtagttgagatgatgcagcgacctcacccaacggaggatttctccttaaaggagacctcaccccatctcggtggtggtctcgccggtgataagcacactagtacttatgatcttgttgagcagatgcaatatctgtatgttcgcgtcgtgaaagctaaagatttgccgacgaaagacgttacaggaagctgtgacccatatgtggaagtgaagcttggaaactataagggtactactcgtcacttcgaaaagaagacaaaccctgagtggaatcaagtatttgcattctcaaaagatcgaatccaagcttctgttgttgaggttttggtgaaagataaagattttatgaaggatgatttcatgggtcgggtttggtttgatctcaatgaagtgcctaagcgtgttccaccagatagtcctttagccccgcaatggtatagattggaagatcgaaaggtgataaagttaaaggagagcttatgttggctgtttggatgggtacccaagctgatgaagcgtttccagaggcgtggcactcagatgcagcaactgtaggtggtgaaggtcatgctaacattcggtcgaaggtatatgtttctcccaaactttggtatcttagggttaatgtgattgaagctcaggacttgcaacctggtgacaaggtagggtacccagaagtttacgttaaagcaatacttggaaatcaagcattgagaactagagcatctcagagccggaacattaacccactgtggaacgaggacttgatgtttgtagcatctgaaccgtttgaagaacacttgatattgagtgtggaagatagagttgcaccaaacaaggatgaagtattgggtaaatgtgtaattcctctacagagcgtggataggagactggatcacagagctgtgaatacaagatggtttaatcttgagaagcacgttgttgttgatggagaaaggaggaaagacaatcgtttttgctagtaggattcatttgagaatttgtttggatggcgggtatcatgtattggacgagtcaactcactacagtagtgatcttagacccacagcaaagcagttatggaagccaagcattggggttctagaattgggaattttgactgcgaatggtttattgccgatgaaaaccaaagatgggcgaggaactacagatgcttattgtgtggctaaatatgggcagaagtggatcagaacaagaacaattattgattgtcctactccgaaatggaatgagcaatacacttgggaggtttatgatccgtgcactgttattacgattggggtttttgataactgtcatttacatggaggggataaatcaaatggtgcaaaggactcgaggatcgggaaggtgagaattcgtctttctacgcttgaagctgatcgggtttatactcactcttatcctcttctggttttacatccttctgggttgaagaagatgggcgaaattcaattggctgtaagatttacatgctcttctttgctcaatatgatgcatatctactctcaaccactattacctaaaatgcactatcttcatccattatctgtcactcaactcgataacttaaggcaccaagctcatcaaattgtatctatgaggctaagtcgtgccgagccaccattaaggaaagaagttgtggagtatatgttagatgttgattcacatatgtggagtatgagaaagagtcgagctaactttttcaggattatgggagttctgagtggattaattgcagttgctagatggtttgatcaaatatgtgtttggaaaaatcctcttacaactattctgattcacatactctttataatacttgttctatacccggaactgattctacccaccatttttctctacttgttcttgattggtgtttggtactttcgttggagaccaagaaagccacctcacatggatacccgactctcacatgccgagaatgttcatccagacgaacttgacgaagagtttgatacctttcctacttctcgaccttctgatatagtaagggcgagatatgatcgattgagaagtgtagctggaaggattcaaacagtggtcggtgatttagcaacccaaggagaaagattgcagtctctgcttagttggcgagacccaagagctacatctctgtttgttactttctgtttgattgctgccattgttctttatgtgactccgtttcgagtggttg

SEQ ID NO: 4681 - DNA, 3855 bp, Theobroma cacao
taaaaaagggaggggtaaggtggtatatttgtcacaaaagccccgtacattgtaactggtgggtgatatcacgagaaaaccaataagattaaaagacaaagagatttgtggtgccccaagagaaagtgaaacccccaacaccaagtcagaggtccaccaacgtacacaacaaacaagcaaacgaaacgaaacaaaacgaaaacaaagtaaactcttctcctcgcatgtgcccaaaccgaccacagtcttcccacgtgtgacctttttctttttcttctttttaacccctttgctactcctactaattgttattgcttcgaagaagaattgaaaaccaattaaacaataaagaaaaggtgaaaagaaaaaagttggtactgagtaggttctttgtgttctttatagatagattcagtctttttaacagttctctcactacccccccaccccctttgtccccatttctatcttgcttcactcctcacttgcttctgcttctaaacatggagataaaagcagatatattctaaaaggttttcattcttgcaccttcaagaaagctgcttcttttcttacactcttgcaaaaggtttttgtgtctcaacttgaaagctttccacaagtgcctagtgttaaactattactcaaaagctaaatatttttatcctcgccttctttcacttccttttattcttccttaattagagatttgagccttcaacactcgaactcccccagcttttgccttttttttttcagctttcaactcttaaggttgtagcagggtttttcttttcttttgtattcaaattgcctgataatcacagctgaacacttcagcttttggtttctgtggcatttttatctctaccatcccgaccgtgtttcaatattctatttctttttgcctgataacagttgtctcgtcttgcataactgttgagtgttctttagaagaaagatgcagaagcctccacaatctgtagattttgccctaaaggagacctcgcccaacattggggcaggagctgtcacgggtgataagctgtcttgcacctatgacctcgttgagcaaatgcaatacctctatgttcgagttgtcaaggccaaggatttacccggaaaagatgtcactggtagttgtgatccctatgttgaggtcaaacttggaaactacaagggagttactaagcatttcgagaagaagaccaatcctgaatggaatcaagtatttgctttctcaaaagaaagaattcaagcttctgttttggaagtgttagtgaaggacaaggacgttgttatagatgatttaatcggcagggttatgtttgatctcaatgaaattccaagaagggttcctccagatagcccactggcgccacagtggtatagattggaagatcgaaagggcaataaagctaagggagagctcatgttggctgtttggatgggaactcaagcagatgaggcatttcctgatgcatggcattcagatgctgcatcggttggccctgatggtgttgcaaatattcgatcaaaagtgtatctttcccctaagctttggtatgtgagggtgaatgtgattgaagctcaggacttggtaccgactgataaaagcaggttcccagaagtttttgtgaaagttgctcttggaaatcaggctttaagaactagagcatctcaaattaagactatcaatccaatgtggaatgaggacttaatgtttgtagttgctgaaccttttgaggagcctttggttctaactgtggaagatagggtgggatcaaacaaggatgaaaccttggggaagtgtgtaattaatctgcatgctgtgcagagaaggttagaccataaacctgtgaacagtaggtggtacaatctggagaaacatgtgattgtggatggagagaagaaagaaacaaaattttccagtaggattcacttaaggatttgtttggaaggagggtatcatgttttggatgaatctacacactacagtagtgatcttagaccaacagcaaaacagttatggagacccagcattggaattctggaactgggtattctaagtgctcatgggctgatgccaatgaaaacaaaagatggacgaggaaccactgatgcttactgtgtggctaagtatgggcagaagtggattcggacgaggacaattgttgacaactttatgccaaagtggaatgagcaatacacttgggaggttttcgacccttgtactgttattacagtaggggttttcgataatggtcatatgcatggggaagctggagggacaaaggatgcgagaattgggaaggtaaggatacggctgtctacacttgaagctgatagggtctatactcactcgtatcctcttctggtgctgcattcttcaggggttaagaagacaggtgaagttcaattggctgtgaggttcacctgctcaactttgattaacatgctgcatatgtattcacatccgctgttgcctaagatgcactacatccatccattgtctgtgattcagcttgatagcttgaggcaccaggctatgcagattgtctcaatgaggctgagccgggctgagccaccattgaggaaggaagttgtggagtacatgcttgatgttgattcacacatgtggagcatgaggagaagcaaagcgaactttttcagaattatgggagttctaagtgggttgattgcagttggaaaatggttggatcaaatatgcaattggagaaaccctcttacaaccattctgattcatatccttttcattatattagttctttatcctgagctaatacttcccacagtttttctctaccttttcctaattggaatctggaactaccggtggaggccacgacaccctcctcacatggacacgcggctctctcatgctgatgctgcccatcctgatgaactagatgaagagtttgataccttccccacttctcggccttcagatattgtcaggatgagatatgaccgtctaagaagtatagcagggagagttcagactgtgattggtgatcttgcaactcaaggggaaagatttcagtctctgctaagctggagagacccaagagcaaccactctttttgtgacattctgtttgatagctgccatagttctttatgttacaccattccaggttgtggctctcctcataggcctttatgccctaaggcatccaagattccgccacaaacttccttctgtacctctcaacttctttaggaggttgcctgcaagatctgacagtatgctataagcataaccagccattatatgttcctccttttcattgaatgtctagtatgcaaatccagaagctgggcaaaagaagcagcacttcgagctctttacttggttgcaaatgcatggttctggtataatgtgtaattttcatctgccttatctagtaaatttcacgcaactgtagcctcttctgtgttttttccggcaacctgttgtcattatgctttcaatttttagatttcaacttcaccattattccatttttctcttcccctatttatcttactaatattatttgcctaagtatgattgtgtgatcaaagttcacaatcatccttttcatttggttttccaggacatttgaatgtatgtgttcagtttttggaggaaacgacagttacaacttagtaaacaaaccagaagtgatcataaacgattgggatggcatcactgtttagaaccttgtggtttcaatctcatgtcagtctatgtgaatgttaaaccagatgcctttccaacagttttatctgttcttctatgcagaccagagagctcaaaatgtttggcattaactaaattgagaattcgcgg

SEQ ID NO: 4682 - DNA, 2700 bp, Glycine max
gggaacggttgttgaaggctttggattataattttgaattttggtttctcggttctctgaagtgagggaaaaatgcagaggcctccacctgaagattttctgttgaaggagaccaagccccaccttggaggcggaaaggtttccggtgatagacttaccagcacctatgatctcgttgagcaaatgcagtacctttatgtgagggtcgtgaaggcgaaggacttgcccgcgaaagatatcactgggagttgtgatccttatgttgaagtcaagcttgggaactacaagggaaccaccaggaatttcgccaagaacacacatcctgagtggaaccaggttttcgccttctcgaaggaccggcttcaggcctcgatgctggaggttaatgtgatagataaagatgttctgaaggatgacctcatcggccgggtgtggtttgacctgaatgagatcccgaaaagggtacctccggatagccctctggctcctcagtggtatagattggaggataggaagagcgacaaagcgaagggggagctgatgctggctgtttggatgggtacacaggctgatgaggcttttcccgaagcttggcactcggatgctgcgatggttagtgggagtgatgctcttgcgaacattagatcgaaagtttatctgtctcccaagctttggtatttgagggttaatgtgatagaggcacaggacctgatgccaactgataagggtagataccctgaggtatttgtgaaggctattctggggaatcaggccttgaggactagaatctctcaaagtaggagtattaatccaatgtggaatgaggatttgatgtttgtggtggcagaacagtttgaggagccgctgattttgagtgtggaggatagagttgcgcctaacaaggatgaagtgttggggaggtgtgccattcctttgcagtatgtggagaggagactagatgagaaacctgtgaacacaaggtggttcaatctggaaaggcatattgtgatagaaggggagaagaaggacaccaaatttgcaagcagaattcacatgaggatttgtctagaaggtggttatcatgttttagatgaatctactcactacagcagtgatcttcgcccaacagcgaaacagctgtggatgcctggtattggtgttcttgaactagggatattgaatgctcagggtttgatgccaatgaagacaaaagatgggagggggacaacggatgcttattgtgtagcaaaatatgggcagaagtgggtcaggacaaggacaatcattgatagctttgcaccgaggtggaatgagcaatatacttgggaggtttttgatccatgcactgtcattacaattggtgtatttgataactgtcatctgcatggtggtgacaaggctggaggggcaagagatgcaaagattggaaaggtacgggttcgtctttccacccttgagactgatcgggtctacacacattcctatccacttcttgttcttcacccgaatggggtgaagaagatgggtgagattcacttggctatgaggttcacttgttcatcttttgtcaatatgatgcacatgtattcacggcccttgttgccaagaatgcactatatacacccattgactgttagccagcttgacagtttgaggcatcaagctactcagattgtttcaatgagactgagtcgcgctgagccacctctgagaaaagaggtagtggaatatatgctggatgttggttctcacatgtggagtatgagaagaagcaaagctaacttcttcaggattatgggggttttgagcggcctaattgctgtaggaaaatggtttgatcagatttgcaattggagaagtccaatcactacaattctgatccatatcttgttcataatattggttatgtatccagagcttatcttaccaacaattttcctttacctcttcttgattggaatttggtactatagatggaggccaaggcaccctcctcacatggacacgcgtctctctcacgcggattcagcgcatcctgatgaacttgatgaagaatttgacacattcccgacctcccggccaaatgacctcgtgaggatgagatatgatagacttagaagcattgctggtaggattcaaactgtggttggggacttggccactcagggtgaaaggctgcaatctttgctgagttggcgtgatcctagagctacatcactatttgtgattttctgtctggttgctgctactgtactgtatgtcactccattccaagttgtggccctctttactggaatttatgttttgagacatccaaggtttcgttacatgcttccttcggtgccgctgaatttcttcaggaggctgcctgcaagaactgattgcatgctttgattccaggatagtgcagtaggttattgttcattattctgtcacaggattttctgtttttacttttgaacttcatgttagtcttgttaatttgtaattttgtaggtttgagtcacagcttaattactttttatgcttaatcagatttagtagtgtttctcaatggggagttagtttaaattggcagtggaggtaatttctgtttttttccctctactatttttttgaagttgctgattaatgcatttcttttaagatatgtttaaatctgttagacaaaacaaccactatctagtttcattggtttta

SEQ ID NO: 4683 - DNA, 3207 bp, Glycine max
gcttctactactacaacacagaggtacagtactactgtaacaaagcaagcgaagagcttaccttctatttctacttatatttctttctttctttcttttgcgtagattcatattcatcagatcccacccccccacaaccagacaaataaaagcagcgaaagcgaaagaaaaaatcaaagaaaagaaagagaagaaaaaaacacacaccaacaagcaaataataataatattactacattcattctgatattattcatctctcgtaacatcttctcagttgtgacgagaaagagtgatttctctctctcacacacacacactctcagaagtgagaacacacttgggctccattgcctctgaatgaaaaatcttacacaccccacaacgacaccgttttgacaaggttaaacaatgggatctaacattttctgagaaaattgttggttttttttccttgacgttggagccatcgaacagtttgtgaaatctgagatctaggctcctgggaacggttgttgaaggctttggattataattttgaattttggtttctcggttctctgaagtgagggaaaaatgcagaggcctccacctgaagattttctgttgaaggagaccaagccccaccttggaggcggaaaggtttccggtgatagacttaccagcacctatgatctcgttgagcaaatgcagtacctttatgtgagggtcgtgaaggcgaaggacttgcccgcgaaagatatcactgggagttgtgatccttatgttgaagtcaagcttgggaactacaagggaaccaccaggaatttcgccaagaacacacatcctgagtggaaccaggttttcgccttctcgaaggaccggcttcaggcctcgatgctggaggttaatgtgatagataaagatgttctgaaggatgacctcatcggccgggtgtggtttgacctgaatgagatcccgaaaagggtacctccggatagccctctggctcctcagtggtatagattggaggataggaagagcgacaaagcgaagggggagctgatgctggctgtttggatgggtacacaggctgatgaggcttttcccgaagcttggcactcggatgctgcgatggttagtgggagtgatgctcttgcgaacattagatcgaaagtttatctgtctcccaagctttggtatttgagggttaatgtgatagaggcacaggacctgatgccaactgataagggtagataccctgaggtatttgtgaaggctattctggggaatcaggccttgaggactagaatctctcaaagtaggagtattaatccaatgtggaatgaggatttgatgtttgtggtggcagaacagtttgaggagccgctgattttgagtgtggaggatagagttgcgcctaacaaggatgaagtgttggggaggtgtgccattcctttgcagtatgtggagaggagactagatgagaaacctgtgaacacaaggtggttcaatctggaaaggcatattgtgatagaaggggagaagaaggacaccaaatttgcaagcagaattcacatgaggatttgtctagaaggtggttatcatgttttagatgaatctactcactacagcagtgatcttcgcccaacagcgaaacagctgtggatgcctggtattggtgttcttgaactagggatattgaatgctcagggtttgatgccaatgaagacaaaagatgggagggggacaacggatgcttattgtgtagcaaaatatgggcagaagtgggtcaggacaaggacaatcattgatagctttgcaccgaggtggaatgagcaatatacttgggaggtttttgatccatgcactgtcattacaattggtgtatttgataactgtcatctgcatggtggtgacaaggctggaggggcaagagatgcaaagattggaaaggtacgggttcgtctttccacccttgagactgatcgggtctacacacattcctatccacttcttgttcttcacccgaatggggtgaagaagatgggtgagattcacttggctatgaggttcacttgttcatcttttgtcaatatgatgcacatgtattcacggcccttgttgccaagaatgcactatatacacccattgactgttagccagcttgacagtttgaggcatcaagctactcagattgtttcaatgagactgagtcgcgctgagccacctctgagaaaagaggtagtggaatatatgctggatgttggttctcacatgtggagtatgagaagaagcaaagctaacttcttcaggattatgggggttttgagcggcctaattgctgtaggaaaatggtttgatcagatttgcaattggagaagtccaatcactacaattctgatccatatcttgttcataatattggttatgtatccagagcttatcttaccaacaattttcctttacctcttcttgattggaatttggtactatagatggaggccaaggcaccctcctcacatggacacgcgtctctctcacgcggattcagcgcatcctgatgaacttgatgaagaatttgacacattcccgacctcccggccaaatgacctcgtgaggatgagatatgatagacttagaagcattgctggtaggattcaaactgtggttggggacttggccactcagggtgaaaggctgcaatctttgctgagttggcgtgatcctagagctacatcactatttgtgattttctgtctggttgctgctactgtactgtatgtcactccattccaagttgtggccctctttactggaatttatgttttgagacatccaaggtttcgttacatgcttccttcggtgccgctgaatttcttcaggaggctgcctgcaagaactgattgcatgctttgattccaggatagtgcagtaggttattgttcattattctgtcacaggattttctgtttttacttttgaacttcatgttagtcttgttaatttgtaattttgtaggtttgagtcacagcttaattactttttatgcttaatcagatttagtagtgtttctcaatggggagttagtttaaattggcagtggaggtaatttctgtttttttccctctactatttttttgaagttgctgattaatgcatttcttttaagatatgtttaaatctgttagacaaaacaaccactatctagtttcattggttttatta

SEQ ID NO: 4684 - DNA, 2477 bp, Nicotiana benthamiana
gtagcattaaaatgcagcgaccaccgcaagaagatttttcgctcaaagagaccaaaccccaccttggtggagggaaggtcacaggtgataagcttactagcacctatgacttggttgagcaaatgcagtatctttatgtccgggtggtgaaagcaaaggacttacctgggaaggatgttacgggtagtcttgatccttatgttgaggttaggctcggaaactataggggtacgacccgtcactttgagaagaagtcaaatcccgaatggagtcaggtttttgctttttccaaggatcggattcaagcttctgtacttgaggtgactgtgaaagataaggatcttgttaaggatgactttgttggtcgcgttatatttgatttgaatgagatcccaaaaagggtacccccagatagtcctcttgctccgcagtggtataggttggaggacagaaatggtaacaaagttaaaggagagctgatgttggctgtttggatgggtactcaagctgatgaagcctttcctgaatcttggcattccgatgctgcgactgttagtggtgctgatgctcttgcaaatataaggtctaaggtgtacctctcaccaaagctgtggtaccttagagttaatgtgattgaggctcaggacttgattcccggtgacagaagtagatttccagaagtttacgtgaaggccatccttggaaatcaggcattgagaaccagagtttccatgattccgggtgacagaagtaggtttccagaagtttatgtgaaggccatccttggaaatcaggcattgagaaccagagtttccatgagcaagactattaatccaatgtggaatgaagatctgatgtttgtagcggcagaaccatttgaggagccattgattttgagtgtggaagacagagttgcaccaaacaaggatgaagttcttggaaggtgtgctattcctttgcagtatattgataggagattggatcacagacctattaatagtaagtggtataatcttgaaaagcatataatggttgagggagaaaagaagaaggaaatcaagtttgcaagcaggcttcacatgaggctatatttggaaggaggctaccatgttctggacgagtcaacccattacagtagtgatcttagaccaactgcaaaacagttgtggaagtccagcattggtgtccttgaattgggtattctgaatgctcagggcctctcgccaatgaaaacaaaagatgggcgggcaacaacagatgcttattgtgttgccaaatatgggcaaaaatgggttcgaacaaggacaattatagatagctttgctcccaagtggaacgagcaatacacttgggaagtatttgatccatgcactgtcataactattggtgtatttgataactgtcatctgcacggaggagataaatccggaggggcaagggactcgaggattgggaaggtcagaatccggctttcaactcttgaaactgatcgtgtctacacacattcttatccactactggtcttgcatcctaccggggtgaagaagatgggtgaaattcacttggctgtaagatttacttgctcatcattaatgaatatgatgcatatgtattctcagcctctgctacctaaaatgcactacattcatcctttaactgtcagccagctcgacagcttaaggcatcaagcgactcagattatcgtttcaataaggctgagtcgtgctgagccacctttaaggaaagagatagtggagtatatgttggatgttggttcccacatgtggagtatgaggagaagcaaagccaacttttttaggattatgggtgttttaggtggattaattgctattggaagatggtttgatcagatatgccattggaaaaaccccattacgactgttctgatccatatcttgttcttaatactggttctatatccggagcttattctgcctaccattttcctttatctcttcttaattggagtttggtactacagatggaggcccagaaatcctccccacatggatactcgtctttcttgtgctgataatgctcatcctgatgaattagacgaagaatttgatactttccctacttcacgtcctcctgatattgttcggatgaggtatgaccgtttgagaagtattgctggacggattcagactgtggttggtgatttggctactcaaggggagaggctgcagtctttgctgagttggagagaccctagagcaaccgcattgttcgttattttctgcttgattgctgccattgtgctctatgtcaccccttttcaagttgtggcgctcttgactggattttatgtgttaagacatccgcggtttcgtcacaagctaccatctgcgcctcttaatttcttcagaagattgcccgcaagaacagactgcatgctatgagctatagtgttggcgggtattatccatttcccctttgtgtcttgagttgatgaa

SEQ ID NO: 4685 - DNA, 3180 bp, Citrus sinensis
cttcactgcttcataactcactgcccattattcatttcccaacacccaataaaataaaattaaaaaaaggattttgatttttcattgctgcaacttcacaacttagctgagcattacgcacattgtgctaaaggttcttggtgctttctgctcaaatgcattgactgaagtgcccagtgtttactctattatggttgacgaggtcctttaatctttttcctttctcatcatgcactagagatctgaaatttagaatccagaaactatgtttgattttctttccttgatttatgccttatcatatcttttagcttcattacacttgtgtcctcaactttctgatctctggtttgtacaatagcctactagctacaacaaaagagttggggtttcgatcattggagacattcattgtgaggttgaacttgacttagaaaatctttgtttcttcttgtgtaactgtaatattcttctgggtagccttggttttgttattacatattagtgaagatgcagaagtctccacaagctatagactttgctctgaaggaaacctcccccaagattggtgcggggtctatcacaggcgataagctttcatgcacctatgaccttgtcgaacaaatgcaatacctttatgtccgggttgtcaaggcaaaggatttacctggaaaagatgttactggtagctgtgatccctatgttgaagtaaaactcggaaactataagggaactacgaagcattttgagaagaagtccaatcctgaatggaatcagtgttttgctttctcgaaagataggattcaggcttcagttttggaagtgttggtgaaggacaaggatgttgttttggatgatttaattggcagggtaatgtttgacctcaatgaagtgccgaaaaggattcctccagacagtcctttggcaccccagtggtacagattggaagatcgtaagggagataaggttaaaactggagagctgatgttggctgtttggatgggaactcaagcagatgaggcgtttcctgatgcatggcactcagatgcagcaacagtcagcggtgaaggagttgcaaatattcgatcaaaggtatatctatcccccaagctttggtatgtgagggtcaacattattgaagctcaggacctgctacctagtgataaaagtaggtttcctgaagtttttgtgaaggctatcctcggaaatcaggcatcgagaactagaatttctccaagtaagactataaacccaatgtggaatgaagatttgatgtttgtagcagccgagccttttgaggaacccttgattctgaccgtcgaagatagggtagcaccaaacaaggatgaagtgttaggtaagtgtctgatcccattgcaggcagtgcagaggaggttggaccataagcctgtgaacactaggtggtttaaccttgagaagcatgttattgtagacggggaaaagaaagagactaaattttccagcagaattcatctgaggatatgtctggatggtggatatcatgttttggatgaatcgacccactacagcagtgatctgaggccaactgcaaaacagttgtggaaacccagcattggaatattggagcttggcgttctcagtgctcatgggctgacgccaatgaagacaaaagatggacgaggaaccacagatgcttattgtgtggccaaatatgggcagaaatgggtgcgaacacggacaattgttgacagcttcgggccacgatggaatgagcagtacacttgggaagtttttgacccatgtactgtcattactgtaggggtatttgataatggccacatccatggacaaggtggcggtgggaaggattcaagaattggtaaagtgaggattcgattatcaacacttgaaactgatagggtttacacacactcttatcctcttttagttttgcatccttcaggggtgaggaaaatgggcgaggttcaattggccgtgaggtttacttgctcgtctttgattaacatgctgcatatgtactcacaaccattgctgcccaaaatgcactacattcatccattgtctgttattcagcttgatagcttgaggcaccaggctatgcagattgtctccattaggctgaaccgagctgagccaccattgaggaaagaggttgtggagtacatgcttgatgtagactctcatatgtggagtatgaggagaagcaaggctaatttctttagaataatgggtgttctaagttcgttgatttctgttggtaaatggttcgatcaaatctgcaattggaaaaaccctcttacaaccattttgattcacatccttttcatcatattggtcctttatcctgagctcatactccccaccgtatttctctaccttttcttgattggcatttggaacttccgttggaggccaaggcaccctcctcacatggacactcgattgtcgcatgccgaagctgctcaccctgatgaactagatgaagaattcgacacattccccactaccaagggatcagacattgttcgcatgagatatgaccgcctgagaagcatagcagggagggttcagacagtgattggtgaccttgcaactcaaggggaaaggtttcagtctctgataagctggagagacccaagagcaaccactctttttgtcactttctgcttgattgctgctatagtcctctatgttactccattccaagttgttgccctccttgcaggcatttacgtgctaaggcatcccaggtttcgccacaagcttccatcggttcctctcaacttcttcaggaggttgccagcaaggtcagacagcatgctataaggacagccaacttttgcttggcctttgctgtctttggatctcacatttagccgcccagattctgaagcagcatgccaatgtactgcaccagcgactcaacatctctctgtttctttatgtgatgtaatttttatctgcacaatctggtaaatttcatgaaaactcagcaggcagcttgttcaagttgatttgattctgttcatttgtaatatgtaaactctaattttaattagtttatgcaaacctgtcacctaaattatgccacctacattgttctgtgcaagtaatataatttaactgctcgtcttggttgtgcttcgtatccacacaaaacccattttcataatcagg

SEQ ID NO: 4686 - DNA, 2768 bp, Eutrema halophilum
ctctttctctttctctagaaatttcccagtgcttatcttctgcttttaacgaggaagaagagaagatccttactctttattttttctattttctgggggtttaacgttaaaggcactgatggagttggagattttctcggcggtttaaatcattttgctggggttttgtttttcaagatctaactcagatctagtgctttgaaacccactcgctgaaaaatcaaatcttttctactttcaaagatgcagagaccacctcctgaagatttctccttgaaggagactaaacctcatctcggtggaggcaaagtcaccggagacaagctcacgtccacatatgacctcgtcgagcaaatgcagtatctctatgtccgtgtcgttaaggctaaagagttacctggtaaagacttaactggtagttgtgacccttatgtcgaggttaagctcggaaactacaaaggtaccacaaggcatttcgagaagaaatcgaatcctgagtggaaccaagttttcgccttttcgaaagataggcttcaagcttctgtccttgaagctactgtcaaggacaaagactttgtgaaagatgatttgattggtcatgttgtgtttgatttgaatgagatacctaagagagtgcctcctgatagtcctttagctcctcaatggtatagattagaagataggaaagggcaaaaagtgaaaggtgagcttatgttagctgtttggtttggtactcaagctgatgaagctttccctgaagcttggcactcagatgctgcaacagttagtggaactgatgccttagccaacattaggtctaaggtttatctctcccctaagctttggtatcttagggttaatgtcatcgaagctcaggatttggtacccagcgataaaggaagatatcctgaagtttatgtgaaagtgatgatgggaactcaggcattgaggacgagagtgtctcaaggcaggggtattaacccaatgtggaatgaggatttgatgtttgttgtagctgagccatttgaggagcctttgattctaagtgttgaagatagagttgcaccaaacaaagatgaagtcttggggagatgcgcaattccgttgcagtatttggacagacggttcgattataaaccggtgaacagcaggtggtttaacctcgagaagcatgttataatggaaagtggagagaagaaagagatcaaattctccagcaagattcacatgaggatttgtttggaaggcgggtatcatgtgcttgatgaatctacacattacagtagtgatcttagaccaactgcaaagcaactgtggaagcctaacatcggtgtgcttgaactagggatcttgaatgcaacgggtttaatgcctatgaaagctaaagaaggtggtaggggagccacggatgcatactgtgttgcaaagtatgggcagaaatggattagaactcggacaattattgatagctttacaccgagatggaatgagcaatatacctgggaggttttcgatccgtgtactgttgttaccgttggtgtgtttgataactgccatctacacggtgctgacaagaacaatggaggtggaggaggaaaagattcgagaattgggaaggtgaggattaggctctctaccctcgagactgatcgcgtctacacacattcatatcctcttttggtgctacatcctaatggagtcaagaaaatgggagagattcacttagctgtgaggtttacttgctcttcattgctcaacatgatgtatatgtattccctgcctctcttaccgaagatgcattacctccatcctctcacagttagccagctcgataacttgaggcatcaagccactcagattgtgtcaacaaggctaacaagagctgagccgccgctgaggaaagaagttgttgagtatatgcttgatgttggttctcacatgtggagcatgcgtagaagcaaggcaaatttcttcaggataatgggagttttaagtggattaatcgctgtagggaaatggtttgagcaaatctgcgtatggaagaatccgataacaacggttttaatccacattttgttcataatccttgttgtctatcctgagctcatcttgcccactgttttcctctacctcttcttgatcggagtttggaactatcgctggaggccgagacatcctccacacatggacacacgtctctcacacgctgactcagcacaccctgatgagctcgacgaagagtttgacacttttcctacttcacgaccagcagatatcgtaaggatgagatatgacagactaaggagtattgcaggtaggattcagacagttgttggtgatcttgcaactcaaggagagagactccagtcgttgctgagctggcgtgacccacgtgctactgctctcttcgtcttgttctgtctgatagctgcagtggttctatatgtaactccctttcagcttgtggctcttatcattggcttgtatgtgcttagacatccgaggctcagatacaggctcccatctgttccacttaacttcttcaggaggcttccggcaagaactgattgcatgctctgagtaattgagttacttactctctgaaaatttctccatttcaagaaagaatcctctggtttattttgttatcgttttaagcgtctaccttttcctgatggtgatgtcttcttctgtttgaaattcttaagttaagacctttttaaaactttgttttataagtagtaagagaagtttatgtgtggtgtttg

SEQ ID NO: 4687 - DNA, 3180 bp, Citrus clementina
cttcactgcttcataactcactgcccattattcatttcccaacacccaataaaataaaattaaaaaaaggattttgatttttcattgctgcaacttcacaacttagctgagcattacgcacattgtgctaaaggttcttggtgctttctgctcaaatgcattgactgaagtgcccagtgtttactctattatggttgacgaggtcctttaatctttttcctttctcatcatgcactagagatctgaaatttagaatccagaaactatgtttgattttctttccttgatttatgccttatcatatcttttagcttcattacacttgtgtcctcaactttctgatctctggtttgtacaatagcctactagctacaacaaaagagttggggtttcgatcattggagacattcattgtgaggttgaacttgacttagaaaatctttgtttcttcttgtgtaactgtaatattcttctgggtagccttggttttgttattacatattagtgaagatgcagaagtctccacaagctatagactttgctctgaaggaaacctcccccaagattggtgcggggtctatcacaggcgataagctttcatgcacctatgaccttgtcgaacaaatgcaatacctttatgtccgggttgtcaaggcaaaggatttacctggaaaagatgttactggtagctgtgatccctatgttgaagtaaaactcggaaactataagggaactacgaagcattttgagaagaagtccaatcctgaatggaatcagtgttttgctttctcgaaagataggattcaggcttcagttttggaagtgttggtgaaggacaaggatgttgttttggatgatttaattggcagggtaatgtttgacctcaatgaagtgccgaaaaggattcctccagacagtcctttggcaccccagtggtacagattggaagatcgtaagggagataaggttaaaactggagagctgatgttggctgtttggatgggaactcaagcagatgaggcgtttcctgatgcatggcactcagatgcagcaacagtcagcggtgaaggagttgcaaatattcgatcaaaggtatatctatcccccaagctttggtatgtgagggtcaacattattgaagctcaggacctgctacctagtgataaaagtaggtttcctgaagtttttgtgaaggctatcctcggaaatcaggcatcgagaactagaatttctcaaagtaagactataaacccaatgtggaatgaagatttgatgtttgtagcagccgagccttttgaggaacccttgattctgaccgtcgaagatagggtagcaccaaacaaggatgaagtgttaggtaagtgtctgatcccattgcaggcagtgcagaggaggttggaccataagcctgtgaacactaggtggtttaaccttgagaagcatgttattgtagacggggaaaagaaagagactaaattttccagcagaattcatctgaggatatgtctggatggtggatatcatgttttggatgaatcgacccactacagcagtgatctgaggccaactgcaaaacagttgtggaaacccagcattggaatattggagcttggcgttctcagtgctcatgggctgacgccaatgaagacaaaagatggacgaggaaccacagatgcttattgtgtggccaaatatgggcagaaatgggtgcgaacacggacaattgttgacagcttcgggccacgatggaatgagcagtacacttgggaagtttttgacccatgtactgtcattactgtaggggtatttgataatggccacatccatggacaaggtggcggtgggaaggattcaagaattggtaaagtgaggattcgattatcaacacttgaaactgatagggtttacacacactcttatcctcttttagttttgcatccttcaggggtgaggaaaatgggcgaggttcaattggccgtgaggtttacttgctcgtctttgattaacatgctgcatatgtactcacaaccattgctgcccaaaatgcactacattcatccattgtctgttattcagcttgatagcttgaggcaccaggctatgcagattgtctccattaggctgaaccgagctgagccaccattgaggaaagaggttgtggagtacatgcttgatgtagactctcatatgtggagtatgaggagaagcaaggctaatttctttagaataatgggtgttctaagttcgttgatttctgttggtaaatggttcgatcaaatctgcaattggaaaaaccctcttacaaccattttgattcacatccttttcatcatattggtcctttatcctgagctcatactccccaccgtatttctctaccttttcttgattggcatttggaacttccgttggaggccaaggcaccctcctcacatggacactcgattgtcgcatgccgaagctgctcaccctgatgaactagatgaagaattcgacacattccccactaccaagggatcagacattgttcgcatgagatatgaccgcctgagaagcatagcagggagggttcagacagtgattggtgaccttgcaactcaaggggaaaggtttcagtctctgataagctggagagacccaagagcaaccactctttttgtcactttctgcttgattgctgctatagtcctctatgttactccattccaagttgttgccctccttgcaggcatttacgtgctaaggcatcccaggtttcgccacaagcttccatcggttcctctcaacttcttcaggaggttgccagcaaggtcagacagcatgctataaggacagccaacttttgcttggcctttgctgtctttggatctcacatttagccgcccagattctgaagcagcatgccaatgtactgcaccagcggctcaacatctctctgtttctttatgtgatgtaatttttatctgcacaatctggtaaatttcatgaaaactcagcaggcagcttgttcaagttgatttgattctgttcatttgtaatatgtaaactctaattttaattagtttatgcaaacctgtcacctaaattatgccacctacattgttctgtgcaagtaatataatttaactgctcgtcttggttgtgcttcgtatccacacaaaacccattttcataatcagg

SEQ ID NO: 4688 - DNA, 2782 bp, Arabidopsis thaliana
tttacttttctctcactacagtcctttctctctatctctttctaaaactctctcaatgcttatcttctgattttacgaggaagaagaagaaaggattcttctttacttctttctttttttgggggtttaatgttaagcagattctgagatttctggtgtaaatcgttttctggggttgtttgtttgttttgaagatctaacttatagatctagtgtttctgaaagaagaaaaaatccaaactttactagtttcaaagatgcagagaccacctcctgaagatttctccttaaaggagacaaaacctcatctcggtggaggcaaagtcaccggagataagctcacaaccacatatgacctcgtcgagcaaatgcagtatctctatgttcgtgtcgtaaaggctaaagaattaccaggtaaagacttaactggtagttgtgacccttacgttgaagttaagcttggtaactacagaggaaccactagacatttcgagaagaaatctaatcctgagtggaaccaagttttcgccttttctaaagatagggtacaagcttcttatcttgaagctactgtcaaggataaagatttagttaaagatgatttgattggtcgtgttgtgtttgatttgaatgagatacctaagagagttcctcctgatagtcctttagctccacaatggtatagattagaagatgggaaaggccaaaaagttaaaggagagcttatgttagctgtttggtttggtactcaagctgatgaagcttttcctgaagcttggcactctgatgctgcaactgttagtggaactgatgctttagctaacatcagatctaaggtttatctctctcctaagctttggtatcttagggttaatgtcattgaagctcaggatttgataccgagcgataaagggagatatcctgaagtctttgtgaaagtgataatgggaaatcaggcattgaggactagagtgtcacaaagcaggagtattaatccgatgtggaatgaggatttgatgtttgttgtagctgagccgtttgaagagcctttgattctaagtgtggaagatagagttgcgccgaataaagatgaagtcttggggagatgcgcggttccgttgcagtatttggacaaaaggtttgactatagaccggtgaacagcaggtggtttaaccttgagaagcatgttataatggaaggaggagagaagaaagagatcaaattcgccagcaagatccacatgaggatttgtttggaaggagggtatcatgtgcttgatgagtctacacattacagtagtgacctaagaccaactgcaaagcaactgtggaagcctaacatcggtgtgcttgagctaggggtcttaaatgcgaccggtttaatgcccatgaaagctaaagaaggtggtaggggaaccacggacgcgtattgtgtggcaaagtatgggcagaaatggatcagaactcggacaattattgacagctttaccccaagatggaacgagcaatatacttgggaggtttttgatccgtgtactgtagttacagttggtgtgttcgataactgccatctacacggtggtgacaaaaacaacggaggaggaaaagattcaagaattggaaaggtgaggataaggctctctactctcgaggctgatcgagtctacacacattcatatcctcttttggtgctacatcctagtggagtcaagaaaatgggagagattcacttagcggtgaggtttacttgctcttcattgctcaacatgatgtatatgtattctatgcctctcttacctaagatgcactacctccatcccctcacggttagccagctcgataacttaaggcatcaagcaactcagattgtgtcgacaaggctaacacgagcagagccgcctttgaggaaagaagttgttgagtatatgcttgatgtgggatctcacatgtggagtatgcgtagaagcaaggcgaatttcttcaggataatgggagtcttgagtgggataatcgctgtagggaaatggtttgaacagatctgcgtatggaaaaatccgataacaacggttttaatccacattctcttcattatccttgttatctaccccgagctcatcttgcccaccattttcctctacctcttcttgattggagtttggtactatcgctggaggccgagacatcctccacacatggacacacgtctctcacacgctgactcagcacaccctgatgagctcgacgaggagtttgacactttccctacttcccgaccatcagacatcgtcaggatgagatatgaccgactcagaagcattgctggtaggattcaaacagttgttggtgatcttgcaactcaaggagagagatttcagtcgttgctaagctggcgtgacccgcgtgccactgctctcttcgtcttgttctgtctgatagctgcagtgattttatatataactcccttccaggttgtggcttttgccattggcttgtatgtgcttagacacccgaggctcaggtacaagctcccatcagttccacttaacttcttcaggaggcttccagcaagaactgattgcatgctctgagttacttaagatttctccatttcaagaaagactcctctgttctagtttgttatcgttttgaagtccttacctcttctttgtgatgttggatgatcatgtttttttctgtttgacattatttatgtttatgtccttttgaaaactttctttggaaagtggtaactagtaagataagtttgtgtttttggattctc

SEQ ID NO: 4689 - DNA, 2861 bp, Gossypium raimondii
atacaaaataaaatgtctcctgttaatatatctttttagttttcatctttgctcttctttttggtgaatcaaattaaatggtgaaaagagaaaaggttgatactttgtactttttatgtgttcttttattactttatagatctttgagtctcacttcccacacctccccgttcttattcttactagtttcgtattttttttcttcaagttatataaacataaaagattttccatttctgcaccttgaagaaagaaagttggttctttttcttgcattcttacaaagctgctgcttgcacaactgttgagtgttgtttagaagcaagatgcagaagccgccgccacaatcagtagactttgccctaaagcagacctcacccaacatcggggccggggcagtcaccggtgataagctttcgtgcacctatgaccttgtggagcaaatgcaatacctgtacgttcgagttgtgaaggctaaggatttacctggaaaagatgtcactggtagctgtgatccttatgtggaggttaaacttgggaactacaagggagtaactaagcatttcgagaagaagagcaatcctgaatggaaccaagtatttggattctcaaaagaaagaattcaagcttctattttggaagtgtttgtgaaggacaaggatgttgttgtagatgatttaattggcagggttgtgttcgatgtcaatgaaattccgaagagggttcctcccgacagcccattggcgccacagtggtatagattggaagatcgaaagggtaataaagcaaagggagagctcatgctggctgtttggatgggaactcaagcagatgaggcatttccggatgcgtggcattcagatgctgcatcagttggcccagatggtgttacaaacattcgatcaaaagtgtatctttcccccaagctttggtatgtgagggtgaatgtcattgaagctcaagacttggtacctagtgataaaggcaggttccctgaagtatttgtgaaagctgttctcggaaatcaggctttgagaactagaatatctccgagtaagaccatcaatccaatgtggaatgaggacttgatgtttgtagttgctgaacctttcgaggagccattgtttctatcagtggaagatagggtgggatcgaacaaggatgaaaccttggggaagtgtgtgattccattacaggtggttcaaagaaggttagaccataaacctgtaaatagtcggtggcacaatctcgagaaacatgtgattgttgatggagagaaaaaagaaatgaaattcgccagccggattcacttaaggatctgtttagaaggagggtatcatgttttggatgaatctacacactgcagcagtgatcttaggccgacagcaaaacagctatggagacctaacattggaattcttgaactgggtattctaagtgcccacggcctgatgccaatgaaaacaaaagatggacgaggaaccacagatgcttattgtgtggccaagtatgggcagaaatggatccggacaaggacaatcgttgacaatttcatgccaaggtggaatgagcagtacacttgggaggttttcgatccttgtactgtcatcactataggggtttttgataatggtcatatacacgggggagctggaggggcaaaggatgcaagaattgggaaggtaaggattcggttatcgacacttgaagccgacagggtctatacgcattcatatcctctactggtgctacattcttcaggggttaaaaaaactggtgaagttcaattggctgtgaggttcacctgctcaactttgattaacatgctgcatatgtattcgcatccactgttgcctaagatgcactacatccacccattgtctgtgattcagctcgatagcttgaggcaccaagctgtgcagatggtctcggtgaggctgagccgggccgagccaccattgaggaaggaagttgtggagtacatactggatgttgattcacatatgtggagcatgaggagaagtaaagcaaactttttccgaattatgggagttctaagtgggttgattgcagttggaaaatggtttgatcaaatctgcaattggagaaaccctattacaaccattttgattcatatccttttcattatattggttctttatcctgagctaatacttcccacggtttttctctaccttttcctaatcggaatctggaactaccgttggcggccactgcaccctcctcacatggatacgcgtctgtctcatgccgatgcagcccatccagatgaactagatgaagagtttgataccttccccacttcccgcccatctgatatcgtcaggatgagatatgatcgtctcagaagtataggagggagagttcagactgtgattggtgatctggcaacacaaggggaaaggttacagtctctgctaagctggagggacccgagagcaaccaccttattcgtgacattctgtttgatcgccgccatagttctttatgttacaccattccaagttgtggctcttctcataggactttatgccttaaggcatcctaggttccgccacaaacttccgtcagtacctcttaacttctttagacggttgcctgcgagatcggacagcatgttatgagcatatcattcaatgtctaattatgcaaaatagcaaagcagggttctttagttggtggcaaatgcagggtcctgttacatgataatatgtaatttgtgtctgcctttgtttaataataaataaaaaaacctaagcttcattgtattattctgcataagccatcgttccaagctaagtatacgttaaaagttcaagagaccattttttttttagttt

SEQ ID NO: 4690 - DNA, 2480 bp, Gossypium hirsutum
aagcaagatgcagaagccgccgccacaatcagtagactttgccctaaagcagacctcacccaacatcggggccggggcagtcaccggtgataagctttcgtgcacctatgaccttgtggagcaaatgcaatacctgtacgttcgagttgtgaaggctaaggatttacctggaaaagatgtcactggcagctgtgatccttatgtggaggttaaacttgggaactacaagggagtaactaagcatttcgagaagaagagcaatcctgaatggaaccaagtatttggattctcaaaagaaagaattcaagcttctattttggaagtgtttgtgaaggacaaggatgttgttgtagatgatttaatcggcagggttgtgttcgatgtcaatgaaattccgaagagggttcctccggacagcccattggcgccacagtggtatagattggaagatcgaaagggtaataaagcaaagggagagctcatgctggctgtttggatgggaactcaagcagatgaggcatttccggatgcgtggcattcagatgctgcatcagttggcccagatggtgttacaaacattcgatcaaaagtgtatctttcccccaagctttggtatgtgagggtgaatgtcattgaagctcaagacttggtacctagtgataaaggcaggttccctgaagtatttgtgaaagctgttctcggaaatcaggctttgagaactagaatatctccgagtaagaccatcaatccaatgtggaatgaggacttgatttttgtagttgctgaacctttcgaggagccattgtttctatcagtggaagatagggtgggatcgaacaaggatgaaaccttggggaagtgtgtgattccattacaggtggttcaaagaaggttagaccataaacctgtaaatagtcggtggcacaatctcgagaaacatgtgattgttgatggagagaaaaaagaaatgaaattcgccagccggattcacttaaggatctgtttagaaggagggtatcatgttttggatgaatctacacactgcagcagtgatcttaggccgacagcaaaacagctatggagaccaaacattggaattcttgaactgggtattctaagtgcccacggcctgatgccaatgaaaacaaaagatggacgaggaaccacagatgcttattgtgtggccaagtatgggcagaaatggatccggacaaggacaatcgttgacaatttcatgccaaggtggaatgagcagtacacttgggaggttttcgatccttgtactgtcatcactataggggtttttgataatggtcatatacacgggggagctggaggggcaaaggatgcaagaattgggaaggtaaggattcggttatcgacactcgaagccgacagggtctatacgcattcatatcctctactggtgctacattcttcaggggttaaaaaaactggtgaagttcaattggctgtgaggttcacctgctcaactttgattaacatgctgcatatgtattcgcatccactgttgcctaagatgcactacatccacccattgtctgtgattcagctcgatagcttgaggcaccaagctatgcagattgtctcggtgaggctgagccgggccgagccaccattgaggaaggaagttgtggagtacatactggatgttgattcacatatgtggagcatgaggagaagtaaagcaaactttttccgaattatgggagttctaagtgggttgattgcagttggaaaatggtttgatcaactctgcaattggagaaaccctattacaaccattttgattcatatccttttcattatattggttctttatcctgagctaatacttcccacggtttttctctaccttttcctaatcggaatctggaactaccgctggcggccactgcaccctcctcacatggatacgcgtctgtctcatgccgatgcagcccatccagatgaactagatgaagagtttgataccttccccacttcccgcccatctgatatcgtcaggatgagatatgatcgtctcagaagtataggagggagagttcagactgtgattggtgatctggcaacacaaggggaaaggttacagtctctgctaagctggagggacccgagagcaaccaccttattcgtgacattctgtttgatcgccgccatagttctttatgttacaccattccaagttgtggctcttctcataggactttatgcactgaggcatcctaggttccgccacaaacttccgtcagtacctcttaacttctttagacggttgcctgcgagatcggacagcatgttatgagcatatcattcaaggtctaattatgcaaaatagcaaagcagggctctttagttggtggcaaatgcagggtcctgttacatgataatatgtaatttgtgtctgcctttgtttaataataaataaaaaaagcctaagcttctatattcaaaaaaaa

SEQ ID NO: 4691 - DNA, 2539 bp, Ambrosia trifida
tcagttgtgaggagatgaagatgatgcataggcctccccctgatgattacttactcaaggagactcggccgcatctcggcggagtaaaaatggcaggggataagcttactagtacttatgatcttgtggaacaaatgcagtacttgtatgttcgcgtagtgaaagcgcgagatttgcctgctaaggatgttactggaagttgtgacccgtatgtggaggttcggttggggaactataagggaactacgcggcattttgaaaagaagtcgaatccggagtggaaccaagtgtttgctttctctagagagaggattcaggcgggtatgcttgaggttacggtgaaggataaagatcttgtgaaggatgattttataggtttgatgtcgtttgatcttcatgaggttccgaagagggtcccaccggacagtcctctagcgcctcagtggtataggttggaagataggaaagggaataagctgaaaggagagataatgttagctgtttggtggggtacgcaggctgatgaagcgtttcctgaagcatggcattcggatgctgcaactgtaggtggagccgatgcgcttgctaatatccgttcgaaggtgtatctttcacctaaattgcggtatctacgagttaatgtgattgaagcgcaggatttgatacctagtgatcgaacgaggtttcctgaagtttatgtgaaggcagttcttggacaccagacgttaagaaccagagtgtcgatgagtaagtctatcaatcctatgtggaacgaagacttaatgtttgtagctgctgaaccgtttgaagaacacttgattttgagtattgaagacagggttgcgcctaataaagaggaagtacttggaatgtgtgtgatccctttgcagcatgtggaacggaggttagatcacagagctattaacacaaggtggtttaatcttgaaaagcatgttatgattgatggcgaaaagaagcaagtgagatttgccagcaagattcatacgaggattggcttagaaggtggctatcatgttctcgatgaatctacgcattatagtagtgatcttagaccaacggataaacggttatggaagaagagcattggtgttcttgaagtgggaatcttgagtgctcatgggttaacaccaatgaagtcaaaagatggaagggcggcaacggatgcatattgtgtagctaaatatgggacgaaatgggtcagaacaagaacaataatagacagttttaccccaaaatggaatgagcagtatacatgggaagtttttgatccgtgcactgttgtaacaatcggtgtgtttgataactgccatctgcatggtggtgataaaggtaacggtgcaaaggattcaagaatcggtaaggttagaattcgtctctcaacacttgaaactgaccgtgtttacacacattcatacccacttctagttttgcatccgtccggggtgaaaaaaatgggcgagattcatttggcggttaggtttacatgttcttcgttgctaaacatgatgcacatgtactcacaaccgcttttgcccaaaatgcactacattcaccccttaactatcacccagcttgagatcttgaggcaccaagccactcagattgtgtctatgcggctgagccgtgctgagccgcctttaaggaaagagattgtggagtatatgctggatgtcggttctcacatgtggagtatgagaagaagtaaagctaatatgtttagaatcatgggagttttgggtggttttattgcgatcggaaaatggtttggtcagatatgtaactggaagaatccgatcactactgttctgattcacattcttttcttgatactggttttgtatcccgagctgattctccccactatttttctttacttattcttgattggcgtttggtactaccgatggagaccaaagaacccaccccatatggacactcgcctctcatgtgcagataacgcacaccccgatgaacttgatgaagaattcgacacctttcccacttctcggcatcctgacattatcagaatgaggtacgaccgtttaaggagtttttctggaaagattcaaacagtggttggtgatatagcaacacaaggagaaagactccagtctttacttagctggagagaccctagagctacagcactgtttgttatcttctgtttaatcgctgctattgttctgtatgtcacaccttttcaagttgtagcccttatcacaggcttctatgtcttaagacacccaaggttccgccacaggctgccatccgtcccactcaactatttcagaagattgcccgcgaaaactgactgcatgctttgatcaaacccaaatcaaaacgcatgaatctttcggcttcatctttgacgttcagataaggcatcagtaccggtaagacgcatacaattttcttgtaatattattttgtacatcttgttgttttgtacccaatgcaatcttgaacttatcaccctttgttcaaatctatcaaaataattgttattagtaaaaaagaa

SEQ ID NO: 4692 - DNA, 1365 bp, Sorghum bicolor
aaccaacaacaacatgtacgcacttatcggcactgctgtctctcgttctattgggtgaaccacatatatacactatagtactgtacacagctactagctagcaatcgaccagaaggcagcagccatggctggtggtggtgttcagcaggtggtggccgtgctcgcggtggtggcgctcatggtgacggtggtggagggtttcatctcgaagaagaagtggagcaccatccggcaggtggaccgcgatggaccctttgtggggctggtggcgcccaacgcctacgagatgaaacccgtactcgactcccccgacttcaaacctagcaacaacatccccatcctagacgtccaagggcgacgattccgcttcggaaccattggaggccaaaacgttgtcatggtcatgactgggctgagcatgctgaatgcagggctcactacccagctgctgctgagcctgttcagggtgaaaggcatcgtgcactggggcatcgccggcaacgccaacgaggacctccagatcggcgacgtgaccatccccgagtcctgggcgcacctctccctgtggaactggcagaggcacggcgacggggcggagaacagggtgccgctcgagatcgccggcgactacacgagggagtacggcttcctccacttctccaactacactgtcggcttggccaacccggagctgtcggcgaacacgctgaacagcgtgtggtaccagccggaggagatcttcccgatctccgctacgccggagaagcggcagcacgcgttctgggtgcccgtcagcaagcgctactacaagctggccggaaagctggaggggctggagctgccggcgtgcgtgaacgcgacgacgtgcctgccccgtgcgccccgggtgacacgggtgccccggggttgcagcgccaacatctacaccgacaacgccagctacaggcagttcatccgctcccacttcgggtgcacccccgtggagatggagagcgccgccgtggccctcgtggcgcaccagcatggagtccccttcatcaccatccgttccctctccgacctcgccggcggcggatcgtctctcagcaacgaggccggaacgttccttgacatcgcggccaagaacgctgtcgacgtaatgctcaagttcgtgcccctcctcggccgcggtggcgcgcaggccgacggtcctggcgaggacatgtaaggcgggaaacagatcgacgacgctgcagtgcaccgtggaattaatgcaatttcgtcctgtatgctttttattttccgcccccaaacttgtatcgctattgcaaacctatcttccgtggaataaataaaattggtcgtcgtgcccatgtgttttatata

SEQ ID NO: 4693 - DNA, 1450 bp, Zea mays
agcaacaccatatacgagctctctagcacaccataccgacacacacagctggtgcccgcccggtcgaaccacgctagctgtacactagctagacgatcaccacgccagttagttagcgcagcgccatggccggcggcggtactcagcatctgctgcaggtcgcggccgtgctcgcggcggcggtggtgctcatggcaacggcgtcggagggcttcatctccaagaagacgtggagcgccatccggcgggcggaccgcgacgggcccttcgtggggctggtggtgcccaacgcctacgagatggtccccgtcctcaactcgccggacttcaaacccagcagcaacatacccatcctagacgtccaagggcgacgattccgcttcggaactattggaagccaaaacgttgtcatggtcatgaccgggctcagcatgctgaacgccgggctcacgacccagctgctgctgagcctgttcagagtgaaaggcatcgtgcactggggcatcgctggcaacgccaacgaggacctccagatcggcgacgtgaccatccctgagtcctgggcccacctgtccctgtggaactggcagaggcacggcgacgggcctgagaacgagctgccgctagagaacgccggcgactacacgagggagtacggcttcctcaacttctccgactacacggtggggcaggacgccggcaacccggagctggcggcgaacacgctcaacagcgtgtggtaccagccggaggagatcttccccatctccggcacgccggaggagcggcagcacgcgttctggtgcccgtgaacaagcgctactacgcgctcgccgggaagctggaggggctggagctgccggcgtgcgtgaacgcgacgacgtgcctgccccgcgcgccccgggtgacgcgggtgcccaggggctgcagcgccaacatctacaccgacaacgccagctaccgccagttcatccgctcccacttcgggtgcacccccgtggagatggagagcgccgccgtggccctcgtcgcgcaccagcacggcgtccccttcatcaccatccgctccctctccgacctcgccggcggcggctcctccatcagcaacgaggcagccacgttcctcgacatcgcggcgcagaacgccgtggacgtcatgctcaagttcgtgcccctcatcgcgcgccgcggtggcgaacaggagcacgccgccgacatgtaatgtaaggcgggatcggatacagatccacgaccacgacgctgagacgaagtgcacctgcatgcgtgccaccgacacaacacaatgcgtgttttcgtcctccaagtttttacttaattttccacgagcccacgatcgatcgaataaatatagcatgtatcgctatactatcttgcaaattaacctatcttgggtggaataaatgaaattggtcatcgtggccaagttata

SEQ ID NO: 4694 - DNA, 1372 bp, Leymus cinereus x Leymus triticoides
ccgttgctgtcgagcacacaaagtctcgtggtatagagaaacggaactagggaagctagctagctcgaccatgggtggtgttcggcagcagctcatcgccgccgtcctcgtggcggtggcgctgatggccacggcggcggaggggtacatctctcagaagacgtggggcgccatccgccgggcgaaccgcgccgggccgttcgtcggcctcgtcgtgcccaacacatacgagatggtccccgtgctcgagtcgcccagcttcgtggccagcaaaagcgtccctaacatggacatccaagggcgaaggtttcgcttcggaaccatcggaggccaaagcgtcgtcatggtcatgacaggactgagcatgctcaacgctggtctgaccacccaaatgctgctgagcctgttccgggtgaagggcatcgtccactggggcatcgccggcaacgccaacgaggacctccagatcggcgacgtcaccatccccgagtactgggctcacgtctccctctggaactggcagcggttcggcgacggcaaggataacgagctgccgctggaggccgccggcgactacacgcgggagtacggcttcctcaacttctccgactacaccgtggggcagagcaacccggaaccatccgcgaaccagctcaacagcatctggtaccagccggaggagatcttcccggcgtccggcgagccggaggagcggcagcacgcgttctgggtgcccgccagcaagcggtactacgcgctggcggcgaagctggagggcatggagctgccggcatgcgtgaacgcgacgacgtgccttccccgcgcgccgcgggtcacccgggtcagcaagggctgcagcgccaacgtgttcctggacaacgccgagtaccgccagttcctccgcaagcagttcgggtgcacccccgtggagatggagagcgccgccgtggccctcgtggcgcacacgcagggggtgccgttcctcaccatccgctcgctctccgacctcgccgggggaggctccgcgctcgggaacgaggccagcaccttcatcgacatcgccgcgaagaacgccgtcgaagtcatgctcaaattcgtgtcgctgctcgggaagaggggcgacgagatggacgacggcgcggccgcggacatgtgatgtgagccagcagccacttgtccatgcatgaataatcggatgcccgtgcgtggcgtatcgttgtttcgctttcctttttttttccttgccccgcgcgacctgctgtaaggcttgcgactttgcgagcctagatcaaatcacagtcggtgagcccacgagttgcagagatgaataaatcaaataatcaggcgtgatgccgtttgtccggaaaaaaaa

SEQ ID NO: 4695 - DNA, 1341 bp, Triticum aestivum
cagcacacaaaacaagtctcgtggtatagagaaacggagctaaggaagctagccagctcgaccatgggtggtgttcggcagcagctcatggccgccgtcctcgtggcggtggcgctgatggccacggcggcggaggggtacatcactcagaagacgtggggcgccatccgccgggcgaaccgcgccgggccgttcgtcggcctcgtcgtgcccaacacatacgagatggtccccgtgctcgagtcgcccagcttcgtggccagcaagagcatccctaacatggacatccaagggcgaaggtttcgcttcggaaccatcgaaggccaaagcgtcgtcatggtcatgactggactgagcatgctcaacgctggtctgaccacccagatgctgctgagcctgttccgggtgaagggcatcgtccactggggcatcgctggcaacgccaacgaggacctccagatcggcgacgtcaccatccccgaatactgggcccacgtttccctctggaactggcagcggttcggcgacggcaaggataacgagctaccgctggaggccgccggcgactacacccgggagtacggcttcctcaacttctccgactacaccgtggggcagagcaacccggcgctatccgccaaccagctcaacagcatctggtaccagccggaggagatcttccccaagtccggcgagcccgaggagcggcagcacgcgttctgggtgcccgccagcaagcggtactacgcgctggcggcgaaactggagggcatggagctgccggcgtgcgtgaacgcgacgacgtgcctgccccgcgcgccgcgggtcacccgggtcagcaagggctgcagcgccaacgtgttcctggacaacgccgagtaccgccagttcctccgcaagcagttcgagtgcacccccgtggagatggagagcgccgccgtggccctcgtggcgcatacgcagggggtgccgttcctcaccatccgctcgctctccgacctggccgggggaggctccgcgctcgggaacgaggccagcaccttcatcgacatcgctgccaagaacgccgtcgaagtcatgctcaagttcgtgccgctgctcgggaagggcggcgacgagatggacgacggcgcggccgcggacatgtgagccagcagccactcgtccatgcatgaataatcggatgcccgtgcgtggtgtatcgtctcgctttcccttttttcttgcgccgcgctatcgatcgataaggcctgagactgcgagccctagctcaacagttggtgagcccacgaccacgagttgcagagatgaataaataaatcaaataatcggcctaatgcc

SEQ ID NO: 4696 - DNA, 1707 bp, Zea mays
gcgagtcgtcttcccccttgtgccgccgcccacccgcggcctcctcttccctcccctttaaaatccaaacgctccccgcttccctcgaaccgtcctcaatcccagttcaagtcccgcccaatggaggacccaccagcgcttcctctgcctgagccggagtccgagcccgatcccgatcccgaggcctcccctgcgcctccgcaaaggctgctgcgattgcgctgcgcggtgcagcactacgagtggggccagcgcggagccgcctccctcgtcgcgcgcctcgccgaccagaaccccgacccggcccgcccctatgccgagctctggatgggcactcacccgtctgccccctccacgctcctcgacgacggtacgctcctcagtgactggctcgcgcggaaccccgacgcgctcggccccgccgtcgctgcgcgctggggagtcgacctcccattcctcttcaaggtcctgtcggtggccaaggcgctctcgatccaggcgcacccggacaagaaactcgccgaggtgctgcacgcgctgcggccttccacttacaaggacgataatcacaagccggagatggccatcgccatcacggagttccgggcgctttgcggctttgccggtatcgaggagctcaaggatgtcctgagggcatttcctgaaattgaaggactagttgggcatgaagatactggcaagctgatgaacatgaaggaagatgatggggttagtgaagtaaaatccagtttgcaatcagcttttgctaagctaatgacagcaagtaaagacatggtttctgaagcagttgcaaaactgatcagtcgcctgaatactaagagcaagattaggaccttaacagacaaagaacagctggttttgtccctggagagacaatatcaagatgatgttggtgttatagcagcacttttctttaactatgtgaagctcagtcctggtgaagccctttacattggtgcaaatgaaccgcatgcatacctctctggggaatgcattgaatgtatggccacttcagataatgttgtacgtgctggtttgacacctaaatacagagatgtgcaaactctctgctcaatgctaacatacaagcagggtttccctgaaattttgcgaggagttcctgtgcagccacacgtaaggcgctacacacctccatttaatgagtttgaggtggattggtgcttggtgcctccaggtggactggtcgtcatatccccggtaccaggtccatccatctttctcgtaatcaccggggaaggcgagattcaattggattttatgtcagatggggagaaagcagaggaaggtgatgttttcttcgtccccgcgtacaccgaggttaagatctctgcgtgtggccccgagtctgtgcagctgtacagggctggggtaaacagcagattcttcagctaacactgtaattgtagggaatgaggatttttgcagttgtcgtaaagtggactacactgtaattgtagggaagttttcccagctaagaaatatacgtgaaatgaaatgattagttagcaaaaggtctcatatactaatgtatagggagggctacgtgctgataaaagaataaactggttactttcatatcttgatgatttactgtaaagatgccttgcagtgcaatccacgttggatgcgctagaaagaaataaaaatgatgaccatttggttgca

SEQ ID NO: 4697 - DNA, 1750 bp, Setaria italica
cgagtcgtcttctcccttcggccgccgccccgcccaacagcggcatccctcctcttccctcccctttaaaatccaaacgcccccgcccctccctccaaccgtccgtccctcaagcccagcgcccgaatctccgcccaaatggaggacccgcctcctccgccggagcccgagcccgcggccgcgtcggcctccccgcagcgcgacgtggagccgtctccgccaccgccgcagaggctgctgcggctgcgctgcgcggtgcagcactacgagtggggccggcgcgggtccgcctccctcgtcgcgcgcctcgccgaccaggaccccgacccggcccgaccctacgccgagctctggatgggcacgcacccgtcgggcccctccacgctcctcgacggcggcgcgctcctcagggactggctcgcgcggaaccccgacgcgctcggccccgccgtcgccgcgaggtggggaggcgacctcccattcctcttcaaggtgctgtcggtggccaaggcgctctcgatccaggcgcacccggacaagaagctcgccgaggtgctgcacgcgctgcggccgtccacctacaaggacgacaaccacaagccggagatggccatcgccatcaccgagttccgggcgctttgcggctttgcgggcattgaggagctcaaggatgtcctgaggactgtacctgaagttgaagggctagttgggcatgaggatactggcaagctgatgagtatgaaggaatatgatgggggtagcgaagtaaaatccagtttgcaatcagcttttgctaagctaatgacagcaagtaaagacatggtttctgaagcaatttcaaaactaattagtcgcctgaatattgagagcaagattaggaccttaacagataaagagcagctggttttgtcactggagaaacaatatcaagaggatgttggtgttctagcagcacttttctttaactatgtcaaacttagtcctggggaagcactttatattggtgcaaatgaacctcatgcctacctctctggggaatgcattgaatgtatggcaacttcagacaatgttgtccgtgctggtttgactcctaaatacagagatgtgcaaactctctgctcaatgctaacatacaaacaggccttcccggaaatattgcgaggggttcctgtccagccacacgtaaggcgctacacccctccatttgatgagtttgaggtcgattgctgcttggtacctccaggtgaactggtggtcatagccccggtgccaggcccatctatgtttctcatcatgatgggtgaaggtgagctccagatagattctctgtctgctggggaaaaggcaaaggatggtgatgttttcttcgtccctgcatatactgaggttaagctctctacctttggcactgagtccatgcagctgtacagggctgggataaacagcagattcttcagctaactggtgcgttgatctttggtcgcctaggaaaggagggtttaggggtgttgtaagtggaccacacgtaattgtagggaagatttcccagctacgaaatatacgtgaaatgaaatgattagttagcaaaaggtttcatatactaatgtatagggttacaggccgacgaaagaataacctggttcctttcatatcttgataatttagtgtaaaaatgtcttacagtgcaatccacattgatgcactagaaaggaataaaaaaaaatgatgttagtatcaaccttttggttgc

SEQ ID NO: 4698 - DNA, 2278 bp, Panicum virgatum
aaaacgccgagaaaattttgcccaaaaattttggcaggtctctgcaacagtccctaccaccgccaacgcagtactcgccccgggttggaggaaaaccgacgcggtcaattcagttgccacgccgcatcgggcgagtcgtcttctcccctcggccgccgcccagcagcggcctcctcttccctcccctttaaaatccaaacgcccccgccccctccctccaaccgtccccaagccgcccagctcccgaatctccgcccaatggaggacccgcctccgcctcctccgccggagcccgagcccgagcccgcggctgcgtccgcctccccgcggcgcgacgcggagccacctccccctcagccgcggcggaggctgctgcggctgcgctgcgcggtgcagcactacgagtggggccggcgcggggatgcctccctcgtcgcccgcctcgccgcccaggaccccgacccggcgcgcccctacgccgagctctggatcggcacgcacccctcgggcccctccacgctcctcgacgacggcgagctcctcggggactggctcgcgcggaacctcgacgcgctcggccccgccgtcgccgcgcggtggggcggcgacctcccattcctcttcaaggtgctgtcggtggccaaggcgctctcgatccaggcgcacccggacaagaagctcgccgaggtgctgcacgcgctgcggccttccacctacaaggacgacaaccacaagccggagatggccatcgccatcaccgagttccgggcgctttgcggctttgcgaccagcgaggagctcaaggatatcctgaggactgtccctgaagttgaagggctagttgggcatgaagatgctggcaagctgatgagtatgaaggagtatgatgggggcagtgaagtaaaatccactttgcaatcagctttcgctaagctaatgacagcaagtaaagacatggtttctgaagcaatttcgaaactgatcagtcgcctgaatattgagagcaagattaggaccttaacagataaagaacagctggttttgtccctggagagacaatatcaagaggatgttggtgttctagcagcacttttctttaactatgtcaaacttagtcctggtgaagcactttatattggcgcaaatgaaccgcatgcatacctctctggggaatgcattgaatgtatggccacttcggacaatgttgtccgtgctggtttgactcctaaatacagagatgtgcaaactctctgctcaatgctaacttacaaacaggccttcccagaaatcttgcgaggtgttcctgtgcagtcacacgtaaggcgctacacccctccatttgatgagtttgaggtcgattcctgcttggtacctccaggtgaactggttctcatatccccggtgccaagcccttctatctttctcgtcatggccggggaaggtgagctccaggctgattctctgtctgatggggaaaaggcaaaggaaggtgatgttttcttcgtccctgcatacactgaggttaagctctcttcctgtggccctgagtccatgaagctgtacagggctggggtaaacagcagatccttcaactaactggtgcgtcgatctttggtcgcctagggcagaagagtgtaggggtgtcgtaagtggaccacactgtaattgtagggaagagttcccagttacgaaatatacgtgaaatgaaatgattagttagcacaaggtttcatatactaatgtatagggctacaggccgatgaaagaataaactggttcctttcatatcttgattgacaacttagtgtaaaaatgtcttacagtgcactccacattgatgcactagaaaggaataaaatgatgattagtatcaaccatttggctgccttttttttatcagagttcaattgtgtgagctgtccaatttacagttctggagcatttggatcattggaaacaaatgttcacatgcagaggcatggatgtgccaatcaggtccattctactactgaacctgaacttaacttgtaaacagttcctcttagttacttggctcataaccaggcacttaataggagcttagtacaggaggattcggatggtatcgcttttggcatgatgcccaggtgggctttgcttctagaagaactgtagcttcggtaactttatggtggaagctcatttgccaaactttggtcatggcaagaatatttatcgtgcacagggccatgtggcgctgtggcctgtgggcgagaaaatgagttcactctgcagtgga

SEQ ID NO: 4699 - DNA, 1833 bp, Panicum virgatum
ccaacgcagcactcgccccgggttggaggaaaaccgacgcggtcaattcagttgccacgccgcatcgggcgagtcgagttgagtcgtcttctcccctcggtcgccgcccagcagcggcctccctctctccctcccctttaaaatccaaacgcccccgcccccctccctccaaccgtcggaccccaagccgcccagctcccgaatctccgcccaatggaggacccgcccccgcctccgcctcctccgccggagcccgagcccgcggccgcctccccgcggcgcgacgcggagccgtctcctccccttcagccgccgccgcggcggaggctgctgcggctgcgctgcgcggtgcagcactacgagtggggccggcgcggggacgcctccctcgtcgcgcgcctcgccgcccgggaccccgacccttcgcgcccctacgccgagctctggatgggcacgcacccctcgggcccctccacgctcctcgacggcggcgagctcctcggggactggctcgcgcggaaccccgacgcgctcggccccgccgtcgccgcgcggtggggcggcgacctcccattcctcttcaaggtgctgtcggtggccaaggcgctctcgatccaggcgcacccggacaagaagctcgccgaggtgttgcacgcgctgcggccttccacctacaaggacgacaaccacaagccggagatggccatcgccatcaccgagttccgggcgctttgcggctttgcgaccattgaggagctcaaggatatcctgaggactgtacctgaagttgaagggctagttgggcatgaagatgctggcaagcttatgactatgaaggagtatgatgggggcagtgaagtaaaatccactttgcaatcagctttcgctaagctaatgacagcaagtaaagacatggtttctgaagcaatttcaaaactgatcagtcgcctgaatattgagagcaagattagaaccttaacagataaagaacagctggttttatccctggagagacaatatcaagaggatgttggtgttctagcagcgcttttctttaattatgtcaaacttagtcctggtgaagcactttatattggcgcaaatgaaccgcatgcatacctctctggggaatgcattgaatgtatggccacttcagacaatgttgtccgtgctggtttgactcctaaatacagagatgtgcaaactctctgctcaatgctaacttacagacaggccttcccagaaatcttgcgaggtgttcctgtgcagccacacgtaaggcgctacaccccaccatttgatgagtttgaggtcgattcctgcttggtacctccaggtaaactggttgtcatatccccggtgccaagcccatctatctttctcgtcatgaccggggaaggtgagctccaggctgattctctgtctgatggggaaaaggcaaaggaaggtgatgttttcttcgtccctgcatacactgaggttaagctctctgcctctggccctgagtccatgaagctgtacagggctggggttaacagcagatccttcaactaactgatgcgtcgatctttggtcgcctagggaaggagagtttaggggtgtcgtaagtggaccacactgtaattgtagggaagagtccccagctacaaaatatacgtgaaatgaaatgattagttagcaaaaggtttcatatactaatgtatagggctacaggccgatgaaagaataaactggttcctttcatatcttgattgacaacttagtgtaaaaatgtcttagtgcactccacattgatgcactagaaaggaataaaatgatgattagtgtcaaccg

SEQ ID NO: 4700 - DNA, 1436 bp, Panicum virgatum
cggaagaagccctcccacccgcccaagccgcggtggcagaccgtgctcagcgtcgccgcgaagaacgccgcgctcctcgccgcgctgctctacctcggggacctcgcctggcgctggtcccacccgcccccgccctccccgccgcccgaccgcgccgcgcgagtcgacgaggtcgaggcctccctcgcccgcaccttccggatgctgcaggtgcagctcgaggccatcgaccgcaagatcgacggcgaagtcggcgccgccaaggccgacctcgccgcgctgctggaggagaagcggctcgcgctcgagggcggccttgcgcggctcgacgggagggtcgacgagctcggcgacgcgctggcagggctcgggcggatggagttcctcaggaaggacgagttcgagaagttctgggaggaggtgaagggcagcctggcctcggggtcagggagcgaggtcgatctggaccaggtccgcgccctcgccagggagattgccctgagggagattgagaagcacgccgcagatgggatcggcagggtcgactacgccctggcgtcgggtgggggaagagttgtccgccactcggagccctacatgcctaaacgtggtatgttgaatgtgtggctgggtggacgtaatgctgaccctcaaaagatgattcagcccagctttggggagcctggccagtgctttcccttgcagggcagcagtgggttcgtggagatcaagctaaagacggggataatccctgaggcagtcactcttgagcatgtctcgaaggatgtggcatatgacaggtccacggctccaaaagattgccgggtgtctggatggtatgacgagacgcctggtgagacccaatcaggtcatgctgctaagatgactgccctggcagagttcacatacgacctggacaagaacaatattcagacatttgatgttacagcaccagatgtaggcatgatcaatatgatacggttggatttcacttcgaaccacggaagctcactgctgacatgtatctaccgcctccgggtgcatggccatgagcctgtctctccaggcaccgcaggtgttctggcatgagtggggtgagggaaggttttcagttcactttagggcctctctttttgtccatctggtttatccctaggatgctgtcatgtacaaactgtaaatctaacaattatttgctggaacctggttacttccagtgcaatggcacgtggcagatattttagtttgtgcattaaatagatatggatgtccaagagccttgtgtcctgtaatatgtggatggtggtttggcgcagttggtagtttgagtaaggctgggtgtggaattatgcataaaaaatgattctgttctgttttgaaaagacaacgtggtgaaatcttttggcattgggaatattttcatcagttcagataaa

SEQ ID NO: 4701 - DNA, 2129 bp, Panicum virgatum
caattcggcgcgttgggccgtgtttggtcgaaacaatgaaatttttttcataaaaagatgactatatgtacaaagtactaaacgaagtttatttgtaaaatttttttatgaataggtgtaatttttcgagataaatctaatgatagtaattattttatgatttgctacagtgatgctacagtagtcgtcctctagttgtgcagtcaaaaaccttattaaattggtctcgcaaatttactaaaaattctgcagataattttgtaatttgattttatttaatactctaaattagatgtcaaatgtgtaaaaagttttggcgaaattttttttagcctaaaccaaacacggcttggtgcgcgtccgctcgtcttccccggagcgcccgcccgcccgcttcggcttcccccaaatttccccagcaattcgcactcgcattcgcatttgagattccccccaagcccaccccgaaccccaaccgcctgcctccgcccccacccttcccatggcgtccccctccctcgccgccgcggccaccagccccgcctcatccccgctaaccctagacgccatccccctcgcctcccgcccaccgcccgccgccgcggccctgcggaagcgcccggtcctcctcctcgacacccgcccgcaccccgcctccccgacgcccccgctcctctcctccaccgccgcggccgcggctgcggccgccgcaccggcgcggcggaagaagccctcccacccgcccaagccgcggtggcagaccgtgctcagcgtcgccgcgaagaacgccgcgctcctcgccgcgctgctctacctcggggacctcgcctggcgctggtcccacccgcccccgccctccccgccgcccgaccgcgccgcgctcgaggcctacgccgcgcgcgtcgacgaggtccaggcctccctcgcccgcaccttacggatggtgcaggtgcagctcgaggccatcgaccgcaagatcgacggcgaggtcggcgccgccagggcggacctcgcggcgctgctggaggagaggcggctcgcgctcgagggcgccctcgcgcggctcgacgcgagggccgacgagctcggcgacgcactggcagggctcgggcggatggatttcgtcaggcaggacgagttcgagaagttctgggaggaggtgaagggcagcctggcctcggggtcagggagcgaggtcgatctggaccaggtccgcgccctggccagggagatcgccctgagcgagattgagaagcatgccgcagatgggatcggcagggtcgactacgccgtggcgtcgggtgggggaagagttgtccgccactcggagccctacgtgcctaatcgtggtggtatcttcaatgggtggctgggtggacgtgatgctgaccctcaaaagatgattcagcccagctttggggagcctggccagtgctttcccttgcagggtggcagtgggttcgtggagatcaagctaaagacggggataatccctgaagcagtcactcttgagcatgtctccaaggatgtggcatatgacaggtccacggctccaaaagactgccgagtgtccggatggtatgacgagacgcctggtgagactcaatcaggtcatgctgctaagatggctgccctggcagagttcacatacgacctggacaagaacaatattcagacatttgatgttacagcaccagatgtaggcatgatcaatatgctccggttggatttcacttcgaaccacggaagctcactgctgacatgtatctaccgccttcgggtgcatggccatgagcctgtctctccaggcaccgcaggtgttctggcatgagagcagtgagggaaggttttcagtacacttttagggcctctctttttgtccatgtggtttagccctaggatgctatcatgtacaaactgtaaatctaacaattatttgctgtaacctggttcattaaatatgtgattggcggcagatgttcagtttgttcattaaatagatatggatgtccgagatccttatgtcctgtaatatgtgattggcggcttggcgcagttggtagtttaaatatgttaaggctgggtgaggatttttgcataaaaatgattatgttctgttttgaaaagac

SEQ ID NO: 4702 - DNA, 1063 bp, Pennisetum glaucum
gaagaagcggctcgcgctcgagggtgggctcaaccggctcgacgcaagggccagtgagctcggcgacgcgctcgcagggctcagtcggatggaattcctccggaaggacgagctcgagaagttctgggaggaagtgaagggcagcctgacctcgggttcagggagtgaggtcgatctggaccaggtccgtgccctggctagggagatcgctatgagggaaattgagaagcattccgcagatgggatcggcagggttgactatgctgtggcatcaggtggaggacgagttgtccgccactcagagccctatgtgcctaaacgtggtagcatctggactggttggctgggtggaggtaatcctgaccctcagaagatgattcagccgagctttggggaacctggccagtgctttgctgtgcagggaagcaatgggtttgtggagatcaagcttaagacagggataatccctgaggcagtcactctcgagcatgtctcgaaggatgtggcatacgacaggtccactgctccaaaagattgccgggtgtctggatggtatgatgagacccctggtgagacccaatctagtcatgctgccaagatggctgccttggctgagttcacatatgacttggacaagaacaatatccagacatttgatgttacagccccagatgttggcatgatcaatatgattcggttggatttcaattcgaaccatggcagctcacagctgacttgcatctaccgcctccgggtgcatggccatgagcctctctctccaagcactgcagggtttaaggcttgagagcagtgtggggaggtttcagtatgctttggggcttgctcttattgcccattcttgtttagctctaggatgctgtcatgtacaaactgtaaatctaacaattgtttgctggtacctggtaccttctagttcaatggcatgtggcggatgtttagtttgtgcattaaatggttatagatgtccaagagccttttgccctgtaatagtctgtggttgtaggctatgcgcaattggtagtttgaacctggtaaagacggc

SEQ ID NO: 4703 - DNA, 914 bp, Panicum virgatum
  misc_feature (189)..(189): n is a, c, g, or t
  misc_feature (213)..(214): n is a, c, g, or t
  misc_feature (449)..(449): n is a, c, g, or t
tcgacgagctcggcgacgcgctggcagggctcgggcggatggagttcctcaggaaggacgagttcgagaagttctgggaggaggtgaagggcagcctggcctcggggtcagggagcgaggtcgatctggaccaggtccgcgccctcgccagggagattgccctgagggagattgagaagcacgccgcanatgggatcggcagggtcgactacnncctggcgtcgggtgggggaagagttgtccgccactcggagccctacatgcctaaacgtggtatgttgaatgtgtggctgggtggacgtaatgctgaccctcaaaagatgattcagcccagctttggggagcctggccagtgctttcccttgcagggcagcagtgggttcgtggagatcaagctaaagacggggataatccctgaggcagtcactcttgagcatgtctcgaaggangtggcatatgacaggtccacggctccaaaagattgccgggtgtctggatggtatgacgagacgcctggtgagacccaatcaggtcatgctgctaagatgactgccctggcagagttcacatacgacctggacaagaacaatattcagacatttgatgttacagcaccagatgtaggcatgatcaatatgatacggttggatttcacttcgaaccacggaagctcactgctgacatgtatctaccgcctccgggtgcatggccatgagcctgtctctccaggcaccgcaggtgttctggcatgagtggggtgagggaaggttttcagttcactttagggcctctctttttgtccatctggtttatccctaggatgctgtcatgtacaaactgtaaatctaacaattatttgctggaacctggttacttccagtgcaatggcacgtggcagatattttagtttgtgc

SEQ ID NO: 4704 - DNA, 1625 bp, Setaria italica
gccgccgcccttcccatggcgtccccctccctcgccgcggccgccaccggccccgcctcctccccgctagccctagacgccatccccatcgcctcccgccccccggccgccgccccgcggaagcgcccggtcctcctcctcgacacccgcccgcacccggcctccccgacgcccccgctcctctcctccaccgccgcggccgccgctgcggccgcatccgctcctccggcgcacgcgcggcgcaagaagccctcccacccgccccggccgcggtggcagaccgcgctcagcatcgccgcgaagaacgccgccctcctcgccgcgctgttctacctcggcgacctcgcctggcgctggtcccacccgcccccgccctccccgccgcccgaccgcgccgcgctcgagggctacgccgcccgcgtcgacgaggtcgaggcctccctcgcccgtgccttcaagatgatgcaggtgcagcttgaggccgtcgaccgcaagatcgacggcgaggtcggcgccgccagggccgacctcgccgtgctgctggaggagaagcggctcgcgctcgagggcgggctcaaccgtctcgacgcgagggccggcgagctcggcgacgcgctggcggggctcagtcggatggagttcctccggaaggacgagttcgagaagttctgggaggaggtgaagggcggcctggcctcgggttccgggagtgaggtcgatctggaccaggtccgcgcccttgccagggagattgccatgagggagattgagaagcatgccgcagatgggatcggcagggttgactacgctgtagcatcgggtggggggagagttgtccaccactcggtgccctacgagcctaaacgtggtatcttcagtgggttgctgggtggaggtaatcctgaccctcagaagatgattcagccgagctttggggagcctggacagtgctttgctgtgcagggcagcagcgggtttgtggagatcaagcttaaatcaggtataatccctgaggcagtgacactcgagcatgtctccaaggatgtggcatatgataggtccacagctccaaaagattgccgggtgtctggatggtatgatgagacgtccggtgagacccaatcaagtcatgctgccaagatggctgccctggcagaattcacatacgacttggacaagaacaatattcagacatttgatgttacagccccagatgtaggcgtgatcaatatgatcaggttggatttcacttcgaaccacggaagctcactgctgacgtgcatctaccgcctccgggtgcatggccgcgagcctgtctctccaggcactgcaggttttcgggcctgagagcagtggggaaaggttttcagtacgctttagggcttgctctttttacccattctggtttagccctaggatgctgtcatgtacaaactgtaaatctaacaattgtttgctgggtaactttagtccaatggcatgtggcagatgtttagtgtgtgcattaaatggatatggatgtccaaaagctttttgtgtcctgtaatatgggttggcggcttgccgcaatttgtaggctgagtgtgcgaagttatcagaaaaaaaatgattctactctgtttcgg

SEQ ID NO: 4705 - DNA, 738 bp, Saccharum officinarum
gcccatgtgaggaggcgcgactgctctcgtctgtgtttgcttcctccgccgccggcaaggaaggcgagagcaaaaccctagctagacttggcgagtggggcgaaggcgcggctgctcgtccgcgacatcgaatttcagcgccgcccgcgagatccccggccttcgttctcttcccccgtgaggagaggtgcggcaatggctgggaaaggcgggccgaccaacttggagaaggagcagatgtttgggatggcggagaaggagatggagtacagggttgatcttttcaataggcttacacagacctgtttcgacaagtgcattgagaaaaggtataaagaagctgagctcaatatgggtgagaacagttgcattgatcgatgtgtttcaaagtattggcaggtgactaatttagtcggtcagatgcttgggaaccggcctcagatgtgaactgagaagcactggttccattttgtagcagaatcctattgctctgtttcttctttttggttggttttagaatgccgccacctgctactaagtacaccaatacagcgacagacaagctaatgcgtggactactttaaagaaaaatcacggtgtcttaccctttccagtgatgcgcattctctctgaatcatgaactgggaacatgcctgtaataatttgatacagctctagagtaattctgtctcgaaagcttgtcctgtctcgtagttaaattctggatttatgttaaaa

SEQ ID NO: 4706 - DNA, 663 bp, Zea mays
gtacggcccatgtgagaaggcgcgcacctgctcctcacctgtgtttgcttccgccgccggcaaggaagaagagagcaaaaccctagctagagttggcgagtgggggtggaggcgcggctgctcgtcacgacatcgagtttcagcgccgcccgcgagatccccggatttcgttctctacccctgagagctgcggcaatggctgggaaaggcgggtcgaccaacttagaaaaggagcagatgtttgggatggcggagaaggagatggagtacagggttgatcttttcaacaggcttacacagacctgttttaacaagtgcattgaaaaaaggtataaagaagctgagctcaatatgggcgagaacagttgcattgatcgatgtgtttcaaagtattggcaggtgactaatttagttggtcagatgcttggaaaccggcctcaaatgtgaactgagaagcactcgttccattttgtagcagaattctattgctctgtttcttctttttggttggttgtagaatgccgcacctgttctaagtacaccaatacagcaacagacatgctactgcgtggaccgctttaaagaaaaaaaatcagtgatgcgcattctctctgaatcatgaactgtaataatttgatacagctctagggcaattctgtttcg

SEQ ID NO: 4707 - DNA, 1048 bp, Setaria italica
atgagccgttcctgcacctcctccttccagtccatcgcccgcagctcacgtcgctccctcctctgcagccgcttctcccgcgccgtcagctcgcccccacccccgccgcctccatcagcggaagccgaagccgataagctcaccgacacgggaagcggagacgatgacgcgatcgcggcatttctcctcaccgtctccttccgccggcccctccgagcaaagggacaaaaccctagagttcggcgagggagggcggaggcgaggctgctggtcggcggtcgctacatcggatctcgacgacgccgcttgaacccaggcctttgttcttcttccccgcgaggtgccgcaatggctgcgaaaggcgggccaaccaacttggagaaggagcagatgtttgggatggcggagaaggagatggagtacagggttgatcttttcaataggcttacacagacctgtttcgacaagtgtgttgagaaaaggtataaagaagctgagctcaatatgggtgagaacagttgcatcgatcgatgtgtttcgaagtactggcaggtgacaaacttggttggtcagatgctcgggaaccggcctcagatatgacctgagaagcattagttgcattttgtagcgtaatctgtcgctctgtttctccattttggttggttttagaatgcctctacctgctattaagtacaccaatgcagcaccagtgactggctgattcgtggaccgctcaaaggaaatcccgatgtcttgcactttccagggatgtgccttgtctatgaatcatgaacagggaacatgcctgtaataatttgatacagctcgggagaataattctgttgctaaagctgtacctgtttcatagttaaactgctgtattgatgcgttgccactgtcgtggcttctggacgcaacttttgcttgcttgcctcgtagcagtctgaggtagtcagggtaatgtttatgtaccattcatattagacatacattcgaagatatcgcagttcaaattaaaattcagtccctcccaaaaaaaaggtttcag

SEQ ID NO: 4708 - DNA, 869 bp, Zea mays
gcaagaaataatgcttttgtgctgatttcagcaagctttcattagagctatattatgggcctcgaggcccatcgccctcggaataaggcgcggacttacaggtgggccctttgtcagtaagcttgccctcgggccatgtatgatgtatcccgttcgggtgcggcccatgtgagaaggcgcgcgcctggacctcatcggtgtttgcttccgcagttccgccgtcggcaaggaaggaaaaagagagcagagaaccctagctagagtttggcgagtggtgcggaggcgcggctgctcctgctcgtcgcgacgtcgaatttcagcgccgcccgcgcgatccttggtctcttcgcccgtgaggagaggcgcgacaatggctgggaaaggcgggccgaccaacctggagaaggagcagatgtttgggatggcggagaaggagatggagtacagggttgatcttttcaacaggcttacaaagacctgttttgagaagtgcgttgaaaaaaggtataaagaagctgagctcaatatgggtgagaacagttgcattgatcgatgtgtttcaaagtattggcaggtgactaatttagtaggtcagatgcttgggaaccagcctcagatgtgaaccgagatgcactagttccattttgtagcagaatcctattgctctgtttattctttttggttggtattagaatcccgccacctgctattaagtacaccaatacagcaccagacttgttaatgcgtggatcgctctgaagaaaaatcacggtgtcttgctctttccagtgatgtgcattatctttgaatcatgaacagggaacatgcctgtaataaatttatagagctcgagagtgatcctgtttcga

SEQ ID NO: 4709 - DNA, 677 bp, Pennisetum glaucum
aaaaccctagagtttggcgagggagggcggaggcgaagctgctggtcggcggttgcttcatcggatctcgacgccgccgctcgaacctaggcctttgtcctccttccccgcgaggtgccgcgatggctgcgaaaggcgggccaaccaacttggagaaggagcagatgtttgggatggcggagaaggagatggagtacagggttgatcttttcaataggcttacacagacctgttttgacaagtgtgttgagaaaaggtataaagaacctgagctcaatatgggtgagaacagttgcatcgatcgatgtgtttcgaagtactggcaggtgacaaacttggttggccagatgctcgggaacaggcctcagatatgacctgagaagcactagttgcattttgtagtgtaatctgttgccccgtttctcccatcttggctggttttagaatgccgccacctgctatgaatcaagtacaccaatgcagcgccagtgactggctaattcgtggaccgctcaaacggaaatcccgatgtcttgcactttccagggatgtgccctgtctatgaatcatgaacagggaacatgcctgtaataatttgatacagctcggagaagaataattctgttgctaaagctgtacctgtttcaattgttaaactgctgtattgatgcgtttca

SEQ ID NO: 4710 - DNA, 529 bp, Triticum aestivum
  misc_feature (509)..(509): n is a, c, g, or t
cgcggctgctcctgctcgtcgcgacgtcgaatttcagcgccgcccgcgcgatccttggtctcttcgcccgtgaggagaggcgcgacaatggctgggaaaggcgggccgaccaacctggagaaggagcagatgtttgggatggcggagaaggagatggagtacagggttgatcttttcaacaggcttacaaagacctgttttgagaagtgcgttgaaaaaaggtataaagaagctgagctcaatatgggtgagaacagttgcattgatcgatgtgtttcaaagtattggcaggtgactaatttagtaggtcagatgcttgggaaccagcctcagatgtgaaccgagatgcactagttccattttgtagcagaatcctattgctctgtttattctttttggttggtattagaatcccgccacctgctattaagtacaccaatacagcaccagacttgttaatgcgtggatcgcctgaagaaaatcacggtgcttctctttccagtgatgtnatatctttgatcatgacagg

SEQ ID NO: 4711 - DNA, 636 bp, Oryza sativa
gagaacaaaaccctagaattgggggaagggttcatcaggtcttcttctcttctggaggcgcgctgctcttcgcggcatctcaattcccaccgccgcatcgcgagatctccggccttttctccttccggttgaggagcaaagagcagcaattatggcggcgaaacccgagccgacccagttggagaaggagcagatgttcgggatgatggagaaggagatggagtaccgggtcgatcttttcaaccgacttacacagacttgttttgacaagtgcattgagaaaaggtataaagaagctgagctcaatatgggtgagaacagttgcattgatcgatgtgtttcgaagtactggcaggtaactaatatggtaggtcagatgctcggtaaccggcctcagatgtgaggcgagaagcagtagaagcattaggccagaccattgtcgctatgtttctccacattggttttagaatgttaccgattgccagaagtacacagcacgagtgagtgtgaccgactaatggattgcccgaaaagaaattgcaatgttcctttccaatggtgtaccttctccctgaatcatgaacaggccacatgcctataataatttggtacagctagacgacgatttttgctgcg

SEQ ID NO: 4712 - DNA, 749 bp, Avena sativa
gggaagggacaagcggtggaggtgcggctgctctagttcttcttcctcgcggcgtctcgaccaccgaccgacgcgctcgcgagatctccagcctcctcagctccccttccccgtgacgcgtcgcgcaacaatggctgcgaaaggaggcgggccgagcgacctggagaaggaacagatgttcgggatggcagagaaggagatggagtacagggtcgatctcttcaaccggctaacgcatagttgtttcgacaagtgtattgagaaaaggcataaagaagctgagctcaatatgggagagaacagttgcattgatcggtgtgtttcaaagtactggcaggtgactaacttggtcggtcagatgctcgggaatcggccccagatgtgagatgggaagcagtagttgcgttttctgtagcagagtattgtcgctatgattctctgttttggttttagaatgtttgccacttgctaagtaaagcatgcgtgactgactaattcatctatactgtttaaaaggaaaccccagtgtgtggccctttccagtgatgtaccttgtctccgaatcatgagcagaggcacatgcctgtaataattcgatacagctcgagagattttgttgccatagctgctcttttcatagttatgattatgcctgtctaaatatctgtgctggaacagatcttctgtactattggcaccttttgcttcctcgactgaagggccaatgttatcatttatatgttcttgaa

SEQ ID NO: 4713 - DNA, 581 bp, Festuca arundinacea
  misc_feature (566)..(566): n is a, c, g, or t
ggcacgaggctctagtcttcttcttcctgctccctagcggcgtctcgaccaccgccgcgaccgcgagatctccggcatcctccggcccccatccctgtgaggcgtcggaaacaatggctgcgaaaggaggcgggccgagcgacctggagaaggagcagatgttcgggatggcggagaaggagatggagtacagggtcgacctcttcaaccggcttacacatagttgttttgacaagtgcattgagaaaaggcataaagaagctgaactcaatatgggagagaacagttgcattgatcggtgtgtttcaaagtactggcaggtgactaacttggttggtcagatgctcgggaatcggcctcagatatgagctgggatgcagtagctgtgttttctgtagcagagtattgtcgctatgttctattttggatttagaatgttcaccaccatctaagtaaagcatgtgtgaccaactaattcgtatactgcttaaaggaaaccccccagtgtgttgccctttccagttatgtaccttgtctccaaatcatgagcagaggcgcatgcctgntataattcgatacag

SEQ ID NO: 4714 - DNA, 778 bp, Brachypodium distachyon
atagtttgggctgaaagggccaatggtaagaagcccatatgaggacgcgaaggtcgttcctcgttctccacgaaagaagaacaaaaccctagaggttgggggaggaacaattggaggcgcggctgctctactgttcttccgcgctcgcgagatctccgacctccttcgctctccttcccggcgaggcggcgcgagaaacaatggcttcgaaaggcgggccgagcaacctcgagaaggagcagatgtttgggatggcggagaaggaaatggagtaccgggtcgatcttttcaaccggcttacacatagttgctttgagaagtgtattgagaaaaggcataaagaatctgagctcaatatgggagagaacagttgcattgatcgatgtgtttcaaagtattggcaggtgactaatttggtcggacagatgcttgggaacaagcctcagatatgagcggggaagcagtagttgaattttctgtagtagaatactgtctctatgtttctccattttgtttctagaaagttgtctacttgccaagtaaagcacatcagtttcggctaattcatggacaaaaggaaaccctttccagtgatgtgtacgttactctccgaatcatgagcagaggcacacgcctgtaataatttgatacagctcgagagaacaattttgttgccaaagctgctcctttttcatattagttctttaatatcccaaagctgtgtctggaactctcgagtctctgtccgctgagtcgctgacacaaattcttctgaact

SEQ ID NO: 4715 - DNA, 736 bp, Panicum virgatum
agttcggtgattgcaccggatatgcctcgtctccgccctctcctttccacggcggccccctcgcggaggaagagcaaagggataaagccctagagtttggcgagggagggcggagccgcggctgctggtcggtggtcgctacatcggatctccccgccgccgtcgcttgaacctaggcctttgttctccttccccgtgaggtgccgcaatggccgcgaaaggctcctcatccaacttggagaaggagcagatgttttggatggcggagaaggagatggagtacagggttgatctcttcaatagacttacacagacctgcttcgacaagtgcgttgagaaaaggtataaagaaactgagctcaatatgggtgagaacagttgcatcgatcgatgtgtttccaagtactggcaggtgtcaaacatagttggtcagatgcttgggaaccggcctcagatgtgacctgggaagcactagttgcatttttgtagcataatctgtcgctctgtttccccattttggttggttttacaatgtggccacctgctagtaagtgctccaatacagcaccagtgacttgctaattcatggaccgcccaaaaggaaatcccaatgtcttgcactttccagggatgtgccttgtctatgaatcatgaacagcgaacatgcttgtaataatttgatacagctcgagagaacaattctgttgctaaagttgcacctgtctggtagttgaac

SEQ ID NO: 4716 - DNA, 859 bp, Panicum virgatum
cccctctccgtctccgccctctccttccaccggcggccccctccgcggaggaagagcaaagggataaagccctagagtttggcgagggagggcggagccgcggctgctggtcggtggtcgctacatcggatctccccgccgccgtcgcttgaacctaggcctttgttctccttccccgtgaggtgccgcaatggccgcgaaaggctcctcatccaacatggagaaggagcagatgttttggatggcggagaaggagatggagtacagggttgatctcttcaatagacttacacagacctgcttcgacaagtgcgttgagaaaaggtataaagaaactgagctcaatatgggtgagaacagttgcatcgatcgatgtgtttccaagtactggcaggtgtcaaacatagttggtcagatgcttgggaaccggcctcagatgtgacctgggaagcactagttgcatttttgtagcataatctgtcgctctgtttccccattttggttggttttacaatgtggccacctgctagtaagtgctccaatacagcaccagtgacttgctaattcatggaccgcccaaaaggaaatcccaatgtcttgcactttccagggatgtgccttgtctatgaatcatgaacagcgaacatgcttgtaataatttgatacagctcgagagaacaattctgttgctaaagttgcacctgtctggtagttgaactattgtatcgatgcatttggactgacatagctggtggattcgacttttgcttgctcgagtcattgcagtttgatgtgcttagagtatactaacatttctgtataatccatattagacatgcatttgaagatatcgtagttc

SEQ ID NO: 4717 - DNA, 555 bp, Eragrostis curvula
aaaaaaagaccaaccagaacttgggtggtttctccactctgcagaacctagttgctgtgcgatcttgcgccggcgtccaacccctccgtgcctgatcccgcttcgttccaggaccaaatctgcgagctgcagcaatggcggcgaatggagccccgacgaacatgcagaaggagcagatgtttgggttggcagaaaaagagatggaatacagggtagatcttttcaaccggcttacacagacatgttttgacaagtgcatcgagaagaggcataaagaagctgagctgaacatgggtgagaacagttgcattgatcgatgtgtttctaagtattggcaggtaactaacttagtcgggcagcttcttggaaatcagcctaaaatgtgaaccaaaatgtggctcaggttcagggtgcaatgtatgtcatactttttgattttatagagtttggtggatttccaggaaaccattgatgagaggaagtcatgtctctcgtttctagcctgtgtattgttgacataacatggttgaaccaacattgaggtttcccgaacag

SEQ ID NO: 4718 - DNA, 701 bp, Setaria italica
ctccgccgctgcctcgctgaaacggggatcccgccgccgccggcatccccaacccgtcagctccagaactccgcgccgcactccccgcttcgttcgtgattccatctgtgagccgcagcaatggcagcgggtggtgcgccgaccaatatgcagaaggaacagatgtttggattggctgagaaagagatggaatacagggttgatcttttcaatcggcttacacagacatgttttgccaagtgcatcgagaagaggcacaaagaagctgagctcaacatgggtgagaacagctgcattgatcgatgtgtttcaaaatactggcaggtaactaatctagtcggacagcttcttggaaatcagcctaaaatgtgaactgagatgaaatttcattttgtggtgcaatattatgtcttcctttttggttctagggttttgatgtattactatgtaaaccaatgtgacatggggtgttcgagagagaaattacatctctaatttttatccttctattggtggcgcaatagggaaaaccaacatgtgaggtttctgataccaaattctacatctacccttcgtttgagctttgaaagcaacatagcctttagttttatggatgcaaatgtgtatcctttctgaaaagataaactgtttcaaccagtttatatcattggtcttaccttgttcggttatacctagtagca

SEQ ID NO: 4719 - DNA, 810 bp, Pennisetum glaucum
ttttgaaacacatttttttcttcttccagcaaaaccctccccacatccgcctatccctgttccgttcctccgccgccgccaccgcctcgctgaaacggggatcccgctgccgccggcatacccaatccgtcagctccttgttttcaaaaaaaaaaaaaccgtcagctccagaactccgcgccgcactccccgcttcgttcgtgattccatctgtgagccgcagcgatggccgcgggtggtgtgccgaccaatatgcagaaggaacagatgtttggattggcggagaaagagatggaatacagggttgatcttttcaaccggcttacacagacatgttttgacaagtgcatcgagaagaggcacaaagaagctgagctcaacatgggtgagaacagctgcattgatcgatgtgtttcaaaatattggcaggtcactaatctagtcggacagcttcttggaaatcagcctaaataaatgtgatctgagatgaaatttcatctcgtggtgctatattatgtcttcctttttggttctaggttttgatggatcactatgtaaaccaatgcaacatggggtgttcaggagagaaattacatctctaatttttagccttctattgctggtgcaatagggaaaaccaacatgtgaggtttctgataccatattctacccttcgtttgagctttgaaagcaacatagtctttagttttatggaggcaaatatgtaacctttctgaaaagataaattatgttgtcaaccatttttacatctaaaaaaaaaaaagaaaaaagaaaaaaaagtaaactctc

SEQ ID NO: 4720 - DNA, 1132 bp, Panicum virgatum
cgccgccgcgagtgccgccgccgcgagggagcaccggcccgggaggcggaagagcagcggataagccaagctcatggcgacgaacgggcgaacggcctcagaggcgaagcagcttggaacaagacgattaaaacgtactgggctgacaggtgggcccctattgtcacggggtatgaggcccattcagatgcggcccacattggaagtcgcggcctccctcggtttctcccctctcccaccggcccccacgccatctccttccaccggccctccctctctgacggaggaagagccaagggacaaaaccctagagtttggcgagggggggagggcggagctgcggctgctggtgggtggtcgctacatcggatctcgccgccggcgccgcttgaactaggcctttgttctccttccccctgaggtgccgcaatggctgcgaagggcttctcatccaacccggagaaggagcagatgttttggatggcggagaaggagatggagtacagggttgaactcttcaataaacttacacagacctgcttcgacaagtgcgttgagaaaaggtataaagaaactgagctcaatatgggtgagaacagttgcatcgatcgatgtgtttccaagtactggcaggtgtcaaacatagttggtcagatgcttgggaaccggcctcagatgtgacatgggaagcactagttgcattttgtagtgtaatttgtcgctctgtttctccattttggttggttttagaatgtggccacctgctgctaagtactccaatacagcatcagtgacttgctaattcatggatcgcgcaaaaggaaatcccaaggtcttgcacttttgagggatgtgccttgtctatgaaccatgacagcgaacatgcctgtaataatttgatacagttcgagagaacaattctgttgcgaaagctgcacgtgtttgatagttaaactattgtatcgatgcatttagacggacatagctggtggacgcgacttttgcttgcttgagtcattgcagtctgatgcacatagagcatgctaacatttatgtataatcagtctaaaaaaacatttatgtataatccatattagacatgcatttgaagatatcgtagttcaaactaaaa

SEQ ID NO: 4721 - DNA, 734 bp, Panicum virgatum
tctcctttccaccgggccctccctctctgacggaggaagagccaagggacaaaaccctagagtttggcgagggggggagggcggagctgcggctgctggtgggtggtcgctacatcggatctcgccgccggcgccgcttgaactaggcctttgttctccttccccctgaggtgccgcaatggctgcgaagggcttctcatccaacccggagaaggagcagatgttttggatggcggagaaggagatggagtacagggttgaactcttcaataaacttacacagacctgcttcgacaagtgcgttgagaaaaggtataaagaaactgagctcaatatgggtgagaacagttgcatcgatcgatgtgtttccaagtactggcaggtgtcaaacatagttggtcagatgcttgggaaccggcctcagatgtgacatgggaagcactagttgcattttgtagtgtaatttgtcgctctgtttctccattttggttggttttagaatgtggccacctgctgctaagtactccaatacagcatcagtgacttgctaattcatggatcgcgcaaaaggaaatcccaatgtcttgcacttttgagggatgtgccttgtctatgaaccatgacagcgaacatgcctgtaataatttgatacagctcgagaacaattctgttgcgaaagctgcacgcgtttgatagttaaactattgtatcgatggtcgatgcatttagactga

SEQ ID NO: 4722 - DNA, 713 bp, Musa acuminata
caacaaccttagtcccgctgcgactcgggctctcctccgccgctgcatccatcggcggctttgcgttctacgaccgatctttgataagctccacaatggctgctaaaaatggcgcaagcagcatcgagaaagagcagcagatttttggaatggcagagaaagaaatggagtacagggtggatctcttcaacaggctcacacagacatgtttcgataaatgtatcgagaaaaggtacaaggaatctgagctcaacatgggtgaaaacagttgcattgatcgatgcgtttcaaaatattggcaggtgacaaatatagttgggcaactacttggttcgaacaggcctccaatgtgaagcatctgatatgccttttttcagactgaaaagctatttcaccgtcagcaacatacatcaaatggttatgcaatcacattcggcataacttgagatatatgcaaccttaagataaatttgtttgaggaacaaacacttcttacctttgatgattagtatttttaatggcgttgactttcttggcatcaaataaacttgcaactgttaatcgaaagcctttggattgtaaaatcagtatgattgtgttgaacttgcagctggtaattgccagcttttggaattagtcaatatgattgtgttattagacatgtgttggtcggaaaaattgtactggaattctgcagacgattagtgcgcatt

SEQ ID NO: 4723 - DNA, 775 bp, Elaeis guineensis
ttataaataaataaaccctagaaaaagaccctcccaagttttatagttatcgtctgcccgttgcaagcttcttgcttcgctgcatcttcgtgcggcggtggtgatctctcttcttctccatcgcgactgcgcctcccttgggagccaagaaccacccgtcgcctgcacgaggatataaaatggcagctaccaatgcccccacaaatatcgagaaagagcagatatttggaatggcggagaaagagatggaataccgggtagatctctttaacaggcttactgcaacatgttttgacaaatgtattgaaaaaaggtataaggaatctgagcttaacatgggtgagaacagttgtattgatcgctgtgtttcaaaatattggcaggtgacaaatttgattggacagttgcttggttccaacaggcctccggtgtgatataacagcagtcattaattgatggcagatactcggattgctgttggttgaagtttaacagatactttgtattttcaaatgaattgaagtagccagaaaatatttggttgaaatattttgcctaggcgagtatcctctcgtaatcggatggaatttgagaagaaccatattacaattttgccttcaatacaggtttgtccgtcccatgtattgtcagcacggcccaagagggagcccatagctgatcattgctagaaaatcttgtcatgaaggtcaacatggctccaggttaattcatccaaagacagcttgcatgatatccaatccggagtctgttaaat

SEQ ID NO: 4724 - DNA, 354 bp, Epimedium sagittatum
agttcaaaatcagatcagagaagaagaagcaaggggttccattccatccagtctctcttctcatcttcttgtcataagtctaggtgtaatggctaccgatggcgttcctgccggattagacaaagaacaggtttttggaatggctgagaaagaaatggagtacagggtggatctgttcaacaggctcacgcagacatgttttaataaatgcatcgaaaagaagtacaaagaatccgagttaaatatgggggagaacagctgcattgaccgttgtgtctcaaaatactggcaggtgacgaacctagtcggtggactgctcggtaatagccggcctccaatgtgaagtttatagca

SEQ ID NO: 4725 - DNA, 644 bp, Persea americana
cgtccttccaaaaactcagaagaccttcatttcgatcgatcggtcgggagatatttctcttccgcaatcttccttgtgttataaaaaaggtgctacaatgggttctaacaatgccgcagcgggattggacaaagaacagatctttgggatggcagaaaaggaaatggagtatagagtagaccttttcaacaggttgactcagacgtgtttcgataaatgtattgagaaaaggtataaggaatctgagctgaacatgggtgaaaacagttgcattgatcgttgtgtttccaaatattggcaggtgactaatttgattgggcagctgcttggttctaatcgacctcctatgtgaagtggtttcaaatgcttgtatgattggtaggagatttttgtgttttggtcttttcatggtgcatatcttaatggatgctgaatagataaaaacaggaattagccatgatatggccttttggatccccgtcacatcggtgttatccaagtaggtaagaaatgattttactatcgttctctcacctccgatggactggtcaattgggaagtgatttatttgtttttgtttgcactaatcctgttgtcgaaatggaacctgaaatttttgttcaataaatataatcattctggtt

SEQ ID NO: 4726 - DNA, 2365 bp, Panicum virgatum
accttttccccctcccgcaaaaccctcctcttcttcgatcggttcctcttctagtcttcttcctccgccgcctgcaacgggaccctagcactggtggctgcccattctgcgaccccgccgccggcagccccagcccttcgctcccagaacccttcgcccccacttcccgcttcgctcgtggttccatctgaagcgagacgcagccatggccgcaggtggtgagccgactaactttcagaaggagcagatgtttggaatggcagagaaagagatggagtacagggttgatatgttcaatcggcttacacagacatgttttgacaagtgcattgcgagcaggcacaaagaagttgagctcaatatgggtgagaacagctgcattgatcgatgtgtttccaagtattggcaggtgacttctctagttggacagcttcttggaaatgcccccaagtgagatgtaatttcgttttgtggtggaagtcttcgattttggctccaaggtttgacggattactaagtaaaccaggactagagaagttacatttttcgatctttagccccgaactttcggcacttggacaacgagcaccggtaccaaattctgcatgtaccgtgcgttttgagcttggaaagcaacatggcatctactcttatccgggcaaactcagccttactgagaatgagaagatgagctatgtttccagcattttacataactggtcttcccctgttcctagttgcatacctatttgtgcccttggcgtactgtagatgctgtcgtttttgtatcgtgggcatattatgtgtgccgccatggtgtctagctgtcttgagtttgatgctggattaaacaacgagcaccagaatttgcacgttgttaatttacaaaatggtggttttacccttgattcaaaaccttcctcgagtaccacctcaactgcaaaaatgtatctggttagaattagaacgtgttcaaaaacgtgtgtgcgcgcgtggcagcctgagtctgtgtgtcatccttagccaagccaaacatccagaaacacatgatcagagtgttctcttgccacggcaattccgaaacagcagtcgtctactcgtctcctagctcgatctatcccctttctgttttcgctttgcaaggcaacgacagaggaagcaagctcatcgtggtcatgcctcacgacgccctttcacgcgcctcatcaggctcccgtggcaagataagctcgcacaactcctcgccaacctcgccaagacggcgtgccgctgccagtgcaagccaacctctccctcgcgcagccgcagccgcctgaactcagcaccactgcaccagcacaccaaagatggccggcgacgggcgctctcccaccggccgctgcgtggtgctgttccccttcccgtccgagagccacaccaccccgatgctccagctcgcggggctcctccgcgcgcggggcctcggcgtcaccgtgctccacgccgacctcaacgcgcccgaccccgcgcggcacccgggtctggccttcgtctccatcggcgagtccctccccgacgagatcgcctccagccccgacctggccgagcgggtgatgagcctcaacgccgcctgcgaggcgccgttccaggcggcgctcgaggatctggtgcgccgcggcgagccggtcgcctgcacggtggtcgacggccagtggtacaggatgctgggcgcggccaggcccgccggcgtccccgcgctcgcgctgggggcggacagcgccgccgcgttccttgccatgctcgccgccacgcgcccccgcgccgacggccacgcccccgtccaaggcacgttccagtaaacccgtgatctcgtggcgacgacggctggcacgtacaccttggtgaccgtcgtttggtttccttgttgcagaggccgatcggctggacgaggtggtgccgggcctcgagccgctccgcgtgcgagacctgatcggcgtcgacggcagcgacgacggcgacacggtgctccgcttcaccgcctcggtcgccggcgccgtgcggggcgcctcgttgggcgtcgtgctcaacacgttcgacgccatcgagggcccggagctggcggggatccggcgcgagctgtcccgcccggtgttcgccgtcgggccgctgcacctggcgggcggcccgccggtggagccgcagcagcacgtgctggacggcggctgcctggagtggctagatgcccgcccgccgcgctccgtgctgtacgtgagcctgggcagcgcggcgcgcgtggaccgcgccgcgttcgaggagatggcgtgggggctggccggcagcggcgtgccgttcctgtgggcgctctgccccggctccgtcggcggcg

SEQ ID NO: 4727 - DNA, 675 bp, Panicum virgatum
gggttcctcttctagtcttcttcctccgccgcctgcaacgggaccctagcactggtggctgcccattctgcgaccccgccgccggcagccccagcccttcgctcccagaacccttcgcccccacttcccgcttcgctcgtggttccatctgaagcgagacgcagccatggccgcaggtggtgagccgactaactttcagaaggagcagatgtttggaatggcagagaaagagatggagtacagggttgatatgttcaatcggcttacacagacatgttttgacaagtgcattgcgaacaggcacaaagaagttgagctcaatatgggtgagaacagctgcattgatcgatgtgtttccaagtattggcaggtgacttctctagttggacagcttcttggaaatgcccccaagtgagatgtaatttcgttttgtggtggaagtcttcgattttggctccaaggtttgacggattactaagtaaaccaggactagagaagttacatttttcgatctttagccccgaactttcggcacttggacaacgagcaccggtaccaaattctgcatgtaccgtgcgttttgagcttggaaagcaacatggcatctactcttatccgggcaaactcagccttactgagaatgagaagatgagctatgtttccagcattttacat

SEQ ID NO: 4728 - DNA, 646 bp, Zostera marina
catcattcgtctatctaaataaatacgaaacaacccctaatttcataaaccctaatttctattgcgttgtctcgactggttgtattatccgcatctgtcttctcctctttcttacggtaccgcggcacaatggcttctccaaatgacctagagaaagagcagatcttggggatggcagagaaggaaatggagtacagggtcgatcttttcaacagacttacgaagacgtgttttgaaaagtgtattgagaagaggtataaggaatctgaactgaacatgggtgaaaacagctgtattgatcgctgcgtttcgaagtattggcaggttactaacctagtcggtcagcttcttggagcgaaccgaccaccaatgtgaagctaccgacgggcatcggctattctttcagtcgtcggctaaagttacaggcaagaataatttcgtatcgaactagtgtctatcatgttgtttccaacattaaatcatccaaggagatgttgtttcctccaaattttcagaatgttatttttcttttactctcacccgttttccttcaaaaatcataatatgttttttagataaatcctgcgtttcctgcccttgtttttgtaacaaaaatacactttttatctaagttggcaatccatta

SEQ ID NO: 4729 - DNA, 629 bp, Liriodendron tulipifera
cgttctgcatctcctctcaaacccttcgccattccaacggtctgatattctcacgatggctgcgaacaatgctgcggcggggctggataaagaacagatctttgggatggcagaaaaagaaatggagtatagggttgatctgttcaacagactgactgggacatgtttcaataaatgtattgagaaaaggtataaggaatctgagctgaatatgggtgaaaacagttgcatcgatcgttgcgtttcgaaatattggcaggtgactaatctgatagggcagctgcttggttctaaccgcccgccaatgtgatgcgactctggttccgcttgctcgcagttggtagagatatattgtgttttgttcattacatgcttagccggctacacagaatataaaaaggcagaaacttagtccagatgtggtctggtctcacatcttgccgactttatcaattttgcaaaaatagacccgtttatcctttttctaataacagtgaatcagagcctttaaaagggaatttgtagcatttttgcaatgatggtgtcatcaacatgatacactgttgaatgttggcagtgtctttgcccatttgcgcgtctatcatttataaaatctgtctatcatttcg

SEQ ID NO: 4730 - DNA, 402 bp, Elaeis guineensis
tgactagggagaaacggagcgaggatgtccgaaggttttatacttcctcaaatcctcgcggtcgatctctttcttgcattccgtggggactgcgcccgctctcctggtggaggatataacgatggctgctaaaaatggccaaacgagtattgagaaagagcagatatttggaatggcagagcaagagatggagtacagggtagatctttttaacaggcttaccaagttatgttttgacaaatgtattgataaaagatacaaggaaactgagctcaatatgggtgagaatagctgtattgatcgttgtgtttcaaaatattggcaggtgacaaatttaatagggcagttgcttgcttccaatcgaccaccgatgtgaagttattgctgcatcgtgcagatgat

SEQ ID NO: 4731 - DNA, 677 bp, Zostera marina
catcattcgtctatctaaataaatacgaaacaacccctaatttcataaaccctaatttctattgcgttgtctcgactggttgtattatccgcatctgtcttctcctctttcttacggtaccgcggcacaatggcttctccaaatgacctagagaaagagcagatcttggggatggcagagaaggaaatggagtacagggtcgatcttttcaacagacttacgaagacgtgttttgaaaagtgtattgagaagaggtataaggaatctgaactgaacatgggtgaaaacagctgtattgatcgctgcgtttcgaagtattggcaggttactaacctagtcggtcagcttcttggagcgaaccgaccaccaatgtgaagctaccgacgggcatcggctattctttcagtcgtcggctaaagttacaggcaagaataatttcgtatcgaactagtgtctatcatgttgtttccaacattaaatcatccaaggagatgttgtttcctccaaattttcagaatgttatttttcttttactctcacccgttttccttcaaaaatcataatatgtttttttagataaatcctgcgtttcctgcccttgttttttgtaacaaaaaatacacttttttatctaagttggcaatccattatccatccacatttggctatggttaaaa

SEQ ID NO: 4732 - DNA, 809 bp, Amborella trichopoda
cttctgtcaattatagacagggaagattagggcttttagaaaacgtaattttagtagagagagagagagggaccgagctcatttgcgctctacctatactccacaatacctagcgcttttttccggcaactttccacgacgaataagcccatcaatccgcctctgttcgaaacccaactgaaatcttgcaatgtcgactaatcccactgcattggagaaggaacagatttttggaatggcagagaaggaaatggaatacagggtagatctgttcaaccggcttacccagacttgtttccacaaatgtattgagaagaggtacaaggactctgagctgaatatgggtgagaatagttgcattgaccgatgtgtctcaaagtattggcaggtaaccaatttgataggacagctgcttggttcaaacaagccaccactgtgagcaaaccgttggtagttatgtcttctatgtttctcagtattaaaaaaggcgcccaaagaactgtaaagaaagctgattcagttttttttgttgggcgtacctgaccaatacaaccaggtgaacgtttttgagttttcatgtatcggtttattttccgccctttttgtttattcttaatatgcggcttgcaatagcccagatctttgtgaaagtccaccacacaggaaaaggcgtattactttctaatttttagcaactcttcttctttccgttcattacggatgagaatcaatgtttagatggaatgagaatttaacttgtgattttacctatcaatggctaatatccaaagtaaaaaatatgtcaaatt

SEQ ID NO: 4733 - DNA, 615 bp, Papaver somniferum
ttttgataattttctctgcaagaaagaaaacctcttgagcacatttgtttacttcgtctttgagtaatttctgagtcaaagatttttattctaaagtctcaatggctgccaacagtgctcaagctgcggctcaagctgctttcgagaaagaccagatgtttggaatggctgcaaatgaaatggaatatagggttgatttgtttaacaggcttactcagacttgctttaacaaatgtattgagaagagatacaaggaggctgagctaaatatgggtgagaacagttgcatcgaccgttgtgtttcaaagtattggcaggtgacaaatttagttggccagctccttggttctaatcgacctccaatgtaagctgaaagctaacggtgtcaatatgaaggttatttcttttgtttgtgatccgctgcgtggacagcaaaaattttctgttttcgtaaatcagccatattgctcaagtgaatttttagtagcaaacttgacatgataagtgtgttactcatttagttgataaaaaaattcgttttattatttgcttttattgtaaggagcgatcttacatacatacaaggtcaaaatagatgtagaatagtacttttgt

SEQ ID NO: 4734 - DNA, 679 bp, Papaver somniferum
aaaaagaaacctcttgagcacatttgtttacttcgatcccaagaatactactatttcatcttgtttcaatggctgccaacagtgctcaagctgcggctcaagctgctttcgagaaagaccagatgtttggaatggctgcaaatgaaatggaatatagagttgatttgtttaacaggcttactcagacttgctttaacaaatgcattgagaagagatacaaggaggctgagctaaatatgggtgagaacagttgcatcgaccgttgtgtttcaaagtattggcaggtgacaaatttagttggccagctccttggttctaatcgacctcctatgtaagcggaaagctaacggtatcattttgaaggttaaatttttgttttctcaattcagtgatccgctgtgtagacagcaaaaattctctgttttcatataaatttgaatcagccctagtggttaagtgaatttttagtagcacacttgagatgataagtgtataactgatttagttgataaaaaaagctatttgctgttattggaaggagtgatcttacatactaccaagtaagtcaaaatagatgtagaatagtacttgagaattgttgactttaatctttttacagtcttgtgcattttctttgttagaaatcatatgttgtggattagtcagaatcctcttgcat

SEQ ID NO: 4735 - DNA, 868 bp, Oryza sativa
gctatttcaaaccaggccaaacagggcttccaaaccacgtttgcaggcgggcccacctgcagatcgaccatcctcaagctccgaaatcgcaaaacacctcctcgcctccaaatctccaatcgatcagacaagccacgaaaaccctagccttgtcctgccgcgatcgccgtcgtgtcggcgcgtcggacccccgcccccgtttccccgattcgttcttggtctagtttgctgagtgagctgcagcgatggccgcgaaaggtcagccggtgaatgtgcagaaggagcaggtgaatatgcagaaggagcagatgtttggattggcagagaaagagatggaatatagggtggatcttttcaatcggcttacacaaacatgtttcagcaagtgcattgagaaaaggcataaagaagctgaactaaatatgggtgagaatagctgcattgatcgatgtgcttcgaagtattggcaggtgactaatttagttggacagctccttggaaatcagcctcaaatgtgagcttagagatgcaattgctcttattggtagtagaacatcattgtcttccttttttggcatggtagttcggcaaattattgagcacaatgagaggagaaaattgtcagttcctcccatttgtatctttgacatgagtctgcttgaccaacacataatgtttgagatacattccaacctgtatcagtactttcagcttgcagaaaggcggcatctgttggctgctgtcattttttggttggtgagctataaaacaatacagagatggaagtttgcctgcatcgctcgcttgtttgatacaattgaggactttttttttcctggttgtttccttcttgtttctggataaatgt

SEQ ID NO: 4736 - DNA, 847 bp, Sarracenia psittacina
aagcttctcttaaatacattcaagagttgatgccctagtttcaagcacgcatacatgaaaatgaaccaagaaattgaaaattttaggagagagagattgtgagagggaagaagcgtagacgagctgctgattcgactcctgttctgatttgacttcctctttttcttctgggattgatcgccgaatagtctcgaacaaccatggctgccaacaacaatcccccaaaccaactggacaaagaacagatctttggcatggcagaaaaggagatggagtatagggttgaattgttcaacaagcttacccacacgtgtttcaacaagtgcgtggagaaaaggtacaaggaagccgagctaaacatgggtgaaaatagctgcattgatcgctgtgtttcaaagtactggcaggttacgaacctcattgggcaactgttgggttctaatcggccaccaatgtgattctttgggcataataatctatattagccggtggctgcagagggagagctggagattttaattattgcttcattcctgccatttgtataacttttttgcaagttgatgtcaagttttgttaacatatgaactttagtggctgccgagggagagctggagattttaattatttgcttcattcctgcctttttgcataactttttgcaagttgatgtcaagttttgttaacatatgaaattatgaatcgatggaacggttgccatatgctgctgtggttgtaaaccgaaagaaaattggttcttttgagaagaggttttttttagaacttaagattgtatcttaataaggccatcacgctatcatgggcatttctgtagagctcatgcatt

SEQ ID NO: 4737 - DNA, 642 bp, Helianthus annuus
aagtggaaattcagaagtattacttaccaaaaggagtcctaaaaccctagatatatcgcaaaagttgcaggttactcgcaatcaataatggctgccaacaacaatatgccgaccgcattagacaaagaacagatctttggaatggctgagaaggagatggaataccgggttgagttgtttaacaagctaacccaaacatgttttgcaaaatgtgtcgagaaaaggtacaaagaatccgagttaaacatgggtgaaaacagttgcattgatcgttgtgtttcaaaatattggcaggtcacaaatcttgtaggccaactacttggttctggcagaccacccatgtgaatcttccacctcgttgttcaacaataatacctgatgatttgttatgcgagtatgcctggcctagaaagttagtgaccacattttagtttattttggcaaattatagtttcgttgtaccgcctatatggaacaaattttgggcccctctcaactatttcttggaatgattttgtgcgatatttgttaaaaactgttatgcaacaaagctttttagatgatgcttcttacagattgtgatttgctgataatgtttgcttgaagagtcttgggtaagacgacatattacacttgtagaaa

SEQ ID NO: 4738 - DNA, 1040 bp, Setaria italica
atggcgaggacgtgtgccggtggtgagcggccgagcggcggtcccagccgcgtgtgctggtggccgcgcagagcacgggactcccgtgtccgcggaagccttgatgggtgctgctctgctggagataaggttccggattaccagaagaggctcgaggtgaaccaagaacaaggtacagcgatcgaagctacgctctgtactcgcgttaataagctcatccatccatcaacagccatttctcgcgtccgtcgctgctgcgttgcagaggtcgtagctaggatcaacaatgcctccccctccgccgcctccgacgcccgcgctgaacaagtgctgccgctgctgctcgtcgccgtcgccgccgacaccgccgaagctgcagcgagctgcggagaccaggaagaagccaatctgtacagcaggcggcggagcagcgaggctgccgatcaccaggagagcccacgccgcctccctcctcctcggcctcgtgggcgtggacgtggcggtggctgcgccggcgccggccagggcggacgacgagagcggcggtggcgaggagggcgtcctcggcgccatcaagtctatcttcgacccgaacgagaagaccaaggccgggaaggtgctccccaaggcgtacctgaaggccgccagggaggtggtgcgcacgctccgggagtcactggaggaggatgacggcggcgacatggccaagttccggcggaacgccgacgccgccaaggaatccatccgcgagttcctgggcgggtggagaggccagcaggccgtcgccgccgaggagtcgtacgttgcgttggagaaggcgatcagatcactggcggagttctactccaaagcaggaccttcagcaccgcttccacaggatgtcaagaacaagatcctcgatgacctcagcaccgcggacgcctacctgtagattttgctttccacaacattgttcgtggcttcgtgcacatctcaacgatgaggaagagttgattctaatttctactccggtacttttatcgcaaataaagcttccttca

SEQ ID NO: 4739 - DNA, 1434 bp, Panicum virgatum
ccacgcgtccgctccaaaagaagggtgagagagagagagactgcaccatggcagcggcggcggccaacggcaagagcagcccggtgaagaacggtgcgggcacacgagggaagcccatcaaatgcaaagcggcggtggcgtggggccctggcgagccgctggcgatggaggaggtggaggtggccccgccggggcgcctggaggtgcgcgtcaaggtgctcttcacatccgtctgccacaccgacctcagcgcctggaagggagagaacgagctgcagcgcaagtttcctcgcatcttcggccacgaggcagccggagtggtggagagcgtgggcgaaggagtggaagaccttgttcctggagaccatgtagtccccatcttcactggggaatgcagggaatgcgtctattgcgagtctgacaagacaaacctctgcgggacctaccgtgtgaaccctttcaagagcaccatggtctctgacaatggcacgaggttctccgtggttgaccggtcaggcgtgcgccagcctgtctaccacttccttaacacgtccaccttcaccgagtacaccgtgctcgacgcggcatgcgctgtcaagatcaaccccaaggcacccctggagaggatgtatctcctcagctgcggcatctccacaggggtgggagcagcgtggaacactgcaaacgtttccaaaggatcaacggtcgcagtattcggcctaggtgctgttggtcttgcggctgccgaggggtgccaggctgcggggggtagctcggataatcggtgttgacataaaccctgaaaagtttattaaaggcaaagagatgggggtaactgacttcatcaactccaaggcctgtggcaaacctgttcatgaggtgatcagggagatgactgatggaggtgtcgactacagcttcgagtgcacggggatgaatgatgtgctccgcgaggccttcgtgtccacgcatgatggctggggtctgacggtggtgctagggattcatgcgacgcccaagatgatgccgctgcacccaatggagctcttcgacggccgccggatcaccggctgcgtcttcggcgacttcaagggaaagtcccagctgccggatctcgtcgacaagtgcatcaatggggaggttaatatcaacttcgatggcttcataacgcacaagatgcccttctcggacatcaacaaggctttccagttgttggaggaaggcaagtccctgaggtgtctgctcaatctctgatcagggagatggacttcaggattggtgttgattcgagtgcaataatgataaagtagagaaatgtttttccagtgttcagtttaccatgtatatgtatgtatattatgaaataaatgggtcttctctcaagaacaaaaggacaactattatccagaataaaatggcaccgatattggcatt

SEQ ID NO: 4740 - DNA, 1583 bp, Panicum virgatum
aataacagagaaatggaatatatctgccttggtcagctctcctccgggccgcctccgctacccctttctctcctttactatataaatataatccagcacgccagcctctacctcactagagctaagaactccatctcgtctctccaaaagaagggtgagagagagagactgcaccatggcagcggcggcggccaacggcaagagcagcccggtgaagaacggtgcgggcacacgagggaagcccatcaaatgcaaagcggcggtggcgtggggccctggcgagccgctggcgatggaggaggtggaggtggcgccgccggggcgcctggaggtgcgcgtcaaggtgctcttcacatccgtctgccacaccgacctcagcgcctggaagggagagaacgagctgcagcgcaagtttcctcgcatcttcggccacgaggcagccggagtggtggagagcgtgagcgaaggagtggaagaccttgttcctggagaccatgtagtccccatcttcactggggaatgcagggaatgcgtctattgcgagtctgacaagacaaacctctgcgggacctaccgtgtgaaccctttcaagagcaccatggtctctgacaatggcacgaggttctccgtggttgaccggtcaggcgtgcgccagcctgtctaccacttccttaacacgtccaccttcaccgagtacaccgtgctcgacgcggcctgcgctgtcaagatcaaccccaaggcacccctggagaggatgtatctcctcagctgcggcatctccacaggggtgggagcagcgtggaacactgcaaacgtttccaaaggatcaacggtcgcagtattcggcctaggtgctgttggtcttgcggctgccgagggtgccaggctgcggggggtagctcggataatcggtgttgacataaaccctgaaaagtttattaaaggcaaagagatgggggtaactgacttcatcaactccaaggcctgtggcaaacctgttcatgaggtgatcagggagatgactgatggaggtgtcgactacagcttcgagtgcacggggatgaatgatgtgctccgcgaggccttcgtgtccacgcatgatggctggggtctgacggtggtgctagggattcatgcgacgcccaagatgatgccgctgcacccaatggagctcttcgacggccgccggatcaccggctgcgtcttcggcgacttcaagggaaagtcccagctgccggatctcgtcgacaagtgcatcaatggggaggttaatatcaacttcgatggcttcataacgcacaagatgcccttctcggacatcaacaaggctttccagttgttggaggaaggcaagtccctgaggtgtctgctcaatctctgatcagggagatggacttcaggattggtgttgattcgagtgcaataatgataaagtagagaaatgtttttccagtgttcagtttaccatgtatatgtatgtatattatgaaataaatgggtcttctctcaagaacaaaaggacaactattatccagaataaaatggcaccgatattggcattagtatctctagtagcgaatttg

SEQ ID NO: 4741 - DNA, 2389 bp, Zea mays
tgtgggctgggcctcatgtctccaaccttgtgaatcgatccgatcttctcggttcctcctccaaatccaccggcatctccaagccctagccccaaccccgaccgcccatgtccgccatcgcggcctcctcggccgccgccgccgcggcgtcgaactccgatgaggaagaaaactatgaggagtacatcccagtcgccaagcgccgggccatggaggccgagcgcctccgccagctccgcctctccaagtcggcgccggcctctgccgtctcatcactcccgatgccacctcccccgcctcttttgccagcgcagacctccgttcccgacgccgccgcgaagcccagccttctcgtcaaggccacgcagcttaagcgcgcggccccggaggtgaccgccacggagcagcgcatccagcaggagaaggaagtgattgaaaatctctcagacaacaaatcgctcaggtcagtccgcgagatcgccaagggcatcatctacacggaaccgatccagaccgggtggaagccgcccctccgcctccgccgcatgccgctcgccaaagccaacgagttccggcgcaagtggcacatcatcgtcgacggtgacgatataccgccgcctgcgcgtgatttccgggatctccgcctcccggagcccatgctccggaagctgcgcgagaggggtatcgttcagcccacgccgattcaggtgcaggggctgcccgttgtgctctctgggcgtgacatgataggcatcgctttcacggggtcggggaagactctggtgttcgtgctgccgcttatcatggtggcgctgcaggaggaatcattgatgccgatcgtgcctggcgagggcccgtttgggatgatcatatgcccgtcgcgggaactggccaagcagacatatgatgtgattgagcagtttctcattccacttaaggaggccggttatccggagataaggcatttgctttgtattgggggtgtggatatgaggacacagctcgatgtgttgaagaagggcgtgcacattgtggtggcaacgcctggtcggctcaaggatttgcttgccaagaagaagatgaaccttgacaactgcaggtacttaaccttagatgaagcggataggctggttgacctaggatttgaagatgacatcaaggaggttttcgaccatttcaaggatcaaaggcaaactcttctcttttctgctactatgcctcagaagattcaaaattttgcgaagaacgcccttgtgaaaccagttactgtcaatgtgggaagagctggagcagcaaatctagacgtcattcaagaagtcgaatatgtaaaggaagatgctagaattatatacctccttgaatgcctccaaaagactccacctcctgttctcattttctgtgaaaacaaggctgatgtcgactacatccatgagtaccttcttctaaagggagtggaggctgttgctatccatggaggaaaagatcaagaggagagacagaacgcaattgactccttcaagactggtaggaaggatgttctggtggctactgatgttgcatcgaagggtcttgattttcctgacattcagcatgtcattaactatgacatgcccgccgaaatagagaactatgtccaccgaatcggtcgaactggtcgatgtgggaagactggcatagcaactaccttcatcaacaagaaccaaactgagaccacgcttctcgatctcaagcacctgctgaaggaggcaaagcagaggattccaccggtgttggcggagctcaacgatccattggatgatgaggaaataattgccaaggagagtggtgtcaaaggttgtgcgtattgtggtgggcttggccatcgtgtcagtgactgtccgaagttggagcatcaaaagtccatggcaattgctggctcgagaaaagactactttggcggcgggggttaccgaggagaaatatgattgctctaggttgatgcttgcgtgtggttatcagaagctaagatgctgcaatttcaggtcatacatgtcacatgtatcagccaccagaacatccttcctcccccatcgttgaagggagacggtctgcgttaacgaacttgtgatatgctgctgggtatgacactgcttgctactgacctaccatatatcttgtttgaaggacgcaagttgattatcctgccctgttgtaaaatgtaaccagaacaattgctggcgtatttcttaagcaccagttttagcccctttctgtaagcagtcgacatttcagttcaactcatgtatgtatattttgatcttgtatacagtactatatttccatcttacgtctgcttcggcatataagagcaactccagtagttggctaaagaattctctaaacaagaaat

SEQ ID NO: 4742 - DNA, 2313 bp, Setaria italica
cacgacccgatctgttcgatctccttcccttccccccaaatccaccgtcacctccaagccctaaccccaacctcgccgcccatggccgccaccgcggccgcctcagccgccgccgccgccgcggcggcgaactccgacgacgacaacaactacgaggagtacatcccggtggccaagcgccgggccttggaggccgagcgcctccgccagctccgcctctcgaagccggcgccgtcctccgccgcctcctccctcgcgatgccgcccccccctcctccgcccccgacgcagccctccgcccccgacgccgccgccaagcccagcctcctcgtcaagtccacgcagctcaagcgcgcggccccggaggtgaccgccacggagcagcgcatccagcaggagaaggaggtgatcgagaacctctcctccgacagcaagtccctcaggtccgtacgcgagatcgccaagggcatcatctacacggagccgatccagaccgggtggaagccgcccctccgcctccgccgcatgccgctcgccaaggccaacgagctccgccgcaagtggcacatcatcgtcgacggcaacgacgtcccgccgcccgcgcgggacttccgcgacctacgcctccccgagcccattctccggaagctgcgcgagaggggcatcgtccagcccacgcccatccaggtgcaggggctgcccgttgtgctctccggccgtgacatgatcggcatcgcgttcacggggtcggggaagacgctggtgttcgtgctaccgcttatcatggtggcgctgcaggaggagatattgatgccgattgtgcctggggagggtccgtttgggatgatcatctgcccgtcgcgggagcttgctaagcagacttatgatgtgattgaggagttcctccttccactcaaggacgccgggtaccccgagataaggccgttgctttgcattgggggtgtggatatgaggacgcagctggatgtgttgaagaagggcgttcacattgtggtggcaacacctggccggctcaaggatcttcttgccaagaagaagatgaatctcgataactgcaggtacttaaccttagatgaagcggataggctggttgacttgggatttgaggaggacatcaaggaggtttttgaccatttcaaggatcaaaggcagacccttcttttttctgctactatgcctcagaagattcaaaattttgcgaagaatgcccttgtgcaaccagttactgtcaatgtggggagagctggagcagcaaatcttgatgtaattcaagaagttgagtatgtcaaggaagatgctagaattatatacctccttgaatgcctccaaaagactccaccccctgttcttatcttttgtgaaaacaaggttgatgtcgactacatccacgagtaccttcttcttaagggtgtggaggctgttgcgatccatggaggaaaagatcaagaggaaagacagaatgcaattgactctttcaagtctgggaagaaggatgttctggtggctaccgatgttgcatcaaagggtcttgatttccctgatatccagcatgtcatcaactacgacatgcctgccgaaattgagaactatgtccacagaatcggtcgaacaggtcgttgtggtaagactggcatagcaactaccttcatcaacaagaaccaaaccgagaccacacttctcgatctcaagcacctgctgaaggaggcaaagcagaggattccaccggtgttggcggaactcgatgacccattggaggacgaggaaataatcgccaaggagagtggtgttaagggatgtgcgtattgtggtgggcttggccatcgtgttggtgactgtccgaagctggagcaccagaagtccatggcaattgcaggctcgaggaaagactactttggcggtgggggctaccgaggagaaatatgattgctctaggttgatgcttgtctgtggttatgaggagcttagacgctgcaacttcagctcaacaatgttatgtgtatgaggtagcagaggctcctccctcatcattgagggaagacagtttgcacgatcaaacctatacgatatgctgggtatcatgctgcttgctagatgggatagcttgttagaggaaggtaagtagattttaccctcttgtaaaatgtaaccaaaagtgaatgccgtggtgtatatttcttgaagtaattttgttaagcaccagtttagaccctttctgtaagcgaatacatttcagataggtgataccacggtaagttccatgtcgtgtgtgatgtgttaattaatatttggtcc

SEQ ID NO: 4743 - DNA, 2192 bp, Pennisetum glaucum
agcgcctccgccgtctccgcctctcgaagccggcgccgtcctccgccgcctcctccctcgcgatgccgcctccccctcctccgcccccgatgcagccctccgcccccgacgccgccgccaagcccagcctcctcgtcacggccacgcagctcaagcgcgcggccccggaggtgacagccacggagcagcgcatccagcaggagaaggaggtcatcgagaatctctcctccgacagcaagtccctcaggtccgtccgcgagatcgccaagggcatcatctacacggagccgatcaagaccgggtggaagccgcccctccgcctccgccgcatgccgctcgccaaggccaacgagctccgccgcaagtggcacatcatcgtggacggcgacgacgtcccgccgcccgcccgggacttccgcgacctacgcctcccggagcccatgcttcagaagctgcgggagaggggcatcgtccagcccacgcccatccaggtgcaggggctgcccgttgtgctctctggccgtgatatgatcggcatcgcgttcacggggtcagggaagacgctggtgttcgttctgccgcttatcatggtggcgctgcaggaggagatattgatgccaattgtgcctggggagggcccgtttgggatgatcatttgcccatcacgagagctcgctaagcagacttatgatgtgattgagcagttcctccttccactcaaggatgctgggtaccctgagataagaccattgctttgcattgggggtgtggatatgaggacacagctggatgtgttgaaaaagggcattcacattgttgtggcaacgcctggccggctcaaggatcttcttgccaagaagaagatgaatcttgataactgcaggtacttaaccttagatgaagcagataggctggttgatttgggatttgaagacgacatcaaggaggtttttgaccatttcaaggatcaaaggcagacccttcttttttctgctactatgcctcagaagattcaaaattttgcaaagaatgcccttgtgaaaccagttactgttaatgtggggagagctggagcagcaaatctagatgtcattcaagaggtcgagtatgtcaaggaagatgctagaattatatacctccttgaatgcctccaaaagactccaccccctgttctcatcttttgtgaaaacaaggtcgatgtcgactatatccatgagtaccttcttcttaagggtgtggaggctgttgcgatccatggaggaaaagatcaagaggaaagacagaatgcaattgactctttcaagtccgggaagaaggatgttctggtggctactgatgttgcatcaaagggtcttgatttccctgacatccagcatgtcatcaactacgacatgcctgctgaaatcgagaactatgtccacaggatcggtcgaacaggtcgatgtggtaagactggcattgctactaccttcatcaacaagaaccaaaccgagaccacacttctcgatctcaagcacctgctgaaggaggcaaagcagaggattccaccggtgttggcggagctcgatgacccattggaggatgaggaaataatcgccaaggagagtggtgttaagggatgtgcatattgtggtgggcttggccatcgtgttgctgactgtccgaagctggagcaccagaagtccatggcaattgcaggctcgaggaaagattactttggtggcgggggataccgaggagaaatatgattgctccaggttgatgcctgtgtgtggttatgaggagctaagatgcagctcaacaaatgttatgttgggtatcatactgtttgcacaatcaaacttgcgatatgctgggtatcatactgcttgctggatgagatagcttgttagaagaaggcaagtagattttaccctcttgtaaaatgtaaccggaagtgattgttgtggcgtacatttcttaaagtaataacttcgttaagcaccagttttagacccctttctgtaagcaaatgcatttcagataggtgatagcagggaaagttctgtgtctaatgtgtacgcgtgcaggaagagtaacatctggacaaaaatatattatagtacatagtgcaatatgttgcatccacattctctgtaatcctgtatttcgttgtgtacttgtgcttaaattaaaactagtgagttaggacc

SEQ ID NO: 4744 - DNA, 3135 bp, Oryza sativa
gtatattcagcctgggttgagattgaggcacatgtagttatgggccaggatccagctcttacggcccaatctccatcacgatctcatgtcggtaaatcgatacgcgtctcagctctcaatctcgacagaagaaaaaaacgaaaaagaaaaagaaaaaaaaaaacccgatcggatcaagtcgattcttcctcctcgcgaattccccatctccgcctccctctccaaaccctaatccccccgccatggccgccgccacggcctcctcgccggcgaccgccgccgccgccaactccgatgacgaagacaactacgaggagtacatccccgtcgccaagcgccgggccatggaggccgaccgcctccgccgcctccgcctctccaagcccgcgcccccatcctcctccgccgcggaggccgcctcggatctcccgcctccccctcccccaccgccgaaccagccctcagccggcggtggcggtggcggcctcgaagcctccgcgaagcccagcctcctcgtcaaggcgacgcagctcaagcgggccgcgccggaggtgacccacacggagcagctcatcatgcaggagaaggagatgatcgagcacctctccgaccgcaagacgctcatgtcggtgcgcgagctcgccaaggggatcacctactccgacccgctcaagacggggtggaagccgccgctccgcctccgccgcatgccgcgcgccaaggccgacgagctccgccgcaagtggcacatcctcgtggacggggacgacgtgccgccgcccgctcgggacttccgcgacctccgcctgcccgagcccatgctgcgcaagctccgcgagaagggcatcgtccagcccactcccatccaggtgcagggattgcccgtggtgctctccgggcgcgacatgattggcattgccttcacagggtccgggaagacgttggtgtttgtgctgccgctcatcatggtggcattacaggaggagatgatgatgccaatcgtgccgggtgaagggccatttgggatgatcatctgtccatcgcgagagctggccaagcaaacgtacgatgtcattgagcagttccttgttccacttaaggaggctgggtacccggagatacgcccgttgctttgcattgggggtgtcgatatgagggcgcagctggatgtggtcaagaagggagtacatattgtggtggctacacctggccgactcaaggatttacttgccaagaaaaagatgaacctcgacaattgcaggtacttgaccttggatgaagctgataggcttgtcgatcttgggtttgaggatgatatccgtgaggtttttgaccatttcaaggcacaaaggcagacacttctattttctgccactatgccgaagaagattcaaaactttgcgaagagtgcccttgtgaaacctgttattgtgaatgttggtagagctggtgcggcaaatctggatgtcatccaagaagttgagtatgtcaaggaggatgccagaattatatatctcctggaatgcctccagaagactccacctccagttcttgtcttttgtgaaaacaaagctgatgtcgactatatccatgagtatcttcttctgaagggtgtagaggctgttgcaatccatggaggaaaggatcaagaggaaagagagaatgcaatcgagttcttcaagaatggaaagaaggatgttttggtggctactgatgttgcctcgaaaggtcttgatttccctgatatccagcatgtgattaactatgatatgcctgctgaaatagaaaactatgttcaccggattggtcgaactggtcgatgtgggaaaactggaatagcaacaaccttcataaacaagaatcaaacggagactacccttcttgaccttaagcacttgcttaaggaagctaagcaaagaataccgccagtgttggctgagctcaatgacccattggaagatgaggaaaccatggccaaggagagcggtgttaagggatgtgcatactgtggtggtcttggccatcgtgttaccgactgtccaaagctggagcaccagaagtccatggcgatcgcgggctctagaagagattactatggcggtggaggctacagaggagaaatatgattgttctaggagaaattcgtatgttgctattgttttatggcacctaagatacaacattataagcacaagctgaagctcctccgtagccatcttgaagaaagatctcctgatactacctcattgcatggttgttagtgctgctgcttcgtatgcaatatattgttgttagatagcattaaccaccacacggagaggggcttgacatctctcaagggtgttgacatgttatgttgtaaaatgtaacctggaggcaatattgaacgagtagcatctctatcaaaattttgagagggggagtattttaagcagtaaccaatgtgtttccgttgtataatcttaccatgccttctgaaatctgaaccgttattgctatgaaattacagttgatgctgctacaacaacagtgaggcagttggtagaggtgagatactctggtgttagtgtgttactgtattgcatgtccggtgtccggcctgcattgctgttgggagaactgaatgaagcactctcactcttaactgtcacagtgtcactgctcatcgaacagctcctgctcctgcatgcgtctatggcagcacgcaatactctcatgctgatgctgctctggcattgccagtacaactacaaataatactcgtgtgctatttatactgctacagagacagtatatagcagtccctggctacaggtttcattcatgtagcaacactgcagagtactggaggatcatcgaaccgttctatcagaacatcaagatgaacagtgccattactacaatgtctcaggaagaaaaaaaagagaggagaagaactgaagcagtagcagcaagccagccactagtacctggagacaatttaccaggctttgcgtctccggcacactgatccgtcagcctctctattaatcgcgccgggacaatggctatgcaacgaaccaaccaagttacacacaggagcaccttaaagagagatagagagagagaagcagcagcaatttcactaacttccac

SEQ ID NO: 4745 - DNA, 2130 bp, Oryza sativa
acccgatcggatcaagtcgattcttcctcctcgcgaattccccatctccgcctccctctccaaaccctaatccccccgccatggccgccgccacggcctcctcgccggcgaccgccgccgccgccaactccgatgacgaagacaactacgaggagtacatccccgtcgccaagcgccgggccatggaggccgaccgcctccgccgcctccgcctctccaagcccgcgcccccatcctcctccgccgcggaggccgcctcggatctcccgcctccccctcccccaccgccgaaccagccctcagccggcggtggcggtggcggcctcgaagcctccgcgaagcccagcctcctcgtcaaggcgacgcagctcaagcgggccgcgccggaggtgacccacacggagcagctcatcatgcaggagaaggagatgatcgagcacctctccgaccgcaagacgctcatgtcggtgcgcgagctcgccaaggggatcacctactccgacccgctcaagacggggtggaagccgccgctccgcctccgccgcatgccgcgcgccaaggccgacgagctccgccgcaagtggcacatcctcgtggacggggacgacgtgccgccgcccgctcgggacttccgcgacctccgcctgcccgagcccatgctgcgcaagctccgcgagaagggcatcgtccagcccactcccatccaggtgcagggattgcccgtggtgctctccgggcgcgacatgattggcattgccttcacagggtccgggaagacgttggtgtttgtgctgccgctcatcatggtggcattacaggaggagatgatgatgccaatcgtgccgggtgaagggccatttgggatgatcatctgtccatcgcgagagctggccaagcaaacgtacgatgtcattgagcagttccttgttccacttaaggaggctgggtacccggagatacgcccgttgctttgcattgggggtgtcgatatgagggcgcagctggatgtggtcaagaagggagtacatattgtggtggctacacctggccgactcaaggatttacttgccaagaaaaagatgaacctcgacaattgcaggtgagttaggtacttgaccttggatgaagctgataggcttgtcgatcttgggtttgaggatgatatccgtgaggtttttgaccatttcaaggcacaaaggcagacacttctattttctgccactatgccgaagaagattcaaaactttgcgaagagtgcccttgtgaaacctgttattgtgaatgttggtagagctggtgcggcaaatctggatgtcatccaagaagttgagtatgtcaaggaggatgccagaattatatatctcctggaatgcctccagaagactccacctccagttcttgtcttttgtgaaaacaaagctgatgtcgactatatccatgagtatcttcttctgaagggtgtagaggctgttgcaatccatggaggaaaggatcaagaggaaagagagaatgcaatcgagttcttcaagaatggaaagaaggatgttttggtggctactgatgttgcctcgaaaggtcttgatttccctgatatccagcatgtgattaactatgatatgcctgctgaaatagaaaactatgttcaccggattggtcgaactggtcgatgtgggaaaactggaatagcaacaaccttcataaacaagaatcaaacggagactacccttcttgaccttaagcacttgcttaaggaagctaagcaaagaataccgccagtgttggctgagctcaatgacccattggaagatgaggaaaccatggccaaggagagcggtgttaagggatgtgcatactgtggtggtcttggccatcgtgttaccgactgtccaaagctggagcaccagaagtccatggcgatcgcgggctctagaagagattactatggcggtggaggctacagaggagaaatatgattgttctaggagaaattcgtatgttgctattgttttatggcacctaagatacaacattataagcacaagctgaagctcctccgtagccatcttgaagaaagatctcctgatactacctcattgcatggttgttagtgctgctgcttcgtatgcaata

SEQ ID NO: 4746 - DNA, 2207 bp, Secale cereale
ctcccgtgcccgacgaaatccccacctttgcctctccttcctccttcctccgaaccctaaccccagccatgccccccggcgcggccgccgcggccaccaaatccgatgacgaggacaactacgaggagtatatccccgtctccaagcgcagggccatggaggctgatcgcctccgccaccagcgcctctccaagcccgccgccgccgcctccgcgggctccctcccaccgcctccgcccccaccgacggccaaccccgccgccgcccccgatgacgccgcccccgccgccaagcccagcctcctcgtcacgtccacgcagctcaagcgcgcggccccggaggtcaccgccaccgagcagatcatcctgcaggagaaggagatgatcgacaacctctccaacaaaaacacgctcatgtccgtgcgggagctcgccaaaggcatcacctacaccgagccgctccgcaccggctggaagccgccgctgcgcctccgccgcatgccgcgaaccaaggccgacgagctccgccgcaagtggcacatcctcgtcgaaggcgacgagatcccgccgcccgcccgcgacttccgtgacctccgcttccccgagcccgtcctccggatgctccgcgagaagggcatcgtgcagcccacgcccatccaggtgcaggggcttcccgtggtgctctccgggcgggacatgatcggcatcgccttcaccgggtccgggaagactctggtgttcgtgctgcccctcatcatggtggcgcttcaagaggagatgttgatgcctattgtgcctggggagggcccgtttggcatgatcatttgcccatcacgggagctggccaagcagacatatgatgtcatcgagatgttcctcactccactcaagcaggctgggttcccagaaatacgtcccttgctttgcattgggggtatagacatgaggacacaactcgatgtggtgaagaagggcgtacatattgtggtggccacacctggacggctcaaggatcttctcgccaagaagaagatgaaccttgacaattgcaggtatttaactttagatgaagctgataggcttgttgatcttggatttgaggatgacattcgggaggtttttgaccatttcaaggcacaaaggcaaacccttcttttttctgccactatgcccaagaagattcagaactttgcaaagagtgccctcgtgaagccagttatcgtcaacgtcggaagagccggggcagcaaatcttgatgtcatccaagaagttgagtatgtcaaggaagatgccagaattatatacctccttgaatgccttcaaaagactccacctcctgttcttatattttgtgaaaacaaagctgatgttgactacatccatgagtatcttcttctaaagggtgtggaggctgttgcaattcatggaggcaaagatcaggaggagagacaaaatgcgattgagttcttcaagaatggaaagaaggatgttttggtggctactgatgttgcctcaaagggtcttgatttccctgatatccagcacgtgattaactatgacatgcctgccgaaatagagaactatgtccacaggattggtcgaactggtcgatgcgggaaaacgggaatagcaactacgttcatcaacaagaaccagacagagactacgctccttgatctcaagcacctgctcaaggaagcgaagcaaagaataccgccggtgcttgctgagcttgttgacccgctggaggatgctgaagctattgccaaggagagtggcgtcaaaggatgtgcattctgtggtggccttgggcatcgtcttgctgactgtccaaagctggagcaccagaagtctgtggcgatcgccggctccagaagagattactacggcggtggaggataccgtggagaaatatgattacatcatcatattattaagagtgtatgctttatcaagaggtaatatgctgcagcttcagctcatccatgcttgagatatcttaagagtgaagtatcatgcaatatgaagttccctccttagtcatcgtatcctagaagatttgtcatcacattatgtttcaagtgatgatgacttgatgtaatatatttctctgcatacgaatctgtactgttgtaatacaatgtatattgaatggcagatttttccgtgggaagggtaaaaattaaaaaaaaaaaaaaaaaaaaaaaa

SEQ ID NO: 4747 - DNA, 2586 bp, Brachypodium distachyon
aattgaatcgagttctcctccaatcctcttcgtctctacccagaaattccccacctccttctccctcctacaaaccctaaccccaaccatggctcccgccgccgtgacgcccgccgccaagtccgacgatgaggacaactacgaggagtacatcccggtcgccaagcgcagggccatggaggccgatcgcctccgcaaccggcgcatctccaagcccgccgccgcctccgacggctcccctgcctccctcccgccaccgccgccgcctccgcccacgaacagcccagcccccgacgccgccgccgccaagcccagcctcctcgtcacgtccacgcagctcaagcgcgccgccccggaggtcaccgccacggagcaggtgatcctgcaggagaaggagatgatcgagaacctctccgaccgcaagacgctcatgtccgtgcgggagctcgccaagggcatcacctacaccgagccgctgctcaccggctggaagccgcccctgcggctccgccgcatgccccgcaccaaggccgacgagctccgccgcaagtggcacatcctcgtcgaaggcgacgaggtacccccgcccgcacgccagtttcaggacctccggttccccgagcccatcctccgcatgctccgcgagaagggcatcgtgcagcccacgcccatccaggtgcaggggctacctgtggtgctctctggccgtgacatgattggcattgccttcaccgggtccgggaagacgctggtgtttgtgctgccgctcattatggtggcgctgcaggaggagatgatgatgcccattgtggccggggagggtccgttcgggatgatcatctgcccgtcaagggagctggccaagcagacgtacgatgttattgagatgttcctcgctccgctcaagcaggctgggttcccggaaataagaccgttgctttgcattgggggtattgacatgaggacacagctcgatgtggtgaagagaggcgtacatattgtggtggccacacctggccggctcaaggatttgctcgccaagaagaagatgaaccttgacaattgcaggtacttaaccttagatgaagctgacaggcttgttgatctgggatttgaagatgacattcgtgaggtttttgatcatttcaaggcacaaaggcaaacacttcttttttctgccactatgcccaagaagattcagaactttgcaaagagcgcccttgtgaagccagtgattgtcaatgttggaagagctggagcagcaaatctagatgtcatccaagaagttgaatatgtcaaggaagatgccagaattatatacctccttgaatgccttcagaagactccacctcctgttcttatattttgtgaaaacaaagctgatgttgactacatccatgagtatcttcttctgaagggggtggaagctgttgcaatccatggaggtaaagatcaagaggaaaggcagaatgcaatcgagttcttcaagaatggaaggaaggatgttctggtggccaccgatgttgcctcaaagggtcttgatttccctgatatccagcatgtgattaactatgatatgccagctgaaatagagaactatgtccacaggattggtcgaactggtcgatgtgggaaaacaggcatagcaactacattcatcaacaagaaccagacagagactacacttcttgaccttaagcacttgctgaaggaagcgaagcaaagaataccaccagtgcttgctgagctcattgaccctgaggacgcagaaactatcgccaaggagagtggtgtcaggggatgtgcaaactgtggtggccttgggcatcgtcttgccgagtgtccaaagctggagcacgagaagtccgtggcaattgcgggctccagaagagattactacggtggtggaggttaccgaggagaaatatgattgccttatatttctctttgttgtgttatcaggagttaaaaatgctgcagcctcagttcaaccttactcgagatatatcatccaatctgaagtccatgcttctcgttctcaaagaagtgtcagcagccttattgtgctagctcttcatttgccaagtgctgatggcttgttgtaatatatattgcttctcttgttatgctctcttgtaaaacgtaactaactagaaggcgatattagttgaggggggtgtttatctctgagtagcagtgccactcctgggtatcatacaatcagccccatctgtcagttagagctgtgaaactgtaataggtactggcatgtaaaccgttgcgatatttagccacgaataagaatatagtacattcatgcatcgacctatcgatgagctgatgttctttaattcttttgggctggtttactgcatatgaagtagtactgcgttgcactgttgctgctgctgctgcatgctggagaagcacatccccgtgggggcttgtctgcatttctggattggaaccggcagtcatgtaccacggaggtacatgcttgtgccagtccctggttgcattgttcatttgtgcaacttctacaatgttaagaaggctatactatacttgcatgttttagaatggggg

SEQ ID NO: 4748 - DNA, 2310 bp, Triticum aestivum
ggcacgaggtcgaatcgatatactctccactctcatctccctcccgtgcccgacgaaatccccaccttagcctctccttcctccgaaccctaaccccagccatgccccccggcgcggcggccgccgccaaatccgatgacgaggacgactacgaggagtacatccccgtctccaagcgcagggccatggaggccgaccgcctccgccaccagcgcctctccaagcccgccgccgccgcctccgcgggctccctcccaccgcctccgcccccgccggcggccaaccccgccgccgcccccgatgacgccgcccccgccgccaagcctagcctcctcgtcacgtccacgcagctcaagcgcgcggccccggaggtcaccgccaccgagcagatcatcctgcaggagaaggagatgatcgacaacctctccaacaagaacacgctcatgtccgtgcgggagctcgccaagggcatcacctacaccgagccgctccgcaccggctggaagccgccgctgcggctccgccgcatgccgcgcaccaaggccgacgagctccgccgcaagtggcacatcctggtcgaaggagacgagatcccgccgcccgcccgcgacttccgtgacctccgcttccccgagcccgtccttcggatgctccgcgagaagggcatcgtgcagcccacgcccatccaggtgcaggggcttcccgtggtgctctccgggcgggacatgatcggcatcgccttcaccgggtccgggaagactctggtgttcgtgctgcccctcatcatggtggcgctgcaagaggaaatgttgatgcctattgtgcctggggagggcccgtttggcatgatcatttgcccatcacgggagctggccaagcagacatatgatgtcatcgatatgttcctcactccactcaagcaggctggattcccagaaatacggccattgctttgcattgggggtatagacatgaggacacaactcgatgtggtgaagaagggcgtacatattgtggtcgccacacctggacggctcaaggatcttctcgccaagaagaagatgaaccttgacaactgcaggtatttaactttagatgaagctgataggcttgttgatcttggatttgaggatgacattcgggaggtttttgaccatttcaaggcacaaaggcaaacccttcttttttctgccactatgcccaagaagattcagaactttgcaaagagcgcccttgtaaagccagttatcgtcaatgttggaagagctggagcagcaaatcttgatgtcatccaagaagttgagtatgtcaaggaagatgccagaattatatacctccttgaatgccttcaaaagactccacctcctgttcttatattttgtgaaaacaaagctgatgttgactacatccatgagtatcttcttctaaagggtgtggaagctgttgcaatccacggaggcaaagatcaggaggagagacagaatgcgattgagttcttcaagaatggaaagaaggatgttttggtggctactgatgttgcctcaaagggtcttgatttccctgatatccagcacgtgattaactatgacatgcctgccgaaatagagaactatgtccacaggattggtcgaaccggtcgatgcgggaaaacgggaatagcaactacgttcatcaacaagaaccagacagagactacgcttcttgacctcaagcacctgctcaaggaagcgaagcaaagaataccaccagtgcttgctgagctcgttgacccgctggaggatgctgaagctattgccaaggagagtggtgtcaaaggatgtgcattctgtggtggccttgggcatcgtcttgctgactgtccaaagctggagcaccagaagtccgtggcgatcgccggctccagaagagattactacggcggtggaggttaccgtggagaaatatgattacatcatcatattattaagagtgtatgctttatcaagaggtaaaatgctgcagcttcagctcatccatgcttgagatatacctcatgcaatctgaagttccctccttagtcatcgtatcctagaagatttgtcatcacattatgtttcaagtgatgatgacttgatgtaatatatttctctgcatacgaagctgtactgttgtaatatgtatattgagtggcagatttttcggtgaggagggtattatttcttgagcaccagtatcatatgtctaaatagtgatctaaacgcttttatatttctttacagaggagtaacagagagtgagggctgtgaagctgtaatagttatattggccgtc

SEQ ID NO: 4749 - DNA, 3462 bp, Setaria italica
tgccaacccggcaacccctctcccctgccatctcatcccccacactgcctttgcaggtcgccgctcgcggcgagcgttccacacaatttccatttcctccggtctcgatcggcagcgaggttcttccaagcaagatcgcgactgtccatgctgcggccctaggggtggtggtgatcgaggaggacatcgcggcagccatggcggcgtcggcgtcggcagcggcgggcaagctggcggccgcgctccaccggaggacgcaccgggtcacgtccgcgctggcgcacgcggccctggagtgggtcctcatcgcgctgctcctgatcaacgggctgctcgcctacgccatcgacaggttcgcggactacttcgggctcgcgccgccgtgcctcctctgctcccgcgtcgaccgcctcttccaggcggacggcggcgaggccggcggcgcgcggtggctgcgggacgccctctgcggcgaccacgccgcggagatctccgcgctcgggtactgcctccgccaccgccggctcgccgagggcagggagatgtgcgaggactgcctgtcctcgacgaaggagaagacaagagatgcagcggagaaaagcgccagggcgtgtgcttgctgcaaagccgttgtacggacttcttcgcgcgagctggagggtacaagggaagaacacgtcgaggagaagataactgaggaagtgacagacgacgaccaaggctatgttctgctggctcaagaagatcatgaagaggaagaggaggagcaggacgaggtcgagaagcaagagcggcagagcgaggtggaaggacaacatcaacaagaaaaagacgaggcgatggctgctgttcaggatgaatccttggaagtcatggctcagggtcagggcgaagagatcgcgctggaggacgaccgattggtacccgttgtggcgcttgatgagatgacgatcgccgatgattcgggtctgcatcgcgatgttgaagaggcggatggaatgaatcaggtagcagaagatgagcaggattcgagggatgtggatatcggagtggttctggaggagaagaggatgttggattcctcggttgcaacgccggccgatgtgatcgaggactctgtcgtgcccatcagccccatcccttgtccagagaccgtagcaagcccatctcatcctgatcataactccaactcccaagatgatgaagatgttcctgaagatgctgttgaagttggagattccacagctgaagaagatcacatctttgtgcctcacgagaccgtttctgaagatgacagaacggcagaggtggacacgaactgcgaagtatcaatcggaagcgatatatgcgaacgggaacaagatgaccatgtcgttccattccaagacttggcaacgcatgaggagcaggttgctccactggctggtgcagatgatcagccatcgccattggagatcctagcctcaactgagcaagaagcaggtgaagccgaacaggaggagatgacaacgaacacgggatcagattaccaaccaaacgaacagaacgaggtggaagaagacaaagcacctgagacaccgacgaatggcgtcgccgcacagctctcggacaggatgtttctgctcgagaggaaacggtcactgtcgctctccctggacgggagcgtcgcaagcgagatggaaggcggcgagccctccaccgtggaccagctgaagtcggcgctgcaggcggagcggaaggcgctgggcgcgctgtacgcggagctggaggaagagcggagcgccgcggcgatcgcggcgagccagacgatggcgatgatcaacaggctgcaggaggagaaggcggcgatgcagatggaggcgctgcagtaccagcggatgatggaggagcagtcggagtacgatcaggaggcgctgcagcttctgaacgagctggtcaccaagcgggagcgggagaagcaggagctggagagggagctcgagctgttcaggcagaaggtgcagcgctacgaggacaaggagaggcggaggatggcgagcttcaaggccaatggcggcagccccagtggcagtggcagtggcacctccgtgtcgtccagcggcgaggacagcgacgggcactccgacgactactgcgagctaggcgagtctccggacggcggcaacattcagatgagctcgtcagatgctgctcttagctccatgagggatccggacagcacgaagcacctagtggctctggatgattccttgacgtacttcgagatggagaggctctccatcttggaggagctcaagacactggaggagaggctcttcacattggaagacgacgatgtcaccgccaatgccgctgctggccattcctccggtgatatggacttgtcggccgatgtgcttcattcacctgaggacatcctcaccggtgacaaggcaagatgcagaggcaggacttctatcagtagagggaagagtcttctgcctctattcgatgcagtcggcaatgagacttgtgatcaaatgccatctgcaagagtaggagaggcagatcaagctgatgattcggcgacaaagccggcatccgtgcttgccaaggagcaggagaggctggcaatcatagaggaggttgatcatgtgtatgagcgattgcaagcgctggaggcggacaaggaattcctgaggcactgcatcaaatccctcaagaaaggagacaagggcatggacctacttcaggagatcttgcagcatcttcgggatctccgtaatgtggaacttcatgttaagaatgctggtgatgccatagctgcaaattcagtgtagcaagttcatctatacgtgtgattagactagattagtatgtattcagttgattggatcggaaggatccaaagcactgcattggtgatggtccctctgcaaggtgatggctgattttaagggaggctctgctcattttgcctgtgggctggaagcaagccgaccctttttgtgctggtccagcactaccaactttttctgttgtggtggtcggtggtaggaatcattaggccttccaaagctgcacaaagctgaatcatggtgccagcttctggacatgttgaaaacaaaagaaaaatgttatctagagtgagtggagacgtggagatttttttttgggttattgttgctttttcagatgtaatcttttgtttaactttcagatttgtttttgtggtgaggtaggcagtgttcatgtatttgctgtatccttttttttggtgaggttgtagcttgtatggttggtacgtgcagcttgttcttttgtttatagccagtagaaaagaaagcttgtttatgacgaaatcttattgtagcatgattgtctagttcttggtgtttctgcttcaaaatttgttaaatcataagctcccatccttgtaaggaagctgttgatatattaatattatatgtcttatgataacca

SEQ ID NO: 4750 - DNA, 2790 bp, Panicum virgatum
tgccaacccggcaacacccttcccccgctgcccttgcaggtcgccgctcgcggcaagcgttccacgcactttcctccggtcccgtccggcggcgagattctcccaggcgagatcgcggctgtccatgccgcaggcgtaggggtggtggtcgaggaggacaccgcggcagccatggcggcgtcggcgtcggcgggcaggttggcgaccgcgctccaccggaggacgcaccgggtcacgtccgcgctggcgcacgcggccctggagtgggtcctcatcgcgctgctcctgatcaacggcctgctcgcctacgccatcgccaggttcgcggactacttcgggctagcgccgccgtgcctcctctgctcccgcgtcgaccggctcttccaggcgggcggcggcgagtccggcggcgcgcggtggctgcgggacgccctctgcggcgaccacgccgcggagatctccgcgctcgggtactgcctccggcaccggcggctcgccgaggccggagagatgtgcgagggctgcctgtcctcgtgcaaggaggagacaagcgacgcacgggagaaaagcgccacggcgtgttcttgctgcaaagttgctgtacggacatcttcgcgcgagcccgagggtataaaggaagaacatgccgaggagaaggtaactgaagaaggaaatgatgacgaccaaggctacgttctgctggctcaagaagatcatgaagaggaggagcaggacgaggtcgaaaaccaggagcaacagagcgaggtggaaggacaacgacgagaagaagacgaggtgatggctgccgttcaggacgaatccttggaagtcatggttcagggcgaagagatcgcgctcgaggacggccgattggtgccggttgtggtgcttgatgagatgacgatcgccgatgattcgggtctgcattgggatgttgaaggggaggatggaatgaatcaagtagaagatgagccggagtcgagggatgtggatatcggagtggttttggaggagaagaggatgttggattcctcggttgcaacgccggctgatgtgatccaggactctgccgtgcccatcagccccatcccttgtccagagaccgtatcgagcccggcccatcctgatcacaactccattccccaagatgatgaagatgttcctgaagatgccgttgaaattggagattccacagctgaagaagatcgcatctttgtgcctcaagtttcagaagccgtttgtgaagacgacaacagaacggcagaggtggacacgaactgcgaagtatcgatcggaagcgacatatgcgaacgggagcaagatgaccacgtcgttccatttcaagacttggcggcgcttgaggatcccgttgctgcagtggctggtgcagatgatcagccatcgccattggagatcctagccccaactgaacaaggtgaagccgaacaggaggaggtggtgaggagcacgggattagacaaccaaccaactggacagaacgagatggaagaagacaaagcacctgagacaccgacgaacagcgtcgctacgcaacgctcggacagaatgtttttgctcgagaggaaacggtcgctgtcgttatccttggacgggagcgtggcaagtgagatggacggcggcgagccttccaccgtggaccagctgagatcggcgctgcaggccgagcggaaggcgctgggcgcgctgtacgcggagctggaggaagagcggagcgccgcggccatcgcggcgtaccagacgatggcgatgatcaacaggctgcaggaggagaaggcagcgatgcagatggaggcgctgcagtaccagcggatgatggaggagcagtccgagtacgaccaggaggcgctgcagctgctgaacgagctggtcaccaagcgggagcgggagaagcaggagctggagagggagctcgagctgtgcaggcagagggtgcagcactacgaggacaaggagcggaggaggatggcgagcttcaaggccaataatggtggcagccccagtggcagtggcgcttccgtgtcgtccagcggcgaggacagcgatgggcactccgacgactactgcgagctcgccgagtctccggacggcggtaacattcagagctcgtcggacgctgctcttagctccgtgagggatcaggacagcacgaagcacctcgtggctctggatgattccttgacgtactttgagatggagagactctccatcttggaggagctcaaagcactggaggagagactcttcacattggaagacgacgacatcaccggcaatgcggctgctggccattcctccggtgatttggacttgtcccccgacggccttcagtcacctgagcacattctcaccggtgacaagcaaaggttcgggggcaggacctctatcagtaggggcaagagtcttctgcctctgttcgatgcggtcggcgatgagacctgtaatcagatgccgtctacaagagcaggagacgcaggtcaagctgatgattcggcgacaaaatcagtatccgtgcttgtcaaagagcaggagaggctggcgatcatagaggaggttgatcatgtgtacgagagattgcaagctctggaggcagacaaggaattcctgaggcactgcatcaagtccctgaagaaaggagacaggggcatggacctccttcaggagatcttgcagcatcttcgcgatctcaggaatgtggaacttcacgtcaagaatgccggtgatgccattgctacaaattcagtgtagcgagttcatctatacgtgtggtaa

SEQ ID NO: 4751 - DNA, 1183 bp, Saccharum officinarum
cgacccacgcgtccgcggccacaccttcctcctcccccggcctccgctctcctcgccgctcgccgccctcctgcctctctctcctcgccgctcgccgccatgaacaacctcctcacggattcctttgagctccctcggcgggactcctcaagagatgcggacattgaaatgggaatgcatcaggctgatgcttcagacaacttaaaagatttcttgaagaaggttgatgcaattgagagtttaattgcaaagctgacaaatctattgaataagctccagactgcaaatgaggaatccaaagcagttacaaaagcaagttccatgaaagcaattaagcagcggatggagaaagatattgatgaagtggggaaaattgctcgtcaggcaaagacaaaagttgatgaactggaaaaagataatttatcaaataggcaaaaacctggatgtggaaagggttctgccgtggatcgatcaagagagcaaactactggagcagtgaaaaagaaattgaaggagcggatggatgattttcagaccttgagagaagcaatcaggcaagagtatcgggaggttgttgaaagaagggtttttactgtaactggtaatcgtcctgatgaagagacaattgatgacttgatagagaccggaaaaagtgagcaaatattcaaagatgctatccaacatcagggaagaggccagatactggacacagttgctgaaatacaggagcgacatgatgctgtaagggatctagagaggaagcttttggagttgcaacagatattcatggacatggcagttcttgttgaggctcaaggagacatgatcaacaacatcgagacacatgtctcgaacgccaccaatcacatacagcatggcgtgaccgcactccagaacgcgaagaaactgcagaagaactcgaggaagtggatgtgctacgccatcatcctgctgctggtgatagtggtggtcattgtcgtcgcagtcatccagccatggaagaagggctagcgtggctccaaagggggagggcagggcatggaatatacgttgcccttcttttctgtttgtgtaatatgtgtgcagttttttgtggggtgattcgtgatttatggttgtacctatggtcgacacaacagaagctttggcgtttcgattcattctgtgtggggatagtccggtc

SEQ ID NO: 4752 - DNA, 1254 bp, Zea mays
accccctctgcctactccacctctctctctctctctcaggtctcagctttaaaagcatcctctccgccgcggcgcaacggccacaccttccgtcccccggcctccgctcgcctgtccctgtctctctctctcctcgctgagtcgccgccagccatgaacaacctcctcacggattcctttgagctcccccggcgggactcctcaagagatgcagacattgaaatgggaatgcatcaagctgatgcttcagacaacttaaaagatttcttgaagaaggtcgatacaattgagagtttaattgcaaagctgacaaatctattgaataagctacagactgcaaatgaggaatccaaagcagttacaaaagcaagttccatgaaagcaattaagcagcggatggagaaagatattgatgaagtggggaaaattgctcgtcaggcgaagacaaaagttgatgaattggaaaaagacaacttatcaaataggcaaaaacctggatgtggaaaaggttctgccgtggaccgatcaagagagcaaactactggagcagtgaaaaagaaattgaaggagcggatggatgactttcagaccttgagagaagcaatcaggcaagagtatcgggaggttgttgaaagaagggtttttactgtaactggtaatcgtcctgatgaagagacaattgatgacttgatagagaccggaaaaagtgagcaaatattcaaagatgctatccaacatcagggaagaggccagatactagacactgttgctgaaatacaggagcgacatgatgctgtaagggatctagagaggaagcttctggagttgcaacagatattcatggacatggcagttcttgttgaggcgcaaggagacatgatcaacaacatcgagacccatgtctcgaacgccaccaaccacatacagcaaggtgtgagcgcgctccagaacgcgaagaaactgcagaggaattcgaggaagtggatgtgctacgccatcatcatactgctggtgatagtcgtggtcattgtcgtcgcagtcatccagccatggaagaagggcacctagcgtggtggtgccttttttcctgtttgtgtaatatgtgtgcagttttttttgtgggtgattcgtgatttgttgttgtacctatagtcgacgcaacaggagctctggcatttcgattcattctgtctagtgaaaggacactgccatcatatgccgataaaaataacgcttcgtatccgtcggtgaaaa

SEQ ID NO: 4753 - DNA, 1657 bp, Zea mays
gaacaagacgaggcaaacacccctggaaatggaaagcaatttttaaaaaactttccatggcacttgccagccagccgcctacctgccgaaagagatcctcgaatggcccacctgccagcctcagcacccgcagcgttaaccctctgcccacccaacctcttccccccagctcaaagcatcctctgcggcgcaacggccacaccttccccggtcccgcctccgtctctgtccagcgggcctccgctctcctcgccgcccgcccgcctgtccctccctctctctccctccctcctcgccgccatgaacaacctcctcacggattcctttgagctccctcggcgggactcctcaagagacgcagatattgaaatgggaatgcatcaggctgatgcttcagacaacttgaaagatttcttgaagaaggtcgatgcaattgagagtataattgcaaagctgtcaaatctattgaataagctccagactgcaaatgaggaatccaaagcagttacaaaagcaagttccatgaaagcaattaagcagcggatggagaaagatattgatgaagtggggaaaattgctcgtcaggcaaagacaaaagttgatgaactggaaagagataacctatcgaataggcaaaaacctggatgtggaaagggttctgccgtggaccgatcaagagagcaaactactggagcagtgaaaaagaaattgaaggaacggatggatgattttcagaccttgagagaagcaatcaggcaagagtatcgagaggttgtcgaaagaagggtttttactgtaactggtaatcgtcctgatgaagagacaattgatgacttgatagagaccggaaaaagtgagcaaatattcaaagatgctatccaacatcagggaagaggccagatactggacacagttgctgaaatacaggagcgacatgatgctgtaagggatctagagaggaagcttttggagttgcaacagatatttatggacatggcagttcttgtcgaggctcaaggagacatgatcaacaacatcgagacacatgtctcgaatgccaccaaccacatacaacaaggcgtgagcgcgctccagaacgcgaagaagctgcagaagaactcgaggaagtggatgtgctacgccatcatcttgctgctggtgatagtggcggtcattgtcgtcgcggtcatccagccatggaagaagtgagcctagggtggctctaaacagggaggagggcgtgggagatacgtttttttttggctgtctgtgtaatatctgtgcagttgttgtgggtggttctgtgatttatggttgtacttatggtcggcaccagagaagctttggtatttccattctttctgtttgggatagttcgtgcagtccattgaccatagctctcagaaatgttattgtggtgaccatatattcatatgtcggtcagctgatgaaaagaatggtgcttctgaatctttccacaaacagtgtgctggtgcccggtaatggctgttggattaatgtaggtttgattcaattaatatttaataatagtcaatgctaatagtctactttaatgttatggtgtactaagaatttagtaccatattgggagttcttatgttttggtgcttaatgccaaagggggagaatttaaggt

SEQ ID NO: 4754 - DNA, 2040 bp, Panicum virgatum
cctttgacacttgccagcctgcctaaaaagatcccgggtggcccacctgccagcctctgcagccgcggcgtgcagcagcttaacccccacctatcctccgcttaaagcgtcctctgcggcgcaacggccacacctcctccggcccccgaccttcctcggctcccctctctctcctcgccgctgcccgtttctctctcctcgccgcaccggtgcaccggagccatgaacaacctcctttcggattcctttgagctccctcggcgggactcttcaagagatgcagacattgaaatgggattgcatcaggctgatgcttcagacaacttaaaggatttcttgaaaaaggttgatgcaattgagagcctaattgcaaagctgacaaatctattgaataagcttcagactgcaaacgaggaatccaaagcagttacaaaagcaagtgccatgaaagcgatcaagcagcggatggagaaagatattgatgaagtggggaaaattgctcgtcaggcgaagacaaaagttgatgaactcgaaaaagataacttatcaaataggcaaaaacctggatgtggaaaggggtctgctgtggaccggtcaagagaacagactactggagcaattaaaaagaaattgaaggagcggatggatgattttcaggctttaagagaagcaatcaggcaagaataccgtgaggttgttgaaagaagggtttttactgtaactggtaatcgtcctgatgaagagacaatcgatgacttgatagagactggaaaaagtgagcaaatcttcaaagacgcaatccaacagcagggaagaggccagatactggacaccgttgctgaaatacaggagcgacatgatgctgtaagggatctagagaggaagctacttgagttgcaacagatattcatggacatggcagttcttgttgaggctcaaggagacatgatcaacaacatcgagacacatgtttcgaatgctaccaatcacatacagcaaggcgttagcgctctacagaatgccaagagattgcagaagaattcgagaaagtggatgtgctatgccatcatcatactgctggtgatagtggtgatcattgttgtggcagtcatccagccgtggaagaagggcacttaacattgtgttttctgcttgtgtaatatgtgtgtagcttttgtgggcatttcttgatttatcattgtacctatggtcgacacaacagaaagcttctgcttgcctttctggcattttcgattcattctgtttgggatggttgggcaatgacattccaactgccttactctgaaatgccgcagcaatgatatcgggggtttcttaaaagatactactgctctttgcagccctgtccgcgcttcacgctacgcgtggcatccagcgcgaactctacggctccaaacaatgcaagtctaggatgtgaccaacaaaagcagcaaggactagagtggataaaggcacagacaaggctgccccagtagaatagatgcatactgatcgtggccgctactaccaagcaacacagactacgtgtgctcgaccatctgttgatgtgtgtgggcaattcaaattgggaaataaaatacttgactacagacttcttcagttttgggttagattctgcatcgcaccatcggtggatttggagaggtggtcgcgtgccacggttgaaaatcttgttgaccgaggaagaggagattgaccagatattttggtttggcaagagttattttattttaaaatagtttttgtttcttaagatagaatcatgtttggtcgtaatcagctaggattgtgttagcgtggggtataaatatgaacccccggctattataaaggttgatacacatccaacaaacacaactttactacttgcaatttattttctcgtcggcgacttcgccacccatttttctttttccgcgagttctttcaagctgatcaaggacgcctcacattcgagcgacttagtttactgataagtcttcgtttaccgagtaaatctgagctttagctttcgggcac

SEQ ID NO: 4755 - DNA, 1317 bp, Setaria italica
catcctctgcggcgcaacggccacacctcctccggcccccggcctccctgcgctcccccttccctcttctctctcctcgccgcctgcctgttcctccctcctcgccgcaccgcccgcctcgccgccatgaacaacctcctctcggattcctttgagctccctcggcgggactcttcaagagatgcggacattgaaatggggatgcatcaggctgatgcttcagacaacttaaaggatttcttgaaaaaggttgatgcaatcgagagtctaattgcaaagctgacaaatctattgactaagctccagactgcaaatgaggaatcaaaagctgttacaaaagcaagtgccatgaaagcaattaagcagcggatggagaaagatattgatgaagtggggaaatttgctcgtcaggcgaagacaaaagttgatgaactggaaaaagataacttatcaaataggcaaaaacctggatgcggaaaggggtctgctgtggaccgatcaagagagcagactactggagcagtgaaaaagaaattgaaggagcggatggatgattttcaggctttaagagaagcaattaggcaagagtaccgtgaggttgttgaaagaagggtttttactgtaactggtaatcgtcccgatgaagagacaattgatgatatgatagagactggaaaaagtgagcaaatcttcaaagatgcgatccaacaaggaagaggccagatactcgacaccgttgctgaaatacaggagcgacatgatgctgtaagggatctagagaggaagcttcttgagttgcaacagatattcatggatatggcagttcttgttgaggcccaaggagacatgatcaacaacattgagacacatgtttcgaatgctaccaatcacatacaacaaggcgtgagcgccctccaaaatgcgaagaaactgcagaagaattcgaggaagtggatgtgctatgccatcatcatactgctggtgatagtggtgatcattgtggtggccgtcatccagccatggaagaagggcgcttagcgtggctccaaactgggagggcgccggatctatacattactttttttctgattgtgtaatatgtgtagcttttgtgggtgattcatgatttatcgctgtacctatggtcgacacaaacagaagcttctgcctgccctttggcatttcgactcattctgtttgggatagttgggtaatggcactcccaacggttccaactctgtgaaacgccgccgcaatcatatatgcctgtgaaaaatgacgctttaatggccgactgctgcttgtccatgtccatcg

SEQ ID NO: 4756 - DNA, 1247 bp, Pennisetum glaucum
cttctcctccccctcctcctccggtccccggcctcccctcctcgccgccgccggcctgtttctccctcctcaccggcctcgccgccatgaacaacctcctcacggattcctttgagctccctcggcgggactcttcaagagatgcggacattgaaatggggatgcatcaggctgatgcttcagacaacttaaagggtttcttgaaaaaggttgatgcaatcgagggtctaattgcaaagctgacaaatttattgactaagcttcagactgcaaatgaggaatcaaaagctgttacaaaagcaaatgccatgaaagcaattaagcagcggatggagaaagatattgatgaagtggggaaaattgctcgtctggcgaagacaaaagttgatgaactggaaaaagataacttatcaaataggcaaaaacctggatgcgggaaggggtctgctgtggaccgatcaagagagcagactactggagcagtgaaaaagaaattgaaggagcgtatggatgattttcaggctttaagagaagcaatcaggcaagagtaccgcgaggttgttgaaagacgggtttttactgtaactggtaatcgtcctgatgaagagacaattgatgacatgatagagactggaaaaagtgagcaaatcttcaaagatgcgatccaacagcagggaaggggccagatactggacaccgttgctgaaatacaggagcgacatgatgctgtaagggatctagagaggaagcttctcgagttgcagcagatattcatggatatggcagttcttgttgaggctcaaggagacatgatcaacaacatcgagacacatgtttcaaacgccaccaatcacatacaacaaggcgtgagcgccctccagaatgccaagaaactgcagaagaattcaagaaagtggatgtgctatgccatcatcttactgctggtgatagtcgtggtcattgtggtggccgtcatccagccgtggaagaagggcgcttagcatggctccaaacagggagagcaccacatctatacattacttttttttctgattgtgtaatatgtgtgtagcgtttgtgggtgattcgtgatttatcgttgtacctatggtcgacacaaacagaagcttctgcctgccctctggcatttcagttcattctgtttgtgatagctgggtaattgacaattccgacggttccatgcttgtgaagacgcttgaatggccgaatgctgctgcccctcatgt

SEQ ID NO: 4757 - DNA, 1630 bp, Panicum virgatum
gaccttcctcggctcccctctctctcctcgccgctgcccgtttctctctcctcgccgcaccggtgcaccggagccatgaacaacctcctttcggattcctttgagctccctcggcgggactcttcaagagatgcagacattgaaatgggattgcatcaggctgatgcttcagacaacttaaaggatttcttgaaaaaggttgatgcaattgagagcctaattgcaaagctgacaaatctattgaataagcttcagactgcaaacgaggaatccaaagcagttacaaaagcaagtgccatgaaagcgatcaagcagcggatggagaaagatattgatgaagtggggaaaattgctcgtcaggcgaagacaaaagttgatgaactcgaaaaagataacttatcaaataggcaaaaacctggatgtggaaaggggtctgctgtggaccggtcaagagaacagactactggagcaattaaaaagaaattgaaggagcggatggatgattttcaggctttaagagaagcaatcaggcaagaataccgtgaggttgttgaaagaagggtttttactgtaactggtaatcgtcctgatgaagagacaatcgatgacttgatagagactggaaaaagtgagcaaatcttcaaagacgcaatccaacagcagggaagaggccagatactggacaccgttgctgaaatacaggagcgacatgatgctgtaagggatctagagaggaagctacttgagttgcaacagatattcatggacatggcagttcttgttgaggctcaaggagacatgatcaacaacatcgagacacatgtttcgaatgctaccaatcacatacagcaaggcgttagcgctctacagaatgccaagagattgcagaagaattcgagaaagtggatgtgctatgccatcatcatactgctggtgatagtggtgatcattgttgtggcagtcatccagccgtggaagaagggcacttaacgtggctccaaacagggggagtgcaggatacaaacacacattgtgttttctgcttgtgtaatatgtgtgtagcttttgtgggcatttcttgatttatcattgtacctatggtcgacacaacagaaagcttctgcttgcctttctggcattttcgattcattctgtttgggatggttgggcaatgacattccaacggccttactctgaaatgccgcagcaatgatatcggggatttcttaaaagatactactgctctttgcagccctgtccgcgcttcacgctacgcgtggcatccagcgcgaactctacggctccaaacaatgcaagtctaggatgtgaccaacaaaagctgcatggactagagtggataaaggcacagacaaggctgccccagtagaatagatgcatactgatcgtggccgctactactaagcaacacagactacgtgtgctcgaccacctgttgatgtgtgtgggcaattcaaattgggaaataaaatacttgactacagacttcttcagttttgggtttgttgatactagattttggtatgtgtcaaggaagagtgttgaaaggagaaaagattctgcatcgtacgatcggtggatttggagaggtggtcgtgtgccacggttgaaa

SEQ ID NO: 4758 - DNA, 1122 bp, Cenchrus ciliaris
  misc_feature (126)..(126): n is a, c, g, or t
cgcttcccctccctcctcgccgcctgcctgttcctccctcctcgccggcctcgccgccatgaacaacctcctctcggattcctttgagctccctcggcgggactcttcaagagatgcggacattgnaatggggatgcatcaggctgatgcttcagacaacttaaagggtttcttgaaaaaggttgatgcaattgagggtctgattgcaaagctgacaaatttgttgactaagctccagactgcaaatgaggaatcaaaagctgttacaaaagcaagtgccatgaaagcaattaagcagcggatggagaaagatattgatgaagtggggaaaattgctcgtctggcgaagacaaaagttgatgaactggaaaaagataacttatcaaataggcaaaaacctggatgcgggaaggggtctgctgtggaccgatcaagagagcagactactggagcagtgaaaaagaaattgaaggagcgtatggatgattttcaggctttaagagaagcaatcaggcaagagtaccgcgaggttgttgaaagacgggttttcactgtaactggtaatcgtcccgatgaagagacaattgatgacatgatagagactggaaaaagtgagcaaatcttcaaagatgcgatccaacagcagggaaggggccagatactggacaccgttgctgaaatacaggagcgacatgatgctgtaagggatctagagaggaagcttctcgagttgcaacagatattcatggatatggcagttcttgttgaggctcaaggagacatgatcaacaacatcgagacacatgtttcaaacgccaccaatcacatacagcaaggtgtgggcgcccttcagcacgccaagaaactgcagaagaattcgagaaagtggatgtgctatgccatcatcttactgctggtgatagtcgtggtcattgtggtggccgtcatccagccgtggaagaagggcgcttagcggggctccaaacagggagagcgatctatacattactttttttctgattgtgtaatatgtgtgtagctgttgtgggtgattcgtgatttatcgttgtacctatggtcggtgcctgccctctggcatttcaattcattctgtttgtgata

SEQ ID NO: 4759 - DNA, 1407 bp, Panicum virgatum
taactgctccagtagtctgttctcttgaccgtcctcggctccccctctctctcctcgccgcctgcccgtttctctctcctcgccgcaccgccgccatgaacaacctcctctcggattcctttgagctccctcggcgggactcttcgagagatgcggacattgaaatgggaatgcatcaggctgatgcttcagacaacttaaaggatttcttgaaaaaggttgatgtaattgagagtctaattgcaaagctgacaaatctattgaataagcttcagactgcaaatgaggaatccaaagcagttacaaaagcaagtgccatgaaagcaatcaagcagcggatggagaaagatattgatgaagtggggaaaattgctcgtcaggcgaagacaaaagttgatgaactcgaaaaagataacttatcaaataggcaaaaacctggatgcggaaaggggtctgccgtggaccggtcaagagaacagactactggagcagttaaaaagaaattgaaggagcggatggatgattttcaggctttacgagaagcaatcaggcaagaataccgtgaggttgttgaaagaagggtttttactgtgaccggtaatcgtcccaatgaagagacaatcgatgacctgatagagactggaaaaagtgaacaaatcttcaaagacgcaatccaacagcagggaagaggccagatactggacaccgttgctgaaatacaggagcgacatgatgctgtgagggatctagagaggaagctacttgagttgcaacagatattcatggacatggcagttcttgttgaggctcaaggagacatgatcaacaacatcgagacacatgtttcgaacgctaccaatcacatacagcaaggcgttagcgctctccagaatgccaagaaactgcagaagaattcgagaaagtggatgtgctatgccatcatcatactgctggtgatagtggtgatcgttgttgtgggaatcatccagccatggaagaaggggtgatcgttgctgtgggagtcatccagccatggaagaaggggtgatcgttgctgtgggagtcatccagccatggaagaagggcgcttagcgtgtcttcaaacagggggaccgcaggatatatatacattgtgttttctgcttgtgtaatatgtgtgtagcttttgtgggcgattggtgatttatcattgtacctatggtcgacacaacataagcttctgcttgcccttctggcattttcgattcattctgtttgggatggttgggcccttctggcatttttgatctgccttgtttagatcccaaaaatttttagctaaaaacgtcacattgaatgtgtttggacacatgcatggagtattaaatgtggataaaagaaaaaactaattgcacagtgtgtgtgtac

SEQ ID NO: 4760 - DNA, 2031 bp, Panicum virgatum
ccctgtgacacttgctagcctgcctaaaaagatccgggtggcccacctgccagcctaagcaaccgcggcgtgcggcagcttaacccccacctctcctccgtttaaagcatcctctgcggcgcaacggccacacctcctccggcacccgaccgtcctcggctccccctctctctcctcgccgcctgcccgtttctctctcctcgccgcaccgccgccatgaacaacctcctctcggattcctttgagctccctcggcgggactcttcgagagatgcggacattgaaatgggaatgcatcaggctgatgcttcagacaacttaaaggatttcttgaaaaaaggttgatgtaattgagagtctaattgcaaagctgacaaatctattgaataagcttcagactgcaaatgaggaatccaaagcagttacaaaagcaagtgccatgaaagcaatcaagcagcggatggagaaagatattgatgaagtggggaaaattgctcgtcaggcgaagacaaaagttgatgaactcgaaaaagataacttatcaaataggcaaaaacctggatgcggaaaggggtctgccgtggaccggtcaagagaacagactactggagcagttaaaaagaaattgaaggagcggatggatgattttcaggctttacgagaagcaatcaggcaagaataccgtgaggttgttgaaagaagggtttttactgtgaccggtaatcgtcccaatgaagagacaatcgatgacctgatagagactggaaaaagtgaacaaatcttcaaagacgcaatccaacagcagggaagaggccagatactggacaccgttgctgaaatacaggagcgacatgatgctgtgagggatctagagaggaagctacttgagttgcaacagatattcatggacatggcagttcttgttgaggctcaaggagacatgatcaacaacatcgagacacatgtttcgaacgctaccaatcacatacagcaaggcgttagcgctctccagaatgccaagaaactgcagaagaattcgagaaagtggatgtgctatgccatcatcatactgctggtgatagtggtgatcgttgttgtgggaatcatccagccatggaagaaggggtgatcgttgctgtgggagtcatccagccatggaagaagggcgcttagcgtgtcttcaaacagggggaccgcaggatatatatacattgtgttttctgcttgtgtaatatgtgtgtagcttttgtgggcgattggtgatttatcattgtacctatggtcgacacaacataagcttctgcttgcccttctggcattttcgattcattctgtttgggatggttgggcccttctggcatttttgatctgccttgtttagatcccaaaaatttttagctaaaaacgtcacattgaatgtgtttggacacatgcatggagtattaaatgtggataaaagaaaaaactaattgcacagtttgtgtgtaaattgcgtgacaaattttttgagcctaattgcaccataatttgacaatgtggtgctacagtaaatatttgctaatgaaaaattaattagatttaatgaatttgtcttgcagtttagacggaatctgtaaaaacttaatgaatttgtctcattgtttgcagacggaatctgtaattctgtttgggaattgggatggttgggcaatgacactccaagggcccaactctgaaatgccgcagcaatcatatgctctgaaatatgacgcttcaacttcaacttcaatagccgtggggtcattatttgcttttgtgacaaatgcaggtcttagttggggacggttcaagtcttgatgttgcaactgcaccatcagaagagggcttggagactgttttacaagtcctgaagattcagcaaaaattttggccaattttaggtccaacctatgcatcactgcaggcacaacaggggtcggttttttccaaatctagtgagtaacgaaaatgcacagctaacatcatggataattgaattacataaacatcatg

SEQ ID NO: 4761 - DNA, 1258 bp, Triticum aestivum
ctctctctctctcctcgccgcgccgcgcctcctgccccgccgccatgaacaacctactcaccgattcctttgagcttcctcggcgggattcctcaagagatggggacgttgaaatgggaatgcatcagcctgatgcttctgataatttaaaaggcttcttgaagaaggttgatggaattgagagcctaatagctaagctgacgaatctcttgactaagctccagactgcaaacgaggaatcaaaagcagttacaaaagcaagtgccatgaaagcaattaagcagcgaatggagaaagatattgatgaagtggggaaaattgctcgtatggcaaaaaccaaagttgatgaactggaaaaagataacttatctaacaggcagaaacctggatgtgggaaggggtctgcagtagatcgatcaagagaacagactactggagcagtcaaaaagaaattgaaggaacggatggacgattttcaggtattgagagaatcaatccggcaggagtaccgggaagttgttgaaagaagggtatttactgtaactggcaatcgccctgatgaagagactattgatgatttaatcgagacagggagaagtgagcaaattttcaaagatgctgttcagcagcaggggagaggccagatattggatactgttgctgagatacaggagcgtcatgatgctgtcagagatctggagaggaagcttctggagttgcagcagatattcctggatatggcagtattggttgaggctcaaggagacatgatcaaccacatagagacacatgtttcaaatgctaccaaccacatacagcaaggtgtgggcgctctccagaatgcaaagaagctgcagaaaaactcgagaaagtggatgtgctacgccatcatccttctcctggtaatagtggttatcatcgtggtcgcggttatccagccatggaagaagtaactcttgagcatgacctggaacccaagatctcggcggaatatatatatatatactgtttttgtgtttgtgcaatctgtgtagttctgtgaccgattcaaactcttctatcgttgtacctatgctcaaccagacaaagccccatattgtttgcccctggaggtgctgctattcatttgtgtttcgtgtgctccagctattttagcggtgaaagtggtgaacgcgaaaccgaaatgtgcattcttgttcctaaatccatttattgcagtttgtgcaccatactaacatgtaagaacgttttgctgtcc

SEQ ID NO: 4762 - DNA, 1440 bp, Triticum aestivum
ggcacacaaaggcgtccagcttaacccccactcgttaaaagcatctccgacagtacaacggccaacctctctctctctctcctcgccgcgccgcgcctccggccccgccgccatgaacaacctactcaccgattcctttgagcttcctcggcgggattcctcaagagatggggacgttgaaatgggaatgcatcagcctgatgcttctgataatttaaaaggcttcttgaagaaggttgatggaattgagagcctaatagctaagctgacgaatctcttgactaagctccagactgcaaacgaggaatcaaaagcagttacaaaagcaagtgccatgaaagcaattaagcagcgaatggagaaagatattgatgaagtggggaaaattgctcgtatggcaaaaaccaaagttgatgaactggaaaaagataacctatctaacaggcagaaacctggatgtgggaaggggtctgcagtagatcgatcaagagaacagactactggagcagtcaaaaagaaattgaaggaacggatggacgattttcaggtattgagagaatcaatccggcaggagtaccgggaagttgttgaaagaagggtatttactgtaactggcaatcgccctgatgaagagactattgatgatttaatcgagacagggagaagtgagcaaattttcaaagatgctgttcagcagcaggggagaggccagatattggatactgttgctgagatacaggagcgtcatgatgctgtcagagatctggagaggaagcttctggagttgcagcagatattcctggatatggcagtattggttgaggctcaaggagacatgatcaaccacatagagacacatgtttcaaatgctaccaaccacatacagcaaggtgtgggcgctctccagaatgcaaagaagctgcagaaaaactcgagaaagtggatgtgctacgccatcatccttctcctggtaatagtggttatcatcgtggtcgcggttatccagccatggaagaagtaactcttgagcatgacctggaacccaagatctcggcggaatatatatatatatactgtttttgtgtttgtgcaatctgtgtagttctgtgaccgattcaaactcttctatcgttgtacctatgctcaaccagacaaagccccatattgtttgcccctggaggtgctgctattcatttgtgtttcgtgtactccagctattttagcggtgaaagtggtgaacgcgaaaccgaaatgtgcattcttgttcctaaatccatttattgcagtttgtgcaccatactaacatgtaagaacgttttgctgtttgttaccggatctaatgctcattcatctttgtttcttgtctttaggtgccagtgtgtgtgttacatgtagactgtgttaccaccgttctgcctcaagaacacgcatgcacactag

SEQ ID NO: 4763 - DNA, 1276 bp, Secale cereale
cggtacaacggccaacctctctctctctcatcgccgcgccgcgccgcgcctccggccccgccgccatgaacaacctactcaccgattcctttgagcttcctcggcgggattcctcaagagatggggacgttgaaatgggaatgcatcagcctgatgcttctgacaatttaaaaggcttcttgaagaaggttgatggaattgagagcctaatagctaagctgaagaatctcttgactaagctccagactgcaaacgaggaatcaaaggcagttacgaaagcaagtgccatgaaagcaattaagcagcgaatggagaaagatattgatgaagtggggaaaattgctcgtatggcaaaaaccaaagttgatgaactggaaaaagataacttatctaacaggcagaaacctggatgtgggaaggggtctgcagtagatcgatcaagagaacagactactggagcagtcaaaaagaaattgaaggaacggatggacgattttcaggtattgagagaatcaatccggcaggagtaccgggaagttgttgaaaggagggtatttactgtaactggcaatcgccctgatgaagagactatcgatgatttaatcgagacagggagaagtgagcaaattttcaaagatgctgttcagcagcaggggagaggccagatattggatactgttgctgagatacaggagcgtcatgatgctgtcagagatctggagaggaagcttctggagttgcagcagatattcctggatatggcagtattggttgaggctcaaggagacatgatcaaccacatagagacacatgtttcaaatgctaccaaccacatacagcaaggtgtgggcgctctccagaatgcaaagaagctgcagaaaaactcaagaaagtggatgtgctacgccatcatccttctcctggtgatagtggttatcatcgtggtcgcggttatccagccatggaagaagtaactcttgagcacgacctggaacccaagatctcggcggtagtaacacaaaaatactatttttgtgtttgtgcaatctgtgtagttctgcgaccggttcaaactcttccatcgttgtaccatctgctcaaccagacaaagccccatattgtttgcccccggaggtgctgctattcatttgtgtttcgtgtgctccagctattttagcggtgaaagtggtgaatgcgaaaccgaaatgtgcattcttgttcctaaatccatttattgcagtttgtgcaccatactaacatgtaagaacgttttgct

SEQ ID NO: 4764 - DNA, 1219 bp, Hordeum vulgare
tctctctcctcgccgcgccacgcctgcggctccgccgccatgaacaacctactcaccgattcatttgagcttcctcggcgggattcctcaagagatggggacgttgaaatgggaatgcatcagcctgatgcttctgataatttaaaaggcttcttgaagaaggttgatggaattgagagcctaatagttaagctgacgaatctcttgactaagctccagtctgcaaacgaggaatcaaaagcagttacaaaagcaagtgccatgaaagcaattaagcagcgaatggagaaagatattgatgaagtggggaaaattgctcgtatggcaaaaaccaaagttgatgaactggaaaaagataacttatctaacaggcagaaacctggatgcgggaaggggtctgcagtagatcgatcaagagaacagactactggagcagtcaaaaagaaattgaaggaacggatggacgattttcaggtattgagagaatcaatccggcaggagtaccgggaagttgttgaaagaagggtatttactgtaactggtaatcgccctgatgaagagactattgatgatttaatcgagacagggaggagtgagcaaattttcaaagatgctgttcagcagcaggggagaggccaggtattggacactgttgctgagatacaggagcggcatgatgctgtaagagatctagagaggaagcttctggagttacagcagatattcctggatatggcagtactggttgaggctcaaggagacatgatcaaccacatagagacacatgtttcaaatgctaccaaccacatacaacaaggtgtgggcgctctccagaacgcaaagaagctgcagaagaactcgagaaagtggatgtgctacgccatcatccttctcctggtgatagtggttatcatcgtggttgcggttatccagccatggaagaagtaactcttgagcacgacctggaacccaagacctcagcggaatatatataaacttttttttgtgtttgtgcaatctgtgtagttctgtgatcgatccactcttctatcgatgttacctatgccaaccagacaaagccctatattgtttgcccctggaggcgctgctattcatttgtatttcgtgtgctccagatattttaggggtgaaagtggtgaacgtgaaaccgaaatgtgcatacttgttcttgaatctatttattgcagttcgtgcacca

SEQ ID NO: 4765 - DNA, 1315 bp, Brachypodium distachyon
ctctcacggcacaacggccacctctctctttctctctctctccttgccgtctgcctgtttctctctcctcgccgcgccgccatgaacaacctcctcactgattcctttgagcttcctcggcgggattcctcaagagatggggacattgaaatgggaatgcatcaggctgatgcttcagataatttaaaaggtttcttaaaaaaggttgatggaatcgagggcctaattgctaagctgacgaatctcttgactaagctccagactgcaaatgaggaatcaaaagcagttacaaaagcaagcgccatgaaagcaattaagcaacggatggagaaagatatcgatgaagtggggaaaattgctcgtacggcaaagaccaaagttgatgaactggaaaaagataacttatcaaataggcagaaacctggatgcggtaaagggtctgcggtagatcgatcaagagagcagaccactggagcagtgaaaaagaaattgaaggaacggatggatgattttcaggttttgagagaatcaatccgtcaggagtaccgtgaagttgttgaaagaagggtgtttacagtaactggtaatcgccctgatgaggagacaattgacgatttaatagagactgggagaagtgaacaaattttcaaagatgcggtccaacagcaggggagaggccaggtattggataccgtagctgagatacaggaacgacatgatgctgtaagggatctagagaggaagcttctggagttgcagcagatattcctggatatggcagtattggttgaggctcaaggagatatgatcaaccacatagagacacatgtttcaaatgccaccaaccacatacagcaaggtgtgggtgctctccagaacgcaaagaagctgcagaagaactcgaggaagtggatgtgctatgccatcatccttctccttgtcattgtggccatcattatcctcgcggttatccagccatggaagaagtaacgcctgagcacggacagaaaccgaagatcttctcgggatatatatatatatatcgcttttttcttttctttatctgtttgtgcaatgtgtgtagttctgtggccgatttacactcctttgtcgcctgtacgtatgtttcaacaagacaaagcccatattgtttgccccctgactgggcgctgctattggtttgcgagtttcatatgctctaattggtcaaaactggtgaatgtgaaacgcgattgtgcatcctgattcctgaatcttgacatctttctattgcagttgtgcaccaataatgacaacgtgcaagaacattttgcca

SEQ ID NO: 4766 - DNA, 1327 bp, Secale cereale
gtggaacacaaaggcgtccagcttaacccccactcgtcaaaagcatctccgacggtacaacggccaacctctctctctctcatcgccgcgccgcgccgcgcctccggccccgccgccatgaacaacctactcaccgattcctttgagcttcctcggcgggattcctcaagagatggggacgttgaaatgggaatgcatcagcctgatgcttctgacaatttaaaaggcttcttgaagaaggttgatggaattgagagcctaatagctaagctgaagaatctcttgactaagctccagactgcaaacgaggaatcaaaggcagttacgaaagcaagtgccatgaaagcaattaagcagcgaatggagaaagatattgatgaagtgggaaaattggctcgtatggacaaaaaccaagttgatgaactggaaaaagataacttatctaacaggcagaaacctggatgtgggaagggtctgcagtagatcgatcaagagaacagactactggagcagtcaaaaagaaattgaaggaacggatggacgattttcaggtattgagagaatcaatccggcaggagtaccgggaagttgttgaaaggagggtatttactgtaactggcaatcgccctgatgaagagactatcgatgatttaatcgagacagggagaagtgagcaaattttcaaagatgctgttcagcagcaggggagaggccagatattggatactgttgctgagatacaggagcgtcatgatgctgtcagagatctggagaggaagcttctggagttgcagcagatattcctggatatggcagtattggttgaggctcaaggagacatgatcaaccacatagagacacatgtttcaaatgctaccaaccacatacagcaaggtgtgggcgctctccagaatgcaaagaagctgcagaaaaactcaagaaagtggatgtgctacgccatcatccttctcctggtgatagtggttatcatcgtggtcgcggttatccagccatggaagaagtaactcttgagcacgacctggaacccaagatctcggcggtagtaacacaaaaaatctatttttgtgtttgtgcaatctgtgtagttctgcgaccggttcaaactcttccatcgttgtaccatctgctcaaccagacaaagccccatattgtttgccccggaggtgctgctattcatttgtgttcgtgtgctccagctattttagcggtgaaagtggtgaatgcgaaccgaatgtgcattcttgttcctaaatccatttattgcagtttgtgcaccatactaacatgtaagaacgttttgctgttt

SEQ ID NO: 4767 - DNA, 1296 bp, Oryza sativa
atctccacctcctacggtacaagggccacgccacgcctaactctctccctctctctctcctcgccgccgccgccgcctccacgtttctctctcctcgccgcgcgccggcgagacctcgccgccatgaacaatctcctcaccgattcgtttgagctccctcggggaggctcttcaagagatggggacattgaaatgggaatgcaagctgatccttcagacaatctaaaaggtttcttgaaaaaggttgacgcaattgaaagcctaattgctaagctgacgaatctcttgcataagcttcagactgcaaatgaggaatctaaagcggttacaaaagcaagggacatgaaagcaattaaacagaggatggagaaagatattgatgaagtggggaaaatcgctcgcatggcaaagacaaaagttgatgaattggaaaaagataacttatcaaacagacaaaagcctggatgtgggaaaggatctgcggtagatcgatcaagagaacagactactggagcagtgaaaaagaaattgaaggagcgcatggatgattttcaggttttgagagaagcaatccggcaggagtatcgtgatgtcgttgaaagaagggtgtttacagtaactggtagtcgtcctgatgaagagacagttgacaatttaatagagactggaagaagtgagcaaattttccaagaagctatccaacagcagggaagaggccaaatactggacactgttgcagagatacaggaacgtcacgatgctgtaagagatctagagaggaagcttctggagttgcagcagatattcatggatatggcagttttggttgatgctcaaggagacatgatcaacaacatagagacacatgtttcaaatgctaccaaccacatacaacaaggcgtcagtgctctacagaacgcgaagaagctccagaagaactccaggaagtggatgtgctacgccatcatcctcctgctcatcatagtggtgatcattgtcgtcgccgtcatccagccatggaagaagggtgcttgattgtaacttggaaaaagaagatcgtgggatatatttttttccctgtttgtgcaatatgtgtagttgtgtctccgattccctcctacccctgtacgtatgcttaacaaaacaacatgatgagattgagattcgtttgcccttaggcgcaggttgattcatcttcataccagatttcctgtgcaatctaccacgccaggggttatgtgtgaaacaatggtcccatcagtctcaacaaaaattgtgaattcctggatcttttac

SEQ ID NO: 4768 - DNA, 1113 bp, Triticum aestivum
tcctttgagcttcctcggcgggattcctcaagagatggggacgttgaaatgggaatgcatcagcctgatgcttctgataatttaaaaggcttcttgaagaaggttgatggaattgagagcctaatagctaagctgacgaatctcttgactaagctccagactgcaaacgaggaatcaaaagcagttacgaaagcaagtgccatgaaagcaattaagcagcgaatggagaaagatattgatgaagtggggaaaattgctcgtatggcaaaaaccaaagttgatgaactggaaaaagataacttatctaacaggcagaaacctggatgtgggaaggggtctgcagtagatcgatcaagagaacagactactggagcagtcaaaagaaattgaaggaacggatggacgattttcaggtattgagagaatcaatccggcaggagtaccgggaagttgttgaaagaagggtatttactgtaactggcaatcgccctgatgaagagactattgatgatttaatcgagacagggagaagtgagcaaattttcaaagatgctgttcagcagcaggggagaggccagatattggatactgttgctgagatacaggagcgtcatgatgctgtcagagatctagagaggaagcttctggagttgcagcagatattcctggatatggcagtgttggttgaggctcaaggagacatgatcaaccacatagagacacatgttgcaaatgctaccaaccacatacagcaaggtgtgggcgctctccagaaggcaaagacgctgcagaagaactcgagaaagtggatgtgctacgccatcatcctcctcctggtggtagtggctatcgtcgtgctcggggtgatccagccatggaagaagaagtaacccttgagccacgacctgggttttacccaacatctcggcgcggtggaatatatagtataacatatataactgtttttctgtttagtggctattcgtagtgtagtcatgtgattgattacaacactcttctatctatcgctgtacgactggctatgttagaaccagaacaagcctatactgtatgcacatatatatactggtggctgcccgacttaagttaaac

SEQ ID NO: 4769 - DNA, 968 bp, Avena sativa
gaccctcaaagtgtcgcctacggtacaacggccacctctgtctccctttctctctcatcgccgtctgcccgttcctctctcctcgccgcgccgccatgaacaacctgctcaccgattcctttgagctccctcggcgggattcctcaagagatggggatgtcgaaatgggaatgcatcagcctgatgcttcagataacttgaaaggtttcttaaaaaaggttgatggaatcgagagcctaatcgctaaactgacggctctcttgactaagctccagactgcaaatgaggaatcaaaagcagttacaaaagcgagtgccatgaaagcaattaagcagcgaatggagaaagatatagatgaagtgggcaaaattgctcgcatggcaaaggcaaaatttgatgagctggaaaaagataacttgtctaacaggcagaaacctggatgcgggaaggggtctgcagttgaccgatcaagagagcagactactggagcagtgaaaaagaaattgaaggggcggatggatgagtttcaggtattgagagaatcaatccggcaggagtatcgggaagttgttgaaagaagggtatttactgtaactggtaatcgtcctgatgaagagactattgacgatttaatagagactgggagaagtgagcaaattttcaaggatgcggttcagcagcaggggagaggccagatattggacactgttgctgagatacaggagcgacatgatgctgtaagggatctggagaggaagctcctggagctgcagcagatattcctggatatggcagtgttggttgatgctcaaggagacatgatcaaccacatcgagacacatgtttcaaatgctaccaaccacatatcgcaaggcgtgggtgctctccagaacgcaaagaagctgcagaggaactcgagaaagtggatgtgctacgccatcatccttctcctcgtggtagtggtgatc

SEQ ID NO: 4770 - DNA, 846 bp, Leymus cinereus x Leymus triticoides
  misc_feature (701)..(703): n is a, c, g, or t
ccgttgctgtcgttgaaatgggaatgcatcagcctgatgcttctgataatttaaaaggcttcttgaagaaggttgatggaattgagagcctaatagctaagctgacaaatctcttgactaagctccagactgcaaacgaggaatcaaaagcagttacaaaagcaagtgccatgaaagcaattaagcagcgaatggagaaagatattgatgaagtgggaaaaattgctcgtatggcaaaaaccaaagttgatgaactggaaaaagataacttatctaacaggcagaaacctggatgcgggaaggggtctgcagtagatcgatcaagagaacagactactggagcagtcaaaaagaaattgaaggaacggatggacgattttcaggtattgagagaatcaatccggcaggagtaccgggaagttgttgaaagaagggtatttactgtaactggtaatcgccctgatgaagagactattgatgatttaatcgagacagggagaagtgagcaaattttcaaagatgctgttcaacagcaggggagagggcagatattggatactgttgctgagatacaggagcggcatgatgctgtaagagatctagagaggaagcttctggagttgcagcagatattcctggatatggcagtattggtcgaggctcaaggagacatgatcaaccacatagagacacatgtttcnnntgctaccaaccacatacagcaaggtgtgggcgctctccagaacgcaaagaagctgcagaagaactcgagaaagtggatgtgctacgccatcatccttctcctggtgatagttgttatcatcgtggtcgcggttatccagccat

SEQ ID NO: 4771 - DNA, 1351 bp, Secale cereale
ctttaaccctcgccgcgccgccgtctgttagtaggttcgtcgccgcgccgccgtccgccgtccgccccgcaccgccgtctgttagtaggttcttcgccgcgccgccgtgccgccatgaacaacctactaaccgactcctttgagcttccgcgccgggattcctccagagatgtgggggatcttgagatgggagtgcatcaccccgacgcttccgataatttgcaagccttctacaaaaaggttgatgccatcgacaccctcattgctaagctcaccaccctcttcaccaagctccagactgccaacggggaatcaaaagcagtcacgaaagcgagcgccatgaaagcaatcaagcagcgcatggagaaagatatcgacgaagtgggcaaaattgctcgtatggcgaaaacaaaactcgatcaactggaaaaagacaactcatctaacaggcagaaacctggatgcggcaaggactctgcggtagatcgttcaagggaacagattactggaggtgtgaaaaacaaactgaaggagcggatggacagttttcaggtattgagagaatcaatccagcaggagtaccgggaagttgttgaaagaagagtatttactgtaactggtaatcgccctgatgaagagacaattgacgatttaatcgagacagggagaagcgagcagattttcaaagatgcggttcagcagcaggggagaggccaggtattggacactgttgctgagatacaggagcggcatgatgctgtaagagatctagagaggaagcttctggagttgcagcagatattcctggatatggcggtcttggttgaggctcaaggagacatgatcaacaacattgagacacatgtttcgaatgctaccaaccacatacaggatggcgtgggcgctctccagaaggcaaagacgctgcagaagaactcgaggaagtggatgtgctacgccatcatcctcctcctggtggtagtggttatcgtcgtgctcggggtgatccagccttggaagaagaagtaacccttgagccacgacctgggtgggttttacccaacatctctcggcacggtggaatatatatatatatacacacacatatatactgtttgttttttctgtttgtgcattctgtctagtcatgtgattgattcacactcttctatgtatcgctgtacggctggctatgttgaacgtatatatactggtggctgctgctattcttttttctttaatttttttgagttgaggctgctgctatttgtttgtgctccgagtattttttagtggtgaaacgaccgaaatgtgcattcatccttagcttgttcctgaatccatttattac

SEQ ID NO: 4772 - DNA, 1134 bp, Secale cereale
gttgcttcagccgtagccttcgccttccccagcagagcagagcagagcactttaaccctcgcctcgccgccgtctgttagtaggttcgtcgccgcgccgccgtccgccgtccgccccgcaccgccgtctgttagtacgttcgtcgccgcgccgtcgtgccgccatgaacaacctactaaccgactcctttgagcttccgcgccgggattcctccagagatgtgggggagtcttgagatgggagtgcatcaccccgaccgcttctgataatttagcaagccttctacaaaaaggttgatgccatcgacaccctcattgctaagctcaccaccctcttcaccaagctccagactgccaacggggaatcaaaagcagtcacgaaagcgagcgccatgaaagcaatcaagcagcgcatggagaaagatatcgatgaagtgggcaaaattgctcgtatggcgaaaacaaaactcgatcaactggaaaaagacaactcatctaacaggcagaaacctggatgcggcaaggactctgcggtagatcgttcaagggaacagattactggaggtgtgaaaaacaaactgaaggagcggatggacagttttcaggtattaagagaatcaatccagcaggagtaccgggaagttgtcgaaagaagagtatttactgtaactggtaatcgccctgatgaagagacaattgacgatttaatcgagacagggagaagcgagcagattttcaaagatgcggttcagcagcaggggagaggccaggtattggacactgttgctgagatacaggagcggcacgatgctgtaagagatctagagaggaagcttctggagttgcagcagatattcctggatatggcggtcttggttgaggctcaaggagacatgatcaacaacattgagacacatgtttcgaatgctaccaaccacatacaggatggcgtgggcgctctccagaaggcaaagacgctgcagaagaactcgaggaagtggatgtgctacgccatcatcctcctcctggtggtagtggttatcgtcgtgctcggggtgatccagccttggaagaagaagtaacccttgagccacgacctgggtgggttttacccaacatctctcagcacggtgga

SEQ ID NO: 4773 - DNA, 1156 bp, Hordeum vulgare
gctgcttacatacatcttcttcctattttacaggattcctttgagcttccccgccgggattcttccactgatctcgagatggggatgcatcaccccgatgcctcccacaatttacaagccttcctcaacaaggtcgatggcatcgacagcctgatagctaagctggccactctcttcaccaagctccagtctgccaacgaggaatccaaagcagttacaaaagcaagcgccatgaaagaaattaagcagcgaatggaaaaggacattgatgaagtgggcaaagttgctcgtctggcgaaaacaaaactcgatcaactggaaaaagataacttatctaacaggcagaaacctggatgcgacaaggattccgccgtagatcgatcaagggaacagactactggagctgtgaaaaagaagttgaagaaacggatggacgattttcaggtactgagagagtcaatccggcaggagtaccggcaagttgttgaaagaagggtattcaccgtaactggtaatcgtcctgatgaagagacaattgatgatttaatcgagacagggagaagcgagcagattttcaaagatgcggttcagcagcagggaagaggccagatattggacactgtggctgagatacaggagcggcatgatgctgtaagagatctagagaggaagcttctggaactgcagcagatattcctggatatggcggtattggttgaggctcaaggagacatgatcaaccacatagagacacatgtttcaaatgctaccaaccacatacagcaaggcgtgggcgctctccagaaggcaaagaccctacagaagaactcgaggaagtggatgtgctacgccatcatccttctcttggtggtagtggctatcgtcgtgctcggggtgatccaaccatggaagaagaagtaacccttgagccacgacccaacatctcggcacggcggaatatatatatatatatatatactgttttttcttcttcttctgtttgtgcattctgtctagttctgtgaccgattcacacactcttctacaatctctgtatggctatgctgaaccatattgtttgcccatatcatgtactggggctgctgctattcttttttccttatgtacttatatctattttgtaggtcagtgggtt

SEQ ID NO: 4774 - DNA, 1322 bp, Hordeum vulgare
taattgttttagcttatgaaagtagcacaattggcttgtcagatcgaattcataacaatcaagccttggtgcaggtgctgcagtacattcgttacatattttatctaaacattccgattttgcaggattcatttgagcttcctcggcgggattcctcaagagatggggacgttgaaatgggaatgcatcagcctgatgcttctgataatttaaaaggcttcttgaagaaggttgatggaattgagagcctaatagctaagctgacgaatctcttgactaagctccagtctgcaaacgaggaatcaaaagcagttacaaaagcaagtgccatgaaagcaattaagcagcgaatggagaaagatattgatgaagtggggaaaattgctcgtatggcaaaaaccaaagttgatgaactggaaaaagataacttatctaacaggcagaaacctggatgcgggaaggggtctgcagtagatcgatcaagagaacagactactggagcagtcaaaaagaaattgaaggaacggatggacgattttcaggtattgagagaatcaatccggcaggagtaccgggaagttgttgaaagaagggtatttactgtaactggtaatcgccctgatgaagagactattgatgatttaatcgagacagggaggagtgagcaaattttcaaagatgctgttcagcagcaggggagaggccaggtattggacactgttgctgagatacaggagcggcatgatgctgtaagagatctagagaggaagcttctggagttacagcagatattcctggatatggcagtactggttgaggctcaaggagacatgatcaaccacatagagacacatgtttcaaatgctaccaaccacatacaacaaggtgtgggcgctctccagaacgcaaagaagctgcagaagaactcgagaaagtggatgtgctacgccatcatccttctcctggtgatagtggttatcatcgtggttgcggttatccagccatggaagaagtaactcttgagcacgacctggaacccaagacctcagcggaatatatataaacttttttttgtgtttgtgcaatctgtgtagttctgtgatcgatccacctcttctatcgatgttacctatgccaaccagacaaagccctatattgtttgcccctggaggcgctgctattcatttgtatttcgtgtgctccagatattttaggggtgaaagtggtgaacgtgaaaccgaaatgtgcatacttgttcttgaatctatttattgcagttcgtgcaccatactaacatgtaagaacgttttgctgtttttttc

SEQ ID NO: 4775 - DNA, 2058 bp, Zea mays
tttcacacttggctccctcgctcgctcgctcgctcgcactgacaacctgggtggccggctggccgccaccgcacacctctgctgtggtctaccgcccctcttcgctctcgctccccgtcgtcggtgagccgcgcccgtccagccgcccaccctctcaccgatggcttcggcggccgcgaggggcgccgcggtgcgctcccctctcctcgtccaccaccgcgtccccctggtacatcccagcgggggaggctcgctccgggtcggctggcccgggattgcgcccggacgggaggggcggcggcggggggccccggttggggctagggttttcgcgcgctactcccaggcccaggacttctccacacgcctccaagatagagctggtgagctgcctaagttagtcgaggaccttatccagacatcgattagcacagggcctcgaggtgctttcaggatggcccaagggatccaagctgtgcttggggttggtggggagtggctgaatgacctctcaaagacagccaacacatcagcaggaattccatctcagatgcagcttggtttgctttctccactttaccttcgaaggctttttgagcgcatgggtgccacttatatcaagttaggccagtttgtagcatctgcgccaactttgtttcctgcagaatatgttgaggaattccagaaatgctttgaccaagcaccagctgtcccatatgacgtgattgaatcaatattacgtgaggagctgcagcggccattagatagtgtgtatgaatacattgatccggtgccaatagcctctgcctcaatagcacaggttcatggggctaggttgaagagctctcagaaagatgtggtgattaaagttctaaagcctggtattgaagatactttggttgctgatctgaattttatctatgttgttgcacgtgttttagagttcttgaaccctgaactacaaaggacatcactggtaggcattgtaaaggatataaaggaatcaatgcttgaggaagttgactttagaaaagaggctgcaaatattcaggcatttcagggatacattgatgcaatggggtttgacaggcaggcaaaagccccatttgtgtatcagcactgtagtacaaaacgtgtattgactatggaaagattgtatggagttccgcttactgatcttgattctataagatctcttgttcctgatcctgagttgactttagtcactgcccttaatgtctggtttggaagcttaatttcatgtgaatccttccatgctgatgtacatgctggaaacctatggttgctccgtgatgggcgaattggttttattgattttgggattgttggtcgaatatctccaagaacttgggcagctatggaggtctttttggcttcttttgcaactgaggattatgatgctatggcctctgccctctctgaaatgggtgctacagggaatgatataaatactaatgaatttgcaaaggacctgcgaaagatattctcatcgatacaggacctggatactgaaatcatagtggcaacagcaaggacccctgatgctacagcagtatctgctaatgttgtccttgatgagaggcagatgaatgctctttttcttgatctggtcagggtgagcgagtcttacgggctgaaatttcctcgggagtttgctcttctcatgaagcagctgctgtattttgatcgctacacaagactgctggctcccagcatgaacatgctgcgagacgagaggatcaacatctccaccaatcgacaaccaagaagaactgatagatttcagtgaagccacgtcgttagtcaccggccacgtactagaggagtcgtgatgggcgataatagcaagctcatgtgacccaatactgtatatagttttgccagaccagcatagaaatgaaccacacgctagaaattgtacactccgtcgtattctgggattgagcgttatatcgtactagtaggtaacatgtaaaggctgtatcccacgaccaaagtaaatttcagatgaactgcttttgtctcatcttttttctg

SEQ ID NO: 4776 - DNA, 2096 bp, Setaria italica
cacttgaccacactgccgccgcagcccgacgccggcgagccgcccacccactctctcctctccactatggcggcggccgcgaggtgcgcttccgcggcgcgctcccctctcctcatccaccaacaccgccgcgtccccaaggtgccgtccggcgggggaggctcgctccgtgtgggtggggccgggattggggccggacgcggacgggaggggcggaggcgggcccaggtcggggtcagggttttcgcgcgctactcccaggcccaggacttatccacgcgcctccaagatagagttggtgagttacctaaattagtcgaggaccttctccagacatcaattagcacaggacctcgaggtgctttcaggatggcgcaagggatccaagctgtgcttggggttggtggggagtggctgaatgacctctcaaagacagctaatgcatcagcaggaattccagctcagatgcagcttggtttgctttctcccctttaccttagaagactttttgagcgcatgggtgcaacttatatcaagctaggccagttcatagcatctgcaccaactttgtttcctgcagaatatgtcgaggaattccagaactgctttgaccgagcaccagctgtcccatatgacgtgattgagtcaatattgcgtgaggagttgcagcggccattagatagtgtatatgaatacatcgatcatgtgccaatagcctctgcctcaattgcacaggttcatggggctaggttgaagagttctcagaaggatgtggtgattaaagttctaaagcctggtattgaagacactttggtcgctgatctgaattttatctatgttgttgcacgcattttggagttcttgaaccctgagctacagaggacatcactggtaggcattgtcaaggatataaaggaatcaatgcttgaagaagttgattttagaaaagaggctgcaaatattcaggcttttcagggatacatagatgctatgggatttgacaggcaggcaaaagccccatttgtgtatcaacactgtagcacaaaacgtgtgttgactatggaaagattgtacggagttccgcttactgaccttgattctataaggtctcttgttcctgatcctgagttgactttagtcactgcccttaatgtctggtttggaagcttgatttcgtgtgaatccttccatgccgatgtgcatgctgggaacctttggttgctccgtgatgggcgaattggtttcattgatttcggtattgttggtcgcatatctccaaggacttgggctgctatggaggtcttcttggcttctttcgcagctgaggattatgatgctatggcctctgccctttctgaaatgggtgctacagggaatgatataaatattgatgaatttgcaaaggacttgcgaaagatattctcatcaatacaggacttggatactgaaatcatagtcgcagcagcaagaggtcctgatgctacagctgtatctgctaatgttgtccttgatgagagacagatgaatgctctgtttcttgatctggtgagagttagcgagtcttacgggctgaaatttccccgggaattcgctcttctcatgaagcagctactgtattttgatcgctacacaaggttgttagctcccagcatgaacatgcttcgagatgagagaatcaacatctccaccgatcggcaacccagaagaacggatcgatttcaatgaggccacttcattaatcgttagcaatatactagagttcttttgtgattgggtgatattagcaagctcatgtaaccaagacactgtatatagttttgccaatagaaatggaccacacatgacacatcagaaaatcttgtacacttgttagtgtcagagaatttggcttataccatagcaactaggcagcatgttaaatatgtatgtatgtcacgatccagtagactgagtttttaaatatatatgctatactagtagagccagagtcaagttaagatgcagctgtactgcaggcaactgtcaacagagaaaatgattgtgcactgcaggtgtatcatgtgctaaacaaggtcggctaaagggcacaatgtttt

SEQ ID NO: 4777 - DNA, 2168 bp, Triticum aestivum
tttattttgagctaaagaacctaccagctacacgtatcgcacccttctcccatacaccccgttgaaggccagcaaacgcacgccgtgccccacgcttcatcacacttcacacctcacgcgcgtacgcttgtctagttcgtccccctcgccggcgacccagccatccactgatggcagcgacggcggccgctaggggcaccgcttctcgctcccctctcctcatccaccaccaccgactccctcaggttccagccggtgggggaggttcgctgagggtgggcgcgctcggggccggacgggattggagacgacgggtccgggtcggggttagggttttcgcgcgctactcctcccagccacaagacttctccagtcgactccaagatagagctggtgaattgccgaaattagtcgaggatcttctccagacgtcgattagcacagggcctcgaggtgcctttaggatggcacaagggatccaagctctccttggggttggtggggagtggctaaacgacttctcgaagacagctaacacatcagaaggaattccagctcagatgcgtcttggtttgctttcccctctttacctcagaaggctttttgaacgcatgggtgcaacttatatcaagctaggtcagttcatagcgtctgcaccgactttctttcctgcagaatatgttgaagaattccagaactgttttgaccgagcaccacctgttccttatagcgagatcgagtcgatattgcgtgaggagttgcagcggccattggatagtgtctatgagtacattgatcccgtgccaatagcatctgcttcaatagcacaggttcatggggctaggttgaagagctctcagaaggatgtggtgattaaagtcctgaaacctggaattgaagatactttggttgccgatctgaattttatctatcttgttgcacgtgttttggagtttctaagccctgaattagagaggacatcactggtagctatcatcaaggacataaaggaatcaatgcttgaggaagttgattttagaaaggaggctgtaaatatggaggctttccagagatacatcgaagcaatgggatttgataggcaggccaaatctccatttgtgtatcagcactgcagcacaaagcgtgtcttaactatggaaagattgtatggcgttccactcaccgatcttgattctataaggtctcttgttcctgatcctgagttgactttagtcactgccctcaatgtctggtttggaagcttgatctcatgtgaatccttccatgcggatgtgcatgcaggaaacctatggttacttcgtgatgggcgtgttgggtttattgattttggaattgttggtcgaatatccccaaggacttgggctgctatggagatctttttggcttctttcgcaactgaggattacaatgctatggcatcggccctttccgaaatgggtgctacagggaatgatatagatgttgactcctttgcaaaggacttgcaaaagatattctcgtcgctacaggagttggatactgaaattatagtggcagctgcaagaagttctgatgctacagctgtatctgctaatgttgttgtagacgagaggcagatgaatgcactgtttcttgatctggtaagggttagcgagtcatatgggctgagatttcctagggaattcgctcttctcatgaagcagcttctttattttgatcggtacacgaggctgctggctcccagcatgaacatgctgcgagatgagaggattaacattacttccaacaagcagaccagaagaatgaattgattctatcttccatcatttgaggaattggtgcaagacctggacaagtgacgtgagttgtgacaagcgtatgtaaccatgctagaactgtatataatttaatacgaccagcataaaagtgaatcacgtaagaggaaacataacactggctcctgttgtggaacttaaggcatcttggagcggaaattgcttttggatctcgggctccatggagactggaatttgaaaattataaaattataattttcaagttttcaaaagttctgaatatatacacacctacaatgggatgtatactactgctctgttcacttatgtaaaacgtttttgacgtccatgtacaaaatcaggcacgtaatg

SEQ ID NO: 4778 - DNA, 2004 bp, Triticum aestivum
gttgaaagccagcaaacgcgcgccgtgccccacgcttcatgacacttcacacctcacgcgcgtacgcctgtgtgcttcgtccccctcgccggcgacccacccatccactgatggcagcgacggccgccgctaggggcgccgcttctcgctcccctctcctcctccaccaccaccgactccctcaggttccagccggtgggggaggttcgctgagggtgggcgcgctcggggcaggacgggattggagacgacgggtccgggttcgggtcggggttagggttttcgcgcgctactcctcccagtcacaagacttctccagtcgactccaagatagagctggcgaattgccgaaattagtcgaggatcttctccagacgtcgattagcacagggcctcgaggtgcctttaggatggcgcaagggatccaagctctccttggggttggtggggagtggctaaacgacttctcgaagacagctaacacgtcagaaggaattccagctcagatgcggcttggtttgctttcccctctttatctcagaaggctttttgaacgcatgggtgcaacttatataaagctaggtcagttcatagcgtctgcaccaactttctttcctgcagaatatgttgaagaattccagaactgttttgaccgagcaccacctgttccttatagcgagatcgagtcgatattgcatgaggagttgcagcggccattggatagtgtttatgagtacattgatcccgtgccaatagcatctgcttcaatagcacaggttcatggggctaggttgaagagctctcagaaggatgtggtaattaaagtcctgaaacctggaattgaagatactttggttgccgatctgaattttatctatcttgttgcacgtgttttggagtttctaagccctgaattagagaggacatcactggtagctatcatcaaggacataaaggaatcaatgcttgaggaagttgattttagaaaggaggctgtaaatatggaggctttccagagatacatcgaagcaatgggatttgataggcaggccaaatctccatttgtatatcaccactgtagcacaaagcgtgtcttaactatggaaagattgtatggtgttccactcaccgatcttgattctataaggtctcttgttcctgatcctgagttgactttagtcactgcgctcaatgtctggtttggaagcttgatctcatgtgaatccttccatgcggatgtgcatgcaggaaacctatggttgcttcgtgatggacgtgttggatttattgattttggaattgttggtcgaatatccccaaggacttgggctgctatggagatctttttggcttctttcgcaactgaggattacaatgctatggcatcagccctttccgaaatgggtgctacagggaatgatatagatgttgactcctttgcaaaggacttgcaaaagatattctcatcgttacaggagctggacactgaaattatagtggcagctgcaagaagttctgatgctacagctgtatctgctaatgttgttgtagacgagaggcagatgaatgcactgtttcttgatctggtaagggttagcgagtcatatgggctgaaatttcctagggaattcgctcttctcatgaagcagcttctttattttgaccggtacacaagactgctggctcccagcatgaacatgctgcgagatgagaggattaacattacttccaacaagcagacaagaagaatgaattgattctatcttccatcatcggaggaattggtgcaagacatggacaagtgacattgtgagttgtgacaagcttatgtaaccatgctagaactgtatataatttaatacgaccagcatagaagtgaatcatctagatgagatatagtttggtctcattcaccttttatagccattggatgtgatgctataagatgcgtgtgtgctgacgtgggttgttttgtttcgttttcaaggtgaatgagaccaaatt

SEQ ID NO: 4779 - DNA, 2059 bp, Triticum aestivum
gttgaaagccagcaaacgcgcgccgtgccccacgcttcatgacacttcacacctcacgcgcgtacgcttgtctagttcgtccccctcgccggcgacccacccatccattgatggcagcgacggcggtcgtgggcgccgcttctcgctcccgtctcctcctccaccaccaccgactccctcaggttccagccggtgggggaggttcgctgagggtgggcgcgctcggggccggacgggattggagacgacgggtccgggtcggggttagggttttcgcgcgctactcctcccagccacaagacttctctagtcgactccaagatagagctggtgaattgccgaaattagtagaggatcttctccagacgtcgattagcacagggcctcgaggtgcctttaggatggcgcaagggatccaagctctccttggggttggtggggagtggctaaacgacttctcgaagacagctaacacgtcagaaggaattccagctcagatgcggcttggtttgctttcccctctttacctcagaaggctttttgaacgcatgggtgcaacttatatcaagctaggtcagttcatagcgtctgcaccaacttcctttcctgcagaatatgttgaagaattccagaactgttttgaccgagcaccacctgttccttatagcgagatcgagtcgatattgcgtgaggagttgcagcggccattggatagtgtctatgagtacattgatcccgtgccaatagcatctgcttcaatagcacaggttcatggggctagattgaagagctctcagaaggatgtggtgattaaagtcctgaaacctggaattgaagatactttggttgccgatctgaattttatctatcttgttgcacgtgttttggagtttctaagccctgaattagagaggacatcactggtagctatcatcaaggacataaaggaatcaatgcttgaggaagttgattttagaaaggaagctgtaaatatggaggctttccagagatacatcgaagcaatgggatttgataggcaggccaaatctccatttgtgtatcagcactgtagcacaaagcgtgtcttaactatggaaagattgtatggtgttccactcaccgatcttgattctataaggtctcttgttcctgatcctgagttgactttagtcactgccctcaatgtctggtttggaagcttgatctcatgtgaatccttccatgcggatgtgcatgcaggaaacctatggttgcttcgtgatggacgtgttggatttatcgattttggaattgttggtcgaatatccccaaggacttgggctgctatggagatctttttggcttctttcgcaactgaggattacaatgctatggcatcggccctttccgaaatgggtgctacagggaatgatatagatgttgactcctttgcaaaggacttgcaaaatatattctcatcgctacaggagttggatactgaaattatagtggcagctgcaagaagttctgatgctgcagctgtatctgctaatgttgttgtagacgagaggcagatgaatgcactgtttcttgatctggtaagggttagcgagtcatatgggctgaaatttcctagggaattcgctcttctcatgaagcaacttctttattttgatcggtacactagactgctggctcccagcatgaacatgctgcgagatgagaggattaacattacttccaacaagcacaccagaagaatgaattgattctatcttccatcatttgaggaattggtgcaagacatggacaagtgatattgtgagttgtgacaagcttatgcaaccattctagaactgtgtataatttaatacgaccagcatagaagtgaatcacgtgaggggaaacataacactggctcctgttgtggaacttaggcatcttggagcggaaattgcttttggatctcgggctacatgtagactggaatttgaaaattataaaatcataattttcaagttttaaaaagttctgaatatatatacacctacaatgggatgtatactactgctcagtcact

SEQ ID NO: 4780 - DNA, 2071 bp, Triticum aestivum
acttcacacctcacgcgcgtacgcttgtctagttcgtccccctcgccggcgacccacccatccattgatggcagcgacggcggtcgtgggcgccgcttctcgctcccgtctcctcctccaccaccaccgactccctcaggttccagccggtgggggaggttcgctgagggtgggcgcgctcggggccggacgggattggagacgacgggtccgggtcggggttagggttttcgcgcgctactcctcccagccacaagacttctctagtcgactccaagatagagctggtgaattgccgaaattagtagaggatcttctccagacgtcgattagcacagggcctcgaggtgcctttaggatggcgcaagggatccaagctctccttggggttggtggggagtggctaaatgacttctcgaagacagctaacacgtcagaaggaattccagctcagatgcgtcttggtttgctttcccctctttacctcagaaggctttttgaacgcatgggtgcaacttatatcaagctaggtcagttcatagcgtctgcaccaacttcctttcctgcagaatatgttgaagaattccagaactgttttgaccgagcaccacctgttccttatagcgagatcgagtcgatattgcgtgaggagttgcagcggccattggatagtgtctatgagtacattgatcccgtgccaatagcatctgcttcaatagcacaggttcatggggctagattgaagagctctcagaaggatgtggtgattaaagtcctgaaacctggaattgaagatactttggttgccgatctgaattttatctatcttgttgcacgtgttttggagtttctaagccctgaattagagaggacatcactggtagctatcatcaaggacataaaggaatcaatgcttgaggaagttgattttagaaaggaagctgtaaatatggaggctttccagagatacatcgaagcaatgggatttgataggcaggccaaatctccatttgtgtatcagcactgtagcacaaagcgtgtcttaactatggaaagattgtatggtgttccactcaccgatcttgattctataaggtctcttgttcctgatcctgagttgactttagtcactgccctcaatgtctggtttggaagcttgatctcatgtgaatccttccatgcggatgtgcatgcaggaaacctatggttgcttcgtgatggacgtgttggatttatcgattttggaattgttggtcgaatatccccaaggacttgggctgctatggagatctttttggcttctttcgcaactgaggattacaatgctatggcatcggccctttccgaaatgggtgctacagggaatgatatagatgttgactcctttgcaaaggacttgcaaaatatattctcatcgctacaggagttggatactgaaattatagtggcagctgcaagaagttctgatgctgcagctgtatctgctaatgttgttgtagacgagaggcagatgaatgcactgtttcttgatctggtaagggttagcgagtcatatgggctgaaatttcctagggaattcgctcttctcatgaagcaacttctttattttgatcggtacactagactgctggctcccagcatgaacatgctgcgagatgagaggattaacattacttccaacaagcacaccagaagaatgaattgattctatcttccatcatttgaggaattggtgcaagacatggacaagtgatattgtgagttgtgacaagcttatgcaaccattctagaactgtgtataatttaatacgaccagcatagaagtgaatcacgtgaggggaaacataacactggctcctgttgtggaacttaggcatcttggagcggaaattgcttttggatctcgggctacatgtagactggaatttgaaaattataaaatcataattttcaagttttaaaaagttctgaatatatatacacctacaatgggatgtatactactgctcagttcacttgtatacactgatataagacgtttttcacgtccatgtacaaaatcaggcacgac

SEQ ID NO: 4781 - DNA, 1954 bp, Hordeum vulgare
cccacgcttcatcacacttcacgcatcacactcgtacgcttgtctacttcgtccccctcaccggcgacccacccatccactgatggcggcgacggcggccgctaggggcgccgcttctcgctcccctctcctcctccaccaccaccaccgactccctcaggttccatccggtgggggaggttcgctgagggtgggcgcgctcggggccggacgggataggagacgacgggtccggggaggggttagggttttcgcgcgctactcctcccaggcacaagacttctctagtcgactccaagatagagctggcgaattgccgaaattagttgaggatcttctccagacgtcgattagcacagggcctcgaggtgtctttaggatggggcaagggatccaagttctccttggggttggtggggagtggctaaacgacttctcgaagacagctaacacatcagaaggaattccagctcagatgcggctcggtttgctttctcctctttacctcagaaggctttttgaacgcatgggtgcaacttatatcaagctaggtcagttcatagcatctgcaccaactttctttcctgcagaatatgttgaagaattccagaactgttttgaccgagcaccacctgttccttatagtgagatcgagtcgatattgcgcgaggagttgcagcggccattggatagtgtatatgagtacattgatcccgtgccaatagcatctgcttcaatagcacaggttcatggggctaggttgaagagctctcagaaggatgtggtcattaaagtcctgaagcctggaattgaagatactttggtcgccgatctgaactttatctatctcgttgcacgtgttttggagtttctaagccctgaattagagaggacatcactggtagctatcatcaaggacataaaggaatcaatgcttgaggaagttgattttagaaaggaggctgtaaatatggaagctttccaaagatacatcgaagcaatgggatttgataagcaggcgaaatctccatttgtgtatcagcactgtagcacaaagcgtgtcttaactatggaaagattgtatggtgttccactcaccgatcttgattctataaggtctcttgttcctgatcctgagttgactttagtcactgccctcaatgtctggtttggaagcttgatttcatgtgaatccttccatgcggatgtgcatgcaggaaacctatggttgcttcgtgatggacgtgttggatttattgattttggaattgttggtcgaatatcctcaaggacatgggctgctatggagatctttttggcttctttcgcaactgaggattacaatgctatggcatcggccctttccgaaatgggtgctacagggaatgatatagatgttgactcctttgcaaaggacttgcaaaagatattctcatcgctacaggagttggatactgaaattatagtggcagctgcaagaagttctgatgctacagctgtatccgctaatgttgttgtagacgagaggcagatgaatgcactgtttcttgatctggtaagggttagcgagtcatacgggctgaaatttcctagggaattcgctcttctcatgaagcagcttctttattttgatcggtacacgagactgctggctcccagcatgaacatgctgagagatgagaggattaacatcacttccagcaagcagaccagagaatgaattggttctagtgtccatcatttgaggaattgttgcaagacatggacaagtgacattgtgacaagcttatgtaaccatgctagaactgtatataatttcatacgaccagcatagaagtgaaccacgtaagagcagacataacactggctcctgttgtggaacttaggcatcttggagcagaaattgcttttggatgtcggcctccattgagccaggaatttgaaaaatataaaa

SEQ ID NO: 4782 - DNA, 2081 bp, Hordeum vulgare
gttgaaggccaacaaacgcacgccgtgccccacgcttcatcacacttcacgcatcacactcgtacgcttgtctacttcgtccccctcaccggcgacccacccatccactgatggcggcgacggcggccgctaggggcgccgcttctcgctcccctctcctcctccaccaccaccaccgactccctcaggttccatccggtgggggaggttcgctgagggtgggcgcgctcggggccggacgggataggagacgacgggtccggggaggggttagggttttcgcgcgctactcctcccaggcacaagacttctctagtcgactccaagatagagctggcgaattgccgaaattagttgaggatcttctccagacgtcgattagcacagggcctcgaggtgtctttaggatggggcaagggatccaagttctccttggggttggtggggagtggctaaacgacttctcgaagacagctaacacatcagaaggaattccagctcagatgcggctcggtttgctttctcctctttacctcagaaggctttttgaacgcatgggtgcaacttatatcaagctaggtcagttcatagcatctgcaccaactttctttcctgcagaatatgttgaagaattccagaactgttttgaccgagcaccacctgttccttatagtgagatcgagtcgatattgcgcgaggagttgcagcggccattggatagtgtatatgagtacattgatcccgtgccaatagcatctgcttcaatagcacaggttcatggggctaggttgaagagctctcagaaggatgtggtcattaaagtcctgaagcctggaattgaagatactttggtcgccgatctgaactttatctatctcgttgcacgtgttttggagtttctaagccctgaattagagaggacatcactggtagctatcatcaaggacataaaggaatcaatgcttgaggaagttgattttagaaaggaggctgtaaatatggaagctttccaaagatacatcgaagcaatgggatttgataagcaggcgaaatctccatttgtgtatcagcactgtagcacaaagcgtgtcttaactatggaaagattgtatggtgttccactcaccgatcttgattctataaggtctcttgttcctgatcctgagttgactttagtcactgccctcaatgtctggtttggaagcttgatttcatgtgaatccttccatgcggatgtgcatgcaggaaacctatggttgcttcgtgatggacgtgttggatttattgattttggaattgttggtcgaatatcctcaaggacatgggctgctatggagatctttttggcttctttcgcaactgaggattacaatgctatggcatcggccctttccgaaatgggtgctacagggaatgatatagatgttgactcctttgcaaaggacttgcaaaagatattctcatcgctacaggagttggatactgaaattatagtggcagctgcaagaagttctgatgctacagctgtatccgctaatgttgttgtagacgagaggcagatgaatgcactgtttcttgatctggtaagggttagcgagtcatacgggctgaaatttcctagggaattcgctcttctcatgaagcagcttctttattttgatcggtacacgagactgctggctcccagcatgaacatgctgagagatgagaggattaacatcacttccagcaagcagaccagagaatgaattggttctagtgtccatcatttgaggaattgttgcaagacatggacaagtgacattgtgacaagcttatgtaaccatgctagaactgtatataatttcatacgaccagcatagaagtgaaccacgtaagagcagacataacactggctcctgttgtggaacttaggcatcttggagcagaaattgcttttggatgtcggcctccattgagccaggaatttgaaaaatataaaatcatactccctccgtctcaaaataagtgtcgtagatttaatagtaaacatttctgcttcggtacaccttcactaaacatatcaagggcttagattaaac

SEQ ID NO: 4783 - DNA, 2028 bp, Secale cereale
cttctcccatacaccccgttgaaggccagcaaacgcgcgtagtctacttcggccccctcgccggtgacccacacatccaccgatggcagcgacggcggccgctaggggcgtcgcttctcgctcccctctcctcctccaccaccaccgactccctcaggttccagccggtgggggaggttcgctgagggtgggcgcgctcggggccggacgggattggagacgacgggtccgggtcggggttagggttttcgcgcgctactcctcccagccacaagacttcaccagtcgactccaagatagggctggtgaattgccgaaattagtcgaggatcttctccagacgtcgattagcacagggcctcgaggtgcctttaggatggcgcaagggatccaatctctccttggggttggtggggagtggctaaatgacttttcgaagacagctaacacgtcagaaggaattccagttcagatgcggcttggtttgctttctcctctttacctcagaaggctttttgaacgcatgggtgcaacttatatcaagctaggtcagttcatagcgtctgcaccaactttctttcctgcagaatatgtcgaagaattccagaactgttttgaccgagcgccacctgttccttatagcgagatcgagtcgatattgcgtgaggagttgcagcagccattggatagtgtctatgagtacattgatccggtgccaatagcatctgcttcaatagcacaggttcatggggctaggttgaagagctctcagaaggatgtggtgattaaagtcctgaaacctggaattgaagatactttggttgccgatctgaattttatctatcttgttgcacgtgttttggagtttctaagccctgaattagagaggacatcactggtatctatcatcaaggacataaaggaatcaatgcttgaggaagttgattttagaaaggaggctgtaaatatggaggctttccagagatacatcgaagcaatgggatttgataggcaggccaaatctccatttgtgtatcagcactgtagcacaaagcgtgtcttaactatggaaagattgtatggtgttccactcaccgatcttgattctataaggtctcttgttcctgatcctgagttgactttagtcactgccctcaatgtctggtttggaagcttgatctcatgtgaatccttccatgcggatgtgcatgcaggaaacctatggttgcttcgtgatggacgtgttggatttattgattttggaattgttggtcgaatatccccaaggacttgggctgctatggagatctttttgtcttccttcgcaactgaggattacaatgctatggcattggccctttccgaaatgggtgctacagggaatgatatcaatgttgactcctttgcaaaggacttgcaaaagatattctcatctctacaggagttggatactgaaattatagtggcagctgcaagaagttctgatgctgcagctgtatctgctaatgttgttgtagacgagaggcagatgaatgcactgtttcttgatctggtaagggttagcgagtcatatgggttgaaatttcctagggaattcgctcttctcgtgaagcagcttctttattttgatcggtacacgagactgctggctcccagcatgaacatgctgcaagatgagaggattaacatgacttccaacaaacagaccagaagaatgaattgattctatcttccatcatttgaggaattggtgcaagacatggacaagtgacattgtgagttgtgacaagcttatgtaaccatgctagaactgtacataatttaatacgaccagcatagaagtgaatcatgtaagaggaaacataacaccggctcctgttgtggaacttaaggcatcttggagcggaaattgcttatcttggagcggaaattgcttttggaatatgtgttcttgatccgatcttgcaagttgtagacacctattacatgttatgatccgcatactccaagatgataataattgggatt

SEQ ID NO: 4784 - DNA, 4927 bp, Brachypodium distachyon
aggctcgggacctgggacttccacgcttcttcccccacttcacacatctcgcgcgctcgctccccaagtcgaggaggccactccagcaaggtccaaaatccaaaccccgatagccgccgtcttcgccggcgagcagccgcccacccacccatcccgcgtcaccgatggcggccgcgcggggcgccgccttgtcacggcccaccatcctcctcctccagcagcaccaccgcagcctccaccaggttccagccgtcgggggaggcttgctgagggtgggcgccggacgacgacgggtccgggccgcaggggttagggttcgcgcgcgctactcctcctcctccccctcccaggcccaaccccaggacttccccagtcgcctccaagatagagctggtgaattgcctaaattggtcgaggatcttctccagacgtcgattagcacggggcctcgaggtgcctttaggatggcgcaagggatccaggctgtccttggggttggtggggagtggctaaatgacttctcaaagacagctaacacatcagccggaattccagctcagatgcggcttggtttgctttctcctctttacctcagaaggctttttgaacgcatgggtgcaacttatatcaagcttggtcagttcatagcgtctgcaccaactttcttccctgcagaatatgttgaagaattccagaactgctttgaccgagcaccagctgttccatatagtgagattgagtcaatattgcgtgaggagttgcagcggccattggatagtgtatatgaatacatcgatcccgtgccaatagcctctgcttcaatagcacaggttcatgcggctaggttgaagagctctcagaaggatgtggtcattaaagtcttaaagcctggtattgaagatactttggttgccgatctgaattttatctatgtcgttgcacgtgttttggagtttttaaaccctgaattagagaggacatcactggtagctatcatcaaagatataaaggaatcgatgcttgaagaagttgattttagaaaagaggctgtaaatatcgaggctttccagagatacctagaagcaatgggatttgataggcaggccaaagctccatttgtgtatcaacactgtagcacaaagcgtgtcttaactttggaaagattgtatggagttccgctcactgaccttgattctataaggtctcttgttcctgatcctgagttgactttagttactgcactcaatgtctggtttggaagcttgatctcgtgtgaatccttccatgctgatgtgcatgcaggaaacctatggttgcttcgtgatggacgtgttggatttattgattttggaattgttggtagaatatccccaaggacttgggctgctatggagatctttctggcttctttcgcgacggaggattacaatgctatggcatccgccctttctgaaatgggagctacagggactgatatagatgttgactcttttgcaagggacttacaaaagatattctcatcaatacaggagttggatactgaaatcatagtcgcaacagcaagaggttctgacgctacagctgtatctgctaatgttgttgtagacgagaggcagatgaatgcactgtttcttgatctggtgagggtcagtgagtcgtatgggctgaaatttccccgggagtttgctcttctcatgaagcagcttctgtatttcgaccggtacacaagactgctggctcccagcatgaacatgctgcgggatgagaggattaacatcaccacgaaccagcagaccagaagaatggactgaacattccagtgtccatcatttgaggatagctctaatacagggacatgtatacaagctagaatttgtataaattcttaaaaccagcatagaagtgaatcacgtacaagaaaaccttgtaccaattgctcctgttagtagtggaactcgggcaattgatactgccagtttgggaaaatgtaaagctgtacgttgatatgatgttaattgaagtaaaactggctagagtgaactgttgatgtcctagatttggttcaactgtaattcgtgttgggttccatgtggcatgtgttgtgcagaatttaccatgatttccttatctactataaggacataacaggttgatttccatgcttgcctaacagatacatcggcagcttactaaattcaaccgctgcatcatagtaatctgaagttttgatagctacaaatatatacagacctcccaacacgctgggggtttcagacaagaaagaggaatagcttaaggcgtcatgtcactcgcacttatcccatcaactaatctagcctcaaaagaagaatcattcagttccagaaggctgagtgctttgccgcgctgcagctccatcatcaccatcgcaagtttctttgcagtctctttcctgacgagcagggttatcctgatggcactcgagttccggcacacaagttgcttggctgttctcagtttcagaaagttgcactatttgtgtggcttcagtttctttgtcgccatcagaagcttgtgtagctgtaattccttcattgccatcaggagattctctgtgttcgttttcctcgtgagcaggactatcctggcggtgattaggttcctgcacacaagtcacttgactgttctcagtttcagaaggttgcgtgatctgcgtcgctgcagtttcttcgtccccatcagaaccttgcattgctgtggttccttcatcaccgttgcaagtgtctctgcactctccttcctggcaagtcgatcgaccgttgtcagtttcagaaggttgaatgatctgcgtagctgtggcagcttcatcttcatccaatgctcctccagactttcttttcttgcaagcaggactgtcctgatcactatctacatcaatgggaacttcatcaccatcacctgacacagctagagactgactaattacaaatgcaccatttgtaatgttggtttccagaacaccgcatcctctgggctcactggttgcctggggatccttgaaagctgatgtatttggagaactgcgattggcagcgccaaacaatgcatctaactgtgttctaacagaaacagccactgctattgcatggtcagaaaccacagagtcactcggtgggcaatgaacgacattagccagtgcctggtaatagcgaagtagggccaaggatggtggtgccaatcccctgtcacggcaaaccttagccgacttcattgcatgtttgcaaaggtttcccttccttgaccagctacaatcgcacaacgcaagctcagaacctgggttcagtatggcatgtgacttctccttgtctttctggcagatcactctagcacaattgccttcgatgacaatgtcagaatctggaatttgcattccctgctgccactggtttgggccatttttccactcactcctccagtaacgagaaaagctgtccttcccagaaaattcatccaaccagtagtaagaatgaactgttgtacccaacttatgtaccaaccaatctgcacgttggtagatgctttcatctgcctcattcaacagccggagttttagcaggtgacggtaactctcaattgctgatgctacctcggcagtagccaatggggtggccttcaagacagttgtccacgcccctgcaagacattgagcagttggcagtaacagattaaacagtcgaatgagagaactcataaaacaccctctaacaagtaaaatccagatatggcaagtaaatcagggtacatgaaagggatatggaccaaccaagtcttggaaaccatatagctttgaagtagtccaaaaagccagagcaatcaacaaaatcttccaggaaggcttgaaataactccatatcaccatttcctccgcagatactggatattacctctccaagtcgtttagccaacattgaacgcttctcaaaatctgaacacttgttcatcagatttttatgccaagcgtgccggacacgccataaggtaatcaacaccgggcattgaaacacttccctgttcagcatgctacagactcaggcaacacaaccctggggaagagtacactaatagagaggcatcagttaccttatagtgcgcacatcggttaagggatcatcaataatgaagccacccaattgccatgtcggatcttttgagcgaactcgatcataaagagcacccatccatctatatatttcaccatgtgtaaaactgggagttatgatccaagcaacaggaattgcatttttctgctggtcgaaaacaaggatgctatgtacaggatactgcaaaatggtgaacaacaatgctactatgaaaacaaatcaaactttgagatactacaaaaacaagaatgcaagagaaatgacattgacaaacctttaacttgtttgttccaaactttgaatcggaagccagtaaactgcggttaccatactgaatcatctgctgtagctgccaatctgtctgaatgcccaagacaaaagcatccttatctgagaaatcttcatagaaaaatgtatactcctggtgattttcaatccacatgttaatactaacagcatcgtcatcatcaagttcataaacagaacgccgtattttcctttccagcctcctaacatatctgtgagtaagaagatcatcacgatttgatggtcctccttgcctttcaaccatttcattatgtctctgcattatagtctcgacaggaataccaacatggagtaaagacataacttcaagatgtaattcatcagatatgtaaggtgcaaacattgctttcgtccctatagccatcttgtccatgggaccatgacagggtgtgcctttcttatctacatgcttattgtggttatatatcacaagagccaatgatggttcagcaatcaaacgc

SEQ ID NO: 4785 - DNA, 2217 bp, Panicum virgatum
tgcctaaattggtggaggaccttctccagacgtcgattagcacagggccctgaggtgcgttcaggatggcgcaagggatccaagctgtgcttggggttggtggggagtggctgaatgacctctcaaagactgctaacgcatcagcaggtattccagctcagatgcagcttggtttgctttctcctctttaccttaggaggctttttgagcgcatgggtgcaacttatatcaagctaggccagttcatagcatctgcaccaactttgtttcctgcagaatacgtcgaggaattccagaactgctttgaccgagcaccagctgtaccttatgatgtgattcagtcaatattgcgtgaggagttgcagcgaccattggatagtatatatgaatacatcgacccggtgccaatagcttctgcctcaatagcacaggttcatggggctaggttgaagagctctcagaaggatgtggtgattaaagttctaaagcctggcattgaagatactttggttgctgatctgaattttatctatgtcgttgcacgagttttggaattcttgaaccctgagctacagaggacatcactggtaggcattgtcaaggatataaaggaatcaatgcttgaagaagttgattttagaaaagaggctgcaaatattcaggcttttcagggatacatagatgctatgggatttgacaggcaggcaaaagccccatttgtgtatcagcactgtagcacaaaacgtgtgttgactatggaaaggttgtatggagttccgcttactgatcttgattctataagatctcttgttccggatcctgagttgactttagtcactgcccttaatgtctggtttggaagcttgatttcatgtgaatccttccatgccgatgtgcatgctgggaacttatggttgctccgtgatgggcgaattggtttcattgatttcggtattgttggtcgcatatctccaaggacttgggctgctatggaggtctttttggcttcttttgcaactgaggactatgatgctatggcctctgccctttctgaaatgggtgctacagggaatgatataaatattgatgaatttgcaaaggacctgcgaaagatattctcatcaatacaggacttggatactgaaatcatagtcgcaacagcaagaggtcctgatgctacagcagtatctgctaatgttgtccttgatgagagacagatgaatgctctatttcttgatctggtgagggtcagtgagtcctatgggctgaaatttcctcgggaatttgctcttctcatgaagcagctactgtattttgatcgctacacaaggttgttggctcccagcatgaacatgcttcgagatgagagaatcaacatctcgaccaaccgacaacccagaagaacagatcggtttcaatgaggccacttcattaataattagcaatatagtagaggggtgataatagcaagcttatgtgaccaaaacactgtatatagttttgccagagcagcatagaaatgaaccacacccaagaaatcttgtacacttgttcttgtatccggggttatgccatagtgactaggcaacatgtaaaatatgtttgttacgatccactagactgaactcccttgttcctggtcgaggggagtcaggttaagatgtggctgtactgtactgctactgtcaacagagtaagtgatgatgtatctttgtaaaagcccaacggtgcaggtgtatcatgtgctaaagggcaccgtgttttgttgcattttctcagggtcacaacgttctttggggattcaactaggattgtacggcgtaaagtgactttctggtcccttcactgctgtggcatgcgtaacagggttccgtgacattgactcggaaaatatcagctcaggttcgagcttcgaataaataccagaattcacattttacattcgtgtggttgcgtttctcagttttagatttcaagaaccaacctgtcattttcgatttttcgttgtgtccccagcagaactcgtatgatggcttgttttacagtgactgtaggatatctgaatgcaggtgacgacatgaaaattatttgacatcttcataagaaaatagtataaccctaatcctagaggcagagccaaggttggaagagactccgggctttgttaggtcctaccgtcctagacaaataaaatggtggttgaagcctaggctttgt

SEQ ID NO: 4786 - DNA, 1966 bp, Avena sativa
caaagtcgaggaccactccaagcctactaccgtgcctcgtccccgtcaccggcgagccaccccactcacccagcgatggcagccgctaggggtgccgcgtctcggtcccctatcctccttcgccattacctcccccaggtgccagccgccgtgggaggctctctcggggccagacgggataggagacggcgggtccggggcggggttagggttttctcgcgctactcctctcaggcacaagatttctccagtcgcgtccaagatagagctggtgagttgacgaaattagttgaggatcttctccagacgtctattagcacagggcctcgaggtgcatataggatggtgcagggggtccaagctatccttggggttggtggggagtggctaaatgaattctcaaaggaagctaacacatcagaaggaattccagctcagatgcgacttggtttgctttctcctctttacctcagaaggttttttgaacgcatgggtgcaacttatatcaagctaggtcagttcatagcatctgcaccatctttttttcctccagaatatgttgaagaatttcagaactgctttgaccgagcaccacctgttccatataatgagattgagtcgatattgcttgaggagttgcagcggccattggatagtctatatgagtacattgatcccgtgccaatagcctctgcttcaatagcacaggttcatggggctagttgaagagctctcagaaagatgttgtgattaaagtcctaaagcctggtattgaggatactttggtcgccgatctgaattttatctatgttgttgcacgagttttggagtttctaagccctgaactagagaggacttcactcgttgctatcatcaaggatataaaggaatcaatgcttgaagaagttgattttagaaaagaggctgtaaatatggaggctttccagagatacatcaatgcaatgggatttgataggcaggccaagtctccatttgtgtaccggcactgtagcacaaagcgtgtcttaactatggaaagattgtatggcgttccactgactgatcttgattctataaggtctcttgttcctgatcctgagttgactttagtcactgccctcaatgtctggtttggaagcttgatttcatgtgaatccttccatgcagatgtgcatgcaggaaatctatggttgcttcgtgatggacgtgttggatttattgattttggaattgtgggccgaatatccccaagaacttgggctgctatggagatctttttggcttctttcgcaactgaggattacaaggctatggcatctgccctttccgaaatgggtgctacagggaatgatatagatattgatgcttttaccaaggacttacaaaagatattctcatcactacaggagttggatagtgaaatcatagtcgcaacagcaagaagttctgatgctacagctgtatcagctagtgttgttgtagacgagaggcagatgaatgcaatgtttcttgatctggtgcggattagtgagtcatatgggctgaaatttcccagggaattcgctctactcatgaagcagcttctttatttcgatcggtacacgagattgctggctcccagcatgaacatgctgcgagacgagagaatcaacatcacctccaacaaacagaccagaacaatcgattgattccagtgtccatcatttgaggaattgattgcaacatattgacaagatcatgtaaccatgctatagctgtatataattccgtacgaccagcatagaagtgaaccacgtatgaggaaacactgtatacttactccagttgttcaactcgggcatctttggctaccgactaggatacttgtaaagctgcaaaaaagaagaagaaaaacaaagtaggaagcctgtaaaactgagtcaatgtcccagcttgcttcagttacagcagaaacagctgttttata

SEQ ID NO: 4787 - DNA, 2359 bp, Zea mays
gccgcgcatcgtgccgcggtgccgccgccgccgttgcctgaattggcaaaaccaacgagcagtcagagcggaagccgccgcggcgcccgccaccaaagccaatggagcccgcgctgcgcgagctgtgggcggagtcccgggacctgttgggcctcccttcctcttctcaggacgccaccgccgtgccgcgcgtcagcctgcccccgacgccgctcgcgttcctccgcgaccacgtctccccgggccgcccgctcctcgtctccgccgcggccactcgccactggcccgccgcgtcgctctggcccaccgcctcctacctcaccgacgcactccgctccaccgccgtctccctccacctcacccccgacgggcgcgccgatgcgcttgcctcgcacccgcacccacggcgacccgggtcctcgaggtgctttgcgtccgcgcacgtccgccgtgtcgacttccctaccgcggtccggcttatcaggggatccgacccggccgccggcctggtagcgtacgcgcagcagcaggacgactgcctccgcggggagtacgcggcggtcgccggtgacgtggacgcgcacgtgccgtgggccaccgaggcgctcggctgcctccccgaggccgtcaacctctggataggcaacgcccactccgtcacctccttccacaaggaccactacgacaacatttacgtcgttctgtccggcgagaagcacttcctcctgctgccccccaccgagcaccaccgtctctacgtccgcgactaccccgccgcccgctacgttgccacggagcagagctccgagggggggcgccagttgaggcttaagctggagatggaagtgcccgagaggatcgttccctggagcagcgtcgacccgtgcccggcgtcgcccgaggagttggccgtgcaggcgtcgtcgtttccgctctactttgacgggccggcgccgatacggtgcacggtccgggccggcgagatgctctacctgccaagcatgtggtttcaccatgtcagccagagtccagggccgaacgggctcaccattgccgtgaactactggtacgacatgcagtttgacatcaagtatgcttacttcaacttcttgaggtcgctggagatcaatggttgttcatcgggcaaacctgatgcttcggaaggtgatctagaggagaagaaagattgaggtggcggacagtgactttgattacccctggtttccgctgagcatcacgatgctgtgccgggctgggtttctcgcggccactgtctaacagagtaacagctcttcgagcataacgaggtgttgctagacacatggaaaccaattaatcggccatgtatgtttgcacaacgtttgcaggtgccaattggcctatcagacccaatgtggttgcaatgcattgtcaaagtttggtggcattcacagagaacatgaattttgttttgaattcagtccatgggttcctgatcgtctttgtttctagcgatgattcttgatatgctggaggcctgatttatagcttgtgcaaatcagcatcattcactggaaggatggattgtcctcgtagaaatctgaatgccagataaagaactgcgtggcgtggataaagaactttatcatcatgggtgagacgctacctttaaaggttggataaaattgaggtcggacagcgattaatccataaggttggaacttgaaaaccaagatgaggctatctagtcaagggagtctccggcgtggaagaagtgggagagggggcagagtttcacttctgtccatgtgttgatggtcagacttcgttgttgttgtgagttgtgacttgtgagagccggcacccataccaatctggttcctgtgcttgttatagtgtgcctttgcttatttgggtttcttccgtacggaagtacgaattccttgtatctttttgttaacaggtctcagagccattgtcaagtttttttagagaagctccatattcctgcggtggacacatgatgcagcactcggcagcatgtagccatatagtcttaagtccaaaactgatatttgatttcctttttctcctttgcaatcataaccgcgcaatcctgcatttttttcatttctcatgttcaaggacctgagaaatccgaagtatttgtgggctggttaacttgtgcgcagcattgcttaggacatgtttggatccaggaactaaagcaaactgaccttaggagctaaaagtgaataaaagcatatatttttactattttagtcacttttacctttggtcttttgcccctaaactccttggatctaaataggcccttactatgcgtggcagcactttcaagtatgtgccagctatgtcc

SEQ ID NO: 4788 - DNA, 1082 bp, Brachypodium distachyon
atggagcgcgcggtgcgggagctgtgggcggaatcacgcgacctgctgggcctccactctccggagtccgtgcagcgcgccgacctgcccccgaccccgctcgccttcctccgcgaccacgtctcccctggccgcccgctcctcgtctccgccgccgccacccgccactggcccgccgcctccctctggcccaccgagtcttacctcaccgacgcgctccgctccaccgacgtttccctccacctcacccccgacggccgcgccgacgccctcgcccctcatccgcgcctccccggcgccaggtgcttcgcgtccgcgtacgtccgccgggtcgacttccccactgccgtgcggctcatcaggggctccggcccggcggccgctggcggcctggtggcgtacgcgcagcagcaggacgactgcctgcgcggggagtacgcggcggtggccggcgacgtggacgcgcacgtgccctgggccagcgaggcgctcggctgcctcccggaggccgtcaacctctggatcggcaactcctgctccgtcacctccttccacaaggaccactacgacaacgtctacgccgtcctctccggcgagaagcatttcctcctcttgccccccaccgagcaccaccgcctctacgtccgcgactaccctgccgcccgctacgtcgcggagaacgaaggagaggaggagctgacggggcttaagctggagatggaagagcccgagaggatcgtgccgtggagcagcgtggacccgtacccggcgtcgccggaggagatggcagcacaggtctcatccttcccgctctacttcgaggggcccaggccgatacggtgcaccgtccgtgctggcgagatgctctacttgccgagcatgtggtttcaccatgtcagccagagccccgggcctaacgggctcaccattgctgtgaactactggtatgacatgcagtttgacatcaagtatgcgtactttaacttcctgaggtcactggagatcagtaattctccgctggacaacaaagatgctgccttggaaggtgatcttgaggagaagaacgattgagctgacgaggt

SEQ ID NO: 4789 - DNA, 2416 bp, Zea mays
cgactcccgctgatccaaatccattgagcgggagaacccgacatccaaaattccccaaaccccctcccaagtcccaaccctagccggctagcctccttccccttcagccttcacacctccgatttctcgcgccttcgtctcccgcccaatttccagaagcttctagaaccaggtttctaaccctaccgcagaatgatgctttcttgcgcctagtagcctggggcggaggcatggacggcggcggggaggggggctcgagcggcgggaggttccctattctgcaggcgaacagggaccccgagtcgaattgggaggtggacgttgccaagagcctcgaggattacctgctcaagatctgctcaggggaggtctccggcgaggacggggcccactctgtcaactttgccgaagcggcgttattactccaaggatcggttcaagtgtacagtaggaaggtggagtacttgtactcgttggtgcttcacgcgttagagttcctctcgcaaaagaaacaggaacaactggaaaatggctcagctcaagctaatcaaaacaaccctagcattattcccagtgaagaagatgatatatttattgggctagatgatgtcccagtggaaacaagaatatctctggataacaatgtcgatcgagatgatttacaaagaaaaattgtgaggccaccagcaaacctactggtgtttgaaggggactgtctggatagtgaagcaagcgagctagattcatatttgttagcaacatgtgatttttatggagatttccttctgctggatccttgtgatgcaccagctgtttttgactttctgcaaggaaaacattctggtaaagaaaatagtgtggctcatcaaggcagtgcagcaccttctaaaagccaagccaatattttcacttccccgaatgcaagatcagtgggcacaggtcgtaaatcagcccctggaaaagtcctaggaggtctagatccaactcaggagaaccaatcttcaactcaagaaaccagtccagataacaaacattggtctgatcctgttgaacctagctttgctgatgatgttgaaatgcatcccccagatgatatagaggaccctgttggagattattctgatgacgaggatccatggaaacctttgaatccacatgaacctggcaatttaaagattcggccttacaggagagtgaaaggttctccacggggtgttattggcatttcgaaaaagaaaactctcaaatcactgtttcctattgcaaagatggttggtgtcgtcatacctgaacatgctaaatcttttgaagcacagcagtctcaggaggaacattatggttcccaatcaccccctcgttttgaaaagtttttgagatcatttgaattaggagaagaaaatcccaatgtgtttggagatttgaaagatgacaatgcatccaatactggcattaattttgattatgatgacccagacatgccaaacgacatagatattgatcttgatgttccaacatgtcctgatgagattattgctataactcccaaaggtacacaggatgacatagatacacatgaaaacctcgacgacttgtgtcggtcacatctgaatgctctccttgccagcattgctgaggttgaaaagcagagtgagatggacgctcgtgtttcaacatggaaagaaagaattgagattgccttggaagagcaggatagaaacccaccttttgatatcggttcatatggggagcaaatacttgacacactttcatcaagaactaacaatacaggaactgcatcttttagtgagattgttagcggcagaccaaagtttgagattgccagaacgttctctgcccttctccagctggtgaacggcagaagtgttgatctggataaaggaaaagccacgaatgagttggtgtgttacacagcagagaatccatttcatgtaaggcttattggtcccaaccggaggccagaaatggaggcacgctttgctcggaagagagtcaagtccccactgcaaaatgcaggcaaagacggtgagtcctccctggcacaacatgagtgtcccaacaagccgttgcgtaaaaatggcaagattccagtcaagacagcgaccaggctgaccccagatgggaaacgaaggcgaaggtcatctgctcacctaatgcagccgatcaatctggaatccagcggatgaacgccagtgcacactgattcttctaattattgtaacttcagtggcggcttcataggcaggatgagcctgtaagttatgacataggcgtagctagcgggtgtatatgtacagttcaactgtaatgctgacagggcaagatttgttcaacggaattgcccttttatagcatttgccattgtttcatttttaatccaataagctaacacgatgcc

SEQ ID NO: 4790 - DNA, 2668 bp, Sorghum bicolor
aggaaaaacgaacttttgtgaaaaattagggaggagaagtagacttttttttttttttttaaaaaaaacgcacccgcgtctccactctccagtgctgccgacggcgcctcctcggctcctccctcaggccatccggcggcgcggcgggagctcctgggtgaggtcgtgaggacgccgcaccaccacgttcggccgctgctcaacacagctaccgcattccttaccgaacgcccgacgccgcggcggcgccgacctcctcccatgggcttctgctccctctctggcgccaccatccaacccacacacttctgctgccgaaccctctcccaaccctagccagctaagcgccccttcttccccttccccttcccctttgcacatccgattcctcgtgcctttgtcgcccgcccaatttccagaagcttatggaaccgggtttctagccctaatcccgcaagaagatgttttcttgcgcctagtagcgcgggacggaggcatggacggcggcggaggggaggtgggctcgaacagcgggaggttctcgattctgcaggcgaacagggaccccgagttgaattgggaggtggacgttgccaagagcctcgaggagtacctgctcaagatctgctcaggggaagtctccggcgaggacgggccccactctgtcaactttgccgaagcggcgttattactccaaggatcggttcaagtgtacaataggaaggttgagtacttgtactcgttggtgcttcacgcgttagagttcctttcgcaaaagaagcaggatcaactggaaaatggctcagctcaagctaatcaaaacgaccctagcacgattgccagtgaagaagatgatatatttatggggttagatgatgtcccagcggagtcaaggacaactctggataacaatgtcaatcgagatgatttacaaagaaaagttgtgaggccaccagcaaatctactggtgtttgaaggggactgtctggatagtgaagcgagtgagctagacacatatttgttagcaacatgtgatttttatggagatttccttctgctggatccttgtgatgcaccagctgtttttgactttctgcaaggtaaacattctggtaaagaaaatagtgtggctcatcaaggcagttcagcaccttctaaaagccgagccaatgttttcacttccccaaatgcaagatcagcgggcacaggtcgtaaattgtctgctggaaaagtcttagcaggtctagatccaacccagaagaatcctgaccaatcttcaactcaagaaaccactccagatgacgaccattggtctgatcctgttgaatctagctttgatgatgatgttggaatgcctcacccagctgatatagaggatcctgttggagattattctgatgatgaggatccatggaaacctttgaatccacatgaacctggcaacctaaagattcggccttaccgaagagtgaaaggttctccacgggtgtttttgagatcatttgaatttggagaagaaaatcccaatgtgtttggcgatttgaaagatgacgatggatcaaatactggccttaattttgataatgatgatccagacatgccaaatgacatagatgttgatcctgatgttccaacatatcctgacgagactattgctccaactcccaatggtacacaggatgacatagatacacatgcaagcctcgatgacttgtgtcggtcacatctgaatgctctccttgccagcatcgctgaggttgaaaagcagagtgagatggatgctcgagtttcaacatggaaagaaagaattgaggatgccttggaagagcaggataaaaacccaccttttgatatcggttcatatggggagcaaatccttgacacactttcatcaagaactgacaatacaggaactgcatcttttagtgagattgtcagtggtagaccaaagtatgaggttgccagaacattctctgcccttctccagctggtaaacggcagaagtgttgatctggacaaaggacaagccatgaatgagttggtgtgttacacagcagagaatccattccatgtaaagctcattggtcccaaccggaggccagaaatggaggcacgctttgctcggaagagagtcaaatccccactgcaaaatgcaggcaaaggtggtgagtcctccctgacacagcatgagtgccccaagaagccgttgcatagaaatggcaagagtccagtcaagacagcgaccaggctgactccagatggaaagcgaaggcgaaggtcagctgctcacctaatgcagccgatcaatctggaaggcagcggatgaacgccaacgggaaactaactcatgggcatctagaggctgattcttctaattgttgacttcagtggcggcttcataggcaggataggctgtgacctgacttaggcgtagctagcgggtgtacatgtacaatagttcattgtgctgttttgtatgtattggtatcagctctcaagtgtaatgctaacaggtagggatgaaaacggatcggatacggacggatattactgatatcatatttgttttcatatttatggtcggattcggattcgaatacagataatatcaaccatgtcggataagatatgattggatatcgacatcacaaatatacgatttaagtat

SEQ ID NO: 4791 - DNA, 2603 bp, Zea mays
gcccctccgaatctcgaatcccgctaatccaaatccatcgagcgggagaaccccgaattccaaaaatccccaaaacccaaccctagctcgctagcctcactgttccccttcgactcttccccttcgcacctctgattcctcgcgccctcgtcccccgctcaatttccagaagcttctagaaccgggtttccagccctaatcccgcaaaaagatgctttcttgcgcctagtagcctgggacggaggcatggacagcggcggcggggagggaggctcgactggcgggaggttccctattctgcaggcgaatagggaccccgagtcaaattgggaggtggacgttgccaaaagcctcgagcagtacctgctcaagatctgttcaggggaggtctccggcgaggacgagtcccattctgtcaactttgccgaagcggcgttactactccaaggatcggttcaagtatacagtaggaaggtggagtacttgtactccttggtgcttcacgcgatagagttcctctcacacaagaaacaggatcaacaggaaaatgtaacagctcaatctaatcaaagcgaccctagcacgattcccagtgaagattatatatttatggggttagatgatgtcctaatggaaacaaggacgtctctggataacaatgttgaccgagatgatttacaaagaaaaattgtgaggccaccagcaaatctactggtgtttgaaggggacgttctggatagtgaagcgagtgagctagactcatatttgttatcaacatgtgatttttatggagatttccttctgctggatccttgtgatgcaccatctgtttttgactttctgcaaggaaaacattctggtaaagaaaatagtgtggctcgccaaggcagtccagcaccttctaaaagccaagccaatgttttcacttccccaaatgcaagatcagcgggcacaggctgtaaagccgcctctggaaaagtcctaggaggtctagattcaactcagaagaatcctgaccaaccttcaactcaagaaaccagtccagatgacaaacattggtctgatcctgttgaacctaactttactgatgatgttgaaaagcctcacccagacgatataggggatcctgttggagattattctgatgacgaggatccgtggaaacctttaaatccacatgaacctggcagcttaaagattcggccttacaggagagtgaaaggttctctacggggggttattggcactttgagaaagaaaactctcacatctatatttcctgtggcaaagatggttggtgtcatcatacctgaacatgctaaatcttttgaagcacagcagtctcagcaggaggaacattatggttcccaatcaccccctcgttttgaaaagtatttggcatcatttgaatttggagaagaaaattccaatgtgtttggagatctgaaagatgacaatggatccgatattggcattaattttgattataatgatccagacatgccaaacgacatagatgttgatcctgacgttccaacatatcctgacgagattattgctgcaactcccaaaggtactcatggtacacaggatgacagagatacacgtgaaagcctcgatgacttgtgtcggtcacatctgaatgctctccttgccagcattgctgaggttgaaaagcagagtgagatggatgctcgagtttcaacatggaaagaaagaatcgagattgccttggaagagcaggataaaaacccaccttttgatatcggttcatacggggagcaaatccttgacgcgctttcatcaagaactgacagcacaggaactgcatcttttagcgagattgtttgtggcagaccgaagtatgaggttgccagaacattctctgcccttctccagctggtaaacagcagaagtgtttatctggacaaaggacaagccacgaatgagttggtgtgttacacagctgagaatccattccatgtaaggctcatcagtcccaaccggaggccagagatggaggcacactttgctcggaagagagtcaagtccccactgcgaaacgctggcaaaggtggtgagtcctccctggcacgacatgagtgccccaagaagccattgcataaaaatggcaagattcaagtcaagacggcgatcaggttgactccagacgggaagcgaaggcgaaggtcagtcactcatctaatgcagccgatcaatctggaatcagcggatgaatgccaatggcagactgactcatgggcatctagagcctgatcgccaatggcagactgactgatgggcatctagagtctgattcttctaattgttgcaacttcagtggcggtttcattggcaggcaacgactgctgtgcaatcagctcccttgacgagacagtgaccatggttcctggttcagatggcgtactgctgacattaggcctagctagcgggtgtacatgtaacatgtacaatagttcattgtgctgttttgtacgtatttgtatcagctctcaagcctaatgctaacagggcaagatttgtctaccgacttgccgttttatacctaatgatattggtagattctttcctggttcaataaa

SEQ ID NO: 4792 - DNA, 2108 bp, Panicum virgatum
ctccggcgaggacggggcccactctgtcaactttgccgaagccgcattattactccaaggatcggttcaagtgtacagtaggaaggtggagttcttgtactcgttggtgcttcatgcgttagagttcctttcgcaaaagaagcaggatcaactggaaaatggctcagctcaagctaatcaaagtgatcctagcacgattgccaatgaagaagatgatatatttatggggttagatgatgtccctgcggaatcaaggacatctctgaataacaatgtcaatcgagatggtttacgaagcaaaattgtgaggccaccagcaaatctactggtgtttgaaggggactgtctggatagcgaagcgagtgagctagacacatatttgttagcaacatgtgatttttatggagatttcctcctgctggatccttgtgatgcaccagctgtttttgacttcctgcaaggaaaacattctggtaaagaaaatagtgtggctcatcaaggcagttcagcaccttctaaaagccgagccaatgttttcacttccccaaatgctagatcagcaggcacaggtcgtaaatcgtccgctggaaaagtcttaggaggtctagatccaacccaggggaatcctgaccaatcttcaactcaagaaaccattcctgatgacaaccattggtctgatcctgttgaacctagctttgctgatgatgttgaaatgcctcacccagatgatatagaggatcctgttggagattattctgatgatgaggatccatggaaacctttgaatccacatgaacctggcaacctaaagattcggccttaccgaagagtgaaaggttctccacgggcggttattggcacttcgaaaaagaaaactctcacatttctttttcctatggcaaagatggatggcattgtcatacctgaacatgctaaatcttttgaagcgcagcagtctcagcaggaggaacattatggttcccaatcaccccctcgttttgaaaagtttttgagatcatttgaatttggagaagaaaatcccaatgtgtttggagatttgaaagatgacaatggatcaaatactggcattaattttgagaatgatgatccagacatgccaaatgacatagatgttgatccttatgttccaacatatcctggcgagactattgctgcaactccgaatggtacacaggatgacataaatacacatacaagcctcgacgacttgtgtcgttcacatctgaatgctctccttgccagcatcgctgaggctgaaaagcagagtgagatggatgctcgagtttcaacatggaaagaaagaattgaggatgccttggaagagcaggataaaaacccaccttttgatatcggttcatatggggagcaaatccttgacacactttcatcaagaactgacaatacaggaactgcatcttttagtgagattgttagtggcagaccaaaatatgaggttgccagaacattctctgcccttctccagttggtgaacggcagaagtgttgatctggacaaaggacaagccacaaatgagttggtgtgtcacacagcagagaatccattccatgtaaagctcatcggtcccaaccggaggccagaaatggaagcacgctttgcacggaagcgagggaagtccccactgcaaaatcctggccaaagtggtgagtcctccctggcgcaacgggagtccctgaagaaaccatcgcataaaaatggcaagattccagtcaagacagctatcaggctgactcctgatggcaagagaaggcgaaagtcagctgctcacctaatgtagccgatcaatctggaatccagcagatgaatggattgattcgtgggcacccagagtgtgattcttctaattgttgtaacctcagtggcagggtgggctgtaacctgtaagttatgacttaggcctaggtagcgggtgtacatgtatattagttcgttgtgctgttatgtaggtacgctatcagccccaagtgtaatgttaacagggcaagatttgttgacggacttgcccttttatacagggacgacgttgtcaagtgattcattctgattcaataaactagcattttgccgag

SEQ ID NO: 4793 - DNA, 788 bp, Saccharum officinarum
cccgcattccccattgcactccgctagggttttactccgcagccgcaccacgccgccggagcagcgcgagacccgaggcgagccacgcgagagagagatgaggctcctgacgcacaacatgctggcgtcgaacgtccggggcgcaaccaccggctacccgttgacgctggaggcgaccaagtggtgcaccaaggaggtggagctcaacgccgacttcatccgcggcctcctccccaagatcgactggcgcgcgctcgtcgccgccacccgcgcgctcggcctccccgagctcctccccgaggagcagccccccgaggaggagatcttcgccgagggcgccgccgacgtcgagggcagcgccatccgccgcatccaccacgcgctcctcgaggtccacgtccaggagggctccctcgtctgccccgacaccagccgctgcttccccatcaacaagggcatccccaacatgatgctccacgaggacgaggtctgatctggcgtgtgtgtgagtctcgccctggccgcttttgcttgctcatctgctcgtcatggtctgtcacggaggatcccaggccttgtgaacttcatactcagattgtatctgtgaagtatggattgcagtcttgcagattgtggccttataatacgatagatagccgtgtagtactcggaattgccgttttgtgttgttaatttggtgcacgtcatgctctgttcttaaatcttaactgtcggcaaattgtttgctgccctgtgactgaagaaatcgaaagaggtagttatttctc

SEQ ID NO: 4794 - DNA, 814 bp, Zea mays
aggctcccggatcgtctaatcaatcccgcattccccattgcacgccgtctccgctagggttttactccgcagccacaccgcgccgccggagcagcgcgagacccgcgaggcgagccacgcgagagagatgaggctcctgacgcacaacatgctggcgtcgaacgtccggggcgcaaccaccggctacccgctgacgctggaggcgaccaactggtgcaccaaggaggtggagctcaactccgacttcatccgcggtctcctccccaagatcgactggcgcgcgctcgtcgccgccacccgcgcgatcggcctccccgagctcctccccgaggagcagccccccgaggaggagatcttcgccgacggcgccgccgacgtcgagggaagcgccatccgccgcatccaccacgcgctcctcgaggttcatgtccaggagggctccctcgtctgccccgacaccagccgctgcttccccatcaacaagggcatccccaacatgatgctccacgaggacgaggtctgattttgccgtgtcagtttcgccctggcctcttttgctcgcgcacctgctctacatggtctgtcgcgaagggtatcaggccttgtggacttcgtactcagattgtacctgtgaagtatggattgcagccttgcagattgtgcccttataatatgatagatagccgtgtaatactcggaattgccgtttcgtgttgttaatttggtgcacgtcatgctttgttcttaactgtctgcgaattgtttgttgccctgtgcctgaggaaatcgaaagaggtaaattacaaattgtgca

SEQ ID NO: 4795 - DNA, 872 bp, Panicum virgatum
tcatcatccattcaggcctccgctagggttttacgccgcagccgcagccgcagcacacgccgccggaggagcgcgactgcccgagaccaccttcgcggtgagaggggagaagcagcagctcgagggccggccgagcgagagatgaggctcctaacgcacaacatgttggcgtccaacgtccgtggcgcgacgaccggctacccgctgaagctggaggcggccaagtgggtgaccaaggaggtggagctcaacgccgacttcctccgcggcctcctccccaagatcgactggcgcgccctcgtcgccgccacccgggcgctcggcctccccgagctcctccccgaggagcagccgcccgaggaggagatcttcgccgagggcgccgccgacgtcgagggcagcgccatccgccgcatccaccacgcgctcctcgagatccacgtccaggagggctcccttgtctgccccgataccagccgctgcttccccatcgataagggcatccccaacatgatgctgcacgaggacgaggtctgatgattgagtctcgccatggtcgcctttacttacatgctcgttgtcgctatcataaaagggttcaaggcttgttgacttctcggattgtggtttgttaaatataaatgatgatggcgttataatttgaatggatgagccgtgttgttctgtttagaattgcgtttttgtgtcagtaatttgatacggctgaaatcgtaaggtacagcggaaactgcatacagtaatttgtgtcagtaatttgacactgcagccttttcaattacttgcaccttttagtacgaaattgtgggtgatttggtggaaccgattatttcttaaggagtgttgtgtttgca

SEQ ID NO: 4796 - DNA, 926 bp, Setaria italica
ctccccgaatcttcatcagccaccgtccagcccccattccccctactccgctagggtttttctccgcagccgcagcacgccgccggagcagcgcgagatcacctacgccgtcggcagaggagaagcagcagctcggatcccatccaatcgagagatgaggctcctgacgcacaacatgctggcgtcgaacgtccggggtgcgacgaccggctacccgctgaagctggaggcggctaagtgggtgactaaggaggtggacctcaacgccgacttcatccgcggcctcctcccgaagatcgactggcgcgccctcgtcgccgccacccgcgctctcggcctccccgagctgctccctgaggagcagccccccgaggaggagatcttcgccgagggcgccgccgacgtcgaaggcagcgccatccgccgcatccaccacgcgctcctcgagatccacgtccaggagggctccctcgtctgccccgataccagccgctgcttccccatcgacaagggcatccccaacatgatgctgcacgaggacgaggtctgatgcgtgagtctcgccacggtcgcctttgcttacctgctcgttgtcggctgtcataaaagggttcaagggcttgtggctgtgaaatataaatgtggatgatgacgttataatttgaatggatgaccgtgttctgtttggaatttcgtttttgtgccagtaatttgatacggctgaaattggatactgcaactttatgtgtgccttttagtgtggaattgggggtgatttggtggaaccaataatttctcattgagttttgtgtttgcagttgttcccagtggatcaattgttccacagaaaactttatgttaatcaggttcggttatagcagttccagtgaggaaattgctttttggttgagtagtttggtgccaaa

SEQ ID NO: 4797 - DNA, 718 bp, Pennisetum glaucum
ccatcccccctactcacgctagggtttttctccgcagccgcagcacgccggcggagcagtgcgacgcgccgacgccgtcgggagaggagaagcaagcagctcgggtcccatccaatcgagagatgaggctcctgacgcacaacatgctggcgtcaaacgtccgtggcgcgacgaccggctacccgctgaagctggaggcggccaagtgggtgaccaaggaggtggacctcaacgccgacttcatccgcggcctcctcccgaagatcgactggcgcgcgctcgtcgccgccacccgcgcgctcggcctccccgagctgctccccgaggagcagccccccgaggaggagatcttcgccgagggcgccgccgacgtcgagggcagcgccatccgccgcatccaccacgctctcctcgagatccacgtccaggagggctccctcgtgtgtcccgataccagccgctgcttccccatcgacaagggcatccccaacatgatgctgcacgaggacgaggtctgatgcctgggtctcgccacggcggtcgcctttgcttacctgctcgttgtcagatgtcataaaaagggtttaagggcttgtagctgtgaagtataaaatgtggatgatgacgttataatttgaatggatgaccgtgttgttctgtttggaatttcgtttttgtgtccataatttgatatggatgacattggaaggtagtgtgc

SEQ ID NO: 4798 - DNA, 968 bp, Panicum virgatum
gttcagcccccgttccccctcgccgtccgctagggttttacgccgcagccgcagccgcagcacacgccgccggaggagcgcgactgcggcgagaaggggagaagcagcagctcgagggccggccgagcgagagatgaggctcctaacgcacaacatgctggcgtccaacgtccggggcgcgacgaccggctacccgctgaagctggaggcggccaagtgggtgaccaaggaggtggagctcaacgccgacttcctccgcggcctcctccccaagatcgactggcgcgccctcgtcgccgccacccgggcgctcggccttcctgagctcctccccgaggagcagccgcccgaggaggagatcttcgccgagggcgctgccgacgtcgagggcagcgccatccgccgcatccaccacgcgctcctcgagatccacgtccaggagggctccctcgtctgccccgataccagccgctgcttccccatcgataagggcatccccaacatgatgctgcacgaggacgaggtctgatgcgttagtctcgccatggtctcctttacttacacatgctcgttgtcggctgtcataaaagggttcaaggcttgttgacttctcggattgtggttgttaaatataaatgatggcgttataatttgaatggatgagccgtgtttttatgtttggaattgcgtttttttgtcagtaatttgatacggctgaaatcgtaaggtacaacggaaattgcatacagtaatttgacacttcagccttttcaattatttgcgccttctagtacggaattgggggtgattcagtggaaccaattattacttaaggaatgttgtgtttgcaattgttcccaatggatcatgagtttgtaatagttggtccatggaatactgtatcttagtcaggttaagctatagtagttccagtgaggaaattgctttttggatgagtattttagtgc

SEQ ID NO: 4799 - DNA, 758 bp, Panicum virgatum
  misc_feature (17)..(17): n is a, c, g, or t
ggccgctagggttttangccgcagccgcagcacacgccgccggaggagcgcgactgcggcgagaaggggagaagcagcagctcgagggccggccgagcgagagatgaggctcctaacgcacaacatgctggcgtccaacgtccggggcgcgacgaccggctacccgctgaagctggaggcggccaagtgggtgaccaaggaggtggagctcaacgccgacttcctccgcggcctcctccccaagatcgactggcgcgccctcgtcgccgccacccgggcgctcggccttcctgagctcctccccgaggagcagccgcccgaggaggagatcttcgccgagggcgctgccgacgtcgagggcagcgccatccgccgcatccaccacgcgctcctcgagatccacgtccaggagggctccctcgtctgccccgataccagccgctgcttccccatcgataagggcatccccaacatgatgctgcacgaggacgaggtctgatgcgttagtctcgccatggtctcctttacttacacatgctcgttgtcggctgtcataaaagggttcaaggcttgttgacttctcggattgtggttgttaaatataaatgatggcgttataatttgaatggatgagccgtgtttttctgtttagaattgcgttttttgtgtcagtaatttgatacggctgaaatcgtaaggttacagcggaaaactgcatacagtaatttgtgtcagtaatttgacactgcagccttttc

SEQ ID NO: 4800 - DNA, 1069 bp, Saccharum officinarum
tgcagcaagaaactttgagccatggccaccaccgcgtctagcctcctcaagtcctccttcgcgggcgcccggctcccggcagccacgcgcacgccgtcgtcgtccgccgtcgtacgcggcgccgccggcccgatccgcgcgtccatcccctcctccaacccgccctacgacctgacgtccttccggttcagccccatcaaggagtcggtcgtctcccgcgagatgacccggcggtacatgacggacatgatcacctacgccgacacggacgtcgtcatcgtgggcgccggctccgcggggctctcctgcgcgtacgagctctccaaggaccccaccgtgagcatcgccatcgtggagcagtcggtgtccccgggcggcggcgcgtggctgggcgggcagctgttctcggccatggtggtgcgcaagccggcgcacctgttcctggacgagctgggcgtcgcgtacgacgaggccgaggactacgtggtgatcaagcacgccgcgctcttcacctccaccgtcatgagccgcctctggcgcggcccacgtgaagctgttcacgccgtcgccgtggaggacctgatcgtcaagcaagggcgcgtcggcggcgtcgtcaccaactgggcgctcgtgtccatgaaccacgacacgcagtcgtgcatggaccccaacgtgatggaggccaaggtggtggtcagctcctgcggccacgacgggccgttcggggccaccggcgtcaagaggctccaggacatcggcatgatcagcgacgtgcccgggatgaaggccctggacatgaacaccgccgaggacgagatcgtgcgcctcacgcgcgaggtcgttcccggcatgatcgtcaccggcatggaggtcgccgagattgacggcgccccgaggatgggcccgacgttcggcgccatgatgatctccgggcagaaggcggcgcacctggcgctgaaggcgctgggcaggcccaacgccgtggacgggaccatcaaggtggtgtcgccggcgttgcgtcaggagttcgtcattgcgtccaaggacgatgaggtcgtggacgcgtgag

SEQ ID NO: 4801 - DNA, 1458 bp, Saccharum officinarum
cagcctcatcccctcacacactacactgctctgagcctctgctgcagcaagatttctccttcccagcagctagccatcatggccaccaccgcggcgtctagcctcctcaagtcctccttcgcgggctcccggctcccggctgccacgcgcgccccgtcgtccgtggtcgtgtccaccggcgccccgcgcaccgccgccgccggccccatctgcgcgtccatctcctcgtccaacccgccctacgacctgacgtcgttccggttcagccccatcaaggagtccgtcgtgtcccgcgagatgacccgccgctacatgacggacatgatcacccacgccgacaccgacgtggtcatcgtgggcgccggctccgcggggctctcctgcgcgtacgagctctccaaggaccccacggtcagcatcgccatcgtggagcagtcggtgtccccgggcggcggcgcgtggctgggcgggcagctgttctcggccatggtggtgcggaagccggcgcacctgttcctggacgagctgggcgtcgcctacgacgaggccgaggactacgtggtgatcaagcacgcggcgctcttcacgtccaccatcatgagcgcgctcctggcgcggcccaacgtgaagctcttcaacgccgtggccgtggaggacctgatcgtgaagcaggggcgcgtcggcggcgtggtcaccaactgggcgctggtgtccatgaaccacgacacgcagtcgtgcatggaccccaacgtgatggaggccaaggtggtggtcagctcctgcggccacgacgggcccttcggggccacgggcgtcaagaggctccaggacatcggcatgatcagcgccgtgcccgggatgaaggcgctcgacatgaacaccgccgaggacgagatcgtgcgcctcacgcgcgaggtcgtgcccggcatgatcgtcaccggaatggaggtcgccgagattgacggcgcgccgaggatgggcccgacgttcggcgccatgatgatctccggccagaaggcggcgcacctggcgctgaaggcgctgggcaggcccaacgccgtggacgggaccatccccaaggtgtcgccggcgttacgcgaggagttcgtgattgcgtccaaggacgacgaggtcgtggacgcctgagtcatcgagcagaagatcgatccacgccagcaagcagcgtcttatctgggccggccggctggccggggtttctttaattcgggactttgcctcctccatgttgaatgaatgaattcgcttcgatcgtgtagctttaatttgtctcgttactagtgtgtcgtgttcatagcaccgccaccgcgccatgccacaccatgcttgttgtgtgctctgtcacgtgggggccactcctggggtgggtcctactgccagaacgaataagagaagatggaattgaatgaatgaaacaataaaatgcatggataattgtct

SEQ ID NO: 4802 - DNA, 2392 bp, Panicum virgatum
caaccgttgatattttactgccgtttcacctaggatcaccaggtcgtggagtccatcatctattcatcttcgtcactacatatcaatctccttgtaaccacagctatatatattggggggggggggggatgtgttgaaagtgtacatataaatagatggaagttgtataaactggaatttgcaaaataacatatgctcccaccaaaacaatatacagaatatggaaggattatagaggtgtaataaattggtggccgttaggtgcacctgtaatccattttagtttaaatatttgtactgtttcttcaaaacaagattctatttttagaaaagtaccacaaatatttgaacatttaagagttaccactaaaattgtagaaggaagaactgccaagctaagtgtaaggagtaattgagtgaacgctgaacgcaccaacagtgcggtgtccatatctcagctcatcactttcttccaaaagccatcctccatccatgaaccgtcgcaaaatatctgcgccgatggggatgccgggaaaactccaacgcagattttgtttgcctctgcccgatttcgtcccgatccaacgcagccggtggccgtggccatccacgccctatctgccatgcacagcgcccagatatttgttgcaggcttgcagcctccctccccttcttaaaccctgccaccgcaagctcatcccctcacacacctgccgagtgccgaggtgccatccccagcagctccaatccttccgtccatctcgatccccagcccaagaagctagctctcggccatggccaccaccgcgtcgaccctcctcaaatcctccttcgccggcgcccggctcccggccgccccgcgcgccccgtcctccgtcgccgtggcgaccccccgcgccgccgggcccatctgcgcctccgcctccgcctcctcctccaccccgccctacgacctcacctccttccggttcagccccatcaaggagtccatcgtcgcccgcgagatgacccgccggtacatgaccgacatgatcacccacgccgacaccgacgtcgtcatcgtgggcgccggctccgcggggctctcttgcgcgtacgagctctccaaggacccctccgtcagcatcgccatcgtggagcagtccgtgtcccccggcggcggcgcctggctcggcgggcagctcttctcggccatggtggtgcgcaagcccgcccaccgcttcctcgacgagctcggcgtcgcgtacgacgaggccgaggactacgtggtcatcaagcacgccgcgctcttcacctccaccatcatgagccgcctcctggcgcgccccaacgtgaagctcttcaacgccgtcgccgtcgaggacctcatcgtcaagcagggccgcgtcggcggcgtggtcacgaactgggccctcgtctccatgaaccacgacacccagtcgtgcatggaccccaacgtgatggaggccaaggtcgtggtcagctcctgcggccacgacgggccgttcggggccaccggcgtcaagcggctgcaggacatcggcatgatcagcgccgtgcccgggatgaaggccctcgacatgaacaccgccgaggatgagatcgtccgcctcacgcgtgaggtcgtgcccggcatgatcgtcaccggcatggaggtcgccgagatcgacggcgccccgagaatgggcccgacgttcggcgccatgatgatctccggccagaaggcggcgcacctggcgctccaggcgctgggcaggcccaacgccatcgacgggacggcccagacggcgtcgccggcgtggcgcgaggagttcgtgatagcgtccaaggacgacgaggtcgtggacgcgtgagcaggggacgcgcgccgggtgggggagcgatttccgtggggattttctccgtttcttctggactctgctgctttgttcagttcagctgtctctcgctagtgtcgtgttcataccactgccacgccagtatgccaccgtgtgctctgtctcgtgggggcaccactctgtggggccctcctggcagctggaataaagagaagatgaaataaaatgcatcttggtaacttggtgtggtactacatgattgattcgttgtaaagagatgagagaagcgggctccacagttctagccgtcttctgctcactgtattcctttgtccctgcaacctgctgtaacagtgaggtgtcttgctgatagataaatgacttgttacactttaaacacttgaatactgaccagtaaattgctggcctggggcatttcatatagacccaaaggaatggcgaaagtactagaaaaccaaggtcttattcataagctttttgctagtatgaaacaatttaacccttattgcggaataacgaatcccagtggaatt

SEQ ID NO: 4803 - DNA, 1780 bp, Panicum virgatum
gtgaaccgtcgcaaaatatctgcgccgataggggtgccggtaaaacaccaacgccgattttggctgcctttgcccgatttcgacccggcccgatgcagccggcggccgtggccaaccacgccctatctgccatgcacagcgcccgacgcccagatatttgttgcagcctccatggcggcgccatccccttcttaaaccctgccaccgcagcctcctcccctcacacctgccgagcgccgagtgccatccccagcagctcttccgtccatctcgatccacagtagcccaagaagctagctagctctcggccatggccaccaccgcgtcgaccctcctcaagtcctccttcgccggcgcccggctcccggccgccccgcgcgccccgtcctccgtcgccgtggcggccccgcgcggcgccgggcccatctgcgcctcggcctcctcctccagtccgccctacgacctcacgtccttccggttcagccccatcaaggagtccatcgtcgcccgcgagatgacccttcggtacatgaccgacatgatcacccacgccgacaccgacgtcgtcatcgtgggcgccggctccgcggggctctcctgcgcgtacgagctctccaaggacccctccgtcagcatcgccatcgtggagcagtccgtgtccccgggcggcggcgcctggctcggcggccagctcttctcggccatggtggtgcgcaagcccgcccaccgcttcctcgacgagctgggcgtcgcgtacgacgaggccgaggactacgtcgtcatcaagcacgccgcgctcttcacctccaccatcatgagccgcctcctggcgcgccccaacgtgaagctcttcaacgccgtcgccgtcgaggacctcatcgtcaagcagggccgcgtcggcggcgtggtcaccaactgggccctcgtctccatgaaccacgacacccagtcctgcatggaccccaacgtgatggaggccaaggtcgtggtcagctcctgcggccacgacgggccgttcggggccaccggcgtcaagaggttgcaggacatcggcatgatcagcgccgtgcccgggatgaaggccctggacatgaacaccgccgaggacgagatcgtccgcctcacgcgtgaggtcgtgcccggcatgatcgtcaccggcatggaggtcgccgagatcgacggcgccccgagaatgggcccgacgttcggcgccatgatgatctccggccagaaggcggcgcacctggcgctgaaggcgctgggcaggcccaacgccatcgacgggacggccccggcggcgtcgccggcgtggcgagaggagttcgtgatggcgtccaaggacgacgaggtcgtggacgcgtgagcaggggaaggcgttggagcgggggacgcgcgctgggtggggcgatttccgtggggattttctccgtttcttctggactctgctgccttgttcaacttagctctgtctcgctagtgtcgtgttcatacttcatagcactgccatgccagtatgccgctgtgtgctctgtctcgtgggggcaccactctgtggggccctcctggcagcaggaataaagagaagatgaaataaaatgcatgttggtgacttggtgtggtacatgattgattcgttgcaaagagatgagagaagcggccgggctcctgaacagctcagttctatagccggcttctgcttactgtattcctttgtccctacaacctgctgtaacagtgaggtgttttgctgatgagtgactttgcactttgaacacttgaa

SEQ ID NO: 4804 - DNA, 1395 bp, Panicum virgatum
ctgccgagcgccgagtgccatccccagcagctcttccgtccatctcgatccacagtagcccaagaagctagctagctctcggccatggccaccaccgcgtcgaccctcctcaagtcctccttcgccggcgcccggctcccggccgccccgcgcgccccgtcctccgtcgccgtggcggccccgcgcggcgccgggcccatctgcgcctcggcctcctcctccagcccgccctacgacctcacgtccttccggttcagccccatcaaggagtccatcgtcgcccgcgagatgacccttcggtacatgaccgacatgatcacccacgccgacaccgacgtcgtcatcgtgggcgccggctccgcggggctctcctgcgcgtacgagctctccaaggacccctccgtcagcatcgccatcgtggagcagtccgtgtccccgggcggcggcgcctggctcggcggccagctcttctcggccatggtggtgcgcaagcccgcccaccgcttcctcgacgagctgggcgtcgcgtacgacgaggccgaggactacgtcgtcatcaagcacgccgcgctcttcacctccaccatcatgagccgcctcctggcgcgccccaacgtgaagctcttcaacgccgtcgccgtcgaggacctcatcgtcaagcagggccgcgtcggcggcgtggtcaccaactgggccctcgtctccatgaaccacgacacccagtcctgcatggaccccaacgtgatggaggccaaggtcgtggtcagctcctgcggccacgacgggccgttcggggccaccggcgtcaagaggctgcaggacatcggcatgatcagcgccgtgcccgggatgaaggccctggacatgaacaccgccgaggacgagatcgtccgcctcacgcgtgaggtcgtgcccggcatgatcgtcaccggcatggaggtcgccgagatcgacggcgccccgagaatgggcccgacgttcggcgccatgatgatctccggccagaaggcggcgcacctggcgctgaaggcgctgggcaggcccaacgccatcgacgggacggccccggcggcgtcgccggcgtggcgagaggagttcgtgatggcgtccaaggacgacgaggtcgtggacgcgtgagcaggggaaggcgttggagcgggggacgcgcgctgggtggggcgatttccgtggggattttctccgtttcttctggactctgctgccttgttcaacttagctctgtctcgctagtgtcgtgttcatacttcatagcactgccatgccagtatgccgctgtgtgctctgtctcgtgggggcaccactctgtggggccctcctggcagcaggaataaagagaagatgaaataaaatgcatgttggtgacttggtgtggta

SEQ ID NO: 4805 - DNA, 1681 bp, Zea mays
cagagtgcccgtgaccaaccacgccccatctgctaaacacgtagccatgcatggcgccacggccacgccagccaagatatttgttgccctcgtctcgtcttgtgcccttcttaatataaaccttgtgcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgtggctgggcgggcagctgttctcggccatggtggtgcgcaagccggcgcacctgttcctggacgagctgggcgtggcgtacgacgaggccgaggactacgtggtcatcaagcacgccgcgctcttcacgtccacggtcatgagcctgctcctggcgcgccccaacgtgaagctgttcaacgccgtggccgtggaggacctcatcgtcaggggagggcgcgtcggcggcgtcgtcaccaactgggcgctcgtgtccatgaaccacgacacgcagtcctgcatggaccccaacgtcatggaggccaaggtcgtggtcagctcctgcggccacgacgggcccttcggcgccaccggcgtcaagaggctccaggacatcggcatgatcagcgccgtgccggggatgaaggcgctcgacatgaacaccgccgaggacgagatcgtgcgcctcacgcgcgaggtcgttcccggcatgatcgtcaccggaatggaggtcgccgagattgacggcgcccccaggatgggcccgacgtttggcgccatgatgatctccggccagaaggcggcgcacctggcgctcaaggccctgggcaggcccaacgccgtggacgggaccatgtcgccgccgttgcgcgaggagttgatgattgcgtacaaggacgacgaggtcgtggacgcctgagtgcggcaagcagagaggaggatcgacgccagcagcgtcttatcttaattgccttgttgttcaatgatgaatcgatcgaattcccttgggttagctttattattgttgttgttattattaatttgactcgctatagtgtgtcgtgttcatagcaccaccaccgcgccatcgacatgccacacctgtgctctgtctgtcacgtcacgtgcgagtcctactacgggaaaaaatgcatggtaatcgtggagttgcttctctgttctcttttgttctgcactgtcactgtaacgctgggactcgtccactaggggataaaatggtacgaatatcggtacgagtatcggttgaaaacagctatataccgaatgtataattggtactcggtaaccgagattaaaatcattaaactttagttccaagcaaaaatatactaaaaa

SEQ ID NO: 4806 - DNA, 1554 bp, Zea mays
tatttgttgcagccgcctgccgccctcgtcccgtgcgtccccttcttaaaccttggcagtgcaagcccaggcagcctcatcccctcagtcctcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccggttcagccccatcaaggagtccatcgtgtcccgcgagatgacccggcgctacatgacggacatgatcacccacgccgacaccgacgtggtgatcgtgggcgccgggtccgcgggcctgtcctgcgcgtacgagctgtccaaggaccccaccgtgagcgtggccatcgtggagcagtccgtgtccccgggcggcggcgcgtggctgggcgggcagctgttctcggccatggtggtgcgcaggccggcgcacctgttcctggacgagctgggcgtgggctacgacgaggccgaggactacgtggtggtcaagcacgcggcgctgttcacgtccaccgtgatgagccggctcctggcgcggcccaacgtgaagctgttcaacgccgtggcggtggaggacctgatcgtgcggcgggggcgcgtcggcggcgtggtcaccaactgggcgctcgtgtccatgaaccacgacacgcagtcgtgcatggaccccaacgtgatggaggccaaggtggtggtcagctcctgcggccacgacgggcccttcggcgccaccggcgtcaagaggctccaggacatcggcatgatcagcgccgtgcccgggatgaaggcgctcgacatgaacgccgccgaggacgagatcgtgcgcctcacgcgcgaggtcgtgcccggcatgatcgtcaccgggatggaggtcgccgagatcgacggcgccccgaggatgggcccgacgttcggcgccatgatgatctccggccagaaggcggcgcacctggcgctgaaggcactgggcaggcccaacgccgtggacgggaccatccccgaggtgtcgccggcgctgcgcgaggagttcgtgattgcgtccaaggacgacgaggtcgtggacgcctgagcgagcatccacgcgccagcatgcaagcagcgtcttatctgggccggcgccatcacggggtttcttcttttaatctgggactttgttgttgttggacgaatgaattcccttcgatcggttagctttaatctgtctcgttagtgtgtcgtgttcgtgtagcaccatgccacagctacgccatgccgtgtgctctgtcacgtgggggccactcgtggggtctcctgctgctgtcagaacgaataagagaagatggaattgtggtgaaacaataaaaatgcatggtttaaattgtcttgttggtgttgcttctc

SEQ ID NO: 4807 - DNA, 1891 bp, Setaria italica
gttgaaaaaggtacacgtaaatagatgaaagtagataaactggaactttgcacaataccaaataagctagtttactcccactaaaacactacgtggattgtagaaggatccacagccggcacatctacaagactacagttgcaaaaggaagaactcgcaggctgagtgtaataattcagtgagagctgagcacagcaagtgtaggtgtccccatctggccatctcagatcacacacactctccaaaagccaaatgccatcctccgtccataaaccctcgcaaaatatctgcgccgatacagcgttgccagcgatccagagcccgtggtggccaaccacgccccatctgctaacacgtagccaggcaccgcgcccagatatttgttgccgcctccctccccttcttataccctgccaccgcagcaccatcccctccactccattccatccatctccagttctccacaacccaagaaggcaagaaactcccgcagccatggccaccaccgcgtcaaccctcctcaagtcctccttcgccggcgcccggctcccgtccgccccgcgcgcgccgtcctccgtcgtcgtggccgccccgcgcgccggccccatctgcgcctccatctcctccaccccctccaacccgccctacgacctcacgtccttccggttcagccccatcaaggagtccatcgtctcccgcgagatgacccgccggtacatgaccgacatgatcacctacgccgacaccgacgtcgtcatcgtcggcgccggctccgcggggctctcctgcgcgtacgagctctccaaggacccctccatcagcatcgccatcgtcgagcagtccgtctcccccggcggcggcgcctggctcggcggccagctcttctccgccatggtggtgcgcaagccggcgcacctcttcctcgacgagctcggcatcgcgtacgacgaggccgaggactacgtggtcatcaagcacgccgcgctcttcacctccaccgtcatgagccgcctcctcgcgcgccccaacgtgaagctcttcaacgctgtcgccgtcgaggacctcatcgtcaagcagggccgcgtcggcggcgtggtcaccaactgggcgctggtgtccatgaaccacgacacgcagtcgtgcatggaccccaacgtgatggaggccaagatcgtggtgagctcctgcggccacgacgggccgttcggggccaccggcgtcaagaggctgcaggacatcggcatgatcagcgccgtgcccgggatgaaggccctcgacatgaacaccgccgaggacgagatcgtccgcctcacgcgtgaggtcgtgccaggcatgatcgtcaccggcatggaggtcgccgagatcgacggcgccccgagaatgggcccgacgttcggcgccatgatgatctccgggcagaaggcggcgcacctggcgctgaaggcgctgggcaggcccaacgccatcgacgggacggcccagacggtgccgcaggtgtggcgcgaggagttcgtgatagcgtccaaggacgacgaggtcgtggacgcgtgagcaggggaaggcgttggaaacaggggatgcgcgtcgggtggagcgatttgagggatttcagcgtttctttgggacctttgccctgttgaatttagctttgcctcgctagtgtcgtgtttcatagcactgccaactgccatgccgtgccaccgtgtgctctgtctcgtggggccaccactctgtggggcccttctggcagcatcgaatgaataaaagagaaattgagaaaatggaataaattgtcaatttccatgttggtgtggtacgtgattgatttgttgcgtactttggcttctttgtttattactaaaatcattacgctgtgattgatttgtgcgta

SEQ ID NO: 4808 - DNA, 1367 bp, Cenchrus ciliaris
  misc_feature (434)..(434): n is a, c, g, or t
ctcccatccaatctcccttctccacaacccaagaagtcaagaagctctcagccatggccaccaccgcgtcgaccctcctcaagtcctccttcgccggcgcccggctcccgaccgccccgcgcgcgccgtcctccgtcgtcgtggcggccccgcgcgccgccgccggccccatctgcgcctccctctccccctccaacccgccctatgacctcacttccttccgcttcagccccatcaaggagtccatcgtctcccgcgagatgacccgccggtacatgaccgacatgatcacctacgccgacaccgacgtcgtcatcgtcggcgccggctccgcgggcctctcctgcgcgtacgagctctccaaggacccctccgtcagcatcgccatcgtggagcagtccgtctcccccggcggcggcgcgtggctcggcggncagctcttctccgccatggtggtgcgcaagcccgcccacctcttcctcgacgagctcggcgtcgcctacgacgaggccgaggactacgtcgtcatcaagcacgccgcgctcttcacctccaccatcatgagccgcctcctggagcgccccaacgtgaagctcttcaacgccgtcgccgtcgaggacctcatcgtcaagcagggccgcgtcggcggcgtggtcaccaactgggcgctcgtgtccatgaaccacgacacgcagtcgtgcatggaccccaacgtgatggaggccaaggtcgtggtgagctcctgcggccacgacgggccgttcggggccaccggcgtcaagaggctgcaggacatcggcatgatcagcgccgtgcccgggatgaaggcgctcgacatgaacaccgccgaggacgagattgtccgcctcacgcgtgaggtcgtgcccggcatgatcgtcaccggcatggaggtagccgagatcgacggcgccccaagaatgggcccgacgttcggcgccatgatgatctccggccagaaggcggcgcacctggcgctgaaggcgctgggcaggcccaacgccatcgacgggacggtgcagacggtgccgccggtgtggcgcgaggagttcgtgatggcgtccaaggacgacgaggtcgtggacgcgtgagcaggggaagccgttggaaaacaggggatgcgcgtcgggtggagcgatttggggggatttcagcgtttctttgggatttaccttgtaacttgttgaatttagctttgcctcgctagtgtcgtgttcatagctctgccatgccatgccaccgtgtgctctgtgactctgtctcgtgggggcaccattctgtggggcccttctagcagcatgaatgaataaagagaagttgagaaaatggaataaaatagttaattacca

SEQ ID NO: 4809 - DNA, 1527 bp, Panicum virgatum
cgagtgccgaggtgccatccccagcagctccaatccttccgtccatctcgatccccagcccaagaagctagctctcggccatggccaccaccgcgtcgaccctcctcaaatcctccttcgccggcgcccggctcccggccgccccgcgcgccccgtcctccgtcgccgtggcgaccccccgcgccgccgggcccatctgcgcctccgcctccgcctccgcctctgcctcctcctccaccccgccctacgacctcacctccttccggttcagccccatcaaggagtccatcgtcgcccgcgagatgacccgccggtacatgaccgacatgatcacccacgccgacaccgacgtcgtcatcgtgggcgccggctccgcggggctctcttgcgcgtacgagctctccaaggacccctccgtcagcatcgccatcgtggagcagtccgtgtcccccggcggcggcgcctggctcggcgggcagctcttctcggccatggtggtgcgcaagcccgcccaccgcttcctcgacgagctcggcgtcgcgtacgacgaggccgaggactacgtggtcatcaagcacgccgcgctcttcacctccaccatcatgagccgcctcctggcgcgccccaacgtgaagctcttcaacgccgtcgccgtcgaggacctcatcgtcaagcagggccgcgtcggcggcgtggtcacgaactgggccctcgtctccatgaaccacaacacccagtcgtgcatggaccccaacgtgatggaggccaaggtcgtggtcagctcctgcggccacgacgggccgttcggggccaccggcgtcaagcggctgcaggacatcggcatgatcagcgccgtgcccgggatgaaggccctcgacatgaacaccgccgaggatgagatcgtccgcctcacgcgtgaggtcgtgcccggcatgatcgtcaccggcatggaggtcgccgagatcgacggcgccccgagaatgggcccgacgttcggcgccatgatgatctccggccagaaggcggcgcacctggcgctccaggcgctgggcaggcccaacgccatcgacgggacggcccagacggcgtcgccggcgtggcgcgaggagttcgtgatagcgtccaaggacgacgaggtcgtggacgcgtgagcaggggacgcgcgccgggtgggggagcgatttccgtggggattttctccgtttcttctggactctgctgctttgttcagttcagctgtgtctctcgctagtgtcgtgttcataccactgccacgccagtatgccaccgtgtgctctgtctcgtgggggcaccactctgtggggccctcctggcagctggaataaagagaagatgaaataaaatgcatcttggtaacttggtgtggtactacatgattgattcgttgtaaagagatgagagaagcgggctccacagttctagccgttttttgctcactgtattcctttgtccctgcaacctgctgtaacagtggggtgtcttgttaatagataaaggacttgttac

SEQ ID NO: 4810 - DNA, 2176 bp, Sorghum bicolor
agcaagtcccctccaaattaaaggccatccagccatcaatctaccctccaaaatatctgcatgcagcagctaatgcaggtgggtgccacgctgctgccagcgttcccagattgcccgtgaccaaccacgccccatctgctaacacgtagccatgcatggcgccagccaagaagagatatttgttgcagcgcctccctcgtcagcggcctcgtccccttcttaaacctcggccgtgcaagcgcaacgcaaccagcctcctcaagtccctcacacactgctctgctgcagcaagaaaccaacaagagcttgctagccatggccaccaccgcggcgtctagcctcctcaagtcctccttcgctggctcccgtctcccgtctgccacgcgcgccccgtcgtccgtcgtcgtgtccaccggcggcgccccacgcacggccgccatctccgcgtccatctcctcctccaaccctccctacgacctgacgtccttcaagttcagccccatcaaggagtcgatcgtctcccgcgagatgacccgccgctacatgacggacatgatcacccacgccgacaccgacgtggtgatcgtgggcgccgggtccgcgggcctctcctgcgcgtacgagctctccaaggaccccacggtgcgcgtcgccatcgtggagcagtcggtgtccccgggcggcggcgcgtggctgggcgggcagctgttctcggccatggtggtgcgcaagccggcgcacctgttcctcgacgagctcggcgtcgcctacgacgaggccgccgacgactacgtggtggtcaagcacgccgcgctcttcacctccaccgtcatgagcgccgtcctggcgcggcccaacgtgaagctcttcaacgccgtcgccgtcgaggacctcatcgtcaagggagggcgcgtcggcggcgtggtcaccaactgggcgctcgtgtccatgaaccacgacacgcagtcgtgcatggaccccaacgtgatggaggccaaggtggtggtcagctcctgcggccacgacgggccgttcggggccacgggagtcaagaggctccaggacatcggcatgatcgccgccgtgccagggatgaaggcgctcgacatgaacgccgctgaggacgccatcgtgcgcctcacgcgcgaggtcgtgccaggcatgatcgtcaccggaatggaggtcgccgagattgacggcgcgccgaggatgggcccgacgttcggcgccatgatgatctccggccagaaggcggcgcacctggcgctgaaggcgctgggaaggcccaacgccgtggacgggaccatccccaaggtgtcgccggcgttgcgcgaggagttcgtgattgcgtccaaggacgacgaggtcgtggacgcctgatcgagtgatcgatcgacgccagcagcaagcagcgtctttatctgggacggacggacggggtttctttaatttgggactttcctttgccttgttgttgaatgaatgaattcccttcgatcgtgtagctttaatttctctcgtctcgttattagtgtgtcgtgttcatagcaccacctgccaccaccgcgccatgccatatgtgtgctcttcacgtgggggccactcgtggggtcctgctgccagaacgaataagagaagatggaattgatgaaacaataaaatgcacggttaatcacaattgtcttggtggtgttggtctctttctgttctgcccaagtgttgtcctgctgtcaccgtaatgctttgctgactggattcatgtctctttcaaatcccgaatcgcggatacatgagggcctggcatcttcacggacgatgatgggcggccaacgtttcgcttcagcgcagagttagtcacatgatcaagaatcgacaaagacgtacaaaagcaaggatctcagcgagaatcagtggtcgactcatctctcctcttagtactatacgaattttgccccatgatccccccggcacctcattttgccacgtcatctgcttttctctagtcccgattcaattttgatcgatcgggtaatgcaaaaactgagcacggcaaccaatttttaggggttaaaaaaaattagtgaggaccatttctaccataacgcgcgcgatactatttttaacatatgatggtaaatcagataccttatagacaacatgtcagccacacatcgtc

SEQ ID NO: 4811 - DNA, 1434 bp, Setaria italica
cgatccggtgccagtggccaactgcgccccatctgttaacgcattcgtagcatgcacggcgcccaaatatttgttgcagccttctccccttctaataccctgccattgcagcctcatcctctcacacttgccagcgctgccatctccacaagccaagaagctctcagagccatggccaccgccgcgtcgaccctccacaagtcctccttcggcggcgcccggctcccgtcggcgccgcgcgccccgtcctccgccgccgccgtggccacccctcgcgccgccggcgtgcccatccgcgcctccatctccaacccgccctacgacctcacgtccttcaagttcagccccatcaaggagtccatcgtctcccgcgagatgacccggcgctacatgacggacatgatcacccacgccgacaccgacgtcgtcgtcgtgggcgccggctccgcgggcctctcctgcgcgtacgagctctccaaggacccctccgtcagcgtcgctatcgtggagcagtccgtgtcccccggcggcggcgcctggctgggcgggcagctgttctcggccatggtggtgcgcaagcccgcccacctgttcctcgacgagctcggcgtcgcgtacgacgaggccgaggactacgtggtggtcagtcacgccgcgctcttcacctccaccgtcatgagccgcctcctggcgcggcccaacgtgaagctcttcaacgccgtcgccgccgaggacctcatcgtcaagcagggccgcgtcgccggggtggtcaccaactgggcgctcgtcgccatgaaccacggcacccagtcgtgcatggaccccaacgtgatggaggccaaggtggtggtcagctcctgcggccacgacgggccgttcggggccaccggcgtcaagaggctccaggacatcggcatgatcagcgccgtgcccgggatgaaggccctcgacatgaacaccgccgaggacgccatcgtccgcctcacgcgcgaggtcgtgcccggcatgatcgtcaccggcatggaggtcgccgagatcgacggcgccccgagaatgggcccgacgttcggcgccatgatgatctccgggcagaaggcggcgcacctggcgctgaaggcgcttggaaggcccaacgccatcgacgggaccacccagacggcgtcgcaggcgtggcgcgaggagctcgtgatggcgtccaaggacgacgaggtcgtggacgcgtgagcaggggaaggcgttggaaacagggggtgcgcgtcgggtggagcgatctggaagtttgtgcatttctttgggactacgtatgtggcttgctgagttgttgaactctcttttggttagcagcagtgtctcgctagtgtcgtgttcgtactccgtaggtcatgccatgctatcgtgtgcggtgtctcgtgggagcaccactctaggggccct

SEQ ID NO: 4812 - DNA, 1280 bp, Pseudoroegneria spicata
ccacaagatttagaatcctcctagcagccggcatggccaccgccgctcccaccctcaagttctcctttgccggcgcccgccctccacctgccacacgctccctgtcccccgtcgtcgtctccaccccgcgcgctgtcgggcccatctcggcctccatctgctcatctaacccgccgtacaaccttaccgctttcaagttcagccccattaaggagtccatcgtttcccgcgagatgacccgccggtacatgactgacatgatcacctacgccgacactgacgtcgtcatcgtcggcgctggatccgcgggtcttacctgcgcgtacgagctctccaaggacccctctgtcagcatcgccatcatcgagcagtctgtgtcccccggcggtggcgcatggctgggcgggcaactgttctcggccatggtggtgcgcaagcccgcgcacctcttcctcgacgaactcgacgtcgcctatgacgaggcagaggactacgcggtgataaagcacgccgcgctcttcacctccaccgtaatgagccgcctcctggcgcgccccaacgtgaagctcttcaacgctgtcgccgtcgaagacctcatcgtcaagcagggccgcgtcagcggcgtggtcaccaactgggcactcgtctccatgaaccacgatacacagtcgtgcatggaccccaacgtgatggaggccaaggtggtggtgagctcctgcggccacgatggacccttcggagcaaccggtgtgaagaggctccaggacattggcatgatcgacaccgtgcccgggatgaaggcgctcgacatgaataccgccgaagacgagatcgtgcggctcacccgcgaggttgtgcctggaatgatcgtcaccggcatggaggtcgccgagatcgacggcgccccgaggatgggcccgacgttcggcgccatgatgatctctggacagaaggcggcgcacctggcgctcaaggcgctgggcaggcccaacgccatggacggctccctccagagcatgtcaccggcgctgcgcgaggagttcgtgctcgccgccaagggcgacgagatcgtggaggcctgaagagaagggagtagaaagcaggggacacgtttggggagcagtgatctgcgtctgttgccttgttagcttttggttgtcgtgaatgctgcatgccataccaccgtttgctgtctcagatttctgctggcacaatgaataaaaccgaataaaactgtgccatgttgatgtggtgtggttgatttgcttcaaaaaaaaaaa

SEQ ID NO: 4813 - DNA, 1237 bp, Festuca arundinacea
  misc_feature (630)..(630): n is a, c, g, or t
  misc_feature (843)..(843): n is a, c, g, or t
  misc_feature (900)..(900): n is a, c, g, or t
  misc_feature (915)..(915): n is a, c, g, or t
  misc_feature (930)..(930): n is a, c, g, or t
  misc_feature (933)..(933): n is a, c, g, or t
  misc_feature (990)..(990): n is a, c, g, or t
  misc_feature (1065)..(1065): n is a, c, g, or t
  misc_feature (1074)..(1074): n is a, c, g, or t
  misc_feature (1078)..(1078): n is a, c, g, or t
gcttccattcgtctccagatctagcgcagcatccacttcctcatggcagccatggccaccaccgcctccagcctcttgaagacctccttcgccggtgctcacctcccggcggccacccgcaccccttcctgcgtcgccgtcccccgtgccggcgccatctgcaactccatctcctcctccacccctccctatgacctcaacgccttcaagttcagccccatcaaggaatccgtcgtctcccgcgagatgacccggcgatacatgacggatatgataacatacgccgacaccgacgtcgtcatcgtcggagccggctccgcggggctgtcctgcgcgtacgagctgtccaaggacccgtccatcagcatcgccatcatcgagcagtccgtctcccccggcggcggcgcctggctcggcggccagctcttctccgccatggtcgtgcgcaagccggcgcacctcttcctggacgagctcaacatcgagtacgacgagcaggaggactacgtcgtcatcaagcacgccgcgctcttcacctccaccgtgatgagccgcctgctggcgcggcccaacgtgaagctcttcaacgccgtcgccgtcgaggacctgatcgtcaaggagagccgcgtngccggcgtggtcaccaactgggcgctcgtgtcgatgaaccacgacacacagtcctgcatggaccccaacgtcatggaggccaaggtcgtggtcagctcctgcggccacgacgggccgttcggcgccaccggagtcaagcggctccaggacatcggcatgatcgagacggtgcccgggatgaaggcgctcgacatgaacacggccgaggacgcnatcgtgcgcctcacccgcgaggtcgtccccggcatgatcgtcaccggcatggaggtngccgagatcgacggngcccccagaatgggnccnacgttcggcgccatgatgatctccggccagaaggcggcgcacctggcgctcaaggcnctcggccgaccgaacgccatcgacgggacgatcaagaacgcgattccggcgttgaacccagagatggtcctggcngcgattaanaacngcgacatcgtggacgcctaaacgacggaggcttacgcttgtgtttgaggaataagattgtttgatgaaacaggggatactttgggacgagaagacgtggacttcctttgtgatttgtctgctcgtgttcgactcccctatttgtctttagtttcttgat

SEQ ID NO: 4814 - DNA, 1461 bp, Avena sativa
ctctcgcacgctctcactccactcatctcctgaagccagcagagacacgcctgctcatggcagccatggccaccgccgcctccagcctcctcaagacctcgttcgccggcgctcggctcccggcggccacgcgcaccccgtcctgcgttgccaccccgcgcgccggtgccatctgcaactccatctcctcctccacccctccctacgacctcaacgccttcaagttcagccccatcaaggagtccatcgtgtcccgcgagatgacccgccggtacatgaccgacatgatcacctacgccgacaccgacgtggtcatcgtcggggccggctccgcggggctgtcctgcgcgtacgagctctccaaggacccctccatcagcatcgccatcatcgagcagtccgtgtcccccggcggcggcgcctggctcggcggccagctcttctccgccatggtcgtgcgcaagccggcgcacctcttcctcgacgagctcaacatcgagtacgacgagacggaggactacgtggtgatcaagcacgccgcgctcttcacctccaccgtgatgagccgcctcctcgcgcggcccaacgtgaagctcttcaacgccgtcgccgtcgaggacctcatcgtcaaggagaaccgcgtcgccggcgtcgtcaccaactgggcgctcgtgtccatgaaccacgacacgcagtcctgcatggaccccaacgtcatggaggccaaggtcgtggtgagctcctgcggccacgacgggcccttcggtgccacgggagtcaagaggctccaggacatcgggatgatcgagacggtgcccgggatgaaggcgctcgacatgaacacggccgaggacgctatcgtgcgcctcacccgcgaggtcgtcccaggcatgatcgtcaccggcatggaggtcgccgagatcgacggcgccccgagaatgggcccgacgttcggcgccatgatgatctccggccagaaggcggcgcacctggcgctcaaggcgctcggccggccgaacgccatcgacgggaccatcaagaacgcgactccggcgctccacccggagatggtcctggcggcgatcaacaacggcgacatcgtggacgcctgaaccacggaggcgtaggcttgtgtgtgtggaataattaagatggtttggagaaacagaggatactttgggacgaggacttcctctgtgacttgtccacccgtgtgtgtgtgattcccatgtttgtctttagtttcttgatgttagcggtctcgttcgtagcactgtcgccatgttgtgctctgccctacgacggcaacaccatgcatggatcttctcgaacaagaggagcgaataaaaggggttgaattccaatgttggtatgtgtgcgtttgagaaaagatggtactctgtgtgttaaaattaatgataaaagaggaaaagattttgatagccaacaaaaaaaaaaaaa

SEQ ID NO: 4815 - DNA, 1419 bp, Avena sativa
atctcctgaagccagcagagactcaactggacatggcagccatggccaccgccgcctctagcctcctcaagacctcgttcgccggcgctcggctcccggcggccacgcgcgccccgtcctgcgtcgccaccccacgcgccggcgccatctgcaactccatctcctcctccgcccctccctacgacctcaacgccttcaagttcagccccatcaaggagtccatcgtgtcccgcgagatgacccgccggtacatgactgacatgatcacctacgccgacaccgacgtggtcatcgtcggcgccggctccgcggggctgtcctgcgcgtacgagctctccaaggacccctccatcagcatcgccatcatcgagcagtccgtgtcccccggcggcggcgcctggctcggcggccagctcttctccgccatggtcgtgcgcaagccggcgcacctcttcctcgacgagctcaacatcgagtacgacgagacggaggactacgtggtgatcaagcacgccgcgctcttcacctccaccgtgatgagccgcctcctcgcgcggcccaacgtgaagctcttcaacgccgtcgccgtcgaggacctcatcgtcaaggagaaccgcgtcgccggcgtcgtcaccaactgggcgctcgtgtccatgaaccacgacacgcagtcctgcatggaccccaacgtcatggaggccaaggtcgtggtgagctcctgcggccacgacgggcccttcggtgccacgggagtcaagaggctccaggacatcgggatgatcgagacggtgcccgggatgaaggcgctcgacatgaacacggccgaggacgctatcgtgcgcctcacccgcgaggtcgtcccaggcatgatcgtcaccggcatggaggtcgccgagatcgacggcgccccgagaatgggcccgacgttcggcgccatgatgatctccggccagaaggcggcgcacctggcgctcaaggcgctcggccggccgaacgccatcgacgggaccatcaagaacgcgactccggcgctccacccggagatggtcctggcggcgatcaacaacggcgacatcgtggacgcctgaaccacggaggagtaggcttgtgtgtgtggaataattaagatggtttggagaaacagaggatactttgggacgaggacttcctctgtgacttgtccacccgtgtgtgtgtgattcccatgtttgtctttagtttcttgatgttagcgtctcgttcgtagcactgtcgccatgttgtgctctgccccacgacggcaacaccatggatctcgaacaagaggagcgaataaaaagggttgaattccaatgttggtatgtgtgcgtttgagaaaagatggtactatgtgtgttaaaatctatctattatatactaaaagtaatataaaggtgtttt

SEQ ID NO: 4816 - DNA, 1506 bp, Avena sativa
tctcactccactcatctcctgaagccagcagagactcaactggacatggcagccatggccaccgccgcctctagcctcctcaagacctcgttcgccggcgctcggctcccggcggccacgcgcgccccgtcctgcgtcgccaccccacgcgccggcgccatctgcaactccatctcctcctccgcccctccctacgacctcaacgccttcaagttcagccccatcaaggagtccatcgtgtcccgcgagatgacccgccggtacatgactgacatgatcacctacgccgacaccgacgtggtcatcgtcggcgccggctccgcggggctgtcctgcgcgtacgagctctccaaggacccctccatcagcatcgccatcatcgagcagtccgtgtcccccggcggcggcgcctggctcggcggccagctcttctccgccatggtcgtgcgcaagccggcgcacctcttcctcgacgagctcaacatcgagtacgacgagacggaggactacgtggtgatcaagcacgccgcgctcttcacctccaccgtgatgagccgcctcctcgcgcggcccaacgtgaagctcttcaacgccgtcgccgtggaggacctcatcgtcaaggagaaccgcgtcgccggcgtcgtcaccaactgggcgctcgtgtccatgaaccacgacacgcagtcctgcatggaccccaacgtcatggaggccaaggtcgtggtgagctcctgcggccacgacgggcccttcggcgccacgggagtcaagaggctccaggacatcgggatgatcgagacggtgcccgggatgaaggcgctcgacatgaacaccgccgaggacgccatcgtgcgcctcacccgcgaggttgtcccaggcatgatcgtcaccggcatggaggtcgccgagatcgacggcgccccgagaatgggcccgacgttcggcgccatgatgatctccggccagaaggcggcgcacctcgcgctcaaggcgctcggccggccgaacgccatagacgggaccatcaagaacgcgactccggcgctccacccggagatggtcctggcggcgatcaacaacggcgacatcgtggacgcctgaaccagggaggcgtaggcttgtgtgtgtggaataattaagatggtttggagaaacagaggatactttgggacgaggacttcctctgtgacttgtccacccgtgtgtgtgtgattcccatgtttgtctttagtttcttgatgttagcgtcccgttcgtagcactgtcgccatgttgtgctctgccccacgacggcaacaccatggatctcgaacaagaggagcgaataaaaagggttgaattccagtatcggtatgtgtgcgtttcagaaagatactacggagtacgagtatgcgtaaggccttgtttatttctctagtgtttttatccatttgagttttgaaaatatgcagaaatttggtgtttattcaatactctctaataatcttctaacaaaaaaaaaaaaaa

SEQ ID NO: 4817 - DNA, 1384 bp, Avena sativa
tttccacccgtcttccagatctagagcaggatccacctccacatggcagccatggccaccaccgcctccagcctcctcaagacatcatttgtcggtgctcacctcccggcggccagccgcaccccttcgtgcatggccgtcccacgtgccggcgccatctgcaactccatctcctcctccacccctccctatgacctgaacgccttcaatttcagccccatcaaggaatccatcgtctcccgcgagatgacccgcaggtacatgacggacatgatcacgtacgctgacaccgacgtggtcatcgtcggcgccggctccgcgggtctgtcctgcgcgtacgagctctccaaggacccgtccatcagcatcgccatcatcgagcagtccgtctcccccggcggcggcgcgtggcttggcgggcagctcttctccgccatggtcgtgcgcaagccggcgcacctgttcctagacgagctgaacatcgagtacgacgagcaggaggactacgtggtcatcaagcacgccgcgctcttcacctccaccgtgatgagccgcctcctggcgcggcccaacgtgaagctcttcaacgccgtggccgtggaggacctgatcgtgaaggagaaccgcgtcgccggcgtggtcaccaactgggcgcttgtgtcgatgaaccacgacacacagtcgtgcatggaccccaacgtcatggaggccaaggtcgtggtgagctcctgcggccacgatgggccgttcggcgccaccggagtcaagcgcctccaggacatcggcatgatcgagacggtgcccgggatgaaggcgcttgacatgaacacggccgaggacgcaatcgtgcgcctgacccgcgaggtcgtccccggcatgatcgtcaccggcatggaggtcgccgagatcgacggcgccccgagaatgggcccaacgttcggcgccatgatgatctccggccagaaggcggcgcacctggcgctcaaggcgctgggccggccgaacggcatcgacggaactctgaagaacgtgactcccgctctgcacccggagatggtcctggcgtcggcagacaacggcgacatcgtggacgcctgaactgaacggctgaggtgacagacaccaaggcctacgcgggtgtctggggcagcaaccaataagatggtttgatgaaacagaggagccccctttgggacgaggagacgaggacttccattgtgattcgtcggctcgtgcttaattcctctgtttttatgtttattattgtttaatttcgtgatgatgttagcgtcttgttcgtagcagtgccgccgtgtgctgtgtgcatcgtgacggcaactccatggatcatggatccttctggaccaagaggaggaaataaaat

SEQ ID NO: 4818 - DNA, 1800 bp, Brachypodium distachyon
actcatgccaagagaccacacaaaatatccccgatgagtccaaaggccgacaccttcggatctgatcgcacgtacacacaaccaccggatatttgcctgctcctctcctcttcttataccctgccaccgccccttatccccatccacccatctccagaaacccaagaaacttcgcacggaaccagatccacctcaccatggcagccatggccacctccgcctccagcctcctcaagacctccttcgccggcgctcgcctcccggcggccgccgcgcgcaccccgtccagcgtcgccaccccgcgcgccggcgccatctgcaactccatctccgcctccacccctccctacgacctcaacgccttcaagttcagccccatcaaggaatccatcgtctcccgcgagatgacccgccggtacatgaccgacatgatcacctacgccgacacggacgtcgtcatcgtgggggccggctccgcggggctgtcctgcgcctacgagctctccaaagacccgtccatcagcatcgccatcatcgagcagtccgtgtccccggggggcggcgcctggctcgggggccagctcttctccgccatggtcgtgcgcaagccggcgcacctgttcctcgacgagctcaacatcgagtacgacgagcaggaggactacgtcgtcatcaagcacgccgcgctcttcacctccacggtgatgagccgcctcctggcccgccccaacgtgaagctcttcaacgccgtggccgtggaggacctgatcgtgaaggaggaccgcgtcgccggcgtcgtcaccaactgggcgctcgtgtcgatgaaccacgacacacagtcctgcatggaccccaacgtcatggaggccaaggtggtggtgagctcctgcggccacgacgggcccttcggcgccacgggagtcaagaggctccaggacatcgggatgatcgacacggtgcccgggatgaaggcgcttgacatgaacatggccgaggacgccatcgtgcgcctcacccgcgaggtcgtccccggcatgatcgtcaccggcatggaggtcgccgagatcgacggcgccccgagaatgggcccgacgttcggcgcgatgatgatctccggccagaaggcggcgcacctggctctgaaggcgctcggccggccgaacggcatcgacgggacgctcaagaacgcgaccccggcgctgcacccggagatggtgctggcctcggcgaacaacggcgacgtcgtggacgcctgaacaaacggcctgaggcgacgccctttagggggtgggtgacaatcaataagatggttgaatgaaacagaggaggcttcgagacgaggactttctgtgtgctttgtcgacttgttttaactcccctgtttgtctctagcttcgtgatgttagcgtcttgttcatagcgctgccgccgtgtgatcggcctcgtgaaactccatggatccttctgggactagaggagcgaataaaaaggttatttagttgtttcatggtgctggtgcgcttatttactccgttactactctgaatgtttgggctatttcttgcggagactaattgttgctcctcccttccagtttataaggctttttgaacaatatctgaaaaacctgtgttctattttttccccctgaatttcaactaagggccagttcgtttctgccctgggaaaagtggaaattcagttcaatttccccagattccctctcaatccctgcaggaatttctgcaaacgaacaaggcctaagcaattttgatatttggtggttcatggtatcccctc

SEQ ID NO: 4819 - DNA, 1375 bp, Hordeum vulgare
gatcagtctccggtctccacccatctcagcaaaaaagaagctagcacagctccacacacaccatggcagccatggccaccaccgcctccagcctcctcaagagctccttctccggcgtccgcctcccggcggcggcccgcaccccgtcctgcgttgccaccccgcgcgccggcgccatctgcaactcaatctcctcctccactcctccctatgacctcaacgccttcaagttcagccccatcaaggagtccatcgtatcccgcgagatgacccgccgctacatgaccgacatgatcacctacgccgacaccgacgtcgtcatcgtcggcgccgggtccgcggggctgtcctgcgcgtacgagctctccaaggacccctccatcagcatcgccatcatcgagcagtccgtgtcccccggcggcggcgcgtggctcggcggacagctcttctccgccatggtcgtgcgcaagccggcgcacctcttcctcgacgagctcaacatcgagtacgacgagcaggaggactacgtcgtcatcaagcacgccgcgctcttcacctccaccatcatgagccgcctcctcgcgcgccccaacgtcaagctcttcaacgccgtcgccgtggaggacctcatcgtcaaggagaaccgcgtcgccggagtcgtcaccaactgggcgctcgtctccatgaaccacgacacacagtcctgcatggaccccaacgtcatggaggccaaggtcgtggtgagctcctgcggccacgacgggcccttcggcgccaccggggtcaagcggctccaggacatcggcatgatccaggcggtgcccgggatgaaggcgcttgacatgaacacggccgaggacgccatcgtgcgcctcacccgcgaggtcgtcccgggcatgattgtcaccggcatggaggtcgccgagatcgacggtgccccgagaatgggcccgaccttcggcgccatgatgatctccggccagaaggcggcgcacctggcgctcaaggccctcggccggccgaacggcatcgacgggacgctcaagaacgttaccccggcgctgcacccggagatgatcctggcggcgtccaacaacgccgacatcgtcgacgcctaagcaacgagctggtgtttgggggcaacaaatcaataagatggttcggtgaaacagaggatgcttagggacgagggcttgcctatgtgatttgtcagactcgtgtttaattccgatgttatctttagttttcttatgttagtgtattttgttcatgtcactgcccgccatgtgctctgctctgctctgccccatgtcagctccatggatgatgagtccttctgtaacaagagggaataaaaaggttgaatctaaaaaaa

SEQ ID NO: 4820 - DNA, 1619 bp, Hordeum vulgare
attgacagaggatcccaggtgctccacaaaaatatcccgaatgagtccaaagtctgtgacatgctcagatctggcagcacgtacccacaatctgcagatatttcgcctctcctcctcttcttataccctgccactcacactcccccttatcatcagtctccggtctccacccatctcagcaaaaaagaagctagcacagctccacacacaccatggcagccatggccaccaccgcctccagcctcctcaagagctccttctccggcgtccgcctcccggcggcggcccgcaccccgtcctgcgttgccaccccgcgcgccggcgccatctgcaactcaatctcctcctccactcctccctatgacctcaacgccttcaagttcagccccatcaaggagtccatcgtatcccgcgagatgacccgccgctacatgaccgacatgatcacctacgccgacaccgacgtcgtcatcgtcggcgccgggtccgcggggctgtcctgcgcgtacgagctctccaaggacccctccatcagcatcgccatcatcgagcagtccgtgtcccccggcggcggcgcgtggctcggcggacagctcttctccgccatggtcgtgcgcaagccggcgcacctcttcctcgacgagctcaacatcgagtacgacgagcaggaggactacgtcgtcatcaagcacgccgcgctcttcacctccaccatcatgagccgcctcctcgcgcgccccaacgtcaagctcttcaacgccgtcgccgtggaggacctcatcgtcaaggagaaccgcgtcgccggagtcgtcaccaactgggcgctcgtctccatgaaccacgacacacagtcctgcatggaccccaacgtcatggaggccaaggtcgtggtgagctcctgcggccacgacgggcccttcggcgccaccggggtcaagcggctccaggacatcggcatgatccaggcggtgcccgggatgaaggcgcttgacatgaacacggccgaggacgccatcgtgcgcctcacccgcgaggtcgtcccgggcatgattgtcaccggcatggaggtcgccgagatcgacggtgccccgagaatgggcccgaccttcggcgccatgatgatctccggccagaaggcggcgcacctggcgctcaaggccctcggccggccgaacggcatcgacgggacgctcaagaacgttaccccggcgctgcacccggagatgatcctggcggcgtccaacaacgccgacatcgtcgacgcctaagcaacgagctggtgtttgggggcaacaaatcaataagatggttcggtgaaacagaggatgcttagggacgagggcttgcctatgtgatttgtcagactcgtgtttaattccgatgttatctttagttttcttatgttagtgtattttgttcatgtcactgcccgccatgtgctctgctctgctctgccccatgtcagctccatggatgatgagtccttctgtaacaagagggaataaaaaggttgaatctatgaccctgattggatacttagctcggttacaggttaaagttagattttaatcctgaattaattttaaactaactttaactaaaaaagtgtttgaatggca

SEQ ID NO: 4821 - DNA, 1417 bp, Leymus cinereus x Leymus triticoides
gtctccacccatctccagcaaaaaagaagctagcacagctccacatatcatggcagccatggccaccaccgcctccagcctcctcaagacctccttctccggcgtccgcctcccggcggcggcccgcaccccgtcctgcgtcgccaccccgcgcgctggcgccatctgcaactccatctcctcctccacccctccctacgacctcaacgccttcaagttcagccccatcaaggagtccatcgtgtcccgcgagatgacccgccgctacatgaccgacatgatcacctacgccgacaccgacgtcgtcatcgtcggcgccggctccgcggggctgtcctgcgcctacgagctctccaaggacccctccatcagcatcgccatcatcgagcagtccgtgtcccccggcggcggcgcctggctcggcggccagcttttctccgccatggtcgtgcgcaagccggcacacctcttcctcgacgagctcaacatcgagtacgacgagcaggaggactacgtcgtcatcaagcacgccgcgctcttcacctccaccgtcatgagccgcctcctcgcgcgccccaacgtcaagctcttcaacgccgtcgccgtcgaggacctcatcgtcaaggaggaccgcgtcgccggcgtcgtcaccaactgggcgctcgtctccatgaaccacgacacacagtcgtgcatggaccccaacgtcatggaggccaaggtggtggtgagctcctgcggccacgacgggcccttcggcgccaccggggtcaagcggctccaggacatcggcatgatccagacggtgcccgggatgaaggcgcttgacatgaacacggccgaggatgccatcgtgcgcctcacccgcgaggtcgtccccggcatgattgtcaccggcatggaggtcgccgagatcgacggcgccccgagaatgggcccgaccttcggcgccatgatgatctccggccagaaggcggcgcacctggcgctcaaggccctcggccggccgaacggcatcgacgggacgctcaagaacgcgaccccagcgctgcacccggagatgatcctggcgtcgaccaacaacggcgacatcgtggacgcctaagcggaggtgacggtcaccaaggcgtacgtacgctggtgtttgggggcaacaaatcaataagatagttcggtgaaacagaggatgcttagggacgagggcttacctttgtgatttgtcgactcgtgtttaattcagatgtttatctttagttttcttatgttagcgtattttgttcatgccacctgcccgccatgtgctctgctctgctctgtcccacggcagctccatggatgatgaatccttctggaacaagaggagggaataaaaaggttgagttctcccgcaaaataaataaataaaaaggttgagttc

SEQ ID NO: 4822 - DNA, 1385 bp, Pseudoroegneria spicata
acccatctcagcaaaaaagaagctagcacagctccacacaccatggcagccatggccaccaccgcctccagcctcctcaagacctccttctccggcgtccgcctcccggccgcggcccgcaccccgtcctgcgtcgccaccccgcgcgccggcgccatctgcaactccatctcctcctccacccctccctacgacctcaacgccttcaagttcagccccatcaaggagtccatcgtctcccgcgaaatgacccgccgctacatgaccgacatgatcacctacgccgacaccgacgtcgtcatcgtcggcgccggatccgcggggctgtcctgcgcgtacgagctctccaaggacccctccatcagcatcgccatcatcgagcagtccgtgtcccccggcggcggcgcgtggctcggcggccagctcttctccgccatggtcgtgcgcaagccggcgcacctcttcctggacgagctcaacatcgagtacgacgagcaggaggactacgtcgtcatcaagcacgccgcgctcttcacctccaccgtcatgagccgcctcctcgcgcgccccaacgtcaagctcttcaacgccgtcgccgtcgaggacctcatcgtcaaggagaaccgcgtcgccggcgtcgtcaccaactgggcgctcgtctccatgaaccacgacacacagtcctgcatggaccccaacgtcatggaggccaaggtcgtggtgagctcctgtggccacgacgggcccttcggcgccaccggggtcaagcggctccaggacatcggcatgatccaggcggtgcccgggatgaaggcgcttgacatgaacacggccgaggatgccatcgtgcgcctcacccgcgaggtcgtccccggcatgattgtcaccggcatggaggtcgccgagatcgacggcgctcccagaatgggcccgaccttcggcgccatgatgatctccggccagaaggcggcgcacctggcgctcaaggccctcggccggccgaacggcatcgacgggacgctcaagaacgtgaccccggcgctgcacccggagatgatcctggcggcgaccaacaacggcgacatcgtggacgcctaagcaaagcaatgaaccacggacaccaaggcgtacgtacgctggtgtttgggggcgaaaaatcaataagatggttcggtgaaacagaggatgcttagggacgagggcgtgtctttgtgatttgtcagactcgtgtttaattccgatgtttatctttagttttcttgtgttagcgtattttgttcatgccacctgcccaccatgtgctctgctctgccccacggcagctccatggatgatgaatccttctggaacaagaggagggaataaaaaggttgaattctatgtta

SEQ ID NO: 4823 - DNA, 1372 bp, Secale cereale
aaaacagaagctagcacagctccacacaccatggcagccatggccaccaccgcctccagcctcctcaagacctccttctccggcgtccgcctcccggcggcggcccgcaccccgtcctgcgtcgccaccccgcgcgccggcgccatctgcaactccatctcctcctccacccctccctacgacctcaacgccttcaagttcagccccatcaaggagtccatcgtctcccgcgagatgacccgccgctacatgaccgacatgatcacctacgccgacaccgacgtcgtcatcgtcggcgccggatccgcgggactgtcctgcgcgtacgagctctccaaggacccctccatcagcatcgccatcatcgagcagtccgtgtcccccggcggcggtgcgtggctcggcgggcagctcttctccgccatggtcgtgcgcaagccggcgcacctcttcctcgacgagctcaacatcgagtacgacgagcaggaggactacgtcgtcatcaagcacgccgcgctcttcacctccaccgtcatgagccgcctcctcgcgcgccccaacgtcaagctcttcaacgccgtcgccgtcgaggacctcatcgtcaaggagaaccgcgtcgccggcgtcgtcaccaactgggcgctcgtctctatgaaccacgacacacaatcctgcatggaccccaacgtcatggaggccaaggtggtggtgagctcctgcggccacgacgggcccttcggcgccaccggggtgaagcggctccaggacatcggcatgatccagacggtgcccgggatgaaggcgcttgacatgaacacggccgaggacgccatcgtgcgcctcacccgcgaggtggtccccggcatgattgtcaccggcatggaggtcgccgagatcgacggcgccccgagaatgggcccgaccttcggcgccatgatgatctccggccagaaggcggcgcacctggcgctaaaggccctcggccggccgaacggcatcgacgggacgctcaagaacgtgaccccggcgctgcacccggagatgatcctggcggcgaccaacaacggcgacatcgtggacgcctaagcaaagcaatgaaccacggacaccaaggcgtacgtacgctggtgtttgggggcgaaaaatcaataagatggttcggtgaaacagaggatgcttagggacgagggcttgtctttgtgatttgtcagactcgtgtttaattccgatgtttatctttagttttcttgtgctagcgtattttgttcatcccacctgcccgccatgtgctctgccctgctctgccccacggcagctccatggatgatgaatccttctggaacaagaggagggaataaaaaggttgagttct

SEQ ID NO: 4824 - DNA, 1415 bp, Triticum aestivum
gacccacgcttccgagtctccacccatctcagccaaaaaaaagctagcacagctccacacaccatggcagccatggccaccaccgcctccagcctcctcaagacctccttctccggcgtccgcctcccggcggcggcccgcaccccgtcctgcgtcgccaccccgcgcgccggcgccatctgcaactccatctcctcctccacacctccctacgacctcaacgccttcaagttcagccccatcaaggagtccatcgtgtcccgcgagatgacccgccgctacatgaccgacatgatcacctacgccgacaccgacgtcgtcatcgtcggcgccggatccgcggggctttcctgcgcgtacgagctctccaaggacccctccatcagcatcgccatcatcgagcagtccgtgtcccccggcggcggcgcctggctcggcggccagctcttctccgccatggtcgtgcgcaagccggcgcacctcttcctcgacgagctcaacatcgagtacgacgagcaggaggactacgtcgtcatcaagcacgccgcgctcttcacctccacggtcatgagccgcctcctcgcgcgccccaacgtcaagctcttcaacgccgtcgccgtggaggacctcatcgtcaaggaggaccgcgtcgccggcgtcgtcaccaactgggcgctcgtctccatgaaccacgacacacagtcctgcatggaccccaacgtcatggaggccaaggtcgtggtgagctcttgcggccacgacgggcccttcggcgccaccggggtcaagcggctccaggacatcggcatgatccaggcggtgcccgggatgaaggcgctcgacatgaacacggccgaggatgccatcgtgcgcctcacccgggaggtggtccccggcatgattgtcaccggcatggaggtcgccgagatcgacggcgccccgagaatgggcccgaccttcggcgccatgatgatctccggccagaaggcggcgcacctggcgctcaaggccctcggccggccgaacggcatcgacgggacgctcaagaacgtgaccccggcgctgcacccggagatgatcctggcggcgaccaacaacggcgacatcgtggacgcctaagcaaagcaatgaaccacggacaccaaggcgtacgtacgctggtgtttgggggcgcaaaatcaataagatggttcggtgaaacggaggatgcttagggacgagggcttgtctttgtgatttgtcagactcgtgtttaattccgatgtttatctttagttttcttgtgttagcgtattttgttcatgccacctgcccgccatgtgctctgctctgctctgcctcacggcagctccatggatgatgaatccttctggaacaagaggagggaataaaaaggttgagttctaaaaaaaaaa

SEQ ID NO: 4825 - DNA, 3320 bp, Triticum aestivum
cgatcttcgcctctcatcctcctcttataccctgccactcacactccccttatcatcagtctccagtctccacccatctcagcaaaaaagaagctagcacagctccacacaccatggcagccatggccaccaccgcctccagcctcctcaagacctccttctccggcgtccgcctcccggcggcggcccgcaccccgtcctgcgtcgccaccccgcgcgccggcgccatctgcaactccatctcctcctccacacctccctacgacctcaacgccttcaagttcagccccatcaaggagtccatcgtgtcccgcgagatgacccgccgctacatgaccgacatgatcacctacgccgacaccgacgtcgtcatcgtcggcgccggatccgcggggctgtcctgcgcgtacgagctctccaaggacccctccatcagcatcgccatcatcgagcagtccgtgtcccccggcggcggcgcctggctcggcggccagctcttctccgccatggtcgtgcgcaagccggcgcacctcttcctcgacgagctcaacatcgagtacgacgagcaggaggactacgtcgtcatcaagcacgccgcgctcttcacctccacggtcatgagccgcctcctcgcgcgccccaacgtcaagctcttcaacgccgtcgccgtggaggacctcatcgtcaaggaggaccgcgtcgccggcgtcgtcaccaactgggcgctcgtctccatgaaccacgacacacagtcctgcatggaccccaacgtcatggaggccaaggtcgtggtgagctcttgcggccacgacgggcccttcggcgccaccggggtcaagcggctccaggacatcggcatgatccaggcggtgcccgggatgaaggcgctcgacatgaacacggccgaggatgccatcgtgcgcctcacccgggaggtggtccccggcatgattgtcaccggcatggaggtcgccgagatcgacggcgccccgagaatgggcccgaccttcggcgccatgatgatctccggccagaaggcggcgcacctggcgctcaaggccctcggccggccgaacggcatcgacgggacgctcaagaacgtgaccccggcgctgcacccggagatgatcctggcggcgaccaacaacggcgacatcgtggacgcctaagcaaagcaatgaaccacggacaccaaggcgtacgtacgctggtgtttgggggcgaaaaatcaataagatggttcggtgaaacggaggatgcttagggacgagggcttgtctttgtgatttgtcagactcgtgtttaattccgatgtttatctttagttttcttgtgttagcgtattttgttcatgccacctgcccgccatgtgctctgctctgctctgcctcacggcagctccatggatgatgaatccttctggaacaagaggagggaataaaaaggttgagttctatgttggtgtgtcggctctgtttactccatggccggatcgagttttcttttttccagtttccggtgacacataaatcagcaatcaaggtttatttttgcgggtgaaaaatgtattactcaactcgagaagttcatacagtcaatcgtagctaattccgtagcaaccaagaaccgatccaagtcatggttctaccttctaaacgagcaaactgagctaaactatcactaaccttattttggctacgaacgatataagtaatacatgattcacgaatagtcataagatactaatctccttgataagcaatgcatagattgatctatccacctcttttgcctggatcatcttcactgcaataaggagtacgacacaaagtattcacacatatgcaataatgcaagcatgcgtaacaaagcaacaatgcatgctgtaaatgaaacaaacatcaaagtagagtgaaattatttggaagaaaaaaattccctacttatctcctcgtcggttaaaaaatccggtcggacagtctggattgatcgaatgattatggtatagacatagataattatgcatctgttctgtagtaaaaagttcaatctagaaacattactagtctgatacacacaaaggttcaaccgtttgagtcacatatgccacagcacagctaaaatgtgtctggaaatgacagaatgtttcagcctataatttggtatagaactagcagagtaacagtgaaaaagggatgctactcgatcgaatatgtccaataggcggatagtcaacaatggccaaccaacctagcatctagaggcttcacttcagggtacttttgctgtagaagagacattccattccacattgctgaaaagcccagcacaagcagggtgtatataatctgcatatgcgtcaggtccaccactactacatacgctgatacgcctgaagggcatcccatcatcctcctagaaagttaaactctgtgaagctcagaacgagttcatttcaaggctgtatgtccgccgcttgaaaagcacctttgccgctgttcgatatggctcctcaaaggcatctgagatccagctagctcctgccggaccagcagcctcaacccctcctccctccctcagcacatcgtcacttggtctgatcgccaccagcgtggcgcccttcagcagtactcccccgggaagttcaatatgcggggcataccaaagtctcataatgagcgctggcatgagcgtgcggtgtgaattgccagaaaccgacacaggccgcactcgcagctcctgtaactgcttcttgtccatagtgagcacaccctgcccgtcagcatccgttaggttcaagctatcaagcatttcatgatcggcgatgattggctgcagcaagtaatgccgagccgatgcagcaatcagcgagctgatggtccagacgacgcggagcttaaggcccccattcgtatgaagcgactcggggatgctcgccaattcttcaggctccctgttgtcatccagagatgtagcctcgctgtcctcggcattaggggacgacattggtgattgcagcggttttgacgatacagaggacgcgccgaggataacacagctgccgagggtggacccaaagtcggccttccacttgaggagcacgccgtcgtcaatgccgagctcgccggtgggcagctcgatgcggaggctgcggagctccttgaaggagcggaggacctcggagggcgagtggtgggagatgtccccggcgggcggaggcggcgaggcgggcggcggggccacggagcggcgggagacgatggccagggtgggggagaggatctggccgagcgcctggatgggcctgacgatgccgccga

SEQ ID NO: 4826 - DNA, 1755 bp, Oryza sativa
agggagaaaggttggaaacgtgggattgcaaacacagcattagtcgtcacggtacccagcaaaaaatcactgaacacagcaccactgttcccgtgagtccgtaacttagcagcacttgtcccgttctcctgaagacagtccaaaaaccctcactaaaccttcccaaaatatctcctccaatcaatccgaaacccagaggcccatactgctgacacgtggacggcactcccagatatttgcgctctcctcttcttcttatacccccgccaacccacgctctatccactcacacacactctcctcatcccagagcaagaagctcagctcctcctcctctcgcatggcagccatggccaccaccgcgtccagcctcctcaagacctccttcgctggcgcgcgcctccccgccgccgcccgcaaccccaccgtctccgtcgcgccgcgcaccggcggcgccatctgcaactccatctcgtcgtcgtcgtccactcccccctacgacctcaacgccatcaggttcagccccatcaaggagtccatcgtgtctcgcgagatgacccggcggtacatgaccgacatgatcacctacgccgacaccgacgtcgtcgtcgtcggcgccggctccgcggggctctcctgcgcgtacgagctctccaaggacccctccgtcagcgtcgccgtcatcgagcagtcggtgtcccccggcggcggcgcgtggctcggcgggcagctgttctccgccatggtggtgcgcaagccggcgcacctgttcctcgacgagctcggcgtcgcgtacgacgagcaggaggactacgtcgtcatcaagcacgccgcgctcttcacctccaccgtcatgagccgcctcctggcgcgccccaacgtgaagctgttcaacgccgtcgccgtcgaggacctcatcgtcaaggagggccgcgtcggcggcgtggtcaccaactgggcgctggtgtcgatgaaccacgacacgcagtcgtgcatggaccccaacgtgatggagtccagggtggtggtgagctcctgcggccacgacgggccgttcggcgccacgggcgtcaagcggctgcaggacatcggcatgatcgacgccgtgcccggcatgcgcgccctcgacatgaacaccgccgaggacgagatcgtccgcctcacccgcgaggtcgtccccggcatgatcgtcaccggcatggaggtcgccgagatcgacggcgccccgagaatgggcccgacgttcggagccatgatgatctccggccagaaggcggcgcacctggcgctgaaggcgctcggccggccgaacgccatcgacggcacgatcaagaaggcggcggcggcggcggcgcacccggagctgatcctggcgtcgaaggacgacggcgagatcgtggacgcctgagcgaatagaacagggtaaaaaaaaatccgcaagacgtggtggtgacacggaggagttggggacgagaagaagatgtggactttcccctgtgtttttttttcgggatttgcattgatccccttgtttgttttagctctggatgttgattagcgtcttgttcatagcacttccactgccaccgtgtgtgtgtgctctgcttgcctgatgagggcaagaaaacttccatggatccgtctctctgggaggaatgaataaaaaggatgaggaaataaaaatgattcagtgccattatatttgttggtcaggttgatgctaatatgatggctgcatgtttttatatgtggaca

SEQ ID NO: 4827 - DNA, 1517 bp, Zea mays
ggactttgcatgcttgggctcgtcggcaaccggacaggaggacagcaaggcggaagcgcaaccgggcgtcgctggtccgacgggcggcacgtgtcagggagcgtgacaggggcggcagatccggacctccacgtccgtatccatatccacatccatccatcaaacacggaagagagagagggagggagggagaggagagattattttggaccagttccaccgcttaatttgcaggaccgccaccccccgcggcgccgacgatcacctcaggcgtgcgcggatatggggcgccgcggctcctccgaccgcctcgaggcgctctccctcgagatcgagcgcaagctgcacaaggccctgatgtccaactcacagcgtcttcagatacttcagcaattgtttgctgacatcgcattgaaggtggatgaccgcgctcgagatgcaattatgagtgagaatgatgatggcattgctccagcagatgaacgggaggatggttggctatgcttctatgagattcttgccaatcattttgttagagtgcctgaaagtggcaggcgtatacttgagttgatagtgcaactctggagccagtccttcgcggccaacatatttgcacttcttttccagaaatggttgtttgaagcccctcttgatgaaaaagaaatatcgctacgatatagctctgctcttgttcaaggtgctacaaatgtattttggattgacatacagacaaatacaagacattttctctctttgtatcattatctccttgaggacgttgctctagtccctgaaagacttagtaaaatatcattacaggctggtagagaccttttccttctgctctctagattcatgttcttctatgatcaagatcacatgctttctagtttcctagagcattttcccaatttcccaaattccttcttggttggtggaccagcagattactttgtaattgaactcgctgatcagcttcaaaagctaaaaattgagccagtactactacactacctctcccgcatgagcatacttcaagggttggaactgaggttgagtacaagcaccagactaaaggcctgcctctacagcttcacttctcctggtggccctacctacccaacacgggcggtgcggcacgcagcctggaacaccttggatttgctgttccctatcggtcgttacccgaggcacgtgatcagcctgttcttccggctgctgtatccgtggtactggccttcctcttgctggaacttcgtgatgacctgtgccatgaccgtgtactactacatcctgaacctgctggtgtcgtgttgggagaacatgaggcggcggcccagtcaccggagaacgcacggtgaatgaagacgcggcggcccatccagtggcaccttgtgttgttgttgttgttcatttttctttcctttgcgcgagtggtgtagtagttagtagcagcggcttatgtgttcgtcgcgaaacaacattccctgtataatataaactgctgtacttgttca

SEQ ID NO: 4828 - DNA, 1528 bp, Panicum virgatum
ccggcgaccggacagcgaggcggacgcaaccgggcgtcggcctcgcggcggccggcacgtggcagcgagcggggacagcagcagcagtatccatatccatccatccatcaaacgcggagcaatttttttttctttcgggccaaaaattccaccgctcaattcgcaggaccgcccccgcctccggcgaccacctcccggcggcagcggtcatgcggagccggagctccaccgaccgcctggaggcgctctccatcgagatcgagcgcaagctgcagaaggctctgagctcaaactcacagcgtctccagatactgcagcaattgtttgccgatatcgcattgaaggtggatgatcgtgcccgagatgcaattatgagcgagaatgatgatggcattgctccagtagatgaacgagaagatggtcggctgtgcttctatgagattcttgccaatcattttgttcgagtacccaaaagtgggcggcgtatactcgagttgatagtgcaactctggagccagtcctttgcgtccaatatatttgcacttcttttccacaaatggttgtttgaagcccctcttgatggaaaggaaatatcgctaagatacagctctgcccttgttcaaggtgctacaaatgtattttggattgacatacagacaaatacaagacattttctctccttgtatcattatctccttgaagatgttgctctaatccctgaccggcttactaaaatatcattacaggctggtagagaccttttccttctgctctctagattcatgttcttctatgatcaggatcatttgctctctagtttcctagagcattttcccccttttccaaattctttcttggttggtggtccagcagattactttgtaattgaactcactgatcagcttcaaaagctaaaaattgagccagtactactgcactacctctcccgcatgagcatacttcaagggttggaactgaggttgagtacaagcactagattaaaggcctgcctctacagcatcacttctcctggtggccctacctatccaacacgagcagtgcggcatgcagcctggaatacattggatttgcttttccctgttggtcgctacccaaggcacgtgataagcctgttcttccggctgctgtatccgtggtactggccttcctcttgctggaacttcgtggtgacctgtgccatgactatctactactacattttaaacctgctcgtctcaacctgggagagcctgaggcggcatagtcatcgaagaacgcacggtgaatgaaggcatgatggctgaaccagtaccatcttgtggtgttgttcattttctttcatttttcgcaaagcagtgcagtaaagcagtgccgtaagtagtaacttatgcgtttgtgcaaacaacatgttctgtataaactgctacatttgttcagttgtctgtataggaagaggaacagaaggtgatgaaggagagcatgtgcatttctggcttcgtttctccggtatttactaacttgcagtgcc

SEQ ID NO: 4829 - DNA, 1398 bp, Panicum virgatum
gatccatcaaacgcggagcaatttttttttttcttttcgggccaaaaattccaccgctcaattcgcaggaccgccaccgcccccacctccggcgaccacctcccggcggcagcggtcatgcggagccggagctccaccgaccgcctggaggcgctctccatcgagatcgagcgcaagctgcagaaggctctgagctcaaactcacagcgtctccagatactgcagcaattgtttgccgatatctcattgaaggtggatgatcgtgcccgagatgcaattatgagcgagaatgatgatggcattgctccagtagatgaacgagaagatggtcggctgtgcttctatgagattcttgccaatcattttgttcgagtacccaaaagtgggaggcgtatactcgagttgatagtgcaactctggagccagtcctttgcgtccaatatatttgcacttcttttccacaaatggttgtttgaagcccctcttgatggaaaggaaatatcgctaagatacagctctgcccttgttcaaggtgctacaaatgtattttggattgacatacagacaaatacaagacattttctctccttgtatcattatctccttgaagatgttgctctaatccctgaccggcttactaaaatatcattacaggctggtagagaccttttccttctgctctctagattcatgttcttctatgatcaggatcatttgctctctagtttcctagagcattttcccccttttccaaattctttcttggttggtggtccagcagattactttgtaattgaactcactgatcagcttcaaaagctaaaaattgagccagtactactgcactacctctcccgcatgagcatacttcaagggttggaactgaggttgagtacaagcactagattaaaggcctgcctctacagcatcacttctcctggtggccctacctatccaacacgagcagtgcggcatgcagcctggaatacattggatttgcttttccctgttggtcgctacccaaggcacgtgataagcctgttcttccggctgctgtatccgtggtactggccttcctcttgctggaacttcgtggtgacctgtgccatgactatctactactacattttaaacctgctcgtctcaacctgggagagcctgaggcggcatagtcatcgaagaacgcacggtgaatgaaggcatgatggctgaaccagtaccatcttgtggtgttgttcattttctttcatttttcgcaaagcagtgcagtaaagcagtgccgtaagtagtaacttatgcgtttgtgcaaacaacatgttctgtataaactgctacatttgttcagttgtctgtataggaagaggaacagaaggtgatgaaggagagcatgtgcatttt

SEQ ID NO: 4830 - DNA, 1076 bp, Saccharum officinarum
aaagagagttattttggaccagttccaccgcttatttgcaggaccgccaccgcccgcggcgcccgccgatcacctccggcgtgcgcggacatggggcgccgcggctcctccgaccgcctcgaggcgctctccctcgagatcgagcgcaagctgcagaaggctctgatctccaactcacagcgtcttcagatacttcagcaattgtttgctgacattgcattgaaggtggatgatcgtgctcgagatgcgattatgagtgagaatgatgatggcattgctccagtagatgaacgggaagatggttggctatgcttctatgagattcttgcaaatcattttgttaaagtgcctgaaagtggcaggcgtatacttgagttgatagtgcaactctggagccagtccttcgcgtccaacatatttgcacttcttttccacaaatggttgtttgaagcccctcttgatgaaaaggaaatatcgctacgatatagctctgctcttgttcaaggtgctacaaatgtattttggattgacatacagacaaatacaagacattttctctctttgtatcattatctccttgaggatgttgcgctagtccctgaccgacttactaaaatatcattacaggctggtagagaccttttccttctgctctctagattcatgttcttctatgatcaagatcccttgctttctagtttcctagagcatttccccacttttccaaattccttcttggttggtggaccagcagattactttgtaattgaactcactgatctgcttcaaaagctaaaaattgagccagtactactgcactacctctgccgcatgagcatacttcaagggatggaactgagattgagtacaagcaccagattaaaggcctgcctctacagcttcacttctcctggtggccctatgtacccaacacgtgcggtgcggcatgcagcctggaatacattggatttgctgttccctattggtcgttacccaaggcatgtgatcagcctgttcttccggctgctgtatccgtgggactggccctcctcttgctggaacttcataatgacctg

SEQ ID NO: 4831 - DNA, 1866 bp, Oryza sativa
atccatttgcaatatcaaaatcacggtgatgcctatcctgccaccaccgctgaactcgcggttactcgccagcgtcgccggcccgccacgtgtacggctctgattggaccgccctaccacgagtcagaagaggggagaggagcaaagagaacaacgacgagacgaatcgttggagaagcgaagcgacgctactcgacccagcgtccacggcgagcgccccccgccggcgacggcgacggcgagagatgcgggcccgagccgccgaccacctcgaggcgctctccctggagatcgagcgcaagctgcagaaggctctcaactccaattcgcaacgtcttcagctgctgcagcagttgtttgctgacatcgcattgaaggtggatgaccgcgctcgagatgtgattttaagcacgaacgatgatggtattgctccagtagatgagcgagaagatacccggttgtgcttctatgagattcttgctaaccattttgttaaagtacctgaaagtgggaggcgtatacttgacttgatagtgcaactctggagccagtcttttgcagcgaacatatttgcacttcttttccacagatggttattcgaagtccctcttgatgggaaggaagtatcactgagatacagctctgctcttgtccaaggagctactaatgttttttggattgacatccaaaccaatacaagacactttctctcattatataattatctccttgaagaggttgctttagtcccagatcaactgagtaagatatcagtacaggctggtagaggtcttttcctcctcctctcgagatttatgctgttctatgatcaagatcacttgcttgcaagtttccttgagcattttcctacttttccaaattctttcttggttggtggccctgcagattactatgtaattgaactcactgatcagctccagaaactaaaagttgaacctgtgcttctgcattacctctcccgcttgaccatccttcaaggattggaattgaggatgagtacaagcactagactgaaggcttgcctttacagcttcacttctcctggaggtcctacctaccctacacgagcagtaaggcatgcagcctggaatacactggatctgctttttcctgttggccgatatccaaggcatgtgataagcctgttctttcggcttctctatccgtggtactggccttcctcttgctggaactttattatgacttgcgtcaagactgtctactactacatcctcaacctaattgtctcaagctgggagaacatgagacggcccaaccaccaaaggatgcatagggactgaagaaatggcagccaaatcaaaggctagcaatagcatcttgtgttgtttttgttttccttttcttttttgttttcaagggtagcctggtagctcttatgtttgttcaaataacatttgctgtataaatttgtctgtttgttatgctgtttacacgggggatggagtgagaaaaaaaaagtaatgcaagagaaaagaaagggaagcctgcaaatttcatcagacttttcagataggaaattacattgttcagatttagtatatgtcaataatcaatggccgagattttaggaagagtctccatagagtcccttttgcaatgcagtgcatggtctgttgaggtagttgagcagcaaatggctaatgtgcagtttgtaccttgtgttgtaatacaactaagggtccaggcaatgaattgcttaggacctctgcactgtagctgccatgagcaagagtgaactgtttatctgtagtctgtactgcacataaatagatgattgtctctgttttgttttgtttgtttgtttttttggcaaatgcacaagag

SEQ ID NO: 4832 - DNA, 1912 bp, Brachypodium distachyon
gagacccccttaaaattgctttgtattcctcttttgatccatgacgcaacctttgctttaaagttaataaacacaccttgctgtaaaaagaattactcctaattcaaggtgtcaaacaaatactaattcaaaacgcaccgctgaatttctcgtctacatccgcacgagtccgccgcccgcctcagcgcgtccgcctgccgtacacgtggaaggagaggcgcacgtggacggcgacgattgataccaccgctttagaagacgagagaaaaggggaaggaaaaatgggctctcctcctccaaatcatacccccgccggagtttgaggttgctgcgcggcctgcgattcccaatcccggcgagcgtggccgaggagagatgccgccccggacgtcggaccacctcgaggcgctctccttgcagatcgagcgcaagctccacaaggctctcacctccaactcacagcgtctccagctgctgcagcagctgttcgccgatatcgcgttgaaggtggatgaccgcgctcgagatgcgattttaagcaggagtgatgagggcattcctccggtagatgaacgagaagatagttacttgtgcttctatgagattcttgcaaatcactatgtaagagtacctgaaagcggaaggcgtatacttgagttaatagtgcaactctggagccaatcctttgcagccaacatatttgcacttcttttccacagatggttgtttgaagtccctcttgatggaagggaagtatcactaagatacagctctgctcttgtccaaggagctaccaacgttttttggattgacattcaaaccaatacaagacactttctcccattgtatcattatctccttgaagaagtcgctttagtccctgatcaactgagtaagatatctttgcaggctggtagaaatctgttctgcctcctctccagattcatgctgttctatgatcaggatcacttgcttgcaagttttcttgaacatttccctgtttttccaaactctttcttggttggtggacctgcagattactttgttatcgaactcactgatcagctccagaagctaaaagtggagcctgtactgctgcactatctttctcgaatgaccatccttcaaggctgggaattgaggatgagtacaagcaccagactaaagtcatgcctttacagcttcacgtctccgggaggccctgcgtacccaacaagagcggtgcggcatgcagcctggaatacgttggattttctttttcctgtgggtcgctatccgaggcacgtgataagcctgttctttcggctactctacccgtggtactggccttcctcttgctggaacttcgtcatgacttgtgtcatgaccgtctactactacatcctgaatctgctcctctcaatctgggacaacatgaggaggcccagccatcaaaggatgcacagagaatgaagaaatggcgcgttagtcacagctagcggcttgtgttgttgttgttgataatgttcctttttgtttcagtttttggtaggttagcggctcatgtgtttgttttggtgaaatttgcgctacaaattcatctgtttgttctgtttacatggatggagagatgtgacataggcatgtgtacaatgcaaaagagaaaggaaagaaaggtaagcgtgtgcatttttggggggctggactgacaacttcacgtgattattgtaagctgaattctgcaagtatatatgtgttatttacttgcaggaatgtcattgatttagcacgctgctccatgtaaggaacacgtacttcctgcgacccatatacatttggtacaaagttgcactaaatcaacgataattaatatgggttggagggagcagtaaatttcttcatcaaagtatatatatgactgaatttcaggaga

SEQ ID NO: 4833 - DNA, 1721 bp, Triticum aestivum
cccccgggctgaggaattcggacgaggaaaaaaaacagagcaggtccgtacaatcggataccgagcgcggccggcggttcgcccccttcccaaatcccggcgacggcggtcggtcggacggagaggagatgcgggcccgcacggcggaccacctcgaggcgctctccctcgagatcgagcgcaagctgcacaaggctctgaattccaactcgcagcgcctcaagctgctgcagcagctgttcgccgatatcgcgctcaaggtcgacgaccgcgctcgagataagattttaagcaccaataatgagggaatcgctccagtagatgaacgcgaagacggccatttgtgtttctatgagattcttgcaaatcactatgtgaaagtccctcaaagtgggaggcgtatacttgagttgatagtgcaactctggagccaatcctttgcagccaacatatttgcgcttctttttcacagatggttgtttgaagtccctcttgaggggaaggaggtatcactaagatacagctctgctcttgtccaaggagctactaacgttttttggattgacattcaaaccaatacaaggtacttcctcccattgtatcattatctccttgaagaagtcgctttagttccagatcaactcattaagatatcaccacaggctggtagaaatctattctgcctcctctccagattcatgctgttctatgatcaggatcacttgcttacaagttttcttgggcatttccctgcttttccaaattctttcttggttggtggagctgcagattactttgtgattgaactcaccgatcagctccagaagctaaaagtggagccagtactgctgcactacctttcccgcatgaccatccttcaaggctgggagttgaggatgagtacaagcaccagactaaagtcatgcctgtatagcttcacatctcctggaggccctgcctatccaacaagagccgtccggcatgcagcctggaatacgttggatttactttttcctgtgggtcgctatccgaggcacgtgataagtctgttctttcggctgctctatccatggtattggccttcctcttgctggaacttcgtcatgacctgcgtgagcaccatctactactacatcctgaatctgctcgtctcgatctgggagaacatgaggaggcgcgaccatcaaaggatgcacagagaatgaagaaatcgcgaccaggcctaaaccgaggctacaatgttgtgttgttgttccttctgttttacctttaggatggttagcatcatgtgtgtgcgcatgaaatttgttgtataaatccaagtgtctgttgtgtttgttatacatggacagaggatgtgatgtgaggcagagatgtgcagtgagagagggaaggaaggggcagtttttatgctcaccagtctgaagctgtaatttgtatacaacattcagcagcttctccaaatgccatcaaaggtttatatgctctaagaggagttggcgcttttgctggaatacgttttgcccataccagctcatctagggcggaaggattcgaacctcaccgctactatctggtattattgattttccttcctggccaaaaggttgagactagattgattttccttcctttggctacttggatgtttacgttcacaaagtttgaaaaatccaaaagagaggatgctggacataggaactacggatacagtttccggg

SEQ ID NO: 4834 - DNA, 1484 bp, Secale cereale
ggagaagggagaagggggccaaaaaacaagagcgagtccgtacaatcggataccgagcgcggccggcggttcgcccccccttcccaaatcccggcgagggcggtcggtcggagatgcggacccgcacggcggaccacctcgagtccctctccctcgagatcgagcgcaagctgcacaaggctctgaattccaactcacagcgcctcaagctgctgcagcagctgttcgccgatatcgcgctcaaggtcgacgaccgcgctcgagataagattttaagcaccaatgatgaggggatcgctccagtagacgaacgcgaagacggccatttgtgcttctatgagattcttgcaaatcactatgtgaaagtacctcaaagtgggaggcgtatactcgagttgatagtgcaactctggagccaatccttcgcagccaacatatttgcccttctttttcacagatggttgtttgaagtccctctcgaggggaaggacgtatcactaagatacagctctgctcttgtccaaggagctactaacgttttttggattgacattcaaaccaatacaaggcacttcctcccattgtatcattatctccttgaagaagtcgctttagttccagatcaacttattaagatatcaccacaggctggtagaaatctattctgcctcctctccagattcatgctgttctatgatcaggatcacttgcttataagttttcttgagcatttccctccttttccaaattctttcttgattggtggcgctgcagattactttgtgattgaactcactgatcagctccagaagctaaaagtggagccagtactgctgcactacctttcccgcatgaccatccttcaaggctgggagttgaggatgagtacaagcaccagactaaagtcatgcctgtatagcttcacatctcctggaggccctgcctatccaacaagagccgtcaggcatgcagcctggaatacgttggattttctttttcctgtgggtcgctatccgaggcacgtgataagtctgttcttccggctgctctacccatggtactggccgtcctcttgctggaacttcgtcatgacctgcgtgagcaccatctactactacatcctgaatctcctcgtctcgatctgggagaacatgaggaggcctgaccatcaaaggatgcacagagactgaagaaaccgcggccgggcctaatcaaggctataatgttgtgttgttgttcttctttacctttaggatggttagcatcatgtgtgtgcgcatgaaatttgttgtataaatccaagtgtctgttgtgtttgttatacatggacagaggatgtgatgtgaggcagagatgtgcagtggaagaggggaggaaggggcagtttttatgttcaccagtgtgaggctgtaatttgtatacaacattcagcagcttctccaaatgccatcaaaggttattagccatgctctaagaggagttgg

SEQ ID NO: 4835 - DNA, 1481 bp, Triticum aestivum
cggataccgagcgcggccggcggttcgcccccttcccaaatcccggcgacggcggtcggtcggacggagaggagatgcggccccgcacggcggaccacctcgaggcgctctccctcgagatcgagcgcaagctgcacaaggctctgaattccaactcgcagcgcctcaagctgctgcagcagctgttcgccgatatcgcgctcaaggtcgacgaccgcgctcgagataagattttaagcaccaataatgagggaatcgctccagtagatgaacgcgaagacggccatttgtgtttctatgagattcttgcaaatcactatgtgaaagtccctcaaagtgggaggcgtatacttgagttgatagtgcaactctggagccaatcctttgcagccaacatatttgcgcttctttttcacagatggttgtttgaagtctctcttgaggggaaagaggtatcactaagatacagctctgctcttgtccaaggagctactaacgttttttggattgacatccaaaccaatacaaggtacttcctcccattgtatcattatctccttgaagaagtggctttagttccagatcaactcattaagatatcaccacaggctggtagaaatttattctgcctcctctccagattcatgctgttctatgatcaggatcacttgcttacaagttttcttgggcatttccctgcttttccaaattctttcttggttggtggagctgcagattactttgtgattgaactcaccgatcagctccagaagctaaaagtggagccagtactgctgcactacctttcccgcatgaccatccttcaaggctgggagttgaggatgagtacaagcaccaggctaaagtcatgcctgtatagcttcacatctcctggaggccctgcctatccaacaagagccgtccggcatgcagcctggaatacgttggatttactttttcctgtgggtcgctatccgaggcacgtgataagtctgttctttcggctgctctatccatggtattggccttcctcttgctggaacttcgtcatgacctgcgtgagcaccatctactactacatcttgaatctcctcgtctcgatctgggagaacatgaggaggcgcgaccatcaaaggatgcacagagaatgaagaaatcgcgaccaggcctaaaccgaggctacaatgttgtgttgttgttccttctgttttacctttaggatggttagcttcatgtgtgtgcgcatgaaatttgttgtataaatccaagtgtctgttgtgtttgttatacatggacagaggatgtgatgtggggcagagttgtgcagtgagagagggaaggaaggggcagtttttatgctcaccagtctgaagctgtaatttgtatacaacattcagcagcttctccaaatgccatcaaaggtttatatgctctaagaggagttggcgcttttgcggaatacgttttgcccataccagctc

SEQ ID NO: 4836 - DNA, 1429 bp, Secale cereale
aaaaacaagagcgagtccgtacaatcggataccgagcgcggccggcggttcgcccccccttcccaaactacccgccgagggcggtcggtcggagatgcggccccgcacggcggaccacctcgagtccctctccctcgagatcgagcgcaagctgcacaaggctctgaattccaactcacagcgcctcaagctgctgcagcagctgttcgcagatatcgcgctcaaggtcgacgaccgcgctcgagataagattttaagcaccaacgatgagggaatcgctccagtagatgaacgcgaagatggccatttgtgcttctatgagattcttgcaaatcactatgtgaaagtacctcaaagtgggaggcgtatactcgagttgatagtgcaactctggagccaatccttcgcagccaacatatttgcgcttctttttcacagatggttgtttgaagtccctctcgaggggaaggacgtatcactaagatacagctctgctcttgtccaaggagctactaacgttttttggattgacattcaaaccaatacaaggcacttcctcccattgtatcattatctccttgaagaagtcgctttagttcaagatcaactcattaagatatcaccacaggctggtagaaatctattctgcctcctctccagattcatgctgttctatgatcaggatcacttgcttataagttttcttgagcatttccctccttttccaaattctttcttgattggtggcgctgcagattactttgtgattgaactcactgatcagctccagaagctaaaagtggagccagtactgctgcactacctttcccgcatgaccatccttcaaggctgggagttgaggatgagtacaagcaccagactaaagtcatgcctgtatagcttcacatctcctggaggccctgcctatccaacaagagccgtccggcatgcagcctggaatacgttggattttctttttcctgtgggtcgctatccgaggcacgtgataagtctgttcttccggctgctctacccatggtactggccttcctcttgctggaacttcgtcatgacctgcgtgagcaccatctactactacatcctgaatctcctcgtctcgatctgggagaacatgaggaggccagaccatcaaaggatgcacagagactgaagaaaccgcggccgggcctaatcaaggctataatgttgtgttgttgttcttctttacctttaggatggttagcatcatgtgtgcgcgcatgaaatttgttgtataaatccaagtgtctgttgtgtttgttatacatggacagaggatgtgatgtgaggcagagatgtgcagtggaagaggggaggaaggggcagtttttattttcaccagtctgaagctgtaatttgtatacaacattcagcagtctttcttcctaaa

SEQ ID NO: 4837 - DNA, 1676 bp, Secale cereale
aagagcgagtccgtacaatcggataccgagcgcggccggcggttcgccccccccttcccaaatcccggcgagggcggtcggtcggagatgcggccccgcacggcggaccacctcgagtccctctccctcgagatcgagcgcaagctgcacaaggctctgaattccaactcacagcgcctcaagctgctgcagcagctgttcgccgatatcgcgctcaaggtcgacgaccgcgctcgagataagattttaagcaccaatgatgaggggatcgctccagtagatgaacgcgaagacggccatttgtgcttctatgagatccttgctaatcactatgtgaaagtacctcaaagtgggaagcgtatacttgagttgatagtgcaactctggagccaatcctttgcagccaacatatttgcccttctttttcacagatggttgtttgaagtccctctcgaggggaaggacgtatcactaagatacagctctgctcttgtccaaggagctactaacgttttttggattgacattcaaaccaatacaaggcacttcctcccattgtatcattatctccttgaagaagtcgctttagttccagatcaacttattaagatatcaccacaggctggtagaaatctattctgcctcctctccagattcatgctgttctatgatcaggatcacttgcttataagttttcttgagcatttccctccttttccaaattctttcttgattggtggcgctgcagattactttgtgattgaactcactgatcagctccagaagctaaaagtggagccagtactgctgcactacctttcccgcatgaccatccttcaaggctgggagttgaggatgagtacaagcaccagactaaagtcatgcctgtatagcttcacatctcctggaggccctgcctatccaacaagagccgtccggcatgcagcctggaatacgttggattttctttttcctgtgggtcgctatccgaggcacgtgataagtctgttcttccggctgctctacccatggtactggccgtcctcttgctggaacttcgtcatgacctgcgtgagcaccatctactactacatcctgaatctgctcgtctcgatctgggagaacatgaggaggcctgaccatcaaaggatgcacagagactgaagaaaccgcggccgggcctaatcaaggctataatgttgtgttgttgttctttgttacctttaggatggttagcatcatgcgtgtgcgcatgaaatttgttgtataaatccaagtgtctgttgtgtttgttatacatggacagaggatgtgatgtgaggcagagatgtgcagtggaagaggggaggaaggggcagtttttatgttcaccagtgtgaggctgtaatttgtatacaacattcagcagcttctccgaatgccatcaaaggttattagccatgctctaagaggagttggcgcttttgctggaatagtgtgcccataccagctcatctaggacggagattcaaaccttgcccggtacccttcttgggctactgagatatttcggtttgctgatgtttcagtttgctgattgtactttgtaatttggtgatttcgaaagttttaagggaaaaaaaaaaaaaaaaaaaaaagtcgctgcgtgatccgatggcttcgggagactcgacagc

SEQ ID NO: 4838 - DNA, 1408 bp, Secale cereale
ccgtacaatcggataccgagcgcggccggcggttcgccccccttcccaaatcccggcgagggcggtcggtcggagatgcggccccgcacggcggaccacctcgagtccctctccctcgagatcgagcgcaagctgcacaaggctctgaattccaactcacagcgcctcaagctgctgcagcagctgttcgccgatatcgcgctcaaggtcgacgaccgcgctcgagataagattttaagcaccaatgatgagggaatcgctccagtagacgaacgcgaagacggccatttgtgcttctatgagatccttgctaatcactatgtgaaagtacctcaaagtgggaagcgtatacttgagttgatagtgcaactctggagccaatcctttgcagccaacatatttgcccttctttttcacagatggttgtttgaagtccctctcgagggaaggacgtatcactaagatacagctctgctcttgtccaaggagctactaacgttttttggattgacattcaaaccaatacaaggcacttcctcccattgtatcattatctccttgaagaagtcgctttagttccagatcaacttattaagatatcaccacaggctggtagaaatctattctgcctcctctccagattcatgctgttctatgatcaggatcacttgcttataagttttcttgagcatttccctccttttccaaattctttcttgattggtggcgctgcagattactttgtcattgaactcactgatcagctccagaagctaaaagtggagccagtactgctgcactacctttcccgcatgaccatccttcaaggctgggagttgaggatgagtacaagcaccagactaaagtcatgcctgtatagcttcacatctcctggaggccctgcctatccaacaagagccgtccggcatgcagcctggaatacgttggattttctttttcctgtgggtcgctatccgaggcacgtgataagtctgttcttccggctgctctacccatggtactggccgtcctcttgctggaacttcgtcatgacctgcgtgagcaccatctactactacatcctgaatctgctcgtctcgatctgggagaacatgaggaggcctgaccatcaaaggatgcacagagactgaagaaaccgcggccgggcctaatcaaggctataatgttgtgttgttgttcttctttacctttaggatggttagcatcatgtgtgcgcgcatgaaatttgttgtataaatccaagtgtctgttgtgtttgttatacatgaagaggatgtgatgtgaggcagagatgtgcagtggaagagggaaggaaggggcagtttttatctcaccagtctgaggctgtaatttgtatacaacattcagcagcttctccaaataccat

SEQ ID NO: 4839 - DNA, 1252 bp, Secale cereale
aagggagaagggggcaaaaaacaagagcgagtccgtacaatcggataccgagcgcggccggcggttcgccccccttcccaaatcccggcgagggcggtcggtcggagatgcggccccgcacggcggaccacctcgagtccctctccctcgagatcgagcgcaagctgcacaaggctctgaattccaactcacagcgcctcaagctgctgcagcagctgttcgccgatatcgcgctcaaggtcgacgaccgcgctcgagataagattttaagcaccaatgatgaggggatcgctccagtagacgaacgcgaagacggccatttgtgcttctatgagattcttgcaaatcactatgtgaaagtacctcaaagtgggaggcgtatactcgagttgatagtgcaactctggagccaatccttcgcagccaacatatttgcgcttctttttcacagatggttgtttgaagtccctctcgaggggaaggacgtatcactaagatacagctctgctcttgtccaaggagctactaacgttttttggattgacattcaaaccaatacaaggcacttcctcccattgtatcattatctccttgaagaagtcgctttagttccagatcaacttattaagatatcaccacaggctggtagaaatctattctgcctcctctccagattcatgctgttctatgatcaggatcacttgtcttaattaagttttcttgagctactttccccttcccttttaccaaatttctttcttgattggtggcgctgcagattactttgtgattgaactcactgatcagctccagaagacaaaaagtggagccagtactgctgcactacctttcccgcatgaccatccttcaaggctgggagttgaggatgagtacaagcaccagactaaagtcatgcctgtatagcttcacatcgcctggaggccctgcctatccaacaagagccgtccggcatgcagcctggaatacgttggatttacttttcctgtgggtcgctatccgaggcatgtgataagtctgttctttcggctgctctatccatggtattggccttcctcttgctggaacttcgtcatgacctgcgtgagcaccatctactactacatcctgaatctgctcttctcgatctgggagaacatgaggaggcgcgaccatcaaaggatgcacagagaatgaagaaaccgcggaccgggccgggcctaatcaaggctaataatgttgtgttgttgttctt

SEQ ID NO: 4840 - DNA, 1367 bp, Setaria italica
ttttttttgaccagttccaccgcttaattcgcaggaccgcgccaccgcccaccgcgtcccctccccgccctccggcgatcacctccggcggccgcggccatgcggagccggggctcctccgaccgcctcgaggcgctctccctcgagatcgagcgcaagctgcagaaggtaccgaccggggctcgccttttggaaatccctgccattattcgcagatattgcattgaaggtggatgatcgtgcccgagatgcgattatgagcgagaatgatgatggcattgctccattagatgaacgagaagatggttggctgtgcttctatgaaattcttgctaatcattttgttagagtgcctgaaagtgggaggcgtatacttgagttgatagtgcaactctggagccagtccttcgcgtccaacatattttcccttcttctccacaaatggttgtttgaagcccctcttgatggaaaggaaataccactaagatacagctctgctcttgttcaaggtgctacaaatgttttttggattgacatacagacaaatacaagacattttctctccttgtatcattatctccttgaagatgttgctctagtccctgaccgacttaataaaatatcattacaggctggtagagaccttttccttctgctctctagattcatgttcttctatgatcaggatcatttgctctctcgtttcctagagcattttcccacttttccaaattctttcttggttggtggtccagcagattactttgtaattgatctcacagatcagcttcaaaagctaaaaattgagccagtgctactgcactacctctcccgcatgagcatacttcaagggttggaactgaggttgagtacaagcaccagattaaaggcctgcctctacagcttcacttctcctggtggtcctacgtacccaacacgagcggtgcggcatgcagcctggaatacactggatttgcttttccctattggtcgctaccctaggcatgtgataagcctgttcttccggctgctgtatccatggtactggccttcctcttgctggaacttcgtgatgacctgtgccatgactgtctactactacatcctaaacctgctcgtctcaacctgggagagcctgaggcggcctagtcaccggagaacgcacgaagagtgaagacatcttgtgttgttgttttgttcattttcttctgtttttcgtgcaagcagtgtagtaaatatagtagcttttgtgtttgtgcaaacaacatgttctgtataaactgctacgtttgttcagctgtctatataggacgaggaacaaaaggtaatgaaggagagcatgtgcatttctgacttcgtttctccgg

SEQ ID NO: 4841 - DNA, 1903 bp, Panicum virgatum
aaagcgacaccctttatcactatctaagtttatatgattatatattatttacctcagattgtttgcaccatggtttctataaatatgttaatcagtaaataaatatcagtggcatattcacataggatgagcagttattggaagaaatttaatcgatttttcacttggaacaacagaaatggaattttcgcatttttgatttccttgaatcattaggctacaatgattatttttgctgtataatcgtttctgttgccttgcaacttcatcttaccataaattctgattattgtttaccaatctatttttttagcaaaatagtgtattcagtcttatgtaagaagtaactgcattatactctgaacagatgcaattatgagcgagaatgatgatggcattgctccagtagatgaacgagaagatggtcggctgtgcttctatgaaattcttgccaatcattttgttagagtgcctgaaagtgggaggcgaatactcgagttgatagtgcaactgtggagtcagtcctttgcgtccaatatatttgcacttcttttccacaaatggttgtttgaagctcctcttgatggaaaagaaatatcgctaagatacagctctgcccttgttcaaggtgctacaaatgtattttggattgacatacaaacaaatacaagacattttctctccttgtatcattatctccttgaagatgttgcactaatccctgaccgacttactaaaatatcattacaggctggtagagaccttttccttctgctatctagattcatgttcttctatgatcaggatcatttgctctctagtttcctagagcattttcccacttttccaaattctttcttggttggtggtccagcagattactttgtaattgaactcactgatcaggttcaaaaactaaaaattgagccagtgctactgcactacctctcctgcatgagcatacttcaagggctggaactgaggttgagtacaagcactagattaaaggcctgcctctacagcttcacttctcctggtggccttacctatccaacacgagcagtacgtcatgcagcctggaatacattggatttacttttccctgttggtcgctacccaaggcacgtgataagcctgttcttccggctgctgtatccgtggtactggccttcttcttgctggaacttcgtggggacctgtgccatgactatctactactacattttaaacctgctcgtctcaacctgggagagcctgaggcggcatagtcaccgaagaacgcacagtgaatgaaggcagggtgtctgaaccagtaccatcttgtgttgttcattttctttcggttttcgcaaagcaatgtagtaaatagtagcttatgcgtttgtgcaaacaacatgttctgtatgaactgctacatctgttcagttgtctatataggaagaggaacaaaaggtgatgaaggagagcatgtgcatttctggcttcgtttctcctgtatttactcacttgcagtgtcctgcgaccatcgaagtctatggactacggccttatgggcagcttgcattggcaaccatgcaaagttactgtcagtccgggcaatgttgagctgtggatcacgagggacctgatgatgttagtccagaagatttcctagtgctacttgcttttgtgttgtgttgatggatgttgaactgcctgctgatgtgttatttgctttggttgctggacacatcagtacacacactagttaatcctggcctctgattttttttaaaaaaaataaacatcagcggtttaatatctgatttggactgcttttgagtttatcctgattgactgtcaatatctgttgatacaaatgacgaatcttcaataacggttcgcgaacatgttacaatctctg

SEQ ID NO: 4842 - DNA, 1523 bp, Saccharum officinarum
ctcggtctctcggttttcccctcgaatcgaaaaggcgaaccgcgacgcgaacccaggatcccgtcgagggcaggcgggaggatcccggcgtgcgagcggcgatgggcgaggcggacgcgagcgccggcgggagcggggccggcggagatccgcagcggctgaagcggatcgccgctgcggcgtacgactacgagaacgatgcgcggtgggccgggtactggtccaacgtcctcgtgccgccccacctcgcgtcccgccccgacgtcgtcgaccacttcaagcgcaagttctaccagcgatacatcgatcctgctttggttgttgagccaatgtcctccatgacttcaactcagtctagcagaccagcagcaaggtcgtcagctacaccgtctggtgagaatgtcagatctcgtgactcaggctctagcacgagatcaactggggcttcccaacagccatcagcagagaggactgcaaattcattacggctagacggacggacaatacatttttctatcaatgcctgggtactggttgtagctagtcttggaatactcccagttctacccaaccatatctcaagtaaagcatacagactttcactgctaggaacaatatgctcgtctgcatattctttatatagcacttatgggaaaccaagagcatggaatatgcctgcaattcagtcctggctgcaatctattattgtagccaaggactttgttcacttgatgttctctcttatgatgttcacatctaatgtgcactttaagattgctctacttcctgtgctttgctgggcgcttgatcatgttgctcgattcctaaggcgtaattttacgcactcttctttatacaggaagtacttagaggacccttgcctatgggtagagacaaacaacactacactcagcctactttgttcgaatgctgaaatcaccctggggtttctcatgatcatctcacttttttcgttgagacgcaatataattcagacatttatgtattttcatctgttgaagttgatgtaccattctcctgtgacatctggttaccaccagagcgtgtgggcaagaataggccgggctgtaaacccgtacatttaccgctatgcgccattcctcaacacacctatttcggcagttcagagatggtggctgaggtaggaaagcatggaatcccaggtatcatcaccacagtgaaaatttacctacacagctacagtgagctccacccctcaattttctttagaagacgtgtattccacagcgttcttttcttgtacacggttgtattcttagttcatgtctgaccgagctactgaaggcataacaccgtatcttttcttacgatgagcagtagctcttgagcgaattctctgatgatttgacgggatacagtttcagacattcagtggtagcacataattcataaggatgcttgctgcagtcaataggatggtgaacaatgaaatgcgagtggaactatcgattcttgaagtaataaattgctgtccttgtctc

SEQ ID NO: 4843 - DNA, 1533 bp, Zea mays
gtgaggaaaaatctccccatctgctgaaaatccttcactcgtccctctctcggtctgtccctttggagcgaaggcgaaccgcgtcgcgaacccaggatcccatcgagggcaggcgggcagatcccggcgtccgacggcgatgggcgaggaggacgcgagcgccgggggagatccgcagcggctgaagcggatcgccgctgcggcgtacgactacgagaacgatgcgcggtgggccgggtactggtccaacgtcctcgtgccgccccacctcgcctcccgccccgacgtcgtcgaccacttcaagcgcaagttctaccagcgatacatcgatcctggtttggttgttgaaccgatgtcctccatgacttcaactcagtctagcagaccagcagcgaagtcttcagctacaccatctagtgagaatgtcagagctcgggactcaggctctagcacgagatcaactgggacctcccaacatccaccagcagagaggactgcaaattcattacagctagacggacggacaataaacttttctatcaatgcctgggtactggttgtagctagtctcggaatactcccagttctacccaaccatatctcgagtaaagcataccgtctttcattgctaggaacaatatgctcgtctgcatattctttatatggcacttatgggaaaccaagagcatggaatatgcctgcaattcagtcctggttgcagtctattattgtagctaaggactttgttcacttgatgttctctcttatgatgttcacatctaatgtgcactttaagattgctctacttcctgtgctttgctgggcgcttgatcatgttgctcgattcctaaggcgtaattttacacactcttctttatacaggaagtacttagaggacccttgcctatgggtagagacaaacaacactacactcagcctactttgttcgaatgctgaaatcaccctggggtttctcatgatcatctcgcttttctcgtcgagacgcaatataatccagacatttatgtactttcatcttttgaagttgatgtaccattctcctgtgacatctggttaccaccagagcgtgtgggcaagaataggccgggctgtaaacccgtacatttaccgctatgcgccattcctgaacacacctatttcggcagtccagagatggtggctgaggtaggaaagcatggaccgcagcacagtgaaaatatgcctaaacagctactctgatctcagcgcctcgatcttttagaaggcgtgcttgcacggcgtgttcttttcttgtaaaggttgtattctcagttcatgtcttactgagctactgaaggcataacactagagaatttcttacgatgagcagtagcgcttgagcaaactgtcgatttgatgggatacagttacaggcataaagtgattgcacagaattttcataaggatgcttgctgcagtcaataggatggaacatgcgagtggcactattgattcttgaagtaataaatgatgttcttgtctattttattttgc

SEQ ID NO: 4844 - DNA, 1651 bp, Setaria italica
gaaaagaaaaaaaaatctccgcatctgctgaaaattcttcagtcgtcccctctccgtctcgaaccccaggaggccaggcaggatcccggcaagagcaggcgagaggatcccgtctcgcggcggcgatgggcgagggggacgcgagcgccggcggagatccgcagaggctgaagcggatcgccgcggcggcgtacgactacgagaacgacgcgcggtgggcggggtactggtccaacgtcctcgtgccgccccacctcgcctcccgccccgacgtcgtcgaccacttcaagcgcaagttctaccagcgatacatcgatcctggtttgattgttgagccaatgtcctccatgaattcaaatcagtctagcagaccagcagccaggtcttcagctacaccttctcgtgagaataccagacctcatgactcaggatctagcacgagatcaactggggcctcccaacaatcatcggcagagagaagtgcaaattcattacggcttgatggacggacaatacacttctctatcaatgcctgggtactggttgtagctagccttggaatactcccaattttacccaaccatatctcaagtaaagcgtacagactttcgttgctaggaacaatatgctcatctgcatattctttatataccacttatgggaaaccaagagcttggaatatgcctgcaattcagccctggttgcaatctattattgtagccaaggactttgttcatttgatgttctcttttatgatgttcacatctaatgtacacttcaagattgctctacttcctgtgctttgctgggcgcttgatcatgttgctcgattcctaaggcgtaattttacacgctcttctttatacaggaagtacttagaggacccttgcctgtgggtagagacaaacaacactacactcagcctactttgttcgaatgctgaaatcaccctgggttttctcatgatcatctcacttttctcgtctagacgcaacataatccagacatttatgtactttcatttgttgaagctgatgtaccatgctcctgtcacatccggataccaccagagcgtttgggcaagaataggccgggcggtaaacccctacatttatcgatatgcaccattcctcaacactcccatttcggcagttcaaagatggtggctgaggtagaaaagcatgaatcccgggtatccttgctacagagaaagcatgcctacacagagcttgcccctcaacaatttatgagatgttcaacgtctcacttgcatagccttcagttcttattcatgattatgttatccgttgatgtttcactgaaccattgaaggcataacacttcgataaatttcttacaatgcgcaatagctattgagcgaactgtccatgattcgattggatactgccagtgatatctcagaatttccgaggatgcttgttgcaatcttgtatgggatggcaaacaatgtagtaatacgagtggcagtattgattcttataaattgccatcgctgtctcttttgttttgcttggtgcagcatccgttgttggtcgttgccatttcgcggtcaggctgattgtactgctgttatggtgagtgttgagaacttctctgctgtttttttatggaagaaatgtcttgtcgtaaa

SEQ ID NO: 4845 - DNA, 1737 bp, Panicum virgatum
aaaaatctccccatctgcttgaaaattcttcagtcatccctctcctctgtctggaacccgacctccgaaccccaggaggccaggatcccggcgaagggcaggcgagaggatccgctctcgcggcggcgatgggtgagggggacgcgagcgccggcgcagatccgcagaggctgaagcggatcgccgcggcggcgtacgactacgagaacgacgcgcggtgggcggggtactggtccaacgtcctcgtgccgccccacctcgcctcccgctccgatgtcgtcgaccacttcaagcgcaagttctaccagcgatacatcgatcctggtttggttgtcgagccaatgtcctccatgacttcaactcagtctggcagaccagcaacaaggtcttcagctacaccgtccagtgagaataccagagcttgtgacgcaggatctagcacgagatcaaccggagcctcacaacaaccatcagcagagaggagtgcaaattcattacggctagatggtcggacaatacacttctctatcaatgcctgggtacttgttgtatctagccttggaatactcccagttctacccaatcatatctcaagtaaagcgtacagactttcattgctaggaacaatatgctcatctgcatattctttatatagcacttatgggaaaccaagagcttggaatatgactgtaattcagccctggttgcaatctattattgtagctaaggactttgttcatttgatgttctctcttatgatgttcacgtctaacgtacactttaagattgctctacttcctgtgctttgctgggcgcttgatcatgttgctcgattcctaaggcgtaattttacacgctcttctttatacaggaaatacttggaggacccttgcctttgggtagagacaaacaacactacactcagcctactttgttccaatgctgaaatcaccctggggtttctcatgatcatctcacttttctcgtcgagacgcaacataatccagacatttatgtactttcatctgttgaagcttatgtatcatgctcctgtcacatccagctaccaccagagtgtatgggcaagaataggccgggccgtaaacccctacatttatcgctatgcgccgttcctcaacacgcccatttcggcagttcaaagatggtggctgaggtagaagagcatgaatcctgggtatccttgctacagaggaaacatccttaaacagagcatgcccttcagttttttacaagatgttcagcgtaccgtttgcatagcattctgttctgatgaatggtcacggtcatgttctctgttcatgtctcactgaactattgaaggcataataccacctgataaatttcttacaacgtgcaatagctatttagcgaactgtccataggattcgattggatatttcaatcttgaataggatgtcaaacaatgaatacgggtgacactattggttcttataaatcgccgtcgtttggtgtcacttttattttgcttggtaaagcatccgttgttggtcgttggcatttcgcggtcagggctgattgtactgctctttacggtgagcgctgataacttttctagtgttatttatggaagaaatgtcttgttaaccattttgattgggtacaccgacccagtcctgtggcacgtatcgtgagaatgcagttttctcacctgtgccacttttcacggaggaaatacatacccaatcactttcccaa

SEQ ID NO: 4846 - DNA, 1666 bp, Panicum virgatum
aaagaaaaaaaaatatctccgcatcggcttgaaaattcttcagtcatccctctcctctgtctcgaacccgacctccgaacccctggaggccaggatcccggcgaagggcaggcgagaggatccgctctcgcggcggcgatgggcgagggggacgcgagcgccggcggagatccgcagaggctgaagcggatcgccgcggcggcgtacgactacgagaacgacgcgcggtgggcgggctactggtccaacgtcctcgtgccgccccacctcgcctcccgctccgatgtcgtcgaccacttcaagcgcaagttctaccagcgatacatcgatcctggtttggttgttgagccaatgtcctccatgacttcaactcagtctagcagaccagcagcaaggtcttcagctacagcgtccagtgagaataccagagctcgtgactcaggatctagcacgagatcaaccggagcctcacaacaaccatcagcagagaggagtgcaaattcattacggctagatggtcggacaatacacttttctatcaatgcctgggtacttgtcgtagctagcctcggaatactcccaattctacacaatcatatctcaagtaaagcatacagactttcattgctaggaacaatattctcatctgcatattctttatatagcacttatgggaaaccaagagcttggaatatgactgtaattcagccctggttgcaatctattattgtagctaaggactttgttcatttgatgttctctcttatgatgttcacatctaacgtacactttaagattgctctacttcctgtgctttgctgggcgcttgatcatgttgctcgattcctaaggcataattttgcacgctcttctttatacaggaagtacttagaggacccttgcctttgggtagagacaaacaacactacactcagcctactttgttcgaatgctgaaatcaccctggggtttctcatgatcatctcacttttctcgtcgagacgcaacattatccagacatttatgtactttcatctgttgaagcttatgtaccatgctcctgtcacatccggttaccaccagagtgtatgggcaagaataggccgggccgtaaacccctacatttctcgctatgcgccgttcctgaacacgcccatttcggcagttcaaagatggtggctgaggtagaagagcatgaatcctgggtatccatgctacagagaaaacatccttacacagagcatgctcttcaattttttataagatgttcagcgtatcgctcgcgtagcattctgttctgatgaatggttatggttatgttctctcttcatgtctcactgaactattgaaggcataatatcacctgataaatttcttacaacgtgcaatagctatttagcgagctgtccatatgattcggttggatatagccagtaagatctcagagtttgctgataatgcttatcgcaatcttaaataggatgtcaaacaatgaatacgagtgacacactattggttattataaattgccatcgtttggtgtctcttttattttgcttggtgaagcatccgttgttggccgttggcatttcgcggtcagggctgattgtactgctgtttacggtgggcgttgagaacttttctgctgtttttttttagatgggag

SEQ ID NO: 4847 - DNA, 1357 bp, Pennisetum glaucum
agagcaggacgggatcctctcgcctgctcttgccggggatcctgtcctgcggcggcgatgggcgagggggacgcgagctccggcggagatccgcagaggctgaagcggatcgccgcggcggcgtacgactacgagaacgacgcgcggtgggcggggtactggtccaacgtcctcgtgccgccccacctcgcctcccgccccgacgtcgtcgaccacttcaagcgcaagttctaccagcgatacatcgatcctggtttgattgttgagccaatgtcctccattaattcaactcagtctagcagaccagcagcaaggtcttcagctacaccttccagtgagaataccagacctcgtgactcaggatcaagcacaagatcaagtggggcctcccaacaaccatcagcagagagaagtgcaaattcattacggctagatggacggacaatacacttctctatcaatgcctgggtactggttgtagctagtcttggaatactcccaattctacccaaccatatctcaagtaaagcgtacagactttcgttgctaggaacaatatgctcatctgcatattcgttgtataccacttatgggaaaccaagagcttggaacatgcctgcaattcaaccctggttacaatctattattgtagccaaggactttgttcatttgatgttctctcttatgatgttcgcatctaatgtacacttcaagattgctctacttcctgtgctttgctgggcacttgatcatgttgctcgattcctaaggcgtaattttacacgctcttctatatacaggaagtacttagaggacccttgcctatgggtagagacaaacaacactacactcagcctactttgttccaatgctgaaatcaccctgggttttctcatgatcatctcacttttctcgtctagacgcaacataatccagacatttatgtactttcatttgttgaagctgatgtaccatgctcctgtcacatctggataccaccagagtgtgtgggcaagaataggccgggtggtaaacccctacatttgtcgctatgcaccattcctcaacacgcccatttctgcagttcaaagatggtggctgaggtagaaaaatatgaatcctgggtatccttgctacagagaaaacatacctgcacagagcttgcccctcaacattttaagatatgttgaacgtctcacttgcatagctttcagttcttattcatggttatgttattatccgttcatgtctcactgaatcattaaaggcataacaccagataaatttcttacaatgcgcaatatctgttgagcgaactgtccatgatccggttggatagatccagtgacatctcaaa

SEQ ID NO: 4848 - DNA, 4005 bp, Oryza sativa
cttttcgctcgtttggttggccaaccgaaaaaaagaaaaaggaaaagaaaaaaaaatcttcccaacagtagtgtgtcatctcatctccctcttcgtctcgagacgcgacgcgactctctcgaacgaacccggaggagtcccgtaccccagcggcagcgaggggggaggcggaggcgagcaccggcggcgatgggggatggggaggggagcaccggcggcggcgggggcggcggagatccgcagaggctgaagcggatcggggccgcggcgtacgactacgagaacgactcgcggtgggcggggtactggtccaacgtcctcgtgccgcctcacctcgcctcccgccccgacgtcgtcgaccacttcaagcgcaagttctaccagcggtacatcgatcctgatttgattgttgagccaatgtcttccacaagttcaagtcaatccaccaaaccagcagcaaggtcttcagcaacaccatccaatgagaatgtcagagctcgtgactcaggatcaagtgcaagatcaactgctgcctcccaaccatcacaaacggaaaggactgcaaattctttatggttggatgggcggactatacatttctctatcaatgcctgggtactggtagttgctagtcttggaatattgccaattctaccaaaacatattgcaagcaaagcctatagactctcattactaggaacaatatgctcctcagcatattctctttatgtcacctatgggaaaccaagagcatggaacatggctgcaattcagccttggttgcaatctataattgtagccaaggactttgttcatttgatgttctcccttatgatgttcacatctaatgtgcactataaaattgctcttcttcctgtgctttgctgggcacttgatcatgttgctagattcctaaggcgtaactttgcacgctcctctttgtacaggaagtatttggaggagccttgtctgtgggtagaaacaaacaacacaacactcagcctcctttgttcaaatgctgaaattactctgggtttccttatgatcgtatctcttttctcgtggagacgcaacataattcagactttcatgtacttccatctattgaagctgatgtaccatgcacccgtaacatctggctatcaccagagcgcatgggcgagaataggccgggccgtaaatccctacatccatcgctacgcaccgttcctcaacacacccatttcagctgttcaaagatggtggttgaggtagaaagcatgatgaatctttgcatagccctcctacagaaagaaaaggtccagagcttttccgttacaatttcgttagaagatactcagcacgtcacttgcattctattgttatgcacagccgtattcttcacttgcgtagcgttctattgttatgcacagctgtattctcatttcagccatagtgccagataagtttctgcaagctatatatagctcttgaatgcattaacggaattactgaggacagacgttataatcaataacagaacggtaaacaacaaaagcggcattttccttgatccatttttgaattttcgattaattatatcatcggtgacgtggagctcttcaacagttgcacttgtgatttctcattatcctgcaactatggtagtacttgttataaactgttatcttagctgctttccagctgggcatcttttgtaagcacgaaaatgggacttgggaattgagagcattggtggtacttatttgatggcattcgtttagacacagtaattttattttaggatatatgctcccctgctcctttgccatgctgcaactcaaaatgtgtagcaatgtaaagcaagcttagacttcccacattaatgaacaatctgagaggtctttacctgtgtgccattaaaaaagatggtgtctgcctctgtgccactaaaaagttcgagactccctttatgccatcgccgaactttatcgtgccctccataccattccgtcgctattctgtttggctttaactgtttgggagctctgacatgtggggctgggtaggaaaaatgtccttcttgcccttttagtctctgcttcgttcccctcttttttttcttccttttcaccagagagagagaggtagccaggcggcgccgacggcgagtgggctaagcggcgtcggcggacagccaaggcggcgcttagcggcgcggcgcgtggcagacaggcggtggcgcggcgtggccggcgactggtgctgcgcggcggctgggtgcaggttcgacgacggcggcgacctgctccccctcccctccctgcaccgcatggcatcgaagcgccccgccgaggaggccgacgcggcggtagcggcgggatcggcctccgagggctccgacgcgtcggcggaggtggcccgcggggcgggatcggcctccgagggctccgacgcgtcggtagcggcgggatcggcctccgagggctccgacgcgtcggtagcggcgggatcggcctccgagggctccgacgcgtcggcggaggtggcccgcggggcgggatcggcctccgagggctccgacgcgtcggtagcggcgggatcggcctccgagggctccgacgcgtcggtagcggcgggatcggcctccgagggctccgacgcgtcggcggaggtggcccgcgggcacgggtcgtcgccgtccccgtccaagacgccgccaccgcgcctccctccgcggtcgcccccgcctccgtcgccggattcgactccggcgccgcctccgactcgcccagggccgccggcaaccccaccggccacccctccaatcggcgctcgtcgttgtcgcagcgccctgtccgtcttcaagttcatccaagcgccgtcggtcttgtcgatgtaggcgtagccgccaaccagcagcgacgccatgaacgagctcacgagcgacatcctccacctcccagcactgtgccgccgtgctgttgtccatccacactggcgactccgtcgtggcgagtgtggcggtgagctatggcgctaggtcctggccaggtcgagggaggcgagcaccgccgccgcgacgtgcttccagtagacgctgccgtgctgctgtgcgttgccggagacggcggcgacgcgggcgtagtccttcccccatcctcctcgacgccccggcctccttccgccgcgtagggccgaccggcgccgccgtcgcctcggcccggtcgttgtcgtcgtcgtcgtcgcagcgttgttgccgacatcttcatcgagcagcgatgccgccgccgccgtcgtcgcagcgccccgtcgtcgtctgtggtggcacagccgcgcactaacgccggccaccggtggcggcggcacaaggccgacgcggcgaggatgcgagagatgtggtggctcagcaccacggccgccgttgtcacccttcgcctcgccgaccgcagcggcatcgccggcgactcccctcccgcttctttgctgctgctgcatttgagggagagaggagagtgctaggaggcctaagggcaattaagtcatttggcgcagccgttatccaccgttaggataaaaacggacggaatgatgcggagggcgcgataaaattcgacgatgtcacagagggaggctcgaactttttagtggcacagaggcagacaccatctttttttaatggcataccgggaaaaacctcacaatctgacatcccgttcttcgtagatgctatccaaatgtcaggtattcgagtgcagtcacttataaatattaaggtctgtgtagcagacgcattgctcggaattatttcgcttttagaccactgtaaagcttacggttacgggcacatcgtataaatggcaccacccatcatggtatacacacatcgttcaagcgcataccagaaagatttcatcctatttatatcataaaatttatttagcacctgaggtctccgaatcctattgtacacataatataaacataattctatgttaaatagaaattgttcgatatatcctataa

SEQ ID NO: 4849 - DNA, 1687 bp, Brachypodium distachyon
ttttgcagtcatctctcaccttcggttcatctcgaatcgcgatcccgagtcccgaacccgaacccaaaaccccccgcagaggccggaggatcccgcgccgtgatgggggaggcggacgcgagcaccggcggcggcggcggcggcggagatccgcagaggctgaagcggatcgcggcgggggcgtacgactacgagaacgacgcgcggtgggcgggctactggtccaacgtcctcgtgccgccccacctcgcctcccgccctgacgtcgtcgaccacttcaagcgcaagttctaccagcgatacatcgatcctgatttggtggttgagccaatgtcttccacaggttcgacccagtccaacagatcagcagcaaggtcttcatctacgccatccagtgagaatatcagagctcgtgactcaggatctgctgcaacccaaccaccatcaacagaaaggacaggaagttctttacggttcgatggacgaactatacatttctctatcaatgcttgggtattagttgtcgctggtcttggaatacttccaattctaccgaaagatatcgcaagcaaagcatatagactttcattgctaggaacaatatgctcatcagcatattctttgtactgcacttacgggaaaccaagagcatggaacatgcctgcaattcagccttggttgcaatctataattgtagccaaggacttcgttcatttgatgttctctcttatgatgttcacatctaatgtgcactttcgaattgctctactgcctgtgctttgctgggcagtcgatcatgttgcaagattccttaggcgtaattttgcacgctcctctttctacagaaggtacttagaggagccttgtttgtgggtggagacgaacaacactacagtcagcctcctttgttcaaatgctgaaattgccctgggcttccttatgatcgtatcacttttctcgtggaagcgtaacataattcagacattcatgtacttccatctgttgaagttgatgtaccatgctcccgtaacatcaggctatcaccagagtgtgtgggcaagaattggccgggctgtaaacccgcacattgatcgttatgcgccgttcctcaatacacccatttcagctgcccaaagatggtggctgaggtagaagacatggatcgtgccattcccatgtatcccttctactgaatatctgctacagtgggtttcaccctccatttttaagaccatacacgtcacttacatattgttctattgttttcacatccccatttcacttctcacagagctagtcaagggatgaccgataacacaggacaaatgtctttgcaagcagtaggtcttgagcaaactgtccatttcttgactgatagtctgatagagttaaaatgatagcagcacataattcttgaggatacttatacataaacaatgaaagaccgcttcctgatattttccattatgtataaaatggtcgcaatacaatcgtgttgctggttagcagaagttcttttgttacgatgatggttgacgttgtttggtgctctctctcgttttgccccatgctgcctggctgtcgcactctttggcgaaatatcttgtacactgttgggctgtttatttgcagtaaataatgaaacaagttcgtttctgtggagtggcatttttggtcaactaaatgg

SEQ ID NO: 4850 - DNA, 1449 bp, Secale cereale
caaacggccaaaccccagaggaggcaggaggatccagcgcggtgatgggggaggcggacgcgagcaccggcggcggggacccgcagaagctgaagcggatcggggcgggagcgtacgactacgagaacgacgcgcggtgggcggggtactggtccaacgtcctcgtcccgccccacctcgcctcccgccccgacgtcgtcgaccacttcaagcgcaagttctaccagagatatatcgaccctgatttggtggttgagccaatgtcttccacaagttcgactcaatccaacagatcagcagcaagttcttcatctacaccatccagtgagaattcccgagctcgtgacacaggatctagtgcgagatcaactggggcatctcaaccaccaccaatagaaaggacaggaaactctttacggctcgatggacgaaccatacatttctccatcaatgcttgggtattgattgttgctagtcttggaatccttccaattctacccaaagatgtcgcaagcaaagcatatagactttctttgctaggaacaatatgctcgtcagcatattctttatactgcacttatgggaaaccaagagcatggaacatgcctgcaattcagccttggctgcagtctataattgtagccaaggactttgttcatttgatgttctctcttatgatgttcacatcaaatgtacgctttaagattgttctactgcctgtgctttgctgggcacttgatcatgttgctagattcctgaggcgtaattttgcacgctcctctttctacaggaggtacctggaggagacttgtttgtgggtggagacaaacaacactacaatcagcctcctttgttcaaatgctgaaattacccttggctttcttatgatcgtttcacttttctcgtggaaacgcaacataattcagacattcatgtacttccatctgttgaagttgatgtaccatgctcctgtaacatcgggttatcaccagagtgtgtgggcgagaattggccgggctgtaaaccctcacattcatcggtacacgccatttctcaatacgccaatttcagcagtccaaagatggtggctgagatagaaggcattgatcgtgccacatctatgtatccattgatcccctctacatatagagagtatctgctacactgggcttccctcgtcatcgttcctttaagaacatacacgtcacttgcacatcgttctattgttttcataccctcatttcacgtcttactgaactagtatactacttaacggatggcaccacataaatttctgtgcaagcagtaagttttgagcggtatgttttgcgatgatgccgaagaattcgttaggatactttgttagtatataaccaatgaaaggtccctcgctactggctggcatttgccaatataaaatcgttgaagacgatttgtaagggtgatggt

SEQ ID NO: 4851 - DNA, 1454 bp, Hordeum vulgare
gatctgcattcacctctcatcttcggttcgtcccggatcacgagtctccaaacccaaaccccagaggggtcaggaggatccagcgtggcgatgggggaggcggacgcggacgcggacgcgagcaatggcggcggggatccgcagaagctgaagcggatcggggcgggagcgtacgattacgagaacgatgcacggtgggcgggctactggtccaacgtcctcgtcccgccccacctggcctcccgccccgacgtcgtcgatcacttcaagcgcaagttctaccagcgatacatcgaccctgatttggtggttgagccaatatcttccacaagttcaactcaatcaaacagatcagcagcaagttcttcatctacaccatccagtgagaatgcccgagctcgtgacacaggatctagtgcgagatcaactggagcatcccaatcaccaccaacagaaaggacaggaaactctttacggttcgatggacgaaccatacatttctctatcaatgcttgggtattgtttgttgctagtcttggaatacttccaattctaccgaaagatgtcgcaagcaaagcatatagactttcgttgctaggaacaatatgctcgtcagcatattctttatactgcacttatgggaaaccaagagcatggaacatgcctgcaattcagccttggctgcagtctataattgtagccaaggactttgttcatttgatgttctctcttatgatgttcacatcaaatgtacgctttaagattgttctactgcctgtgctttgctgggcacttgatcatgttgctagattcctgaggcgtaattttgcacgctcttctctctacaggaggtacatggaggagccttgtttgtgggtggaaacaaacaacactacaatcagccttctttgttcaaatgctgaaattacccttggctttcttatgatcgtatcacttttctcgtggaaacgcaacataattcagacattcatgtactttcatctgctgaagttgatgtaccatgctcctgtaacatcgggttatcatcagagtgtgtgggcgagaattggccgggccataaaccctcacattcatcggtacacgccattcctcaacacacccatttcagcagtccaaagatggtggctgagatagaaggcatggatcgtgccacacctatgtatcccttgatcacctctacatatagagaatatcagctacacgtcacttgcacatcgttctattgttttcataccctcatttcagtcttactgagccactgaacggatgacaccggacaattttttctgtgcaagcagtaggttttgagcgatcttgactgagacagttgcaatgttggcgcagaattcttgatgatatatttttagtatataaacagtgaatggtccctcggtgctggctggtatttgccaatataaagtcgttgaagacga

SEQ ID NO: 4852 - DNA, 1403 bp, Triticum aestivum
ggatcacgagtctccaaacccaaaccccagaggaggcaggaggatccagcgcggcgatgggggaggcggacgcgagcaccggcggcggggatccgcagaagctgaagcggatcgcggcgggagcgtacgactacgagaacgacgcgcggtgggcggggtactggtccaacgtcctcgtcccgccccacctcgcctcccgccccgacgtcgtcgaccacttcaagcgcaagttctaccacagatacatcgaccctgatttggtggttgagccaatgtcttccacaagttcgactcaatccaacagatcagcagcaagttcttcatctacaccatccagtgagaattcccgagctcgtgacacaggatctagtgcgagatcaactggtgcatctcaaccagcaccaacagaaaggacaggaaactctttacggttcgatggacgaaccatacatttctctatcaatgcttgggtattgattgttgctagtcttggaatccttccaattgtaccgaaagatgtcgcaagcaaagcatatagactttcgttgctaggaacaatatgctcgtcagcatattctttatactgcacttatgggaaaccaagagcatggaacatgcctgcaattcagccttggctgcagtctataattgtagccaaggactttgttcatttgatgttctctcttatgatgttcacatcaaatgtacgctttaagattgttctactgcctgtgctttgctgggcacttgatcatgttgctagattcctgaggcgtaattttgcacgctcctctttctacaggaggtacatggaggagccttgtttgtgggtggagacaaacaacactacgatcagcctcctttgttcaaatgctgaaattacccttggctttcttatgatcgtatcacttttctcgtggaaacgcaacataattcagacattcatgtactttcatctgttgaagttgatgtaccatgctcctgtaacatcgggttatcaccagagtgtgtgggcgagaattggccgggctgtaaaccctcacattcatcggtacacgccatttctcaacacgccaatttcagcagtccaaagatggtggctgagatagaaggcatggatggtgccacgcctatgtatcccttgatcccctctacatatagagtatctgctacagtgggtttccctcgtcatcgttccgttaagaacatactacacgtcacttgcacatcgttctattgttttcataccctcatttcacgtcttactgagctactcaacggatggcacagcataaatttttctgtgcaagcagtaggttttgagcggtctgtccatatctaatatcttgactgatacagttgcaacgatggcgatgcattcttgaggatatttcaacaagtga

SEQ ID NO: 4853 - DNA, 1562 bp, Triticum aestivum
ggcgagacaaaaaagaaatgaaagaatagtcttccctctcgcaacccatttgggtagcaccaacagaaaatttctgagtttgtaaaaaaaaacagaaaatttctgcagtcacctctcatcttcggttcgttccggatcacgagtctccaaacccaaaccccagaggaggcaggaggatccagcgcggcgatgggggaggcggacgcgagcaccggcggcggggatccgcagaagctgaagcggatcgcggcgggagcgtacgactacgagaacgacgcgcggtgggcggggtactggtccaacgtcctcgtcccgccccacctcgcctcccgccccgacgtcgtcgaccacttcaagcgcaagttctaccacagatacatcgaccctgatttggtggttgagccaatgtcttccacaagttcgactcaatccaacagatcagcagcaagttcttcatctacaccatccagtgagaattcccgagctcgtgacacaggatctagtgcgagatcaactggtgcatctcaaccagcaccaacagaaaggacaggaaactctttacggttcgatggacgaaccatacatttctctatcaatgcttgggtattgattgttgctagtcttggaatccttccaattgtaccgaaagatgtcgcaagcaaagcatatagactttcgttgctaggaacaatatgctcgtcagcatattctttatactgcacttatgggaaaccaagagcatggaacatgcctgcaattcagccttggctgcagtctataattgtagccaaggactttgttcatttgatgttctctcttatgatgttcacatcaaatgtacgctttaagattgttctactgcctgtgctttgctgggcacttgatcatgttgctagattcctgaggcgtaattttgcacgctcctctttctacaggaggtacatggaggagccttgtttgtgggtggagacaaacaacactacgatcagcctcctttgttcaaatgctgaaattacccttggctttcttatgatcgtatcacttttctcgtggaaacgcaacataattcagacattcatgtactttcatctgttgaagttgatgtaccatgctcctgtaacatcgggttatcaccagagtgtgtgggcgagaattggccgggctgtaaaccctcacattcttcggtacacgccatttctcaacacgccaatttcagcagtacaaagatggtggctgagatagaaggcatggatggtgccacgcctatgtgtcccttgatcccctctacatatagagagtatctgctacagtgggcttccctcgtcatcgttccgttaagaacatacacgtcacttgcacatcgttctgttgttttcataccctcatttcacgtcttactgagcttttttttccggggattactgagctactcaacggatggcacagcataaatttttctatgcaagcagtaggttttgagcggtctgtccatatctaatatcttgactgatacagttgcaacgatggcgatgcattcttgaggatactttgttctttacaaa

SEQ ID NO: 4854 - DNA, 1321 bp, Zea mays
ctttatttacccagaaaccctagtctctcacgctcgcggagtcagtctcaccatctctctcggccgacagccggccaccaccagccgccagtagcaatagcaaattagcaacccgccgagcaccgacctctccatagttcctctacggctctaccgagcaaccgccggcgtcgaccctgccgtccaggcccgtcctgccgcggtgccgcctgcgtccctgccccagccacccggccgccacccgccgccgccagcgaggagcgagtagtagcgaccctggtccctgccgcccttgcgttcgtggctccctgcccagtgcccctgcgtcagcgtcactgcactctccgaggtggaggtggttctcaaatctcaagtccatccacggcgctactaccctcgctgcaatggagttgaggaggcctgcatcctctcctcttgtcgacaactacgtggtacctggtgacgtcgtcctggacctctctgagatgaacaaccagaccattaaactcggcgcgggtctgcgtcaggagtgtgacaccatccaggcgactagtgctgggaagctgcggcagttgaaacccaacaagtattggattgaaaactcacagaaaagatatataccttctgtagaagataccgttcttggtattgtggtcgacaccaaaccagacaactttttggtagacataaagggtcctaatttggcctttctaccagtactttcatttgaaggcggtacaaggagaaacatacccaagttcgagattggtacattaatatatgctcgagtggtgaaagcaaatagtatcatgaatcccgagctctcatgcatggatgctactgggaaagctgccgaatttggacagctcaaagatggttatatgttcgacacatcaactggcatgtcacgaatgttgttaagttccccaacgtgtccagttctggaggtccttgggaaaaaactgtcgtttgagattgctgttggactcaatggtcgagtctgggtgaatgctcctgcagcaagtactgtcattcttgtatcaaatgcaataatgaggtcagaatctttgagcggcataaaacaaagagctatggtagaaaatctattggagagattgtcatgatgataagtcagcaagcattagtctaaagtaaaatggaggagtttccattgtgtcagttcaaagtaaaagtaggaaagtttgagatcaaagtgactatccccatcaaaagattattatgtatcacgtgtcgtagtatacagtacactatactcttttttatattaaattatcaatgtatttatcaaagtcttgcgtcc

SEQ ID NO: 4855 - DNA, 1472 bp, Zea mays
gcgacggcgccgtggacctccactccggaaattccggccgcacgtcgcccgtctcgcccggagtccggatccctaggctatacaagccatgccttcgcatctctctattcccctgctcctttgcgcccacgccaacccagttaccagagccgccattgccgccggccctgcgtatcggcaacaccacacgaccgcagccattgtatcacctattcggtccgagacgcttcgattcagctcgctgttggtgttcccggactcgctgcgcgggattgatggcaggtgacgcgtgaatttgtcgtcggagttgaagctccgccgtgaccgcgctcactgccgtggcccggaacatttgcgctactaacctcggtggaggtggttctcaaatctcaagtccatccacgcggaatcggacttgacctttatttaaggcgcagggctgcaggcccgttccctcagctgaccatacgcaaccgcacaggaaacaggaccgtcgccgcgaaccgccgtactctataccgacttctccgaacctcctgtcctccataccggcgctcctaccctcgctgcaatggagttgaggaggcctgcgccctctcctctcgtcgacaactacgtggtacctggtgatgtcgtcctggacctctccgagatgaacaaccagaccattaaactcggcgcgggcctgcgtcaggagtgtgacaccatcgaggcgactagtgctgggaagttgcggcagttgaaacccaacaagtattgtattgaaaactcccagaagcggtataaaccttctgtagaagataccgttcttggtattgtggtcgacaccaaaccagacaactttttggtagacataaagggtcctaatttggcctttctaccagtactttcatttgaaggcggtacaaggagaaacatacccaagttcaagattggtacattaatatatgctcgagtggtgaaagcaaatagtatcatgaatcccgagctctcatgcatggatgctactgggaaagctgccaaatttggacagctgaaagatggttatatgttcgacacatcaactggcatgtcacgaatgttgttaagttccccaacgtgtccagttctggaggtccttgggaaaaaactgtcgtttgagattgctgttggactcaatggtcgagtctgggtgaatgctcctgcagcaagtactgtcattcttgtatcaaatgcaattatgaggtcagaatctttgagcggcataaaacaaagagctatggtagaaaatctattggagagattgtcatgatgataagtcagcaagcattagtctaaagtaaaatgggggaatttccattgtgtcagttcaaagtaaaagtaggaaagtttgagatcaaagtgactatccacatcaaaagattattatgtatcacgtgtcgtagtatacagtacactatactctttttttattaaatttatcaatgtattta

SEQ ID NO: 4856 - DNA, 1809 bp, Panicum virgatum
ctactaaccacacgccttgatgcacagacagaggctaggaccgccgccgcctacaactcctcctcgccggcgcccccgaccgctttcgagttcgagcaatggagtcgatgaggccgccgccctcccccctcgtcgacagctatgtggtacccggcgacgtcgtcctggacctatccgagatgaccaaccagaccataaagctcggcacgggcctgcgtcaggaatgtgacaccatccaggcgaccagtgctggggtgctgcggttgtcgaagcccaacaagtattgggttgagagctcccagaagaggtatgtaccttctgtagaagatacaattcttggtgttgtggtcaacacaaaaccagataactttttggtggatataaagggtcctaatgtggcctttctaccggtgctttcatttgaaggtggtaccaggagaaacataccaaagtttgagattggtacattaatatatgctcgagtggtgaaggcaaatagcatcatgaatccagagctctcatgcatggatgctactgggaaagctgctgaatttggtcagttgaaaggtggctatatgtttgacacatcaactggcatgtcaagaatgttgttaagttcgccaacatgtccagttctggaggcccttgggaaaaaactatcatttgagattgctgttggactcaatggtcgagtctgggtgaatgctcctgcaccaagtacggtcattcttgtatcaaatgcaattatgaggtcagaatctttgagcggcataaaacaaagagctatggtagaaaatctcctggagaggttgtcatgatggtaagtcagcaagctttaatccaaagtaaaatgggtccaatctgaatccattgtgtttgtttgaagtaaaagtagagaagatcaagatggttgtccacatcgaagattattattgtatcacatgtagtaataccctttcctttttgttttatttataaatgcatgttcacatttctctctttgaaacaaagtttattatatttctctcaatttttcatcttgagctttgtgcgcttgctatctccaccagatgaaatcgtacttctatgttgtttgatttcccatatattgttatatgttgcatccactactgaccctatatggcggacaatagggtaacttcattgctttcagttttatcttatcaataaagtttttttgtgggatcagtggtaatgatgacatgtttctggaccaaacatcatccaatatcacaatttgtaacatacttctttacctatttgattccttgtattgttatcgtttccacagctaaactttagtcagaattgggtgatatttattgccttatgtatggtcaggcaatgtactctcacgcaatcgatgtattttggagaattgcttggttagatgccacagccgattctgcaacaggaaaaggttggtggccactatcatctcagcagggcacactagatggatcattgactttgcacataaattaggtatgggatttggcgagagagactggtgttattttttcaatgttgtagaatgtcgactcaactaatagattggctggtttagaatgaattttctggctgatactacattgtatgttgcctatctggatgctgtaagtcagatacctgcactaggttgccagccgatcttgttgaaagaagcctcatgatcactcatttccaacatttttttaaatattcgttgcactcagaaatgccgatcttgttgaaagaagcctcatgatgactcaattgcaacatcttttttgtatcctttgaactcag

SEQ ID NO: 4857 - DNA, 881 bp, Setaria italica
caatggagtcgaagaggccgccgccctcccccctcgtcgacacctatgtggtacccggcgacgttgtcctggacctctccgagatgaccaaccagaccataaagctcggcacgggcctgcgtcaggagggcgacaccatccaggcgaccagtgccgggatcctgcggctgtcgaagcccaacaagtattgggttgagagctcccagaagaggtatgtaccttccgttgaagatacagttcttggtgttgtggtcgacaccaaaccagacaactttgtagtggacataaagggtcctcatttggccttcctaccagtgcttgcatttgaaggtggtacaaggagaaacataccaaagtttgagattggtacattaatatatgctcgagtggtgaaagcaaatattatcatgaatccagagctctcatgcatggacgctactgggaaagctgctgaatttggtcagttgaaagatggctatatgtttgacacgtcaactggcatgtcacgaatgttgttaagttcgccaacatgtccagttctggaggcccttgggaaaaaactatcttttgagattgctgttggacttaatggtcgagtctgggttaatgcccctgcaccaaacactgtcattcttgtatcgaatgcaattatgaggtcagaatctttgagtggcatacaacaaagagctatggtagaaaatctcttggagagattgtcataatggtaagtcagcaagctttagtccaaagtaaaatgggcgtagtttgaatccatcgtgtctgtttgaagtaaaagtagaaaagtttgaaatcaaagttccacatcgaagattattgtgtatcatctgtagtaaactagtaatgcccaaccatacttctct

SEQ ID NO: 4858 - DNA, 1163 bp, Pennisetum glaucum
ggtaacccacacgctctgacgcacacagaagaacagaagccaggaccgccgccgccgcgttctactcctccacgccggcgtccctcgacagccatctttgagttcgagaaatggagtcgaagaggccgccgccctcccccttcgtggaaacctatgtggtacccggcgacgtcgtcctggacctctccgagatgaccaaccagaccataaagcttggcactggcctgcgtcaggagtgtgacaccatccaggcgaccagtgctgggatactgcgtctgtccaagcccaacaagtattgggttgaaagctcccagaagaggtatgtaccttccgttgatgatacagttcttggtattgtggtcgacaccaaaccagacaactttgtagtggacataaagggtcctcatttggccttcttaccagtgcttgcatttgaaggtggtacaaggagaaacataccaaagtttgagattggtacattaatatatgttcgagtggtgaaagcaaatagcatcatgaatccagagctctcatgcatggatgcttctggcaaagctgctgaattcggtgagttgcgaggtggctatatgtttgacacgtcaactggcatgtcacgaatgttgttaagttcgccaacatgtccagttctggaggcccttgggaaaaaactatcctttgagattgctgttgggctgaatggtcgagtctgggtgaatgcccctgcagcgaacactgtcattcttgtatcaaatgcaattatgaggtcagaatctttgagtgggatacaacaaagagctatggtagaaaatctcttggagagattgtcataatggcaatgaacaatcacgctatcaatgtacctgggggagttgcttggttagatgccacagccgattctgcgaacatggggggcaaaacatagtgatcgctatcacctctgcagggcattctaaatggaggtgttgcacataaattaaatatggctgtagaggctggtgtttttttatgttgtaggctgaatcgctgaagaaatagattggctagtattagaaacaactttcttgagaatactatgttgactatctgagggtgctgcaaggagcctcatgatgacacagttgcaacacttttcatattcgttgcactcagaaattgacttctgc

SEQ ID NO: 4859 - DNA, 2542 bp, Oryza sativa
cgcgccgcctcccagctcccgtctccgcctcggcgccacctgactcagcctcccctccccggcacccccactcctgttggctgtcgcccagcgccggcgccggtgggtggcgagtcggcgaccgcccccctggaaagggaagacagggaggcgtcgaggcgagccgggtcccctaggcagctcggctcctccccattcgccacctctccctcttcttgacgaccgtcgaccgagacccacgagctccctctccagctctcctgctgcccggaaaagtgcaaaggaccacccgacgattcgttcctggagccggcaccgcccgctccaccgcacccgcgcgctgcagccaccgagcaatggaatcgaggaagccgccaccctctgccctcgttgacaaccacgtggtccccggagacgtcgtcctcgacctcaccgagatgaccaaccagaccatcaagctcggcgctggcctgcgacaggattgcgacaccatacaggctaccagtgctgggaggctacggctttcgaagcccaacaaatattgggtcgagagctcgcagaagaggtatataccttctgtagaagatacagttcttggtgttgtggttgacaccaaaccagataacttcttggtggatataaaaggtcctaatttggcctttttaccagttcttgcatttgaaggtggtaccaggagaaatattccaaagttcgagattggtacattaatatatgcacgagtggtgaaagcaaatagcatcatgaacccagagctctcgtgcatggatgctactgggaaagcagccgaatttggtcaactaaaagatggctatatgtttgacacgtctactggcttgtcgcggatgttgttaagttctccaacatgtccagttctagaggcccttggaaaaaaactttcatttgagattgctgttggcctgaatggccgagtctgggttaatgcaccttctccaagtaatgtcattgttgtatcaaatgcgattataaaatcagaatctttgagtggcatagggcaacgaagtatggtggaaagtctcttggagagactatcttgatggggcaacagggtatgatgctccggcagtactaatggatcttaaaggactggttaggcgtcagttatgattctgcaaaccggagaaacggcactataatcatgttatctcaacaggtagcggtagatgaatgtacacataagcaggtacatgaaagaagctgatgcgttctgatgaatgtatgaagttaactggatgattccgcttatgaaactttgtagcgagttttgttccaatcatacgtgatacgttggttcgtaagatgtcctgggatttgcacaaggttacttgctgatctgctggtcttgttgatttagaacgaaatcatgacctggtaaatggtaattaatattttcactggtattgagtgagcgaattgaacttttttcccaggtataatttgaacatgttaagacaaacatctattacttatcacctcaattcagagaggtttctgatactcatcagaatgtaaactgacttaactcctgtgacacacacacaaccttcttgccaacattttttccactgaatagaccaaccaacgcagcaggtgcattctccaaccctatgctcatgtcttctacatacacaatcttgccatctctgtaatgctttgccatgtcactgacaaactgtgggaacatatggaggtggtcgctctggatgaacccctgcattcttatcctctttggtacaaggcagaagatgttgtggatccctacaggatcagtcagcgcattctgagagaccatcccgcatacggcaatgcgaccatgggtcctcatgttgaggagtacagcatcaagcattggaccacctacgttctcaaagtagatgtcaataccttcagggaaatacctacacaaggacaaatcacaaacagacttagatcatgacaacggtattatgaatcattcagtgagttcagcaggtcgattttttaaacaataacacattaagtgtatgaatccatctttttttcactcgcgaatttagctataacaggagcatgttccacactattgcagtattttaattaagatttttagatgatcgttataatctatcttaattcatcaattgctcattgaacctaaattaagccgtgccttttaactgaaagagaaggcctgaccttttcaaggctgcagtcaagtcaggctcctctttatagttgaaagctgcatcaaatccaaacttgcccttcaagagctcaacctgaaacattgctgtaaaccctgaatgatgcatctatacaggtaatgaatgcaattatcagttttaagttaatactttctgatttgttccagcacttcccacaacatagcatccatgaagctttgcgagttgtcctacaatttgcccaactgctcctgatgcagccgaaacaaaaacaaactcgcccttcttcggtgagcagatctcatagaaaccagcataagctgtaaaaccaggcatgcctg

SEQ ID NO: 4860 - DNA, 3299 bp, Oryza sativa
agattattctgtcctctcagtggtccaaatagtgggctgcaagtgaacaacattagcccagcccaaactcatcactaggcccatctcctgccaaactcatcacctgccaagcccatagcatgtgttccaacttaccctaggcccatctcctccacagcaagcactctcaggcaagcagacgcccgcaccgaagcgccgccgccgcgttcaccgttcgtccgttccgctcttccgctccagtctccaccgcacccgcccacccgcgcgccgccgccgccgccgtgcaatggaatcgaggaagccgccgccctccgccctcgtcgacaaccacgtggtccccggggacgtcgtcctcgacctcgccgagatgaccaaccagaccatcaagctcggcgccggcctgcgacaggattgcgacaccatacaggctaccagtgctgggaggctacggctttcgaagcccagcaaatactgggtcgagagctcgcagaagaggtatataccttctgtagaagatacagttcttggtgttgtggttgacaccaaaccagataacttcttggtggatataaaaggtcctaatttggcctttttaccagttcttgcatttgaaggtggtaccaggagaaatattccaaagttcgagattggtacattaatatatgcacgagtggtgaaagcaaatagcatcatgaacccagagctctcgtgcatggatgctactgggaaagcagccgaatttggtcaactaaaagatggctatatgtttgacacgtctactggcctgtcgcggatgttgttaagttctccaacatgtccaattctagaggcccttggaaaaaaactttcatttgagattgctgttggcctgaatggccgagtgtgggttaatgcaccttctccaagtaatgtcattgttgtatcaaatgcgattataaaatcagaatctttgagtggcatagggcaacgaagtatggtggaaagtctcttggagagactatcttgatggtaagcaactttttttttttggcttggggtaaagttgaatttggggttccattttgctttaaatattaacaggtataacatggggtcttatcatttttcgttacttaattttaaatattcattcccatttatgtttctatgagggtatatatttaccttaaacaaaaacttaagctgcggtcagttttaccttgggctctctgcattctgcagctgccctcaggtccctactaagatgaaagcatactttgttctgttgttcgatttcccatttatttgttactatcatgcaaccaccaactttgaggttgatatgacagcttcctttgtcatgttagctagatctggattcctaggtcccttacgagcattcttccttatctgttattgtctctcttgattattagccatagcccacaaattatgtagccttcacatcatgttatacaaaaatatgttgtcatgtatagcgtaggactactacctctaatctacacctttatgctcatttttccttatcattattattttgtgggtacactgttctctagtcagtgtagggagaaccgactggcagtactaatgaatcttaaaggaattactggttagacgtcagctatgattctgcaaaccggagaaacggcactataatcgtgttatctcaacagggagcggtagaagaatgtacacataagcaggtacatgaaagaagttgatgcgttttgatgtcttatatatgaagttaactggatgattccgcttatgaaacttcatagagagttttgttccaatcatacgtgatacgctggtttgtaagatgtcctgggatttgcacaaggttacttgctgatctgctggaagatgattggtgggtgatattgaatttctcagatatatggcgtgtgaaattccccatctgtataaactaacatatcagctgaactagtacttctcaaatgataatttagctcccatctttaagtgacctatgcgtgacgttgggagaatttagccacatatgcctcgcaagtcgcagactatcgccttctcaatccgggatgacaagtgcaacaggtgtagaaaaggtcgaagtctggtgccaagacctagccatgggtggcaggagtgctaaatggcagagttgaaatcaatgcaaataaatgtgggacgcatccaacgccaagtaaaccatattatgtggataaaatcgataccaatgaacaaaaggttgtccactatcaagttaattgtagaccagcaagagatcgcaataccggttcctactctgtgaagcaccattacccatctcctattgtttcttggatagaagacctttcgagcttcggcaatgtttcttttagccaggatcctgaatatgctgatgagcaatcaagatcttcagtggggcagtcttcagcatctgtcaatttgcatgacatgcagatatcagttagattgacagatgaattcatcgaacttgcaaaggagaatacaggcaacaatgtagagacttgtggaatcctaggtgcttcatttagagatgggacttactatgtgactatgttgatcataccaaagcaagaagcaactgctcattcttgccaggctgtcagtgaggaggagatacatgctattttatcggagcaatcactttaccctgcagggtggatacatacacacccttcacaaacgtgtttcttatcatcaattgatctgcacactcaatactcctaccaggttatgttaccagaggccgttgcgattgtgattgctcccactgatcctactaggaactgtggaatattcaggctgacagacccaggagggatgggtgtgcttagggagtgcagtgaaagtgggttccacgcccaccgggagacaacggacggcggcccaatctatgaaacctgctccaaggttatattcaacccaaatttgaggttcgagattgttgacctgcgttccgctccctgaacaatgtaattcagcctcaaactctccatgtactccctgcgtgctgccaaaatatgcaagtaaaaaaaaacaaatgccataatcgtccaggcaatacggcaatatctgctcatcgtttggatgggttgggtgggtattactaatccatggtatcaactgagctttgatgatggtacagtaatatggtatttgtaagaatgaagtgtaactgggagagagaagaaaagcagtgatgaattgtcttacaacttctggcctttgtaccgacacttctctaaaagaattaaagaccagcactcttggtaaggttagagcca

SEQ ID NO: 4861 - DNA, 1129 bp, Panicum virgatum
gaattccccatcctccaccttcgcttcccttccggcgccgcctctccttccctgtcgcgttgtagctcctccgagggtaggatggtgaaggggaccgaggacctccttgcaaccttaaccatgtcctccgccgctggttctgctgccgtgaaggagacgaactcgtcgtcgtggtccggacgtccgcgtactgggtcacgacgtccctcccatgtccgaggcctcgtcgacagctatgtggtacccggcgatgtcgtcctggacctatccgagatgaccaaccagaccataaagctcggcacgggcctgcgtcaggaatgtgacaccatccaggcgaccagtgctgggatgctgcggttgtcgaagcccaacaagtattgggttgagagttcccagaagaggtatgtaccttctgtagaagatacagttattggtgttgtggtcgacacaaaaccagacaactttttggtggacataaagggtcctagcgtggcctttctaccagtgctttcatttgaaggtggtaccaggagaaatataccaaagttcgagattggtacattaatatatgctcgagtggtgaaggcaaataacatcatgaatccagagctctcatgcatggatgctactgggaaagctgctgaatttggtcagttgaaaggtggctatatgtttgacacatcaactggcatgtcacgaatgttgttaagttcaccaacatgtccagttctggaggcccttgggaaaaaactatcatttgagattgctgttggactcaatggtcgagtctgggtgaatgctcctgcaccaagtacggtcattcttgtatcaaatgcgattatgaagtcagaatctttgagtggcataaaacaaagagctatggtagaaaatctcctagagaggttgtcatgatggtaagtcagcaagctttaatccaaagtaaaatgggtctaatctgaacccatcgtgtctgtttgaagtaaaagtagagtagtttgagatcaattgtccacttcgaagattattattgatttattgtatcacgtgtagtaataccctttccttttgttttatttataaatgcatgttcccatttctctctttcaaaaaagattattatatttctctc

SEQ ID NO: 4862 - DNA, 1419 bp, Panicum virgatum
ggagaggacgcggacgggcctctggtgttcgggccggcctttcctctcggcctgtatactctcggcctcttggaggaaccgctaatacctaaccctagcttcccccgatccccaattccccatcctccaccttcgcttcccttccggcgccgcctctccttccctgtcgcgttgtagctcctccgagggtaggatggtgaaggggaccgaggacctccttgcaaccttaaccatgtcctccgccgctggttctgctgccgtgaaggagacgaactcgtcgtcgtggtccggacgtccgcgtactgggtcacgacgtccctcccatgtccgaggcctcgtcgacagctatgtggtacccggcgatgtcatcctggacctatccgagatgaccaaccagaccataaagctcggcacgggcctgcgtcaggaatgtgacaccatccaggcgaccagtgctgggatgctgcggttgtcgaagcccaacaagtattgggttgagagttcccagaagaggtatgtaccttctgtagaagatacagttattggtgttgtggtcgacacaaaaccagacaactttttggtggacataaagggtcctagcgtggcctttctaccagtgctttcatttgaaggtggtaccaggagaaatataccaaagttcgagattggtacattaatatatgctcgagtggtgaaggcaaataacatcatgaatccagagctctcatgcatggatgctactgggaaagctgctgaatttggtcagttgaaaggtggctatatgtttgacacatcaactggcatgtcacgaatgttgttaagttcaccaacatgtccagttctggaggcccttgggaaaaaactatcatttgagattgctgttggactcaatggtcgagtctgggtgaatgctcctgcaccaagtacggtcattcttgtatcaaatgcgattatgaagtcagaatctttgagtggcataaaacaaagagctatggtagaaaatctcctagagaggttgtcatgatggtaagtcagcaagctttaatccaaagtaaaatgggtctaatctgaacccatcgtgtctgtttgaagtaaaagtagagtagtttgagatcaattgtccacttcgaagattattattgatttattgtatcacgtgtagtaataccctttccttttgttttatttataaatgcatgttcccatttctctctttcaaaaaagattattatatttctctctatttttcatcttgagcactgtgcgcttgatatctccaccagatgaaatcgtacttctatgttgtttgatttcccatatatctcatattgttatatgttgcatccactactgactctatatggtggacaatagggcaacttcattgctttcagttttattttatcaagatagtttttt

SEQ ID NO: 4863 - DNA, 1190 bp, Panicum virgatum
cctcgtcgacagctatgtggtacccggcgacgtcgtcctggacctatccgagatgaccaaccagaccataaagctcagcacgggcctgcgtcaggaatgtgacaccatccaggccaccattgctggggtgctgcggttgtcgaagcccaacaagtattgggttgagagctcccagaagaggtatgtaccttctgtagaagatacaattcttggtgttgtggtcgacacaaaaccagataactttttggtggatataaagggtcctaatgtggcctttctaccggtgctttcatttgaaggtggtaccaggagaaacataccaaagtttgagattggtacattaatatatgctcgagtggtgaaggcaaatagcatcatgaatccagagctctcatgcatggatgctactgggaaagctgctgaatttggtcagttgaaaggtggctatatgtttgacacatcaactggcatgtcaagaatgttgttaagttcgccaacatgtccagttctggaggcccttgggaaaaaactatcatttgagattgctgttggactcaatggtcgagtctgggtgaatgctcctgcaccaagtacggtcattcttgtatcaaatgcaattatgaggtcagaatctttgagcggcataaaacaaagagctatggtagaaaatctcctggagaggttgtcatgatggtaagtcagcaagctttaatccaaagtaaaatgggtctaatctgaatccattgtgtttgtttgaagtaaaagtagagaagatcaagatggttgtccacatcgaagattattattgtatcacatgtagtaataccctttcctttttgttttatttataaatgcatgttcacatttctctctttgaaacaaagtttattatatttctctcaatttttcatcttgagctttgtgcgcttgctatctccaccagatgaaatcgtacttctatgttgtttgatttcccatatattgttatatgttgcatccactactgactcctatatggcggacaatagggtaacttcattgctttcagttttatcttatcaataaagtttttttgtgggatcagtggtaatgatgacatgtttctggaccaacatcatccatatcacaatttgtaacatacttctttactatttgattccttgtattgtatcgtttcacagctaaacttt

SEQ ID NO: 4864 - DNA, 1337 bp, Brachypodium distachyon
aagcacgggcaacggagcgagaagcgcagccgcgccgcgcgcagaacaccctaccccagcgtacacgccggcacgctcacccgcccgccgtccccgagcaatggagtcgaaaaagccgccgccgtccgccctcgtcgacaaccacgtggtccccggagacgtcatcctggacctcgctgacatgaccaaccagacaatcaagctcggagcgggcctgcgccaggattatgacactatccaggcgactagtgctgggaggcttcgactatccaagcccaacaagtactgggtggagagctcccagaagaggtatataccttctgtagaggatacagttcttggtattgtagtcgacaccaaaccagataacttcttggtggacataaaggggcctaattttgcctttttaccagttctttcctttgaaggtggcaccaggagaaacataccaaagtttgagattggtacgctaatttatgcccgagtggtgaaagcaaatagcatcatgaatccagagctttcatgcatggatgctagtggaaaagccgctgaatttggtcaattgaaaaatggatatatgtttgacacatcaactggcctgtcaagaatgcttttaagttccccaacgtgtccacttctggaggcccttgggaaaaaactatcatttgagatagctgttggactgaatggtcgagtctgggtgaatgctccttcgccaagtaatgtaattgttgtatcaactgcaattataagatcagaatcttatactcaaatacaacaaaaaagtatggtggaaaatcttttggtgaaactctcatgatgggaacaggacatactccggcactatgatgggattcagaagtactgttcgttaatcgccacagcgattcttcaacccgaaagatgggtagtcattgtcatgtaccccagaaggggatagtgcgtgtatggcacgtgaaatagatgcattaaaagggctaacgctttttatggtctaggcctgaattaacggaagaatggtaatcttttttaaaccagagtgcaatcttgtacttccgcatacatggttattgggttagatgttagagatttgcacaaggttgcgtgctgctctgcggaaagacgattttttttttagggaagattgatggtatataaactagatcagccgaactgctgcccaacatgttatctctcgctccatccgttccgtagtgtttgctaatttagtataaagttgtgctacatcacggacacttattatgcattggagagagtattttcttttgatgtgaaaacgacgggattgggttgtgtcgtaacgatccatcaagatt

SEQ ID NO: 4865 - DNA, 1193 bp, Leymus cinereus x Leymus triticoides
  misc_feature (47)..(47): n is a, c, g, or t
  misc_feature (1071)..(1071): n is a, c, g, or t
cttctgaaggcacgcgcaccggaacggagaagagcagccgcgccgcncacacaacaccaccctactcccgcgtcgacgccgtcacgccgcccgcccgccgtccctgagcaatggagtcgaggaagccgcagcgctccgctctcgtcgacagctatgtggtccccggcgacgtcatcctggacctcgccgatatgaccaaccagaccatcaagctcggcgccggtctgcgccaggattgtgacactatccaggcaactagtgctgggaggcttcgactgtccaagcccaacaagtactgggtggagaactcccagaagaggtatgtaccttctgtagaagatacggttcttggtattgtcgttgacaccaaaccagataacttcttggtggacataaaggggcctaatttggcctttttaccagttctttcatttgaaggtggtaccaggagaaacataccgaagtttgagattggtacattaatatatgccagagtggtgaaagcaaatagcattatgaatccagagctttcatgcatggatgcaagtggaaaagctgctgaatttggtcaattgaaaagtggttatacgtttgaaacatcaactggcctggcaagaatgcttttaagttccccaacatgtccacttctagaggcccttgggaaaaaactatcatttgagatagctgttggactgaatggtcgagtatgggtgaatgctcctttgccaagtaatgtcattcttgtatcaagcgcaattaaacaatcagaatcttatagtcgcttacaacaaaaaagcatggtggaaaaactcctggctaaactgtcatgatgggagcaggacataatcaggcactgtaaaaggattctgaatcattgtttgttaaacgccgcagatgattctgcaaccataaagatggctcgtcattatcatgcaccttagcaaggaatagtagatgggatggcatgtaaaatagatgcgttaaagtggttggtgctttttgatgatgtagggctaaagcagccggtagattggtaaacgttctaaatcaccgtgtggatcttgtacttgnggatacatggttttgtaaggtgtttaagagatttgcgcaaggctgcgtgtgctgctctcctgtaagttgattgatggatagtactactatatttcagattcatagcgtgtggaactatgaca

SEQ ID NO: 4866 - DNA, 1343 bp, Triticum aestivum
ctcacagttcggtccaagggcaccaaacaaacaaggcgccatcgttttcgaggcccaggcccaggcccatctactcctgaaggcacgggcaccggaaggaagaagcgcagccgcgccgcgcagacaacaccaccctactccagcgtcgacgccgtcacgccgccagcccgccgtccctgagcaatggagtcgaggaagccgcagcgctccgctctcgtcgacagctatgtggtccccggcgacgtcatcctggacctcgccgatatgaccaaccagaccatcaagctcggcgccggtctgcgccaggattgtgacactatccaggcaactagtgctgggaggcttcgactgtccaagcccaacaagtactgggtggagaactcccagaagaggtatgtaccttctgtagaagatacggttcttggtattgtagttgacaccaaaccagataacttcttggtggacataaaggggcctaatttggcctttttaccagttctttcatttgaaggtggtacaaggaggaacataccaaagtttgagattggtacattaatatatgccagagtggtgaaagcaaatagcattatgaatccagagctttcatgcatggatgcaagtggaaaagctgctgaatttggtcaactgaaaagtggttatacgtttgaaacatcaactggcctggcaagaatgcttttaagttccccaacatgtccacttctagaggcccttgggaaaaaactatcatttgagatagctgttggactgaatggtcgagtatgggtgaatgctccttcgccaagtaatgtcattgttgtatcaagtgcaattaaagaatcagaatcttatagtcgcttacaacaaaaaagcatggtggaaaaactcctggctaaactgtcatgatgggagcaggacataatcaggtactgtaaaaggattctgaattattgtttgtcaaacgccgcagatgattctgcaaccggaaagatggctagtcactatcatgcaccttagcaaggaatagtagatgggatggcatgtaaaatagacgcgttaaagtggttggtgctttttgatgatgcaggggctaaagcaaccggttgattggtaaacattctaaatcaccgtgtggatgttgtacttgcggatacatggtttcttagctttgtaatatgctactgtaagagatttgcacaaggctgcgtgtgctgctctattagaagatgattgatggatgttactcctatattttataaatttatggtgtgaaactatcacactgagctctgtaagcaagatcaggtgaactcctgctcaatgatatggtgcatgatttcaaaacc

SEQ ID NO: 4867 - DNA, 1386 bp, Triticum aestivum
ctcacagttcggtccaagggcaccaaacaaacaaggcgccatcgttttcgaggcccaggcccaggcccatctactcctgaaggcacgcgcaccggaaggaagaagcgcagccgcgccgcgcagacaacaccaccctactccagcgtcgacgccgtcacgccgccagcccgccgtccctgagcaatggagtcgaggaagccgcagcgctccgctctcgtcgacagctatgtggtccccggcgacgtcatcctggacctcgccgatatgaccaaccagaccatcaagctcggcgccggtctgcgccaggattgtgacactatccaggcaactagtgctgggaggcttcgactgtccaagcccaacaagtactgggtggagaactcccagaagaggtatgtaccttctgtagaagatacggttcttggtattgtagttgacaccaaaccagataacttcttggtggacataaaggggcctaatttggcctttttaccagttctttcatttgaaggtggtacaaggaggaacataccaaagtttgagattggtacattaatatatgccagagtggtgaaagcaaatagcattatgaatccagagctttcatgcatggatgcaagtggaaaagctgctgaatttggtcaactgaaaagtggttatacgtttgaaacatcaactggcctggcaagaatgcttttaagttccccaacatgtccacttctagaggcccttgggaaaaaactatcatttgagatagctgttggactgaatggtcgagtatgggtgaatgctccttcgccaagtaatgtcattgttgtatcaagtgcaattaaagaatcagaatcttatagtcgcttacaacaaaaaagcatggtggaaaaactcctggctaaactgtcatgatgggagcaggacataatcaggcactgtaaaaggattctgaattattgtttgtcaaacgccgcagatgattctgcaaccggaaagatggctagtcactatcatgcaccttagcaaggaatagtagatgggatggcatgtaaaatagacgcgttaaagtggttggtgctttttgatgatgcaggggctaaagcaaccggttgattggtaaacattctaaatcaccgtgtggatgttgtacttgcggatacatggtttcttagctttgtaatatgctactgtaagagatttgcacaaggctgcgtgtgctgctctactgaaagatgattgatggatattactcctatattttataaatttatggtgtgaaactatcacactgagctctgtaagcaaaatcagctgaagtcctgctcaatgatatggcgcatgatttcacgtttcttgacacgaaaacgtagcagaactggtttgtactgatccggc

SEQ ID NO: 4868 - DNA, 1222 bp, Secale cereale
ggcccaggcccactctaccctcgaaggcacgcgcaccgaacgaagaagcgcagccgcgccgcgcagacaacaccacccaactccagcgtcgacgccgtcacgccgccagcccgccgccccggagcaatggagtcgaggaagccgcagcgctccgccctcgtcgacagctatgtggttcccggcgacgtcatcctggaactcgccgacatgaccaaccagaccatcaagctcggcgccggtctgcgccaggattgtgacactatccaggcaactagtgctgggaggcttcgactgtccaagcccaacaagtactgggtggagaactcccagaagaggtatgtaccttctgtagaagatacggttcttggtattgtagttgacaccaaaccagataacttcttggtggacataaaggggcctaatttggcctttttaccagttctttcatttgaaggtggtaccaggagaaacataccgaagtttgagattggtacattaatatatgccagagtggtgaaagcaaatagcattatgaatccagagctttcatgcatggatgcaagtggaaaagctgctgaatttggtcaattgaaaagtggttatacgtttgaaacatcaactggcctggcaagaatgcttttaagttccccaacatgtccacttctagaggcccttgggaaaaaactgtcatttgagatagctgttggactgaatggtcgagtatgggtgaatgctccttcgccaagtaatgtcattgttgtatcaagcgcaattaaagaatcagaatcttatagtcgcttacaacaaaaaagcatggtggaaaaactcctggctaaactgtcatgatgggagcaggacatgatcaggcactgtaaaaggattctgaattattgtctgttaaacgctgcagatgattctgcaatcggaaagatggctagtcactatcatgcaccttagcaaggaatagtactacgagtagatgagatggcatgtaaaatagacgcgttaaagtggtgtgtgctttctgatgatgtagggcaaaagcaaccggttgattggtaaacattctaaatcaccgtgtggatcttgtacttgcggatgcatggtttattaactctaatatgctaagaaatttgcacaaggctgcgtgtgctgctctattgaaagatgattgatggattatttacttattattttaataaattttattgtagtcgtaagt

SEQ ID NO: 4869 - DNA, 1186 bp, Hordeum vulgare
acggcgccgcgcagacaccaccaccctactccagcatccagcgtcgacgccgtcacgccgccagcccgccgtccctgagcaatggagtcgaggaagccgcagcgctccgctctggtcgacagctatgtggtccccggcgacgtcatcctggacctcgccgatatgaccaaccagaccatcaagctcggcgccggtctgcgccaggattgtgacactatccaggcaactagtgctgggaggcttcgactgtccaagcccaacaagtactgggtggagaactcccagaagaggtatgtaccttctgtagaagatacggttcttggtgttgtagttgacaccaaaccagataacttcttggtggacataaaggggcctaatttggcctttttaccagttctttcatttgagggtggtaccaggagaaacataccgaagtttgagattggtacattaatatatgccagagtgctgaaagcaaatagcattatgaatccagagctttcatgcatggatgcaagtggaaaagctgctgaatttggtcaattgaaaagtggttatacgtttgaaacatcaactggcctggcaagaatgcttttaagttccccaacatgtccacttctagaggcccttgggaaaaaactatcatttgagatagctgttggactgaatggtcgagtatgggtgaatgctccttcgccaagtaatgtcattgttgtatcaagcgcaattaaagaatcagaatcttatagtcgcttacaacaaaaaagcatggtggaaaaactcctggctaaactgtcatgatgggagcaggacacaatcaggcactgtaaaaggattctgaattattgtctgttaaacgctgcagatgactctgcaaccggaaagatggctagtcattatcatgcaccttagcaaggaatagtagatgggatggcatgtaaaatagacgcgttaaagtggctggtactttttgatgatgtaggggctaaggcaaccagttgattggtaaacattctaaatcaatcacctgtggatcttgtacttgtggatatgtggtttattagctttgtaaggtgttttaagggatttgcacaaggctgcgtgtgcggctctcctgaaagaggattgatgggtactatactatatttctgatgattcatagcgtgtgaaactatcacacagagct

SEQ ID NO: 4870 - DNA, 1367 bp, Hordeum vulgare
gcaccggaacgaagaagcgcagccgcgccgcgcagacaccaccaccctactccagcatccagcgtcgacgccgtcacgccgccagcccgccgtccctgagcaatggagtcgaggaagccgcagcgctccgctctggtcgacagctatgtggtccccggcgacgtcatcctggacctcgccgatatgaccaaccagaccatcaagctcggcgccggtctgcgccaggattgtgacactatccaggcaactagtgctgggaggcttcgactgtccaagcccaacaagtactgggtggagaactcccagaagaggtatgtaccttctgtagaagatacggttcttggtgttgtagttgacaccaaaccagataacttcttggtggacataaaggggcctaatttggcctttttaccagttctttcatttgagggtggtaccaggagaaacataccgaagtttgagattggtacattaatatatgccagagtgctgaaagcaaatagcattatgaatccagagctttcatgcatggatgcaagtggaaaagctgctgaatttggtcaattgaaaagtggttatacgtttgaaacatcaactggcctggcaagaatgcttttaagttccccaacatgtccacttctagaggcccttgggaaaaaactatcatttgagatagctgttggactgaatggtcgagtatgggtgaatgctccttcgccaagtaatgtcattgttgtatcaagcgcaattaaagaatcagaatcttatagtcgcttacaacaaaaaagcatggtggaaaaactcctggctaaactgtcatgatgggagcaggacacaatcaggcactgtaaaaggattctgaattattgtctgttaaacgctgcagatgactctgcaaccggaaagatggctagtcattatcatgcaccttagcaaggaatagtagatgggatggcatgtaaaatagacgcgttaaagtggctggtactttttgatgatgtaggggctaaggcaaccagttgattggtaaacattctaaatcaatcacctgtggatcttgtacttgtggatatgtggtttattagctttgtaaggtgttttaagggatttgcacaaggctgcgtgtgcggctctcctgaaagaggattgatgggtactatactatatttctgatgattcatagcgtgtgaaactatcacacagagctctgcaagtcagatgagctgaactcctgctcgatgttgtgacgcgttatttcacgttccttgacacggaaacgtagcacagaagtggtttgtactaatgcggcaattgattctagactagagagacttgtatgtaatgttggaaaggttatcagccctaaa

SEQ ID NO: 4871 - DNA, 765 bp, Avena sativa
gactgagcaatggagtcgaagaagccgccgcgctccgcccttgtcgacgactatgtggtccccggcgacgtcatcctggacctcgccgatatgaccaaccagaccatcaagctcggcgccggcctgcgccaggattgtgacactatccaggtgactagtgctgggaggctgcgactgtccaagcccaacaagtactgggtggagaactcccagaagaggtatataccttctgtagaagatacagttcttggtattgtagttgacaccaaaccagataacttcttggtggacataaaggggcctaatttggcctttttaccagttctttctttcgaaggtggtaccaggagaaacataccaaagtttgagattggtacattgatatatgcccgagtcgtgaaagcaaatagcatcatgaacccagagcttacgtgcatggatgcaactggcaaagccgctgaattcggtcaattgaaaaatggttatacgtttgaaatatcaactggcttggcaagaatgcttttaagttccccgacatgtccacttctggaagcccttgggaaaaaattatcatttgagatagctgtcggactgaatggtcgagtatgggtgaatgctccgtcgccaagtaatgtaattcttgtgtcggaagcaattaaaaaatcggaatcttttaatcgcatacaacagagaagtatggtggagaaactcctagctaagctggcatgatgttattgttgctatgcaacccgttaactgcatatg

SEQ ID NO: 4872 - DNA, 2171 bp, Zea mays
agagagagaagagaagcggggggctcgcagaggcgtagctcgcgatccgggcgccgagctggtgcgtacttggtttggtcgcgcggctcggtcgggaggctagctagctagggctcgcggcgggcgggatggcgaagggcggtgcggtcgtggggacggctgtggtggtgtgcgccgcggctgccgcggcggtgggggtagcggtggtgctgtcgcgcaggaggagtcggcggcgggaggcggaggacgagaggaagaggaaggcggccgcggtaatcgaggaggtggagcagcggctctccacgcccaccgcgctgctccggggcatcgcggacgccatggtcgaggagatggagcgcggccttcgcgctgagccccacgcgccgctcaagatgctcatcagctacgtcgacaacctcccaaccggggatgaacatggtctgttttatgcactggaccttggcgggaccaactttcgtgtcatccgggtccaacttggcggaagggacagacgtgtcgtgaagcaacagtatgaagaggtctccattccgcctcatcttatggttggaacttctacggaactatttgatttcattgctgctgagttggaaaaatttgtgcggactgaaggagaagatttccacctaccagatagcaagcagagggaactgggtttcaccttttctttcccagtgcaccaaacatctatatcatcggggactctaattaagtggaccaaaggattttgcatcaatggcacggttggagaagatgttgtggctgaattgagtagggccatggaaaggcagggtcttgatatgaaagttgcagctctggttaatgatactgtaggcacattggctggtgggagatatgctgataatgatgttgttgctgctgtaatattgggcactggcacaaatgcagcttatgtggaacatgcaaatgtgattcctaaatggaccgggctgctacctagatcagggaacatggtaatcaacatggagtggggaaacttcagatcagataaacttccaaggtcggagtatgataaatccttagacttcgaaagtttgaaccctggtgagcagatatatgaaaagatgatttctggaatgtatcttggagaaattgtccggaggatcctgctgaaactggctcatgatgcttcattgtttggggatgttgttcctccgaaactggaacagctatttatactgaggacgccagatatgtcagccatgcaccatgacacctcacatgatctcaaacacctgggagctaagctgaaggacattcttggggttcctgatacttctctggaagcaagatacatcactcttcatgtgtgcgaccttgtcgcagagagaggtgcacgcctggctgctgctggtatatatggtattctgaagaagctgggtaaagacaaattgctaggtgactttagccaacaaaggactgtagttgctattgacggtggcctatacgagcactacaagaagttcagtgcctgcctagaggcgacgctcacagacctgctcggcgaggaggttgcctcatcggttgttgtcaagttggccaacgacggctcaggaattggagctgcacttcttgctgcctcgcactcccagtatgctgaagctgcatagttctaggagctcgggggtcctagtgtaacctttttttttgtttcccaccatttcccccttcaatcgagaagcccccctcgtgcgattcgcatctctctattttctttcctcagcagcgggatatagctaggatggtgccattgagcttggagtacattatcactagcaacaagcattagcagcggcaggaaagaagtggaagcggaggcctgaataagccgttccattcctgccgattctttttcttcccaatcccttgaagtttgtattatgaggcgatatcacaaaacagccagttcttatctgtgtgatctcgtctttcaaaataaggagagaggtgggggaccaaatcatacagtctttactcattttttattgaatcgtgcagtgcttctgcctttatttcagaaacaactgcaatggcaatatttgcttgttcttatgtttgattggtcaaatgtgtgtgatttaatacaattatacggtgtgaaaccccacaaaggccatggtgacaagttatta

SEQ ID NO: 4873 - DNA, 2195 bp, Setaria italica
tcgtggctctcgtcccactcccacgcttccgcaagcggagaaaagagctggaggcagagagagaagtgagaggagagagaagcggtgtgctgctgtggcctagctcgcgatccgggcgcccagctgttccggtcttgggtcggtcgcgcggctcgatcgggaggctagggttcgtccggtcggcgggggcgcgatggggaagggcgcggtcgtcgggacggcggtggtggtttgcgccgcggccgccgcggcggtcggggtggcggtggtggtgtcgcggaggaggcggcgccggcgggaggccgagaacgagaggaagaggaaggcggcagcggtgattgaggaggtggagcaggcgttctccacgcccaccgcgctgctgcgcggcatcgcggacgccatggtggtggagatggagcgcggcctgcgcgccgacccgcacgcaccgctcaagatgctcatcagctacgtcgacaacctccccaccggggatgagcatggactgttttatgcactggatcttggcgggaccaactttcgtgtcatacgggttcaacttggaggaagggagaagcgtgttgtgaagcaacaatacgaggaggtctccattccgcctcatctgatggttggaacttccacggagctattcgatttcattgctgctgagttggaaaaatttgtgcggactgaaggagaggatttccacctaccagatggcaagcagagagaactgggtttcaccttttctttccccgtgcaccaaacatcaatatcatcgggcactctaattaagtggaccaagggcttttccatcaacggcacggttggagaagatgtcgtggctgaattgagtagggctatggagaggcagggtcttgatatgaaagttacagccctggttaatgatactgtaggcacattggctggcgggagatacgttgataatgatgttgctgctgctgtaatattgggcactggcacaaatgcagcttatgtggaacatgcaaatgcgattcctaaatggaacgggctactacctagatcaggaaatatggtaatcaacatggaatggggaaacttcaggtcagataagcttccaagttcagagtatgacaaagccttggactttgagagcttgaaccctggcgagcagatatatgaaaagatgatttctggaatgtatcttggagaaattgtgcggaggatcctgctgaaactggctcatgacgcatcgttgtttggggatgttgttccgccaaaattggaacaactttttgtactgagaacgccggatatgtcagccatgcatcatgacacctcacatgatctcaaacacctgggagccaagctcaaggatattctgggggttcctgatacttccctcgaagcaagatacattactcttcatgtatgtgaccttgtcgcggagcgaggtgcacgcttggctgctgctggtatatatggcattctgaagaagctaggcaaggacaaattgccaaatgactttagccaacaaaggactgtggtcgctatggatggtggcttatatgagcattacaagaagttcagtgcctgcctggaagcgacacttacagatctgctcggtgaggaggctgcctcgtcggttgttgtcaagttggccaacgatggctcaggaatcggagctgcgcttcttgcagcctcacactcccagtatgctgaagctgcatagttctaggagctcgagagatcgagttcttagtgtaacctttttcttttcctccctcttcccttcaaccgagagctcccctcgtgcgattcgcatctcttttttgcctctgcagcgtaatatagctagtatggcgccaatgagttcggagtatatcacttgaacaagcattagcaactgcagggaagtggaagcggatgtgacatctgagtgaagccgttcctttcctgcccattcttttttccctatccatttaagtttgtattatgatgcgatatcgcaaaccgaccagtggttatctgtgtaatcttgtatttcagaataaagaggggggacaaagtcatacaatcttactcatttttgaatgaatgtgcacagctcctgcttttatttcagagagaactacaatagcagcgtgtgcttattgttgtgttttattggtctagtatgtgtatgatctaaaaatttactgtgtcaaaccccagaa

SEQ ID NO: 4874 - DNA, 2044 bp, Pennisetum glaucum
ccggctgttccggtctcggggctctcgtcccactcccacacttccgcaagaggagaaagagagctggagaggcagagtgaacagaggagtgacaggagagagggaaggggtgggcgcgggctgctgtggcctagctcgcgatccgggcgcccggctgttccggtctcgggtcggtcgcgcggctcgatcgggaagccttggaggttcgtccggccggtcggcggggggcgcgatggggaagggagcggtcgccgggacggcggtggtggtgtgcgccgcggctgtcggggtggcggtggtggtgtcgcggagcaggaggcgccggagggaggcggagggagagaggaagaggaaggcggcggcggtgatcgaggaggtggagcaggcgctctccacgcccaccgcgctgctgcgcggcatcgcggacgccatggtcgtggagatggagcgcggcctgcgcgccgacccgcacgccccgctcaagatgctcatcagctacgtcgacaacctcccaaccggggatgagcagggattgttttatgcactggatcttggcgggaccaactttcgtgtcatacgggttcaacttggaggaagggagaagcgtgttgtgaagcaagaatacgaggaggtatccattccatctcatctgatggttggaacttccacggagttgttcgatttcattgctgctgagttggaaaaatttgtgcggactgaaggagaggatttccacctcccagatggcaagcagagggaactgggtttcaccttttctttcccagtgcaccaaacatcaatatcatcgggcactctaattaagtggaccaagggattttctatcaatggcacggttggagaagatgtcgtggctgaattgagtagagctatggagaggcagggtcttgatatgaaagttacagccctggttaacgatactgtaggcacattggctggtgggagatacatcgataatgatgttgctgctgctgtaatattgggcactggcacaaatgcagcttatgtggaacatgcaaatgcgattcctaaatggaaagggctactacctaaatcaggaaatatggtaatcaacatggaatggggaaacttcaggtcagataagcttccaagttcagagtatgataaagccttggactttgagagcttgaaccctggtgagcagatatatgaaaagatgatttctggaatgtatcttggagaagttgtgcggaggatcctgctgaaactggctcatgacgcttcgttgtttggggatgttgttccacccaaattggaacaactttttgtactgagaacgccggatatgtcagccatgcatcatgacacctcacatgatctcaaacacctgggagccaagttgaaggatattctgggggttgctgatacttgcctcgaagcaagatacattactcttcgtgtatgtgaccttgtcgcagagcgaggtgcacgcttggctgctgctggtatatatggcattctgaagaagctaggcaaggacaaattgccaaatgactttagccaacaaaggactgtggtagctatggatggtggcttatatgagcattacaagaagttcagtgcctgcctagaagcgacacttacagatctgctcggtgaggaggctgcctcatcagttgttgtcaaattggctaacgacggctcaggaatcggagctgcgcttcttgcagcctcacactcccactatggtgaagctgcatagttctaggagctcgagagaccgagttcttagtgtaacctttttcttttcctccctttccccatgaatcgagagcccccctcgtgcgattcgcatctccttttgcctctgcagcagaatatagctagtatggcgccaatgagtttggactttggagtgtatcacttggaacaagcattagcaactgcaggcgtgacatctgagtgaagccgttcctttcctgccaattcttttttccctatctatttaagtttgtattatgatgcgatatcgcaaaccaacaagtggttagttgtgtaatcttgt

SEQ ID NO: 4875 - DNA, 2128 bp, Panicum virgatum
gggcgagagaggagagagaagcggtgggcttgcagcggcctagctcgcgatccgggcgccgagctgttccgggcttgggatcggtcgcgcggctctatcggggaggctagggctcgcccggcggggcgcgatggcgaagggcgcggtcgtcgggacggcggtggtggtgtgcgccgcggccgccgctgcggttggggtggcggtggtcgtgtcgcggcggcggcggcgccggcgggaggcggaggacgagaggaagaggaaggcggcggcggtggtcgaggaggcggagcaggcgttctccacgcccaccgcgctgctgcgcggcatcgcggacgccatggtggaggagatggagcgcggcctgcgcgccgacccgcacgccccgatcaagatgctcatcagctacgtcgacaacctccccaccggggatgagcatgggttgttttatgcactggatcttggcgggaccaactttcgtgtcattcgggttcaacttggaggaagggagaagcgtgttgtgaagcaacaatacgaggaggtctccattccgcctcatctcatggttgggacttccacggagctgtttgatttcattgctgctgagttggaaaaatttgtggggattgaaggagaggatttccacctaccagatggaaggcagagagacctcggtttcaccttttctttcccagtgcaccaaacatcaatatcatccggtactctaattaagtggaccaagggcttttccatcaatggcacggttggagaagatgttgtgggtgaattgactagggccatggagaggcagggtcttgatatgaaagttacagccctggttaatgatactgtaggcacattggctggcgggagatatgtggataatgatgttgttgctgctgtaatattgggcaccggcacaaatgcagcttatgtggaacatgcaaatgtgattcctaaatggaacgggcgactgcctagatcagggaatatggtgatcaacatggaatggggaaacttcaggtcagataagcttccaagatcggagtatgataaagccttggactttgaaagtttgaaccctggcgagcagatatatgaaaagatgatttctggaatgtatcttggagaaattgttcggaggatcctgttgaaactggcacatgacgcctctttgtttggggatgttgttccaccaaaattggaacaattatttatactgagaacaccggatatgtcagccatgcatcatgacacctcacatgatctcaaacacctgggagctaagctgaaggatattctgggggttccagatacttccctcgaagcaagatacattactcttcatgtatgtgaccttgtcgcggagaggggtgcacgcttggctgctgctaaatgactgggcaagatacatatggcattctgaagaagctgggcaaggacaaattgctaaatgacttcagccaacaaaggactgtggttgctatggatggtgggttatatgagcattacaagaagttcagttcctgcctagaagcaacactttcagatcttctcggtgaggaggctgcctcatcggttgttgtcaagttggccaacgacagctcaggaattggcgctgcgcttcttgcagcctcacactcccagtatgctgcatagtcctaggagctcggctcctagtgtaacatttttgttttccgcattttgccccttctgtcaaagctcccctctgcgattcgcatctctttttgcctctgcagcgggatatagctagtatgtcgccaatgagtttgcagtatatcacttcgaacaagcattagcaactgcagggaagtggaagcggacgtctgagtgaagcggttcctttcctgcaattcttttttccctacacctttaactttgtattatgatgcgagatatcgcaaactgactagtgcttatctgtgtaatcttgtatttcaaaataaagaggggtataaaattattcaatcgtactcatttttgaatgaatgcgcagaggtcctgcctttatttcagaaagctacaacagtttgtgcttgttcttctgttttatttctatacaacatgtgtgtggtttgttaagaatttacagtgtgagaccctaaaatgg

SEQ ID NO: 4876 - DNA, 6092 bp, Oryza sativa
ttttgatacataaacccctcacgaaatctccatattacaggcagcagcacgcagagccacgaaacgaatccagacaaagcccgcgttggggcatctgcaatctgagccctacggttacagaaaggacaaatcagggccgttcatacgtaagggcatatccgtaaataacgtcaaactcgagggcgatttattcgcgagcaaaaacgcccaactcgtggctctcgtcccattcccacgcttgcgcaagcggaagaaaagagtagaggagagagactgagggagggaggcaggaggaaggaggaggaggaggacgctgcagtggtgggtggcgtagctcccgatccgggaagccgacccggtctgggggatttgctcctggcgcgcgctcgatcgagagggaggccagggttgggttggggggagcgtgaagaagcgcgcgcgcggctatggggaaggggacggtagtggggacggcggtggtggtgtgcgctgcagcggccgcggcggttggggtggcggtggtggtgtcgcggaggaggaggagcaagcgggaggcggaggaggagcggcggaggagggccgccgctgtgatcgaggaggtggagcagaggttctcgacgcccacggcgctgctgcgcggcatcgcggacgccatggtggaggagatggagcgcggcctccgcgccgaccctcacgccccgctcaagatgctcatcagctacgtcgacaacctccccaccggggatgagcacggactgttctatgctctcgatcttgggggcaccaatttccgtgttatacgtgttcagcttggaggaagggaaaagcgtgttgttagtcaacagtacgaagaggttgccattccacctcacctgatggttgggacttctatggaactgtttgacttcattgcggctgagttggaaagttttgtcaagaccgagggagaggatttccacttgccagagggcaggcagagagagttaggcttcaccttttctttcccagtgcaccaaacatcaatatcatcaggcactcttattaagtggacaaagggattttccatcaatggcacggtgggggaagatgttgtggctgaattgagcagggctatggaaaggcaagggcttgatatgaaagttacagctcttgttaatgacactgtaggcacattggctggcggaagatatgttgataatgacgttgctgctgctgtaatattaggcactggcacaaacgcagcctacgtggagcatgcaaatgcaattccaaaatggactggattactacctagatcaggaaatatggtgattaacatggaatggggaaacttcaagtcagaaaggcttcctcgttcagattacgataatgccttggactttgaaagtttaaacccaggcgagcagatatatgaaaagatgatttccggcatgtatcttggagagattgtgcgcagaatcttgcttaagcttgctcatgatgcttccttgtttggagatgttgttccaacaaagctggagcagcgctttatactgaggacgccggacatgtcagcgatgcatcatgatacctcacatgatctgaaacacctgggagctaagctgaaggatatcctgggggtcgctgatacttccctggaagcacgatacatcacccttcatgtctgcgacctcgttgcagagagaggtgcacgcttagctgctgctggtatatatggcattctaaagaagctgggcagggacagagtgccaagtgacggtagtcaaaagcagaggactgtcattgctctggatggtggtctctatgagcattacaagaagttcagaacctgcctagaagcaacgcttgcagacctgcttggagaggaggctgcctcatcagttgttgtcaagttggcaaacgatggctctggcatcggagctgcacttcttgcagcatctcactcccagtatgctagcgtcgagtagtaacaggagctcatgggactgagctcccagtgtagcttgttttcctcccattttccccgtttctttccaatgggagttcgtttccctcctgcgattcgcatctccttttgctattctgcagtcacataaacgagtgcctgtgcagcgggatgtagctagtatggcgccaaagagtttgcagttatcacatgaacaagcatttgcaactgcagggaagtgaaaacgggggcttgaatgatgccgttcttttcctgcaaattattttccccctttccctgtaagtttgtattgtgatgcgatgtcgcaaaccaatcacagcggtttcgcgtgtagccttttgtcattcagatttcagaataaagagggggacataatttcacttttcgtatgtcagtttgaactatgtatgtactcttacacactggtatcaaagctcaaatgatctgatcagccgcgagcagctaacaaaatagtactaagaagtgtaccatcaaggtaaggtaatagagtatgatcatcttttctagtactgtctaatatggcgtttatattcatgcagtgcagtgctggctcatagactaaccattccctgctcacatcagtgtttcctagtaggtaaaggtgcggcagtgctctgctcctttcttcagacaatggaatcgaaatcgctcctctcgtcagcgtcgtcgtctgctcctttggccttcgcgggctgtttccggcggctgcctcgttgcggcagcaacagcggcgccacttcgtactcctcctgcccgctctccgccttgcatttctggtgcgtctgctcggagcatttgaccaggatctgcagcacgtccttcatggttggccgtgacgcgggcgtggcccccgtgcacatcacgcctagcctgaacaccacctcgatctcgtcggagtaacccgcgtacctgatgcactgatccgtagcgtcggggatgctctctcccgattgatagtggtgccgcgcccagtccgccagggaaccgtgctcgccgccgtcgttggccgccttgcccgtggtaagctccaggagcaccaccccaaagctgtacacgtccaccttctcatcaacctttctcgtgtaaccacactctgaaaagagagagagagtaagtctcagtgataataatactcgaattaattaactagacatgttctgtatagaatacggcacaaaaggagagtacaaaattaacagtgtcaagcagagagagatcgttaccgggagccatgtagccgaacgagcctgcaacggcggacacggtgtcgggcgtgccggcctgcgccagcatcctggccagcccaaagtcggcgaccttagcccggaactcggagtcgagcaggatgttgctcgtcttgacgtcgcggtggacgatgggcggggtgcactcgtggtgcatgtagtacagcccctgcgcggcgccgacggccaccctgagcctcgtcggccagtccaaagcgggcgcgccgccccgcgcggaccgcgccctcgccacagcggccaccacggggcgcccgtcgttgatggcgcggcgcccgtggagccacccgtccaggctgccgttgtccatgtagtcgtacaccaggagcttggcctcgtcgccggagacgcagcagagcagcctgacgatgttgttgtgccggacgttgccgaggatgcgcgcctccgactcgaactcgcgctccagcttctcctccaccttcgcggcgcccgtccgtatcttcttcacggccacggcgccgtcgccgccggtgtaccggttggtgtaggcgacgcggtacacgctccccgagccgccgcggccgacgaggttctcctccgttagaccccggagtatggccgcctcgctgaagcccagatcggtctggaaaggcgtgatcttccagtcctcgcgctgcgccacgcgcttccttcttctcctgatgtcgcggacggcgaagaaggccaacgccacgatgacgaggaggagcgcggccccggctacgaggagaccggcgcggagccctggcgagacgccaccggaggaagcgctgcctggcgatccggcgttgcaggaccgcacgccggcgaggtagctggagcccaggcctgaggtacagagggtggggttgtcaaggaagctgcgggcgtaggcacctatggcgaacttggccggcacctggccgctgagctggttggacgagaggttgagcgagttgagattcagactggcaagagacgacggtatgccgccggagagcctgttcgacgacaggtcaagtgcgttgagcaccggcatggcgcccagctcggccggtatctcgccggagagctggttcttgctcaaatcaagctgagtcaagactttaagcttggaaacgctcttcgggatcccgccggagagctggttaccagacaggtttagtgtctgcagcaccggcatgccgttgccgagactctccgggatctccccggaaaaattgttgttcccggcgatgaacttctgaagagcagccgccgccgcggggatgctaccacgaaattggttgttctccacggttaagctcgaaaggttgctgtacatggtggaaggcagagtcccggtgaggccattattctgcagctgcacgaattggagctttgtcgccgtccatagcgcctctggcacatcgccggacagcttgttgttggggagaaacagggtctggagcgtggtgcagccggcgagcctctccgggatggagccgttcaagaggttgttcgctgcggtgaatatgttgagcttgccgccgtcacacagcccctcaggaatcgggccggtgaacttgttgaaatcaacctcaagatcccacaaatccggtgacttctgcccaagctccggtggtagaacgccggtgagactattattgaataggtgtatttccttcaatgccggcaaccgaccgatgctcgccggtatctcaccggagaagttgttaaagtacaggtggatgacttcaagcttctgcaagagaccaaagtcttgaggaatcggtccacccagcttgggattcgcggacaggtcgatgaaaaccaaattcactgcggcgaaagcaccatcggcgacgacgatgtcgccggtgagcttgttcgcaaatagaaacaggcactgcagcttcttcaggctccagatccccggaggaatgcttcctgtcaagttgttgaccgccaggtcgagcgtcaccaagtccggcatgtcggccacataggctggcatgtcgccgacgagctgacactttctcgcccagagggttgtcagcttagtcaggttcttgaacgactccggcagctgacccggtccgagcttgttcgtcgagatcgtcagcgtcgtaaggctcgtcaggtcgccgagctctcccgggattgtgccggtgaggttgttgttgtccagcatcagccactccagcttctgcaatcgggacaacgacttggggatggtgccagtgaagtagttgccgctgaggactagagttgtcaggttctccccgaggccgacgccgatgtcggcggggagctccccgccgaggtagttctgagacaggttgaggtaccggagagaaacgcagcggtacacgctcgtcgggaacgtaccgttgatgttgttgttgtagaggtcgaggtgcacgaggctggagaggccgccgacggcgtccgacacggggccggacacgttggtgttggcgagggagaggttcgtgacgcgcccggcggtgtcgcatgtgacgtagggccaggagcagtgagccgcgggcgcggccgtgtcgttccatcccgcgagcacggccgggtcgccccacgcgcgcttgatctggaggagcagccgcgcctcgttcgccgcgggctgggccgcgccgcggtgcgggatgaggcagcaaggcagcgcgagcagcaggaagaggaggtacacagggcccggtgcttttgccatggtttccatggtgtgttctgcccccgccgcaagccgctgtggacgcgggaagaagtggggggagttcggtttgagaatgttaagcaaatgcggcgggaacgagaccgttataagctcctgcgtgcttgcttcgaagcttcatgttgcttaccggagc

SEQ ID NO: 4877 - DNA, 2846 bp, Brachypodium distachyon
cctcgtccgactgccacgcttgcgcaagcgaggaaagagcaaggacagaggagagagagcgagagacggggggaggaagggagaggctgtggtgagtggcacaggcccccccgatacggaagccggtcctgttctggtgtccgggcgtgtgggggtgcgggtttcggtcgtggagagagtgcgatcgatggggaaggagacgacggtcgtggggacggcggtggccgtgtgcgccgcggccgcggcggcggtaggcgtggcggtggccgtgtcgcggaggaagagcaggcggggcgccaaggcggagaggcggaagaaggccgccgatgtgattgaggaggtggaccgggcgttcgcgacgccgacgccgatgctgcgcgacatcgccgacgccatggtggaggagatggagcgcgggctgcgcgccgacccccacgccccgatcaagatgctcatcagctacgtcgacaacctccccaccggggacgagcatggactgttctatgcactcgatcttggtgggaccaactttcgtgttataagggttcagcttggaggaaaggagaagcgtgttgtccaacaatatgaagaggtggccattccacctcatctgatggttgggacttctatcgaactatttgatttcatcgccgctgagctggaaagatttgttgcgactgaaggggatgatttctacttaccggagggcagacagagagaactgggtttcaccttttctttcccagtaaaccagacctcaatatcttcagggacccttattaagtggacaaagggattttccatcaatggcacggttggggacgacgttgtggctgaattgagcagggctatggagcggcaggggcttgatatgaaagttacagctctggttaatgatactgtaggcacattggctggcgggatatatgatgataaggatgtcgttgctgctgtgatattgggaactggcacaaatgcagcgtatgtggagcatgcaaatgcaattccaaaatggaacggactactacctagatcaggaaacatggtaatcaacatggaatggggaaactttaagtcagacaagcttcctcattccgagtacgatagggccttggattttgaaagtttgaaccctggggagcagatatatgagaagatgatttctggcatgtatcttggagagattgtgcgaagaatcttgcttaagctggctcatgatgcttcattatttggagatgttgttcctccaaaattggagcacctatttgcactgaggacaccggatatgtcagccatgcatcatgacacctcacatgatctcagattcatgctgtctaaactgaaggatatcctgggggttgctgatatttcgctggaagcaagatacattactcttcacatctgcgacaaggtcgcagagagaggtgcacgcttagctgctgctggtatatatggcattctaaagaagctgggcagggacagagtgccgagtgatggtagtccaaagaaaaggacagtcgttgctgtagatggtggtctgttcgagcactacaagaagttcagctcctgcgtagaagcgacactagcagacttgctcggcaaggaggctgcctcatctgttgtcgtcaagatggccaatgatggctctggcattggtgctgcacttcttgcagcctcgcattcccaatatgctattgccgagtagtcctaggagagggactgagctccttgcgcagcttcttgttttcctcctttattttgccgtttctctctactgagagttcttcccctcttgcggttcgcgtcttcttttgctattctgcagacacataaggacataatcagagcctgtgcagcgggatatatataactagtatagagccaatgagttccagaattcggagcttggagtatgtcaaatggaaaaggcgtttgcaactgcatgaaagtggaaaaggaggtcagaacgatgtcgttcttttcctgccaattctttttcccctaaacctgtaattttctattgcgatgcggtatcgcaaactaatatcagatctgcatgtaatcttttgtaattcagaataagagggctgtataatccaatacttggtatttcttctgctcaattggtcatatatgtgtacatgtctgtctaggtgtcaaaacaaggtaggcagtgtatacaataacgactctgaagcaaaattgagactattaatcctctggtaatagtattgccaattctgcactggagtacaaatgcactgtcctgggtcatcatagctgttgtgctaactaagtgcactccttaattcagacaatggagtcgaagtcgctcttctcctcgctgtcggatcctgaagagtcggaaagctgcttccgacggctgccgcgctgtggcagcaagagcggagctgcctcgtgctctcggcgatgccccgtcttgcctttctgtagcgtctgttccgagcacttgagtaagatctgcagcacgtccttcatcgtcggccgcgaggagggcgaggctccggtgcacatcacggctagcctgaacacggcctcgatctcctccgagcaccccgcgtatctgatgcgggtatctgtagcgtcggggatgcttcctcctgactggtaatggagccgcgcccattccgccagggacccgtgctcgccgccttcgttggccgccctgccggtggtgagctccaggagcacgacgccgaagctgtacacgtccaccttctctgtcactttcctcgtgtaagcgcactctgcagacaagcagaggacagtgttaagaacttggaaagtttgccctgtaaaatttcagaacagaggatatggttgat

SEQ ID NO: 4878 - DNA, 4067 bp, Pennisetum glaucum
gaagggagaggtgatccactgaggtgttgttggcctcggatccggaaacgcgaagtccctcctccttgcggcgctcggatcggtccctccatccaagggcggcgcgcgcgcgaggtggtggatcgggatcggcagtgatggggaaggccgcggcggtgggcacggctgtggtggtgtgcgcggccgtgggtgtggccgtggtgctggcgcgcaagcgcagcaggcgggctgccgagctgctggggtccgcggaggcggaaaggaagaggcgcgcggcggccgtgatcgaggaggtggagcgcagcctcgccacgcccaccgcgctgctgcggagcatcgcggacgccatggtaaccgagatggagcgcggcctgcgcggggacatccacgcgcagctcaagatgctcatcagctacgtcgacaacctcccaagcggagatgagcatgggctgttttatgcactggatcttggaggcacgaactttcgtgtgctgcgagtccaactaggaggaagggagaaacgtgtcgtcaaacaacagtacgaggaggtttccattccaccacatctgatggtcgggacttccttggaactattcgattttattgctgctgcattggctaaatttgtcgatactgaaggtgaagatttccaacttccagagggtcgacagagagaacttggtttcaccttttcgttcccagtgaaccaaacatcaatatcatcaggaacactcatcaaatggacaaagggcttttctgtcaatggcatggttggtgaagatgttgtgtctgagttgagcaaggccatggagaggcaggggctagatatgaaagttacggcgttggttaatgatacggttggcacattggctggtggaagatatatggataatgatgtagttgcagctgtaatattgggcacgggtacaaatgcagcatatgtggagcatgcaaatgcaattcctaaatggactgggttactgcctaaatctgggaacatggtaattaatacagaatggggaagcttcaaatccaagcttcctctttcagaatacgataaggccatggactttgaaagtttgaaccctggagaacagatatatgaaaaattgatttccggcatgtatctaggagagatcgtgcgaagaattttactgaagttggcacatgatgcttccctgtttggggatgttgttccacctaagctggaacagccatttgttctgaggacaccagatatgtcagccatgcatcatgactcctcacatgacctcaaaattctgggagcaaagttgaaggatattgtgggggttgcggatacttccctggaagtaagatacattactcgacacatctgcgaccttgttgcagagcgtggggcacgcttagctgctgctggtatatacagcatcctgaagaagttaggccgggacaaagcaccaagcaatggcagtaaaatgccgagaaccgtcgttgctttggatggtgggctctatgaacattacaagaagttcagcagttgcgtagaaacaactcttacagacttgctcggtgaagaggtggcgtcctctgtggttaccaagctggccaacgatggctctggcattggagctgctcttctcgcagcatcgcactcccaatatgccgaggttgactagtcttggaatcaagcgtggatcaaactttgagtgtagtttctcattttttcccttaaaaccttcctaatattccgggctctcctcggggaaattttcggctctctttcttggctattctgcgggtgcactgaagtaactgcagcgggatatagctagtgtagaaccaaatgagtttggaggttctctaatggcataaatgtgtggacggcaggagcatggaaatggaggttggacaaatgccattcatgttctgcccattcttttccccttgtatggtgttgtaaaccaatcaattttttttaaccttttgctgttgacaataaagaggaggacacgaactaatttaaccgtgttccttcactgcttcctcaaatatatgacggctatatattttgcagttgcagtacaatgcctaaaatatacgatagtttcatctttcatgccttcaaaattatacagtaaatgctacgtacacctagaggtggcaccgcgattatggcaggaagtggtgttagctgcgagcctgcgactatccgtcaggtggtctcacgactgcacaaggctgctgctagtgtacgtgtaccgtcaggtggtcaggtattgcgatagccatctgctcattctgcttttcttcagacactgcagtcgaaaccgccctcgctgccatcgtccatcaccttggcatcggagagctgtttccctttccctcggctgcctcctcgcacctgcaggagcggggcggcgtcgtagtcggcggcgaccttctcctccgcggctttccggtgcgcctgctcgcaccgctgcagtatctgcagcacgtccttcatcgtcggccgcgtcgacggctgccggcccgtgcatatgatcccgagcttgaagacggcctcgacctcgtcaccgtacccggcgtccctgatgcacttgtccgcagcgtcggcgatgcttctgccggactgcaggtgccgccacgcccagtcggccagggacccgtgctcgccgccgtcgttggcctcccgtcccgtggtcagctccaacagaacgaccccgaagctgtacacgtcgaccttctcgttcaccttcctcgtgtacccgcattcgggagccatgtagccgaacgatccggcgatcgcgcacaccgtgtcagccttgccggtctcggccagcatcctcgcgaggccgaagtcggcgaccttggcgttgaggtccgagtcgagcaagatgttgctggacttgacgtcccggtgcacgaccggcggcgagcactcgtggtgcatgtagcacagcccgcgcgcggcgccgacggccaccctaaccctcgccggccagtccagcggcgctcgccggaccgacggggccctcgccatcgcgctcccggccatccatttctcgccgtgcagccacttgtccaggctgccgttctccatgaactcgtagacgaggagcttggtctccgcgcgggagaggcagcagaggagcttcacgatgttgctgtggcggatgtggccgaggacgtccacctccgccgcgaacgcgcgctccaggctcttgtccaccttcccgccggtccagatgcgcttcacggccacggtgccccccgcgccgccgctgcttcggctggtgtacgcgacgcggtacacgcgccccgagccgcccttgccgatgaggttttcgtcggcgagcccccgcgccacggcggcctcgccgaagtccaggggatggaacggggtgagcttccatggctcctcggcctgcgcgagccgccgcttccgcctcctgatgtcgcggacgacgaatacggcgagcgccgcgatgagggcgacgagcacggcgcccgcggcgaggaggcccgcacggaggcgcggcgagacatggtcggttgcctgggccgcgcacgagcgcacgcccttgaggctccctaccaacgacgcggcgacacagaggccagggttgcccaagaagctctcatcgttggccgggtttgccagagccgccgggatctcgccagtgagctggttggaggacaggttaagttggctggacctcagcgatgccagcgacgccggtatggcactggaaagctggttcgacgaaaggtccagcaggttgagcaccggtatggagcccaacccggccggaatctcgccggtgagctggttatggctcaagttcatctgcgacacggcactgagcgacgccatgctctctgggattgccccagagagctggttcgccgacaggtccagctcctgcagcagtggcatcccagcagcaaaccctgatggtatgtcaccagagaacagattgttgctggcatgaaacttttggagcttagccgccgtcgccggaatccggccagtgaaccggttgttgtcgataaaaagcctcgatatgttccagtacagggtctcc

SEQ ID NO: 4879 - DNA, 6271 bp, Setaria italica
tgaagaggagctgttcctcccccgcggacagttgcttgccggcctttgaccctgcaaccgcccgctcggatggctccgtcccacacgaatctccaagaggccctcgagacatcccgtcctcacgtcaggaatctccgctgggcccggcccgtgcacgtggatgagatcccccgctttcaatgctgtatccctatctaattaccttccgatttgggctcagcggcctaacgcaacccctatcacgccccctgatgcgtgggcctcggcttacctggacccaccagtcattgtctactggcaagcacgacgggccacccgattgtttggtgggacatttcttgcggaaacaatcgcttatctgtttccatcctccaactaatctcatgcccatccagtaattagcacatatcctctcatccccgaggctacactaccaggcaggccccccagatccgtttaccccacgctccgatccggcccgtccagctcgaccacgggcgcatcccggccgtccgaatccgagggtggacccgtgaattccggaaagccgaggggtggttggctaccggttaaaaacgcccgtgccagtggctccccatcctcctcctcctacgcggccggggcaggaacggagaggtgatccactgggtgttggcctcggatccggaacgcggagtccctgcggcgctcggatcggtccctccatccaagggcgcgggcgcgaggtgggggatcgggatcggcagtgatggggaaggccgcggcggtgggcacggcggtggtggtgtgcgcggccgtgggtgtggccgtcgtgctggcgcgcaggcggcgccggcgcgatgccgagctgctggggtccgcggacgcggacaggaagaggcgggcggcggccgtgatcgaggaggtggagcgcagcctcgccacgcccaccgcgctgctgcggagcatcgcggacgccatggtcaccgagatggagcgcggcctgcgcgcggacatccacgcgcagctcaagatgctcatcagctacgtcgacaatctccccaccggagatgaacatggactgttttacgcactggatcttggaggcacaaacttccgtgtgctgcgagtccaactaggaggaagggagaaacgtgttgtcaaacaacagtatgaggaggtttccattccaccacatctgatggtcgggacttccttggaactattcgattttattgctgctgcattggctaaatttgtcgacactgaaggtgaagatttccacctcccagagggtcggcagagagaacttggtttcaccttttccttcccagtgaaccaaacatcaatatcatcaggaacactcatcaagtggacaaagggcttttccgtcaatggcatggttggtgaagatgttgtgtctgagttgagcaaggccatggagaggcaggggctagatatgaaagttacggcgttggttaatgatacggttggcacattggctggtggaagatatatggataacgatgtagttgcagctgtaatattgggcactggtacaaatgcagcatatgtggagcatgcaaatgcaattcctaaatggactgggttacttcctaaatctgggaacatggtaattaatacggaatgggggagcttcaaatccgacaagcttcctctttcagaatacgataaagccatggacttcgaaagtttgaaccctggagaacagatatacgaaaaattgatttccggcatgtatctaggagagattgtgcgaagaattttactgaagttggcgcatgatgcttccctgtttggggatgttgtaccatctaagctggagcagccatttgtactgaggacaccagatatgtcagccatgcatcatgactcctcacatgacctcaaaattctgggagctaagctgaaggatattgtgggggtcgcggatacttccctggaagtaagatacattactcgacacatctgcgaccttgttgcagagcgtggggcacggttagccgccgctggtatatacagcatcctgaagaagataggccgggacaaagtaccaagcaatggcagtaaaatgccaaggaccgtcattgctttggatggtgggctctatgaacattacaagaagttcagcagctgcgtagaaacaactcttacagacttgctcggtgaagaggcctcctcctccgtggttgccaagctggccaacgatggctctggcattggagctgctcttcttgcagcctcacactcccagtatgctgaggccgattagtcttgaaatcaagcgtggatcaaactttgagtgtagcttctcatttttctttttttcccttcaaacattcctaatattccgggctctcctcggggaaattttcggcttcctttcttggatatcctgcggacgcactcaagttctctgcagtgggatatagctagtatagagtgagtttggaggttctctaatggcataaatgtttggacggcaggagcatggaaatggaggttggacaatgccattcgtgttctgcccattctttccccttgtatggtgttgtaaaccaatcaaattttttaaccgttttgtgttggcaataaaagaggaggacacgaacgaatttaaccatgtgttctcttcactgcttcctcaaatatatgactgagttgtatattttgcagttatagtgcatagtttcatggcttcaatattatactttgcagttacatagctactggcacctataggagggcactgccactgtggcattgtccatcagtgttgttggctacttggcttgtggtgagctgtgcctatcctttggtctgctctcctaagactgcacacaaggctgctagtgtacccgtcctagatcctaacctgaggtggtcagggttcctacagccatctgctcattctgcttttcttcagacgttgcagtcgaaaccaccctcgctgccatcgtccatcactctggcatcggagagctgtttccgtcggctgcctcctcgcacctgcacctgcaggagcggggcggcgtcgtagtcggcggcgaccttctcgtccgcggctctctggtgcgcctgctcgcaccgctgcagtatctgcagcacgtccttcatcgtcggccgcgtcgacggctggcggccggtgcatatgatcccgagcttgaagacggcctcgacgtcgtcaccgtacccggcgtccctaatgcacttgtccgcggcgtcggcgattcttctgccggactgcaggtgccgccacgcccagtcggccagggacccgtgctcgccgccgtcgttggcctccctgcctgtggtcagctcaagcagaaccaccccgaagctgtacacgtcgaccttctcgttcaccttcctcgagtacgcgcactctgcacgaacgagcgtgacaaaaataagttgacgtgcctgccactagaaagaaattggcattcaggatcagcgagacgatcacgagacagacacgtaccgggagccatgtaaccgaacgatccggcgacggcggacaccgtgtcggccttgccggtctcgaccagtatcctcgcgaggccgaagtcggcgaccttggcgttgaggtccgagtcgagcaagatgttgctggacttgacgtctcggtgcacgatcggcggcgagcactcgtggtgcatgtagcacagcccgcgcgcggcaccgacggccaccctgaccctcgtcggccagtccagtggcgcttgccggaccgacggggccctcgctatcgcgctcccggccatccatttctggccgtgcagccacttgtccaggctgccgttctccatgaactcgtagacgaggagctttgtctccgcgcgggaaaggcagcagaggagcttcacgatgttgctgtggcggatgtggccgaggacgtccacctccgccgcgaacgcgcgctcctggcccttgtccaccttcccgccggtccagatgcgcttcacggccacagtgccccccgcgccgccgctgctccggctggtgtacgcgacgcggtacacgcggcccgagccgcccttgccgatgaggttctcgtcggcgagcccgcgcgccacggcggcctcgccgaagtccaggggctggaacggggtgagcttccagggctcttcggcctgcgcgagccgccgcttccgcctcctgatgtcgcagacgacgaagacggcgagcgccgcgatgagggcgacgagcgccactcccgcggcgaggaggcccgcacggaggctcggcgagacatggtcggttggctgggccccgcacgagcgcacgcccttgaggctcccgaccaacgacgcggcggcgcagagacccgggttgcccaagaagctctggtcgttggcggggtttgccagcgccgccgggacctcgccgctgagctggttggacgacaggttaagctggctggacctcagcgatgccagcgacaccggtatggcaccggaaagctggttcgacgaaaggtccagcaggttgagcaccggtatggagcccaacccggccggaatctcgccggtgagctggttatggctcaagttcatctgcgacacggcacagagcaacgccatgctctctgggattgccccagagagctggttcgccgacaggtccagctcctgcagcagtggcatcccagcagcaaaccccgctggtatgtcaccggagaagagattgttgctggcatgaaacttttggagcttagccgccgtcgccggaatccgtccagtgaaccggttgttgtctatcgaaagcctcgatatgttccagtacaggttctccggcagggttccgctcagctgtccattgttctgcaagaacagggtcaaaagcttgggcaccgtccacagtgcggccggcacctcaccggacaactcgttatcttggagctgaagccatatgagagtggggcagctggcaagactggacgggattaagccgttaagctggttatcggaggcggtgagcaccaacaaccgtttgttgctgcagattccttccggaattggcccgacaaagttgttgctgtcgatctggatgtctctcagcaacggcgtctgctttccgagctccgccgggagctctccactgaggctgttgtcccacagccacaagaactccaaggacggtagccgggcaatactcgccggtatctcgccggtgagattgttctggtgcaagttcaagtatctcagtttcagcaagcttccaaagctttccgagatggttccactcagctggttcatggacaggtcgacctctaccaattctgttgccccgatcttgccattgatgccaatgtcgccggtgaggttgttggcgaaaagatacaagtactgcagcttttggaggttccaaatcccgggtggtatgtttccggtgaatctgttcgtcgacaggtcgagccactgcatccccggcatctgcgtgacgtaattcgggaattcaccaccgaggctgcaattcgccagccagacagtggttagcttcgtcaagcttttgaacgactccggcagcatgccggcatcgaacggattgctctcgagcttgagcgcctcgaggctaatcaggtcaccgagctccggcgggatcgtgccggtgagctggttctcgttgagagcgaggtacgtcaggttcttgagcttggacaccgccgccggtatcgtgccggtgaagctgttgtggtccaaggcgaggtaagtcaggttgcccccgagccggccgatgtcggccgggagcttcccggcgagccggttgttggagaggtcgatccgcgcgatgccggtgcagttgtagaggaacgccgggaagccgccgccgacgctggtgttggagaggtcgagcgccgtgagggcggtgagcccaccgatgtcgtcggggacggcgccggacagggtcacgttggggagggccagcgacgcgacccggccgctcgcgtcgcaggacacgtaggtccagttgcagtgcggggaggccccggccgcggcggtccacgacgcgagcgccgccgggtcgccccatgcgctcttgatacggaggagcagccgcgcctcgccgccgtcgtcggcctgctgcgccgcggcgtggcgcgggaggaggcacgccaacagggcgaggcaggcgcacgccaggggcaggacgcggtgccaggcgtggccgggcggcgacgaccgtgccatggtctttgggctggttccgccgcgcgccgccgtgcgtttcaggtgcggtggtggttggctgccatcgcggaccgtgt

SEQ ID NO: 4880 - DNA, 2663 bp, Zea mays
tgaagaaagagagctgttcgtccaccggggacacagacacagttgctggcagttgaccttgcaacctccacgcggatgacagcaccgtactacacgaatctccaacaggcccgcgaccgcgaggcatccccgtcctggcgtccggaatctcagctggggtccgaccgtccacgtgggacaagaccccccgctttgaatgcggcatccctcgtctaattaccttctgattcgagctcaaggccccgacgcaatctccgctgcctccctgatctgtggccccgagacggtaggaaccacctgtcagcctgtactggctaccacgacgcgccaccgactgtttggtgacccatttcttgcgcgagcagagtcgctaatcgatttccatcctccaactaatctcacaccaatcgggtaattagcgaatatatatatatccatatttactagacaagccccccgggtccccagatccgtccacccccacgctccgatccagcccgtccagttcgacgcgaagcggatcgtagccgtccgaatccgaggggtggacccgtgaattccgggaaggacgaggggtagttggctaccggttaaaacgcccgtgccagtggcccccgtcttcctcctctcctacgcgggcggggaagccaaggaagaagaagtagtagttcgctggaggagttggggcctcgtcctcggatccagagcgcggaaacccgtgcgcgcgtccggatcgacccgctcgctcgacggccgcgggcgcgaggctagggatcaggatcggcggcggcggcggcgatggggaagtccgtggtggtgggcgcggcggtcgtggcgtgcgcggcggtgggggtggcggcggtgctggtgcaccgccggcgcaagcgcgacgccgcgctcctggggtccgcggaggcggagaggaggcggcgcgcggccgcggtgatcgaggaggtggagcgcagcctcgccacgcccacggcgctgctgcggggcatcgcggacgccatggtcgccgagatggagcgcggcctgcgcggggacatccacgcgcagctcaagatgctcattagctacgtcgacaatctccccaccggagatgaacatgggctgttttatgcactggatcttggagggaccaacttccgtgtgctgcgagtccaactaggaggaagggagaaacgtgttgtcaaacaacagtacgaggaggtttccattccaccgcatttgatggtcgggacttccattgaactatttgatttcattgctgctgcattggctaaatttgttgatactgaaggtgaagatttccacctcccagagggtaggcagagagaacttggtttcacgttttccttcccagtgaaccaaacatcaatatcatcaggaacactcatcaagtggacaaagggcttttccatcaatggcacggttggtgaagatgttgtttctgagttgagcagggccatggagaggcagggactagatatgaaagttacggcattggtcaatgatacagttggcacattggctggtgggagatatatggataacgatgtagttgcagccgtaatattgggcactggtacaaatgcagcatatgtggagcatgcaaatgcaattcctaaatggactgggttactgcctaaatctggaaacatggtaattaatacggaatggggaagctttaaatccggcaagcttcctctctcagaatacgacaaagccatggactttgaaagtttgaaccctggagagcagatatacgaaaaaatgatttctggcatgtatctgggagagattgttcgaagaattttactcaagttggcacatgacgcttctctatttggagatgttgttccaactaagctggagcagccatttatattgaggacgccagatatgtcagccatgcatcatgactcttcgcatgacctcaaaactcttggatctaaactgaaggatatagttggggtcgcagatacttccctggaagtaagatacattacccgtcacatctgtgaccttgtcgcagagcgtggagcacgcttggctgccgcaggtatatatagcatcctgaagaagataggccgggacaaagtaccaagcagtggcagtaaaatgccaaggactgtaattgccttggatggtgggctctatgagcattacaagaagttcagcagctgcgtcgaagcaactcttacagacttgctcggcgaagaggcctcttcctccgtggttgccaagctggccaacgatggctctggcattggagctgctctccttgcagcctcacactcccagtatggcgagagtgactagtcttgaaaacgggtgtggatcgaacttcgagtgtagctctcatttttatctttttttcccttcaaaacatccctaatattctggctctcctcggggaatttttcggcttcctttcttggctattctgtggatgcacttaaggctctgcagcgggatatagctagtatagagccaatcagtttggaggttatctaatggcataaggtttggacggcaggaacatagaaatggaagctgaacaatgccattcatgttctgcccagtttttcttctccttgtatggtgttgtaaaccaatcaaaacttttaacctttttgtgttggcaataaagaggaggcacg

SEQ ID NO: 4881 - DNA, 3032 bp, Sorghum bicolor
gtttgcacggcccatgtgtcggtggtgtttgccgtggcccgtgagcgatggttgaagaagagctgttcgtccaccggggacagtcgctgcgccgttgaccttggaaccgccgcgtggatggctgcaccgtacacgaatctccaacaggcccgcgagacatcccgtcctcacgtccggaatctccgccgggcccggccgtccacgtgggcatgagacccccgctttcaatgcggtatccctcatctaattgccttctgatttgggctcatagccacgaccgcagtctctgatatgtaggccccgtgattgtgggaaccacccgtcagtgtctactggctaccacgacgcgccaccgattttgtttggtgagacatttcttgccgagcgcaatcgcttatctatttccatcctccaactaatctcataccaatccagtaattaacacatatatccaaatatcctctcgtccgcgtagcctatattactagacaaccaccccagatccgttcacctcacgctccgatctggaccgtccagtttgacgcgaagcggattgtggccgtccaaatccgagggtggacccgtgaattccggaaagacgaggggtggttgtctaccggttaaaaacgcccgtgccagtggctcccgtcttcctcttctcctacgcggacggacggggaaggaggaggaggaggaggaagtggttcgctggagttggcctggcctcggatccagagcgcggaaactcgtgcggcggcgttcggatcgacccgctcgaaggccgcgggagcgcgaggtaggtagggatcaggaccggcgaggcgatggggaaggccgtggtggttggcacggcggtggtggcgtgcgcggcggtcggggtggccttggcgctggcgcaccgcaggcggaagcgggatgccgagctcctgggatccgcggaggccgagaggaagaggcgcgcggccgccgtgatcgaggacgtggagagcagcctcgccacgcccacggcgctgctgcggagcatcgcggacgccatggtcaccgagatggagcgcggcctgcgcggggacatccactcgcagctcaagatgctcattagctacgtcgacaacctccccactggagatgaacatgggctgttttatgcactggatcttggaggcaccaacttccgtgtgctgcgagtccaactaggaggaagggagaaacgtgttgtcaaacaacagtatgaggaggtttccattccaccgcatttgatggttgggacttccatggaactatttgatttcattgctgctgcattggctaaatttgttgatactgaaggtgaagatttccacctcccagagggtagactgagagaacttggtttcaccttttccttcccggtgaaccaaacatcaatatcatcaggaacactcatcaagtggacaaagggcttttccatcaacggcacggttggtgaagatgttgtttctgagttgagcagagccatggagagacaggggctagatatgaaagttacggcgttggtcaatgatacagttggcacattggctggtgggagatatatggataacgatgtagttgcagccgtaatattgggtactggtacaaatgcagcatatgtggagcatgcaaatgcaattcctaaatggactgggttactgcctaaatctggaaacatggtaattaatacagaatgggggagcttcaaatccgacaagcttcctctttcagaatacgacaaagccatggactttgaaagtttgaaccctggagagcagatatacgaaaaaatgatttctggcatgtatctgggagagattgtgcgaagaattttactgaagttggcacatgacgcttctctatttggggatgttgttccatctaagctggagcagccatttatattgaggacaccagatatgtcagccatgcatcatgactcctcgcatgacctcaaaactcttggagctaaactgaaggatatagttggggtcgcagatacttccctggaagtaagatacattactcgccacatctgtgaccttgttgcagagcggggagcacgcttggcagctgcaggtatatatagcatcctgaagaagataggccgggacaaagtaccaagtagtggcggtaaaatgccaaggactgtagttgccttggatggtgggctctatgaacattacaagaagttcagcagttgcgtagaagcaactcttacagacttgctcggcgaagaggcctcttcctccgtggttgccaagctggccaatgatggctctggcattggagctgctcttcttgcagcctcacactcccagtatggggagagtcactagtcttgaaaacgggcgtggatcgaactttgagtgtagctctcactttcttttttttgcccccttcaaacattcctaatattccagctctcctcggggaattttttggcttcctttcttggctattctgtggatgcacataagtgtctgcagcgggatatagctagtatagaaccaatgagtttggaggttatctaatggcataaggtttggacggcgggagcatggaaatggaagctgaacaatgccattcatgttctgcccatttttctccttgtatggtgttgtaaaccaatcgaaaattttaaccctttttttgttttggtaataaagaggaggacacaatccaatttgaccatttgttctcttcattgctttgtcaaatataattcttgatttaggttcatagtttcaaaattatatagttttgccgttacagttacagtacatacacacctataggattggcactgtccatcagtgttgttgtaatgagctgtgatgactatccttatctctgctgtcaggctaagaccgtggacggtgcacaagctcaaggtagctggtgtaacggctatgcctatatcctagattcctaggttcaggcctcaggtggtctggattcctatagtcagcctgttcggaaacttatttgtcgaatctgctagccatttaacagtgtttttc

SEQ ID NO: 4882 - DNA, 5209 bp, Panicum virgatum
accactagcaacttaaggtcaaaagaccaatacaggtttccaagaccttgcctgctccattgaccatatatcgatgtcatgagcatcattggtatttttaaatcctgaactgggcctcgaggaagggcgcggcaaagccgcgcgagtcttcctagttaccttctgatttggactccgcggcctaccgcaacgcccaccgctttcgctggagcgtgggcctccgctcgtctggaccacacgtcagttcccactggctagcacgacagatcacccgattggtttggtgagacatttcttgcgggatcaaacgcttatctgtttccatcctcaaactaatcgcgtacccatccggtaattagcacatatcctctcgtcccggaagctatattaccaggcaggccccgcagatccgtttaccccacgctccgatccggcccgtccagcccgacggcggaggcatcccagccgtccgaacccgagggtggacccgtgaattgcggaaagccgaggtggggttggctaccggttaaaacgcccgtgccagtggctccccgtcctcttctcctacgcggccggggcaggaagggagggagaggtgatccactggtgttgggccctcggatccggaacgcggagctcctgcggcgctcggatcggtcgctcggagggcgcggggcgcgaggtagggaccgggatcggcagtgatggggaaggccgcggcggtgggcacggcggtggtggtgtgcgcggccgtcggggtggcggtcgtggtggcgcacaggcggcgccggcgggaggccgagctgaaggggtccgcggaggcggacaggaagaggcgggcggccgccgtgatcgaggaggtggagcgcagcctctccacgcccaccgcgctgctgcggagcatcgcggacgccatggtgtccgagatggagcgcggcctgcgcggggacatccactcgcagctcaagatgctcatcagctacgtcgacaacctccccaccggggatgaacatgggctgtattatgcactggatctcggaggcacaaacttccgtgtgctgcgagtccaactaggaggaagggagaaacgggttgtcaaacaacagtatgaggaggtttccattccaccacatctgatggtcgggtcttccatggaactatttgattttattgctgctgcattggccaaatttgttgatactgaaggtgaagatttccacctcccagagggtaggcagagagaacttggtttcaccttttccttcccagtgaaccaaacatcaatatcgtcaggaacactcattaaatggacaaagggattttccgtcaacggcacggttggtgcagatgttgtgtctgagttgagcaaggccatggagaggcaggggctagatatgaaagttacggcgttggttaatgatacggttggcacattggccggtgggagatatttggataacgatgttgttgcagctgtaatattgggcactggtacaaatgcagcatatgtggagcacgcaaatgcaattcctaaatggactggtttactgcctaaatctgggaacatggtaattaatacagaatgggggagcttcaaatccgacaagcttcctctttcagaatacgataaagccatggactttgaaagtttgaaccctggagaacagatatacgaaaaaatgatttctggcatgtatcttggagagattgtgcgaagaattttactgaagttggcacacgatgcttctctgtttggggatgttgttccatctaagctggagcagccatttgtactgaggacaccagatatgtcagccatgcatcatgactcctcacatgacctcaaaattctgggagctaagctgaaggatattgttggggttgcggatacttcactagaagtaagatacattactcgacacatctgtgaccttgttgctgagcgtggggcacgcttagctgctgctggtatatatagcatcctgaagaagataggccgggacaaagtaccaagcaatggcagtaaaatgccgaggaccgtcattgctttggatggtgggctctatgaacattacaagaagttcagtagttgtgtagaaacaactcttacagacttgctcggtgaagaggcctcatcctccgtggttgccaagctggccaacgatggctctggcattggagcagctcttcttgcagcctcacactcccagtatgccgatgttgactagtcttgaaatcaagcgtggatcaagctttgggtgtagtttctcttttttttccctccttttcccttcaaacattcctaatattccgggcactccgtcgggaaattttcggcttcctttctctggatgcacccaagttctctgcagcggaatatagctagtattgaaccaatgagtttggaggttctctgatggcataaatgtttggacggcaggagcatagaattggaggttgaacaatgccattcatgttctgcccattctttccccttgcatggtgttgtaaaccaatcgaatttttaacctttttttgtgttagcaataaagaggaggacaagaacgaatttaaccatgtgttctcttcattgcttcttcaaatatgtacgagtgaatttagttgcatggcttcaaaattatatagttacagtacattgctatttgttacacacacctacatgatgccactgttgcattgtcaatcgatgtcgttgcaggaagtggtgcttgttctagtgagctgtgactatcctttgctctgatcacctagcactgcacaaggctggctgctactgtaccgtcctagatcctaacctcagtaggagatcagggttcctacagacattttccgatttccccattctgcttttcttcagacgttgcagtcgaaaccgccatcgtcgctcactttggcatcggagagctgtttccggcggctgcctcctcgcacctcgagtagcggggcggcgtcgtagtcagcgaccttctcgtcggcgaccttccggtgcgcctgctcgcagcgctgcagtatctgcagcacgtccttcatcgtcggccgcgtggacggctggcggccggtgcatataatcccgagcttgaagacggcctcgacgtcgtcgccgtacccggcgtccctgatgctcttctccgtggcggcggcgatgcttttgccggcctgcaggtgccgccacgcccagtcggccagggacccgtgctcgccgccgtcgctggcctccctgccggtggtcagctccaggaggacaaccccgaagctgtacacgtcgaccttctcgttcaccatcctcgtgtacgcgcactctgcacagaggaacgtgacaaaaaaaaaattaagtcaatgtgccgctagaaattggtattcaggatcagcaaggcgatcgcgaggcacgcaccgggagccatgtaaccgaacgatccggcgacggcggtcaccgtgtcagccctgccggcctcgaccagcatccttgcgtggccgaagtcggcgaccttggcgttgagctccgagtcgaccaggatgttgctgcacttgacgtcccggtgcacgatcggcggcgagcactcgtggtgcatgtagtagagcccgcgcgcggcgccgacggccaccttcaccctcgccggccagtccagcggcgcccgccggaccgacggggccctcgccgtcgcgcccccggcctggaaccatttgtgcccgtgcagccacttgtccaggctaccgttgtccatgaactcgtagacgaggagcttggtctccgcgcgggagaggcagcacaggagcttcacgatgttgctgtgccggatgtggccgaggacgtccacctccgacgcgaacgcgcgctccaggctccggtccagcttcccgccggtccagatgcgcttcacggccacggtgccccccgcgccgccgccgctccggctggtgtacgcgacgcggtacacgcgccccgccccgcccttgccgatgaggttctcgtcggcgagcccgcgcaccacggaggcctcgccgaagtccagggggtggaaaggggtgagcttccagggttcctcagcctgcgcgagccgccgcttccgcctcctgatgtcgcggatgataaacacggcgagcgccgcgatgacggcgacgagcgcgacgcccgcggcgaggaggaccgagcggagacgcggcgagacgtggtccgctggctgggccgcgcacgagcgcacgcccttgaggctcccgaccatcgacgcggcggcgcagagccccgggttgcccaagaagctttggtcgttggcggggttggccagcgccgccgggacctcgccggtgagctggttggaggacaagttgagctggctagacctcagcgatcccagcgacggcggaatggaaccggagagctggttcgacgaaaggtccagcaggttgagcaccggtatggagcccaaccctgccggaatatcgccggtgagctggttgtggctgaggttcatctgcgccacgccggtgagcgacgcgatgctctctgggatagccccagagagctggttcgccgacaggtccagctcctgcagccgtggcatcccggcggcaaactccgccggtatgtcgccggagaacgagttgttgctggcgtggaacctctggagacgagtggccgatatcggaatccgtccggtgaaccggttgttgtcgatgtaaatcctcgtcgtgttccagtacagcttctccggaaggcttccgctcagctgcccgttgtcctgcaggcacaaggtcagaagcttcggcaccgtccacagagcggccggcacctcgccggacaactcgttatcttggagctggagccatatgagagcagagcagctggcgagaccggtcgggatcgagccgttcaggcggttaccggaggcggtgagcacccacaactgttggtggctgcagatcccctccggtatcggcccgaaaaagtcgttgccgtcgatctggatgtctcttaacagcggcgtctccttcccgagctccgccgggagctccccgctgaggtggttgtcccacagccacaggaataccaaggacggcagccaggcaatgctcggcggtatcccgccggtgagattattctgttgcaagttcaagaaccgtagttgcagcaagctccctaaacttctggatggttccgatcagctggttcatcgacaggtcaacctccacc

SEQ ID NO: 4883 - DNA, 2977 bp, Panicum virgatum
cggtggagatataaaattcaccgaatatgtcgggcatagaggctgcacagcgtggtgtcggtggtgcgtggtcctgcttcccgtttcccatgagccgtcgttctagcggtgagaggagctccgcggacagttgctggcggttgaccctgcaaccgccgctcggacggctccgtcctgcacgaatctctgagaggcccgcgggacatcccgtcaggtcaggaatctcccgctgggcccggcagtccacgtgggatgagccccccgctttcaatgcccgtatccctatctaattaccttctgatttgggctccgcggcctaacgcaacctccaccgctctcgctggagcgtgggcccctgctcgtcgggaccacacgtcagtacccactggctagcgcgacagatcacccgattggtttggtgagacatttcttgcgggaacaaacgcttatctgtttccatcctcaaacaaatcgcgtacccatccggtaattagcacatatcctctcgtcccggaagctatattaccagccaggtcccccagatccatttaccccacgctccgatccggcccgtccagcccgaccacggaggcatcccagccgtgcgaacccgagggtggacccgtgaattgcggaaagccgaggggtggttggctaccggttaaaacgcccgtgccagtggctccccgtcctcctcttctcctacgcggccggggcaggaagggaggggtgatccactggtgttcggccttcggatccggaacgcggagctcctgcggcgctcggatcggtcgctcggagggcgcgggcgcgcggtagggaccgggatcggcagtgatggggaaagccgcggcggtgggcacggcggtggtggtgtgcgcggccgtcggggtggcggtcggggtggcgcgcaggcggcgccggcgggaggccgagctgcaggggtccgcggaggcggataggaagaggcgggcggccgccgtgatcgaggaggtggagcgcagcctctccacgcccaccgcgctgctgcggagcatcgcggacgccatggtgtccgagatggagcgcggcctgcgcggggacatccactcgcagctcaagatgctcatcagctacgtcgacaacctccccaccggggatgaacatgggctgtattatgcattggatcttggaggcacaaacttccgtgtgctgcgtgtccaactaggaggaagggagaaacgggttgtcaaacaacagtacgaggaggtttccattccaccacacctgatggtcgggtcttccatggaactattcgattttattgctgccgcattggccaaatttgttgatactgaaggtgaagatttccacctcccagagggtaggcagagagaacttggtttcaccttttccttcccagtgaaccaaacatcaatatcatcaggaacactcatcaaatggacaaagggattttccgtcaacggcacggttggtgcagatgttgtgtctgagttgagcaaggccatggagaggcaggggctagatatgaaagttacggcgttggttaatgatacggttggcacattggctggtgggagatatatggataacgatgttgttgcagctgtaatattgggcactggtacaaatgcagcatatgtggagcacgcaaatgcaattcctaaatggactggtttactgcctaaatctgggaacatggtaattaatacagaatgggggagcttcaaatccgacaagcttcctctttcagaatatgataaagccatggactttgaaagtttgaatcctggagaacagatatacgaaaaaatgatttctggcatgtatctaggagagattgtgcgaagaattttactgaagttggcacatgatgcttctctgtttggggatgttgttccatctaagttggagcagccatttgtactgaggacaccagatatgtcagccatgcatcatgactcctcacatgacctcaaaattctgggagctaagctgaaggatattgttggggttgcggatacttccctggaagtaagatacattactcgacacatctgcgaccttgttgctgagcgtggggcacgcttagccgctgctggcatatatagcatcctgaagaagataggccgggacaaagtaccaagcaatggcagtaaaatgccgaggaccgtcattgctttggatggtgggctctatgaacattacaagaagttcagcagttgtgtagaaacaactcttacagacttgctcggtgaagaggcctcatcctccgtggttgccaagctggccaacgatggctctggcattggtgcagctcttcttgcagcctcacactcccagtatgctgatgttgactagtcttgaaatcaagcgtggatcaaactttgagtgtagtttctctttcttttcccccctttttcccgtcaaacattcctaatattctgggctctcctcggggaaattttcagcttcctttcttggctattctggatgcagccaagttctctgcagcgggatatagctagtatagaaccaatgagtttggaggttctctgatggcataaatgtttggacggcaggagcatagaattggaggttgaacaatgccattcatgttctgcccattctttccccttgtatggtgttgtaaaccaatcaaaatttttaaccttttctgtgttggcaataaagaggacacggacgaatttaaccatgtgttctattcattgcttcctcaaatatgtatggctgaatttagtttcatggcttcaaaaccatatggttgctgttacagtacattgttacacaaacccggacgagcctcctctgcagtactgcagggggactcgtcccacacacctatatggcactgccactgttgcattgtccatcagtgttttgcaggaagtggtactgtggtgagcaaccaaatgaagtgttgtagtcagctgtgactgaccatcctctcctcttg

SEQ ID NO: 4884 - DNA, 2245 bp, Secale cereale
gactggttaaaacgcccggccagtggctcccccctctctcccttctttctcccctccgcccgcgcccggggaaccagcgatcgatccctcctcctcctcctccattcaccggatccagagcggagctcgcgctcggacgcccgatccagtccagcccaggcgccaggatgggcaaggcggcggcggtggggacggcggtggtggtgtgcgcggcggtcggcacggccgtcgtgctcggccggcgccggcgccggagggacgcggagctgctcagcgccgccgaggcggagcggaagcgcaaggtggcggccgtcatcgaggacgtcgagcgcacgctctccacgcccacggccctgctgcggggcatctccgacgcgctcgtcctcgagatggagcgcggcctgcgcggggacatccactcccagctcaagatgctcatcagctacgtcgacaacctccccaccggagacgaacatggcttgttttatgcattggatcttggaggtaccaacttccgtgttctgcgagtccaacttggaggaagggagaaacgtgttgtcaagcagcagtatcaggaagtctctattccaccacacctgatggtcggaacttccttggaactatttgatttcattgctgctgtattggccaaatttgttgaaactgaaggtgacgagttccacctcccagtggggaggcagagagagctgggtttcaccttttcctttccggtaaaccaattatcaatatcatcaggaacactcatcaagtggacaaagggcttttcaatcaatggcacggttggtgaggatgttgtggctgagttgagcaaggccatggagaggcaggggctggatatgaaagtttcagcactggttaatgacacagtcggcacattggctggtgggagatatatggataatgatgtggttgctgctgtaatattgggcactggtacaaacgcagcatatgttgagcatgctaatgcaattcctaagtggaatggactactgccaaaatccggaaatatggtaatcaacacggaatggggaagctttaaatcggacaagcttccactttcagaatacgacaaagcattggacttcgaaagtttgaaccctggagaacagatatatgaaaagttgatttccggcatgtatcttggagagattgtgcgaagaatcttactgaaactggctcatgatgctgcattgtttggggatgttgttccacctaagctggaactgccattcgtacttaggaccccagatatgtccgccatgcaccacgatgcatcacacgaccttaaaattctgggaagtaagctaaaggatatcgttggggttgcggatacttccctggaagtaagatacattactcgtcacatatgtgacatcgttgcagagcgcggcgcacgcttggccgcagctggcatatatggcatcctgaagaagctaggccgggacaaggtgccaaccgacggcagcccgatgccaaggaccgtggttgccttggacggtgggctctatgaacactacaagaagttcagcagctgcttagaggcgactctttcagatctcctcggggaggaagcctcttcttcgctggttgccaagctggccaatgacggctccggcattggagctgctctcctcgccgcttcgcactcccagtacgccgaggtctactagtcttcttggtaacgagcccgatggatggattgaaccctgagtgtagcagcctcttctcttccttttttttcttttcttttcccttcgaaccttcctaatcgcctggtggtggaattttagcttcttcggctattctgcggacactctccggtgcctctgcagcgggatgtagctagcatagcgccaaagagcttggaggtttatataatggcataaaagtttgagtggcaggaacatatggaaatggaggtttggacaatgccattcctgtcctgccgattctttttccccttgtctggtggtgttttgtaatccataacattttgttaatcccttttttttgtattttctcctcccaataaagatggggatcgacatcatccagtttaaccatctttttatgttgcctggtttctccactatatacatatatgtatgtctgaatgctcatctctgtcttcagaataatactagtattgtctgaatttgatagaaaacaaaaaaaaaaaaaaaaaaacaagtactctgtcgtagactacacgtgtacttctaga

SEQ ID NO: 4885 - DNA, 2043 bp, Hordeum vulgare
gcgagcgatccctcctccctccctcctactcctccacccggcctccggatccagagcggggacgaggacgaccgatctaggcgcgaagatggggaaggcggcggcggtggggacggcggtggtggtgtgcgccgcggtgggcacggccgtggtgctcggccggcgccggcgccggagggacgcggagctgctcggcgcggccgaggccgagaggaagaagaaggtggcggccgtcatcgaggaggtcgagcgcacgctcgccacgcccaccgccctgctgcggggcatctccgacgcgctcgtcctcgagatggagcgcgggctgcgcggggacatccactcccagctcaagatgctcatcagctacgtcgacaacctccccaccggagacgaacatgggttgttttatgcactggatcttggaggtaccaacttccgtgttctgcgagtccaacttggaggaagggagaaacgtgttgtcaagcaacagtatgaggaagtctctattccaccacacctgatgatcggaacttccttggaactatttgatttcattgctgctgtattggccaaatttgttgatactgaaggtgacgagtaccacctcccagtggggaggcagagagagctgggtttcaccttttcctttcctgtaaaccaactatcaatatcatcaggaacactcatcaagtggacaaagggcttttcaatcaacggcacggttggcgaggatgttgtggctgagttgagcaaggccatggagaggcaggggttggatatgaaagttacagcactggttaatgacacagtcggcacattggctggtgggagatatatggataatgatgtggttgctgctgtaatattgggcactggtacaaacgcagcatatgttgagcatgctaatgcaattcctaaatggactggactgctgcctaaatctggaaatatggttatcaacacggaatggggaagctttaaatcggacaagcttccactttcagaatacgacaaagcattggacttcgaaagtttgaaccctggagaacagatatatgaaaagttgatttccggcatgtatcttggagagattgtgcgaagaatcttactgaaactggcacatgatgctgcattgtttggggatgttgttccagctaagctggaactgccatttgtacttaggaccccagatatgtccgccatgcaccatgatgcatcacatgaccttaaaattctgggaagtaagctaaaggatatcgttggggttgcggatacttccctggaagtaagatacattactcgtcacatatgtgacatcgttgcagagcgcggcgcacgcttggccgctgctggcatatatggcatcctgaagaagctaggccgggacaaggtgccagccgacggcagcccgatgccaaggaccgtggttgccttggacggcgggctctatgaacactacaagaagttcagcagctgcttagaggcaactctttcagatctcctcggggaggaagcctcttcgtcgctggttgctaagctggccaacgacggctctggcattggagccgctctcctcgcggcctcgcactcccagtacgccgaggttgactagtcctcttgataacgacgagccctatggattggaccctgagtgtagccgcctcttctgttcttctttttttccctttgaaccttcctaatcgtctggtggtggaattttaccttcttcggctattctgcggacactctcctgtggctctgcagcgggatgtagctagtatagcgccagagagtctggaggtttatctaatggcataaacgtttcagtggcaggaacatatggaaatggaggtttgaacaatgccattcctgttctgccgattctttttcaccttgttgtctggtgttgtaatccataacattttgttaatccttttttgtatcttctcttcccaataaagatggggatccacatcatccaatttaaccatctttttatgttgcctggtttctccagtatatacatatatgtatgtctgaatg

SEQ ID NO: 4886 - DNA, 2174 bp, Hordeum vulgare
aaaaaagctgtaccggttaaaacgtccggccagtggctcccccctccccctcccttctttctcccccggggaagcagcagcagccagcgagcgatccctcctccctccctcctactcctccacccggcctccggatccagagcggggacgaggacgaccgatctaggcgcgaagatggggaaggcggcggcggtggggacggcggtggtggtgtgcgccgcggtgggcacggccgtggtgctcggccggcgccggcgccggagggacgcggagctgctcggcgcggccgaggccgagaggaagaagaaggtggcggccgtcatcgaggaggtcgagcgcacgctcgccacgcccaccgccctgctgcggggcatctccgacgcgctcgtcctcgagatggagcgcgggctgcgcggggacatccactcccagctcaagatgctcatcagctacgtcgacaacctccccaccggagacgaacatgggttgttttatgcactggatcttggaggtaccaacttccgtgttctgcgagtccaacttggaggaagggagaaacgtgttgtcaagcaacagtatgaggaagtctctattccaccacacctgatgatcggaacttccttggaactatttgatttcattgctgctgtattggccaaatttgttgatactgaaggtgacgagtaccacctcccagtggggaggcagagagagctgggtttcaccttttcctttcctgtaaaccaactatcaatatcatcaggaacactcatcaagtggacaaagggcttttcaatcaacggcacggttggcgaggatgttgtggctgagttgagcaaggccatggagaggcaggggttggatatgaaagttacagcactggttaatgacacagtcggcacattggctggtgggagatatatggataatgatgtggttgctgctgtaatattgggcactggtacaaacgcagcatatgttgagcatgctaatgcaattcctaaatggactggactgctgcctaaatctggaaatatggttatcaacacggaatggggaagctttaaatcggacaagcttccactttcagaatacgacaaagcattggacttcgaaagtttgaaccctggagaacagatatatgaaaagttgatttccggcatgtatcttggagagattgtgcgaagaatcttactgaaactggcacatgatgctgcattgtttggggatgttgttccagctaagctggaactgccatttgtacttaggaccccagatatgtccgccatgcaccatgatgcatcacatgaccttaaaattctgggaagtaagctaaaggatatcgttggggttgcggatacttccctggaagtaagatacattactcgtcacatatgtgacatcgttgcagagcgcggcgcacgcttggccgctgctggcatatatggcatcctgaagaagctaggccgggacaaggtgccagccgacggcagcccgatgccaaggaccgtggttgccttggacggcgggctctatgaacactacaagaagttcagcagctgcttagaggcaactctttcagatctcctcggggaggaagcctcttcgtcgctggttgctaagctggccaacgacggctctggcattggagccgctctcctcgcggcctcgcactcccagtacgccgaggttgactagtcctcttgataacgaggagccctatggattggaccctgagtgtagccgcctcttctgttcttctttttttccctttgaaccttcctaatcgtctggtggtggaattttaccttcttcggctattctgcggacactctcctgtggctctgcagcgggatgtagctagtatagcgccagagagtctggaggtttatctaatggcataaacgtttcagtggcaggaacatatggaaatggaggtttgaacaatgccattcctgttctgccgattctttttcaccttgttgtctggtgttgtaatccataacattttgttaatccttttttgtatcttctcttcccaataaagatggggatccacatcatccaatttaaccatctttttatgttgcctggtttctccagtatatacatatatgtatgtctgaatgcacatctctgtcttcagaatggtggtattgtctgaattcgatcca

SEQ ID NO: 4887 - DNA, 1987 bp, Leymus cinereus x Leymus triticoides
  misc_feature (394)..(394): n is a, c, g, or t
  misc_feature (527)..(527): n is a, c, g, or t
  misc_feature (581)..(581): n is a, c, g, or t
  misc_feature (610)..(610): n is a, c, g, or t
  misc_feature (644)..(644): n is a, c, g, or t
  misc_feature (650)..(650): n is a, c, g, or t
  misc_feature (786)..(786): n is a, c, g, or t
cagcgatccctcctccttcactagcctctggatccagagcggaattcgtgttcgggcgctcggggacgaccgatctaggcgcgaagatggggaaggcggcggcggtggggacggcggtggtggtgtgcgcggcggtggggacggccgtggtgcttggccggcgccggcgcaggagggacgcggagctgctcggtgcggccgaggcggagaggaagcagaaggtggcggacgtcatcgaggaggtcgagcgcacgctcgccacgcccacggccctgctgcggagcatctccgacgcgctcgtcgccgagatggagcgcggactgcgcggggacatccactcccagctcaagatgctcatcagctacgtcgacaacctccccaccggagacgaacntgggttgttttatgcactggatcttggaggtaccaacttccgtgttctgcgagtccaacttggaggaaaggagaaacgtgttgtcaagcaacagtatgaggaagtctctattccaccacacctgatggtcggnacttccttggaactatttgatttcattgctgctgtattggccaaatttgttganactgaaggtgacgagttccacctcccagnggggaggcagagagagctgggtttcaccttttcntttccngtaaaccaaatatcaatatcatcaggaacgctcatcaagtggacaaagggcttttcaatcaacggcacggttggtgaggatgttgtggctgagttgagcaaggccatggagaggcaggggttggatatgaaagttncagcactggttaatgacacagtcggcacattggctggtgggagatatatggataatgatgtagttgctgctgtaatattgggcactggtacaaacgcagcatatgttgagcatgctaatgcaattcctaaatggactggactactgcctaaatccggaaatatggtaatcaacacggaatggggaagctttaaatcagacaagcttccgctttcagaatacgacaaagcgttggatttcgaaagtttgaatcctggagaacagatatatgaaaagttgatttctggcatgtatcttggtgagattgtgcgaagaatcttactgaaactggctcatgatgctgcattgtttggggatgttgttccagctaagctggaacagccatttgtactgaggaccccagatatgtcagccatgcaccatgatgcatcccatgaccttaaaattctgggaagcaagctaaaggatatcgttggggttgcagatacttccctggaagtaagatacatcacccgtcacatatgtgacattgttgcggagcgtggtgcacgcttggctgctgctggcatatatggcatcctgaagaagctaggccgggacaaggtgccaaccgacggcagccggatgccaaggaccgtcgttgccttggacggtgggctctatgaacactacaagaagttcagcagctgcttagaggcaactctttcagatctcctcggggaggaagcctcttcttcgctggttgccaagctggccaatgacggctctggcattggagccgctctcctcgcggcttcgcactctcagtacgctgaggtcgactagtcttctttgtaatgagcccgatggatggattgaaccctgagtgtagcagcctcttctcttttttttttcccttcgaaccttcctaatcgcctggtggtggaattttaccttcttcggctattctgcggacactctccggtgcctctgcagcgggatgtagttagtatagcgccaaagagcttggaggtttatctaatggcataaacgtttgagtggcaggaacatatggtaatggaggtttgaacaatgccattcctgttctgccgattctttttccccttgtctggtggtgtttgtaatccaaaacattttgttaatccttttttgtattttctcttcccaataaagatggggatcgacatcatccaatttaacca

SEQ ID NO: 4888 - DNA, 2817 bp, Brachypodium distachyon
aagaggggaacccgaagttaccggttaaaacgccctcccgaaagccagtggctcccgtcttccttctcccctacgcggccggggaacgattcccttctctcactgggtggtatagcctcggatccagagcggaattcgtgtggggttcgggagatcgtcgctgttgggggtgtcaggggcgagagggatctagcgagaggcggcgatcatggggaaggcggcggcggtgggtacggcggttgtggtgtgcgccgcggtgggcacggccgttgtgctggcgcggcgccggcggcggaaggatgcggagctggtgggggcggaggtggacaggaagaggaaggtggcggcggtgatcgaggaggtggagcgcacgctggccacgcccacggcgctgctgcggggcatctcggacgccctggtgtcggagatggagcgcggcctgcgcggggacatccactcccagctcaagatgctcatcacctacgtcgacaacctcccaaccggagatgaacatgggttgttttatgcactggatcttggaggaaccaatttccgtgttctgcgagtccaacttggaggaagggagaagcgtgttgtcaagcaacagtatgaggaagtctctattccgccacacctaatggtgggaacttccatggaactatttgatttcattgctgctgcattgtcctcttttgtggatactgaaggtgccgatttccacctcccagaggggaggcagagggagctgggtttcactttttccttcccggtgaaccaaacatcaatatcatcagggacactcatcaagtggacaaagggcttttccatcagtggcacggttggtgcggatgttgtctctgagttgagcaaggccatggagaggcaggggctggatatgaaagtttcagcattggttaatgacactgtcggcacattggctggtgggagatatatggatagtgacgtagttgctgccataatattgggcactggaacaaatgcagcatatgttgagcatgctaatgcaattcctaaatggactggattactccctagatctggaaatatggtaatcaacacggaatggggaagctttaaatcggacaaacttccactttcagaatacgataaagccatggattttgaaagtttgaatcctggagagcagatatatgaaaagatgatttctggcatgtatcttggagagattgtgcgaagaatcttactgaaactggctcatgatgcttcgttgtttggggatgttgttccacctaagctggaacagccgtttgttctgaggaccccagacatgtctgccatgcaccatgatgcgtcacatgaccttaaagttctgggaactaagctaaaagatatcgtgggggttgcagatacttccctggaagtaagatacatcacccgtcacatctgtgacatcgttgcagagcgtggtgcacgcttggctgctgctggtatatatggcatcctgaagaagctaggccgagacaaagtgccaagtgatggaagcccaatgccaaggacagtcattgccttggatggtgggctctatgaacactacaaaaagttcagcagttgcttagaagcaactctcgccgacctccttggggaggaagcttcttcatcgatggttgctaagctggccaacgatggttctggcattggagccgctctccttgctgcctcgcactctcagtatgcagaggtcgactagtcttgacaacgagccctttggattgaactctgagtgtagcctctctctcttttttttcccttccagtcttcctaatattctgggctcccatggtggaattttaccttctccggctattctgcagacacactactccggtgcctctgcagcaggaaaatagctagtatagcgccaatgagtttggaggttatctaatggcataaacgtctcagtggcaggaacatggaaatggaggtttgaacaatgccattcctgatctgccaattctttttccccttgtatggtgttggaaaccaaacattttttctacccttctgtattttctcttcccaataaagatggggacatcatccaatttaactatctgttgtctttcttgatttctccagtgtatctgtatatgactctgtgcacatctttgtcttcaaaatgatgttaaactcaacacacataaaggatggcacacagtgcccaatccgccattgttatctgctctgctttcctaagaaaccgggaaactgcgcaagtcatacatctgcacggtactactgtagtctatctgcttattgtcgctgcacatttcggcacatcgtcagacgttgcagtcaaaaccatcgtcggggaccttttttcggcggctgccaccccgcgccggaagcagcggcgcagcgtcgtactcggagaccttcccgtcggtcgccgtcttctggttcgccgcctgctcgcagcgcagcagtatctgcagcacgtccttcatggtaggccttgtcgacggctgcgcgcccgtgcatataatgccgagcttgaacatgacctcgacgtcgtcgccgtgcgccgcatcgccgaggcgcttgtccgccgcgtcggcgacgggtctcccggactgcaagtgccgccacgcccactcggcgagggacccgtgctcgccgccgtctctggcttccctccccgtggccagctccagcagcaccaccccgaagctgtacacgtccaccttctcgttcgccttcctcgtgtacgcgcactctgcatcaaacacaaagattagttaactggcgttcgatcaggattcaggaggaggattgatc

SEQ ID NO: 4889 - DNA, 2065 bp, Zea mays
taaaacgccggtgccagtggctgcctcccgtctccctcttctcctacgcgcacggggagggaagaattggttcgttggcgttggccttggcctcggatccagagcgcggaacgcgtgcggcgttcggatcgacccgctcgaaggccggggggcgcgaggtaggggccaggatcggcggcgatggtgaaggccgtggtggtgggcgcggcggtcgtggcgtgtgcggcggtcggggtggcggtggtgctggagcgccgccggcgtaagcgagacgccgacctcctggggtccgcggaggcggagaggaggaggcgcgcggccgccgtgatcgaggaggtcgagagcagcctcgccacgcccacggcgctgctgcggagcatcgcggacgccatggtcgccgagatggagcgcggcctgcgcggggacatccacgcgcagctcaagatgctcattagctacgtcgacagcctccccaccggagatgaacatgggctgttttatgcactggatcttggagggaccaacttccgtgtgctgcgagtccagctaggaggaaaggagaaacgtgttgtcaaacaacagtatgaggaggtttccattccaccacatttgatggtcgggacttccatggaactatttgatttcattgctgctgcattggctaaatttgtcggtactgaaggtgaagatttccaactcccagagggtaggcagagagaacttggtttcactttttccttcccggtgaaccaaacatcaatatcatcaggaacactcatcaagtggacaaagggcttttccatcaatggcacggttggtgaagatgttgtttctgagttgagcagggccatggagaggcagggactagatatgaaagctacggcattagtcaatgatacagtgggcacattggctggtgggagatatatggataccgatgtagttgcagctgtaatattgggcactggtacaaatgcagcatatgtggagcatgcaaatgcaattcctaaatggactgggttactgcctaaatctggaaagatggtaattaatacagagtgggggagcttcaaatccaacaaacttcctctttcagaatatgacaaagccatggactttgaaagtttgaaccctggagagcagatatacgagaaaatgatttctggtatgtatctcggagagattgttcgaagaattttactgaagttggcacatgaagcttctctatttggggatgttgttccacctaagctggagctgccatttatattgaggacgccagatatgtcagccatgcatcatgactcctcacatgacctcaaaactcttggagctaaactgaaggacatagtcggggtcgcggacacttccctggaagtaaggtacatcactcgtcacatctgtgaccttgtcgcagagcgtgcagcacgcctggccgccgcaggcgtgtacagcatcctgaagaagataggccgggacaaagtaccaagcggtggcggtaaaatgccgaggaccgtagttgccttggacggtgggctctacgaacactacaagaagttcagcagttgcgtagaagcgactctcacagacttgctcggcgaggaggcttcttcctccgtggtcgccaagctggccaacgacggctctggcattggagctgcgcttctcgcagcctcacactcccagtatcagtatggcgcgagtgactagtagtcctgaaatgggcgcggatcgagattttgagtgtagctctcatttatcttttcttttttcccttttcaaaacatctttttggggatttttttcggcttccttttgttggctattccgtggatgcacttacggctctgcattgggatgtagctagtatagagccaatgagtttggaggttatctaatggcacaaggcaggagcatggaaatggaagcagagcaatgacattcatgctctgcccattcttttttccccttgtatggtgttgtaaaccaataaaaaaatgttaacccttttttttgtgtgtgttggcaataaagagaatacgataatttgaccatgtgtcaagta

SEQ ID NO: 4890 - DNA, 5784 bp, Oryza sativa
ttacgacaaacacccaatccaggccgtccattcccaaacaagagcggatctgagccgtacaaatcctgagtgcggatccgcttatggcgcaaaggcgaagggtactcgaggctaccggttaaaacgcccaagtcagtggctctcgtcctcctttctcctacgcggccggagagaggaggggggaagagaggatctcgcagagcgccatagcctcggatccagaagcggaattcggtggaggtctcgggcacctggatcgatcggaggaagggaaggcggagcagcggtgatggggaaggcggcggcggtggggacggcggtggtggtggccgcggcggtcggggtggcggtggtgctggcgcggaggcggaggaggagggacctggagctggtggagggagccgcggcggagaggaagaggaaggtggcggcggtgatcgaggacgtggagcacgcgctgtcgaccccgacggcgctgctgcggggcatctcggacgccatggtcaccgagatggagcgaggcctgcgcggggacagccacgccatggttaagatgctcatcacctacgtcgacaacctccccaccggaaatgaacaggggttgttttatgcattggatcttggaggaaccaacttccgcgtcctgcgagtccaactcggtggcaaggagaaacgtgtcgtccaacaacagtacgaggaagtctcaattccaccacatctgatggttggaacttccatggaactgtttgattttattgcttctgcattgtcaaaatttgttgatactgaaggtgatgatttccacctcccagaagggagacagagagagctgggcttcaccttttccttcccagtgagccagacatcaatatcgtcaggaacgctcatcaagtggacaaagggtttctccatcaatgacgcggttggcgaagatgttgtatctgagttgggcaaggccatggagaggcagggattagatatgaaaattgcagcattggttaatgacactgtcggcacattggctggtgggaggtatgcggataacagtgttgttgctgctataatattgggcactggtacaaatgcagcatatgttgagaatgctaatgcaattcctaaatggaccggtttactgcctaggtccggaaatatggtaatcaacacagaatgggggagctttaaatcagataagcttcctctttcagaattcgataaagcaatggattttgaaagcttgaatcctggagagcagatatatgaaaagttgatttctggcatgtatcttggagagatagtgcgaagaatcttgctgaagcttgctcatgatgcagctttgtttggggatgttgttccatctaagctagagcaaccgtttgtactaaggacaccggatatgtcagccatgcatcatgactcgtcacatgaccttaaaactgttggagctaagctaaaggatatcgtcggggtcccagatacttccctggaagtaagatacattaccagtcacatttgtgacatagttgcagagcgtgctgcacgcttggctgctgctggcatatatggggtcctaaagaagctaggtcgggacaagatgccaaaagacggcagtaagatgcctaggactgtcattgccttggatggtgggctctatgaacattacaagaagttcagcagttgcttagaatcaactctaacagaccttcttggggatgatgtctcgtcttcggtggttaccaagctggccaacgatggttctggcattggagctgctcttctcgcagcctcgcactcccagtatgccgagatcgactagctttaaggatgatcttgatgaatgatgaatcaaactccgtttgtaggttctcatttcccccttcaaaatccacataatactcctggctccccccttgaaatcttaccatctttttttggctattctgagggcaaacataagtgcctctgcagcgggatatagctagtatagcgccaatgagtttggaggttttctaatggcataaaacgttggatggcagtagcagactaacagggaaatggaggcacaggcaatttccattcctgttctgtcagattcttttcccccttaattgatgttgagaaccaagatttttttgctctgtattttctcttcgtaataaagaaggggacataatctaattgctcttgtttgatctcatatatgtatgtgactgcactctcactgtcccaaaattttatagatgcatttacaaagttacaatactcattacatgcaaataactgaaggatggcgaatgtatttgtctggtatctacctgctctcctaactagcgtgccatctctcctagatggtaaccattggatcaggttatacttcttattgaccattgttctcatactatgctgtccaagctgccgttgccgtcgtcgatgcctttggtgtccgaaagctgcttccggcggctgccacccctgatcggcagaaacggcgcgccgtcgccgtcgtactccgccaccttcccgtccacggtgttctggagcgcctgctcgcacctcaccagaatctgcagaacgtccctcattgtcggcctcgtcgccggctgcgcgccggtgcagatgatgccgagcttgaacacgacctcggcgtcgtcgccgtacccggagtcggtgatgcacctgtccaccgcgtcggcgatgctcctgcccgattgcaggtgccgccacgcccactccgccagcgagccgtgctcgccgccgtcgtgggcttccctgccggtgatcagctcgaggagcaccaccccgaagctgtacacgtcgaccttctcgttcaccttcctcgtgtacgcgcactctgcacgagacgatcgtggtcagcacaaggtaagtcgctgtgctaagagaagaaatcaagggagaatcgtgagacgagcagcgaggttggttgaggtgaattaccgggagccatgtagccgaacgatccggcgacggcggtcatggtgtccggcgtcccggcctggaccagcatccgggcgagcccgaagtcggcgaccttggccatgagctcagcgtcgagcaggatgttgctggacttgatgtcccggtgcacgatcggcggcgagcactcgtggtgcatgtagcagaggcccctcgccgcgccgacggccaccctgaccctcgccagccagtccagcggcgctcgccggaccgacggcgccctcgccgtcgcgccaccggccagcaatttgttcccgtggagccacttgtcgaggctgccgttctccatgtactcgtacacgaggagcttcgtctccgcgcgggagaggcagcagaggagcttcacgatgttggtgtggcggacatggccgaggatgtccacctccgaatcgaactcgcgctccaggttcttgtccagcttgccgccggtccatatgcgcttcacggcgacggtgccgccggcgccgccgctgctccggctggcgtacgcgacgcggtacacgcgccccgcgccgcccttgccgatgaggttctcgtcggcgagcccgcgcacaagggaggcctcgctgaagtcgaggggctggaatggggtcatcttccatgccggctctgtccgcgcgagccgcttccgcctcttgatgtcgcggacgacgaagaaggcgagcgccccgatcaagacgacgagggccgcgccggcggcgaggagacccgaccggagacccggcgatacgccgtcggatgccttcgcggcgcacgagcgcaggcccgcgaagttacccgccggcgccgccgatacgcagagaccggggttgccgaggaagctctggtcgtaggcggagatggcgagcgcggccgggatctcgccggtgagctgatttgacgacaggttaagctggttaatcttcagcgatcccagcgacgtcggaataccgccggagagcttgttcgacgaaaggtcgagcagggtgagcaccggcatggagcccaatcccgccggaatatcgccggtgaactggttcctgctgaagttcatctgcgacaagccactgagcgacgcgatgctcaccgggatggccccggagagctgattccttgacaggtccagctcctgcagcaatggcatcccggcggcgaacccgtcaggtatctcgccggagaacaagttgttctcggcgttgaacttctggagcttggtggccgtcgccggaagccggccactgaaacggttgttgtggatgtaaagcctcgtcagattccaatacagcttctccggcaggcttccggtgaggtgtccattgttctgcaggagcacggtgatcagcctcgtctccgtccacagcgccgccggcacctcgccggaaagctcgttgtcctggagctggagactcagcagcgccgggcaagtggcaagactcgccggaattgagccgttcaaccggttgccggcggcggagatgatccacaaccggcggttgtcgcagaccccctccggtattggcccggtgaggtcgttgttgtcgacctcgatgtctctcagaaatggcgagtgcttcccgagctccgccggaatctgaccggtgagattgttctcgaacagcttcattatcaccagcgatggaagctgagcaaggctcgccggtatctcgccggagaagttgttcgtcatcaaggctaagttagttaggttcatcaaacttccaaagctctctgggatcgttccagtcagctggttctcagatatgtcgagataaattaagctcgctgctccaatcttgccattgacgacgacgtcgccggtgagctggttggtgtacaggaacaagtactgcagctttggaatgttccaaatcccaggaggtatgcttccggtgaatgaattctgggacaggtcgagatactccatctccatcatctctgtgacgtagctggggaaatcgccggtgaggttgcactgcgccagccagaccgtcttcaggctcgtcaagttcttgaacgatcccggcagctcgccgggggtgaactgattcacctcgagcttgagcgtctcgaggctagtgagctcgccgagcgccgccgggatcgtgccggtgagctggttgcagttgagggtaaacaccttcaggttcttgagcttcgacaccgccgccggtatcacgccggtgaagttgttgttgttcaaggcgaggtaggtcaggttcttgccgagccggtcaatgtcggcggggagctcgccgccgatactgttcatcgagaggtcgatggaggtgatcgcggtgaggttgtagaggaacgccgggaacacgccgccgacgctggtgttctggaggttgagcaccgtgagcgccgtcagcccgccgatggcgtcggggacggcgccggcgaccgcgacgttggggagggacagcgacgtgacgcggccggtgccgccgccgtcgcaggacacgtacacccagcggcagtgcggcgccgcgtccgtccacgacgcgagcgccgcggggtccccccacgcgcgcttgacctggagcaggagctgcttctcgtcgacgccgccctgctgcgccgcgccgcgccgcgcgacgaggcttggcaggatcgcgagcaggaggaggtggaggtagtaggctttgccgctcgggaatgccatgtcttcgcgtggtttcttggtcgccgccggcgagcgcgtgcgttcactcggtgaggcaagcagccatcgcggactccaccgtgagaaacatgggtgggccatttatatgcagtgtgaacggcacgtgcagacttttcttcctccattat

SEQ ID NO: 4891 - DNA, 2048 bp, Triticum aestivum
tccaggcgcgaagatggggaaggcggcggcggtggggacggcggtggtggtgtgcgcggcggtgggcacggcggtcgtgctcggccggcgccggcgccgcagggacgcggagctgctcggcgcggccgaggccgagcgcaagaagaaggtggcggccgtcatcgaggacgtcgagcgcacgctcgccacgcccacggccctgctgcggggcatctccgacgcgctcgtcgtcgagatggagcgcggcctgcgcggggacatccactcccagctcaagatgctcatcagctacgtcgacaacctccccaccggagacgaacatggcttgttttatgcattggatcttggaggtaccaacttccgtgttctgcgagtccaacttggaggaagggagaaacgtgttgccaagcaacagtatcaggaagtctctattccaccacacctgatggtcggaacttccttggaactatttgatttcattgcttctgtattggccaaatttgttgaaactgaaggtgacgagttccacctcccagtggggaggcagagagagctgggtttcaccttttcctttccggtaaaccaattatcaatatcatcaggaacactcatcaagtggacaaagggcttttcaatcaacggcgcggttggtgaggatgttgtggctgagttgagcaaggccatggagaggcaggggctggatatgaaagtttcagcactggttaatgacacagtcggcacattggctggtgggagatatatggataatgatgtggttgctgccataatattgggcactggtacaaacgcagcatatgttgagcatgctaatgcaattcctaagtggactggactactgccgaaatccggaaatatggtaatcaacacggaatggggaagctttaaatcggacaagcttccactttcagaatacgacaaagcattggacttcgaaagtttgaaccctggagaacagatatatgaaaagttgatttccggcatgtatcttggagagattgtgcgaagaatcttactgaaactggctcatgatgctgcattgtttggggatgttgttccagctaagctggaactgccattcgtacttaggaccccagatatgtctgccatgcaccacgatgcatcacatgaccttaaaattctgggaagtaagctaaaggatatcgttggggttgcggatacttccctggaagtaagatacattactcgtcacatatgtgacatcgttgcagagcgcggcgcacgcttggccgctgctggcatatatggcatcctgaagaagctaggccgggacaaggtgccaaccgacggcagcccgatgccaaggaccgtggttgccttggacggtgggctctatgagcactacaagaagttcagcagctgcttagaggcaactctttcagatctcctcggggacgaggcctcttcttcgctggttgccaagctggccaatgacggctctggcattggagctgctctcctcgccgcttcgcactcccagtacgctgatatctactagtcttcttggtaacgagcccgatggatggattgaacccagagtgtagcagcctcttctcttcctttttttttttttcttttcccttcgaaccttcctaatcgcctggtggtggaattttaccttcttcggctattctgcggacactctccggtgcgtctgcagcgggatgtagctagcatagcgccaaagagcttggaggtttatctaatggcataaaagtttcagtggcagcaacatatggagatggaggtttggacaatgccattcctgttctgccgattctttttccccttgtctggtggtgttttgtaatccataacattttgttaatccttttttttgtattttctcctcccaataaagatggggatcgacatcatccaatttaaccatctttttatgttgcctggtttctccagtatatacatatatgtatgtctgaatgctcatctctgtcttcagaataatactagcattgtctgaatttgatccaaaaaaaaaaaaaaaacga

SEQ ID NO: 4892 - DNA, 1783 bp, Panicum virgatum
cggcggtggcgaggaggcgagcaggcgttctccacgcccaccgcgctgctgcgcggcatcgcggacgccatggtggaggagatggagcgcggcctgcgcgccgacccgcacgccccgatcaagatgctcatcagctacgtcgacaacctccccaccggggatgagcatgggttgttttatgcactggatcttggcgggaccaactttcgtgtcatacgggttcaacttggaggaagggagaagcgtgttgtgaagcaacaatacgaggaggtctccattccgcctcatctcatggttgggacttccacggagctgttcgatttcattgctgccgaattggaaaaatttgtggggactgaaggagaggatttccacctaccagatggcaggcagagagaactcggtttcaccttttctttcccagtgcaccaaacatcaatatcatccggcactctaattaagtggaccaagggcttttccatcaatggcacggttggagaagatgttgtggctgaattgactagggctatggagaggcagggtcttgacatgaaagttacagccctggttaacgatactgtaggcacattggctggcgggagatatgtggataatgatgttgttgctgctgtaatattgggcaccggcacaaatgcagcttatgtggaacatgcaaatgtgattcctaaatggaacgggccactacctagatcagggaatatggtaatcaacatggaatggggaaacttcaggtcagataagcttccaagttcggagtatgataaagcgttggactttgaaagtttgaaccctggcgagcagctatatgaaaagatgatttctggaatgtatcttggagaaattgttcggaggatcctgctgaaactggctcatgacgcctctttgtttggggatgttgttccaccaaaattggaacaattatttatactgagaacaccggatatgtcagccatgcatcatgacacctcacatgatctcaaacacctgggagctaagctgaaggatattctgggggttcctgatacttccctcgaagcaagatacattactcttcatgtatgcgaccttgtcgcggagaggggtgcacgcttggctgctgctggtatatatggcattctgaagaagctgggcaaggacaaattgctaaatgacttcagccaacaaaggactgtggttgctatggatggtgggttatatgagcattacaagaagttcagctcctgcctagaagcgacacttacagatcttctcggtgaggaggctgcctcatcggttgttgtcaagttggccaacgacggctcaggaattggagccgcgcttcttgcagcctcacactcccagtatgctgcatagtcctaggaactcggctcctagtgtaacctttttgtttcccgctcttttccccctcagcggagctcccctcgtgcgattcgcatctctttttgcctctgcagcaggatatagctagtatggcgccaatgagtttgcagtatatcacttggaacaaccattagcaactgcagggaagtggaagcggacgtctgaatgaagccgttcctttcctgccaattcttttttccctacaccttgaactctgtattatgaatttatgatgcgatgtcgcaaacctatcagtgcttgtctgtgtaatcttgtgtttcaaaataaagagggggataaaatcattcaatcgtactcatcttttgaatgaatgtgcagaggtcctgccattatttcagaaagctacaacagtttgtgctta

SEQ ID NO: 4893 - DNA, 5428 bp, Triticum aestivum
cgaccatggcgtcgccacaccgcgcctatctcccactcctcgcactctgcctcgtcctgcacctgcaccatgccgcggcgcagcaggccgacgagcggcagctcctgctcgaggtcaagcgcgcgtggggcgacccgccggagctcgcgtcgtggtcggcggccacgggctcgccctgcaccggctgggcccacgtctcctgcgacggcgccggccgggtgacctccctcgccctgtcgaacgtcaccgtctccggccccgtccccgacgccatcggccggctcgccagcctcgccacgctcgacctcagcaacaccagcgtcagcggcggcttcccggagtccctctacaactgcacgggcctcacgcacctcgacctctcgatgaacaggctctcgggcgacctccccgccgacatcggccgcctcggggggaacctcacctacctggccctgaacggcaacggcttcaccggcgaggtgccgcccgcgctgtccaagctcaagaacctgacggtcctcgctctcgacagcaaccagctcaccggcaccatcccgccggagctcggggagctgactggcctccagacgctcaagctcgagcacaaccatttcggccccggcaagctgccggagtcgttcaagaacttggcgaagctggccactgtctggctagccggatgcaacctcaccggcgagttcccgagctacctcccggagctgtcggagttggtgtggcttgacctgtcgacgaacgcgttcaccgggaacattccaccgtcgatctggaacctcaccaagctgcaggtgttgtacttacactataacaagctcgccggtgacgtcgtcatcgatggcgccatcggagcggcgggtctaatcgagatcgacctgtcctacaacaagctgaccggcgcgatcccggaaagcctcggaacattgacgaagcttagcaaattatgcttgagcggcaacggcttctccggcgagataccggcgagcctcgcccagctaccgtcgctggtgttcctgtggctgtttgagaacaaactcacgggggcgcttccggcggagctcgggatgcactcgccgtcgctgagagacatccaggtcgacgacaacgacctctccgggccgatacctgcgggggtctgcaagaaccgcgggctgtgggtcatcaccgcctccggcaaccgcctgaacggctcgatcccggccagcctcgccaagtgccccgcgctcataagcctgcagctccaagacaacaagctttccggcgaggtgccggccgcgctctggacggagacgaagctgatgactctgcttttgcagaacaatggagggctcaccggcaccctgccagagacgctgttttggaacatgacgaggctctacatcatgaataacaagttcagaggcagccttccgtcgtcggcggctaagctgcagaagttcaacgccgggaacaactccttctccggcgagatacccgcggggctcaccgccggcatgccgctgctgcaggagttcatcctgtcgtccaaccagctgtcgggcgcgatcccggcgagcatcgcgtcgctcggtggcctgacgcagatgaacttcagcaacaaccagctcaccggcgagataccggcggggttgggctccatgccggtgctcaccctgctcgacctctcatccaaccaactctccggcagcatcccgccagcgctgggatcgctgaggctgaaccagctaaacctgtcatccaatgacctcgccggcgaggtcccggaggcgctcgctgtccccgcctacgaccgaagcttcctgggcaaccgcgcgctctgcacgggcgcggcgtcgtcggggaacctcgccggcgtgggctcgtgcgcagcccggtcatccgacaaggtgtcaccaggcctccgcatcggccttgtcgccgctgccgccgcgctactcgtcgtcatcgcggcgctcgccttcttcatcgtccgcgacatgaagaggcggaaggggctcgcgccgcccgaagaggcctggaagctcacccctttccagccgctggacttcggcgagggccccgtgctgcgcgggctcgtcgacgagaacctcatcggcaagggcgggtcgggacgggtgtaccgcgtggagtgccccagccggagcggcgcgagcggcggcacggtggtggccgtgaagcgcatctggaccggcgggaaggtggagaggaagctgcagcgggagttcgagtcggaggtggaggtgctcggccacgtccggcacaccaacatcgtcaagctcctgtgctgcctctcccgcgcggagaccaagctcctcgtctacgagtacatgggcaacggcagcctggacaagtggctgcacggccacaggtggccggcgccggctgggagctcgatgccggcgagggccccctcggccaggcgagcgccgctgaactgggcggcgagggtgagggtggccgtgggcgcggcgcgggggctgagctacatgcaccacgagtgctccccgccggtggtgcaccgggacgtcaagtgcagcaacatcctgctcgacgcggagctcaacgccaaggtcgccgacttcgggctcgccaggatactcgccgaggccgccggcacgacgccgcacgacaccgtgtccgccgtcgccggaaccttcggctacatggctccagagtgcgggtacacgaggaaagcgaacgagaaggtggacgtgtacagcttcggggtggtgctgctggagctggccaccggcagggaggccggcaacggcggcgagcactgctcgctggcggagtgggcgtggcggcacctgcagtccgggaagagcatcgctgacgcggcggacgagtgcatcggcgacgccaggcaaagtgacgacttcgatgtcgtgttcaagctcggcatcgtctgcaccggcgctcagccgtcgacgcggccgaccatgaaggacgtgctgcagatactgctgcgatgcgagcaggcgcaccggaaaaacctcgacgagaagacggccgtctccgagtacgacggcgccccgctgctgccagcagtgcgagggggcagccgccggaaacggctatccgacgccgctgacggcaagggtagcttcgacgatgtcgtctgacgaaatgccgtagtgacgttgtaaggttcagtagtaactaagtagtaagacagtgcagtttcagagcagagcagataacaatggtggaatgttgtacacagtgtgccagccttgagacgagcagttgcttgaagtggatcaaattcagacaaaactagtattattctgaagacaaagatgagcattcagacatacatatatgtatatactggagaaaccaggcaacataaaaagatggttaaattggatgatgtcgatcctcatctttattgggaggagaaaatacaaaaaaaaggattaacaaaatgttatggattacaaaacaccaccagacaaggggaaaaagaatcggcagaacaggaatggcattgtccaaacctccatctccatatgttcctgccactgaaacttttatgccattagataaacctccaagctctttggcgctatgctagctacatcccgctgcagacgcaccggagagtgtccgcagaatagccgaagaaggtaaaattccaccaccaggcgattaggaaggttcgaagggaaaagaaaagaaaaaaaaaaggaagagaagaggctgctacactctgggttcaatccatccatcgggctcgttaccaagaagactagtagatatcagcgtactgggagtgcgaagcggcgaggagagcagctccaatgccagagccgtcattggccagcttggcaaccagcgaagaagaggcctcgtccccgaggagatctgaaagagttgcctctaagcagctgctgaacttcttgtagtgctcatagagcccaccgtccaaggcaaccacggtccttggcatcgggctgccgtcggttggcaccttgtcccggcctagcttcttcaggatgccatatatgccagcagcggccaagcgtgcgccgcgctctgcaacgatgtcacatatgtgacgagtaatgtatcttacttccagggaagtatccgcaaccccaacgatatcctttagcttacttcccagaattttaaggtcatgtgatgcatcatggtgcatggcagacatatctggggtcctaagtacgaatggcagttccagcttagctggaacaacatccccaaataatgcagcatcatgagccaatttcagtaagattcttcgcacaatctctccaagatacatgccggaaatcaacttttcatatatctgttctccagggttcaaactttcgaagtccaatgctttgtcgtattctgaaagtggaagcttgtccgatttaaagcttccccattccgtgttgattaccatatttccggatttcggcagtagtccagtccacttaggaattgcattagcatgctcaacatatgctgcatttgtaccagtgcccaatattatggcagcaaccacatcattatccatatatctcccaccagccaatgtgccgactgtgtcattaaccagtgctgaaactttcatatccagcccctgcctctccatggccttgctcaactcagccacaacatcctcaccaaccgcgccgttgattgaaaagccctttgtccacttgatgagtgttcctgatgatattgataattggtttaccggaaaggaaaaggtgaaacccagctctctctgcctccccactgggaggtggaactcgtcaccttcagtttcaataaatttggccaatacagaagcaatgaaatcaaatagttccaaggaagttccgaccatcaggtgtggtggaatagagacttcctgatactgttgcttggcaacacgtttctcccttcctccaagttggactcgcagaacacggaagttggtacctccaagatccaatgcataaaacaagccatgttcgtctccggtggggagctggtcgacgtagctgatgagcatcttgagctgggagtggatgtccccgcgcaggccgcgctccatctcgaggacgagcgcgtcggagatgccccgcagcagggccgtgggcgtggcgagcgtgcgctcgacgtcctcgatgacggccgccaccttgcgcttcctctcggcctcggccgcgccgagcagctccgcgtccctgcggcgccggcgccggccgagcaccacggccgtgccgaccgccgcgcacaccaccaccgccgtgcccaccgccgccgccttccccatcgtcgcgcctggactggatcggtcgtctccctagcgcccggacacgaactccgctctggatccggaggccaggtgaagggggagcggtcgctggttaccccgggcgcgggcggaggagagaaagagaggggggag

SEQ ID NO: 4894 - DNA, 2033 bp, Panicum virgatum
ccgcaagcggagaaagagctggaggcagacaagtgaggggggaggagagggagggagagagagagagagagagagagaagcggtgggctgcagcggcctagctcgcgatccgggcgccgagctgttccgggcttgggatcggtcgcgcggctctatcggggaggctagggctcgcccggcggggcgcgattgcgaaggccgtggtcgtgtcgcgacggcgccggcgccggcgggaggcggaggacgagaggaagaggaaggcggcggcggtggtcgaggaggcggagcaggcgttctccacgcccaccgcgctgctgcgcggcatcgcggacgccatggtggaggagatggagcgcggcctgcgcgccgacccgcacgccccgatcaagatgctcatcagctacgtcgacaacctccccaccggggatgagcatgggttgttttatgcactggatcttggcgggaccaactttcgtgtcatacgggttcaacttggaggaagggagaagcgtgttgtgaagcaacaatacgaggaggtctccattccgcctcatctcatggttgggacttccacggagctgttcgatttcattgctgccgaattggaaaaatttgtggggactgaaggagaggatttccacctaccagatggcaggcagagagaactcggtttcaccttttctttcccagtgcaccaaacatcaatatcatccggcactctaattaagtggaccaagggcttttccatcaatggcacggttggagaagatgttgtggctgaattgactagggctatggagaggcagggtcttgacatgaaagttacagccctggttaacgatactgtaggcacattggctggcgggagatatgtggataatgatgttgttgctgctgtaatattgggcaccggcacaaatgcagcttatgtggaacatgcaaatgtgattcctaaatggaacaggccactacctagatcagggaatatggtaatcaacatggaatggggaaacttcaggtcagataagcttccaagttcggagtatgataaagcgttggactttgaaagtttgaaccctggcgagcagctatatgaaaagatgatttctggaatgtatcttggagaaattgttcggaggatcctgctgaaactggctcatgacgcctctttgtttggggatgttgttccaccaaaattggaacaattatttatactgagaacaccggatatgtcagccatgcatcatgacacctcacatgatctcaaacacctgggagctaagctgaaggatattctgggggttcctgatacttccctcgaagcaagatacattactcttcatgtatgcgaccttgtcgcggagaggggtgcacgcttggctgctgctggtatatatggcattctgaagaagctgggcaaggacaaattgctaaatgacttcagccaacaaaggactgtggttgctatggatggtgggttatatgagcattacaagaagttcagctcctgcctagaagcgacacttacagatcttctcggtgaggaggctgcctcatcggttgttgtcaagttggccaacgacggctcaggaattggagctgcgcttcttgcagcctcacactcccagtatgctgcatagtcctaggaactcggctcctagtgtaacctttttgtttcccgctcttttccccctcagcggagctcccctcgtgcgattcgcatctctttttgcctctgcagcaggatatagctagtatggcgccaatgagtttgcagtatatcacttggaacaaccattagcaactgcagggaagtggaagcggacgtctgaatgaagccgttcctttcctgccaattctttttttccctacaccttgaactctgtattatgaatttatgatgcgatgtcgcaaacctatcagtgcttgtctgtgtaatcttgtgtttcaaaataaagagggggataaaatcattcaatcgtactcatcttttgaatgaatgtgcagaggtcctgccattatttcagaaagcc

SEQ ID NO: 4895 - DNA, 1867 bp, Saccharum officinarum
cccacgcgtccgcacaattctcacgcaggccctgtgaatagtggggagagtggccagcaaagtgccaaaggaaaagggaatcgccatcagcgtgtgtgtgtgaccccataaagagcagggcgtgggcggggggcgggcagagcagagctgcctccaacagtccaaccacagacgagacgagaggaggacgcggcaccgctctcggtagcagccagcgttgagcacttgagcgcagtgccctcttgtctgttgtctccccgtccccgctgctcagttcacactccctcccacttcccagcctcgcacccccgtccccgtcccggcgtcccctggtcggagggagctgagctgcgagggagcgcggaggggggtttaggagatggagccagattcggcgaggaagaggctcgcattgctggcgctgctgctcctggcggcgcccgcctgcccggcctcggcggctccggtggaggatggcctgctcagcaatggtgactttgagacagcaccagccggtggttttgtaaaatctgcgtctgttgctgagggtgcatcgtcaatccctggttggacgatcaatggcacggttgagctcatttcagcaggccagcaccagggtggcatgatcctgattgttccacagggggaccatgctgtaaggctagggaatgatgctagcgttgggcaggtggtggacgttgagaagggctcagagtatgctatcacattcagcgctgcccgaacatgtgcacaactggaggcactgaatgtttccgtgctaggtggcgtatcacagacagtagacttgcagacattgtacaacatagaaggctgggatgcgtacgcgttggcttttcaggcaacggaagagcaggcacatcttcaattcatgaaccctggcatggaggatgatccaacttgtggtcctatcctagacaatgttgccgtcaagaagctcttcactccagacaaaccaaaggataacgtggtgctgaatggagactttgaggagggtccatggatgttcccgaacacgagctttggcgtgctgctcccaactaaccttgacgagcagacatctgccatacctggttggatgatcgagtcaaaccgcgccgtccgctacatagactctgatgagtacaaggttccccaggggaagcgtgccattgagcttctgtcaggcaaggagggtatcatctcccagatggttgagacgacccctcagaaggtttacagcctgacgttcacactgggcacggcgggggactcgtgccaaccaccaatggccgtcatggcattcgcgggggatcaggcccagaacttccactactccccaatgggcaacgccaccagccaggctgcgaatgtgacgttcactgcacgtgctgagagaacacgtgtggcattctacagcgtgtactacaacacgaggagtgacgaccacagctcactgtgtggaccggtgatcgacgacgtccgggtatggggcttgaacgcagcggctgggttaaaggcaagtattggactggttcttggcattgttggtgtcgttggcatggtgctgttctgaaatctgaatctctcagtggctgtggtcttgggaagtatggatgtataacctcttctgttcgttggaggaggcttactagttttggtagtaagcttgaagtttgttgagtgatatgagcttaggctaaaaagcaaccagaacctacatgttattgcttgtgttacttcatttgtgatttccgaagtaacatgcaattatatgggattgtgtggtttgtttgccctagcttgtaatatgagatgtcagaattgttctaagttcatctcttcagtatattagaaaagagtaaagtag

SEQ ID NO: 4896 - DNA, 1882 bp, Zea mays
agcccgcggtaggagtgttgaccgctgttgccacagttctcaccaaggcaggggctggtgtctggggagagttgccagcaaagtgccaaaagaaaggggaatcgccatcataaaaaagcagggcgtgggcgggggacgggcatagcagagcagagctgagctgagctgcctccaactccgactccgacccacacccacggcacggcagtcggcagcagccagcgtcgagcgcagtgccctcttgtctgctgccccgcgcccagtctcactcacacgctcccacttccgagtctcgctcgcagcctgtgctcctggggtccgatcggagggggctgtgaggagatggagccagattcggcgacgacgaggctcgcattgctggcgctgcttctcctggcggcgcccgcccgcccggcctcggcggctccggtggaggatggcctgctcagcaatggtgactttgagacggcaccagccggcggttttgtaagatctgcgtctgttgctgagggtgcatcgtcaatccctggttggacaatcaatggcacagtcgagctcatttcagcaggccagcaccagggtggcatgatcctgattgttccacagggagaccatgctgtaaggctagggaatgatgctagcgttgggcaggtggtggacgtcgagaagggctcggactacgctgtcacattcagcgctgcccggacatgtgcacaactggaggcactgaacgtctccgtgctaggtggcgtgtcgcagacagtagatttacagacgttgtacaacatagaagggtgggacgcgtacgcgctggcttttcaggcgacggaagagcaggcgcatcttcagttcatgaaccctggcatggaggacgatccaacttgtggccccatcctagacaacgttgctgtcaagaagctcttcactccggacaaaccaaaggataacgtggtgctgaatggagactttgaggagggcccttggatgttcccgaacaccagctttggcgtgctgctcccaactaaccttgatgagcagacatctgccatacctggctggatgatcgagtcaaaccgcgctgtccgctacatcgattctgatcagtacaaggttccccaggggaagcgtgccattgagcttctgtcaggcaaggagggtatcatctcccagatggtcgagacgacccctgagaaggtttacagcctgacggccatgctgggcgcggcgggggactcgtgccaaccaccaatggccatcatggcgttcgccggggaccaggcccagaacttccattactcaccattgggcaacgccacgagccaggctgtgaacgtgacgttcactgcgcgtgctgagaggacacgcgtggcgttctacagcgtgtactacaacacgaggagtgacgaccacagctcgctgtgcgggccggtgatcgacgacgtccgcgtatggggcttgaacaccgcggctgggttgaaggcgagtgctggactggttcttggcattgttggcgtcgttggcatggtgctgttctgaaatctggatctctcagtggctgtagcctgtagtcttgggaagcatggatgtgtaatctcatctgttagttcgaggaggggcagggcttactggttttggtagtaagcttgaagtttgtcgagtaatatgagcttaggctaaaaaaaaaagctaccagaacccacatgttattgcctgtgttacttcatttgtgattcctgaagtaacatgcaattctatgggattgtgtggtttgtttgccctagcttgtactgtaatatgagatgttagaactgttacaagttcatctcctcacaatatgaaaatattgttattgtaaagttaaaatcgtgcattatgccgtctt

SEQ ID NO: 4897 - DNA, 1825 bp, Panicum virgatum
gccaaaggaaaaggaatcgcatcaggcctgtctgtgtgaggatgtgaccccatgaaaagcaggggaaggtgggcgggggcagagctgcctccaacccagacgagacgaggacgcggccccggctcggcacaggccagcacagtgctctcttgtatccttcctcttccactccactcggtggccgctcacgctaccactccccagttcccactcgcgcccccagccaagctctgtgctgcagagtcagagctgctgagcggggagggagcgcagaggggccgagagggctaggagatggagcggggttcgccgagggagaggcgcgcattgctggcgctgtgctcggcgctgcttctcctggcggcgcccgcccggtcggtatgggcggctccggtggaggatggcctgctcagcaatggtgactttgagaccgcaccagccggtggttttgtcaaatctgcatctgttgctgagggtgcatcatcaatccctggttggacgatcaatggcacagttgagctgatttcagcaggccagcaccagggtggcatgatccttattgttccacagggggatcatgctgtacggctaggaaatgatgctagtgttgggcaggtggtggaggttgagaagggctcagagtatgctatcacattcagcgctgcccgtacatgtgctcagctggaggcactgaatgtgtccgtgctaggtggtgtatcacagacagtggatttgcagacattgtacaacatagaaggctgggatgcgtatgccctcgcttttcaggcaacagatgagcaggcacatattcagttcatgaaccctggcatggaggatgatccaacctgcgggcctatccttgacaatgtcgccatcaagaagctcttcactccagacaagccaaaggataatgtggttctcaatggagactttgaggaaggtccgtggatgttcccaaacacaagctttggagtgctgctcccgaccaacctcgatgagcaaacatccgccatacctggctggatgatagagtcaaaccgggctgtccgcttcattgactctgatgaatacaaggttccacaggggaagcgcgccatcgagcttctgtcaggcaaggagggcatcatctcccagatggtggagacaaccccccagaaggagtacagccttacgttcacgctggggacggcgggggactcatgccagccaccaatggccatcatggcgttcgctggcgaccaggcccagaacttccactactcgccgatgggcaatgccaccagccaggctgcaaatgtgacgttcacagcgcgcgccgagaggacacgcgtggcattctacagcgtgtactacaacacgaggagcgacgaccacagctctctgtgcgggccggtgatcgacgacgtccgcgtatggggcttgaatgcggccgccgggttgaaggcaagtgttgggctggttctcggcattgttggtatggtcggcatggtgctcctctgaaatctgaatttccctgcgctgtgatcttgggtgtgggttaaggatatatatataacctcttctataactctgaggaggctgctagttttggtagtaagcttgaagtttctacgagtttgattaatgtgagcataggctgaagctaccagaacctatatgtggttgcttgtgttacttcatttgtgattcaggaagtagcatgcaattaatatggtcttgtgtggtctgtgtgccaggagcttgtaatgtgaaatctcagaaatgttccaagttggtctcttcaatgtattagaaaatttgaagagctcagcatctccaaattaca

SEQ ID NO: 4898 - DNA, 1813 bp, Setaria italica
gcaaagtgccaaaggaaaagggaatcgccctcagcctgtgagtgtgtgaccccataaaaagcagggcgtgggcgggggcagagctgcctccaacccagacgaggacgcggcccggctcggctccgctcggcagtgccctgccctcttgtctccgtcctcctccactcctcagtctcacgctaccgattcccagttcccactcgcgcccccagccaagctctgctgctgctagtggggaaggagcttgagctgggagggagcgcagaggggtcgagagggctagatggggcgagattcgccgagggggaggtgcgcattgctggcgctgtgctcggcgctgcttctcctggcggcgcccgcccgcccggcgtgggctgctccggtggaggatggccttctcagcaatggtgactttgagacagcacccgctggtggttttgtcaaatctgcgtctgtagctgagggtgcatcgtcaatacctggttggacgatcaatggcacagtggagctcatttcttctggccagcatcagggtggcatgatccttattgttccacagggggatcatgctgtacggctagggaatgatgctagcgttgggcaggtggtggaggttgagaagggctcggagtatgctatcacattcagcgctgcccggacatgtgcacagctcgagtcactgaatgtgtccgtgctaggtggtgtatcacagacggtggatttgcagacactgtacaacatagaaggctgggatgcgtacgccctggcttttcaggcaacagatgagcaggcacatattcagttcatgaaccctggcatggaggatgatccaacttgtgggcctatccttgacaatgtcgccatcaagaagctcttcactccagacaagccaaaggataatgtggtgctcaatggggactttgaggaaggtccgtggatgttcccaaacacaagctttggagtgctgctcccaaccaacctcgacgagcaaacatccgccatacctggctggatgatcgagtcaaaccgtgcggtacgcttcattgactctgatgaatacaaggttccacaggggaagcgcgccatcgagctcctgtcaggcaaggaaggcatcatctcccagatggtggagacgacccctcagaaggaatacagcctgacgttcacgctggggacggccggcgactcgtgccagccaccgatggccatcatggcgttcgcgggcgaccaggcccagaacttccactactcgccgatgggcaacgccaccagccaggctgcgaatgtgacgttcatggcgcgcgccgagaggacgcgcgtggcattctacagcgtgtactacaacacgaggagcgacgaccacagctcgctgtgcgggccggtgatcgacgacgtccgcgtctggggcttgaacgcggcggccgggttgaaggcaagcgttgggctggttcttggcattgtgtgtatggtcagcatggtgctgctctgaaatctgaatttccctgtggatgtggtcttgggtatggtataaggatatataacctcttctgtaacgctgaggaggctgctagttttggtagtaagcttgaagtttctacgcgtttgagtaatgtgagcttaggctgaagctaccagaacctgtatgtggttgcttgtgttacttcatttgtgattcaggaagtagcatgccattatatgggcttgtgtggtctgtgtgccaagagcttgtaatgtcagatgtcagaaatgttccaagttcatctcttcattatattagaaagtttgaagagttaataccatggcgtcttacccg

SEQ ID NO: 4899 - DNA, 1578 bp, Panicum virgatum
gctgcctccaacccagacgagacgaggaggacgcggcccggctcggctgcgctcggcaggccagcacagtgccctcttgtatccttcctcttccactccagtactccactcggtctcacaccactccccagttccgccactcgcgcccccagccaagctctgtgctgctattagcagggacggagctgcagtcctgtagagcggggagagggctaggagatggagcggggttcgccgagggggaggtgcgcattgctggcgctgtgctcggcgctgcttctcctggcggcgtccgcccgctcggcatgggcggctccggtggaggatggcctgctcagcaatggtgactttgagaccgcaccagccggtggttttgtaaaatctgcatctgttactgagggtgcatcatcaatccctggttggacgatcaatggcacagttgagctgatttcagcaggccagcaccagggtggcatgatccttattgttccacagggggatcatgctgtacggctaggaaatgatgctagtgttgggcaggtggtggaggttgagaagggctcagagtatgctatcacattcagcgctgcccgtacatgtgctcagctggaggcactgaatgtgtccgtgctaggtggtgtatcacagacagtggatttgcagacattgtacaacatagaaggctgggatgcgtatgccctcgcttttcaggcaacagatgagcaggcacatattcagttcatgaaccctggcatggaggatgatccaacctgcgggcctatccttgacaatgtcgccatcaagaagctcttcactccagacaagccaaaggataatgtggttctcaatggagactttgaggaaggtccgtggatgttcccaaacacaagctttggagtgctgctcccgaccaacctcgatgagcaaacatccgccatacctggctggatgatcgagtcaaaccgggctgtccgcttcattgactctgatgaatacaaggttccacaggggaagcgcgccatcgagcttctgtcaggcaaggagggcatcatctcccagatggtggagacaaccccccagaaggagtacagccttacgttcacgctggggacggcgggggactcatgccagccaccaatggccatcatggcgttcgctggcgaccaggcccagaacttccactactcgccgatgggcaacgccaccagccaggccgcaaatgtgacgttcacagcgcgcgccgagaggacacgcgtggcattctacagcgtgtactacaacacgaggagcgacgaccacagctctctgtgcgggccggtgatcgacgacgtccgcgtatggggcttgaatgcggccgccgggttgaaggcaagtgttgggctggttctcggcattgttggtatggtcggcatggtgctcctctgaaatctgaatttccctgcgctgtgatcttgggtgtgggttaaggatatatatataacctcttctataactctgaggaggctgctagttttggtagtaagcttgaagtttctacgagtttgattaatgtgagcataggctgaagctaccagaacc

SEQ ID NO: 4900 - DNA, 1718 bp, Panicum virgatum
cggccccggctcggcacaggccagcacagtgctctcttgtatccttcctcttccactccactcggtggccgctcacgctaccactccccagttcccactcgcgcccccagccaagctctgtgctgcagagtcagagctgctgagcggggagggagcgcagaggggccgagagggctaggagatggagcggggttcgccgagggggaggcgcgcattgctggcgctgtgctcggcgctgcttctcctggcggcgcccgcccggtcggtatgggcggctccggtggaggatggcctgctcagcaatggtgactttgagaccgcaccagccggtggttttgtcaaatctgcatctgttgctgagggtgcatcatcaatccctggttggacgatcaatggcacagttgagctgatttcagcaggccagcaccagggtggcatgatccttattgttccacagggggatcatgctgtacggctaggaaatgatgctagtgttgggcaggtggtggaggttgagaagggctcagagtatgctatcacattcagcgctgcccgtacatgtgctcagctggaggcactgaatgtgtccgtgctaggtggtgtatcacagacagtggatttgcagacattgtacaacatagaaggctgggatgcgtatgccctcgcttttcaggcaacagatgagcaggcacatattcagttcatgaaccctggcatggaggatgatccaacctgcgggcctatccttgacaatgtcgccatcaagaagctcttcactccagacaagccaaaggataatgtggttctcaatggagactttgaggaaggtccgtggatgttcccaaacacaagctttggagtgctgctcccaaccaacctcgacgagcaaacatctgccataccttgctggatgattgagtcaaaccgggctgtccgcttcattgactctgatgaatacaaggttccacaggggaagcgcgccatcgagcttctgtcaggcaaggagggcatcatctcccagatggtggagacaaccccccagaaggagtacagccttacgttcacgctggggacggcaggggactcatgccagccaccgatggccatcatggcgttcgccggcgaccaggcccagaacttccactactcaccgatgggcaacgccaccagccaggccgcaaatgtgacgttcacggcgcacgccgagaggacgcgcgtggcattctacagcgtgtactacaacactaggagcgacgaccacagctctctgtgcgggccggtgattgacgacgtccgcgtacggggcttgaacgcggctgccgggttgaaggcaagtgtcgggctggttctcagcattgttggtatggtcggcatggtgctcctctgaaatctgaatttccctgcgagtgtggtcttgggtgtgggttaaggatatataacctcttctgtaactctgagggggctgctagttttggtagtaagcttgaagtttctacgcgtttgagtaatgtgagcttaggctgaagctaccagaacctatatgtggttgcttgtgttacttcatttgtgattcaggaagtagcatgcaattaatatggtcttgtgtggtctgtgcgcctagagcttgtaatgtgaaatctcagaaatgttccaagttcgtctcttcaatgtattagaaaatttgaagagttatttcaaaaaaacaaaatttgaagagt

SEQ ID NO: 4901 - DNA, 1703 bp, Pennisetum glaucum
gggcgcagagctgcctccaacccagacgaggaggcgcggcccggctcggcagtgcccagcatagtgccctcttgtctccgtcctcctccccactcatcctcccaggctcccagtctcacgctaccactttccagttcccactcgcgcccccagccaagctcagctgcttctagagtagagggaggaggtgctgagctgtgtgagccgggagggagcacacaggggctaggagatggggcgagatcctccgagggggaggcgcgcattgctggcgctgtgctcggcgctgcttctcctggcggcggcgtctgctgctccggtggaggatggccttctcagcaatggtgactttgagacagcacccgccagtggttttgtcaaatctgcatctgttgctgagggtgcatcatcaatccctggttggacgatcaatggcactgttgagctcatttctgctggccagcaccagggtggcatgatcctcattgttccacagggggatcacgctgtacggctagggaatgatgctagtattgggcaggtggtggaggttgagaagggctcggagtatgctatcacattcagtgctgctcggacatgtgcacagctggagtcactgaatgtgtccgttctaggtggtgtatcacagacggtggatttgcagacattgtacaacatagaaggctgggatgcgtacgccctggcttttcaagcaacagatgagcaggcacatattcaattcatgaaccctggcatggaggatgatccaacttgtgggcctatccttgacaatgtcgccatcaagaagctcttcactccagacaagccaaaggataatgtggtgctcaatggggactttgaagaaggtccatggatgttcccaaacacaagctttggagtgctgctcccgaccaaccttgacgagcaaacatctgccatacctggctggatgatcgagtcgaaccgcgcggttcgcttcattgactctgatgagtacaaggttccacaggggaagcgcgccatcgagcttctgtcaggcaaggaaggcatcatctcccagatggtggagacgactcctcagaaggagtacagcctgacgttcacgctggggacggcgggcgactcgtgccagccaccgatggccatcatggcgttcgcaggcgaccaggcccagaacttccactactcaccgatgggcaacgccaccagccaggccgcaaatgtgacattcacggcgcgcgccgagaggacacgtgtggcattctacagcgtgtactacaacacgaggagcgacgaccacagctcgctgtgcgggccggtgatcgatgacatccgtgtctggggattgaacgcagcggccgggttgaaggcaagtgttgggctggttcttggtattgttggtgtggtcagcatggtgctgctctgaaatccgaatttccatgtgggtctggtcttggcctcttgggtatggtctaaggatatataacctcttctgtaatgctgaggaggctcctagttttggtagtaagcttgaagtttctacgcgtttgagtaatgtgagcttaggctaaagctaccagaacctatatacggttgcttgtgttacttcatttgtgattcaggaagtagcatgccattatatgggcttgtgtggtctgtgtgccaagagcttgtaatgccagatgtcagaaatgttcaaagtg

SEQ ID NO: 4902 - DNA, 1882 bp, Oryza sativa
aaaaaagcaaaaggcagcagggtgacctctagagtattttattgaccatcgacgccattctcaccatccagtggtcactgctcctccttcctttcctttcagaccccacgcctgcgagaaaaatagaataatgggggtggccagcaaagtgccaaaggaaaagggaatcgccatcccataaaaagcagggcgtgagcagagagctgcctccagcccagtgagagtaggactggctcggctcgctcactcggtcagctgcacacacactgcacttcggctcactctctccactgttcttcttcctcggcgaggggggaaggaggaggcgagagctcgaggcggctaggaggaggagatggagggagattcggcgaggaggctcgcattgctggggctgtgcctgggcctgcttctgctggcgccctcccatctggcctcggccgctgcggtggaggatggcttgctcagcaatggtgactttgagacagcaccagctggtggttttgtcaaatctgcttcagttgctgaaggtgcatcatcgatccctggctggacgatcaatgggacagtcgagctcatctcagcaggccagcaccagggtggcatgattcttattgttccacagggggatcatgctgtacgtcttggaaacgacgcaagtatagggcaggtggtgcaggttgagaagggctcagagtatgctatcacgttcagtgctgcccgaacgtgtgcacagctagagtcactcaatgtgtctgtgctcggtggtgcatcacagacagtggacctgcagacattgtacaacatagaaggctgggatgcatatgcattggcttttcaggcaacagatgagcaggcgagccttgagttcaggaaccctggtatggaggatgatccgacttgtggacctatccttgacaacgttgccataaagaagctcttcactccagacaaaccaaaggatactgtggtgtcaaatggagactttgaggagggtccatggatgtttccaaacacgagctttggggtgcttctcccaaccaacctcgatgagcagacgtctgccttgcctggctggatgattgagtcaaaccgagctgtccgctttgtcgactctgaccaatacaccgttccccaagggaagcgcgccattgagcttctatcagggaaggaaggcatcatctcacagatggtcgagacaacccctcagaaagagtacagcctgacattcacattgggctcagcaggggattcatgccagccaccaatggctgtcatggcattcgcaggtgaccaggcccagaacttccactactcgcccatgggtaatgccacaagccaggctgcgaatgtgacattcacagcacgagctgagaggacgcgggtagcgttctacagtgtgtattacaacacgagaagcgacgaccacagctcgctctgtgggccagtgatcgatgatgtgcgcgtctggggcttgaatggagctgctgggttgaaggcaagtattgggctgctgcttggcattgttagcattgtcagtctgatgttgttctgaatctcttagtgattgtggtcgaaagatatataaacctcttctgtaagtatgaggaggccactagttttggtagtaagcttgaagtttctattaggttgagtaatgtgagattgtgagcttaggctaaagctacctgaagctatgtatggctgtttctgttgctttcttttgtgattcagaaagtaacatgccattgtgggaagtgtgtggtggttagtgtgccaagagcttgtaatgttcaaatatcatcccttcaatatattagaaatttcaggagttgatccgatctccattgtcttctagtctgatgaatgccgtttcagacat

SEQ ID NO: 4903 - DNA, 1692 bp, Oryza sativa
aggggaatcgccatcggagtcccataaaaagcagggcgtgagcagagagctgcctccagcccagtgagtagggctggctcggctcgctcactcggtcagctgcacacacactgtacttcggctcactctctccactgttcttcttcctcggcgaggggggaaggaggaggcgagagctcgaggcggctaggaggaggagatggagggagatacggcgaggaggctcgcattgctggggctgtgcctgggcctgcttctgctggcgccctcccatctggcctcggccgctgcggtggaggatggcttgctcagcaatggtgactttgagacagcaccagctggtggttttgtcaaatctgcttcagttgctgagggtgcatcatcgatccctggctggacgatcaatgggacagtcgagctcatctcagcaggccagcaccagggtggcatgattcttattgttccacagggggatcatgctgtacgtcttggaaacgatgcaagtatagggcaggtggtgcaggttgagaagggctcagagtatgctatcacgttcagtgctgcctgaacgtgtgcacagctagagtcactcaatgtgtctgtgctcggtggtgcatcacagacagtggacctgcagacattgtacaacatagaaggctgggatgcatatgcactggcttttcaggcaacagatgagcaggcgagccttgagttcaggaaccctggtatggaggatgatccgacttgtgggcctatccttgacaacgttgccataaagaagctcttcactccagacaaaccaaaggataatgtggtgtcgaatggagactttgaggagggtccatggatgtttccaaacacgagctttggggtgcttctcccaaccaacctcgatgagcagacgtctgccttgcctggctggatgattgagtcaaatcgagctgtccgctttgtcgactctgaccagtacaccattccccaagggaagcgcgccattgagcttctatcagggaaggaaggcatcatctcacagatggtcgagacaacccctcagaaagagtacagcctgacattcacattgggctcagcaggggattcatgccagccaccaatggctgtcatggcattcgcaggtgaccaggcccagaacttccactactcgcccatgggtaatgccacaagccaggctgcgaatgtgacattcacagcacgagctgagaggacgcgagtggcgttctacagcgtgtattacaacacgagaagcgacgaccacagctcgctctgtgggccagtgatcgatgatgtgcgcgtctggggcttgaatggagctgctgggttgaaggcaagtattgggctgctgcttggcattgttagcattgtcagtctgatgttgttctgaatctcttagtgattgtggtcgaaagatatataaacctcttctgtaagtatgaggaggccactagttttggtagtaagcttgaagtttctatgaggttgagtaatgtgagattgtgagcttaggctaaggctacctgaagctatgtatggctgtttctgttgctttcttttgtgattcagaaagtaacatgccattgtgggaagtgtgtggtggtggtggttagtgtgccaagagcttgtaatgttcaaatatcatcccttcaatatattagaaatttcaggagttgatccgat

SEQ ID NO: 4904 - DNA, 1457 bp, Zea mays
attactaaatttacacttacaatgattagtgatctcttggcttcttgcactacaggcctgctcagcaatggtgactttgagacagcaccaagtggtggttttgtaaaatctgcttctgttgctgagggtgcatcgtcaatccctggttggacgatcaacggcacggttgaactcatttcagcaggccaacaccagggtggcatgatcctgattgttccacagggggaccatgcagtaaggctagggaatgatgctagcgttgggcaggtggtggacgttgagaagggttcggagtatgctatcacattcagtgctgcccggacatgtgcacaactggaggcactgaatgtttccgtgctaggtggcgtgtctcagacagtagacttgcagacgttgtacaacatagaaggctgggatgcgtacgcgttggcttttcaggcgacggaagagcaggcacatcttcaattcatgaaccctggcatggaggatgatccaacttgtggtcctatcctagacaacgttgccgtcaagaagctcttcaccccagacaaaccaaaggataacgtggtgctgaatggagactttgaggagggtccatggatgttccccaacacgagcttcggcgtgctgctcccaactaaccttgacgagcaaacgtctgccatacctggttggatgatcgagtcaaaccgcgccgtccgctacatagactctgatgagtacaaggttccccagggaaagcgtgccattgagcttctgtcaggcaaggaaggtatcatctcccagatggttgagaccacccctcagaaggtttacagcctgacgttcacactgggcacggcgggggactcgtgccaaccaccaatggccgtcatggcattcgcgggggatcaggcccagaacttccactactccccaatgggcaacgccaccagccaggctgcgaatgtgacgttcactgcacgcgctgagagaacacgtgtggcgttctatagcgtgtattacaacacgaggagtgacgaccacagctcgctgtgtggcccggtgattgacgatgtccgggtatgggcattgaacgccgcggctgggttgaaggcaagtattgggctggttcttggcattgttggtgtcgttggcatggtgttgttctgaaatctgaatctctcggtgccagtggtcttgggaagtatggatgtataacttcttctgttagttggaggcttactagttttggtagtaagcttgaagtttgttgagtgatatgagcttaggttaaaaagctacgagaacctacatggtattgcttgtgttacttcattggtgacatgcagttgtatggtattgtgtggcttgtttgccctagcttgtaatatgagatgtcagaattattcgaagatcatctcttcaatatattagaaaagagtaaagtgcaacatcaattgtccaatgtttatctt

SEQ ID NO: 4905 - DNA, 1516 bp, Panicum virgatum
aacttgatacttactatagtgacttggtgatttctaacccaacaggcctgctcagcaatggtgactttgagaccgcaccagccggtggttttgtcaaatccgcatctgttgctgagggtgcatcatcaatccctggttggacgatcaatggcacagttgagctgatttcagcaggccagcaccagggtggcatgatccttattgttccacagggggatcatgctgtacggctaggaaatgatgctagtgttgggcaggtggtggaggttgagaagggctcagagtatgctatcacattcagcgctgcccgtacatgtgctcagctggaggcactgaatgtgtccgtgctaggtggtgtatcacagacagtggatttgcagacattgtacaacatagaaggctgggatgcgtacgccctggcttttcaggcaacagatgagcaggcacatattcagttcatgaaccctggcatggaggatgatccaacttgcgggcctatccttgacaatgtcgccatcaagaagctcttcactccagacaagccaaaggataatgtggtcctcaatggagactttgaggaaggtccgtggatgttcccaaacacaagctttggagtgctgctcccaaccaacctcgacgagcaaacatctgccataccttgctggatgattgagtcaaaccgggctgtccgcttcattgactctgatgaatacaaggttccacaggggaagcgcgccatcgagcttctgtcaggcaaggagggcatcatctcccagatggtggagacaaccccccagaaggagtacagccttacgttcacgctggggacggcaggggactcatgccagccaccgatggccatcatggcgttcgccggcgaccaggcccagaacttccactactcaccgatgggcaacgccaccagccaggccgcaaatgtgacgttcacggcgcacgccgagaggacgcgcgtggcattctacagcgtgtactacaacactaggagcgacgaccacagctctctgtgcgggccggtgattgacgacgtccgcgtacggggcttgaacgcggctgccgggttgaaggcaagtgtcgggctggttctcagcattgttggtatggtcggcatggtgctcctctgaaatctgaatttccctgcgagtgtggtcttgggtgtgggttaaggatatataacctcttctgtaactctgagggggctgctagttttggtagtaagcttgaagtttctacgcgtttgagtaatgtgagcttaggctgaagctaccagaacctatatgtggttgcttgtgttacttcatttgtgattcaggaagtagcatgcaattaatatggtcttgtgtggtctgtgcgccaagagcttgtaatgtgaaatctcagaaatgttccaagttcgtctcttcaatgtattagaaaatttgaagagttatttcaaaaaaacaaaatttgaagagtacataccatggattcttacctgagatatctggagcagctactg

SEQ ID NO: 4906 - DNA, 1967 bp, Brachypodium distachyon
aaaaatagaataatggaagtggccaacaaagcgccaaagaaaagggaatccaagtcccataaagcagcgcgtgggcgagcagagagagtcgcctcccagaacagacccagcgaggagccgaggacctcgcttggctggctgcacacccgcccagtgagtggcgacgcctcttgcagtcttgcttgccacacctcccacccagctcacttcactcgctccccaaagcttcttcggcgggggggggaaggacccggcggagcgagggagctgtgagctcgcgcgcgagatggggctcacattgctggggctgtgcctggccgttcttctgctggcacccccctcccgtctggcctcagccgcagctgtggaggatggcctgctcagcaatggtgattttgagacagcaccagtaggtggttttgccaaatctgcttctgtttctgagggggcatcgactatcccaagttggacgatcaatggcacagttgagctcgtttcagcaggccagcaccagggtggcatgatccttattgttccacagggggatcatgctgtgaggctagggaatgatgcaggtattgggcaggtggtgcaggttgagaagggatcggagtatgcaatcacattcagtgctgcccggacgtgtgcgcagctggagtcactgaacgtgtctgccggtggtgtgtcgcagacagtagacttgcagacattgtacaacatagagggctgggatgcatatgcattggcttttcaagcagtggatgagcaggccaaccttgaattcaggaaccctggcatggaagacgatccaacttgtggacctatcctcgacaatgtggcaatcaagaagctcttcgctccagagaaaccaaaggataacatggtggtcaatggagactttgaggagggtccatggatgttcccaaacacgagctttggtgttctgctcccaacaaacctcgacgaacagacatcagccttgcctgggtggatgattgagtcgaaccgtgctgtccgcttcgtcgactctgaccagtacaccgtaccccaggggaagcgcgccatcgagcttctctctggcaaggagggcattatctcacagatggtcgagacaactcctcagaaagtgtacagcctgacgttcacgctgggctctgcaggtgattcatgccagccaccaatggccgtcatggcatttgcaggcgatcaggcccagaacttccactactcacctatgggcaatgccacgagccaggctgcgaacgtgaccttcacagcacgtgctgagaggacacgtgttgcgctctacagcgtgtactacaacacaagaagcgatgaccacagctcattatgtgggcctgtgatcgatgatgtgcgtgtttggggcttgaatggtgctgctgggttgaaggcaagtattgggctgcttcttggcatggttagtgtcattggcctgatgctgttctgaagttcgtagttggtgtggtttaaggatatacatatgtggcctgctgtgaaggatgaggagaccactaggtttggtagtaagcttgaagttcctatgagattgagtaacgtgagcttaggctaaagctatcagcagccatatatggctgtcttgttgccttctttcgtgattcagaaagtagcatgccattatggattgcatggttagtgtgccaagagcttgtgatgtgagatgccagaattattcaaagttcatctcttcaatgcattagaaatttcaggggtctctgtttttccttggcttgtctgaatcttatatcttgggcgctgataattttgtagtgatcaccgaccaatttactacaatctcgttgtcgacggttttgccatatatattttccccagcaatttatctcggcagtcgtcagtgactgatgtacacagctagtcatcatgcttgaatagatctgcatcgcatcaatgccatatgcattaaccag

SEQ ID NO: 4907 - DNA, 1340 bp, Festuca arundinacea
  misc_feature (94)..(94): n is a, c, g, or t
  misc_feature (108)..(108): n is a, c, g, or t
  misc_feature (130)..(130): n is a, c, g, or t
  misc_feature (148)..(148): n is a, c, g, or t
  misc_feature (154)..(154): n is a, c, g, or t
  misc_feature (167)..(167): n is a, c, g, or t
  misc_feature (179)..(179): n is a, c, g, or t
  misc_feature (222)..(222): n is a, c, g, or t
  misc_feature (229)..(229): n is a, c, g, or t
  misc_feature (253)..(253): n is a, c, g, or t
  misc_feature (313)..(313): n is a, c, g, or t
  misc_feature (322)..(322): n is a, c, g, or t
ggcacgagggggactagctgcctaggaggaggaggaggagatggagcggctcgcatggctggggctgggggtggcactgctcctgctggcgccngcttctcgtctggnctcagccgccgcggtggagganggcctgctcaccaatggngacttngaaacagctccanctggtggttttnccaagtctgcttctgtctctgagggcgcatcgacgatcccagnttggacnatcaatggcacagttgagctagtntcagcaggccagcaccagggtggcatgatccttattgttccacagggggatcatgctgtncggctaggnaatgatgcaggcattgggcaggtggtgcaggttgagaagggctcagagtatgcaatcacattcagtgccgcccggacgtgtgcgcagctggaggcgctgaatgtgtctgctgggggtgtatcacagacagtagaccttcagacattgtacaacatcgaaggctgggatgcatatgcactggcttttcaagcagtggatgagcaggcaacccttgaattcaggaaccccggcatggaggatgatccaacctgtggacctatccttgacaatgtggccatcaagaagctctttgctccggacaaaccaaaggatagcacggtgatcaatggagactttgaggagggtccatggatgtttccaaacacaagctttggtgttctactcccgacgaaccttgatgaacagacatcagccataccaggatggatgattgagtcgaaccgtgcagtccgcttcgttgactctgaccagtacagcgttccccaggggaagcgcgcgattgagctcctctccggcaaagagggaattatctcacagatggtggagacaacccctcagaaagtgtacagcctgactttcacatttggctcagcaggcgattcatgccagccaccaatggctgtcatggcatttgcaggcgatcaggcccagaacttccactactcgccgatgggcaatgccacaagccaagctgcaaatgtgacgttcacagcgcgtgctgaaaggacgcgcattgcgctctacagcgtgtactacaacacgagaagcgacgaccacagctcactatgcgggccggtggtcgacgatgtgcgggtctggggcttgaatggggctgctgggttgaaggcaagtattgggctgcttcttggtatggttagtgttgttggcctgatgatgttctgaatttcttagtggtgaggtttaaggatatatgtacgtaacctcccctgtaaggatgaggaggccactagttttggtagtaagcttgagatttctatgtgattgagtaatgtgagct

SEQ ID NO: 4908 - DNA, 1523 bp, Leymus cinereus x Leymus triticoides
  misc_feature (5)..(7): n is a, c, g, or t
  misc_feature (1135)..(1135): n is a, c, g, or t
actcnnncgaggacgaaagggtgtaggaggagatgggggattgagggaggggactagctaggcggaggaggagatggggcgagggctcgcattgctggggctggcgcttcttctgctggcaccctctcctcgtctggcctcggccgctccggtggaggacggcctgctcatcaatggtgatttcgagacagcgccacctggcggtttcgtcaaatctgcttctgtttccgagggcgcagcgatcccaagttggacgatcaatggaacagtcgagctcatttctgcaggccagcaccagggtggcatgatccttattgttccacaaggggatcatgctgtacggctagggaatgatgcaggtattgggcaggttgtgcaggttgagaagggctccgagtatgcaatcacattcagtgccgcccggacttgcgcgcagctggagtcactgaatgtctccgctgggagcgtgtcgcagacagtagacttgcagacactgtacagcatagagggctgggatgcatatgcactggcttttcaagcagtggatgagcaggccaaccttgagtttaggaaccctggcatggaggacgacccaacttgtgggcctatccttgacaacgtggccatcaaaaagctcttctcccccgacaaacctaaggagaacatggtgatcaatggagactttgaggaggggccatggatgtttccaaacacaagcttcggtgtcctgctcccgacgaaccttgacgagcagacatcagccttaccagggtggatggttgagtcgaaccgcgcagtccgcttcgtcgactccgaccagtacaccgttccccaggggaagcgtgccattgagcttctctccggcaaggagggcattatcgcgcagatggttgagacaacccctcagaaggcctacagcctgacgttcacgctgggctcggcaggtgattcatgccagccaccaatggccgtcatggcattcgcaggcgaccaggcccagaacttccactacgcccctatgggcaatgccacgagccaggctgtgaacgtgaacttcacagcgcgtgctgagaggacgcgcgttgcgctctacagcatctactacaatacgagaagcgacgaccacagctcactntgcgggccggtgatcgacgacatccgtgtctggggcttgaatggggctgctggcttgaaggcaagtatcgggatgcttattgccatggttagtgccatcgttcttgtgctgttctgaatatacgtatgtaacctcccctgcaaggacgaggaggccactagttttattagtaagcctgaggtttctatgagattgatgagtaatgtgagcttaggctaaagctaccagtagctataaatggttgtttgttgctttcttttgagtgattcagaaagtagcaagccatgatgggattgcgtggttagtgagccaagggcttgtactgtgagatgtaagaactgttccaaagttcatctcttcaatgcatcagtaagttcagaaaaaaaaa

SEQ ID NO: 4909 - DNA, 1668 bp, Hordeum vulgare
cggcacgaggaatccgagcaccataaaaagcagggcgtgggcaggcgagcagagcgcaagcagagtcgcttggctgcacccggcaccgctgcccccttcttctcgtcagccgcatctcccactcacctcactcccactcccaccccccactcttctacgcatcgaggacgaaagggtagggtggtggtgactggtgagggagccggggagccgagggggcgagctgccaggcggaggaggagatggagcgagggctcgcattgctggggctggggctggcgctgcttctgctggcgccctctcgccgcctggcctcggccgctccggtggaggacggcctgctcatcaatggcgatttcgagacagcaccgcctggtggtttcgtcaaatcttcttctgtttcggagggcgcagcgatcccaagctggacgatcaatggaacagttgagctcatttccgcaggccagcaccagggtggcatgatccttattgttccacaaggggatcatgccgtacggctagggaatgatgcaggcattgggcaggtggtgcaggttgagaagggctccgagtacgcgatcacattcagtgccgcccggacctgcgcgcagctggagtcactgaatatctccgctgggagcatatcgcagacagtcgacttgcagacactgtacagcatagaaggctgggatgcatatgcactggctttccaagcagtggatgagcaggccaacattgaatttaggaaccctggcatggaggacgacccaacctgcgggcctatccttgacaacgtggccatcaagaagctcttctcccccgacaaagcaaaggagaacatggtgatcaatggagactttgaggaggggccatggatgtttccaaacacaagcttcggcgtcctgctcccgacaaaccttgacgagcagacatcggccttaccagggtggatgatcgaatcgaaccgcgcagtccgcttcatcgactccgaccagtacactgttccccaggggaagcgcgccattgagcttctctccggcaaggagggcatcatctcgcagatggttgagacgacccctcagaaggcgtacatcctgacgttcacgctgggctcggcaggcgattcgtgccagccaccaatggccgtcatggcattcgcaggcgatcaggcccagaacttccactactcccctatgggcaatgccacgagtcaggccgtgaacgtcaacttcacagcgcgcgccgagaggtcacgcgttgcgctctacagcgtctactacaacacgagaagcgacgaccacagctcgctgtgtgggccggtgatcgacgacgtccgtgtctggggcttgaatggggctgctgggttgaaggcgagcatcgggatgcttattgccatggttagtgtcatcgttctcgtgctgttctgaatatatactacatatgtgacctcgcctgcaaggacgaggaggccacttagttttgttagtaagcctgaggtttctatgagattgagtaatgtgagcttaggctcaagctaccagtagctataaatggttgttctgttgctttcttgtgtgattctgaaagtagcaagccatgatgggattgcgtggttagtgagccgggcttgtaatgtgagatgtaagaattgttccaagttcatctctt

SEQ ID NO: 4910 - DNA, 1823 bp, Hordeum vulgare
gcgaaccaagcgccaaagaaaagggaatccgagcaccataaaaagcagggcgtgggcaggcgagcagagcgcaagcagagtcgcttggctgcacccggcaccgctgcccccttcttctcgtcagccgcatctcccactcacctcactcccactcccacccccccactcttctacgcatcgaggacgaaagggtagggtggtggtgactggtgagggagccggggagccgagggggcgagctgccaggcggaggaggagatggagcgagggctcgcattgctggggctggggctggcgctgcttctgctggcgccctctcgccgcctggcctcggccgctccggtggaggacggcctgctcatcaatggcgattttgagacagcaccgcctggtggtttcgtcaaatcttcttctgtttctgagggcgcagcgatcccaagctggacgatcaatggaacagttgagctcatttccgcaggccagcaccagggtggcatgatccttattgttccacaaggggatcatgccgtacggctagggaatgatgcaggcattgggcaggtggtgcaggttgagaagggctccgagtatgcaatcacattcagtgccgcccggacctgcgcgcagctggagtcactgaatatctccgctgggagcatatcgcagacagtcgacttgcagacactgtacagcatagaaggctgggatgcatatgcactggctttccaagcagtggatgagcaggccaacattgaatttaggaaccctggcatggaggacgacccaacctgcgggcctatccttgacaacgtggccatcaagaagctcttctcccccgacaaagcaaaggagaacatggtgatcaatggagactttgaggaggggccatggatgtttccaaacacaagcttcggcgtcctgctcccgacaaaccttgacgagcagacatcggccttaccagggtggatgatcgaatcgaaccgcgcagtccgcttcatcgactccgagcagtacactgttccccaggggaagcgcgccattgagcttctctccggcaaggagggcatcatctcgcagatggttgagacgacccctcagaaggcgtacatcctgacgttcacgctgggctcggcaggcgattcgtgccagccaccaatggccgtcatggcattcgcaggcgatcaggcccagaacttccactactcccctatgggcaatgccacgagtcaggccgtgaacgtcaacttcacagcgcgcgccgagaggtcacgcgttgcgctctacagcgtctactacaacacgagaagcgacgaccacagctcgctgtgtgggccggtgatcgacgacgtccgtgtctggggcttgaatggggctgctgggttgaaggcgagcatcgggattcttattgccatggttagtgtcatcgttctcgtgctgttctgaatatatactacatatgtgacctcgcctgcaaggacgaggaggccacttagttttgttagtaagcctgaggtttctatgagattgagtaatgtgagcttaggctcaagctaccagtagctataaatggttgttctgttgctttcttgtgtgattctgaaagtagcaagccatgatgggattgcgtggttagtgagccgggcttgtaatgtgagatgtaagaattgttccaagttcatctcttcaatgcattagaaagttcagaagtcctatctctgcttttctttggcttcttgtctgaatcttatctgtggcagtgacgattttgtagcgacctgccaatattactggagtacaatacattacgttatggacgattttgc

SEQ ID NO: 4911 - DNA, 1668 bp, Triticum aestivum
tcatcgctgtctggaacagcgatgactcgagaagcagagtctcttggctgcacccgtcaccggttcccccatcttcgtcagcttgcaatctccactcacctcactcccactccacctcccacctcccactcttctccatatcgaggacgaaagggtgaggagggagctgggggactagctgctacgcggaggaggaggagatggagcgagggctcgcattgctgggtctggggctggcgcttctcctgctggcgccctctcgtcgtctcgcctcggccgctccggtggaggacggcctgctcatcaatggtgatttcgagacagcgccacctggcggtttcgtcaaatctgcttcagtttccgagggcgcagcgatcccaagctggacgatcaatggaacagttgagctcatttccgcaggccagcaccagggtggcatgatccttattgttccacaaggggatcatgctgtgcggctagggaatgatgcaggcattgggcaggtggtgcaggttgagaagggctcagagtacgcgatcacattcagtgccgcccggacctgcgcgcagctggagtcactgaacatctccgctgggagcgtttcgcagaccgtcgacttgcagacactgtacagcatagaaggctgggatgcatatgcactggctttccaggcagtggatgagcaggccagcattgagtttaggaaccctggcatggaggacgacccgacctgcgggcccatcctcgacaacgtggccatcaagaagctcttctcccccgacaaagcaaaggagaacatggtgatcaatggagacttcgaggaggggccatggatgtttccaaacaccagcttcggcgtcctgctcccgacgaacctcgacgagcagacgtcggccttgccagggtggatgatcgagtcgaaccgcgcagtccgcttcgtcgactccgaccagtacaccgtgccccaggggaagcgcgccatcgagcttctctccggcaaggagggcatcatctcgcagatggtggagacgacccctcagaaggcgtacaccctgacgttcacgctcggctcggcaggcgattcgtgccagccgccgatggccgtcatggcgttcgccggcgaccaggcccagaacttccactacgcccccatgggcaacgccacgagccaggccgtgaacgtgaacttcacggcgcgtgccgagaggacgcgcgttgcgctctacagcgtctactacaacacgagaagcgacgaccacagctcgctctgcgggccggtgatcgacgacgtccgcgtctggggcttgaatggggctgctgggctgaaggcgagcattgggctgcttattgccatggctagtgtcatcgttctcgtgctgttctgatcttctgaatatacgtatgtaacctcccctgcaaggacgaggaggccactagttttgttagcagtaagcctgaggtttctgtgagattgatgagtaatgtgagcttaggctaaagctaccagtagctgtaagtggtggttttgttgctttcttgtgtgattcagaaagtagcaagccatgatgggattgcgtggtaaaatgtgagatgtaagaattgttccaacttcatctcttcaatgcattagaaagttcagaaaaaaaaaaaaaaagggcggccgctcta

SEQ ID NO: 4912 - DNA, 1659 bp, Triticum aestivum
tcatcgctgtctggaacagcgatgactcgagaagcagagtctcttggctgcacccgtcaccggttcccccatcttcgtcagcttgcaatctccactcacctcactcccactccacctcccacctcccactcttctccatatcgaggacgaaagggtgaggagggagctgggggactagctgctacgcggaggaggaggagatggagcgagggctcgcattgctgggtctggggctggcgcttctcctgctggcgccctctcgtcgtctcgcctcggccgctccggtggaggacggcctgctcatcaatggtgatttcgagacagcgccacctggcggtttcgtcaaatctgcttcagtttccgagggcgcagcgatcccaagctggacgatcaatggaacagttgagctcatttccgcaggccagcaccagggtggcatgatccttattgttccacaaggggatcatgctgtgcggctagggaatgatgcaggcattgggcaggtggtgcaggttgagaagggctcagagtacgcgatcacattcagtgccgcccggacctgcgcgcagctggagtcactgaacatctccgctgggagcgtttcgcagacagtcgacttgcagacactgtacagcatagaaggctgggatgcatatgcactggctttccaagcagtggatgagcaggccagcattgagtttaggaaccctggcatggaggacgacccgacctgcgggcctatccttgacaacgtggccatcaagaagctcttctcccccgacaaagcaaaggagaacatggtgatcaatggagactttgaggaggggccatggatgtttccaaacacaagcttcggcgtcctgctcccgacgaacctcgacgagcagacgtcggccttgccagggtggatgatcgagtcgaaccgcgcagtccgcttcgtcgactccgaccagtacaccgtgccccaggggaagcgcgccatcgagcttctctccggcaaggagggcatcatctcgcagatggtggagacgacccctcagaaggcgtacaccctgacgttcacgctgggctcggcaggcgattcgtgccagccgccaatggccgtcatggcgttcgccggcgaccaggcccagaacttccactacgcccccatgggcaacgccacgagccaggccgtgaacgtgaacttcacggcgcgcgccgagaggacgcgcgttgcgctctacagcgtctactacaacacgagaagcgacgaccacagctcgctctgcgggccggtgatcgacgacgtccgcgtctggggcttgaatggggctgctgggttgaaggcgagcattgggctgcttattgccatggctagtgtcatcgttctcgtgctgttctgatcttctgaatatacgtatgtaacctcccctgcaaggacgaggaggccactagttttgttagcagtaagcctgaggtttctatgagattgatgagtaatgtgagcttaggctaaagctaccagtagctgtaagtggttgttttgttgctttcttgtgtgattcagaaagtagcaagccatgatgggattgcgtggtcactgagccaagggcttgcaatgtgagatgtaagaattgttccaagttcatctcttcaatgcattagaaagttcagtaa

SEQ ID NO: 4913 - DNA, 1754 bp, Secale cereale
gactatccgggtagcataaaaagcagggcgtgggcgggcgagcagagcgcaggcagactcgcttggccgcacccggcaccggtgtcccctacccttcttcgtcagccgcatctcccactcccacccccactcttctacatatcgaggacgagagggtggcgagggagctcgagaaccgaagggactagcaggctaggcggaggaggagatggagcgagggctcgcattgctgctggggctgctgccgcttcttctgctggcgcccgcttctcgcctggcctcggctgctccggtggaggacggcctgctcatcaatggtgattttgagacagcaccacctggcggtttcgtcaaatcggcttctgtttccgagggcgcagcgatcccaagttggacgatcaatggaacagttgagctcatttccgcaggccagcaccagggtggcatgatccttattgttccacaaggggatcatgctgtacggctagggaatgatgcaggcattgggcaggtggtgcaggtggagaagggctcagagtactcaatcacattcagtgccgcccggacctgcgcgcagctggagtcactgaacatctccgctgggagcgtatcgcagacagtcgacttgcagacgctgtacagcatagaaggctgggatgcgtatgcactggctttccaagcagtggatgagcaggccaacattgagtttaggaaccctggcatggaggacgacccaacctgtgggcctatccttgacaacgtggccatcaagaagctcttctcccccgacaaagcaaaggagaacatggtgatcaatggagactttgaggaggggccatggatgtttccaaacacaagcttcggcgtcctgctcccgacgaacctcgacgaggagacatcggccttgccagggtggatgatcgagtcgaaccgcgcagtccgcttcgtcgactccgaccagtacaccgttccccaggggaagcgcgccatcgagcttctctccggcaaggagggcatcatctcgcagatggttgagaccacccctcagaaggcgtacagactgacgttcacgctcggctcggccggtgattcgtgccagccgccaatggctgtcatggcgttcgccggcgaccaggcccagaacttccactactcccccatgggcaacgccacgagccaggctgtggacgtgaacttcacggcgcgcgccgagaggacacgcgtcgcgctctacagcgtctactacaacacgagaagcgacgaccacagctcgctctgcgggccggtgatcgacgacgtccgcgtctggggcttgaacggcgctgctgggctgaaggcgagcatcggtatgcttattgccatggctagtgtcatcgccctcgtcgtgctgttctgaacatactacatatgtaacctcccctgcaaggacgaggaggccactagttttgttagcagtaagcctgaggtttctgtgagattgatgagcaatgtgagcttaggctaaagctaccagtagctgtaagtggttgttttgttgctttcttgtgtgattcagaaagtagcaagccatgatgggattgcgtggtcagtgagccaagggcctgtaatgtgagatgtaagaattgttccaagttcatctcttcaatgcattagaaagttcagaaaaaaaaaaaaaaaaaaaaaaaaaaaaaacaaaaactagaagactacgacgaacggacaacgacggagggtagaggccccccccccccccc

SEQ ID NO: 4914 - DNA, 1607 bp, Secale cereale
gactatccgggtagcataaaaagcagggcgtgggcgggcgagcagagcgcaggcagactcgcttggccgcacccggcaccggtgtcccctacccttcttcgtcagccgcatctcccactcccacccccactcttctacatatcgaggacgagagggtggcgagggagctcgagaaccgaagggactagcaggctaggcggaggaggagatggagcgagggctcgcattgctgctggggctgctgccgcttcttctgctggcctcggccgctccggtggaggacggcctgctcatcaatggtgattttgagacagcaccacctggcggtttcgtcaaatcggcttctgtttccgagggcgcagcgatcccaagttggacgatcaatggaacagttgagctcatttccgcaggccagcaccagggtggcatgatccttattgttccacaaggggatcatgctgtacggctagggaatgatgcaggcattgggcaggtggtgcaggtggagaagggctcagagtactcaatcacattcagtgccgcccggacctgcgcgcagctggagtcactgaacatctccgctgggagcgtatcgcagacagtcgacttgcagacgctgtacagcatagaaggctgggatgcgtatgcactggctttccaagcagtggatgagcaggccaacattgagtttaggaaccctggcatggaggacgacccaacctgtgggcctatccttgacaacgtggccatcaagaagctcttctcccccgacaaagcaaaggagaacatggtgatcaatggagactttgaggaggggccatggatgtttccaaacacaagcttcggcgtcctgctcccgacgaacctcgacgaggagacatcggccttgccagggtggatgatcgagtcgaaccgcgcagtccgcttcgtcgactccgaccagtacaccgttccccaggggaagcgcgccatcgagcttctctccggcaaggagggcatcatctcgcagatggttgagaccacccctcagaaggcgtacagactgacgttcacgctcggctcggccggtgattcgtgccagccgccaatggctgtcatggcgttcgccggcgaccaggcccagaacttccactactcccccatgggcaacgccacgagccaggctgtggacgtgaacttcacggcgcgcgccgagaggacacgcgtcgcgctctacagcgtctactacaacacgagaagcgacgaccacagctcgctctgcgggccggtgatcgacgacgtccgcgtctggggcttgaacggggctgctgggctgaaggcgagcatcggtatgcttattgccatggttagtgtcatcgttctcgtcgtgctgttctgaatatactacatatgtaacctcccctgcaaggacgaggaggccactagttttgttagcagtaagcctgaggtttctgtgagattgatgagtcatgtgagcttaggctaaagctaccagtagctgtaagtggttgttttgttgctttcttgtgtgattcagaaagtagcaaagccatgatgggattgcgtggtcagtaagccaagggcttgtaatgtgagatgtaagaatt

SEQ ID NO: 4915 - DNA, 1598 bp, Triticum aestivum
caccggtgtccccttcttcgtcagcttgcaatctccacccacctcactcccactcccacctcccaccccccgctcttctacacatcgaggacgaaacggtggtgagggagccgggggactagctgctaggcggaggaggagatggagcgagggctcgtcgcattgctgggtctggggctggcgcttcttctgctggcgccctcccgtcgtctcgcctcggccgctccggtggaggacggcctcctcatgaatggtgatttcgagacagcaccacctggcggtttcgtcaaatctgcttcagtttccgagggcgcagcgatcccaagctggatgatcaatggaacagttgagctcatttccgcaggccagcaccagggtggcatgatccttattgttccacaaggcgatcatgctgtgcggctagggaatgatgcaggcattgggcaggtggtggaggttgagaagggctcagagtacgcgatcacattcagcgccgcccggacctgcgcgcagctggagtcactgaacatctccgctgggagcgtgtcgcagacagtcgacctgcagacactgtacagcatagaaggctgggatgcatatgcactggctttccaagcagtggatgagcaggccagcattgagttcaggaaccctggcatggaggacgacccgacctgtgggcctatccttgacaacgtggccatcaagaagctcttctcccccgacaaagcaaaggagaacatggtgatcaatggggactttgaggaggggccatggatgtttgcaaacacaagcttcggcgtcctgctcccgacgaacctcgacgagcagacgtcggccttgccggggtggatgatcgagtcgaaccgcgcagtccgcttcgttgactccgaccagtacaccgttccccaggggaagcgcgccatagagcttctctccggcaaggagggcatcatctcgcagatggtggagacgacccctcagaaggcgtacaccctgacgttcacgctgggctcagcaggcgattcgtgccagccgccaatggccgtcatggcgttcgccggcgaccaggcccagaacttccactacgcccccatgggcaacgccacgagccaggccgtgaacgtgaatttcacggcgcgcgccgagaggacgcgcgtcgcgctctacagcgtctactacaacacgagaagcgacgaccacagctcgctctgtgggccggtgatcgacgacgtccgcgtctggggcttgaacggggctgctgggttgaaggcgagcatcaggatgcttattgccatggctagtgtcatcgttcttgtgctgttctgatcttctgaatatacgtacgtatgtaacctcccctgcaaggacgaggaggccactagttttgttagcagtaagcctgaggtttctatgagattgatgagtaatgtgagcttaggctaaagctaccagtagctgtaagtggttgttttgttgctttcttgtgtggttcagaaagtagcaagccatgatgggattgcgtggtcagtgagccaagggcttgtgatgtgagatgtaagaattgtttcaagttcatctcttcaatgcagtagaaa

SEQ ID NO: 4916 - DNA, 1315 bp, Secale cereale
gactggcacagtcgcttggccgcacccggcaccggtgtcccctacccttcttcgtcagccgcatctcccactcccacccccactcttctacatatcgaggacgagagggtggcgagggagccggggaacggaagggactagcaggctaggcggaggaggagatggagcgagggctcgcattgctgctggggctgctgccgcttcttctgctggcgcccgcttctcgcctggcctcggctgctccggtggaggacggcctgctgatcaatggtgattttgagacagcaccacctggcggtttcgtcaaatcggcttctgtttccgagggcgcagcgatcccaagttggacgatcaatggaacagttgagctcatttccgcaggccagcaccagggtggcatgatccttattgttccacaaggggatcatgctgtacggctagggaatgatgcaggcattgggcaggtggtgcaggtggagaagggctcagagtactcaatcacattcagtgccgccggacctgcgcgcagctggagtcactgaacatctccgctgggagcgtatcgcagacagtcgacttgcagacgctgtacagcatagaaggctgggatgcgtatgcactggctttccaagcagtggatgagcaggccaacattgagtttaggaaccctggcatggaggacgacccaacctgtgggcctatccttgacaacgtggccatcaagaagctcttctcccccgacaaagcaaaggagaacatggtgatcaatggagactttgaggaggggccatggatgtttccaaacacaagcttcggtgtcctgctcccgacgaacctcgacgaggagacgtcggccttgccagggtggatgatcgagtcgaaccgtgcagtccgcttcgtcgactccgaccagtacaccgttccccaggggaagcgcgccatcgagcttctctccggcaaggagggcatcatctcgcagatggtcgagaccacccctcagaaggcgtacagactgacgttcacgctcggctcggccggtgattcgtgccagccgccaatggctgtcatggcgttcgccggcgaccaggcccagaacttccactactcccccatgggcaacgccacgagccaggctgtggacgtgaacttcacggcgcgcgccgagaggacacgcgtcgcgctctacagcgtctactacaacacgaggagcgacgaccacagctcgctttgcgggccggtgatcgacgacgtccgcgtctggggcttgaacggggctgctgggctgaaggcgagcatcggtatgcttattgccatg

SEQ ID NO: 4917 - DNA, 1571 bp, Secale cereale
cccccggcacccggtgtcccctacccttcttcgtcagccgcatctcccactcccacccccactcttctacatatcgaggacgagaggtggcgagggagctcgagaaccgaagggactagcaggctaggcggaggaggagatggagcgagggctcgcattgctgctggggctgctgccgcttcttctgctggcctcggccgctccggtggaggacggcctgctcatcaatggtgatttcgagacagccccgcctggtggtttcgttaaatctgcttcagtttccgagggcgcagcaatcccaagttggacgatcaatggaacagttgagctcatttccgcaggccagcaccagggtggcatgatccttattgttccacaaggcgatcatgctgtacggctggggaatgatgcgggcattgggcaggtggtgcaggttgagaagggctcagagtactcaatcacattcagtgccgcccggacctgcgcgcagctggagtcactgaacatctccgctgggagcgtatcgcagacagtcgacttgcagacgctgtacagcatagaaggctgggatgcgtatgcactggctttccaagcagtggatgagcaggccaacattgagtttaggaaccctggcatggaggacgacccaacctgtgggcctatccttgacaacgtggccatcaagaagctcttgtcccccgacaaagcaaaggagaacatggtgatcaatggagactttgaggaggggccatggatgtttccaaacacaagcttcggcgtcctgctcccgacgaacctcgacgaggagacgtcggccttgccagggtggatgatcgagtcgaaccgcgcagtccgcttcgtcgactccgaccagtacaccgttccccaggggaagcgcgccatcgagcttctctccggcaaggagggcatcatctcgcagatggtcgagaccacccctcagaaggcgtacagactgacgttcacgctcggctcggccggtgattcgtgccagccgccaatggctgtcatggcgttcgccggcgaccaggcccagaacttccactactcccccatgggcaacgccacgagccaggctgtggacgtgaacttcacggcgcgcgccgagaggacacgcgtcgcgctctacagcgtctactacaacacgagaagcgacgaccacagctcgctttgcgggccggtgatcgacgacgtccgcgtctggggcttgaacggggctgctgggctgaaggcgagcatcggtatgcttattgccatggttagtgtcatcgttctcgtcgtgctgttctgaacatactacatatgtaacctcccctgcaaggacgaggaggccactagttttgttagcagtaagcctgaggtttctgtgagattgatgagcaatgtgagcttaggctaaagctaccagtagctgtaagtggttgttttgttgctttcttgtgtgattcagaaagtagcaagccatgatgggattgcgtggtcagtgagccaagggcctgtaatgtgagatgtaagaattgttccaagttcatctcttcaatgcattagaaagt

SEQ ID NO: 4918 - DNA, 2002 bp, Zea mays
atccaataaccgctcggtgagcgcacaaagccccaccgctcaccgatgttgtagctgcactgcactgttgcagctaacagttttagcacgccaatctactttctcttttacgtctcgatcagtcattttcagggtccatcagacaatttttttttaccgggaaacaccgtcaccatgttttgaagtgcacgccaactccgaaagagctgaggtggccagtgcgcggatgcgccgcccggtgactgtgagccggtgacctgaaccgagcgcgcacccctcgcggagttcagtcgcgcacaccaacagggcaatgggcacggaagggaacaaaagcacccggttcgcctccaccccgcgcatcccttcggcttaaaatctcccctataggccccttcgcctccctccgattcccatcccttcggcgaccagtggcttcttcctcatcgcgcactttaaaatccccgcgccgcctccccacttcctccccaccccgcgcatcgactcctccttcacccgcatagcgtagtaccatggccgccgcggcgcaccaggtctccgccgtgatctttgatctcgacggcactctccttgacacagagagggcgacaagggacgtcctcaccgaattcctggcggcatacgggaaggtccccgatgcgggggaggaggagaagaggctggggcagatgtatttggaatccaccaccgggatcatcagagactacggcctgccgctcacggtcgacgagtactccaaggcgatgtatcccctgtacctgaaaaggtggcaaaaggcaaaaccgcttccgggagtgaagaggcttgttaagcatcttcacaagaacggagtgccactcgcacttgcttctaactccattaggagaaatgttgatcacaagcttccgaaactagaagattggggaaagtgtttttctgttattcttggtggagatcaagtcccaaatggaaaaccttcccctgacatatttttggaggctgcaaagaggcttggtgcaaatccatcgtcttgcttggttatagaagattctgtcgttggagtcaagggtgccaaggcttctggggcaaaggcagttgcagtaccatcacttcaaaatcagaggaaccactattacattgctgatgtcatcctatattcgcttttggactttcaacctgagatgtggggtcttcctccatttgaagatcgcattcaaggtgttctgccaattgatcccttactttcaaatgcccggataggtggtaaaattttgaacaacattcattgggtaatttcagatgactgtgcctacgagtatattcctgaccaaatatcaggaatttttttgggttgggccaagtccaaagtgcatggattctccaaggtgatcgtagctactgggtgggacttctcacagcagaccgtcgagagagtgatgcatgtacattttcttgattgctctggcacggttgaaacagagcctgtgaagctgctcataattggttacatccggaagctccaaagtgcagatgatatattgcaagcattaagcgtaactgacgaagacaggagaattgcaagggatgcattggatctcccaactttctctgaatatgctaatgaccttcatcttgcctgagtccggctttgtcattgcaagctctcacctcactacctcacgtttgtatttgttattgttaacaagcaaacatgatgatgccagctgcgttttcttctatgaagacttcatatggaatgcacttcttgctcggagaagattagagaagagaagggcggaaggcatgaagcttgtctttcatctagaggtccatcgatgttatcgtatgctgtaaaattttcacgtttaatttttatatactctcttcatccacaaatctagctcaagctaagtttgtagtaaagaatgttagcacttacatataaaattaaagttattataacaatatattttataactaatataatggtacttattatgtatta

SEQ ID NO: 4919 - DNA, 1532 bp, Setaria italica
tctcatccgctcgacggccacggcaagtggcctcctcctcctcacgcacttaaaatccccccgcgcgccgccaccccgctttctccccatcccgcccatccactccgcgcctcgaccagaccatggcagcggcacaccaggtctccgccgtgatcttcgacctcgacggcaccctcctggacacagagagggcgacgagggatgtcttgaacgaattcttggcgtcgtacgagaaggtccctgacccggagaaggaagagaagaggctgggccagatgtacatggaatccaccaccgggatcatcagagattacgggctgccgctgaccgtcgaggagtactccaaggcgatgcatccactctacctgaaaaggtggcaaaaggcaaagccgcttccaggagtgaagaggcttgtcaagcatctttacaagaatggagtgccactcgcacttgcttcaaactccatcaggagaaatattgatcacaagcttccgaaactagaagattggggagagtgtttttctgttattcttggtggagatcaagtccctaatggaaaaccttcccctgacatatttctggaagctgcaaagagacttggcgtaaatccatcatcatgcttggtcatagaagattctgtcgttggagtcaagggtgccaaggcttctggggcaaaggcagttgcggtaccatcacttcaaagtcaaaggaagcactattacattgccgatatcatcctctattcgcttttggacttcgatcctgagctgtggggtcttcctccatttgaagatcgcgtccatggtgttttgcccattgatcccttactttcaactgctcaaataggtgataggattttaaacaatcttcatagggtaatttcagacgtacatacctacgaatgtattcctgaccaaatatcaggaatttatatgggttgggccaggtccaaagtgcatggattctctaaggtggtcattggtactgggtgggacttttcacagcagaccgtcgagagagtgatggtagtagagtttcttgattccactggcaagattgaaacagagcctgtgaagcttcttgtaattggttacatccggaagctacaaagcacagatgatatgttgcaagctttaagtgtaactgacgaagacaggagcattgcaagggatggactggacctcccaactttctctgaatatgcccacgaccttcattttccctgaatgtggccatatgattgcaagctctcacagcactaccttagggttggcattgttattgttagctcacaaacattatgccagcttcatttacgtctaggaagactacacgaaatacgtgtatttgaagaagaggaaaagggtacagaaggaatgaagtttgttgtcatcttagaggtggttggatgttaccatatgctgtaataattgtcttggcttcatgtcttattttgaaaaaaaatatcattgcatctgcaccttccttaaggggcagagagatagaaaaaattgcaagcatatagattattc

SEQ ID NO: 4920 - DNA, 1819 bp, Panicum virgatum
cagacgacaccgacggtgagcgatgcgagcagaggacgcggccggggttcggcgatcaggtaatattccttgctcgaatagtttattccacctgtgcagtaaccgcacggtgaacgtactaaacctcaccgctcgccgccaccatgcctcaccggtgcgccggactagcggtggcgcggtgacccgagccgagcgcgcacgccccgcgccgccgcacggcgtcggcccacgccccacgatggcaagagcaacagggcaggcacggaacaaaagcacccggttcggttctaccccgcgagccaaccagacccgattctgccaattggcatagtggcatcccccctcggcggccacggccagtggcctccgcctcctcacgcacttaaatcccccgcgccgcctccccgtttcctccccatcccgcgccctcgccttctcatcgccccatcgcctcgaccatggcggcggcgcaccaggtctccgcggtgatcttcgatctcgacggcaccatcctggacacagagaggacgacgagggatgtcttggacgagttcttggcggcgtacgggaaggtccctgacccggagaaggaagagaagaggctgggccagatgtacttggaatccaccaccgggatcatcagagattacggactgccgctgaccgtcgaggagtactccaaggcgatgcatccactctatctgaaaaggtggcaaaaggcaaaaccgcttccgggagtgaagaggcttgttaagcatcttttcaagaacagagtgccactcgcgattgcttcaaattccgtcaggagaaatattgatcacaaagttccaaaactagaagattggggagagtgtttttctgttattcttggtggagatcaagtccctaatggaaagccttcccctgacatatttttggaagccgcaaagcgacttggcgtaaatccatcatcatgcttggtcatagaagattctgttgttggagtcaagggtgccaaggcttctgaggcgaaggtggttgcagtaccatcacttcaaagtcaaaggaagcactataatattgccgatatcatcctctattcacttttggacttcgatcctgagctgtggggtcttcctccatttgaagatcgcattcaaggtgttttgcccattgatcccttaatttcaactggtcaaataggcgatagaattctaaataatcttcataggctaatttcagatgaacgtacctacgactgtattcctgaccaaatatcaggaatttatttgggttgggccaagttgaaagtgcatgggttttctaaggtggtcataggtactgggtgggacttttcacagcagaccgtcgaaagagtgatggtagtagagtttcttgattactctggccagattgaaacagagcctgtgaagcttcttgtaattggttacgtcaggaagctacaaagcacagatgatatattgcaagctttaaatgtaactgatgaagacagaagcattgcaagggacgcattggacctcccaactttctctgaatacgcccacgacattcatttttcctgagagtgaccgcccacgacattcatttttcctgagagtgaccgtatctttgcgagctctcacaccatttcctcaggtttggcattgttattgttagctcatgatggagccacatttcgtccaggaaactctacatgaatacgtgtcattcgaagaacaggaaaaaagtacagagaaaaaaacgtggttcgatgttaccaatttaccatatgttgtaatatttgtttagtctcatgtctctagaaatatcattgcatctg

SEQ ID NO: 4921 - DNA, 1446 bp, Zea mays
aattggcctggctacccagacaagagcacgcaacgcaagcaactgcgacgtctcccgcccccgccgcgccccggaccttttccgcagatattttttttatccccccacgcccccggctcgttcccttccattccaccacctctcgccagacaacgagatgtgcgaggcaccgcggctcggcaaccgcgccggcgccggcgacccggccgccgccgacgtcgacgtcgtcacgacgggcgggcgccggaggatccccgcgcattcctctgtcctggcctcggcgtcgccggtgctcggcagcatcctggagcgtcgcctgcggaaggacagggagagcggcaagcccgggcggtccgtcgtccggatccgcggcgtcaccgacgacgccgccgcggccttcgtccgcctcctctacgccggcaggtgcggcgaggatgaggatgacgacatggaggagcacgcggtgcaggtgctggtgctggcgcacgcgtaccaggtgccgtggctgaagcgggcgtgcgagggcgccatcggcgcgcgcctcaccgcggactcggtggtggacgtgctgcagctggccggcctctgcgacgcgccgcgcctgcacctgcgctgcgccaggctgctggccaaggagttcgcggccgtggagcgcaccgaggcctggcgcttcctgcaggagaacgacccctggcaggagctccacgtcctgcagcgcctgcacgaggccgacatgcggcggcgcaagtggcggcggaagcgcgcggagcagcgcgtgtacatggagctgagcgaggccatggactgcctggaccacatctgcacggagggatgcacggaggtcggcccggcggggcgggcgccggcgccggcgccgtgcgcgcgctacgccacgtgccggggcctgcagctgctcatccgccacttctcccagtgccaccgcaagagctgcgcgcggtgccagcgcatgtggcagctgctccgcctccactccgcgctctgcgaccgtaccgaccgctgcaacaccccgctctgcatgaggtttaagcagcaggagcaggataaggcggctgccaagggcggcgatgatggcgacaaatgggggcttctggtgaagaaggtgaagactgccagggtcttctcttctctggccaacaggaagcagatgagcaccaccaccacccagtgctgaggagcagcctgggatgcttaggggtcaaagttagattagtgagagagaatgaagcgagcagtttttttttgggtctgttttgagatgtcagatctcttttgagatatgtacatgtacatgcctactttgtcaccctacgttggtatagctcttttatcgaggtgggagttggtcagccggaagtctatgtaaaaagtgcgcatgtatcattatataataatagggaaatatgagaagtattttagtcttatgat

SEQ ID NO: 4922 - DNA, 1574 bp, Setaria italica
ctccctcgcagcagacgcagcagagcacgcagcgacgtctcccccgtcgccgtccgtccccaacccaaacatctcgcgcgctcctcttgccaccagatatttttttattgttcccctgcgagctggttcctcccatttcctcgccgtcgcgtcgtgattcttatccgccgccggtgaaccggaggagaagatgtgcgaggcgccacggctccgctgcgacgccggcgccggcgaagcggtcgccgccgctgatgtcgacgtcgtgaccaccagaggccgcaggaggatcccggcgcattcctctgtcctggccacggcgtcgccggtgctggggtgcatcctggagcggcgcctgcggaaggacagggagagcggcaagaaggccgggcggtccgtcgtccggatccgcggcgtcaccgacgacgccgcggccgcgttcgtccgcctcctctacgccggcaggtgcggtgatggcgaggaggaggacatggagaagcacgcggtgcaggtgctggtcctggcgcacgcgtaccaggtgccgtggctgaagcgggcgtgcgagggcgccatcggggcgcgcctcaccgcggactcggtggtggacgtgctgcagctcgccgcgctctgcgacgcgccgcggctgcacctgcgttgcaccaggctcctcgccaaggagttcgccgccgtcgagcgcaccgaggcctggcgattcctccaggagaacgacccatggcaggagctccaactcctgcagcgcctgcacgaggccgacatgcggcggcgcaagtggcggcggaagcgcgcggagcagcgcgtgtacgtggagctgagcgaggcgatggactgcctcgaccacatctgcacggaggggtgcacggaggtcgggccggcggggcgggcgccggcgccgtcgccgtgcgcgcgctacgccacctgccggggcctgcagctcctcatccgccacttctcccagtgccaccgcaagagctgcgcccggtgccagcgcatgtggcagctgctccgcctccactccgcgctctgcgaccgccccgaccgctgcaacaccccgctctgcacgaggttcaagcagaaggagcaggagaaggcggccgtgaaggccggcgatgatggcgacaaatgggggctcctggtgaagaaggtgaaggctgccagggtcttctcttccctggccaacaggaagcagatgagctccacctcccagtgctgagcaaatgcagtatcagccggggatggttagggttagttattaggttagtgagtgagatgagattaagtgagcagtttttttttgggtctgttttgatatgccaggtctctgttgagctatgtgctgtacaattgtacatgcctactatgttactgtccatgcctttgttacattattacaccctgtgatatagcatagtagtaagttggtagagttctttagcaaggtggggaatcaatgagcccgaaatcgttgtaaaaattgcatgtattgtagcagggaaatatgagataaataaacatgtttatgatatcttattgccccctggcagactgatgaaacctgc

SEQ ID NO: 4923 - DNA, 1532 bp, Panicum virgatum
ctccctccagccccgtctcctcctcccctcgccacgcacgcagcgaccagcgacgcgacgtcgcccccgtccgtcccccaggccccaaacacctcgcgcgctccacgccagatattttttattcctcccctgctgcctcctcccatttccttgccgccgtcgagattcgtatccgcgccgggagaccggaggaagatgtgcgaggcaccacggctccgctgctgcggcgccggcgacgcggctgccgcagacgttgacgtcgacgtcgtcaccaccggcggacgccggaggatcccggcgcgttcctctgttctggcctcggcgtcgccggtgctggcgagcatcctcgagcgccgcctgcgcaaggacagggagagcggcaaggccggccgctccgtcgtccggatccgcggcgtcaccgacgacgctgcggccgcgttcgtccgcctcctcgacgccggcaggtgcggcgacggcgaggaggacgacatggagaagtacgcggtgcaggtgctggtgctggcgcacgcgtaccaggtgccgtggctgaagcgggcgtgcgagggcgccatcggcgcgcgcctcaccgcggacacggtggtggacgtgctgcagctcgccgcgctctgcgacgcgccgcgcctgcacctgcgctgcgccaggctgctcgccaaggagttcgccgccgtcgagcgcaccgaggcgtggcgcttcctgcaggagaacgacccatggcaggagctccaggtcctgcagggcctgcacgaggccgacatgcggcggcgcaagtggcggcggaagcgcgcggagcagcgcgtgtacgtggagctgagcgaggccatggactgcctcgaccacatctgcacggagggctgcacggaggtcggcccggcggggcgggcgccggcgccggcgccgtgcgcgcgctacgccaccacctgccggggcctgcagctgctcatccgccacttctcccagtgccaccgcaagagctgcgcgcggtgccagcgcatgtggcagctgctccgcctccactccgcgctctgcgaccgccccgaacgctgcaacaccccgctctgcaagaggttcaagcagaaagagcaggaaaaggcggccgggagggccggtgatgatggcgacaaatggggccttttggtgaagaaggtgaaggctgccagggtcttctcttccctggccaacaggaagcagatgacccccacctcccggtgctgagcaaacgtagtttcagccgggaatggttagggttagttagattagtgagagtgagaagattaagtgagcagttattttttgttctgttttttttttgatacgccagatctctgtgagctatgtactgtacacgccttttggctacaccctgtggtatacacttcatagtacgttgctagagtccttcagcaaggtgcccaggtggggaatcaatgaacccgaaatcgttgtaaaaactgcttgtattgtaacagggaaatatgagataaataaatatatatgtttatgatatctttgag

SEQ ID NO: 4924 - DNA, 2485 bp, Hordeum vulgare
ggtagatggatctatccgcagtctcgacactgcatactgggttggccaccctcaatcaccgcacgaccatccccgtcccatgccaccggcatccgtcagcaccagtcaataccaccaccacaggcactcccgcaaaccgccagaccgcgccacaaatctacccgcgtcagaatccccattaattccagatcgccgcggggacgcgcaaacgaaacacacgcgcccctctctcccgcggcgcccgtttcaccgtagagagaatccctcctcctcctccctcgccgccgcggcattcccccgagcaccctccgcgcgttgcgcgagcgcggcagccatgggctcgctcccggtgctctccctgccggaatgcgcggcgcctccgcaggagggggcgcgggcgacggtagcggcgccggacctggcggcgctcttccgcgcgcagcggcgccacctcgaccacttcttcgaccggctcgacatgccgcaggcggcggcgttcgcgcaggcgctgctggacgcgcccggggccgtcttcttcacgggcgtcggcaagtccggcatcgtggcgcgcaagctggcgcagacgctcgcctccctcggcttcgcgcgcgccgggttcctctcccccgtcgacgcgctccacggcgacatcggctccctcttccccggggacgtcctcgtgctgctctccaagtccggggcatccgacgagctgctcgcgctcgtgccatgcgcgcgcgccaagggcgcgcgcctcatctccctcacctccgcggcatccggcgcagactgcccgctcgccgccgcatgcgacctcaacgtgcacctcccgctgcagggggaggtctgccccttcggcctcgcgcccgtcacctccaccgccatacagatggtcttcggcgacaccgtcgtcgccgccatcatggaggcgcgccgcctcaccagggaccagtacgcggccaaccaccccgccgggaaaatcggaaagaccctcatcttcaaggttaaggatgtcatgaagaaacaaaatgatcttccattgtgcaaggagggagatatgataatggatcaacttactgagctcactagtaaaggttgtggctgtcttcttgtggttgatgatgagtatcatttgattggaactttcaccgacggagacctccggcgtacactcaaggcaagcgggccagctattttcagtctaacagttggagagatgtgcaacaggaacccaaggacaatcaccgcgggtgcaatggcggttgaagccatggagaagatggagtcgcccccttcacctgtgcagttcctgcctgtcgtcgatgacaagaacgttgtgtctgggatcattacactgcatggtttggtctctgctggattgtaactggttctttgtgtgtagcctgccccggttcttcgtgtttctttgtgtgtagcctgccccggtttttcgtggttctttgtgcctgcttggtcctcccaagacatcagataaattcttgtgaatctgatcggcatcatcttatcgctgttgtagcatctgtagtctagatatgtggagattatatgttcgaaggcacactaccagtatcatcccatagcccctctatagtgtttttgttaagaggaatatgtgggaccttgttcaagcagggttgaggttaaataaatcttaagttgccaatattatatcctttttatgcatgtcaaaggtactgtttgctgtatttcacccttgtccgtgacacattttgcgacatactcgaatgactcccagcatcccagcatttgaagtacacgcgggccacatgattgaacagccattaaggacatccacgcaagtcatcatatcttaaactagaacagagattcgccctgaatctagaagtgcactgaacagacacgagagaaacacagtttgacatcctaacttcaatctcctcgggtacaataaaatctgataaagacagttccctagtttgatcacaaaagaaacacagtttgacatcccacgtatccacgcatttcagtggcgagctacggtggtgcctaaagccctctggcgagctgctgcgaggaggaaagcttcacctgtcccattcagaatctgggtttgggcgctcgaacctaggcttgctagctgaggtcggggcgctttgagggtgagtggatagggcctggtcccagcccatgatgtgcggcaatgcaaactgcacgaatatacacatatatcgagtagtcaaaagacatcataaacgacggtttacatgtaacgtaattgtagagaagcaaagcaacaacaaaaatattgttggcaacagcctcaagttatcactagtagttacagtgatatacttgaaaattgcctaaatagaaaagcaaatatgagcaccaggggtcaatgaccaggtaacattgtggaagagaatgaatccatacagcatgacacaaacttgaagctataaaatgtaatgctgtgaaacag

SEQ ID NO: 4925 - DNA, 882 bp, Sorghum bicolor
atgggctccctcccggtgccagcctcggcggaatgcgccccgcaggggcgcgccacggtgtcggcgtcggacctggcgccgctcttctccgcgcagcgccggcacctggaccacttcttcgacagcctcgacatgtcgcaggcggcggcgttcgcgcaggcgctgatcgacgcgccgggcgccgtcttcttcacgggcgtcggcaagtcgggcatcgtggcgtgcaagatcgcgcagacgctggcgtcgctgggcttcgcgagggcggggttcctggcccccgtcgacgcgctccacggcgacatcggcgcgctcttccccggggacgtcctcgtgctcatctccaagtccggagcctccgacgagctgctcgcgctcgcgccctgcgcgcgcgccaagggcgcctacctcatctcgctcacctccgcggcctcgggggctgaatgcccgctcgccgcggcctgcgacctcaacgtccacctgccgctgcagggagaggtgtgccccttcggcctcgcgcccgtcacctccaccgccatccagatggtgtttggggacaccgtcatcgccgccatcatggaggcaaggcgactctccagggaccagtacgcctccaaccatcccgctggcaagatcggcaagaccctcatcctgcaggttaaggatgttatgaagaaacagaatgaacttcctctgtgcaaggagggagatatgataatggagcaactcactgagctcaccagtaaaggttgtggttgtttgcttgtggttgatgaagagcatcatttgattgggaccttcactgatggtgatctccggcggacattgaaggcaagcgggccagctatcttcagtctcacagttggagagatgtgcaacagg

SEQ ID NO: 4926 - DNA, 882 bp, Panicum virgatum
atgggctccctcccggttaacgcctcgccggaatgcgccccgcaggggcgcgccacggtgtcggcgtcggacctggcgccgctcttctccgcgcagcgccggcacctggaccacttcttcgatcgcctcgacatgtcgcaggcggcggcgttcgcgcaggcgctgctcgacgcgcccggggccgtcttcttcacgggcgtcggcaagtccggcatcgtggcaaggaagatcgcgcagacgctggcgtcgctgggcttcgcgcgggcaggattcctggcccccgtcgacgcgctccacggcgacatcggcgcgctcttcccgggggacgtcctcgtgctgctctccaagtccggcgcctccgacgagctgctcgcgctcgcgccctgcgcgcgcgccaagggcgcctacctcatctcgctcacctcggcggcgtcgggggccgactgcccgctcgccgccgcctgcgacctcaatgtgcacctgccgctgcagggggaggtctgccccttcggcctcgcgcccgtcacctccaccgccatccagatggtgttcggggacaccgtcgtcgccgccatcatggaggcgcgccgactctccagggaccagtacgcctgcaaccaccccgccggcaagattggcaagaccctcatcctgcaggttaaagatgttatgaagaaacagaatgaacttcctctgtgcaaggagggagatatgataatggaccaactcacagagctcaccagtaaaggttgtgggtgtctgcttgtggttgatgaagagcatcatttgattggcaccttcactgatggtgatctccggcgtacattgaaggcaagcggcccagctattttcaatctcacagttggagagatgtgcaacagg

SEQ ID NO: 4927 - DNA, 1720 bp, Saccharum officinarum
cgattaaaccctagcgggcagcggcgattcctctccagtctccagcagtccagctcgatcgcgaccggagacctgcaatccatggccgccccaaccgccgcgccgctcgaagagggcaaggcgaagaaagtcattcgccaggtggagttctacttcagcgacagcaacctaccccgcgacaagttcctgcgggagacggtcgagcagagcgacgacggattggtgagcttgcccctgatatgctccttctcgcggatgaagtcccacctggggctggacgcagatgtgaaggccgagactatgccagaggagaccgtgcttgcggttgctgaggtgctccggcgttctccagtcctccgcatatcagaggatggaaagaagattggtagagctagtgaactctcgaagccagatgagatcatagaacaagtagactctaggactattgctgtatctccactgccttacaatgtaaagctggaagacatccaatcttttttcacaaattatgcgaaggtaaacagcgtgaggcttccacgaaatattgtcaacaaaaaacacttctgcgggactgctttggttgagttttctgaagaagaggaagcaaaaagtattatggacaatgctttagtatttgcaggggcaaatctggaaataaggccaaagaaggagtttgatgctgaacaggagtccaaaaaagaagcatatgaaaaggcacgccctagaaaggacaaccaggatgaaggctatccaaaaggtctaattgtggccttcaaattgaagaagaccatggttggttctgtggtgcagcaagataacatagatgaagggaatgactccgccacgaaattagaagtttccagttccatggaaaaactctcaggccagggtccagagtccacccttgagagcgatggtactaagcaagggaagtcctcagatgacatgaccaaagagaaagagctaaacactgcagaagctgcagaatctgagaagtgtattggtgatgccccagtagaaagtgataaacatggtgatagtggatcattgagcagggatggcaaaaacatttctggcaatgtgaatgtgaaaaaccaaatatcaagggaggatctaaaaggagcattcaaaaaatttggaactgttcggtatgtggacttcagcatcggggataattcaggataccttcgctttgaagattctaaggcagctgaaaaggcccgcatgtccgctgtactttctgatgaaggtagtttgataattaaagaccacattgttactttggagcctgtgactggtgaagctgagaaggattattggaacacaattcgcggcattcaaggaaagtacaaggatagtagaagctacaagggaagggctttaaagaaccagagaggaggaaagcatttcaacaggaagcgagatagaaaccccgaatcagagaagaattctaacaagacgcagaaggttgaagctgctgcgtaggttattttaggtaccttagctcgacttgaggagtaacatgttacgccagcatgatcgacttcactagtcttcaagtttgtagaagtgacttgttttcattgctttttagccatcattttcattttggtcgtttggccaccttattcgatgtttatctctatgctataatccttttgtgatggctttactgtgatacaaggggtcacccaatggcgtgtaaattgaacgcaccaag

SEQ ID NO: 4928 - DNA, 2041 bp, Zea mays
cagcgctgctgctaaaacctcccgactaaaccctagcagcggttcctctccagtctccagcagtccagctcgatcgcgatcggaggccagaaatccatggccgctcccgccgccgcgccgctcgacgagggcaaggcgaagaaagtccttcgccaggtcgagttctacttcagcgacagcaacctcccccgcgataagttcctgcgggagacggtcgagcagagcgatgacggattggtgagcttgcccttgatatgctccttctcgcggatgaagtcccacctggggctggacgcagatgtcaagcccgagactgtgccggaggagaccgtgcttgcggttgctgaggtgctccggccttctcctgccctccgcgtatcggaggatggaaagaagattggtagagctagtgaactcttgaagccagatgagatcatagaacaagtagactctaggactattgctgtatctccgctgccttgcaatgtaaagcaggaagacgtccaatcttttttcacaaattatgcaaaggtaaacagcgtgagacttccacgcaatattgccaacaaaaaacacttctgtgggactgctttggttgagttttctgaagaagaggaagcaaaaagaattatggagactgctttagtatttgcaggggcaaatctggaaataaggccaaagaaggagtttgatgctgagcaaaagtccaaaaaagaagcatatgaaaagacacaccttaaaaaggacaaccagtatgaaggctatcaaaaaggcctaattgtggccttcaaattggagaaggccacagctgatactgtagtgcagcaagataacatagataaagagaatgactctgctacgaaattagatgtttccagttccatggaaaaaccttcaggccaggggccagaggagtctatccttgagagcgatgttattaagcaagggatgtcctcagatgacatgaccaaagagaaagatctaaacactggggaagctacagaatctgagaagtgtattagtgatgtccccatagaaagtgataaacatggtgatagtgaaccattgagcagggaaggcaaaatcatttctggcaatgtgaatgtgaagaaccaaatatcgagggaggatctaaaagaagcattcaaaaaatttggagctgtccggtatgtggacttcagcatcggagataattcaggataccttcgctttgaagattctaaggcagctgaaaaagcccgcatgtctgcagtacttgctgatggtggcttgataattaaggaccacattgttactttggagcctgtgactggtgaagctgagaaggattattgggacacaatccgcagtattcaaggaaagtacaaggatagtagaagctacaagggaagggcttcaaataaccagagaggaggaaagcgtttcaacgcgaagcgagatagaaacccagactcggagaagaattctaacaaggctcggaaggttgaagctatcgcatgaggttaatttaggtaccttagctcgactaaagaagtaacatgttatgccagcatgatcgacttcagtactctccaagtttctagaatcgacttgttttttagctatcgttttcattttggtcgttttgccaccttattcgatgttcgtcccttagctataatccttttgtaatggctttactgtgatgcgagggctcacccgatggcgtgtaatttgagcacaccaagcttaggcttcccttgcgaaagggtggaagcctttctattctttcactagcaaatatgcagttagggcttattcggttatttccatttctaacatagcctaaagcttaagggccgtttggatcccttgcggctgcttgctttaggaggatgggcaagaaattgtgtttggtttgtttattggctttctcaatttttgcactatcaatgtttcgtattgctaacttgggttgagatagaaatgctctccgctgctgccaaggttagtcttgctgagcggggcgaggccagttgcacaggttcaccgcaaaaaaaaa

SEQ ID NO: 4929 - DNA, 2571 bp, Panicum virgatum
agaatgtggggaagaaaaatctcgtggaaaatgtataggattcccgccgaggagctcgctgatgaaatttggcgtcgacgcctcttacagcccaagtgccgttggtctcggcctcacagagaaagcaggccattttgtaagccattggctggaaatgtgagccgggccggtacaaacaccttggagaaccggattgaggagtgaacagccgacgccagagcccacagcagctcctcgccgacgccactcctaaaaccacctaaaccctaacctcccgattcctctccggattccgatctccagctcgatcgcaaccggagcgcaggcatccatggccgcccccgccgccgcgccgctcgacgaatccaaggcgaagagcgtccttcgccaggtggagttctacttcagcgacagcaacctcccccgcgacaagttcctgcgggagacggccgagcagagcgacgatggcctggtgagcttggccttgatatgttccttctcgcggatgaagtcccacctgggcctcgacgcctctgtcaagcctgagactgtgccggaggagactgtgctcgcggtggctgaggtgcttcggcgttctccggtgctccgtgtatcagaggatggaaagaagattggtagagcaagtgagctgctgaagccagaggagattatagagcaagtggattctaggacagtggctgcgtcgccactgccttacaatgtaaagctagaagacgtgcaatcattctttgcacaatatgcaaaggtgaacagtgtgagactaccacgccatattgcaaacaaaaagcacttctgtggcactgctctagttgagttttctgaagaagaggaagcaaaaaaggttttggagaatagtttggttttttctggggcaaacctggaaataagacctaagaaggaatttgatgcggaacaggaatataaaaaagaagaacacaaaaaggcgcaccctgtcaaggatagtcaggatgaaggctatccaaaaggcctaattgtggccttcaaattggagaagactatggctgattttgttcaaaaaaatagcgtagacaaagtggatgactctgccaccaaattagaaacttcgaattcaatggtgaatccatcaggcgaagcatccgaggggattgctgagagcagtgattcaaaggaagagaagtcctcagaaaacgtgaccaaagagaaagaggtaaacattagtgaaactacggaatctgagaagtgcattggtgatgccttggtagaaagcgaaaagcgtggagatagtgagtctggcaatttgaagaattcaatctcgagggaagatctaaaagaaacactcaagaaatttggaactgttcggtatgtggacttcagcattggggatgattcaggataccttcgttttgaagattctaagggagctgaaaaggctcgcatggctgctgtactagccgatgaaggtggcttgataataaaagaccacattattactttggagcctgtgactggtgaagctgagaaggattactggagcacaattcgtggtattcaagggaaatacaaggacaatagaagctacaaaggaagggccgcaaagaactacagaggaggaaagcagttcagcgggaagcgtggtagaaaccccgattctgagaagaattctaacaaggcccagaaggtcgaagctgccgcgtgagattaatttagctaccttaccttgatggagaagtaacatgctccatgctgcttacctgcattagtctcccagcatcggagactttgctcttatctttaggcggcttattttgatgtttacttgcttaaactatgatcatttggttgagttcattgtgatatgagaggccaactaatatggtgtattttgtatataatcaaaactagggtctcatgagttctaaaattgcacttagaaaaatactcgaggctgaaacatcagtaccagcccgactggtgcaggcgttctttttctgttctctcttccagtactcgttgctgggtgttgcagagcagcgctacctatacatgattccatccttatgaaacttatttcatttctctcagttaactctctgccacatcatcacactgttatgacactacttaatgagaatgaagcttattgtaagattgctaatggaggtctggattgccccgataaagttgttaggttgaaactatggattttgtaaggtcatccacttgccaatccattcgccaacagtacaattggaattgttatccgataaatttatccacatttatctctttcctagataagctgggacgtgaccctcaaacatgccaccacccaaataaatgttttgaagaataggaaggacagcgtttgtgctagagcaactactattaccatgcaatggccttgtttggtttacggcaattcctagtgcacgcaagtctagaaaaaattttcatacatgaagtccagaatgaagtctatttgcaaaatctcttcagaaaacttttcgcgacgaatctaataacggtaattaatcgatgattggctacagtgatgctacagtaaccatc

SEQ ID NO: 4930 - DNA, 1585 bp, Zea mays
gcgctcccggtctcggactctaggctcgctccagtttccgcctggctccaccaacaaaaaccaacgctccccctgcccccctctttcctccccagacccgcgctcccctccgtggcgtgcaacgcgttcctcggctcctgcaggcggcgacctcggaaaggcgggggcgtctcgtcgcgaggcatttgaggccaggattttttggtgctctcattgttagctgactggtgagggtctggatctagcaatggcggaaaacacccacggtagtggtcgccacgtgcttggggacttgacaaatgttatttgcaagcgagcagccacatcagatctggagaagagtacaggtgggataaagatcagacggattgaaaagactgggactaggaaagagtacgatgcaaatgcaaaagctagcagtattgggaaaggaattgtatttggccatttgtttgatgatgttgccagagagaaatttcaaagccattctatctttcagaatagtagggttcaacacatagctgccgaagcagctggactcttatccaaggaagccaatgactcgaagaaccactatgcatcaatcggtccattagatctcagtgataaggagcaggattcttcacttgaatctgaagacgactatgatgatgaagataatgatgagacgaatggtgaattgctgcaccattttttcagctcagagctagctaataaaatgtcaacaaatgatggtgagtgcttgactcaggaggagatagttgggtcatctggaaatcagaaacctctgtcttcattggatgctacgacaggtggtgacttgccaatttctagtgctcagcatgcttctgtgagaactggtggtttggaagaagctgttgccccaaaatcttgtgcttgttctttctgtctcaaggctgcttttatgtggatggatctccattatcaggatgcaagaagccggctttctgtattgaagaaaagcatcaagtttgccaggtcattggaggaaaaatgtagaggaaatgaatatgcggccaatgtagctggatatgaatcaaagcgagctgtgggagtggagtttgaactatctcaacaacagagatcactctttctttatacagaaaatgcccttgtccgtgagtcaacgcagcttcattctgcttttgtgaaactgaaagaattgagagagaactgcaagacagatcttgagacgctcagcaattcttcaatgagaaaatgagtgctgcatgttgcgttgctgaactgttagtttcctgagacttagtatgatcagctggcttgtcttgaagcaagatgtgctgagattgaaccacaacttaggaattatggtgcttaccatcaatttgggacttcaatttggctgtagtgattattcctatcataaagcgttggtctagtatgcttgtagctgatgtaaaaataaccatggtaaggtaggaactgtatgtttgtctcgttgaggcatcgtcatcttcacttgtaccttgcagtgagcttccttcatatgaacattctttccacgttctccaaacaaaagggaaaaccatatcgtttcgtgctt

SEQ ID NO: 4931 - DNA, 1379 bp, Setaria italica
gaattcatatagataattggtgaggttctggacctggtaatgacggaaagcactcatggtagtggtcgccatgtgtttggggacttgacaaatgtccttcgcaagaggccagccccatcagacccagagaagagcatgggtggagtaaagattagacggatcgaaaaggacactgcaacttggaaagagtttgatgaatatgcaaaaaacagtagtggagggaaaggaattgtatatgggcatttgtttgatggtgtttccaaagagaattttgaaaggccttctatttttcggaactctaaggtccagcacatggctgctgaagcagctgggctgctatccaaggaggacagtgacctgaggaaccattgtgcatcaatagattcatttgatctcagtgctaagggacaggattcttcgctggaatctgaaggtgactatgataatgaggatgatgatgagacgggtggtgaattgggccattttagtagctcagagctagctaataaaacagcagctaatgatggtgagtgcctgactcaagaggagatagttggatcatcaggaaatcagaagcctctttcttcattggacttcacgacaggtggtgacatggcaagttctagtgttcagcatgcttcagtgagaactagcgggtcagaagaagctgtcgccacaaagtcctgtgcttgttctttctgccttaaggctgctttaatgtggacggatctccattgtcaggatgcgagaagccgtctttctgtattgaagaaaagcataaagtttgctaggttgttggaggcaaaaagcaaaggtgatgaatatgctgccaatgtagccggatataactcaaaacgagctgtagagatggagtttgaactatctcaacaacggagatcactctttctgtatacagagaatgcccttgttcgtgagtcaacacagcttcattcagcttttgtgaagttgaaggaactgagggagaactgcaagacagatgttgagacgatcggcaattcttcagtgggaaaatgagcgatgcatggatgcgatgctgaactgtttgtttccctgagacttggagcagctggctcggtttgatcaagatgcgcattgagataggctgtcaactttaggaatgggtggtagttgccatcactttgggactttggctgtagtgattactcgtatcataaagcatagccccagcatgtttgtagctgatgtaaaaatatccttggtaagctaggaaactgtatgtgttgtctcattgagacgtaggcttgttcacctgtactttgcagcgagcgaaacggaggtagtttgaagattgtttgtctatctccaaacaaaagggaaaacagtgtcgtttggagctt

SEQ ID NO: 4932 - DNA, 1605 bp, Panicum virgatum
atgtacttatttttcctcgtacgttggccagatccaattgtttccctgattggcaaaacctaccctttgtttgagtccacataatgctgccagagttatacttttactcttacctaaacacatgctaacatgttgcttactgtgtcttttcgtttgtggattggctgggacattttggtctggggtttgtgcagaattaatatagctagctggtgaggttctggatctagtaatggcggaaagcactcatggtagtggtcgccatgtgtttggggacttgacaaatgtcctttgcaagcgaccagccccatcagacctggagaatagtatgggtggaataaagattagacggattgaaaaggatgctgggacttggaaagagtttgatgaatatgcaaaaaacagtagtagagggaaaggaattgtatatgggcatttgtttgatggtgttgccaaagagaacttcgaaaggccttctatttttcggaactctaaggtccagcacatggctgctgaagcagctgggctgttatccaaggaggacattgacttgcggaaccgtcgtgcatcaatagacccatttgatctcagtgataaggagcaggattcttcgctggaatctgaaggtgactatgatgaagatgatgatgggatggatggtgaattgccaggccattttatcagctcagagctagctaataaaacagctgctaatgacagcgagtgcctgactcaagaggagatagttggttcatcaggaaatcagaagcctctgtgttcactggactttacaacaggtggtgacatgccaagttctagtgctcagcacgcttcaatgagaactagtggctcagaagcagctgtccccacaaaatcttgtgcttgttcgttctgtcttaaggctgcatctatgtggacagatctccattatcaggatgcaagaagccgacttgctgtattgaagaaaagcataaagtttgctaggtcgttggaggcaaaaagcaaaggcaatgaatatgctcccaatgtagctggccacaagtcaaaacaagctgtggagatggagtttgaactatctcaacaacggagatcactctttctttatacagagaatgcccttgttcgcgagtcagcacagcttcattcagcttttgtgaagttaaaggaattgagagagaagtgcaagacagatcttgagatgataagcagttcttcattgggaaaatgagcactcccatgttggcgctgtggttgctgaactggttccggcttgatatgtgcattgacataggctgtcagctttaggaattgtgttggttaccatcgctttgtgactttggctgtagtgactactcctatcataaagcattgttccagaatgtttgtagctgatgtaaaatctccatggtgaggtaggaactgtatgttttgtctcatagagacgtaggcatcgacttgattctgatggttgagtgacgttttatactgtttgtgcactggaaaaggcaagggcttgtaccgtgcattgctctgtactgtactctgtgagtacgttacgtttatttaggtttctcagtaaattcgacatcgccaaatgtgttgaga

SEQ ID NO: 4933 - DNA, 2006 bp, Panicum virgatum
aaaaacacaaaaaaccttctgaacccgcccccctccgcaccggccaccgccaatcgccgccctaatcccgcgccggcgcccccaaatcccgcgccggcgccccccaagtcgcgcactcgcgctgcctccaacccgccatccatgacgctggctcccgtatgtgcttcctgccggagctggaggaggccgtgagtcccagtggcgggcctaagggttggtactccaggcaggcaacccgctagttccaccacgagcccgaccctgcgccttcgcgtgaggccgggcgcgtcgccgaccgcccccttcgactcccgcggcctgctctggcctctgggcaggggcgcgcctcccgccctgaccctggcgctgcccgcagcacgcagccccgcaccggcctgcacccgcggcctcccgcccgtccgccccgacgcgagcggcagggggcaatctcgggcatcagccccagcaggcagcatccattgcccaattgtctgctctagtttcaaatcctgggtacgctactgcctgtgaccccagagccggaggagcccgtgacgccgacccctggaggagcctgcctgacgccccgcctgcgctgcctgctttcagtccaaccgagaattaatatagctagttggtgaggttctggacctagtaatggcggaaagcactcgtggtagtggtcgccatgtgtttggggacttgacaaatgtccttcgcaagagacctgccccatcagacctggagaagagtatgggtggaataaagattagacggtttgaaaaggacgctgggacttggagagagtttgatgaatatgcgaaaaacagcagcagagggaaaggaattgtatatggacatttgtttgatggtgttgccaaagagaacctcgaaaggccttctatttttcgggactctaaggtccagcacatggctgctgaagcagctgggctgttatccaaggaggacagtgacttgcagaactgtcgtgcatcaatagatccatttgatctcagtgataaggagcaggattcttcgctggaatctgaaggtgactatgatgaagatgatgatgagatggatggtgagttgccaggccattttatcggctctgagctagctagtaaaacagctgctaatgacagcgagtgtctgactcaagaagagatagttggatcatcaggaaatcagaagcctctgtgttcattggaatttacggcaggcggtgacatgccaagttttagtgttcagcacgtttcaatgagaactaatggctcagaagcagctgtccccacaaagtcttgtgcttgttcgttctgtcttaaggctgcctctatgtggacagatctccattatcaggatgcaagaagccgactttctgtattgaagaaaagcataaagtttgctaggttgttggaggcaaaaagcaaaggcaatgaatatgctgccagtgtagccggctacaagtcaaaacgagctgttgagatggagtttgaactatctcaacaatggagatcactctttctttatacagagaatgcccttgttcgcgagtcaacacagcttcattcagcttttgtgaagttaaaggaattgagagagaactgcaagacagatcttgagatggtaagcagttcactgggaaaatgagcacttgatggtggcgttgcggttgctgaacttgttcggtttgatcaagatgtgcattgacataggctgtcagcttaggaattgtggtggttaccatcgctttgtgactttggctgtagtgattactcctatcataaagcattgttccagaatgtttgtagctgatgtaaaaatctccatggtgaggtaggagctgtatgttttgtctcgtagggacgtaggcatctacttgattctgatggttgagtgacgttttatacgtttgagagtttgtgcacttgaaaaggcaaggggcttgtactgcgcattgctctgtactgtatatgtgagaacgttacgtttatttaggtttatta

SEQ ID NO: 4934 - DNA, 697 bp, Saccharum officinarum
caccacaatccatcgccatggccgccaccaccagcagcagccgggcagcttccaccacgctcctcctgctgctgtgcgccgccgcgctggcgcccggcgccacggcggccgacgacaccgggttcacgaccttcaagctctacttccacgacatcgtggcgggcacgtcgtccccaaccgccgtccgcatcgcgcaggcggcgtcgtccaacacctcctccacctccttcggcgccgtggtggccatcgacgacccgctcaccacggggcccacgcgcgcgtcgggcaccgagatcggccgcgcgcagggcacctacacgttcgcggaccagaagacgttcgggctcctcatggtgatgaacttcgtgttcacgggcggggagcacaacggcagcacgctctcgatcatggggcggaacgaggtgctcagcgacatccgcgagatgagcatcgtcggcggcagcggcaagttccgcatggcgaaagggtatgtgcaggcgcacaccatcgactccggcgccacctccggggagaccgtcgtccagtacaccgtcaacgtcaaggtttaggtagctagctagctgctctaccttgcttgcttgcttgcgactccggccatggcttcttgagttcttgtacgtccatctccggctgctgctttgtatacacagcttgtcgttcttcggtgttacatgac

SEQ ID NO: 4935 - DNA, 862 bp, Zea mays
ccgaccgtatcgataccattgtcccatccccgccggtgcaggtggctctttaccaacaaccactcccaccccgacccaccgttacatatctccatctcacccgcgcgcccacgcgcctccaccacgccatccatcgcaatggccgccgccgccgcgctcctcctcctcctgtgcgccgcgtctctcgcgtccgcagccgccgacgacgggttgacgaccttcaaggtgtacttccacgacgtcgtggcggggacgaacccgacggcggtgcgcatcgcgcaggcggcgtcctccaacacgtcgtccaccaacttcggcgcggtggtggccatcgacgacccgctgacgacgggtcccacgcgcgccgcgggcacggaggtgggccgcgcccagggcacctacacgttcgcggaccagcagacgttcggcctcctcatggtcatgaacttcgtgttcacggccggcgagcacaacggcagcacgctctccatccttggccgcaacgaggtgctcagcgacgtccgcgagatgagcatcgtcggcggcagcggcaagttccgcatggcgcgcgggtacgtgcaggcgcacaccatcgactccggcgccacctccgggaccaccgtcgtccagtacaccgtcaacgtcaaggcctagctacctgttacgtacccttgcttgcgactccgggccgtggcttctcgtacgtccatccatatctccggctgctttgtacacaccttgtctgtcgtctttgagcgggattcggatttgcagagccgaatttactactaaagtttcaaaatttcacagagttgtagggtcgagaattaaatgtgtcgaaaacacgttagcgaccattctt

SEQ ID NO: 4936 - DNA, 995 bp, Zea mays
tgccactgccccgccaccgtatcagatgccagtgctcctgccaccgaaccgctgctctttaccaaccactcccaccaccctctcaccgttgtccgttacatatccagcggccacccgttcctcttcctcgtccgcctccacgaccaccatccatcgccatggctggccccaccaccacgctcctcctcctgctgctgtgctccgctgggctcgcgtccggcgccacggcggctgacgacagcgggttcactaccttcaaggtatacttccacgacatcgtggcggggacgagcccgacggccatccgcatcgcgcagggggcggcgtccaacacctcgtccaccagcttcggcgcgatggtggccatcgacgacccgctgacgacgggccccacgcgcgccgcgggcaccgaggtgggccgcgcccagggcacctacacgttcgcggaccagcagacgttcggcctcctcatggtgatggacttcgtgttcacggccggggagcacaagggcagcacgctctccatcctcggccgcaacgaggtgctcagcgacgtccgcgagatgagcatcgtcggcggcagcggaaagttccgcatggcgcgtgggtacgtccaggcgcacaccatcgactccggcttcaaatccggcgagaccgtcgtccagtacaccgtcaacgtcagggcctagctacccgctcgatctaccttgcttgctcctccggcccatggccgactgcccgcccggcttcttgtgcgtcgatccatctccggatgctttgtacacaccttgtcgttcttcgatgttactacatgacatgtatttagtagactgcgatttcagacatcgagtctatcttcatttgctattgagcgggatctggatctgcagacccgaatctagttctacgcgaatctgcagaggtacggcgggtcgatcgaaatgtgcgaagaacacgtcagagcctaattctagtagtaaaaaaacaagaattac

SEQ ID NO: 4937 - DNA, 1444 bp, Setaria italica
ctcacctaccggccccagtaacaacagcaaagctggcgacctgccgcagagacccgccagaccgcgactgcttcttcactgtatcaccaaccactcccacagtcccacccttacatatcctgatatcctgtagctaggtgcctcatcttcatctcggccacctcctgccgcagcacccctccatccatcacccacacttccaccaccatggccatggccaccaccgtcctcctcctgtgcgccgccgtcgcgctggcacccaccccgtcctccgcggcggacgacgccgccgggttcacgacgttcaagctctacttccacgacatcgtgggcgggacgagcccgacggcgatccgcatcgcgcaggctccgtcctccaactcctcctccaccttcttcggcgcggttgtggccatcgacgacccgctcacctccggcccgacacgcgccgccggcaccgaggtgggccgcgcccagggcacctacacgttcgcggaccagaagacgttcggcctcctcatggtgatgaacttcgtgttcacggccggggagtacaacgggagcagcctgtcgatcctgggccggaacgaggtgatcaacgacgtccgcgagatgagcatcgtcggaggcagcggcaagttcaggatggcgagagggtacgtccaggcacacaccatcgactccggcgccacctccggcgagaccgtcgtccagtacaccgtcaacgtcaaggcctagtatagctggtagagctctccggccggccgccggccgtggctccgtggctgatggccgtgtgtttatatggtttgcagtctttgtattgtgtatcgagctggtttctacaccgtgtcgttcttcagtgttactagcttgagatgagagaattcagatgaattcttgccggaacaattttaacgggattcggatttgcagaaatacgaaatgattcttcggaatatttacagagctggacggatcgaatcggctgcaaaaggacgagcatgtggctgttgatgattgcatcgactgtccaaccgaaacagcatgtgtgctgcaagaaaaaggtgcccaagtagtaggtgagcggcgactccaaagtcagtcagtgagccgtgcatgccggtggtgctgtcggcgggtcactcgctttccagatccgatccaatcgcattgcccagaaaaagcaggggagtccagccgtccagcgtggggtgctttcatcgtttctccggacaagagctgcttcaatatctgtgaaatttgcgcaaaaaaaaaaaacttgcctataaaccacggggatttcagaaacccctacagtttcctctcaaaatttagtatctcatccatgttacgctgcgaaagtttgctctcacttactactaccttaatggctccgtgccaaattataagtcgttttgattttcctatatgtgtagatatc

SEQ ID NO: 4938 - DNA, 706 bp, Cenchrus ciliaris
  misc_feature (222)..(222): n is a, c, g, or t
  misc_feature (247)..(247): n is a, c, g, or t
  misc_feature (257)..(257): n is a, c, g, or t
  misc_feature (265)..(265): n is a, c, g, or t
  misc_feature (301)..(301): n is a, c, g, or t
cagctgcccacccccatctcggccgcgcgcctcacaccaccaccaccaccatatggctaccacccgcagcgccctcctcctcctctgcgccgccgccttcgtcgccgcgctggctccgacgccgacctcggcggcggacgacttcacgacgttcaagctctactttcacgacgtggtgggcgggacgagcccgacggcgatccgcgtcgcgcaggcgccgtnttccaactcctcctccaccttcttnggcgcggtgntggccatngacgacccgctcaccacggggcccacgcgcgccgcnggcaccgagatcggccgcgcccagggcacctacacgttcgcggaccagaagacgttcggcctcctcatggtgatgaacttcgtcttcaccgccggcgagcacaacgggagcagcctctccatcctgggccggaacgaggtgctcaacgacgtccgcgagatgagcatcgtcggcggcagcggcaagttcaggatggccagagggtacgtccaggcccacaccatcgactccggcgccacctccgggacgaccgtcgtccagtacaccgtcaacgtcaaggcctagtagttgttgccgcctagctatctagcactagagctcaccggccgccggcggttgctgatggtcgctgctgatatggttttcagtcttgtatcatcgagagctacgttctggcttcttcta

SEQ ID NO: 4939 - DNA, 690 bp, Zea mays
ccacggcaccacccgcactgtgcagcagcctcctttcgtctcgtagttggctggggttgccaacgcgacacctcgtcggaatccggtcgcgcgacctccacttctcgccggccggagcgggtgcgccatcaccatggacccggaagcggtacggaaaagcctggagcccaccgcaaactgtcgaaaaaatcaccggctccacccctgcgcggctccacttctacgaccccttcgtcctcagcggagtcagcatcgaagccgccgagcacggtcgcctcctctgctcctttgtcgtcacccctcgccttgcgagtcccgcggggtacctccgcagcggtgtcacagcgacgctcgccgaccagctgggatcggccgtgtttttctgcagcgggctccccagcagcggggtatccctcgaaatcagcgtctcctttgttgacgcggctgccgtcggggaggaaatagaggtcgagggaaagctgttgcgtgccggcaagtcagtcggtgtcgtctctgtcgatttcaggaagaaaaagacaggaaaactgatggcgcaggcccgtcacaccaagtatcttgtggcatcaagcagattgtgaggctgcccccttctgttaacaagatgtcaacataattgcgcccgaactgtccattactgatgccattattaataggcagcaacgatacaac

SEQ ID NO: 4940 - DNA, 1202 bp, Zea mays
gcgctgtttaaataggataattaagcgagtgctatgagaattgagatgttgttttggcggcgacgacaaagggctaaaaaacaatcttgccgctccaaccaattcgtcttggttgccgacacggcacctcgtcggaatcaggtggcgcgacctcctcgccggccggcgcgacaccaccatgggcccggaagcagtgcggaaaagcctggagcccaccgcaaccgccgaggaaatcactggctccacccctgcgcggctccacttctacgaccccttcgtcctcagcggcgtccgtatcgaagccgccgagcacggccgcctcctctgctctttcgtcgtcacccctcgcctcgcgagtcccgtgggatacctccgcagcggtgtcacagcgacgctcgccgaccagctgggatcggctgtgttcttctgcagtgggatccccagcagcggggtctccatcgagatcagcgtctcctttgtcgactcggctgccgtcggggaggaaatagaggttgagggaaagttattacgtgctggaaaatcagtcggtgtcgtctccgtagatttcaggaagaaaaagacagggaaattgatggcacaggcccgtcacaccaagtatcttgtggcatcaagcaaactgtgaggcgctccccttttgttaacaagatatcaacatcaattgcgcccagactctccatactggtgccattattagtagtcagcaatcatgaaatgtttgtggcatatctttttttttcaaaaaaattcctgtatatattatatatatgaaattcaagtaagtatcattggtgcctctgatgcatatcggtctagtcatgttactttcacttgacagccatgatcagattatatatgttttcaaagaaggcaccgggttgtaagtaacttcgcaggaaactttcagttattgttggctcagtctgccaccatcttgggagattctctccgttaacaaaaggaattgatcgttgctgcatcactctattattgccctagaagatgcatggtatttaatctgggtccacacatcggcctgagatagttggtgaaagtaggcccgactgccaccatgctgtgtttttgtgtgtacgagttctaggtccttgtgggctatctcctgtctgttctgctgttggttgaccccaaattgttatcgacttatgatgataggatcccaacaa

SEQ ID NO: 4941 - DNA, 1212 bp, Panicum virgatum
aaaaaaaaaaatgaacgcccagcgtgcaccacctgtacaatttttttatattaaataaaggaaggaaaaaggaagaagagccgcttgcgggtcccactaccagatatccgttcgttcgtactcctaggcataaaaaatatccgttcgtagccccacctgtcagtgtaggcaaggcaagcccaatcgtcttgtcagttgcctgccgagcgaactccatcgcccgttttgtctgcccggtggtgcgacctcccgtcctcgccggcccggcgcgccgccgaccatggacccggacgcggtgcggcgcagcctcgagcccaccgcctccgcggaggagatcacgggatccaccccggcccgcctccacttctacgaccccttcgtcctcagcggcgtcagcatcgagtacgccgagcacggccgcctcctctgctccttcgtcgtcgccccgcgccacgccagccccgcggggtacctccgcagcggcgtcacggcgacgctcgccgaccagctggggtccgccgtcttcttctgcagcgggctccgcgcgagcggggtctccgtggagatcagcgtctcctttgtcgacgcggctactgtcggggaagaaatagaggtcgagggaaagttgttgcgtgctggaaaatctgttggcgtcgtttctgtcgatttcaggaagaaaaagacaggaaagttgatggcacaggcccgtcataccaagtatcttgctgtgtcaagcagattgtgaggctcccattctgctaacaagataataagatatcaacacaattgcggccaaactcaccaatctccataactgtgccattattactcgtcaacaatcatacaatgcttgtggtctatctttttttagaaaaaaaaatgatgtatctattagaaattcatgtatcaagggtggtgtgtcatctatgatcagattatatatttcactgaggattgtaggctgtacttcacaagaaacacagtaaaccattcaaaattcatatgcaactccagtccccttgactcttgttgccttggtgtagtctgtcatcatcttgggagattccctctgtaaaaaatgggatcatagctgcattagtcttttatcggcttaaaaggtgtagatatttaatgtgggtgttgtgtactacattggcctaagttggtgaatgtaggcccagctgccatcacgctgtgtttatgcgagtgtac

SEQ ID NO: 4942 - DNA, 935 bp, Panicum virgatum
  misc_feature (26)..(26): n is a, c, g, or t
  misc_feature (319)..(320): n is a, c, g, or t
  misc_feature (557)..(557): n is a, c, g, or t
  misc_feature (788)..(788): n is a, c, g, or t
ctgcctggtggtggtgcgacctcccntcctcgccggcccggcgcgccgccgaccatggacccggacgcggtgcggcgcagcctcgagcccaccgcctccgcggaggagatcacgggatccaccccggcccgcctccacttctacgaccccttcgtcctcagcggcgtcagcatcgagtacgccgagcacggccgcctcctctgctccttcgtcgtcgccccgcgccacgccagccccgcggggtacctccgcagcggcgtcacggcgacgctcgccgaccagctggggtccgccgtcttcttctgcagcgggctccgcnngagcggggtctccctggagatcagcgtctcctttgtcgacgcggctactgtcggggaagaaatagaggttgagggaaagttgttgcgtgctggaaaatctattggtgtcgtttctgtcgatttcaggaagaaaaagacaggaaagttgatggcgcaggcccgtcataccaagtatcttgctgtgtcaagcaaattgtgaggctcccattctgctaacaagataataagatatcaacncaattgcggccaaactctccaatctccatcactgtgccattattactcgtcaacaatcatacaatgcttgtggtctatcctttttagaaaaaaaaaatagaatgctgtatctattaggaattcgtgtatgaagggtggtctgtcatagattatatatttcgatgaggcttgtgggctgtaacttcacaagaaaacagtaaaccatccgcaattcgtattcaactccacggnccccttgactcttgttgcattggtgtagtctgtcattcttgggagattcactctgtaaaaaatgagatcatagttgcattagtcttttatcggcctaaatggtccacatatttaatgtgggtgttgtgtaatccattgccctaagat

SEQ ID NO: 4943 - DNA, 934 bp, Setaria italica
agcaaacccacgcagccacgctacgcagcctccattcgtctcaggattcaggaatttgcgtgccgtcttgtctgcctgccggcacctcgtcggattcaggtggcgcgacctcctctccctctcctcgccggcccggcgcaccgccgaccatggacccggaagcggtgcggcgaagcctcgagcccaccgcctccgcagaggaaatcacgggctccacccctgcccgcctccacttctacgaccccttcgtcctccaaggcgtcagcatcgagtcctccgagcacggccgcctcctctgctccttcgtcgtcgccccgcgccacgccagccccgcggggtacctccgcagcggcgtcacggcgacgctcgccgaccagctggggtcggccgtcttctactgcagcgggctcccgaggagcggggtctccgtggagatcagcgtctccttcgtcgacgtggctaccgtcggggaagaaatagaggttgagggaaagttgttgcgtgctggaaaatccgttggtgttgtctctgtcgatttcaggaagaaaaagacaggaaaattgatggcacaggcccgtcataccaagtatcttgctgtatcaagcagattgtgaggcttgccttccgctaacaagataataagatatcaacatgattgcggcgaaactctccattaccatgccattattaatcggcaacaatcatacaatgcttatagtctctctctttttcagaattctgtatctatcagaatttaagtgtcaagggtggttctgtgatgcatattgctctatccatttcgttttcacttgacagctatgatcagattatacatttcgacaaaggttgtgtctgggttgtaagttgtaacttcactggaaacacagtaaaccatccacaattcatatcaaatcctttaactcttgctgcatca

SEQ ID NO: 4944 - DNA, 1191 bp, Panicum virgatum
ctgtcagtctaggcaaaacccaagctgcgccgcctccagtccactcgtcttgtctgcctagtggtggtgcgacctcccctcctcgccggcccggcgcgccgccgaacatggacccggacgcggtgcggcgcagcctcgagcccaccgcctccgcggaggaaatcacgggatccaccacggcccgcctccacttctacgaccccttcgtcctccacggcgtcagcatcgagtccgccgagcacggccgcctcctctgctccgtcgtcgtcgccccgcgccacgccagccccgcggggtacctccgcagcggcgtcacggcgacgctcgccgaccagctggggtccgccgtcttcttctgcagcgggctccgcatgagcggggtctccctggagatcagcgtctcctttgtcgacgcggctactgtcggggaagaaatagaggttgagggaaagttgttgcgtgctggaaaatccattggtgtcgtttctgtcgatttcaggaagaaaaagacaggaaagttgatggcgcaggcccgtcataccaagtatcttgctgtgtcaagcaaattgtgaggctcccattctgctaacaagataataagatatcaacccaattgcggccaaactctccaatctccatcactgtgccattattactcgtcaacaatcatacaatgcttgtggtctatcctttttagaaaaaaaaaatagaatgctgtatctattaggaattcgtgtatgaagggtggtctgtcatagattatatatttcgatgaggcttgtgggctgtaacttcacaagaaaaacagtaaaccatccgcaattcgtattcaactccacggcccccttgacttttgttgcattggtgtagtctgtcatcatcttgggagattcactctgtaaaaaatgagatcatagttgcattagtcttttatcggcctaaatggtccacatatttaatgtgggtgttgtgtaatacataggcctaagatagttggtgaatgtaggcccagctgccatcacgctgtgtgttatgtgagtgtacaaacaaacccaaggtccttatgggctgtctgctgtctgatctgttgttagttgaccccaatttgttattgagttatggtaggattccagcataactcgcaaattgtccttttcatcccctatgctcatgcggatttttgaatatgtg

SEQ ID NO: 4945 - DNA, 921 bp, Pennisetum glaucum
ggggaggaatttccgtgccgtcttgtctgcctgtcgacagctcgtcggattccggtgacctccatcctcctcgccggcccggcgcgccgccgaccatggacccggaagcggtgcgccgaagcctcgagcccaccgcctctgcggaggaaatcacgggctccacccctgcgcggctccacttttacgaccccttcgttctccaaggcgtcagcgtcgagtccgccgagcacggccgcctcctctgctccttcgtcgttgccccacgccacgctagccccgcggggtacctccgcagcggcgtcacggcgacgctcgcagaccagctggggtcggccgtcttcttcggcagcggccttcccaggagcggggtctccgtggagatcagcgtctctttcgtcgacgtggctaccgtcggggaagaaatagaggttgagggaaagttgttgcgtgctggaaaatctgttggcgttgtctctgtcgatttcaggaagaaaaggacaggaaaattgatggcacaggcccgtcataccaagtatcttgctgtgtcaagcagattgtgaggctcgccttctcctgacaagataataagatatcgacatgattgcggcgaaaccctacattacggtgccattattaatcaaaaacaatcatacaatgctgatggtctatctctttttcagaatgctgtatctatcagaaattcaagtgtcaagggtggttctgctatgcatgttgttcttatgttctatccatttcattttcacttgacagctatgataagattgtatttttcgacgaaggctgtgtctgggctgtaaattgtaacttcacaggaaacacagtaaaccatccgcaatttatattcaatcctttaattcttgctacaaaaaaaaaaaaagtaaaactctgcgttgtataacc

SEQ ID NO: 4946 - DNA, 819 bp, Cynodon dactylon
gggggtctgggacttgcgtgccgcggtggtgactggaaagcggaaagcctcgttgggtccggtggtgcgacctcgtcaccggtcggagcaccgccgctagccatggacccggaagcggtgcggcggaccctggagcccaccgcctccgcggaggaaatcaccgggtccaccccaccgcggtcccacttctacgaccccttcgtcatcaacggcgtcagcctcgaggccgcggagcacggccgcgtcctctgctccttcgtcgttagcccccgcctcgccagccccgcggggtacctccgcagcggcgtcacggcgaccctcgccgaccagttggggtcggccgtgttctactgcagcggcctcgtcaccagccgaccagcggggtctctgtcgagatcagcctctccttcgtcgacgcggctgcagtcggggaagaaatagaggttgagggaaagttgttgcgcgcgggaaagtctgttggctttgtatctgtcgatttcaggaagaaaaagactggaaaattgattgcacaaggtcgtcacaccaagtatctcgccgtatcaagcagattgtgaggctccccttctgtggcgagatatcaacatgattctacgaccgattcttcattacggtgccattatggtaggcaagaatcatattatgcttgtgctctaatctaaaaagaaaaaaaaaaggaaaaaaaaaaagatatctatctgatatcacaatatcgatggttgttcttgtatgcacgttgtatattcttgtagtcatttatcttttcatattacggacatgaccagataacatacttcgaag

SEQ ID NO: 4947 - DNA, 502 bp, Saccharum officinarum
gtcgacccacgcgtccgcttcggagctgcgtgcgtcttggttgccgacacgacacctcgtcggaatcaggtggcgcggcctcccctcctcgccgcccggcgcgccaccaccatggacccggaagcggtgcggaaaagcctggagcccaccgcaaccgccgagaaaatcaccggctccacccctgcgcggctccacttctacgacccctttgtcctcagcggcgtcagcatcgaagccgccgagcacggccgcctcctctgctccttcttcgtgacacctcgccttgcgagtcccgtggggtacctccgcagtggtgtcacagcgacgctcgccgaccagctgggatcggccgtgttcttctgcagcgggctccccagcagcggggtctccatcgagatcaagcgtctcctttgtcgacgcggctgcagtcggggaggaaatagaggttgaggggaagttgttgcatgctggaaaatcagttggtgtcgtctctgtcgatttc

SEQ ID NO: 4948 - DNA, 758 bp, Saccharum officinarum
ttttccagatcagaagaacctccgacaggatctgtgccgcggtggcgacgccgaacggtacgcggatggacggcggcggcggcgacctgcggagcaccatcaagaagtggaacgtcatctaccctgtctacctcaactccaagaagaccgtcgccgagggccgccgcatcgccgccgccaaggcctgcccggaccccacctgcgtcgagatcgccgattgctgttcgcacctcaagatcccccacgccgtcgagctggataaggcgtacccaagggatttcttccaggtggggagggtcagggtgcagctcaagaaagatgacggctcccccgtcaatcctgctattaaaacaaagaagcagctgatgatccaaatagcagagctagttcccaagcatcatggaaggacaaagaagcaggaggcagcgaccagttcttcagccggcggcagttcaaagaacacaaaaggcgggaaaaagaaaaagtgatgtcagtatcattttgtgttttttttttctgttcgtcgtcatactaagcgtgtggaagttgtctttctgaggccagaaaatcattgtgacttttggtgggattttggtccatttgaaatttatgtacccatctttcctgttatcttcagattcagaagctacacctaacctgaggcagctgcttgatagaactttgtcactaatcctgcttagatacttcatttcacaaatataatagagctggttttgtatcttcgtcgtggttcgatt

SEQ ID NO: 4949 - DNA, 665 bp, Cenchrus ciliaris
caaaaaaccaaccggatctcctcctacggatctgtgctgtggtagcgtcgaccgccgcgcagatggacggcggcgggggcgacctacggagcaccatcaagaagtggaacgtcatctacccggtctacctcaactccaagaagacagtcgccgaaggccgccgcatcgccgctagcaaggcctgccccgaccccacctgcatcgagatcgccgactgctgctcgcacctcaagatcccccacgccatcgagctggataaggcgtaccctcgggatttcttccaggtggggagggtcagggtgcagctcaagaaggatgacggctcccccgtcaatcctgctattaaaacgaagaagcagctgttgatccaaatagcagagctagttcccaagcatcatggaaggacaaagaagcaggaatcagcacccagttcttcagccggcggcagttcgaagaacacaaaaggtgggaaaaagaaaaagtgatggcagtatcatccagttttttctgttcaacctcatgttaagtttctgtggaagttgtctttctgaggtctgaaaaatcattgcgacttttggtggggttttgatccgtttggaagtttccatacccatatttcttgtattctcccgattcagatggtacacctaaaaatgtggtagcca

SEQ ID NO: 4950 - DNA, 746 bp, Saccharum officinarum
cattcctggctgaaacgaatgggcctcatgttgtagagtttcgattcctgagccagatccattggtgaccaggttttagtgaaccaccaggatccactcgatccggcccaggaagagaaacaagccttgttttcaacctggaacaactgaacaaggcctaaaacctcgctccccctttggttttgtgccacgtgacaggatctgttccgcggtggcgacgccgaataccacacgtatggacggcggcggcgacctgcggagcaccatcaagaagtggaacgtcatctaccctgtctacctcaactccaagaagacggtcgccgagggccgccgcattgccaccgccaaggcctgcccagaccccacctgcatcgagatcgctgactgctgttcgcacctcaagatcccccatgccatcgagttggataaggcgtacccaagggatttcttccaggtggggagggtcagggtgcagctcaagaaagatgacggctcccccgtcaatcctgctattaaaacaaagaagcagctgatgatccaaatagcagagctagttcccaagcatcacggaaggacaaagaagcaggaatcagcgcccagttcttcagccggtggcagttcaaagaacacaaaaggcgggaaaaagaaaaagtgatgacattatcattttgtgttttttttcctgttcgtcctcatactaagcttctgtggaagttgtctttcttaggcctgaaaatcattgtgac

SEQ ID NO: 4951 - DNA, 940 bp, Panicum virgatum
taaaaactgcagccataccctcatcccacctcctatgctgtatttaggagagaggagaaaggaaaaaccgagctctaatctccctccccgacggagatcgcctgctcctggagcaaccgccgctccttcccgcaccggcgcggacgccactcccgccagaaccgtatcaacctcggactccctgcagttcttgtgctaggatctgtgccgtggggcgtcaaacagctcgcagatggacggtggcgggggcgacctgcggagcactatcaagaagtggaacgtcttatacccggtctacctcaactccaagaagacggttgctgaaggccgccgcatcgccgccagcaaggcctgccctgaccccacctgcatcgagatagccgactgctgctcgcacctcaagatcccccacgccattgagcttgataaggcgtaccctcgggatttcttccaggtggggagggtcagggtgcagctcaagaaggatgacggctcccctgtcaatcctgctattaaaacaaagaagcagctgatgatccaaatagcagagctagttcccaagcatcatggaaggacaaagaagcaggaatcagcactcagctcttcagctggtggcagttcgaagaacacaaaaggtggaaaaaagaaaaagtgatggcagtataatcttgcatttttctgtccatccccgtactaagtttatgtggaagtgtccttctgaggcctgaaaatcattgtgacttgtgggattttgatccatttgaaaatttccatacacatctttcttgtagtatccagatctagatgtgctaaacctaaaaatatggcagccatgacatgggatccaatttacagatgctgttgtttaatagaactttgtttactaacacagcggagatgctttattcattttaatcaatagaatagaactgttcttgca

SEQ ID NO: 4952 - DNA, 796 bp, Panicum virgatum
ggagagagaaaggaaaaaccgagctctaatctccctccccgacggagatcgcctgctcctggagcaaccgccgctccttcccgcaccggcgcggacgccactcccgccaggatctgtgccgtggggcgtcaaacagctcgcagatggatggtggcgggggcgacctgcggagcactatcaagaagtggaacgtcttatacccggtctacctcaactccaagaagacggttgctgaaggccgccgcatcgccgccagcaaggcctgccctgaccccacctgcatcgagatagccgactgctgctcgcacctcaagatcccccacgccattgagcttgataaggcgtaccctcgggatttcttccaggtggggagggtcagggtgcagctaaagaaggatgacggctcccctgtcaatcctgctattaaaacaaagaagcagctgatgatccaaatagcagagctagttcccaagcatcatggaaggacaaagaagcaggaatcagcgctcagctcttcagctggtggcagttcgaagaacacaaaaggtggaaaaaagaaaaagtgatggcagtataatcttgcatttttctgtccatccccgtactaagtttatgtggaagtgtccttctgaggcctgaaaatcattgtgacttgtgggattttgatccatttgaaaatttccatacacatctttcttgtagtatccagatctagatgtgctaaacctaaaaatatggcagccatgacatgggatccaatttacagatgctgttgtttaatagaactttgtttact

SEQ ID NO: 4953 - DNA, 794 bp, Setaria italica
tctgctgccgaaggatctctcgaaacattcaggcccgcatcaacctcgctcctcctgcggttcttgtgccaggatctgtgccgtggtggcgtcgaacggcgcgcagatggacggcggcgggggcgacctgcggagcaccatcaagaagtggaacgtcatctacccggtctacctcaactccaagaagacggtcgccgagggccgccgcatcgccgccagcaaggcctgccccgaccccacctgcatcgagatcgccgactgctgctcgcacctcaagatcccctacgccatcgagctggataaggcgtaccctcgggatttcttccaggtggggagggtcagggtgcagctcaagaaggatgacggctcccccgtcaatcctgctattaaaacgaagaagcagctgatgatccaaatagcagagctagttcccaagcatcatggaaggacaaagaagcaggaatcagcacccagttcttcagccagcggcagttcgaagaacacaaaaggcgggaaaaagaaaaagtgatggcagtatcatcctgttgttttttctattcaacctcatgttaagtttctgtggaagttgtctttctgaggcctgaaaaatcattgcgacttttggtgggattttgatccatttgaaaattaccatacccatatttcttgtagtctccagattcagatggtacacctaaaaatgtggcagccatgaccatgggatccaatttacagatgctgctgtttgatagaacttttactaatccagctgagatgcttcactaaatttcatg

SEQ ID NO: 4954 - DNA, 790 bp, Pennisetum glaucum
tctgctgccgaaggatctctagaaatattcagacccgcatcaacctcgctcccccctgcggttcttcttccaggatctgtgccgtggtagcgtcgaccggcgcgcagatggacggcggcgggggcgacctgcggagcaccatcaagaagtggaacgtcatctacccggtctacctcaactccaagaagacggtcgccgaaggccgccgcatcgccgctagcaatgcctgccccgatcccacctgcatcgagatcgccgactgctgctcgcacctcaagatcccccacgccatcgagctggataaggcgtaccctcgggatttcttccaggtggggagggtcagggtgcagctcaagaaggatgatggctccctcgtcaatcctgctattaaaacgaagaagcagctgttgatccaaatagcagagctagttcccaagcatcgtggaaggacaaagaagcaggaatcagcacccagttcttcagctggcggcagttcgaagaacacaaaaggtgggaaaaagaaaaagtgatggcaatatcatcctgttgttttttttttctgttaaacctcatgtcaagtttctgtgaaagttgtctgaggcctgaaaaatcattgtgacttttggtggggttttgatccatttggaagttttcatacccatatttcttgtagtctccagattcagacggtacaccgaaaaatgtggcacccatgacccggatccaatttacatgtcatgctgtttgatacaactttttctaatcgagctgagatgctttactaaatttt

SEQ ID NO: 4955 - DNA, 765 bp, Panicum virgatum
ccacgcgtccgaatccccgtgccacgtcgtccgctcactcctcccccagacccccagcttcccccaatctcgtcggcagatggacagtggcgggggcgacctgcggagcactatcaagaagtggaatgtcatctacccggtctacctcaactccaagaagacggttgctgaaggccgccgcatcgccaccagtaaggcctgccccgaccccacctgcatcgagatcgccgactgctgctcccacctcaagatcccccacgccatcgagttggataaggcgtaccctcgggatttcttccaggtggggagggtcagggtgcagctcaagaaggatgacggctcccctgtcaatcctgctattaagacgaagaagcagctgatgatccaaatagcagagctagttcccaagcatcacggaaggacaaagaagcaggaatcagcgcccagctcttcaactggtggcagttcgaagagcacaaaaggtgggaaaaagaaaaagtgatggcagtatcatcttgttgcgttgttctgttcatccccgtaccaagtttatgtggaagttgtgtccttttgaggcctgaaaatcattgtgacttgtgggattttcatccatttgaaaatttccatacatattgttcttgtagtatccagattttgatgtgctacacctccaatttacagatgctgttgtttgctagaactttgtttactaacccagctgagatgctttattaaatttaatcaatagaatagaactgtttttgc

SEQ ID NO: 4956 - DNA, 792 bp, Zea mays
tttttctattgatttgttcgcgtcatattaacgccagggagggccttttctctctcctgtgaacgccaaacagtgtctcttttccagttccagacctgaagaaactccgaccggtggcggcaggatctgtgccgcgatggcgacgtcgaacaccgcgcggatggaggacggcggcggcgacctgagaagcaccatcaagaagtggaacatcatctaccctgtctacctcaactccaagaagacggtcgccgagggccgccgcatcgccgctgccaaggcctgcccggaccccacctgcatcgagatcgctgactgctgttcgcacctcaagatcccccacgccatcgagttggataaggcgtaccctcgggatttcttccaggtggggagggtcagggtgcagcttaagaaagatgacggctcccccgtcaatcctgctattaaaacgaagaagcagctgatgatccaagtagcagagctagttcccaagcatcacggaaggacaaagaagcaggagccagcgcccaatcccggtggcagttcaaagaacacaaaaggcgggaaaaagaaaaagtgatgcagtatcattgtgttgttttttattctgttcgtcatcatacactaagcttctgtgaaaaaggaaaagtcttggacgttgttgttatgttgccattatgccattttttcatgtataagaacttactaagaatcttccattgactcggtaaaatgcaacttaaaaaaatttggcgtcgctagattaaagggccctttgacaaggcttcaccttct

SEQ ID NO: 4957 - DNA, 793 bp, Zea mays
tttttctattgatttgttcgcgtcatattaacgccagggagggccttttctctctcctgtgaacgccaaacagtgtctcttttccagttccagacctgaagaaactccgaccggccggtgggcggtggcggcagccggcaggatctgtgccgcgatggcgacgtcgaacacggcgcggatggaggacggcggcggcgacctgcggagcaccatcaagaagtggaatatcatctaccctgtctacctcaactccaagaagacggtcgccgagggccgccgcatcgccgctgccaaggcctgcccggaccccacctgcatcgagatcgctgactgctgttcgcacctcaagatcccccacgccatcgagttggataaggcgtaccctcgggatttcttccaggtggggagggtcagggtgcagcttaagaaagatgacggctcccccgtcaatcctgctattaaaacgaagaagcagctgatgatccaagtagcagagctagttcccaagcatcacggaaggacaaagaagcaggagccagcgcccaatcccggtggcagttcaaagaacacaaaaggcgggaaaaagaaaaagtgatgcagtatcattgtgttgttttttattctgttcgtcatcatacactaagcttctgtgaaaaagaaaaagtcttggacgttgttgttatgttgccattatgccatttttcatgtataagaacttactaagaatcttccattgactcggtaaaatgcaacataaaaaaatggcttcgctagattaaagggccctttgaca

SEQ ID NO: 4958 - DNA, 1194 bp, Oryza sativa
gccttcgactctgaaagtcggaagctcgtcaacctcttgcttgggtcgaaactcgaaagtccatccccggtacgcatgacgcatcaaacctcccttccatgtctatagaccctcgagccctaatccggggacgagattcatccctccgcgaccaaagaaaccgaattaacctccgagtcctctgctccctctttgcttcttggaccaggatctgatctgcgcggcgctcgaccggaatcgcgcggagatggacggcggcgacctgaggagcagcatcaagaagtggaacgtcatctacccggtgtacctcaactccaagaagacggtcgccgagggccgccgcatcgcctccggcaaggcctgccccgaccccacctgcgtcgagatcgccgattgctgctcccacctcaagatccctcacgccatcgaattggataaggcgtatccacgagatttcttccaggtgggaagggtgagagtgcagctcaagaaggatgacggctccccagtcaatcctgcaatcaaaacaaagaagcagctgatgatccaaatcgcggagctagtccccaagcatcatggcaggactaagaagcaggaaccagcagcttcttcaactgcagggacttcaaaggggaaaggtggcaagaaaaagaagtgatgatagtacaccatcttgtgtcgttcttctgtccataggaagttccctgagattcgtcgatgtctgttttgaggcctgaaattctgcgtctcttctgtgctctgaatttctaatttctcgggaaacatcaatcaatgcccgtatttcttgtgatttggactattggaaagaggaagattgcactgttgtttgcaatggatagcttccaagttatgtttttgaatagagctcaccttgaacatgcttatgctactaaaccccttgcaacagtgggctagcagaggttatgacttatgaggctaacagtggccatcggatgattaatcgttcatgtgtcaattgggccttggcctacgtttctttactcgttttggtctgaattcaacttgggtattggtgaaggagaagcgtatcacgtgggtgagagaatttacaacctgccatggcttctctgatttggttgtttaattacaaaatttcttatgtgcgttttgagttattggtcttcttatcttaataccactgagtttgcctaa

SEQ ID NO: 4959 - DNA, 521 bp, Lolium multiflorum
ctcggagctccgtcagtctcgacgaaaacgcaagcctccagatctcccggatctgccccgtgcccggctcgaatcgcgcggagatggacgtcggcggcgccgacctgaggagcagcatcaagaagtggaagatcatctaccccgtgtacctcaactccaagaagacggtggccgagggccgccgcatcgccgccgccaaggcatgccccgaccccacctgcatcgagatcgccgacagctgcgccttcctcaagatccctcgcgcgattgagttggataaggcatatccgcgagatttcttccaggttgggagggtgagggtgcagctcaccaatgatgacggctccccggtcaatccagcaatcagaacaaagaagcagttaatgatccaaatagcagagctggttcccaagcatcatgggaggactaagaagcaggaaccagcggctggtccgtcagtagcatctagtaacaacaagaagaagaacaagaacaagaagtgatggaagtagcatctcatg

SEQ ID NO: 4960 - DNA, 1709 bp, Saccharum officinarum
gcgagggcgatctaaatcaagagtcctcccgtttcatcgcctgcgaaaaaggcgagaaatccccaacggaaggagcagcagcgccagtgctagcagcagaagaagaagcagcagcagcagcagcagcgattccttcctcgatcctcgtacctttcgccgcgctccctcgctcggatcgaaacccctagggtttcgcatcggcctcccgccacttcctatcccttccccctccttccgccgcgcgcgcgcgcgcggcgagccaccaaaccctaggacggcaaatccggtgcgatcgcccacggtggaggcctcgtcggctgccgagaggagccgctcagggctcgggtcagggttccggtacctcgccggcgccgcctctgggtggtgggaccggtggatggtcatgggagccagcggctccaagcttgagaaggccctcggtgaccagttcccggaaggcgagcgctacttcggcctcgagaacttcggcaacacctgctactgcaacagtgtccttcaggcactttatttttgcattccattcagggagcagttactggaatattatgcaaataacaaaactccaggtgacgctgaggaaaatcttttgacttgtttggccgacctttttatgcagataagccaagcaaagaaaaagaccggtgttattgctccaaaacgttttgttcagagagtgaagaaacagaatgagttgtttcgcagctacatgcaccaggatgcacacgagttcttaaatttccttttgaatgaacttgttgatattctggaaaaagagtcaagtgctgctaaggactcgccccaatcgtcatctcctgaaaaagctccaaatggcccagttcaacctttagccaatggagttaaaaaagaaccgccagttactctggtccataaaaatttccagggcatattgaccaacgaaacaagatgcttaagatgtgaaacagtaactgcaagggatgaaacatttcttgatcttagtgttgacattgaacaaaatagttctatcacaagctgcctgaaaaatttctgttctacagagactttaaatgcagaggataaattcttctgcgacaagtgctgcagtttgcaagaagcacagaagagaatgaagatcaagaaggctccccacatattggtgatccatctaaagcgtttcaagtacattgagcagcttggccggtataagaagctttcataccgggttgtattccccatggaactgaagctcagtaatacatccgacgatgtagacactgagtactccctctttgctgtcgtggtccatgtcggaagtggccccaaccatgggcattatgtaagccttgtcaaaagccacaaccactggttgttcttcgacgacgaaaacgtcgagatggttgaagagcagaccctacaaacattcttcggttcctcacatgaatactcaggcaacacagaccatgggtatatcttgttttacgaggggcttggtgggaagagttagatcagtttattcaccttccctgttccttttctcctttttctctttggagcttgcaagttcactcttgtacctacacagctactatttcattacctccatggaatcgaagaggttgtatgtggtgaggacgccagattttgggtggtttcagtgtacaggggataatggaatctagctcccaacgatgaaataaggtgtaattttt

SEQ ID NO: 4961 - DNA, 2067 bp, Setaria italica
agtagtaattcgatgtgacgatggattccaacgtcacagcagccacaaaccgctcagatctgcggtagaaagagaagtaaagaaatacagataggcccgggccccacaggtccagtgaaatgcttgcccacgaaccaaacagcaagaacaaccacggcgagcgaggccgatctaaatcaagcaaagctccccccgtttcatcgccccagaaagaggcgagaaatccccaacgaaaggagcagctgctccagcgacagcagcagccgccgtagcgattcctttcctcttcctcctcgtcgtcgagttcgcccgcccggatcgaaacccctagggtttcgcatcggcctcccaccgcccacctcctccacctctctccctccgccgcgcgcgcgcgcggggagccaccaaaccctaggacggcaaatccggtgcgatcgcccacggtggaggcctcgtcggcggccgagaggagccgctcagggctcgggtcagggttccggtacctcgccggcgccgcctccgggtggtgggaccggtggatggtcatgggagccagcggctccaagctcgagaaggccctcggcgaccagttcccggaaggcgagcgctacttcggcctcgagaacttcggcaacacctgctactgcaacagtgtccttcaggcactctatttttgcattccattcagggagcagttactggaatattatgcaaataacaaaaatccaggagacgcagaggaaaatcttttgacttgtttggctgacctctttatgcagataagccaagcaaagaaaaaaactggtgttattgctccaaaacgttttgttcagagagtgaagaaacaaaatgagttgtttcgcagctacatgcaccaggatgcacacgagttcttaaattttcttttgaatgaacttgttgatattctggaaaaggagtccagtgctgcgaaggactccccccaatcttcatctcctgaaaaagctccaaatggtccagttcaacctttagccaatggagttaaaaaggagccacccgttaccctggtccataagaattttcagggcatattgaccaatgaaacaagatgcttaagatgcgaaacagtaactgcaagagatgaaacatttcttgatcttagtgttgacattgaacaaaatagttctatcacgagctgcctgaaaaacttctgctctacagagactttaaatgcagaggataaattcttctgtgacaaatgctgcagtttgcaagaagcacaaaagagaatgaagatcaagaaggctccccacatattggtgatccacctaaagcgcttcaagtacattgagcagcttggccgatataagaagctttcataccgggttgtattccccatggagctgaagctcagtaatacatccgatgacgtagacaccgagtactccctcttcgctgtcgtggtccacgtcggaagtggccctaatcatgggcattatgtgagcctcgtcaaaagccacaaccactggttgttctttgacgacgaaaacgtggagatggtcgaggagcagaccctgcaaacattcttcggttcctcacatgaatactcgggcaacacagaccatgggtatatcttgttttacgagggccttggtgggaagagttaggttgttttccttggccttccctgttcctttttcaccctctctttggagcatgcaagttcactcttgtacctacacagctgctatttcatacctccatggaaaattgccaatcgaagaggttgtatgacatgaggacgccagattttgggtggtttcagtgtacaggggataatggaatcttgctcccagtgatgcaataaggtgtaaatcgttttaagtgcgcctgaccagtttcttctcaggactaacatctttttgttaaagaatggaacattgctattgggcacactgtacattaattctagttcaaaatcttggatgcatttcccagttctgctgactttgggatctggaatcatgttacatgtttgggcttgtcaactttggtcggttaagcgtgtggttcgttttacatgtcata

SEQ ID NO: 4962 - DNA, 1746 bp, Zea mays
gtcgaacacaaacagcaagaaccaccaagcgaccaagccaccaagggagcccgatctgagtcaagcgtcttcccatttcatcgcctggaaaaaggcgagaaaccccgaagtgaaggaacagcagcacgagtgctagcagcagcagcgattccttcgccataccgttcgccgcgctcgctcactcggatcgaaccctccctagggtttcgcatcgtcctcccgccaactcctatccctcccccctccctccgccgcgcgcgcgcggggagctaccaaaccctaggacggcaaatccggtgcgatcgcccacggtggaggcctcgtcggccgccgagaggagccgctcggggctcgggtcagggttccggtacttcgccggcgccgcctctgggtggtgggaccggtggatggtcatgggagccagcggctccaagcttgagaaggccctcggagaccagttcccggaaggcgagcgctacttcggcctcgagaacttcggcaacacttgctactgcaacagtgtccttcaggcactttatttttgcattccattcagggagcagttactggaatattatgcaaataacaaaactccaggtgacgttgaggaaaatcttttgacttgtttggccgacctttttatgcagataagccaagcaaagaaaaagaccggtgttattgctccaaaacgttttgttcagagagtgaagaaacagaatgagttgtttcgcagctacatgcaccaggatgcacacgagttcttaaattttcttttgaatgaacttgttgatattctggaaaaagagtcaagtgctgctaaggactcaccccaatcatcatctccagaaaaagctccaaatggcccagttcaacctttagccaatggagttaaaaaagaaccaccagttactctggtccataaaaatttccagggcatattgaccaatgaaacaagatgcctaagatgtgaaacagtaactgcaagggatgaaacgtttcttgatcttagtgttgacattgaacaaaatagttctatcacaagctgcctgaaaaatttctgttctacagagactttaaacgcagaggataaattcttctgtgacaaatgctgcagtttgcaagaagcacagaagagaatgaagatcaagaaggctccccacatactggtgatccatctaaagcgtttcaagtacattgagcagcttggccggtataagaagctttcataccgggttgtattccccatggaactgaagctcagtaatacatctgacgatgtagacactgagtattccctctttgctgtcgtggtccatgttggaagtggccccaaccatgggcactatgtaagccttgtcaaaagccacaaccactggttgttcttcgatgacgaaaacgtcgagatggttgaagagcagaccctacaaacattcttcggttcctcacatgaatactcaggcaacacagaccatgggtatatcttgttttatgaggggcttggtgggaagagttagatgggtttattcatcttccttgtttcttttctccttttctctttggagcttgcaaattcactcttgtgcctacacagctactatttcattacctccatgggaaacgggtcaatcgaaggggtgttgtatgaggtgaggacgccagattttgggtggtttcagtgtacaggggataatggaatctagctccaacgatgaaataaggtgtattttttttaacttctcagggcta

SEQ ID NO: 4963 - DNA, 2156 bp, Panicum virgatum
tgacgagaattccaataccagccacaagcccacaaccactcagatctgcggtagaaagaggtgtaaagaaatacagataggctcggggcccacaggtccagtgaaatgcttgcccacgaacacaaacagcaggaaccaccgcggctaggccgatctgaatcaagcgagtcgccgtttcatcacccccagaaaaaggcgagaaatccccaacggaaggagcagcagcagcagcagcgcaaattctttcctcctcatcttcgccgcgcttgcccacccggatcgaaacccctagggtttcgcatccgcctaccaccgcgtactacttcctctccccgtctccctccgccgcgcgcgcgcgcggggagccaccaaaccctaggacggcaaatccggtgcgatcgcccacggtggaggcctcgtcggcggccgagaggagccgctcagggctcgggtcagggttccggtacctcgccggcgccgcctccgggtggttggaccggtggatggtcatgggagccagcggctccaagctggagaaggccctcggcgaccagttcccggaaggcgagcgctacttcggcctcgagaacttcggcaacacctgctactgcaacagtgtcctccaggcactttatttttgcattccattcagggagcagttactggaatattatgcaaataacaaaaatccaggagacgcagaggaaaatcttttgacttgtttggctgacctttttatgcagataagccaagcaaagaaaaaaactggtgttattgctccaaaacgttttgttcagagagtgaagaaacagaatgagttgtttcgtagctacatgcaccaggacgcacatgagttcttaaatttcctattgaatgaacttgttgatattctggaaaaggagtctagtgctgcaaaggactccccccaatcatctcctgaaaaagctccaaatggtccagttcaacatttagccaatggagttaaaaaggagccaccagttaccctggtccataagaattttcagggcatactgacgaacgagacaagatgcttaagatgcgaaacagtaactgcaagagatgaaacatttcttgatctcagtgttgacattgaacaaaatagttctatcacaagctgcctgaaaaacttctgctctacagagactctaaatgcagaagacaaattcttctgtgacaaatgctgcagtttgcaagaagcacagaagagaatgaagatcaagaaggctccccacatattggtgatccacctaaagcgtttcaagtacattgagcaacttggccggtataagaagctttcataccgggtagtattccccatggagctgaagctcagtaatacatctgatgacgtagacaccgagtactccctcttcgctgtcgtggtccatgtcggaagtggtcccaaccatgggcattatgtgagcctcgtcaaaagccacaaccactggttgttctttgatgacgaaaacgtggagatggttgaggagcagaccctgcaaacgttcttcggttcctcacatgaatactcaggcaacacagaccatgggtacatcttgttttacgagggccttggtgggaagagttagattgcttttcttggccttccctgttccttttcaacctttctctttggagcatgcaagttcactcttgtacctacacagctactatttcattacctccatggaaaatcaccaatcgaagaggttgtatgacatgaggacgccagattttgggtggttccagtgtacaggggataatagaatcttgctcccagggatgcaataaggtgtaaattgttaagtgcgcctgaccagtttcctctcagggctaacatctttttgttaaagaatggaacattgctattgggcacactgtacattaattctagttcagaagctaggatgccacttcccagttgtgatgacttcgggttctggaaccatgttacatgtttgggtttgttagctttggtcagttaaacctggtgtgggcattagcatcttgttttacatgttacatctggaatcattttacatctagttgtatgtaccgcttcacaccaacaatgctcttcagaggggggaaatgctgctctcgtgcatcaaatctgttaatttgtaatttccattcgt

SEQ ID NO: 4964 - DNA, 2069 bp, Zea mays
cggagcaagaaacctctctgttgaagtgctgatgatggattacaatgaatttcagtccacagcagaaaaaaaaaaccccggttagatctgtgtagaaagagtaaagaaatacagataggcccggggtccacaggtccagtgaaatgcttgcccacgaacagaaacagcaagaaccaccacaaggcgagtccgattctagatcaagcgagtcctcccgtttcatcgcctcggaaaaaggcgagaaatctgcaacagaagaagcagcagcgacagcgattccttcctcgtacctttcgttgcgctcgcgcactcggatcgacccctctagggttttgcatcggcctcccgccagctcctatccctcccctctccctccgccgcgcgcccgcgcggggagccaccaaaccctaggacggcaaatccggtgcgatcacccacggtggaggcctcgtcggcggccgagaggagccgctcagggctcgggtcagggttccggtacctcgccggcgccgcctctggctggtgggaccggtggatggtcatgggagccagcggctccaagcttgagaaggccctcggagaccagttcccggaaggcgagcgctacttcggcctcgagaacttcggcaacacctgctactgcaacagtgtccttcaggcactttatttttgcattccattcagggagcagttactggaatattatgcaaataacaaaactccaggagacgctgaggaaaatcttctgacttgtttggccgacctttttatgcagataagccaagcaaagaaaaagaccggtgttattgctccaaaacgttttgttcagagagtgaagaaacagaatgagttgtttcgcagctacatgcaccaggatgcacatgagttcttaaatttccttttgaatgaacttgttgatattctggaaaaagagtcaagtgctgctaaggactcaccccaatcgtcgtctcctgaaaaagctccaaatggcccagttcaacctttagccaatggagttaaaaaagaaccaccagttaccctggtccataaaagttttcagggcatattgaccaacgaaacaagatgcttaagatgtgaaacagtaactgcaagggatgaaacatttcttgatcttagtgttgacattgaacaaaatagttcaatcacaagctgcctgaaaaatttctgttctacagagactttaaatgcagaggataaattcttctgtgacaaatgctgcagtttgcaagaagcacagaagagaatgaagattaagaaggctccccacatattggtgatccatctaaagcgtttcaagtacattgagcagcttggccggtataagaagctttcatacagggttgtattccccatggaactgaagctcagtaattcatccgacgatgtagacactgagtactccctctttgctgtcgtggtccatgtcggaagtggcccgaaccatgggcattatgtaagccttgtcaaaagccacaaccactggttgttcttcgacgatgaaaatgtcgagatggttgaagagcagaccctacaaacattcttcggtacttcacatgaatactcaggcaacacggaccatgggtatatcttgttttacgaggggcttggtgggaagagttagattggtctattaacctttcctgttcctttttttccttctctttggagcttgcaagttccactcttgtacctacacagctactatatcattacctccatggaaaacggtcaatccaagaggttgtatgaggcgacgatgccagattttgggtggtttcagtgtacaggggataatggaatctagctcccaacgatgaaataaggtgtaattttgaagttcgcctgaccagttccttctcagggctaacatcttctgttaaagtgtgggactttactattgggcacactgtacatcaattctcgttcataactttgtacgcattttccagttctgatccatgtacgtgctgaaacttgtgagcatttggcatgtttgattttgtttttcagtttacccatgtaactgtattttctcagggcgaacagag

SEQ ID NO: 4965 - DNA, 1796 bp, Panicum virgatum
gcaagaacaggcgaggccgatctgaatcaagcgagtcgcccccgtttcatcacccccagaaaaaggcgagaaatccccaacggaaggagcagcagcagcagcgcaaattctttcctcctcatcttcaccgcgcttgcccacccggatcgaaacccctagggtttcgcatccgcctcccaccgcctactacttcctctccccgtctccctccgccgcgcgcgcgcgcggggagctaccaaaccctaggacggcaaatccggtgcgatcgcccacggtggaggcctcgtcggcggccgagaggagccgatcagggctcgggtcagggttccggtacctcgccggcgccgcctccgggtggttggaccggtggatggtcatgggagccagcggctccaagctcgagaaggccctcggcgaccagttcccggaaggcgagcgctacttcggcctcgagaacttcggcaacacctgctactgcaacagtgtcctccaggcactttatttttgcattccattcagagagcagttactggaatattatgcaaataacaaaaatccaggagacgcagaggaaaatcttttgacttgtttggctgacctttttatgcagataagccaagcaaagaaaaaaactggtgttattgctccaaaacgttttgttcaaagagtgaagaaacagaatgagttgtttcgtagctacatgcaccaggacgcacacgagttcttaaatttcctattgaatgaacttgttgatattctggaaaaggagtctagtgctgcaaaggactccccccactcatctcctgaaaaagctccaaatggtccagttcaacatttagccaatggagttaaaaaggagccaccagttaccctggtccataagaattttcagggcatactgacgaacgagacaagatgcttaagatgcgaaacagtaactgcaagagatgaaacatttcttgatctcagtgttgacattgaacaaaatagttctatcacaagctgcctgaaaaacttctgctctacagagactctaaatgcagaagacaaattcttctgtgacaaatgctgcagtttgcaagaagcacagaagagaatgaagatcaagaaggctccccacatattggtgatccacctaaagcgtttcaagtacattgagcaacttggccggtataagaagctttcataccgggtagtattccccatggagctgaagctcagtaatacatctgatgacgtagacaccgagtactccctcttcgctgtcgtggtccatgtcggaagtggtcccaaccatgggcattatgtgagcctcgtcaaaagccacaaccactggttgttctttgatgacgaaaacgtggagatggttgaggagcagaccctgcaaacgttcttcggttcctcacatgaatactcaggcaacacagaccatgggtacatcttgttttacgagggccttggtgggaagagttagattgcttttcttggccttccctgttccttttcaacatttctctttggagcatgcaagttcactcttgtacctacacagctactatttcattacctccatggaaaatcaccaatcgaagaggttgtatgacatgaggacgccagattttgggtggttccagtgtacaggggataatagaatcttgctcccagggatgcaataaggtgtaaattgttaagtgcgcctgaccagtttcctctcagggctaacatctttttgttaaagaatggaacattgctattgggcacactgtacattaattctagttcagaagctaggatgc

SEQ ID NO: 4966 - DNA, 1757 bp, Cynodon dactylon
gggggaggccgatctatatcaagcgagtccacatttcatcacgccagaaaaaggccataaatccgccaaagaaagcagcagcagcagcagcaattccttcttcttccactcggttgctcagcccttccggatcggaaccctaggtttcacatcggccacctcccgcctccgccccctccccctcccctccttcctccccggcgcgcgcgcggggagccaccaaaccctaggacggcaaatccggtgcgatcgcccacagtggaggcctcgtcggcggccgagaggagccgctcagggctcgggtcggggttccggtacctcaccggcgccgcctccgggtggtgggaccggtggatggtcatgggagccagcggctccaagctcgagaaggccctcggcgaccagttcccggaaggcgagcgctacttcggcctcgagaacttcggcaacacctgctactgcaacagtgtcctccaggcactttatttttgcattccattcagggagcaattactggaatattattcaaataacaaaaatccaggagacgcagaggaaaatcttttgacctgtttggctgacctttttatgcagataagccaagcaaagaaaaagaccggtgttattgctccaaaacgttttgttcagagagtaaagaagcagaatgaattgtttcgcagctacatgcaccaggatgcacatgaattcttaaatttcttgctgaatgaacttgttgatattttggaaaaagagtcgagtgctgcaaaggactctccccaatcaacatctcctgagaaagttccaatggtccagttcaacctttagcaaatggagttaagaaagagccaccggttaccctggtccataaaaattttcagggcattctaactaatgaaacagatgcttaagatgtgagacagtaactgcaagggatgaaacattccttgatcttagtgttgacattgaacaaaatagttctatcacaagctgcctgaaaaatttctgctctacagagacattaaatgccgaggacaaattcttctgtgacaaatgctgcagtttgcaagaagcacagaagagaatgaagatcaagaaggctccacacatattggtgatccacctgaaacgctttaagtatattgagcagcttggtcggtataagaagctttcttatcgggttgtttttccaatggagctgaagctcagtaatgcatctgatgatgtagacactgagtactcgctctttgctgtcgtggtccatgttggaagtggacccaaccatgggcattatgtgagcctcgttaaaagccacaaccactggttgttcttcgatgatgaaaacgtggagatggtggaagagcagaccctgcaaacattctttggttcttcacatgaatactcaggcaacacagatcatggatatatcttgttttatgagggcctcggagggaagagttagattggtttttcgccttccctgtgcttctctcttctctttggagcatgcaagctttctcttgtacctacacagctattccgttacctccatggaaaattgacaattgcagaggttgtatgaagcgaggatgccaaaattttgggtggtttcagtgtacaggggataatgaaatcttgctcccaatgatgaaataaggtgtaaattgttaaagtgcacctgaccagttttctttctcgggactaacatctttgttaaacaatggaacattgctgttgagcactgtatattgattctagtt

SEQ ID NO: 4967 - DNA, 2172 bp, Oryza sativa
cgtggagaaaaaagaagtccagatagaccccggaccccacgagtccagtcaatcgcaaacagcgcccacccacgaccacgacgaacacaaacagtaagaaccaccaacgaaaccgatctaacccaagcgaactccccactccacccgcaagcaagggtagtagactagtagtaggcgaaagaaaaaaaaaatccccccaaacgagagaagcggcagcgacgacgacgacgacggcgacagcagcagcggcggcagaagcagcagaagcaaccccctcctccgccgctccgccccatcggatcgaggccgccctagggtttcccccaggctccgcccctccgcttcccccctctccgccgcgcgcgcgcggggagccaccaaaccctaggacggcaaacccggcgcgatcgcccacggtggaggcctcgtcggcggccgagaggagccgctccgggctcgggtcggggttccggtacctcaccggcgccgcctccgggtggtgggaccggtggatggtcatgggagccagcggctccaagctcgagaaggccctcggcgaccagttcccggaaggcgagcgctacttcggcctcgagaacttcggcaacacctgctactgcaacagtgtcctccaggcactatatttctgcatcccgttcagggagaaattgctggaatattatgcaaataacaaaactcctggagatgcggaggagaaccttttgacttgtttggcggatcttttcatgcaggtaagccagtcaaagaaaaagactggcgttattgctccaaaacgctttgtccaaagagtaaagaaacagaatgaactatttcgcagctacatgcaccaggatgcacatgagttcttaaattttctgttgaatgagcttgttgatattctggaaaaggagtctaatgctgcgaaggactcccctcaatcatcatctcctgaaaaggttccaaacgggccagttcaacctttagccaatggtgttagaaaagaaccaccggttaccttggtgcataagaattttcagggcatactgaccaatgagaccagatgcttaagatgcgagacagtaacagcaagggatgaaacattttttgatctgagtgttgatattgagcagaatagttctatcacaagctgcttgaaaaacttctgctccacggagactttaaatgctgaggacaaattcttctgtgacaaatgctgcagcttgcaagaagcacagaagagaatgaagatcaagaaggctccacacatattagttatccacctaaagcgcttcaagtacatagagcagcttggtcggtataagaagctttcataccgggttgtattcccaatggagctgaagctcagtacatctgatgatgtagataccgagtactccctctttgctgtcgttgtccatgttggaagtggccccaaccatggacattatgtaagccttgtcaaaagccacaaccactggttgttcttcgatgatgaaaatgtcgagatggttgaggagtcgaccctgcaaacattcttcggttcttcacatgaatactcaggcaacacggaccatggatacatcttgttttatgagggtcttggtgggaagagttagattgattttcttcaccttccctgttcttttcttttttttttctttggagcatgcaagaataccgttgtatttacacagctatttcattacctccatggaaaattgttgatctcagagattgtgagtatgaacatgaggacgctggattttgggtggttttagtgtacagagcataatggaaccttgctcctagtggtgaaataaggtgtaaatcattaagtacgcctgacttttttttttcgtcagcattgacatctttaccaaagaatgcaacattgctccttgcgcgcagtgtattgattctagtttggaatttttgatgtaggcatttcttgatcctgttgtattattgtgtaaagctgtacgaaagctgcctgagaatcacgcgctgagtgagaattgttgtaagtttgattagatttagggaacttggtcggttatgcttgctgtgtaactcattatgtatcgctccaatcatgtgatcttgaaaggaaaacattttttttctcctgtaggaactcttgcatgtattgtctccaatcatgttgatcctgag

SEQ ID NO: 4968 - DNA, 2124 bp, Brachypodium distachyon
ggatcataccagggaacctatctgaaccatcaaactacatctcctcccctgcagcctggacttttcttgtccaccatcccgtacctttcctcttcctccccgatccattcctctcccacgctgctctcatgctctgacctacccaagttccagtcaatccaaatgcgtctgtaaaatctcccctatagtccaccaccgctgtaccctagagctgccgccttgccgtagcttagttagcgtcaccgccggcacctcacaaccccaaccccttcgcctccgacacgcgttcgccgccatcgccgttcctgttccacctcgtcgcgtccccgctgactcaaccccgctcgcagttttggacattggttttcgagatccgccctggcctcttcggcggccgagaggagccgctccgggctcgggtcaggtttccggtacctcaccggcgccgccacggggtggtgggaccggtggatggtcatgggagccagcggctccaagctcgagaaggccctcggcgaccagttcccagaaggcgagcgctacttcggcctcgagaacttcggcaacacctgttactgcaacagtgtactccaggcactttatttttgcactccattcagggaacagttactggaatattatgcgaataacaaaagtcctggagatgcagaggaaaatcttttgacttgtttggcagatcttttcatgcaggtaagccaatccaagaaaaagacaggcgttattgctccaaaacgttttgtccaaagggtgaagaaacaaaatgagttatttcgcagctacatgcaccaggatgcacatgagttcttaaattttctgttgaatgagcttgttgatattctggagaaagagtctagtgctgcaaaagactcgccacaatcgtcatctcctgaaaaagttccaaatgggccagttcaacctttggccaatggagttaaaaaagagccaccaattaccttggttcataagaattttcagggcatactgaccaatgaaaccagatgcttaagatgtgagactgtaactgcaagggatgaaaccttttttgatctgagtgttgacattgagcagaatagttccattacaagctgcctgaaaaatttcagctccacggagactctaaatgctgaagacaaattcttctgtgacaaatgctgcagtttgcaagaagcacagaagagaatgaaaatcaagaaggctccccacatattggtgatccacctaaagcgctttaagtacattgagcagcttggccggtataagaagctttcatatcgggtcgtattccccatggagctgaagatcagcagtacatctgatgatgtagataccgagtactctctctttgctgtcgtggtccatgttggaagtggccccaaccatggccattacgtgagcctcgttaaaagccacaaccattggttgttctttgatgatgaaaatgtggagatggttgaagagtcgaccctgcagacattcttcggatcttcacacgagtactcaggcaacacagatcatggatacatcttgttttacgagggccttggtgggaagagttaggttgattttcttcgccttccctgttcctttttctttttcgttggagcatgcaaatatactgttgtatgtacacagctatttcattacctccatcaaaaaattgttgatctcagagattgtgagtatgaacctgaggatgccagatttttggtggttgtagtgtacagcgggaaaatggaaccttgcttcgactgatcaaataaggtgtatgtcattaagtacacccaactattttccccttctcattgacatctttaccaaagaatgaagcgttgctattgggttatgtatattggttctaggtttgaagtttttatgcattaggtgtaacaatttcctagttctgatgtactggcaacgcttacatggtaccaaaggaatcatctgctaagttagaactatgttgtatgtttggtttgaatttggttagatgatgtttgatgtcgggaaagcagctagctaaggttgctatgagttcatgttatctgatgtatcgctccaatgaatttcataggagatttgcctttcttttcatttaatctcttg

SEQ ID NO: 4969 - DNA, 1742 bp, Triticum aestivum
gagatccgccctggcctcctcggcggccgagaggagccgctccgggctcgggtcaggtttccggtacctcaccggagccgccaccgggtggtgggaccggtggatggtcatgggagccagcggctccaagctcgagaaggctctcggcgaccagttccctgaaggcgagcgctacttcggactcgagaacttcggcaacacctgctactgcaacagtgtactccaggcactttatttttgcactccattcagggagcagctactggaatattatatgaataataaaaatccgggagatgcagaggaaaatcttttgacttgtttggcagatcttttcatgcaggtaagccaatcaaagaaaaagacaggcgttattgctccaaaacgttttgtccaaagagtgaagaaacaaaatgaattatttcgcagctacatgcaccaggatgctcatgagttcttaaattttctgttgaatgagcttgttgatattctggagaaagagtccagtgctgcgaaggactccccccaatcatcatctcctgaaaaagttccaaatgggccagttcaacctttggccaatggagttaaaaaagaaccacctgttaccttggtccataagaatttccagggcatactgaccaatgaaaccaaatgcttaagatgtgagacagtaactgcaagggacgaaacgttttttgatctgagtgttgacattgagcagaatagttccattacaagctgcctgaaaaatttcagctccactgagactttaaatgccgaggacaaattcttctgtgacaaatgttgcagtttgcaagaagcacagaagagaatgaagatcaagaaggctccccatatattggtgatccacctaaagcgctttaagtacattgagcagcttgggcggtataagaagctttcgtatcgggttgtcttccccatggagctgaagatcagcagtacatctgatgatgtggatactgaatactctctctttgctgtggtggtccatgttggaagcggccccaaccatggccattatgtaagcctcgtaaaaagccacaaccactggctgttcttcgatgatgaaaacgtggagatggttgaagagtcaaccctgcaaacattcttcggttcttcgcacgaatactcaggcaacacagatcatggatacatcttgttttacgagggccttggtgggaagagtttaggttgattttccctgttgtttttcttttctctttctttggagcatgcaagtttactgttgtatgtacacagctatttcaccacctccatgggaaattgttaatctcagagattgtgagtatgaacctgaggaaagccagattttttgtggttctagtgtacagcggaaaatggaaccttgctccagtgatgatgaaataaggcgcaagtcataaagtacgctcgactatacttcccaccgacattcttacgaaggaatgtaacaatgcattgggttctatatgttgattctaatttgaagcttttatacactagatttagccatttgatgtgatagcagtgcccttcgaggcttggaatcatatgtccagttagaattataatagtatggtgtatgcttgactttatgatggttgaattgatttagggagtttggctattgaggttacttttgaattcatgtatcccatgtgtttctccagttatgtggatgcaaaaaatattcgtaggaaatgtacgtctcatttttgttg

SEQ ID NO: 4970 - DNA, 1629 bp, Pseudoroegneria spicata
  misc_feature (1311)..(1311): n is a, c, g, or t
  misc_feature (1410)..(1410): n is a, c, g, or t
  misc_feature (1583)..(1583): n is a, c, g, or t
  misc_feature (1585)..(1585): n is a, c, g, or t
  misc_feature (1597)..(1599): n is a, c, g, or t
aaaatcttctcctatactccaccgccgccgtgccctagagctgccgccgtgccgagctaagcgttaccgccggcgcctcacacccaactctttcgcctctcacgcgcgtcgccgccatcgccgcccccgttctaacccatcgcgtcaccgctgactccacccccgcctgcatatccgacatcggtttttgaggtatgagctcttgttcataccgtgattgctcaatcccaaattaacctccacaaattcccggtgcgcgcaccatctagatccgccctggcctcctcggcggccgagaggagccgctccgggctcgggtcaggtttccggtacctcaccggagccgccaccgggtggtgggaccggtggatggtcatgggagccagcggctccaagcttgagaaggctctcggcgaccagttccccgaaggcgagcgctacttcggcctcgagaacttcggcaacacctgttactgcaacagtgtactccaggcactttatttttgcactccgttcagggagcagttactggaatattatacgaataacaaaaatcctggagacgcagaggaaaatcttttgacttgtttggcggatcttttcatgcaggtaagtcaatccaagaaaaagacaggcgttattgctccaaaacgttttgtccaaagagtgaagaaacaaaatgaattatttcgcagctacatgcaccaggatgctcatgagttcttaaattttctgttgaatgagcttgttgatattctggagaaagagtccagtgctgcgaaggactccccccaatcatcatctcctgaaaaagttccaaatgggccagttcaacctttggccaatggagttaaaaaagagccacctgttaccttggtccataagaatttccagggcatactgaccaatgaaaccaaatgcttaagatgtgagacagtaactgcaagggacgaaacgttttttgatctgagtgttgacatcgagcagaatagttccattacaagctgcctgaaaaatttcagctccactgagactttaaatgccgaggacaaattcttctgtgacaaatgctgcagtttgcaagaagcacagaagagaatgaagatcaagaaggctccccacatattggtgatccacctaaagcgctttaagtacattgagcagcttgggcggtataagaagctttcttatcgggttgtattccccatggagctgaagatcagcagtacatctgatgatgtggatacagaatactctctctttgctgtggtggtccatgttggtagcggccccaaccatggccattatgtnagcctcgttaaaagccacaaccactggttgttcttcgatgatgaaaatgtggagatggttgaagagtcgaccctgcaaacgttcttcggttcttcgcangagtactcaggcaacacagatcatggatacatcttgttttacgagggccttggcgggaagagtttaggttgattttccctgttctttttcttttctttactttggagcatgcaagtttactgttgtatgtacacagctatttcattacctccatggaaaattgttaatctcananattgtgagtaannncctgaggaatacagattttttgtggttcaa

SEQ ID NO: 4971 - DNA, 1784 bp, Secale cereale
ctcctccccccacgccgctctcatattctgacctacccaagctccatgccagttccaatccaaacccagcgacttcctaaaatcttctcccgtactccaccgccgccgtgccctagagctgccgccgtgccgagctaagcgtcaccgccggcgcctcaccgcccccagctccttcgcccctcacgcgcgtcgccgccatcgccgccctcgttctaccccgtcgcgtcaccgctgactccacccccgcctgcatattggacatcggtttttgagatccgccctggcctcctcggcggccgagaggagccgctccgggctcgggtcaggtttccggtacctcaccggagccgccaccgggtggtgggaccggtggatggtcatgggagccagcggctccaagctcgagaaggccctcggcgaccagttccctgaaggcgagcgctacttcggactcgagaacttcggcaacacctgttactgcaacagtgtactccaggcactttatttttgcactccgttcagggagcagttactggaatattatatgaataacaaaaatcctggagacgcagaggaaaatcttttgacttgtttggcggatcttttcatgcaggtaagtcaatccaagaaaaagacaggcgttattgctccaaaacgttttgtccaaagagtgaagaaacaaaatgaattatttcgcagctacatgcaccaggatgctcatgagttcttaaattttctgttgaatgagcttgttgatattctggagaaagagtccagtgctgcgaaggactccccccaatcatcatctcctgaaaaagttccaaatgggccagttcaacctttggccaatggagttaaaaaagagccacctgttaccttggtccataagaatttccagggcatactgaccaatgaaaccaaatgcttaagatgtgagacagtaactgcaagggacgaaacgttttttgatctgagtgttgacatcgagcagaatagttccattacaagctgcctgaaaaatttcagctccactgagactttaaatgccgaggacaaattcttctgtgacaaatgctgcagtttgcaagaagcacagaagagaatgaagatcaagaaggctccccacatattggtgatccacctaaagcgcttcaagtacattgagcagcttgggcggtataagaagctttcttatcgggttgtattccccatggagctgaagatcagcagtacatctgatgatgtggataccgaatactctctctttgctgtggtggtccatgttggtagcggccccaaccatgggcattacgtaagcctcgttaaaagccacaaccactggttgttcttcgatgatgaaaacgtggagatggttgaagagtcgaccctgcaaacgttcttcggttcttcgcacgagtactcaggcaacacagatcatggatacatcttgttttacgagggccttggtgggaagagtttaggttgattttccctgttcttcttttcttttctttggagcatgcaagtttaccgttgtatgtacacagctatttcattacccccatggaaaattgttaatctcgagattgtgagtattaaccagaggaatacagatttttgtggttctagtgtacagcgggaaacggaaccttgctccagtgatgaaataaggcgcaggtcataaagtaggcccaactattttgcgctttgcaccgacattcttaaaagcgaatgtaacaatgtgttgggttctgtatgtatgactgtatgttgattctaatttg

SEQ ID NO: 4972 - DNA, 1938 bp, Triticum aestivum
catcccgtacctttcctcttccttcccgatccactcctccccccacgctgctgctctcatactctgacctacccaagctccattccagttccaatccaaacccaatgagtttctaaaatcttctcccgtactccaccgccgccgtgccctagagctgccgccgtgccgagctaagcttcaccgccggcgcctcacaccccccaactccttcgcctctcacgcgcttcgccgccatcgccgtcctcgttctaccccatcgcgtcgctgctgactccacccccgcctgcatattgacatcggtttttgagatccgccctggcctcctcggcggccgagaggagccgctccgggctcgggtcaggtttccggtacctcaccggagccgccaccgggtggtgggaccggtggatggtcatgggagccagcggctccaagctcgagaaggctctcggcgaccagttccctgaaggcgagcgctacttcggcctcgagaacttcggcaacacctgctactgcaacagtgtactccaggcactttatttttgcactccattcagggagcagctactggaatattatatgaataataaaaatccgggagatgcagaggaaaatcttttgacttgtttggcagatcttttcatgcaggtaagtcaatcaaagaaaaagacaggcgttattgctccaaaacgttttgtccaaagagtgaagaaacaaaatgaattatttcgcagctacatgcaccaggatgctcatgagttcttaaattttctgttgaatgagcttgttgatattctggagaaagagtccagtgctgcgaaggactcaccccaatcatcatctcctgaaaaagttccaaatgggccagttcaacctttggccaatggagttaaaaaagaaccacctgttaccttggtccataagaatttccagggcatactgaccaatgaaaccaaatgcttaagatgtgagacagtaactgcaagggacgaaacgttttttgatctgagtgttgacattgagcagaatagttccattacaagctgcctgaaaaatttcagctccactgagactttaaatgccgaggacaaattcttctgtgacaaatgttgcagtttgcaagaagcacagaagagaatgaagatcaagaaggctccccatatattggtgatccacctaaagcgctttaagtacattgagcagcttgggcggtataagaagctttcgtatcgggttgtcttccccatggagctgaagatcagcagtacatctgatgatgtggatactgaatactctctctttgctgtggtggtccatgttggaagcggccccaaccatggccattatgtaagcctcgtaaaaagccacaaccactggttgttcttcgatgatgaaaacgtggagatggttgaagagtcgaccctgcaaacattcttcggttcttcgcacgaatactcgggcaacacagatcatggatacatcttgttttacgagggccttggtgggaagagtttaggttgattttccctgttgtgtttcttttctttttctttggagcatgcaagtttactgttgtatgtacacagctatttcaccacctccatggaaaattgttaatctcggagattgtgagtatgaacctgaggaaagccagattttttgtggttctagtgtacagcggaaaatggaaccttgctccagtgatgatgaaataaggcgcaagtcataaagtacgctcgactatactttccaccgacattcttaccaaggaatgtaacaatgcattgggttctgtatgttgattctaatttgaaatttttatgcactagatttagccatctgatgtgctagcagtgcccttcgaggcttggaatcatatgtccagttagaattataatagtatggtgtatgcttgactttatgatggttgaattgatt

SEQ ID NO: 4973 - DNA, 1892 bp, Hordeum vulgare
tctcccacgctgctctcatactctgacctacccaagcccaagctccaatccatccaaacccaacgagctcctaaaatctcctcccatacgccaccgccgccgtgccctggagctaagcgtcaccgccggcgcctcacccacccaactccttcgccccccacgcgcgtcgccgccatcgccgccctcgtttctaccccgtcgcgtcaccgctgactccacccccgcctgcatatccgacatcggttcttgagatccgccctggcctcctcggcggccgagaggagccgctccgggctcgggtcaggtttccggtacctcaccggagccgccaccgggtggtgggaccggtggatggtcatgggagccagcggctccaagctcgagaaggccctcggcgaccagttccctgaaggcgagcgctacttcggactcgagaactttggcaacacctgttactgcaacagtgtactccaggcactttatttctgcactccgttcagggagcagttactcgaatattatacgaataacaaaaatcctggagacgcagaggaaaaccttttgacttgtttggcggatcttttcatgcaggtaagtcaatccaagaaaaagacaggcgttattgctccaaaacgttttgtccaaagagtgaagaaacaaaatgaattatttcgcagctacatgcaccaggatgctcatgagttcttaaattttctcctgaatgagcttgttgacattctggagaaagagtccagtgctgcgaaggactccccccaatcatcatctcctgaaaaggttccaaatgggccagtccaaccattggccaacggagttaaaaaggagccgcctgttaccttggttcataagaatttccagggcatactgaccaatgaaaccaaatgcttaagatgtgagacagtaactgcaagggacgaaacgttttttgatctgagtgttgacattgagcagaatagttccattacaagctgcctgaaaaatttcagctccactgagactttaaatgctgaggacaaattcttctgtgacaaatgctgcagtttgcaagaagcacagaagagaatgaagatcaagaaggctccccatatattggtgatccacctaaagcgctttaagtacattgagcagcttgggcggtataagaagctttcatatcgggttgtattccccatggagctgaagatgggcagtacatctgatgatgtagataccgagtattctctctttgctgtagtggtccatgttggaagcggccccaaccatggccattatgttagcctcgttaaaagccacaaccactggctgttcttcgatgatgaaaacgtggagatggttgaagagtcgaccctgcaaacattcttcggttcttcgcatgagtactcaggcaacacagatcatggatacatcttgttttacgagggccttggtgggaagagtttaggttgattttcccggttgtttttcttttcttttttctttggagcatgcaagcttactgttgtatgtacacagctatttcatcacctccatggtaaattgttaatctcagagattgtgagtacgaactgaggaaagccagattttttgtggttctagtgtacagcggaaaatggaaccttgctccagtgatgatgaaataaggcgcaagtcataaagtacgctcgactatactttgcaccgacattcttaccaaggaatgtaacaatgcattgggttctgtatgttgattctaatttgaattttttgtgcactagatgtagccatctgatgtcctagcagtgcccttcgaggcttgaaatcatatgctcagttagaattacaatgtggtgtatgcttgactttgtgatggttgaattgatttagtgagttctgct

SEQ ID NO: 4974 - DNA, 1772 bp, Triticum aestivum
aagcttcaccgccggcgcctcacaccccccaactccttcgcctctcacgcgcttcgccgccatcgccgtcctcgttctaccccatcgcgtcgccgctgactccacccccgcctgcatattggacatcggtttttgagatccgccctggcctcctcggcggccgagaggagccgctccgggctcgggtcaggtttccggtacctcaccggagccgccaccgggtggtgggaccggtggatggtcatgggagccagcggctccaagctcgagaaggctctcggcgaccagttccctgaaggcgagcgctacttcggcctcgagaacttcggcaacacctgctactgcaacagtgtactccaggcactttatttttgcactccattcagggagcagctactggaatattatatgaataataaaaatccgggagatgcagaggaaaatcttttgacttgtttggcagatcttttcatgcaggtaagtcaatcaaagaaaaagacaggcgttattgctccaaaacgttttgtccaaagagtgaagaaacaaaatgaattatttcgcagctacatgcaccaggatgctcatgagttcttaaattttctgttgaatgagcttgttgatattctggagaaagagtccagtgctgcgaaggactcaccccaatcatcatctcctgaaaaagttccaaatggggcagttcaacctttggccaatggagttaaaaaagaaccacctgttaccttggtccataagaatttccagggcatactgaccaatgaaaccaaatgcttaagatgtgagacagtaactgcaagggacgaaactttttttgatctgagtgttgacattgagcagaatagttccattacaagctgcctgaaaaatttcagctccactgagactttaaatgccgaggacaaattcttctgtgacaaatgttgcagtttgcaagaagcacagaagagaatgaagatcaagaaggctccccatatattggtgatccacctaaagcgctttaagtacattgagcagcttgggcggtataagaagctttcgtatcgggttgtcttccccatggagctgaagatcagcagtacatctgatgatgtggatactgaatactctctctttgctgtggtggtccatgttggaagcggccccaaccatggccattatgtaagcctcgtaaaaagccacaaccactggttgttcttcgatgatgaaaacgtggagatggttgaagagtcgaccctgcaaacgttcttcggctcttcgcacgaatactcgggcaacacagatcatggatacatcttgttttacgagggccttggtgggaagtgtttaggttgattttccctgttgtgtttcttttctttttctttggagcatgcaagtttactgttgtatgtacacagctatttcaccacctccatggaaaattgttaatctcggagattgtgagtatgaacctgaggaaagccagattttttgtggttctagtgtacagcggaaaatggaaccttgctccagtgatgatgaaataaggcgcaagtcataaagtacactcgactatactttccaccgacatccttaccaaggaatgtaacaatgcattgggttctgtatgttgattctaatttgaaatttttatgcactagatttagccatctattgtgctagcagtgcccttcgaggcttggaatcatatgtccagttagaattacaatatggtgtatgcttgacttatgatggttgaattgatttagggagtt

SEQ ID NO: 4975 - DNA, 1507 bp, Musa acuminata
cggcggccgagagggggccggagaggtcgcgttccggtcttggtctagggttccggtacctcaccggggtcgccggcggctggtgggacaagtggacagtcatgggggccgccggctccaagcttgagaaggccctcggcgaccagttccctgaaggcgagcgctacttcggccttgagaacttcggcaacacctgctactgcaacagcgtcttgcaggctctatatttttgtattcctttccgggagcagttactggactattatgcaaataacaagaatctgggcgatgttgaagaaaaccttctaacatgtttggcagacctatttactcagattagctcccaaaagaaaaaaactggtgttattgctccaaaacgctttgtgcagagagtgaagaaacagaatgagtatttccgtagttatatgcaccaggatgctcatgagtttttgaatttcttgctgaatgagcttgttgatattctggaaaaagagtctgatgctgcaaaaagttccccagaaaccttgtcaccatctaaaaagattgccaatggaccaagccatcctgtggctaatggtgtgcaaaaggagccacttgttacatgggttcacaagaactttcagggcatactgaccaatgaaacaagatgcttacgttgtgaaactgttactgcaagggatgaaacatttcttgacttgagccttgatattgagcagaacagttctataacaagctgcctcaaaaacttcagttcaacagagaccttaaatgctgaggacaagttcttctgtgataagtgctgcagtttgcaggaagcacagaagagaatgaagatcaagaagccgccacatattcttgtgatccacctcaaacggttcaaatacattgagcagcttggtcggtacaagaaattatcgtaccgtgtggtgtttcccatggagctgaaacttactaacacggtcgaagatgcggactccgagtactctctctttgcagttgtggtccacgtggggagcggtcccaaccatggtcactacgttagccttgtcaaaagccacaaccactggctgttatttgatgacgaaaatgtggagatgatcgatgaatcaactgtgcagacattctttggttcctctcaggagttttcaggcaacacagatcatgggtacatcttgttctacgagagacttggtggaaagagctaaaaaaaaccctttgcttacatttccttctggcctttctacctgtattagctctttccaatttttactccatgtaacacaatcggaagctcttgggattttgtgaggtgagcgagctagtgagaggatgtgatggtttgggtggatgcaatgtacagtggatggtggaaaagcactgtccgtttgttccaagaataaaatagaaatgtacgtgggtggcaggagcttaaggtacaactttttcctgcactctttgtttttttggctttttggacgtctatgaatacagagtgcgattcttccac

SEQ ID NO: 4976 - DNA, 1757 bp, Aquilegia formosa
aaattttctccccaactcccaatcaacttcttttaatctctttctctctctaaaacacaaacatctctctatctctctcttatcgctttctctctccaccgtactctctcttaaacaaacctctctctcgctctttctctttctctctctgcaactagttaaaaacacgaaaccctaatttagctgaaacagaataagaaatcaaaatagcttgttttgaatctagttgttcatggcgatagaatcgctttagctcaagttgagaaaaaaagaagaaggagatttgttgttgttatgggtgccgcaggttctaagcttgagaaagctcttggtgaccagtttcctgaaggcgagagatactttggacttgagaatttcggaaatacttgttattgtaatagcgttttacaggccctctacttctgtgttccattccgtgaacaattgcttgattattatgcaaataacaaaactacgggtgatgttgaagaaaatcttttgacatgcttggcagatttattctcacagataagttctcaaaagaagaaaacaggcgtcatagctccaaagcgctttgtacagagagttaagaagcaaaatgaacttttccgcagttacatgcaccaggacgctcatgaatttttgaacttcctactaaatgaacttgttgacattctggagaaagagtctaatgctgcaaaaatttctcctgaagcttcatcaccatctgaaaaggttgcgaatggccctagaactgctcaatccaatggcgttcagaaggaacctctagttacctgggttcacaaaaatttccagggtatattgaccaatgagacaaggtgcttacgttgtgaaacagtcactgcaagggatgagacatttctagacttgagccttgacattgagcagaacagttcaattaccagttgtcttaagaatttcagttctacagagactttgaatgccgaggataagttcttttgtgacaagtgctgcagtttgcaagaagctcagaagaggatgaagataaagaaacctcctcatatcctggttatacatctaaaacgtttcaaatacattgaacaactcggaagatacaagaagctgtcatatcgtgtggtctttccgttggagcttaagctaagcaatacggtggaagacgcagattccgagtattctttatttgcagttgtggttcatgtggggagtggacccaaccacgggcactatgtcagcctcgtgaaaagccacaatcactggttgttctttgatgatgagaatgtggagatgattgatgaatctgccgtgcagacattctttggatcatcacaggagtattccagcaacactgatcatggctacatcctattttacgagagccttgctacaagtagcaagagttgagcaaggatcaaaagtattatggtgatttgttcactcaaggagtggttggtaattgcctattctaatgaactccttttcttgtaattttgatttccttttcccccctttctttaacttaatgggaggagctctcagatgccagtaacttaggtgagtcacaatgtgaaagaaagtattttcaggttgcaggtggttgccatgtacagtggatagtggtgggaaacacacatctatcttgtttttcaacaataagaaaaggattgtaaatcgtattgaaagagaggatttcacagacaattgtaatctttactgttcggaacattttatttataatagaaatgcaattgcagtcc

SEQ ID NO: 4977 - DNA, 1738 bp, Aquilegia formosa
aaattttctccccaactcccaatcaacttcttttaatctctttctctctctaaaacacaaacatctctcctatcgctttctctctcctatcgctttctctctccaccgtactctctcttaaacaaacctctctctcgctctttctctttctctctctgcaactagttaaaaacacgaaaccctaatttagctgaaatagaataagaaatcaaaatagctgtagttgttcatggcgatagaatcgctttagctcaagttgagaaaaaaagaagaaggagatttgttgttgttatgggtgccgcaggttctaagcttgagaaagctcttggtgaccagtttcctgaaggcgagagatactttggacttgagaatttcggaaatacttgttattgtaatagcgttttacaggccctctacttctgtgttccattccgtgaacaattgcttgattattatgcaaataacaaaactacgggtgatgttgaagaaaatcttttgacatgcttggcagatttattctcacagataagttctcaaaagaagaaaacaggcgtcatagctccaaagcgctttgtacagagagttaagaagcaaaatgaacttttccgcagttacatgcaccaggacgctcatgaatttttgaacttcctactaaatgaacttgttgacattctggagaaagagtctaatgctgcaaaaatttctcctgaagcttcatcaccatctgaaaaggttgcgaatggccctagaactgctcaatccaatggcgttcagaaggaacctctagttacctgggttcacaaaaatttccagggtatattgaccaatgagacaaggtgcttacgttgtgaaacagtcactgcaagggatgagacatttctagacttgagccttgacattgagcagaacagttcaattaccagttgtcttaagaatttcagttctacagagactttgaatgccgaggataagttcttttgtgacaagtgctgcagtttgcaagaagctcagaagaggatgaagataaagaaacctcctcatatcctggttatacatctaaaacgtttcaaatacattgaacaactcggaagatacaagaagctgtcatatcgtgtggtctttccgttggagcttaagctaagcaatacggtggaagacgcagattccgagtattctttatttgcagttgtggttcatgtggggagtggacccaaccacgggcactatgtcagcctcgtgaaaagccacaatcactggttgttctttgatgatgagaatgtggagatgattgatgaatctgccgtgcagacattctttggatcatcacaggagtattccagcaacactgatcatggctacatcctattttacgagagccttgctacaagtagcaagagttgagcaaggatcaaaagtattatggtgatttgttcactcaaggagtggttggtaattgcctattctattgaactccttttcttgtaattttgatttccttttcccccctttctttaacttaatgggaggagctctcagatgccagtaacttaggtgagtcacaatgtgaaagaaagtattttcaggttgcaggtggttgccatgtacagtggatagtggtgggaaacacacatctatcttgtttttcaacaataagaaaaggattgtaaatcgtattgaaagagaggatttcacagacaattgtaatctttactgttcggaacattttatttataataga

SEQ ID NO: 4978 - DNA, 1998 bp, Elaeis guineensis
ggtgtgtggagtcaacagaagaaatcaccgagatagaagaggaggacccggcgattaatccatcgacgcctctccatcgctctcccgcttgcttcttctcaccctcaactcctgacgcgatgatcgaaagggcgaaacggaaaccctagggcactgcctccccttactctccaaagaagccggtttcaaaccctaggaggctgcatccgtctccggcacccacggcggaggacgggaagcgcgcggtggcggcggtggcggtggtggaaggagggttggagaaaggaaggtcgtcggcggggccggggctggggaccgggctgcggtatctcgccggggtcgccggggggtggtgggacaagtggatggtaatgggagccgcggggtccaagctcgagaaggctcttggagaccagttccccgaaggcgagcgatacttcggcctcgagaacttcggcaacacttgctattgtaacagcgtcttgcaggcattatatttttgtgttccattcagggagcagttactcgaatattattcaaataacaagaacctaggagagacagaggagaacattttgacatgtttggcagatttgttcactcagataagttcccaaaagaaaaaaactggtgttatcgctccaaaacgttttgtgcagagagtgaagaaacagaatgagtatttccgtagttacatgcaccaggatgcgcatgagtttttgaatttcttgctgaacgagctcgttgaagttcttgagaaagagtctagtgctgcaaaaagttcccctgaaacctcatcagcatcagaaaagactactaatgggccagtccaccctcaagcaaatggagtccgtaaagagccacttgttacatgggtccataagagttttcagggtatattgaccaatgaaactagatgcttacggtgtgaaacggtcactgcaagggatgaaaccttttttgacttaagccttgacattgagcaaaatagttctatcacaagctgcctcaaaaacttcagttcaacggagactttaaatgctgaagacaagttcttctgtgacaagtgctgcagtttgcaggaagcccagaaaaggatgaagattaagaagcctccgcatatcctggtgatccatctcaagcgcttcaagtatattgagcagcttggccgatacaagaaattgtcataccgggttgtgtttcccatggagttgaagcttaacaacacggttgatgatgcagactctgagtactctctctttgcggttgtggtacatgtcgggagtggtcccaaccatggacactatgtcagccttgttaaaagccacaaccattggttgttctttgatgatgaaaatgtggagatgatagacgagtccattgtgcagacgttctttgggtccgcacaggagtactcaggcaatacagatcatgggtacatcttattctatgagagccttggaggaagaagttaagagagaggttttcgtcacagctggttatttgcctggcgcttgtttacctccattactttcccctccatggaacaattagacgttcttggagctgtgtaagatgagatgtgaaagatgtgatcttttgggtgattgtagtgtacagtggatagtggaaatgcaccgtctgtttcttcaacaataaaatagaagtctacatgggtggtaaaggttttagtcgtgttgtattcttcaatgttgatatataatagacaatgcgatcttcccccagagagtatttcttgtgagctgtagctgcatgtattggaaagcaggacttataggactttttcttgagccttgatacctttgactgtacatgcgagggggcctggatcttccgcactttataagccagttttgtctatcaaattttggcaaatgtaaaaacctagacaggaaattagactgcaggtaattgtgtctgtaattgaattgaatggactggattctcaactttttaaggtttatgcaggattctgtt

SEQ ID NO: 4979 - DNA, 2108 bp, Vitis vinifera
cgtctctcccatatttctttttccgtctcatctcttccaaatttcgctgccaattccctctggaagaaaccctaacgttcgaaaatagagaaaaagggttgaagagcgtttttggatggtgaaggaattcctgagttgaaacggacgatcgatccgagtcgccgtggttatttgctcaatcctccgatgggcgctgcaggttcgaagctcgagaaagctcttggcgatcagttccccgaaggcgagcgatacttcgggctcgagaattttggcaacacttgctattgcaacagcgtcttgcaggctctttatttttgtgttccatttcgtgaacaattgctagaatattacacaaataacaaaaatctcgcagatgcagaagaaaatctattgacatgcttggcagacttattcatgcagataagctcacagaagaagaaaacaggtgttattgcaccaaagcgttttgtacagaggctgaagaaacaaaatgagctttttcgcagctatatgcaccaggatgcacatgaatttttgaacttcttgctaaatgaacttgttgacatactggagaaggaggcttctgcttcaaaaagtgatccagaaacctcatccccacctgagaagactgcaaatgggccaaagactgctcaggctaatggtgttcagaaagagcctctagttacctgggtgcacaaaaattttcagggtatactcacaaatgagacaaggtgcttgcggtgtgaaacagtcacagcaagggatgaaacatttttggacttgagcctggatattgaacagaacagttccatcacaagctgtctgaaaaattttagctcaacagaaactttgaatgcagaggacaaatttttctgtgacaaatgctgcagtttacaagaggcccagaaaagaatgaagataaagaaaccacctcacatactggtcatccatttgaagcggttcaagtacattgagcagctgggcaggtacaagaagctatcttaccgggttgttttcccgcttgagctgaagctgagcaatacagtagaagatgcagattctgaatattccctctttgctgtggttgttcatgttggaagtgggcccaaccatgggcactatgtgagccttgtgaaaagtcataaccattggttattttttgatgatgaaaatgtggagatgattgatgagtcttccgtgcaaactttctttgggtctgcacaggagtattcgagtaacactgatcatgggtacatcttgttctatgagagccttgctacaaatgacaagagctaagaagccggggattcagttttatgatgtgtaggtattcttaatcttcgaactcgattttcttttgttccctatgttttatttatttctctttatcaccctatttaacctgtgggaagagcctctcaagtatcagtgagatgatatgggatgtgaaaagtgtatacttaggtggttgccatgtacagtgggtggtggaagctcaccgtcctttttttttttttttttttttaacaataagggaaaaaaaaaagccatatatttggtggtgaatgaggatttcagagagaaatttgtactcttcataacaatagaaatgcaatgaatgaaattgctcccaaccaatggctatctatatgaacctacaaagaggctatttttttgtaggtttattttttggatgcctattttccttatagcattggattgatggaggatagtttgagctataagatttgaccaacatggcatgcatatggaatttgtaatatgtgctttcaggtatttggattttggtctaattatgtacctgagaatttcaagaggagaacaacagtcggcacacctctgtcactggggccatccctcccaagatgagctgaaggatttcagtgttttgtattgtttatccattttttttctctctcccggttcagggttggattttgagggcatcagaaattggtgagattagggttttggacttgttccattattgactgaaactgggttctggattccggcactgtaacaaatttaactgaattttatcttctatggctttagtagtccattcatattctgcactgttgttt

SEQ ID NO: 4980 - DNA, 1817 bp, Elaeis guineensis
ccgtgaaaccctaagaatcgccgaccaatccttgctcatttgtcttcgtcgacggagtgggagctgctgagagagggagagagagggaagacgtctagggttagggtttcgatcgagatcgggcgccgggggtggagcttttggcggcggtgaggagggcttggatggtgatgggagccgcgggctccaagctcgagaaggctctgggagaccagtttcccgaaggagagcgctactttggcctcgagaacttcggcaacacttgctattgcaacagcgtcctgcaggctctttatttttgtctccctttccgagaacaattactggagtattatgcaaataacaaaactgggggagaagcagaagacaatcttttgacatgtttggctgatctattcactcagattagctcccagaagaagaaaactggtgtgattgctccaaagcgttttgtgcagagagtgaagaaacaaaatgagcttttccgcagctatatgcaccaggatgcccatgaatttttaaatttcttgctgaatgagcttgttgatattctggagaaagagaatgctgcaaaaacttcccctgaaatctcatcatcatcagaaaagattgcaaatgggcctagccatcctcaaggcaatggtgttcgaaaagagccagtttctacatgggtgcacaaatgttttcagggcatactgaccaatgaaacaagatgcttacggtgtgaaactgtcactgcgagggatgaaacttttttcgacctaagccttgacattgagcaaaatagttcgatcacaagctgtctcaaaaatttcagctcaacagagactttaaatgctgaggataagttcttctgtgacaaatgctgcagcttgcaagaagcccagaagaggatgaagataaagaagccaccaaacatcctagtgatccatctcaagcgcttcaagtacattgagcagcttggccggtacaagaagctatcgtatcgtgttgtgtttcctttggagctgaagcttagcaacaccattgacaacgcagactgcgagtattctctctttgcagttgtggtgcatgttgggagtgggcccaaccatggtcactatgttagtctggtcaaaagtcataaccattggctgttcttcgatgatgaaaatgtggagatgattgatgagtccatgatacagactttctttgggtccacgcaggagtactcgagcaacactgaccatgggtacatcttgttctacgagaggcttggtggaagaagttgaaggctttacaaacttctcagtttgtgggtgattacactctgctcgtttcttctcaccatatcaaatatttttcctccatttggaatagctcacagaaatctttatgctggagcgacagcatccaatatcagaggtagtcatgtatagtggatgctgacgcatcatcttgttcatttgataataaagtgaaaatgagttttgagggtttcagtgaggaggagatttcctttgtatccttcactgttggatatttcaatatagcaaaatgcaattgccccaaacaagctctctgggaggttagcttaagttttgatagcaacattctggaactgcttataattgatccttcaatcaattccagatgctaggaagtaataacggttagtctttctaagttaccagggagttcattgttctttctctagcctaaactttaaaaattagctcttaaagttagtccaatgaatagatatgttatttaccctaaaaaaaaaacaaaaactaagagactacgacgaacgacgacacggaagggaaggtagaggg

SEQ ID NO: 4981 - DNA, 1658 bp, Manihot esculenta
aaagccaaacaaaccctcgtctccctttcattacctgcaaaattcccatttcccgaacaaaaccctaatagcaatccaaacttacccgacagggtcatacagataatagccgagaagacttgtttatggaaattgttgaatcgctgagttgaatcggacgagggagccacagagatctgagtctaatcaatccatgcactgatgggtgctgcaggctccaaactcgagaaagctcttggagaccagttccctgaaggcgagcgatactttggcctcgagaattttggcaacacttgctactgtaacagcgtcttacaggcactttacttctgtgtaccatttcgagaacaattactagaatattatgcaaataataaaaattcaggagatgctgaagagaatctattgacatgcttagcagacttatttacacagataagttcacagaagaagaaaacaggtgtaattgctccaaagcgtttcgtacagagattgaaaaaacaaaatgagcttttccgtagctatatgcatcaggatgctcatgaatttttaaattttttgctaaatgaacttgttgacatactggagaaggaggctcaagctgcaaaaagtgacccagaaacttcatccccacctgaaaagactgcaaatgggccaaagaatgctcaggcaaatggtgtttcaaaggagcctttggttacttgggtgcacaaaaattttcagggaattcttaccaatgagacaagatgcctgcagtgtgagactgttacagcaagggatgaaacatttttcgacttaagccttgatattgaacagaatagttcaataacaagctgtttgaaaaattttagttccacagagactttgaatgcagaggataagtttttctgtgacaagtgctgcagtttgcaagaagcccagaagaggatgaagataaagaaacctcctcacatattggtgatccatctgaagaggttcaaatacattgagcagctgggtcggtacaagaagctatcttatcgagttgtgttcccacttgagctgaagctgagtaacaccatggaagatgcagatattgaatactcattatttgcagtagtagttcatgttggaagtgggcccaatcatggacattatgtcagccttgtcaaaagccacaatcactggctattttttgatgatgaaaatgtggagatgattgatgagtctgctgtgcagacattttttgggtcagcacaggaatactcaagtaatacggaccatggatacatcttgttctatgagagcctaggcgctagtagcaagagttgagaagatgatggctttggttttacaagtaggtacatttaaacaacgtttggactgatctcatttttcagttattattgtttttcttttcccttctgtccttcaaccactgggaaatgggaagagctctcaaattagagatttgggaggatgatgatatgggttgtgaaaaatgtatacttgggttgtttccatgtacagtggatggtggaagctcactgtccttttgtttttttccagaataagaagaaagaagatcagtgtatatggtgtgagaaattcagagacactttgtattcttcatggttgagaacgtcttaattaaacattagaaaatgcaattcaattgg

SEQ ID NO: 4982 - DNA, 1726 bp, Ricinus communis
aaaacgaaacaaacaagcgaaccctcgtcgtgtcgtccccttccttttcatttcattttcctgcgaaaacaaaattataaaagaaaaagaaagatttcacaaacaaaccctaatttgcaatacataaaacattgaaacagcgaagataaacaaaatagaaaacagaaaagtgtagaaactattgaatcggagagaatatcaataaatcgatgcagtaatgggagcagcaggctctaaactcgagaaagctctgggcgaccagtttcctgaaggcgaacgatactttggcctcgagaattttggaaacacttgttactgtaacagcgtcttgcaggcactttatttttgtgtaccttttcgagaacaattactagaatattatgcaaataataaaagtggtggagatgctgaagagaaccttttgacatgcttggcggacttatttacacagataagttcacagaagaaaaaaacaggtgtaattgctccaaagcgttttgtacagagattgaaaaaacaaaatgagctttttcgtagctatatgcaccaggatgctcatgaatttctgaatttcttactaaatgaacttgttgacatactggagaaggaggctcaagctgccaagagtgatccagaaacttcatcctcgcctgagaagattccaaatgggcccaagaatggtcaggcaaatggtgtttcaaaggagcctttagtgacctgggtgcacaaaaattttcagggaattcttaccaatgagacacgatgcctgcagtgtgagactgttacagcaagagatgaaacatttttcgacttgagccttgatattgaacagaacagttcgataacaagctgtttgaaaaattttagttccacagagaccttgaacgcagaggataagtttttctgtgacaagtgctgcagtttgcaagaagcccagaagaggatgaagataaagaaaccccctcacatcttggtcatccatttgaagaggttcaaatacattgagcagctgagccggtacaagaagctatcctatcgagttgtattcccacttgagctgaagctgagtaacacagtagaagattcagacattgaatactcattatttgcagtagttgttcatgttggaagcgggcccaatcatggacactatgtcagccttgtgaaaagccataatcactggctgttttttgatgacgaaaatgtcgagatgattgatgagtctgctgtgcaaactttctttgggtcatcacaggaatattcgagtaatacggatcatgggtacatcttgttttacgagagccttggtgctagtaacaagagttgaaaaaagagagtgttggttttacagataggtactttaatcattcggactggactcatcttttccttattttctgttattattgttttaccttttcccttttgaccttcaacaagtgggaagagttctcaaatgtcatatttgagaatgataatgatgagttgtgaaaaatgtatacttgggttgtttccctgtacagtggatggtggaagcactgctatccttttgtttctttcttcttctttttctttttccccttttactttctcagaataagaggaaagaagatcagtgtatatggtgtgagaatttcagagacactttgtattcttcatggttgagaatgtttaatcattcattaaaattgcgatccaatgggaacttctcaaattgatatgcgaa

SEQ ID NO: 4983 - DNA, 1949 bp, Amborella trichopoda
ttgtgcaacaactgcactatactcgatcgaaaacggacccatctctctctctctctcctctgaaacaagggcagatcacactcgcaaatccttctctctgaaactctaccttctctctcctgaaaatttccttatactctctctctctctctctccatctatctatctttctttctatcggatttatgcgctgttttttcacgacttttagccagttgttttgttttcatggaagaatcagagcatgcctcctaattaattagaggctgaatgcgtgattaggagtagggcatggtcatgggagccgctggttcgaagcttgagaaggccttgggtgaccaattccctgaaggcgagcgttactttggtctagagaactttggtaatacctgctactgcaacagcgttttacaggccctttatttctgtgtcccttttcgtgagcagttgttagaatactacggtaataacaagactcagggagatgcagatgataaccttctgacttgcctggctgaacttttctctcagatatgctcacagaagaagaaaacgggtgttattgcaccaaagcgttttgtccagagagtgaagaaacagaacgagctttttcgcagttacatgcatcaggatgcacatgaattcctgaattttctattgaacgagctggttgatattttggaaaaagaatctaatgctgcaaaagcttctccagaaacttcatcaccatctgaaaaaactgccaatgggccccgtagtcttcaacctaatggtgtccagaaagaacctctggtcacctgggttcataagaattttcagggtatactgactaatgaaacgcgatgcttgagatgtgagactgtgaccgcaagagatgagacgtttctcgacctgagtcttgacattgaacagaatagttccattacaagctgtcttcgaaacttcagctctactgagacattgaacgcggaagacaaattcttctgtgacaagtgttgcagcctacaggaagctcagaaaagaatgaagataaagaagccacctcatatccttgttatccaccttaagcgcttcaaatacattgagcagcttgggcgatacaagaagctttcttatcgtgttgtcttcccattagagctcaagcttagcaacacagtcgaggatgcagattcagaatactctctattcgctgtggtggtccatgtgggttcaggccccaaccatggtcactatgtgagccttgtgaagagccataaccactggctgttttttgatgatgaaaatgtggaaatgattgatgaatcagctgtgcagaccttctttgggtctgcgcaggagtactcaagcaacactgatcatgggtatatcctcttctacgagagcctcaagtgagagaatgttatcatgtgaggagcctcaagggagaacggaagagtatgctgattttcctccagtgagagagaagcatgttgattttttttatggtttcgggtatttgttctgttccgtggtatgatctcaactctcccaatttatgtctacttggcacggggcagtggctatggttcctctaatttttcaagtgtttagaagagaactcggggaaaatttggtttttttgttggtcattttctttgatttttccttttacaatatattctcgagtacatgcacagatgggggtgcctatttgagtgccatggatgtgaagtatcattgcaatgttgccatgtacagtggacagttgaagcacactgtcctttgttcaataaggagtgtaaattgaggttagagacattgtatttttctctgatgggacgtattttattttgtcatagaaatgcaatttgttccagcaacttcatgttttattttccttctggtattccatggttttagagcaggggagcttcttttacctgaattatttattgttgttgaaccaaaaa

SEQ ID NO: 4984 - DNA, 1272 bp, Carica papaya
ctctgctcatcaggaagcaaagctaaagaacgaaaccctcatttccttttcgtagaaatttctcattaccgaaacaaggaccctaacgatttaagggaacattgggcaagagagacagtttatggaatcactgagttgaatcggccgaggaaagatctaagagactgcagtgcgaaaactacgcgctaaatgggtgctgccggctcgaaactcgagaaagctctgggcgaccagtttcccgaaggcgagcgatacttcggactcgagaattttggcaatacttgctactgcaacagcgttttgcaggcactttatttttgtgttccatttcgcgaacaattgctggaatattatgcaaataataaaaatgttggggatgctgaggagaatctcttgacatgcctcgccgacttatttacgcagataagttcacagaagaagaaaactggtgtcattgctccaaagcgctttgtacaaagactgaagaaacagaatgagctcttccgaagctatatgcatcaggatgcacatgaattcttgaattttttgctaaatgaacttgttgatatattggagaaagaggctcaggctgcaaaaagtgatcaagaaacatcctcacctcctgagaaaattgcaaacgggccaaagaatcatctggcaaatggtgttcaaaaagagccgttagttacatgggtgcacaaaaattttcagggaatactcaccaatgagacaaaatgcttgcgatgtgagacagtgacggcaagagatgaaactttctttgacttgagccttgatattgaacagaacagttccataacaagctgtttgaaaaattttagttcaacagagactttgaatgctgaggacaaatttttctgtgataaatgctgcagtttacaagaagcacagaagaggatgaagataaagaagcctcctcacatccttgtcattcatttgaaacgattcaaatacattgaacaactgggaaggtacaagaagctttcttaccgagtcgtcttcccactcgagctaaagctcagcaacacagtagaagatgcagacatagaatattcactgtttgccgtagttgtccatgttgggagtgggcccaatcatggacactatgttagcctcgtgaaaagccataaccattggttattttttgatgacgaaaatgtagagatgattgacgagtctgcagtgcagacatttttcgggtcagctcaggagtattcaagtaatactgatcatgggtacatcttgttctatgag

SEQ ID NO: 4985 - DNA, 1809 bp, Gossypium raimondii
aattgatctaaaaagatgttttaaatagatgctaccgagaacagaagcaagaatcatttcctttggctccttttcactgctcttaacggaaatagggaaacggtggaaaccttttttttttaattgtcctccaaacaaaccctaagtcggattcggataaaccgaagagagcaagatagagccagtcgttgatggggtattgaatcgctgagttgaaccggtcggaagaagatccaagttagagttgtagacgaactcaattctatatctaatagatgggcgcggcgggttcgaagctcgagaaagctttgggtgaccagttcccggaaggcgaacgatattttggtctcgaaaactttggcaacacttgctattgtaacagcgttttgcaggcactttatttttgtgtcccatttcgcgaacagctgctagaatattattcaagtaataaaaatggtgttgatgctgaagataatctgctgacatgcttggcagatctgtttacacagataagttcacagaagaagaaaacaggtgtcattgctccaaagcgctttgtacaaagattgaagaaacaaaatgagctttttcgcagctatatgcaccaggatgctcatgagttcttgaactttttgctaaatgaacttgttgatatactggagaaagaggcacaagcagcaaaaaatgatgcagaaacttcttcaccatctgaaaagactgcaaatgggccaaagaatcctcaggctaatggtgttaaaaaagagcctttggttacttgggtacacaagaattttcagggaatacttaccaatgagacaagatgcttgcgatgtgagacagtgacagcgagagacgaaactttctttgacttgagccttgacattgaacagaacagctcaataaccagctgtttgaaaaattttagttctactgaaacattgaatgctgaggacaaatttttctgtgacaagtgttgcagtttgcaagaagcacagaagagaatgaagataaagaagcctcctcacatcctggttatccatttgaagcggttcaagtacattgagcagcttggacgatacaagaagctctcctatcgtgttgtatttccacttgagctgaagctgagcaataccgtggaagatgcagatttggagtattccttatttgctgtagttgttcatgtgggaagtggacctaaccatggccactatgttagcctggtaaaaagccataaccactggttattttttgatgatgaaaacgtggagatgatcgatgagtcggcggttcagacattttttgggtcagcccaggagttctcaagtaatacagatcatgggtatatcttgttttatgaaagcctgggtgctggcaacaagagctaagaagtgagtttgagaaggtattctaataatcttcacttagacctcattttcttttaattgcgagaagaggtggcatataatgatgtgggttttgagaaaaatgtatacttgggtcattgccatgtacagtgaatggtggaagcaacctgtcctttttttttttttcttgttttacaataagagggaaaaagaagagtgtataggtttgagaaatatcacggagactgtgctgtgtatgatttaacagtttttctctatctgtagtttctcctgcagagcttagacctttgttaattcaaagagagagaagctgtttcatgttcatgctttcctattaacttctaatactcattcatttccgaaaagcaagatttatgtgaattaaccaagagtaactaatatcatagcctcatggattaggcgg

SEQ ID NO: 4986 - DNA, 1495 bp, Chelidonium majus
cgaacgtaaccctaaactttagtttccttccttattaattacctaactttaatttagtttactttcttcttcttcttaaaaacaccctatctttgtctaccacttctggttgaagaaccctaaaattagaattagaatatctatacatatatagagagagaagtgaatctggtggttatggagagagaaaatcaaagctgaaaaagaaaacgacggagagagataaagggttgttgttgttgttggggtgttgggttaaaggggtggtgatgggtgccgctggttcgaagcttgagaaagctctaggtgaccagtttcctgaaggcgaaaggtacttcggactcgagaatttcgggaatacttgctattgtaacagcgttttacaggctctctatttttgtgttcccttccgtgaacaattgcttgaatattatgcaaacaataaaactccaggtgatgcagaagagaatcttttgacatgtttggcggatttattcactcagataagttctcagaagaagaaaacgggagttattgccccaaagcgctttgttcagagagtgaagaaggaaaacgagctattccgtagctacatgcaccaagatgctcatgagtttctgaacttcttgcttaatgagcttgttgacatactagagaaagagtctcgtgctgctgctgctgctaagaattctccagaaacttcttcaccagctgaaaagactgcaaatgggccgaggaatctgcaggcaaatggtgttcaccgagaaccgttggttacctgggttcacaaaaactttcaggggttactgaccaatgagacgaggtgtctacggtgtgaaacagtgacagcaagggatgaaacatttttagacttgagtcttgacattgaacagaacagttccattactagttgcctaaaaaatttcagttctacagagacattgaacgctgaggataagttcttctgtgacaagtgctgcagtttgcaggaagcccaaaagaggatgaagattaagaagccacctcaaatccttgttatccatctgaagcggttcaagtacattgagcagcttggtaggtacaagaagttatcttatcgagttgtcttcccgttggagctgaagctaagcaataccgtggaggatgcagactccgagtactctctatttgcggtggtcgttcacgttgggagtggaccaaaccatggacattatgtaagcctgtgaagagtcacaatcactggttgttcttgatgacgagaatgtagagatgattgacgagtcagcagttcagacattctttggctctgctcaggagtacacgagtaacacggatcacggatacatcttattctatgagaaggttgctactgctagccagacttgagtagggaaattggttacatggtgagtctgtttcctatttgttctgtttagttgagaggggtggttggtgttttctatcatccaaatcttctaccttattctactttggt

SEQ ID NO: 4987 - DNA, 1659 bp, Malus domestica
ctctctctctctcgctctctctctcaactcaaccttcattttgttcatgctccacttccgaacaaaaccctaagaattcaacacatacacacacacagcgacgcggtgagcaactcagttgtcaatggcatgcgaatcgttgacttgaatcggagagagaggatctgagtcgtcggcgacataatttagattgtgtattgactcggtctgatgggtgctgcgggctccaaactcgagaaggctctcggcgaccagtttccggaaggcgagcgatatttcggactcgagaatttcggcaatacttgctattgtaacagcgttttgcaggcactttatttttgtgttccgtttcgtgagcagttgctagaatattattccagcaacaaaagtgctggggatgcagaagaaaatctgttgacatgcttggcggatttgtttacacagataagttcacaaaagaagaaaacgggtgtcattgctccaaagcgtttcgtacaaagattgaagaaacaaaatgagcttttccgtagctatatgcaccaggatgctcatgaattcttaaactttttgttaaatgaacttgtggacatactggagaaagaagcccaagctgcaaaaagtgatcaagaaacttcttcacctcctgaaaaaatgggaaatggtccgaagaatgttcaggccaatggtactcataaagatcccttagttacctgggtgcacaaaaattttcagggtatactcaccaatgaaacaaggtgtttacggtgtgagacagtgactgcaagagatgaaacattttttgacttgagcctggatattgaacagaacagttcaataacgagctgtttgaaaaacttcagttccacagagacattaaatgccgaggacaaatttttttgcgacaagtgctgcagcttgcaagaagcgcagaagaggatgaagataaaaaagccgcctcacatccttgtcatccatcttaaacggtttaagtacatcgagcagctaggccgttacaagaagctatcttaccgggttgtattcccgctagagctgaagctgagtaacacagttgaggatgtagaatctgagtactctctatttgcggtggttgtccatgttggtagtgggccaaaccatggacattatgttagccttgtgaaaagccataaccactggctattttttgatgacgagaatgtggagatgattgatgagtctgctgtgcaaactttctttgggtcggcacaggagtattcgagtaatacagatcatggatacatcttgttctatgagagcctcggcaccagtaacaagagttaagacaacggctcgggatttaagatggttgggtatttctaatcatttggacctttacgcttctgtttttttgtttaccatctctcttttcttctttttcttcccttttcaacctgtggccagagctgtcgagatgatgatatgggttgtgaaaaatgtatacttaggcggttcgcgtgtacagcggatggtggaagcacaccattctttttttcctttctttttctttttaacaataaggaaaagagtagtgtatatggtgagaaatttcagacagtattcgtcacggttgagaacattaaacactagaaatgccatgaaatcggaatttgctcatcgcca

SEQ ID NO: 4988 - DNA, 2933 bp, Citrus clementina
ctcaaccaaccgaaatcacccttacatcccaatgacgacaaactcccaaagtactcatccaaagtgatcaccacctcatctcaccatttggaagcagtaaacataagtttcattcagcatttcactttaaaaaggggaattcccacaacatcttcctgagcctcttgttttatattatatagttagctcaaaactcatcgtcatcttttggctgcttcgctgcgttgagtgagcaatgtgccttcgtgaacagcgctaagtacgtacttgagtaagcaatcgataaggctggcttctccttttgtttttatatttttcttttgtaaaattttattatatgaattatgttatatatataactaaatttttttatatgaaataataaagcaagaacaacattttatttgtcttccctttaccttactgaaattttcaaacgttagtctaaataaaatttttatgggaaaaggtttagtgaaaattattttaaaaaatttaaaataatgtgcaacggatgggtgtgcctttttttattaaaagaactatgagcttataatttaatatgttggttcaataaaaacatacctatttcaccatcacgagtattttatataatcattcacaatatttaaaattatttttaagattcttaatttatctataatcttatataacaaacattgtgcttaatttttaaatattggtcgatgttaaaaaattaaaattaaaaaataaaagtacttgttgcatagtttttcaataactcattcataacatgaataacaactattgatttggttaacacaaaacataatttatatatcaaccattaaaattttttaatttaacaaaaaaatatgtacgcttcttataaagtttttcgtaattaataaaatgttgttccctatgattttattaagtcgcgataaataaatcatttaggatggtcatgtgagtataattatcattaaaacaataaaaaaaatttcagtaacaagcttttgtccttgtaatttgtgttaattatttctttttaatttaaccaaatatttttcgcgtacaatttacagcttggcaggctggcagcacgtgatatggagtggcagcagcaaattcaaaggagtggcaaactaattttttttttttaaacaaaaaaacctcatatatattattattattatttattttaatccgtcatcccctaactttcatttgtttatttcggaagaatttattttactttattttcttcaccgttcttatttcccctctccattttttcttcacttgaatataaaagaaaatcactaaccctaactgattcaattcaattcaattttaattcaattttcaattgaaaacagaagaacaaacaataaacatatgggaagtgaatcggcgtggtgagttgaatcggagcgggtgaagaagatctaaaactgagtggtgagtaatgggtgctgcgggttctaaactcgagaaagctctcggcgaccagttccctgaaggcgagcgttacttcggcctcgagaatttcggcaacacttgctattgcaacagcgttttgcaggccctttatttttgtgttccatttcgtgaacaattgctagactattactcaaataataagaaccttggggatgctgaagagaatctcttgacgtgcttggcagacttgtttacacagataagggctcagaagaagaaaacaggtgtcattgctccaaagcgctttgttcagaggttgaagaaacaaaatgagctttttcgcagctacatgcatcaggatgctcacgaattcttgaatttcttgctaaacgaacttgttgacattctggagaaagaggaagctgcaaaaagtgatccagaaagttcatcgccatctgagaagactgcaaatggcccaacaaatggtctggcaaatggtgttcgaaaagagccattggttacgtgggtgcataaaaattttcagggaattcttaccaatgagacaaggtgcttgcgatgcgagacagttacagccagggatgaaactttttttgacttgagtcttgatattgaacaaaatagttctataacaagctgcttgaaaaattttagctccacagagactttgaatgctgaagacaaatttttctgtgataaatgctgcagtttgcaagaagcgcagaagaggatgaagataaagaaatctccccatactctggtcattcatcttaagcgatttaaatacattgagcagctggggcgatacaagaagctatcttaccgtgttgtctttccgcttgagctgaagcttagcaacacagcagaagatgcagatattgagtattcgctatttgctgtagttgtccatgtaggcagtggaccaaaccatgggcattatgtcagtctcgtgaaaagtcataaccactggttattttttgatgatgaaaatgtggagatgatcgatgagtctgctgtgcagacattttttggatcggcacaggaatattcaagtaatacggatcatgggtacatcttgttctatgaaagccttggtgctggtagtaacaagagctgagtagagagacgggcgggttttggttttacaatgattaggtattttaatcattcggactaatttttcttctgttgtctatgtttattattttcatttcttttgcctacttcaccctgtggaaagagctatcgatgctataaagcgggttgtcaaaagaatgtatacttaggtggtttccatgtacagtgtggatggtggaagcacactatcctttttttttttttggttcacaaataagagggaagggagcaacagtgtatatggtgtgtgagaattttcacaagagacaatttgtattcttctatggttgagaatgttcaattaacaccataaatgcaaatacaatgcagttggaattgctctcttattt

SEQ ID NO: 4989 - DNA, 1624 bp, Gossypium hirsutum
ttttttttaattgtcctccaaacaaaccctaagtcggattcggttaaaccgaagagagcaagatagagccagtcgttgatggggtatgaatcgctgagttgaaccggtcggaagaagatccgagttagagttgtagacggactcaattctatatctaatagatgggcgctgcgggttcgaaactcgagaaagctttgggtgaccagttcccggaaggcgaacgatattttggtctcgaaaactttggcaacacttgctattgtaacagcgttttgcaggcactttatttttgtgtcccatttcgcgagcagctgctagaatattattcaagtaataaaaatggtgttgatgctgaagataatctgctgacatgcttggcagatctgtttacacagataagttcacagaagaagaaaacaggtgtcattgctccaaagcgctttgtacaaagattgaagaaacaaaatgagctttttcgcagctatatgcaccaggatgctcatgagttcttgaactttttgctaaatgaacttgttgatatactggagaaagaggcacaagcagcaaaaaatgatgcagaaacttcttcaccatctgaaaagactgcaaatgggccaaagaatcctcaggctaatggtgttaaaaaagagcctttggttacttgggtacacaagaattttcagggaatacttaccaatgagacaagatgcttgcgatgtgagacagtgacagcgagagacgaaactttctttgacttgagccttgacattgaacagaacagctcaataaccagctgtttgaaaaattttagttctactgaaacattgaatgctgaggacaaatttttctgtgacaagtgttgcagtttgcaagaagcacagaagagaatgaagataaagaagcctcctcacatcctggttatccatttgaagcggttcaagtacattgagcagcttggacgatacaagaagctctcctatcgtgttgtatttccacttgagctgaagctgagcaataccgtggaagatgcagatttggagtattccttatttgctgtagttgttcatgtgggaagtggacctaaccatggccactatgttagcctggtaaaaagccatagccactggttattttttgatgatgaaaacgtggagatgatcgatgagtcggcggttcagacattttttgggtcagcccaggagttctcaagtaatacagatcatgggtatatcttgttttatgaaagcctgggtgctggcaacaagagctaagaagtgagtttgagaaggtattctaataatcttcacttagacctcattttcttttaattgcgagaagaggtggcatataatgatgtgggttttgagaaaaatgtatacttgggtcattgccatgtacagtgaatggtggaaccaacctgtccttttttttttcttgtttcacaataagagggaaaagaagagtgtataggtttgagaaatatcacggagactgctgtgtatgatttaacagtttttctctatctgtagtttctcctgcagagcttagacctttgttaattcaaagagagagaagctgtttcatgttcatgctttcctattaacttctaatactcattcatttc

SEQ ID NO: 4990 - DNA, 2931 bp, Citrus sinensis
ctcaaccaaccgaaatcacacttacatcccaatgacgacaaactcccaatgtactcatccaaagtgatcaccacctcatctcaccatttggaagcagtaaacataagttccattcagcatttcactttaaaaaggggaattcccacaacatcttcctgagcctcttgttttatattatatagttagctcaaaactcatcgtcatcttttggctgcttcgctgcgttgagtgagcaatgtgccttcgtgaacagcgctaagtacgtacttgagtaagcaatcgataaggctggcttctccttttgtttttatatttttcttttgtaaaattttattatatgaattatgttatatatataactaaatttttttatatgaaataataaagcaagaacaacattttatttgtcttccctttaccttactgaaattttcaaacgttagtctaaataaaatttttatgggaaaaggtttagtgaaaattattttaaaaaatttaaaataatgtgcaacggatgggtgtgcctttttttattaaaagaactatgagcttataatttaatatgttggttcaataaaaacatacctatttcaccatcacgagtattttatataatcattcacaatatttaaaattatttttaagattcttaatttatctataatcttatataacaaacattgtgcttaatttttaaatattggtcgatgttaaaaaattaaaattaaaaaataaaagtacttgttgcatagtttttcaataactcattcataacatgaataacaactattgatttggttaacacaaaacataatttatatatcaaccattaaaatttttaatttaacaaaaaaatatgtatgcttcttataaagtttttcgtaattaataaaatgttgttccctatgattttattaagtcgcgataaataaatcatttaggatggtcatgtgagtataattatcattaaaacaataaaaaaaatttcagtaacaagcttttgtcctagtaatttgtgttaattatttctttttaatttaaccaaatatttttcgcgtacaatttacagcttggcaggctggcagcacgtgatatggagtggcagcagcaaataccaaggagtggcaaactaatttttttttttaaacaaaaaaacctcatatatattattattattatttatttttaatccgtcatcccctaactttcatttgtttatttcggaagaatttattttactttattttcttcatcgttcttatttcccctctccattttttcttcacttgaatataaaagaaaatcactaaccctaactgattcaattcaattcaattttaattcaattttcaattgaaaacagaagaacaaacaataaacatatgggaagtgaatcggcgtggtgagttgaatcggagcgggtgaagaagatctaaaactgagtggtgagtaatgggtgctgcgggttctaaactcgagaaagctctcggcgaccagttccctgaaggcgagcgttacttcggcctcgagaatttcggcaacacttgctattgcaacagcgttttgcaggccctttatttttgtgttccatttcgtgaacaattgctagactattactcaaataataagaaccttggggatgctgaagagaatctcttgacgtgcttggcagacttgtttacacagataagggctcagaagaagaaaacaggtgtcattgctccaaagcgctttgttcagaggttgaagaaacaaaatgagctttttcgcagctacatgcatcaggatgctcacgaattcttgaatttcttgctaaacgaacttgttgacattctggagaaagaggaagctgcaaaaagtgatccagaaagttcatcgccatctgagaagactgcaaatggcccaacaaatggtctggcaaatggtgttcgaaaagagccattggttacgtgggtgcataaaaattttcagggaattcttaccaatgagacaaggtgcttgcgatgcgagacagttacagccagggatgaaactttttttgacttgagtcttgatattgaacaaaatagttctataacaagctgcttgaaaaattttagctccacagagactttgaatgctgaagacaaatttttctgtgataaatgctgcagtttgcaagaagcgcagaagaggatgaagataaagaaatctccccatactctggtcattcatcttaagcgatttaaatacattgagcagctggggcgatacaagaagctatcttaccgtgttgtctttccgcttgagctgaagcttagcaacacagcagaagatgcagatattgagtattcgctatttgctgtagttgtccatgtaggcagtggaccaaaccatgggcattatgtcagtctcgtgaaaagtcataaccactggttattttttgatgatgaaaatgtggagatgatcgatgagtctgctgtgcagacattttttggatcggcacaggaatattcaagtaatacggatcatgggtacatcttgttctatgaaagccttggtgctggtagtaacaagagctgagtagagagacaggcgggttttggttttacaatgattaggtattttaatcattcagactaatttttcttctgttgtctatgtttattattttcatttcttttgcctacttcaccctgtggaaagagctatcgatgctataaagcgggttgtcaaaagaatgtatacttaggtggtttccatgtacagtgtggatggtggaagcacactatccttttttttttttggttcacaaataagagggaagggagcaacagtgtatatggtgtgtgagaattttcacaagagacaatttgtattcttctatggttgagaatgttcaattaacaccataaatgcaaatacaatgcagttggaattgctctcttattt

SEQ ID NO: 4991 - DNA, 1629 bp, Cajanus cajan
ctttttttcggaagatttttctcaaacgccgttcttatttccattttctccattttttcttcttcttttctccatctctttcgattcagaacacaaacccaaaccctagcgattccaagctatcttcgacgatggcgcgccacgcgactcattgagttgaatcggataaagatctgatcggtttgacgcgctcatgggtgctgcgggctccaagctcgagaaggctctcggcgaccaattccccgaaggagagcgttactttggccttgagaatttcggcaatacttgttactgcaacagcgttttgcaggccctatacttctgcgttccatttcgagaacaattgctagagtattatgcaaataacaagagcatggcggatgcagaggaaaatcttttgacttgcttagctgacttattttcacagataagttcccagaagaagaaaacgggtgtcattgctcccaaacgatttgtgcagaggttgaaaaaacagaatgaactcttccgtagttatatgcaccaggatgcccacgaattcttgaactttttgttaaatgaacttgttgacattctggagaaagaggcccagactgcaaaaaatgatcaagagacctcgccaccttctgaaaaggctgcaaatggacctaagaatggtctagctaatggtgctaaaaaagagcctttagttacttgggtgcacaaaaattttcagggaatactcaccaatgaaactaggtgcctgcgatgtgaaactgtaacagctagggatgaaacattttttgatttgagccttgatattgaacaaaatagttcaattacaagttgtttgaaaaacttcagttcgactgagacattgaatgctgaagacaaatttttttgtgacaagtgctgcagtttgcaagaagctcagaagagaatgaagataaagaaaccacctcacatcttggtcattcaccttaagcggtttaaatacatcgaacagctgggtcgatacaagaagttgtcttaccgagttgttttccctcttgagctgaaattgagtgatactgctgaagatgcagatattgagtattctctatttgcagtagttgtccatgttgggagtgggccaaaccacgggcactatgtaagccttgtgaaaagccataaccactggttattttttgacgacgaaaatgttgagatgattgatgagtctgctgttcagacattctttgggtcatcgcaagagtattccagcaatacagatcatggttacattttgttctatgagagcattggctctggtaacaaaaactagacgttggagccttgcgagttttaggtacttggatcatttggacttgtctatttcatctgtttaattattaattattttttcccgttttattcaacctgcttgagtagttgttatacatcaaatgagaggatacgggttgtgagaatgtatacttagtggtcgacatgtacagtggatagtggaagaagcactgtcctttttccctttttaaaaaaaaaataataagagcagtgtatatggtttgagaacatcgccgacagtgtattcattatgttaagtgtttaatcaatagaaacacagtgcaatggcagtcactgatcagtatt

SEQ ID NO: 4992 - DNA, 1665 bp, Glycine max
aagacctctttattttcggaagattttttttcctaaacgccgttcttctttccattttctccattttttcttcctccatctgcattctctttcgctcgacaaaccctagcgatttgatgctgtgcgatgcgactcgctgagttgaaccggataaagatctgagtcgcggtgatcggttcgacgcgctcatgggtgctgcgggctccaagctcgagaaggctctcggcgaccaattccccgaaggagagcgttactttggcctcgagaattttggcaatacttgttactgcaacagcgttttgcaggcactatacttctgtgttccatttcgagaacaattgctagaatattatgcaaataacaaaagcataacagatgcagaggaaaatcttttgacttgcctagccgacttattttcacagataagttcccagaagaagaaaacaggtgtcattgctcccaaacgatttgtacaaaggttgaaaaaacagaacgaactcttccgtagctatatgcaccaggatgcccatgaattcttgaactttttgttaaatgaacttgttgacattctggagaaagaggcccaggctgcaaaaaatgatcaagagacttcaccaccttctgaaaaggctgcaaatggacctaagaatagtctagccaatggtgctaaaaaggagcctttagttacttgggtgcacaaaaattttcagggaatactcaccaacgagaccaggtgcttgcgatgtgaaactgtaacagctagggatgaaacattttttgacttaagccttgatattgaacaaaatagttcaattacaagttgcttgaaaaacttcagttcaacggagacattgaatgctgaagacaaatttttttgtgacaagtgctgcagtttgcaagaagctcagaagcgaatgaagataaagaaaccacctcatgtgttggtcatccaccttaagcggtttaaatacattgaacaactgggtcgctacaagaagctgtcttaccgggttgtcttccctcttgagctgaaattgagtgatactgctgaagatgcagatattgagtattctctatttgcagtagttgtccatgttgggagtgggcccaaccacgggcattatgtaagccttgtgaaaagccataaccactggttattttttgacgacgaaaatgttgagatgattgatgagtctgctgttcagacattctttgggtcttcgcaagaatattccagcaatacagaccatggttacattttattctatgagagcattggctctggtaacaggaactagacggaggagcctttgagttttagatacttgaatcagttggacttgtcttttttatctgtttaattattaattattttttccggttttattcaacctgcttgagtagttgttatacatcaatgagaggatacgggttgtgaaaatgtatacttagtggtcggcatgtacagtggatagcggaagcactgtcctttttccccttatttttttgttacaataagagcagtgtatatggtttaagaatttcaccgacagtacattcacgatgttaactgttaagtgttaaatcaatagaaacacaatgcaatggcagagtcactagtaaattatggtgttttcatctacattctggtatacaagagcttct

SEQ ID NO: 4993 - DNA, 1764 bp, Glycine max
cacagttgaaattgaaagttgagacttgaaaccgtttttacacaatctgtcacggatattatggagggcaacagtggcgcgtcctaagacctctttattttcggaagattttttttcctaaacgccgttcttctttccattttctccattttttcttcctccatctgcattctctttcgctcgacaaaccctagcgatttgatgctgtgcgatgcgactcgctgagttgaaccggataaagatctgagtcgcggtgatcggttcgacgcgctcatgggtgctgcgggctccaagctcgagaaggctctcggcgaccaattccccgaaggagagcgttactttggcctcgagaattttggcaatacttgttactgcaacagcgttttgcaggcactatacttctgtgttccatttcgagaacaattgctagaatattatgcaaataacaaaagcataacagatgcagaggaaaatcttttgacttgcctagccgacttattttcacagataagttcccagaagaagaaaacaggtgtcattgctcccaaacgatttgtacaaaggttgaaaaaacagaacgaactcttccgtagctatatgcaccaggatgcccatgaattcttgaactttttgttaaatgaacttgttgacattctggagaaagaggcccaggctgcaaaaaatgatcaagagacttcaccaccttctgaaaaggctgcaaatggacctaagaatagtctagccaatggtgctaaaaaggagcctttagttacttgggtgcacaaaaattttcagggaatactcaccaacgagaccaggtgcttgcgatgtgaaactgtaacagctagggatgaaacattttttgacttaagccttgatattgaacaaaatagttcaattacaagttgcttgaaaaacttcagttcaacggagacattgaatgctgaagacaaatttttttgtgacaagtgctgcagtttgcaagaagctcagaagcgaatgaagataaagaaaccacctcatgtgttggtcatccaccttaagcggtttaaatacattgaacaactgggtcgctacaagaagctgtcttaccgggttgtcttccctcttgagctgaaattgagtgatactgctgaagatgcagatattgagtattctctatttgcagtagttgtccatgttgggagtgggcccaaccacgggcattatgtaagccttgtgaaaagccataaccactggttattttttgacgacgaaaatgttgagatgattgatgagtctgctgttcagacattctttgggtcttcgcaagaatattccagcaatacagaccatggttacattttattctatgagagcattggctctggtaacaggaactagacggaggagcctttgagttttagatacttgaatcagttggacttgtcttttttatctgtttaattattaattattttttccggttttattcaacctgcttgagtagttgttatacatcaatgagaggatacgggttgtgaaaatgtatacttagtggtcggcatgtacagtggatagcggaagcactgtcctttttccccttatttttttgttacaataagagcagtgtatatggtttaagaatttcaccgacagtacattcacgatgttaactgttaagtgttaaatcaatagaaacacaatgcaatggcagagtcactagtaaattatggtgttttcatctacattctggtatacaagagcttcttggtggtttagtct

SEQ ID NO: 4994 - DNA, 1751 bp, Theobroma cacao
tatgccaccattttcttttaccatctttattttcttcgtctctcgtctctccccaaacgctctcaaaacaaaacaaaaacaaaccctcatttccttttgcctgtttttcactgcctcaaaacggatataggaaaaacgaaaacaagttttttttttttcttcccttcctccagacaaaccctaaaggaattcaaatcgaacggaggagagtgagagcgagcgagtggtgaatggaaagatagaatagaatcgctgagttgaataggtcggaagaagatctgtgttcgagttgtagacaaaaagtcaattctataaatgggcgcggcgggttcaaaactcgagaaagctttgggcgaccagttccctgaaggcgaacgatattttggcctcgaaaactttggcaacacttgttattgtaacagcgttttacaggcactttatttttgtgtcccatttcgtgaacagttgctagaatattattcaagcaacaaaaatgttgctgatgctgaagagaatctgctgacatgcttggcagatctgtttacacagataagttcgcagaagaagaaaacaggtgtcattgctccaaagcgctttgtacagagattgaagaaacaaaatgagcttttccgcagctatatgcaccaggatgctcatgagttcttgaattttttgctaaatgaacttgtcgacatattggagaaagaggctcaagcagctaaaaatgatgcagaaacttcatcaccacctgaaaagactgcaaatgggccaaagaatcctcaggcaaatggtgttctaaaagagcctttggttacatgggtacacaagaattttcagggaatacttaccaatgagacaagatgcttgcgatgtgagacagtgacagcaagagatgaaattttctttgacttgagccttgacattgaacaaaacagttcaataactagctgtttgaaaaattttagttctaccgagacattgaacgcagaggacaaatttttctgtgacaagtgctgcagtttgcaagaagcccagaagagaatgaagataaagaagcctcctcacatcctggttattcatttgaagcggttcaagtacattgagcagcttggccggtacaagaagctctcctaccgcgtcgtgtttccacttgagctgaagctgagcaatactgtggaggacgcggattcagagtattctctatttgctgtagtagttcatgtgggtagtggaccaaaccatgggcactatgttagccttgtgaaaagccataaccactggctattttttgatgacgaaaacgtggagatgatcgatgagtcagcagttcagacattttttgggtcagcccaggagtattcaagtaatacagatcatgggtatatcctgttttacgaaagccttggcgcaaacaggagctgagaagagggtttgatttcgccaacagtagttattctattctctcggacctcatttttcttaaaattgtctatgcgtattaaatttttttttcacttttattaaaaaaaaaaatcattttccaaccttgtgggaagagctggcatgtatcagtgaggtgatgtgggttgcgaaagaatgtatacttaggttgttgccatgtacagtggatagtggaagcacactgtccttgttttttcacaataagaggaaaaaaaaatagcagtgtatatggtgtgagaatatcacagagacagtttgtattcttcatggttgagcatgtttttaacatt

SEQ ID NO: 4995 - DNA, 1706 bp, Elaeis guineensis
caacagtcaacagataataagaagatacaggaaaccctaggaatgaccgaacgatccatctccatttctcctcgtcgacgaagagacaatccctgagagagagagagggaaggccgactagggttaggtatttttatcgagatcggggaacggcggtggagctttggcggcgttgaggaggagttggatggtgatgggagccgcgggctccaagcttgagaaggctctgggggaccagttccccgaaggcgagcgctacttcggcctcgagaacttcggcaacacttgctattgcaacagcgtcctccaggcactttatttttgtctccctttccgagagcaactactggagtattatgcaaattacaaaactgggggtgaagcagaagataatcttttgacatgtctggctgatctattcacccagattagctcccagaagaagaaaactggtgtaattgctccaaagcgttttgtgcaaagagtgaagaaacaaaatgagattttccgtagctacatgcaccaggatgctcatgaatttttaaatttcttgttgaatgagcttgttgacattctggagaaagagtctaatgctgcaaaaacgtcccctgatacctcatcatcatcagaaaatattgcaaatgggcctagccatcctcaagccaatggtgttcaaaaagagccagtttccacatgggtgcacaaatgttttcagggcattctgactaatgaaacaagatgcttacggtgtgaaactgtcactgcaagggatgaaactttttttgacctcagtcttgacattgagcaaaatagttcaatcacaagctgcctcaaaaatttcagctcaacagagactttaaatgctgaggataagttcttctgtgacaaatgttgcagcttgcaagaagcccagaagaggatgaagataaagaagccaccaaacattctagtgatccatctcaagcgcttcaagtacatcgagcaccttagccggcacaagaagctatcataccgtgttgtgtttcctctggagctgaagcttagcaacaccattgacaatgcagactgcgagtactctctctttgcagttgtggtgcatgttggaagtgggcctaaccatggccactatgttagtctcgtcaaaagtcataaccattggttgttctttgatgatgaaaatgtagagatgattgatgagtccattatacagactttctttgggtccacacaggagtactcgagcaacactgaccatgggtacatcttgttctatgagaggctaggtggaaggagttgaaggctttacaaatttttcagttgtgagaattatactgatcatttcttctcgatgtatcaaatatttttcctccctccgggaagagctcacaggaaactttatgctggagtgagaggatgcaacatcagaggtggttatgtatagtggatggtgacccatcatcatgttcttttcataataaagagtgtaaatcaatttcgagggtttcggtgagggcaaagggatttctgtgtccttcgctgctggatatttaatatagcaaaatgcagttcctcaaacaagctctctgggaggcttgtttgaagttttttttttctgaaagcaggattctagaactgctcattcttttgatcctttaattaatttgagatactaatttgtaataatggaaggaacgaccttcaatgta

SEQ ID NO: 4996 - DNA, 1418 bp, Eutrema halophilum
ttcgaaatctgaaatctccagagcgaatccttcattgattgactcattctttctagattctccgagtcgaatcggacgagtcagggacgaaatcacggtgttacggaggctgtttctagggttaatgggcgccgcgggctccaaactcgagaaagctctcggcgaccagttcccggagggagaacgctacttcggattcgaaaatttcggcaacacttgttactgtaacagtgtattgcaggccctttatttttgtgctcccttccgtgaacaattgcttgagtactgtgcaaataataaaagtgtagctgatgctgaggagaatctcttgacctgcttagcagacttattctcgcagataagttcccaaaagaagaaaacaggagttattgctccgaagcgctttgtacagaggttgaagaaacaaaatgagcttttccggagttatatgcatcaggatgcccatgagttcctgaattatttactaaatgaacttgttgacatcttggagaaagagacaaaagctacaaaaatggaaatcgacatttcatcatctcctgaaaagattgccaatggaccgaaggttcctcaggcaaatggcgtgcataaagagcctattgttacatgggtgcacaagatttttcagggtatacttaccaacgagacaaggtgtttgcggtgtgagacagtaacagcaagagacgaaacattcctagacctaagccttgatatcgaacaaaacagttcaataactagctgtttaaaaaacttcagctctacagagactctgcatgcagaagacaaatttttctgtgacaaatgttgcagtttacaagaagcgcagaagaggatgaagattaagaaaccgccacacatcttagttatacatctgaaacggtttaaatacatcgaacagttgggccgctacaagaagctatcttacagagtcgtcttccctctggaactgaaactcagcaacactgtggaagaatatgtggacattgagtactctctctttgcagtggtggttcatgtcggaagcggacccaaccatggtcactatgttagcctcgtgaaatcccataaccattggctcttctttgatgatgagaatgttgaaatgatcgaagaatctgctgtacagacattcttcggttcatcacaagagtactcgagcaatactgatcatggctacatcttgttctatgagagcctcggaacaagatagagaaaaaaaggctttttaatgagttgacaacaacataatctctctcttccaagctattttgtgacttgaaatcaagaagtcatttttcttttaactccaaaaacagaaagcttgtatactaatggaaaccaaccatgtacaatttaatgacaaggaaggtttactatttggttataagttaacttatatt

SEQ ID NO: 4997 - DNA, 1826 bp, Prunus mume
gtttaattttacctccatttatttatcgatttattaatttcggtaattttctcatttcctttcgttccccttcctcctctctctcgaaaaaaaactcaaccttcattctttccaagctcaacttccgaacgaaaccctaacaattcagacgcacagagagagagcaaaccagttgagcaagcgacccagttgtatatggcatgcgagtcgttgagttgaatcggcgaaagaggatctgagtggtcggcgataattgatattgggtattgacttggtctgatgggtgctgcgggctccaaactcgagaaggctctcggcgaccagttccccgaaggcgagcgatatttcggcctcgagaatttcgggaacacttgctattgtaacagcgttttgcaggcactttatttttgtgttccatttcgtgaacaattgcttgaatattattccagcaacaaaagtactggggatgcagaagaaaatctcttgacatgcttagcagacttgtttacacagataagttcccagaagaagaaaacaggtgtcattgctccaaagcgtttcgttcagagattgaagaaacaaaatgagcttttccgtagctatatgcaccaggatgctcatgagttcttaaattttttgcttaatgaacttgttgacatactggagaaagaagcccaagcagcaaaaagtgatcaagaaacttcacctcctgaaaagatggtaaatggtccaaagaatgctcaggccaatggttctcataaagatcccttagttacctgggtgcacaaaaattttcagggaatactcaccaatgaaacgaggtgcttacggtgtgagacagtgactgcaagagatgaaacattttttgacttaagcctggatattgaacagaacagttcaattacaagctgtttgaaaaacttcagttcgacagagacattgaatgctgaggacaaattcttttgcgacaagtgctgcagcttgcaagaagcgcagaagagaatgaagataaaaaagccacctcacatcttggtcatccatttgaagcgatttaagtacatcgagcagcttggccgttacaagaagctatcttatcgggttgtattcccacttgaactgaagctgagtaacacggttgaagatgcagaatccgagtattctctgtttgccgttgttgtccatgtcggaagtggcccaaaccacggacactatgttagccttgtgaaaagccataaccactggttattttttgatgacgaaaacgtggagatgattgatgagtctgctgtgcaaactttctttggatcagcgcaggagtattcaagtaatacagatcatggatacatcttgttctacgagagcctcggcaccagtaacaagagttaagaagatggctttggatttaagatggttgggtatttctaatcatttggacttttgcatttcttctgttttgtgtttactatttttctttttttcttttttatttttccccctttttcaacctgtgggaagagctgtcaaatatcaatgagatgatgtgggttgtgaaaaaaaaaaaaaaatgtatacttaggtggttcgcatgtacagtggatggtcgaagcacaccatccttttttctttttcctttttttttttataacttttttcacaataaggaaaagggtagtgtatatggtgagaaatttcagacagtcagtattcttcgcggttgagaacattaaacactagaaatgccatgcaattggaattgctcatcactatttttcttcttgtgaaccttgtctttatgaggcttaggttttgcaggtgttcaggggtcg

SEQ ID NO: 4998 - DNA, 1664 bp, Malus domestica
tctctcatgaaactcaaccttcattcttggcaagctccatttccgaacaaaaccctaacaattcaaacacacacacacgcacagagcaactcggttagcgactcagttgtccatggatgtgaatcgttgacttgaatcggagagaggatctgagtcgtcggctatattctaaattgtgtattgactgggtgtgatgggtgctgcggggtccaaactcgagaaggctctcggcgaccagtttccggaaggcgagcgatactttggactcgagaatttcggcaacacttgctattgtaatagcgttttgcaggcactttatttttgtgttccatttcgcgagcagttgctagaatactattccagcaacaaaagtgctggggatgcagaagaaaatctcttgacatgcttagcagacttgtttacacagataagttcacaaaagaagaaaacaggcgtcattgctccaaagcgtttcgtacaaagattgaagaaacaaaatgagcttttccgtagctatatgcaccaggatgctcatgaattcttaaattttttgttaaatgaacttgtcgacatactggagaaagaagcccaagctgcaaaaagtgatcaagaaactacttcacctcctgaaaaaatgggaaatggtccaaagaatgttcaggccaatggtactcataaagatcccttagttacctgggtgcacaaaaattttcagggtatactcaccaatgaaacaaggtgcttacggtgtgagacagtgactgcaagagatgaaatatttttggacttgagcctggatattgaacagaacagttcaataacgagctgtttgaaaaacttcagttccacagagacattaaatgccgaggacaaatttttttgcgacaagtgctgcagtttgcaagaagcgcagaagaggatgaagataaaaaagccacctcacatcctggttatccatcttaaacggtttaagtacatcgagcagcttggccgttacaagaagctatcttatcgggtagtattcccactagagctgaagctgagtaacacagttgaggatgcagaatctgagtattctctatttgctgtggttgtccatgttggcagcgggccaaaccatggacactatgttagccttgtgaaaagccataaccactggttattttttgatgatgaaaatgtggaaatgattgatgagtctgcagtgcaaactttcttcggatcagcacaggagtattcaagtaacacagatcatggatacatcttgttctacgagagcctcggcaccagtaacaagagttaagaagacggctcgggatttaagatggttgggtatttctaatcatttggactttttcgcgtctgtttttgtgtttaccttttctctttttttcggtttccccccttttcgacctgtggaagagctgtcaaatgtcaatgagatgatatgggtggtgaaaaatgtatacctaggtggtccggatgtacagcagatggtggaagcagaccatcctccttttcgttttttcctttcttttatctttttgacaataaggaaaagggtagtgtatatgctatatggtcggaaatttcagacagtaattggttgtcacggtcgagaacattaaacactataaatgccatgaaatcggaatttgctcatc

SEQ ID NO: 4999 - DNA, 1579 bp, Gossypium hirsutum
tgtcctccaaacaaaccctaagtcggattcggataaaccgaagagagcaagatagagccagtcgttgatggggtattgaatcgctgagttgaaccggtcggaagaagatccaagttagagttgtagacgaactcaattctatatctaatagatgggcgcggcgggttcgaagctcgagaaagctttgggtgaccagttcccggaaggcgaacgatattttggtctcgaaaactttggcaacacttgctattgtaacagcgttttgcaggcactttatttttgtgtaccatttcgcgaacagctgctagaatattattcaagtaataaaaatggtgttgatgctgaagataatctgctgacatgcttggcagatctgtttacacagataagttcacagaagaagaaaacaggtgtcattgctccaaagcgctttgtacaaagattgaagaaacaaaatgagctttttcgcagctatatgcaccaggatgctcatgagttcttgaactttttgctaaatgaacttgttgatatactggagaaagaggctcaagcagcaaaaaatgatgcagaaacttcttcaccatctgaaaagactgcaaatgggccaaagaatcctcaggctaatggtgttaaaaaagagcctttggttacttgggtacacaagaattttcagggaatacttaccaatgagacaagatgcttgcgatgtgagacagtgacagcgagagacgaaactttctttgacttgagccttgacattgaacagaacagctcaataaccagctgtttgaaaaattttagttctactgaaacattgaatgctgaggacaaatttttctgtgacaagtgttgcagtttgcaagaagcacagaagagaatgaagataaagaagcctcctcacatcctggttatccatttgaagcggttcaagtacattgagcagctggggcgatacaagaagctctcctatcgtgttgtgtttccacttgagctgaagctgagcaataccgtggaagatgcagatttagagtattccttatttgctgtagttgttcatgtgggaagtggacccaaccatggccactatgttagcctggtaaaaagccataaccactggttattttttgatgatgaaaacgtggagatgatcgatgagtcggcggttcagacattttttggttctgcccaggagttctcaagtaatacagatcacgggtatatcttgttttatgaaagcctgggtgctggcaacaggagctaagaagtgagtttgagaaggtattctaatagtcttcacttaagacctcattttcttttaattgtgagaagaggtggcatataatgatgtgggttttgagaaaatgtatacttgggtcattgccatgtacagtgaatggtggaagcaacctgtctttttcttttttagttcttgttttacaataagagggaaaaagaaatagtgtataggtttgagaaatatcacggagactgtgctgtgtatgatttaacagtttttctctatctgtagtttctcctgcagagcttagacctttgttaattcaaaaagagaggagctgtt

SEQ ID NO: 5000 - DNA, 1686 bp, Prunus persica
taaactcaaccttcattctttccaagctcaacttccgaacgaaaccctaacaattcagacgcacagagagagagcaaaccagttgagcaagcgacctagttgtatatggcatgcgagtcgttgagttgaatcagggaaagaggatctgagtggtcggcgataattgatattgggtattgacttggtctgatgggtgctgcgggctccaaactcgagaaggctctcggcgaccagttccccgaaggcgagcgatatttcggcctcgagaatttcgggaacacttgctattgtaacagcgttttgcaggcactttatttttgtgttccatttcgtgaacaattgctcgaatattattccagcaacaaaagtactggggatgcagaagaaaatctcttgacatgcttagcggacttgtttacacagataagttcccagaagaagaaaacaggtgtcattgctccaaagcgttttgttcagagattgaagaaacaaaatgagcttttccgtagctatatgcaccaggatgctcatgagttcttaaattttttgcttaatgaacttgttgacatactggagaaagaagcccaagcagcaaaaagtgatcaagaaacttcttcacctcctgaaaagatggtaaatggtccaaagaatgctcaggccaatggttctcataaagatcccttagttacctgggtacacaagaattttcagggaatactcaccaatgaaacgaggtgcttacggtgtgagacagtgactgcaagagatgaaacattttttgacttaagcctggatattgaacagaacagttcaattacaagctgtttgaaaaacttcagttcgacagagacattgaatgctgaggacaaattcttttgcgacaagtgctgcagcttgcaagaagcgcagaagagaatgaagataaaaaagccacctcacatcctggtcatccatttgaagcgatttaagtacattgagcagcttggccgttacaagaagctatcttatcgggttgtattcccgcttgagctgaaactgagtaacacggttgaagatgcagaatccgagtattctctgtttgccgttgttgtccatgttggaagtgggccaaaccacggacactatgttagccttgtgaaaagccataaccactggttattttttgatgatgaaaacgtggagatgattgatgagtctgctgtgcaaactttctttggatcagcgcaggagtattcaagtaatacagatcatggatacatcttgttctacgagagcctaggcaccagtaacaagagttaagaagacggcgttggatttaagatggttgggtatttctaatcatttggacttttgcatttcttctgttttgtgtttactattttcctttttttctttttttctttttttctttttccccctttttcaacctgtgggaagagctgtcaaatatcaatgagatgatgtgggttgtgaaaaaaaaaagagtatacttaggtggttcgcatgtacagcggatggtcgaagcacaccatccttttttctttctttttccttttcttttttttcacttttttcacaataaggaaaagggtagtgtatatggtgagaaatttcagaccgtcagtattcttcacggttgagaacattaaacactagaaatgccatgcaattggaattgctcatcac

SEQ ID NO: 5001 - DNA, 1686 bp, Glycine max
cgttctttctttatttatttttcctcaaattttctttaaattttcatcagcattttcgtcctcctctctctctcgcacgcgaaacccttgttctgttccctgctaacatatctgtagagaaaaccagacaccagaaaaggttcgttcagagacaaaaccccaacgatccaaacggtcattgagcatttcatggtgcgagtcactgagttgaatcggataggaatctgagtttgtgatcgtttgacgcggtcatgggtgctgcgggctccaagctcgagaaggctctcggagaccaattccccgaaggagaacgttactttggcctcgagaatttcggcaacacttgttactgcaacagcgtcttgcaggcactatacttctgtgttccgtttcgcgaacaattactagagtattatggaaataacaaaagcatattggacggggaagaaaatcttttaacttgcttagcggacttattttcacagataagttcccagaagaaaaaaactggtgtcattgctcccaaacgatttgtacagaggttgaaaaaacagaatgaactcttccgtagctatatgcaccaggatgcccatgagttcttgaactttttgctgaatgaacttgttgacattctggagaaagaggctcaggctgcaaaaactgatcaggagacatctccaccttctgaaaaggctgttaatgggcccaagaatggtcaagctaatggtgttcacaaagagcctttagttacttgggtacacaaaaattttcagggaatactcaccaatgagacaaggtgcttgcaatgtgaaacagtgacggctagagatgaaacatttttggacttgagtcttgatattgagcaaaacagttcaattacaagctgtttgaaaaatttcagttccaccgagacactgaatgctgaagacaaatttttttgcgacaaatgctgcagtttgcaagaagctcagaagaggatgaagataaagaaaccacctcacatcttggtcatccatcttaagcggtttaagtacatggaacagctaggccgctacaagaagctgtcctaccgggttgttttcccccttgagctgaagttgagtaacacagttgaagatgcggatattgagtattctctatttgcagtagttgtccatgttgggagtgggcccaaccacgggcattatgtcagtcttgtgaaaagccataaccactggttattttttgatgacgaaaatgtagagatgattgacgagtctgctgtgcagacgttctttggatcatcacaggagtattcaagtaatacagaccatgggtacattttgttctatgagagccttggctctggtaacaggagttaggcggaggatttctacaactctcttaaatcatttggacttctttttaacatggtttccatatttattttccttttaccgttttccctttattcaacctgttggaggagctgttacatactctagaggatacgggttgtgaaaaggtatacttaggtggttggcatgtacagtggatagtgctaggcactgtccttttttctttttcctttctcacaataagaacagtatatatatcaggtgaaaatttcaccaacgatgtgtattcatggttgcaagcgttcaaccaacattagaattacaatgaaatggaaattggtcctaactc

SEQ ID NO: 5002 - DNA, 1741 bp, Glycine max
cgttctttctttatttatttttcctcaaattttctttaaattttcatcagcattttcgtcctcctctctctctcgcacgcgaaacccttgttctgttccctgctaacatatctgtagagaaaaccagacaccagaaaaggttcgttcagagacaaaaccccaacgatccaaacggtcattgagcatttcatggtgcgagtcactgagttgaatcggataggaatctgagtttgtgatcgtttgacgcggtcatgggtgctgcgggctccaagctcgagaaggctctcggagaccaattccccgaaggagaacgttactttggcctcgagaatttcggcaacacttgttactgcaacagcgtcttgcaggcactatacttctgtgttccgtttcgcgaacaattactagagtattatggaaataacaaaagcatattggacggggaagaaaatcttttaacttgcttagcggacttattttcacagataagttcccagaagaaaaaaactggtgtcattgctcccaaacgatttgtacagaggttgaaaaaacagaatgaactcttccgtagctatatgcaccaggatgcccatgagttcttgaactttttgctgaatgaacttgttgacattctggagaaagaggctcaggctgcaaaaactgatcaggagacatctccaccttctgaaaaggctgttaatgggcccaagaatggtcaagctaatggtgttcacaaagagcctttagttacttgggtacacaaaaattttcagggaatactcaccaatgagacaaggtgcttgcaatgtgaaacagtgacggctagagatgaaacatttttggacttgagtcttgatattgagcaaaacagttcaattacaagctgtttgaaaaatttcagttccaccgagacactgaatgctgaagacaaatttttttgcgacaaatgctgcagtttgcaagaagctcagaagaggatgaagataaagaaaccacctcacatcttggtcatccatcttaagcggtttaagtacatggaacagctaggccgctacaagaagctgtcctaccgggttgttttcccccttgagctgaagttgagtaacacagttgaagatgcggatattgagtattctctatttgcagtagttgtccatgttgggagtgggcccaaccacgggcattatgtcagtcttgtgaaaagccataaccactggttattttttgatgacgaaaatgtagagatgattgacgagtctgctgtgcagacgttctttggatcatcacaggagtattcaagtaatacagaccatgggtacattttgttctatgagagccttggctctggtaacaggagttaggcggaggatttctacaactctcttaaatcatttggacttctttttaacatggtttccatatttattttccttttaccgttttccctttattcaacctgttggaggagctgttacatactctagaggatacgggttgtgaaaaggtatacttaggtggttggcatgtacagtggatagtgctaggcactgtccttttttctttttcctttctcacaataagaacagtatatatatcaggtgaaaatttcaccaacgatgtgtattcatggttgcaagcgttcaaccaacattagaattacaatgaaatggaaattggtcctaactcatgtcggattattttatattttatagtttgacgaacactttggtaatagactaat

SEQ ID NO: 5003 - DNA, 1627 bp, Glycine max
tcctaaacgccgttcttctttccattttctccattttttttttccttcatccaatctgcattctcttgcgctcgctcgacaacaacagaaagcggcacgacaaaccctagcgattcgatggtgtgcgatgcgactcactgagttgaactagataaagatctgagtcgcggtgattggttcgacgcgctcatgggtgctgcgggctccaagctcgagaaggctctcggcgaccaattccctgaaggagagcgttactttggccttgagaatttcggcaatacttgttactgcaacagcgttttgcaggcactatacttctgtgttccatttcgagaacaattgctagagtattatgcaaataacaaaagcatagcggatgcagaggaaaatcttttgacttgcttagccgacttattttcacagataagttctcagaagaagaaaacaggtgtcattgctcccaaacgatttgtacaaaggttgaaaaaacagaatgaactcttccgtagctatatgcaccaggatgcccatgaattcttgaactttttgttaaatgaacttgttgacattctggagaaagaggcccagtctgcaaaaaatgatcaagagacttcaccaccatctgaaaaggctgcaaatggacctaagaatggtctagccaatggtgctaaaaaggagcctttagttacttgggtgcataaaaattttcagggaatactcaccaacgagactaggtgcctgcgatgtgaaactgtgacagctagggatgaaacattttttgatttgagccttgatattgaacaaaatagttcaattacaagttgtttgaaaaacttcagttcgacggagacattgaatgccgaagacaaatttttttgtgacaagtgctgcagtttgcaagaagctcagaagagaatgaagataaagaaaccacctcacatcttggtcatccaccttaagcggtttaaatacattgaacaactgggtcgctacaagaagctgtcttaccgggttgtcttccctcttgagctgaaattgagcgatactgctgaaaattcagatattgagtattctctatttgcagtagttgtccatgttgggagtgggcccaaccatgggcattatgtaagccttgtgaaaagccataaccactggttattttttgacgacgaaaatgttgagatgattgatgagtctgccgttcagacattctttgggtcatcgcaagaatattccagcaatacagaccatggttacattttgttctatgagagcattggctctggtaacaggaactagacggaggagccttatgagttttagatacttaaatcatttggacttgtctttttcatctgtttaattattaattatttttttcccgttttattcaacctgcttgagtagttgttatacatcaatgagaggatacgggttgtgaaaatgtatacttagtggtcggcatgtacagtggatagtggaagcactgtcctttttccccttatttttttttacaattaagagcagtgtatatggtttgagaatttcaccgacagtatattcacgatgttaactgttaagtattaaatcaatagaaacacgatgcaatggcaggatcactcgtaaa

SEQ ID NO: 5004 - DNA, 1745 bp, Glycine max
tttttacacaatctgtcacggatattgtggagggcaatagtggcgcgtccaaagacctcttattttcggaagttttttttttcttttttcctaaacgccgttcttctttccattttctccattttttttttccttcatccaatctgcattctcttgcgctcgctcgacaacaacagaaagcggcacgacaaaccctagcgattcgatggtgtgcgatgcgactcactgagttgaactagataaagatctgagtcgcggtgattggttcgacgcgctcatgggtgctgcgggctccaagctcgagaaggctctcggcgaccaattccctgaaggagagcgttactttggccttgagaatttcggcaatacttgttactgcaacagcgttttgcaggcactatacttctgtgttccatttcgagaacaattgctagagtattatgcaaataacaaaagcatagcggatgcagaggaaaatcttttgacttgcttagccgacttattttcacagataagttctcagaagaagaaaacaggtgtcattgctcccaaacgatttgtacaaaggttgaaaaaacagaatgaactcttccgtagctatatgcaccaggatgcccatgaattcttgaactttttgttaaatgaacttgttgacattctggagaaagaggcccagtctgcaaaaaatgatcaagagacttcaccaccatctgaaaaggctgcaaatggacctaagaatggtctagccaatggtgctaaaaaggagcctttagttacttgggtgcataaaaattttcagggaatactcaccaacgagactaggtgcctgcgatgtgaaactgtgacagctagggatgaaacattttttgatttgagccttgatattgaacaaaatagttcaattacaagttgtttgaaaaacttcagttcgacggagacattgaatgccgaagacaaatttttttgtgacaagtgctgcagtttgcaagaagctcagaagagaatgaagataaagaaaccacctcacatcttggtcatccaccttaagcggtttaaatacattgaacaactgggtcgctacaagaagctgtcttaccgggttgtcttccctcttgagctgaaattgagcgatactgctgaaaattcagatattgagtattctctatttgcagtagttgtccatgttgggagtgggcccaaccatgggcattatgtaagccttgtgaaaagccataaccactggttattttttgacgacgaaaatgttgagatgattgatgagtctgccgttcagacattctttgggtcatcgcaagaatattccagcaatacagaccatggttacattttgttctatgagagcattggctctggtaacaggaactagacggaggagccttatgagttttagatacttaaatcatttggacttgtctttttcatctgtttaattattaattatttttttcccgttttattcaacctgcttgagtagttgttatacatcaatgagaggatacgggttgtgaaaatgtatacttagtggtcggcatgtacagtggatagtggaagcactgtcctttttccccttatttttttttacaattaagagcagtgtatatggtttgagaatttcaccgacagtatattcacgatgttaactgttaagtattaaatcaatagaaacacgatgcaatggcaggatcactcgtaaattatggtgttttcatctacattgtcataca

SEQ ID NO: 5005 - DNA, 1469 bp, Amsonia hubrichtii
aagattcgagggaagacactgatggatgggtattgggactgatctgaattgtgatttttaaattatgaagtgatgggggcggccggctcgaaactggagaaggctttgggggaccagtttcccgaaggcgagcgatactttggtctcgaaaattttggcaacacttgctattgcaatagcgtgcttcaggctctatatttttgtgttccctttcgggagcacttgatagaatactattcgaataacaaaaatcttgctgatgcagaagaaaatctgttgacatgtcttgcagacctttttatgcagattagctcgcagaagaagaaaactggtgtgatagctccaaagcgctttgtacagagactaaaaaagcaaaatgagatattccgcagctatatgcaccaggatgcccatgaatttctgaattatttgctgaacgaattggtggacatattggaaaggagtcacgtgctgcaaaaagtgatcctgaaacttcttctccatctgaaaagattccaaatggaccaacaaataataatgctagtggtgcacagaaggagccttttgtcacctgggtgcacaaaaatttccagggcattctaacaaatgaaacaagatgcttgcgttgtgagacagtcacggcaagggacgaaactttccttgacttgagcctggatattgaacagaacagttcaattacaagctgcttgaaaaactttagttccactgagactttgaatgcagaggacaaattcttttgtgataagtgttgtagcttgcaggaggcccaaaagagaatgaaaattaaaaagccacctcacatcttagtgatccatttgaagcgattcaagtacattgaacagttgggcagatataagaagctatcttatcgtgttgtcttcccactagaactgaagctaagtaacacagttgaagatgcagatgccgagtattccttatttgccgtggttgtccatgttggaagtggccccaaccatggacactatgtcagcctcgtcaaaagccacaatcattggctgttctttgacgatgagaatgtcgagatgattgatgagtccgctgtccagactttctttggatcagctcaagaatattctagtaacacagatcacggctacatcttattctatgaaagaatcaccagttctggtagcacaagctaaagaggaaatacaattgtttcctaacactttacttcccaatttttgtaacaggacttctgttgctaatcttcatctttatttttttaccttctaccttctaggaaaattttcgcgtattagccagttcaagatggaatgtgaaaaatatatactaggttgttgccatgtacagtggacagtgaaagctcactgccctatttttccaccaataaaggaaaatgacagtgtatatggtggtgaaatttatagattgtatgctgtagtgcctttgcgtgtttacctatt

SEQ ID NO: 5006 - DNA, 1753 bp, Musa acuminata
aaaaaaaggaaaaagaaaactcgtcgatcaatcacggtgacctcgtttcagtctccgtcactctcgatcatttcttctccacccatcgctcgccaattcgtttggcggcctcggaattcgcttccggttctgcatgaatccccgcttcgagccctaggagctccatccttcccgcgatctctcacggtggataccccttcgtcgacggaggagaggggaacggaggccgacagggggccggagagggcgcgctccggtctggggtcagggttccggtacctcaccggggtcgccggcggctggtgggataggtggatggtaatgggggccgcgggttccaagctcgagaaggtcctcggcgaccagttcccggaaggcgagcgctatttcggcctcgagaacttcggaaatacttgctattgcaacagcgtcttgcaggctctttatttttgcattccttttcgggagcagttactagattattatgcaaataacaagaatctgggagatgctgaggagaaccttttaatgtgtttggctgatctattttctcagattagttcccaaaagaaaaaaactggtgttattgctccaaagcgatttgtgtatagagtgaagaaacagaatgagattttccgcggatacatgcaccaggatgctcatgagtttttgaatttcttgctgaacgaacttgttgatattcttgaaaaagagtctaatgctttaaaaagtcccccggaggccttgtcaccgtctgaaaagattagcaatggaccaagccatcctgtgatgaatggtgtcagaaaagagccaattgttacgtgggttcacaagaactttcagggcatattgactaatgaaacacgatgcttatgttgtgaaactgtcaccgcaagggatgagatgttttttgacttgagccttgatattgagcaaaatagttctataacaagctgcctcaaaaacttttgttcgacagaaactttaaatgctgaggacaagtttttctgtgataagtgctgcagtttgcaggaagcacagaagcgaatgaagatcaagaagccaccacatatccttgtgatccacctcaaacgctttaagtacatggagcagcttggccggtacaagaagctatcctaccgtgttgtgtttcccatggagctgaaacttaacacggccgaggatgcagactccgagtacattctttttgcagttgttgtccatgtggggagcggccccaaccatggtcactatgtcagcctcgtcaaaagccacaaccactggttgatgttcgatgatgacaacatcgaaatgattgatgaatcgaccgtgcagacattctttgggtcctctcaggagtacccaggcaacacagatcatggttacatcttattctatgagtgtcttggtggaaagagttagagagctagcctgttgtgaacaatgatttcttgggtgttttctaccttcaaaagctcatcccagtgttcacttgatggaacaaacagtattgtggggtgcgatattttaggtggaaaagcagtgtacagtagtagatggtggtggaaacaaatagctcgttggttcaaaagaataaaacagaaatgtaggtgggtggtgagagctttaggaacaactcttgtattcttttccttgtgggcatggataaatagaagatagaggattcgtttctcccactgctcgttgtttgtgtaggcctgcctgtacaataacatgtctggtgacataattg

SEQ ID NO: 5007 - DNA, 1688 bp, Solanum tuberosum
aaaattcaatgtcacctccatctcttcctctataaattgtcttacccaatttgtgagtgatgaagatttactgaatttgaagaccgaaagaatcataaaaacagaatagaggagtactggtatttggttgatggtctcatgggtgcaacgggttccaagctcgagaaagccctcggagaccaatttcccgaaggtgaacgatactttggtctcgaaaatttcggcaacacttgttattgcaacagcgtcttgcaggccttatacttttgtgtccccttccgcgagcaactgctagagtattatgcaaataataaaagtcctccagaagctgaggagaatctcttaacttgtttggctgaattgttttcacagataagttcacagaagaagaaaacaggtgttatagctccaaggcgctttgtacaaagagtcaggaagcaaaatgaacttttccgaggttacatgcatcaggatgcccatgagtttttgaacttcttgttgaatgaactcgttgatatcttggagaaagagtcacatgcagcaaaaagtttagcagcaagttctcctgaaaaagtctcaaatggaacatgtaatggtcatgcgaatggcgttaagaaggagccacttgttacctgggtgcacaaaaattttcagggtatattaaccaatgaaacaagatgtttgaggtgtgagacagtcacagctagggatgagacattttttgatttgagccttgatattgaacaaaacagttcaattacaagctgcctaaaaaatttcagttctacagagaccctcaatgcagaggacaaatttttctgtgacaagtgttgtagcttgcaagaagcacaaaaacggatgaagataaagaaacctccacacatcctggtcattcatttgaagcgcttcaagtatatggaacaactaggtcgttacaaaaaattgtcttaccgcgttgtgtttcctctggagctaaaactcagcaacaccactgaaaacacagattctgagtattctctatttgctgttgtggttcatgtcggaagtgggccaaaccatgggcattatgttagtcttgtgaaaagccacaaccactggttgttctttgatgatgagaatgcggagatcattgatgagtctgctgttcagaccttttttggctcagctcaagagtactccagcaatacagatcatggctatatcctcttttatgagagtcttgcagcaagcaagagctgaaaatagtactcacatgttgagacctaactattgcgtatgtgtctgctcaacttttgtcgtgtttagctttcatggttcattggaccggcttaacgaatgtttacgagttcagtgttcaacacacaaggggttgcaagtgttttgacttgttttaacaataaagagatgtaaatcttggtatagaaactttaatgagatgttgatactgtattattagctatgtaactgcatcaacttccagtgaactccattggcagaacccggaaagcaggaataagtcaagtttctcctttgtgtaatttcaatctgaaaaacactgctcctgtgttgttttgttttgaggtgctgagatgcacattcatggagtatgactagtacttaattattccttttctttcttacaacaatgcctgtactgagtaatataccacacttgtcttctactctaa

SEQ ID NO: 5008 - DNA, 1806 bp, Solanum phureja
ttgggtcaaaggtggagagagaaaatagagcccagatggcaccgcctctataagcacgcctttgagatgaatgacacattcagcccaaacacaatccaaaattcaatgtcatctccatctcttcctctataaattgtcttacccaatttgtgagtgatgaagatttactgaatttgaagaccgaaagaatcataaaagcagaatagaggagtactggtatttggttgatggtctcatgggtgcaacgggttccaagctcgagaaagccctcggagaccaatttcccgaaggtgaacgatactttggtctcgaaaatttcggcaacacttgttattgcaacagcgtcttgcaggccttatacttttgtgtccccttccgcgagcaactgctagagtattatgcaaataataaaagtcctccagaagctgaggagaatctcttaacttgtttggctgaattgttttcacagataagttcacagaagaagaaaacaggtgttatagctccaaggcgctttgtacaaagagtcaggaagcaaaatgaacttttccgaggttacatgcatcaggatgcccatgagtttttgaacttcttgttgaatgaactcgttgatatcttggagaaagagtcacatgcagcaaaaagtttagcggcaagttctcctgaaaaagtctcaaatggaacatgtaatggtcatgcgaatggcgttaagaaggagccacttgttacctgggtgcacaaaaattttcagggtatattaaccaatgaaacaagatgtttgaggtgtgagacagtcacagctagggatgagacattttttgatttgagccttgatattgaacaaaacagttcaattacaagctgcctaaaaaatttcagttctacagagaccctcaatgccgaggacaaatttttctgtgacaagtgttgtagcttgcaagaagcacaaaaacggatgaagataaagaaacctccacacatcctggtcattcatttgaagcgcttcaagtatatggaacaactaggtcgttacaaaaaattgtcttaccgcgttgtgtttcctctggagcttaaactcagcaacaccactgaaaacacagattctgagtattctctatttgctgttgtggttcatgtcggaagtgggccaaaccatgggcattatgttagtcttgtgaaaagccacaaccactggttgttctttgatgatgagaacgcggagatcattgatgagtctgctgttcagaccttttttggctcagctcaagagtactccagcaatacagatcatggctatatcctcttttatgagagccttgcagcaagcaagagctgaaaatattactcacatgttgagacctaactattgcgtatgtgtctgctcaacttttgtcgtgtttagctttcatggagttcagtgttcaacacacaaggggttgcaagtgttttgacttgttttaacaataaagagatgtaaatcttggtatagaaactttaatgagatattgatactgtattattagctatgtaactgcatcaacttccagtgaactccattggcagaacccggaaagtaggaataagtcaagtttctcctttgtgtaatttcaatctgaaaaacactgctcctgtgttgttttgttttgaggtgctgagatgcacattcatggagtatgactaatacttaattattccttttctttcttacaacaatgcctgtatagagttaatctaacacacttctcttctactctaattatcgattctttcttctcgtactatgctagtataaagtgaattaaacac

SEQ ID NO: 5009 - DNA, 1597 bp, Gossypium hirsutum
gcacatttttacaacctcaaacgggaaacaggagaaaagaaaagctttccttcaaccaaccaaaccctaaatcgattcaatttattcaaatcaaacagagcggagatagagccactcgttaatggagagagagaatcgtttgagttgaatcggtcagaacaagatctgagttcgaggttgtaattaaacttaatttttttgtattaaatgggggcggcgggttcaaaactcgagaaggctttgggcgaccagtttcctgaaggcgaaagatattttggccttgaaaactttggcaacacttgctattgtaacagcgtgttgcaggcactttatttttgtgtcccattccgtgaacagctgctagaatattattcaaattataaaaatggtgctgatgctgaagagaatctactgatatgcttggctgatctgtttacacagataagttcacagaagaagaaaacaggtgtcattgctccaaagcgctttgtacagagattgaagaaacaaaatgagcttttccgaagctatatgcaccaggatgcccacgagttcttgaattttttgctaaacgaacttgttgacatattggagaaagaggctcgaacagcaaaaaatgaggctgaaacttcaccacctgaaaaggttgcaaatggtccaaagaatcctcaagcaaatggcgttcaaaaagagcctctggttacatgggtacacaagaattttcagggaatacttaccaatgagaccagatgcttgcgatgtgagacagtgacagcgagagatgaaactttctttgacttgagccttgacattgaacagaacagctcaattactagctgtttgaaaaattttagttctactgagacattgaacgctgaggacaaatttttctgtgacaagtgctgcagtttgcaagaagcccagaagagaatgaagataaagaagcctcctcacatcctggtcatccatttaaaacgattcaagtacattgagcagcttggccggtacaagaagctctcataccgtgttgtgtttccgctcgagctgaagctgagcaatactgtggaagatgcagattcggagtattctctgtttgctgtagtcgttcacgtgggaagcgggcctaaccatgggcactatgttagcctggtgaaaagccataaccactggttattttttgacgatgaaaacgtggagatgattgacgagtctgcagttcagacattttttgggtcagcccaggagtactcaagtaatacagatcatgggtatatcttattttatgaaagtcttggtgcaaacaagaatagctgaggaagagggtttggctttgaccatgagttgctgttctagaatcagtaaaaaaggaaaaaaaaacaaatagacaaactgtgcagatatgctagaatcagtaaatgtgaaataagaaggggctatttgcaaatgaggagatagagaagctgttgtttttacagctttggatgtcctgtaattagaatgtgggtgttaggagagttgactttaatagcgtagctttttgacctatatatttggtacattcattggttacaaatacagattttcacatattttgtta

SEQ ID NO: 5010 - DNA, 1818 bp, Gossypium raimondii
gcgccatcacttttttcctcctttattttcttcatctatcgcctctattaaattctctctcagaaaaccataaaaaatatacatataaaaattttctttggctcatttttacaacctcaaacgggaaacaggagaaaagaaaagctttccttcaaccaaccaaaccctaaatcgattcaatttattcaaatcaaacagagcggagatagagccactcgttaatggagagagagaatcgtttgagttgaatcggtcagaacaagatctgagttcgaggttgtaattaaacttaatttttttgtattaaatgggggcggcgggttcaaaactcgagaaggctttgggcgaccagtttcctgaaggcgaaagatattttggccttgaaaactttggcaacacttgctattgtaacagcgtgttgcaggcactttatttttgtgtcccattccgtgaacagctgctagaatattattcaaattataaaaatggtgctgatgctgaagagaatctactgatatgcttggctgatctgtttacacagataagttcacagaagaagaaaacaggtgtcattgctccaaagcgctttgtacagagattgaagaaacaaaatgagcttttccgaagctatatgcaccaggatgcccacgagttcttgaattttttgctaaacgaacttgttgacatattggagaaagaggctcgaacagcaaaaaatgaggctgaaacttcaccacctgaaaaggttgcaaatggtccaaagaatcctcaagcaaatggcgttcaaaaagagcctctggttacatgggtacacaagaattttcagggaatacttaccaatgagaccagatgcttgcgatgtgagacagtgacagcgagagatgaaactttctttgacttgagccttgacattgaacagaacagctcaattactagctgtttgaaaaattttagttctactgagacattgaacgctgaggacaaatttttctgtgacaagtgctgcagtttgcaagaagcccagaagagaatgaagataaagaagcctcctcacatcctggtcatccatttaaaacgattcaagtacattgagcagcttggccggtacaagaagctctcataccgtgttgtgtttccgctcgagctgaagctgagcaatactgtggaagatgcagattcggagtattctctgtttgctgtagtcgttcacgtgggaagcgggcctaaccatgggcactatgttagcctggtgaaaagccataaccactggttattttttgacgatgaaaacgtggagatgattgacgagtctgcagttcagacattttttgggtcagcccaggagtactcaagtaatacagatcatgggtatatcttattttatgaaagtcttggtgcaaacaagaatagctgaggaagagggtttggctttgaccatgagttgctgttctagaatcagtaaaaaagggaaaaaaaatcaaatagacaaactgtgcagatatgctagaatcagtaaatgtgaaataagaaagggctatttgcaaatgaggagatagagaagctgttgtttttacagctttgtatgtcctgtaattagaatgtaggtgttaggagagttgactttaatagcgtagctttttgacctatatatttggtacattcattggttacaaatacagattttcacatattttgtcatggtagcagagctgattgctcttcggaaaaccttgtcaatttgtggtttacattaccttgccacatcaacaatatacatctgaaaaaaaggttcagtgttttctcttttttccctcaaaa

SEQ ID NO: 5011 - DNA, 1764 bp, Lotus japonicus
aacgaaacccttatttcatttccagcgattacattagaaaacccagaaaccatagaagaagattcactctgcaactaaccctaacgatccaaacaaccattgagcattgagcatttcatgctacgactcgctgagttgaatcggataacaatctgagtttctgagtgatcggttgacgcacgcacgcacgcgctcatgggtgctacgggctccaagcttgagaaggctcttggcgatcaattccctgaaggagaacgttacttcggccttgagaatttcggcaacacttgttattgcaacagtgttttgcaggcactatacttctgtgtgccatttcgggaacaactgctggagtattatggaaataacaaaagcataggggatccggaagaaaatcttttgacttgcttagctgacttattttcacagataagttcccagaagaagaaaacaggtgtcattgctcccaaacgatttgtacagaggttgaagaaacagaatgaactcttccgtagctatatgcaccaggatgcacatgagttcttgaactttttgctgaatgaacttgtcgacattctggagaaagaggctcaggctgcaaaaactgatccagatacatcaccaccttctgaaaaggttgccaatgggttcaagaatggtcatgttaatggtggtcagaaagagccgttagttacttgggtacacaaaaattttcagggaatactcaccaacgagacaagatgcttgcaatgtgaaacggttacagccagagatgaaacattttttgacttgagccttgatattgagcaaaacagttcaattacaagctgcttgaaaaatttcagttccactgagacattgaatgctgaggacaaatttttctgtgacaaatgctgcagtttgcaagaagctcagaagaggatgaagataaagaaaccacctcacatcttggtcatccatcttaagcggtttaaatacatggaacagctgggccggtacaagaagctgtcttaccgagttgttttcccgcttgagctgaagttgagcaacactgttgaagatgcagatattgagtattctctatttgcagtagttgtccatgtcgggagtgggcccaaccatggccattatgtcagcctcgtgaagagtcataaccactggttattttttgatgacgaaaatgttgagatgattgatgagtctgctgtgcaaacgttctttggatcagcacaggaatattctagcaacacagaccatggttacattttgttctatgagacccttggtgacaagaactagacggaggagttctgcaagttttagaggatacgggttggagatgtatacttaggatgttggcatgtacagtggatggtggttgcactgtcctttgttcgttttatccctttctcacaataagagcagtatatatatttatatgggtggaaatttcgccgataagaggtgtattcatggttgcaattgttcaaccaacattagaagaacaatgaagtggaaattgctcgttactcatggtagattatttgtattttgtagtttgtcaagatctctcaagtctaaactgatttaacacactctgcaaagaatgttttttaagcagtgtgatgtaccacattatctaagtgaagataatggtgctgaaactttaaactaattgggaacatacgattttgcacattacattatatttgcattaaagcgcgttgattttgcattataagattggtttaaaggttttttctg

SEQ ID NO: 5012 - DNA, 1684 bp, Glycine max
atcctcaattttctttaaattttcgccagcattttcgtcgtggtcctcctcctcctctctctcgcgtaacccttgtttcgctccctgctaacataatctgtagagaaaacctgacaccagaaaaggttcgttccgagacaaaacccaacgatccaaacggtcattgagcgtttcatggtgcgagtcactgaattgaatcggataggaatctgagtttgtgatcggttgacgcggtcatgggtgctgccggctccaagcttgagaaggctctcggcgaccaattccctgaaggagaacgttactttggcctcgagaatttcggcaacacttgttactgcaacagcgtcttgcaggcactatacttttgtgttccctttcgcgaacaattactagagtattatggaaataacaaaagcatattggacggggaagaaaatcttttaacttgcttggcggacttattttcgcagataagttcccagaagaaaaaaactggtgtcattgctcccaaacgatttgtacagaggttgaaaaaacagaatgaactcttccgtagctatatgcaccaggatgcccacgagttcttgaactttttgctgaatgaacttgttgacattctggagaaagaggctcaggctgcaaaaactgatcaggagacatctccaccttctgaaaaggctgttaacgggcccaagaatggtcaagctaatggtgttcacaaagagcctttagttacttgggtacacaaaaattttcagggaatactcaccaatgagacaaggtgcttgcaatgtgagacagtgacagctagagatgaaacatttttggacttgagtcttgatattgagcaaaacagttcaattacaagctgtttgaaaaatttcagttccactgagacactgaatgctgaagacaaatttttttgcgacaaatgctgcagtttgcaagaagctcagaagaggatgaagataaagaaaccacctcacatcttggtcatccatcttaagcggtttaagtacatggaacagctaggccgctacaagaagctgtcctaccgggttgttttcccccttgagctgaagttgagtaacacagttgaagatgcggatatcgagtattctctatttgcagtagttgttcatgttgggagtgggcccaaccacgggcattatgtcagtcttgtgaaaagccataaccactggttattttttgatgacgaaaatgtagagatgattgacgagtctgctgtgcagacgttctttggatcatcacaggagtattcaagtaatacagaccatgggtacattttattctatgagagcattggctctggtaacaggagttaggcggaggatttctacaactctcttaaatcatttggacttctttttcacatggtttccatatttattttcctttctaccgttttccctttattcaacctgttggaggagctgttacatcctctagaggatacgggttgtgaaaaggtatacttaggtggttggcatgtacagtggatagtgctaggcactgtccttttttctttttcctctttctcacaataagaacagtatatatatatcgggtgaaaatttcaccaacgatgtgtattcatggttgcaagcgttcaaccaacattagaaacacaatgaaatggaaattggtcccaactcatgttaga

SEQ ID NO: 5013 - DNA, 1768 bp, Glycine max
aataattccgttatttctttatttatttatcctcaattttctttaaattttcgccagcattttcgtcgtggtcctcctcctcctctctctcgcgtaacccttgtttcgctccctgctaacataatctgtagagaaaacctgacaccagaaaaggttcgttccgagacaaaacccaacgatccaaacggtcattgagcgtttcatggtgcgagtcactgaattgaatcggataggaatctgagtttgtgatcggttgacgcggtcatgggtgctgccggctccaagcttgagaaggctctcggcgaccaattccctgaaggagaacgttactttggcctcgagaatttcggcaacacttgttactgcaacagcgtcttgcaggcactatacttttgtgttccctttcgcgaacaattactagagtattatggaaataacaaaagcatattggacggggaagaaaatcttttaacttgcttggcggacttattttcgcagataagttcccagaagaaaaaaactggtgtcattgctcccaaacgatttgtacagaggttgaaaaaacagaatgaactcttccgtagctatatgcaccaggatgcccacgagttcttgaactttttgctgaatgaacttgttgacattctggagaaagaggctcaggctgcaaaaactgatcaggagacatctccaccttctgaaaaggctgttaacgggcccaagaatggtcaagctaatggtgttcacaaagagcctttagttacttgggtacacaaaaattttcagggaatactcaccaatgagacaaggtgcttgcaatgtgagacagtgacagctagagatgaaacatttttggacttgagtcttgatattgagcaaaacagttcaattacaagctgtttgaaaaatttcagttccactgagacactgaatgctgaagacaaatttttttgcgacaaatgctgcagtttgcaagaagctcagaagaggatgaagataaagaaaccacctcacatcttggtcatccatcttaagcggtttaagtacatggaacagctaggccgctacaagaagctgtcctaccgggttgttttcccccttgagctgaagttgagtaacacagttgaagatgcggatatcgagtattctctatttgcagtagttgttcatgttgggagtgggcccaaccacgggcattatgtcagtcttgtgaaaagccataaccactggttattttttgatgacgaaaatgtagagatgattgacgagtctgctgtgcagacgttctttggatcatcacaggagtattcaagtaatacagaccatgggtacattttattctatgagagcattggctctggtaacaggagttaggcggaggatttctacaactctcttaaatcatttggacttctttttcacatggtttccatatttattttcctttctaccgttttccctttattcaacctgttggaggagctgttacatcctctagaggatacgggttgtgaaaaggtatacttaggtggttggcatgtacagtggatagtgctaggcactgtccttttttctttttcctctttctcacaataagaacagtatatatatatcgggtgaaaatttcaccaacgatgtgtattcatggttgcaagcgttcaaccaacattagaaacacaatgaaatggaaattggtcccaactcatgttagattattttatattttatagtttgacgaacactttggtaataactaatagttgggcat

SEQ ID NO: 5014 - DNA, 1725 bp, Fragaria vesca
cctctcatttcttttgcttcgttctcttcactcacgaaaactccaaccctctcattccctcgttctcgaaactcacttgcagaccaaaaccctagcaatttccccaaacgcgacccgacccgacccacacgcgattgaaccggcatgcgaatcgctgcgctgaaccggcgaaagaggaggatctagacttttccgattgagggtgcattgactcggtccgacgatgggcgctgccggctccaaactcgagaaggctctcggcgaccagttccccgaaggcgagcgctatttcggcctcgagaatttcggcaacacttgctattgtaacagcgttttgcaggcgctttatttttgcgttccatttcgtgaacagttgttagaatactattccaacagtaagaatattggggatgcagaagaaaatctcttgacgtgcttagccgatttgtttacgcagataagttcacaaaagaagaagacaggtgtaattgctccaaagcgtttcgtacagagattgaagaaacaaaatgagctctttcgtagctacatgcatcaggatgctcatgaattcttaaactttttgctaaatgaacttgtcgacatactggagaaggaagcacaagctgcaaaaagtgatcaagaaacttcttcacctcctgagaagctggcaaatggtccgaagaatggtcaagctaatggttctcataaagatcccttagttacgtgggtgcacaaaaattttcagggaatacttaccaatgaaacaaggtgcttacggtgtgagacagtgactgcaagagatgaaacattttttgacttgagccttgatattgaacagaacagttcaataacaagctgtttgaaaaacttcagttccacagagacattgaatgctgaggacaaatttttttgcgacaagtgctgcagcttgcaagaagcgcagaagaggatgaagataaagaaaccacctcacgttctggtcatacatctgaagcggttcaagtacattgagcagcttggccgttacaagaagctatcttaccgggttgtatttcctcttgagctcaagttgagcaacacggttgaagatgcagagtctgagtattccctgtttgcagtagttgtccatgtcgggagtggtccaaaccatggacactatgttagccttgtgaaaagccataatcactggttattttttgatgacgaaaatgtggagatgattgatgagtctgctgtgcaaactttctttgggtcagcacaagagtattcgagtaatacagatcacggatacatcctgttctatgaaagcctcggcaccagtaacaagagttaagattaagaagaagacagctttcgatttaagatggttaggtatttctaatcatatggacttttgtttttcttctgtttccccgatgtttactatttttctcgttttcccctttttctaacctgtgggaagagctgtcaaatatcaatgagatgtggtatgggttgtgaaaaaatgtatacttaggtggttcgcatgtacagtggatgatggaagcacaacatccttttttttgtttctctttcttcttttcttaacaataagaaaaagggtagtgtatatggtgagaatattcagacagtatttattcttcacggttgagggaatgttaacattagaaatgccatgaatgggaatttgctcatcactcctctcttatatggaaccttgtcatc

SEQ ID NO: 5015 - DNA, 1776 bp, Castanea mollissima
tctctctctctctctcttacagtctcgtgcgaaaccctcattctctctttcaacttacaaagagagaaacaaaaaaccatccgaactaacttttcaaacaaaccctaacgattccaacacataaaattaaaaaaaaaacaaacaaaatacacaaagctcgtctctacgagtcatcgatggagagcgaatcgctgagttgaaacaccgccaagtttgaaagatctgagagttctgagagaaagagagatttatataaatttttttcgaagaaaacaacaaagaaaaagtcatcgctcggtttttgcaacgcgctctcatgggtgctgcgggctcgaagctcgagaaagctctcggagaccagttccctgaaggcgagcgctacttcggtctcgaaaatttcggcaacacttgctattgcaacagcgttttgcaggcactttacttttgtgtcccatttcgcgagcaactgctggattattttgcaaacaacaaaagcattggtgatgtggaagaaaatctgttaacatgcttggcagacttattttcacagataagttctcagaagaagaaaacaggcgtgattgctccaaagcgatttgtacagagattgaagaagcaaaatgagcttttccgtagctatatgcaccaggatgcccatgagtttttgaattttttgctgaatgaacttgttgacatactggagaaagaggcccaagctgtgaaaagtgatccagaaacttcatcaccttctgataaaattgcaaatgggccaaagaatgcacaggctaatggtgctctaaaggagcctttagttacctgggtgcacaaaaattttcagggaatactcaccaatgaaacaaggtgcctgcggtgcgagacagtgacagcaagggatgaaactttttttgacttgagcctcgatattgaacagaatagttcaattacaagttgtttgaaaaacttcagctcaacagagacattgaatgccgaggacaaatttttctgtgacaaatgctgtagtttgcaagaggcacagaaaaggatgaagataaagaaaccacctcacattttagtcatccatctgaagcggttcaaatacattgagcagttgggtcggtacaagaagctgtcataccgggttgtcttcccacttgagctgaagctgagcaacacaatggaagatgcagattctgagtattccctgtttgcagtagttgttcatgttggaagtgggcccaaccatggacactatgtaagccttgtgaaaagccataaccattggttgtttttcgatgatgaaaacgtggagatgattgatgagtccgctgtgcagacattctttgggtcagcgcaggaatattcgagtaatacagaccatgggtacattttattctatgagtgcctgggcagcaccagtaacaagagctgagaagagggacttttgaatttaccaaggttagataatttaattatttggactcacttttcttctgtttttattttatgtttattattttttccctttttcaacctatgggaaggagatgtcaaatatcaatgagatattatgggttgtgaaaaatgtatacttagctggttgccatgtacagtggatggtggaagcacactgtcctttggtttttcacaataagaagaaaaagagcagtgtatatggtgtgagagaatttcacagagaaagtttgtattcttcatgactaagaatgtttaattgacatcagaaatgcaatgcaatcggatctgctcacaacggttcta

SEQ ID NO: 5016 - DNA, 1544 bp, Euphorbia peplus
aaatagtgattagatacgataatccatccatccatccagagaagagaagagaagattggttgatggagaatgttgaatctgtgagttgaatcggtcaaaggagattgataattaaatatagtaggttgaaagatctgtgactatcgatgcagtaatgggcgcggcggggtctaaactcgagaaagctttgggcgaccagtttcctgaaggcgaacgttactttggcctcgagaatttcggcaacacttgctactgtaacagcgttttgcaggctctttatttttgtgtgccttttcgggaacaattgctagaatattatgcgaataataaaaattctggggatgccgaagacaatctcttgacatgcttagcagacttatttacacagataagttcacagaagaagaaaacaggtgtgattgctccaaagcgtttcgtgcagagactaaagaaacaaaatgagattttccgtagctacatgcaccaggatgctcatgaatttttgaattatttgcttaatgaacttgttgacaccctagagaaggagggccaagctgcaaaaagtgatcctgaaagttcctcctcccctgagaagactgcaaatggaccaaaaaatggtttggctaatggcatctcaaaggagcccttggttacctgggtgcacaagaattttcagggaattcttaccaatgagacaaggtgccttcagtgtgagacggttacagcaagggatgaaacgtttttcgacttgagcctggatattgaacagaatagttctataacaagctgtttgaaaaatttcagttccaccgagacattgaatgcagaggacaagtttttttgtgacaagtgctgcagcttacaagaagcccaaaagagaatgaagataaagaaacctcctcacatattggttattcatctgaagaggttcaaatacatagagcagctaagtcgttacaagaagctatcttatcgcgtggtcttcccacttgagctgaagctgagtaacacagtagaagacacagacattgaatactcattatttgcagtagttgttcatgttggaagtggaccaaaccatggacactacgtgagccttgtgaaaagccataatcactggctattttttgatgacgaaaatgttgagatgatcgatgagtctgctgtgcagaccttttttggatcagcgcaggaatattcaagtaatacggatcatgggtatatcttgttttatgagaatcttggtgctagtagcaacaagaattgagaaagaggagctttggttttacgagtaggtatgctaatatcatttgcactgaagtaatctttccttatttttctgttattatattttgttttccccttttgttcttcaaccagtgggaatagatgtcaagtttcataatttgatatatgggttgtgagaaatgtatacttgggctgtttccatgtacagtaatggagaagcagaccatctgtgctttgttttttttctccagaataaagaggaaagatcagtgtatatggtgtgagaaaattttaca

SEQ ID NO: 5017 - DNA, 1863 bp, Quercus alba
ttattattgttatttttttctttcttcaatctcttcgtccactctctctctcttacagtctcgaacgaaaccctcatttcctctttcaactcacaaagagagaaaaaaaaccatccgaactaactttccaaacaaaccctaacgattccaacacataaaattaaaaaacaaaacacaaagctcgtctctacgagtcgacgatggagagcgaatcgctgagttgaaactccgccgagttgaaagatctgagagttctgagagatagagagatatatataatttttttcgaagaaaacaacaaagaaaaagtcatcgctcggtttttgcaacgcgctctcatgggtgctgcgggctcgaagctcgagaaagctctcggagaccagttccctgaaggcgagcgctacttcggtctcgaaaatttcggcaacacttgctattgcaacagcgttttgcaggcactttacttttgtgtcccatttcgcgagcaactgctggattattatgcaaataacaaaagcattggtgacgtggaagaaaatctgttaacatgcttggcagacctattttcacagataagttctcagaagaagaaaacaggcgtgattgctccaaagcgctttgtacagagattgaagaaacaaaatgagcttttccgtagctatatgcaccaggatgcccatgagtttttgaattttttgctgaatgaacttgttgacatactggagaaagaggcccaagttgtgaaaagtgatccagaaacttcatcaccttctgataaaattgcaaatgggccaaagaatgcacaggctaatggtgctctaaaggagcctttagttacctgggtgcacaaaaattttcagggaatactcaccaatgaaacaaggtgtctgcgatgcgagacagtgacagcaagggatgaaactttttttgacttgagcctcgatattgaacagaatagttcaattacaagttgtttgaaaaacttcagctcaacagagacattgaatgccgaggacaaatttttctgtgacaaatgctgtagtttgcaagaagcacagaagaggatgaagataaagaaaccacctcacattttagtcatccatctgaagcggttcaaatacattgagcagctgggtcggtacaagaaactgtcataccgggttgtcttcccacttgagctgaagctgagcaacacaatggaagatgcagattctgagtattccctgtttgcagtagttgttcatgttggaagtgggcccaaccatggacactatgtaagccttgtgaaaagccataaccattggttgtttttcgatgatgaaaacgtggagatgattgatgagtccgctgtgcagacattctttgggtcagcgcaggaatattcgagtaatacagaccatgggtacattttattctatgagtgcctgggcagcaccagtaacaagagctgagaagagggacttttgaatttaccaaggtggttgccatgtacagtggatggtggaagcacaccgtcctttggtttttcacaataagaagaaaaagagcagtgtatatggtgtgagagagtttcacagagaaagtttgtattcttcatgactaagaatgtttaattgacatcagaaatgcaatgcaatcggatctgctcacgacggttctgtaacattgtatgctttgttttccttttttttgagtttttaggttgttggaggcaaatattagtagtaatatttggtcatcacaataattacttttaacaaaaaaagaaaatagtcatcacagtaaagcttatattgtgcccttgaattttggtttatcttctacccactttagttccttacaagttctgtctgtctgtctctt

SEQ ID NO: 5018 - DNA, 1754 bp, Populus trichocarpa
tatttttctcttgttttcttctctctctctctctcacaaaaccataccataccagacaaacacaaaccctcgttccgttcctttcctttccttccactaccaacaaaatcataaaacaaaattcttatttcccaaacaaaccctaactaacaatcaaaatcacagaggcagagaaacttgctcgttgattaggatggtggaattagtgagttgaatcgggatctgagttgactcaatcgatgcagtaatgggtgcagcaggttctaaactcgagaaagctttaggcgaccagtttcctgagggcgaacgatacttcggcctcgagaatttcggcaacacttgttactgtaatagcgtcttgcaggcactttacttttgtgcaccatttcgagaacagttgttagaatattatgctaatagtaaaaatattggggatgctgaagagaatctcttgacttgcttggcagacttatttactcagataagttcacagaagaagaaaacaggtgtcattgctccaaagcgtttcgtacagaggttgaaaaaacaaaatgaacttttccgaagctatatgcaccaggatgcacatgagtttttgaattttttgcttaatgaactggttgacatcctggagaaagaagcccaagctgttaaaagtgaaactgaaacctcttccccacctgaaaaaactgcaaatggaccaaagcatgctcaggcaaatggtgtttcaaaggagcctttggttacctgggtgcacaaaaattttcagggaatacttaccaatgagacaaggtgcttgcaatgtgagactgtgacagcaagagatgaaacgttttttgacttgagccttgatattgaacaaaacagttccataacaagctgcttgaagaattttagttccacagagactttgaatgcagaggataagtttttctgtgacaagtgctgcagtttgcaagaagcacaaaagaggatgaagataaagaagcctcctcatatcttggtcatccatttgaagaggtttaaatacattgagcagcttggtcggtacaagaaattgtcttaccgagttgtcttcccacttgagctgaagctgagcaatactgtggaagatgcagatatagaatactctctatttgccgttgttgtccatgtgggaagtggacctaatcacgggcactatgtgagccttgtgaagagccacaaccactggttatttttcgatgatgaaaatgttgagatgattgacgagtctgctgtgcagacattttttgggtcagcgcaggaatattcaagtaatacggatcacgggtatatcttattttacgagagcattggtgctagtaacaacaagagttgagaggagggggcatttggttttacaagtaggtatttaaatcatttggactggacttatcttttgtttaatctgttattattgttttttcttttcccttttgtccttcaaacaatgggaagagctctcaaatgtccacatttgagatgatgatgatgatgatgatgatgattgtgacaaatgtatacttgggttacttccatgtacagtggatggtggaagctcaccatccttgtgtttttccagaataagaggataaaagagcagtgtatatggtttgaaaatttcacagaaacagcttgtattgttcatggttgagaatgttccaaaagcagaaatacaatccagttggaaattggttggagcaatcctcgtattagtgaatttgttctaacgt

SEQ ID NO: 5019 - DNA, 1871 bp, Populus trichocarpa
tatatttttctcttgttttcttctctctctctctctcacaaaaccataccataccagacaaacacaaaccctcgttccgttcctttcctttccttccactaccaacaaaatcataaaacaaaattcttatttcccaaacaaaccctaactaacaatcaaaatcacagaggcagagaaacttgctcgttgattaggatggtggaattagtgagttgaatcgggatctgagttgactcaatcgatgcagtaatgggtgcagcaggttctaaactcgagaaagctttaggcgaccagtttcctgagggcgaacgatacttcggcctcgagaatttcggcaacacttgttactgtaatagcgtcttgcaggcactttacttttgtgcaccatttcgagaacagttgttagaatattatgctaatagtaaaaatattggggatgctgaagagaatctcttgacttgcttggcagacttatttactcagataagttcacagaagaagaaaacaggtgtcattgctccaaagcgtttcgtacagaggttgaaaaaacaaaatgaacttttccgaagctatatgcaccaggatgcacatgagtttttgaattttttgcttaatgaactggttgacatcctggagaaagaagcccaagctgttaaaagtgaaactgaaacctcttccccacctgaaaaaactgcaaatggaccaaagcatgctcaggcaaatggtgtttcaaaggagcctttggttacctgggtgcacaaaaattttcagggaatacttaccaatgagacaaggtgcttgcaatgtgagactgtgacagcaagagatgaaacgttttttgacttgagccttgatattgaacaaaacagttccataacaagctgcttgaagaattttagttccacagagactttgaatgcagaggataagtttttctgtgacaagtgctgcagtttgcaagaagcacaaaagaggatgaagataaagaagcctcctcatatcttggtcatccatttgaagaggtttaaatacattgagcagcttggtcggtacaagaaattgtcttaccgagttgtcttcccacttgagctgaagctgagcaatactgtggaagatgcagatatagaatactctctatttgccgttgttgtccatgtgggaagtggacctaatcacgggcactatgtgagccttgtgaagagccacaaccactggttatttttcgatgatgaaaatgttgagatgattgacgagtctgctgtgcagacattttttgggtcagcgcaggaatattcaagtaatacggatcacgggtatatcttattttacgagagcattggtgctagtaacaacaagagttgagaggagggggcatttggttttacaagtaggtatttaaatcatttggactggacttatcttttgtttaatctgttattattgttttttcttttcccttttgtccttcaaacaatgggaagagctctcaaatgtccacatttgagatgatgatgatgatgatgatgatgattgtgacaaatgtatacttgggttacttccatgtacagtggatggtggaagctcaccatccttgtgtttttccagaataagaggataaaagagcagtgtatatggtttgaaaatttcacagaaacagcttgtattgttcatggttgagaatgttccaaaagcagaaatacaatccagttggaaattggttggagcaatcctcgtattagtgaatttgttctaacgtctttgtagatcttattggccattaatcattatgcatgccataggatgattccctacaagcctttaaccttcatggtcgttttgtatttgctatcaatccaggctcaaatttaggc

SEQ ID NO: 5020 - DNA, 1522 bp, Solanum phureja
agaaaaaaaaagccctcattttccacctcttctgattcagttttttcatcagtgtttgtaaatcgctgctgagagaagtcgaagaaaccctaattcccattttatcaaatttgacgttgtagaaggagatttaggaatgaactgagatgggtgcagcaggttccaaactcgagaaagctctgggtgaccaatttcctgaaggagaacgttactttggccttgagaatttcggcaatacttgctattgtaacagcgttcttcaggctctatatttctgtgttccatttcgagaacagctactggattattattcaaataacaaaaatcttgctgacgcagatgaaaatctcttgacatgccttgctgacctgtttatgcagataagctcacaaaagaagaaaactggtgtcattgctcccaagcgcttcgtacagagattgaagaagcagaatgagattttccgcagttatatgcatcaggacgcacacgaatttttaaactatttactgaacgaactggttgacatactggagaaagtagccagtgcagctaaaagtgatcaagaaacttcttccccaacagaaaaaattgcaaatggaccaaccagtgttcatgctaatggtgttaaaaaggagcccctggttacatgggtgcacaaaaatttccagggtatactcacaaatgaaacgaagtgcttgcgttgtgagactgtaactgcacgagatgagacatttcttgatttgagcctcgacattgaacagaacagttcaataactagctgcctgaagaactttagttccacagagactttgaatgcagaggataaattcttctgtgacaagtgttgcagcttgcaggaagctcagaagaggatgaagattaaaaagccccctcacatcctagttatccatttgaagcgatttaagtacattgaacagcttggtcggtataagaagctctcataccgcgttgtcttcccacttgagctgaagctgagcaatacagttgaggatgcagacgctgagtattccttattcgctgtggtagtccatgttgggagtggaccaaaccacggacactacgtcagccttgtgaagagtcacaaccactggttgttctttgatgatgagaatgttgagatgattgatgagtcagctgttcaaacattttttgggtcagctcaagagtattccagcaatacagaccacgggtacatcttattttacgagagagtctccaatggaagcactagttagtagcttaatgagtttagtttattttgtttccaattttgaactcaatttctacctctagtgatcaattttatcatttgctacaacattcctttgtagtttcttcagaaattttctagtgagttgacatgaaatgtgaagaatacatatctaggttgttgccttgtacagtggatggtaaaagctataccatctatttttccaacaataaaaggggaaaaaagatatgtagtgtatgtgatgcttgagtttagtaggatttattcttc

SEQ ID NO: 5021 - DNA, 1869 bp, Trigonella foenum-graecum
cggccgggggattttacaacttgttgctctctctctctctctagcaaaaccctcgtttcattcttccccgataatatccacataaaaacccagaaaccttcatggttcgaatcactctgtaacaaacaaccataacgatccaaaacgccacgtaagcatttcatggttcgaatcagcgagttgaatcggataggaatctgagttcatcgttgatcgattgacgcacgcgctaatgggtgctgctggttccaagcttgagaaggctctcggtgatcaattccctgaaggagaacgttacttcggtcttgagaatttcggcaatacttgttattgtaacagcgttttgcaggcactatacttttgtgttccatttcgggaacaactgctggagtattatggaaataacaaaaccttaggggatgcagaagaaaatctgttgacttgtttagctgacttgttttcacagataagttcgcagaagaagaaaaccggtgtcattgctcccaagcgatttgtacagaggttgaaaaaacagaatgaactctttcgtagctatatgcatcaggatgcccatgaattcttgaactttttgctgaatgaacttgttgacattctggagaaagaggctcaggctgtgaagagtgatcctgagacaccaacaccttctgaaaaggttgcaaatgggttcaagaatggtcatgctaatggacctcagaaagagcctttaattacttgggtacacaagaattttcagggaatactcaccaatgagacgaggtgcttgcaatgtgaaactgtgacagctagggatgaaacattttttgatttgagccttgatattgagcaaaacagttcaattacaagctgtttgaaaaatttcagttccactgagacgttgaatgctgaggacaaatttttctgtgacaagtgctgcagtttgcaagaagctcagaagagaatgaagataaagaaacctcctcacattctggtaattcatctcaagcggtttaagtacatggaacagctgggccgctacaagaagttgtcttaccgagttgtttttcctcttgagctgaagctgagcaacactgttgaagattcagatattgagtattctctatttgccgtagttgttcatgttggtagtggtcccaaccatgggcattatgtcagccttgtgaaaagccataaccactggttattttttgatgacgaaaatgtggagatgattgatgagtccgccgtgcagacgttctttggatcaccacaggaatattcaactaacacagaccatgggtacattttgttctatgagagccttgggcccggtaacagtaactagatggaggtgtgttatacaacttttaggtactcaaatcatttggacctgtttttttccatctagttcctctacttgttttcatgttataccattattcaacccgttggggggagctgttgcatcctttagagcatacaggttgtgttgtgaaatgtatacttaggtggttggcatgtacagtttgatggtgctagcactgtccttttcctttctcacaataagagcagtatatatatggtggaaattttgccgacaatatgtattcatggttgcaagtgttcaaccaacattagaaacacaatgaaatggactatatgcgtattcgtggttgcaagtgttcaaccaagattagaaacaatgaaatgtaaaatgctcataacttatgctaacattattttagtttcataagagctctatagttatgcttgtgttaggggatcaaccgacttgtattaatgacaaacaaatgcaagtgttcaaccaagattagaaacacaatgaaatataaaatgctcataacttatgcc

SEQ ID NO: 5022 - DNA, 1900 bp, Citrullus lanatus
taaattttgattgttggagtttagttcgatccacgtggcatgtaaatgttgctctccaattttgagaagccatcgattgatttaataccaaaccagaccttcccctcttttccttcgtctccctttcttcttcttcttcttcttcttcacccaaaccctcgtttccatcttccttcactctctgcaaccacaatttcgacaaacgaaccaccaactgaactcaagcacgctcacaaaaaccctagaatttccattcaactacggaggagcccaccagtctctgaaccgagagatttcattttttatttttttatttttggttttctttttatatggcgaccaatttcctgattaagatctgagtcgcgtttgattctttcatttcgaccacgcggatgggtgctacgggctcaaagctcgagaaggctctcggtgaccagttccctgaaggcgagcgctacttcggccttgaaaattttggcaatacttgctactgtaacagcgtcttgcaggcactgtatttttgtgttccttttcgtgagcaattgttagattattactcaaataacaaaagtattggagatgcggaagaaaacctcttaacatgcttagcagatttgttcacccagattagttcccaaaagaaaaaaactggtgtcattgctccaaagcgctttgttcagagattgaaaaagcagaatgagattttccgtagctatatgcaccaagatgctcatgaatttttgaactttttgctcaacgaacttgttgacatactggagaaagagacacatgctactaaaagtgatgcagaaagttcatcaccatctgaaaaaatttcaaatggtcctaagactggtcaggcaaatggtgctcaaaaagagccgttggtgacttgggtgcataaaaattttcagggtttactaactaacgagacaaggtgtttgcggtgcgagacagttacagcaagggatgaaacttttcttgacttgagccttgatattgaacagaacagttcaataactagctgtttaaaaaatttcagttccactgagacactgaatgctgaggacaagtttttctgcgacaagtgctgcagtttgcaagaagcacagaagaggatgaagattaagaaaccacctcgtatccttgttattcatctgaagcggtttaaatacatcgagcagcttggccgctataaaaagctgttatacagagttgttttccctcttgagctgaagcttagcaacacaatggaggacgcagattctgagtactctttgtttgctgttgtggtccatgttggaagtggacccaaccatggacactatgttagccttgtgaaaagccataaccactggttattttttgatgacgaaaatgtggaaatgattgatgagtctgtcgtgcagacattctttggatccgcacaggaatattctagtaatactgatcatggctacatcttattctacgagagcattggcaccggcaacaagagctgatatttggagaatttcccatttcatcaggccatcgggtaatttatgattcgactcttgttttttggcttcgcatgtttattaatgttattattactttttctttttcttttttttttttttcatttcataacaccattgggaagagctgtgaaatattatttgatgttatggactgtgaaaaatgtatacatggtcggttgccagtttggcatatatagtgtatggcggcagcttttcttttcccctttaaataagtgaaaagagagcaatgtatgatgtttatgaatgctgctttagaggaaagactattctaattctgattctgtttctacatataatctgatgaatattgagagcaatcagccaacatctatgctttgaattcctcatcacaa

SEQ ID NO: 5023 - DNA, 1650 bp, Vigna unguiculata
cctcaattcctccttaaattttcatctgcattttcgtccttcttcgttttgtttctctctcacgggaaacccttgtttcatttcttgctatcatatctatagagaaaacctgacaccagaaagaggttctttctgcgacaaaccctagcgatccaaacggtcattcagcatttcatggtgcgaatcaccgagttgaatcgcatagcaatctgagtttctgatcggttgacgcggtcatgggtgctgcgggctccaagcttgagaaggctcttggcgaccaattccccgaaggagaacgttacttcggccttgagaatttcggcaacacttgttactgcaacagcgtcttgcaggcactatacttttgtgttccttttcgtgaacaattactggagtattatggaaataacaaaagcatactggatggggaagaaaatcttttgacgtgcttggcggatttgttttcacagataagttcccagaagaaaaagactggtgttgttgctcccaaacgatttgtacagaggctgaaaaaacagaacgaactcttccgtagctatatgcaccaggatgcccatgaattcttgaactttttgctgaatgaacttgttgacattcttgagaaagagagtcaagctgtaaaagctgctgatcaggagacctcaccaccttccgaaaaggctgttaatggccccaagaatggtcaagctaatggtgttcacaaagagccattagttacttgggtacacaaaaattttcaaggaatactcaccaatgagacaaggtgcttgcaatgtgaaacagtgacagctcgagatgaaacatttttagacttgagtcttgatattgagcagaacagctcaattacaagctgtttgaaaaatttcagttccactgagacactgaacgctgaagacaaattcttttgtgacaaatgctgcagtttgcaagaagctcagaagaggatgaagataaagaaaccacctcacatcttggtcatccatcttaagcgttctaagtacatggagcagcttggtcgctacaagaagctgtcatatcgggttgtttttcccctggagctgaagctaagtaacactgttgaagatgcagatatagagtattctctatttgcggtagttgtccatgttgggagtgggcccaaccatgggcattatgtgagccttgtgaaaagccataaccactggttattttttgatgacgaaaatgtagagatgattgacgaatctgctgtgcagacgttctttggatcatcacaggaatattcaagtaatacagatcatgggtacattttgttctatgagagccttggctctggtaacaggaattagatggaggagttctacaactcttctgtaatcatttggacttcttcttttcaccaggtttccatatttattttccctttctaccgttttccctttattcaacatcccccagaggattcgggttgtgaaaatttatacttaggtggttgccatgtacagtggatagtgttagcactgtcctttttctttttactctttctcacaataagaacagtatatatatcgggtgaaaatttcaccaaccgatgtgtattcatggttgcaaacgctcaaccaacattagaaacaaatgaaaattgatcct

SEQ ID NO: 5024 - DNA, 1505 bp, Gossypium hirsutum
agaagatctgagttggacttttagataaagttaattttataaatgggcgccgcgggttctaaacttgagaaagcattgggcgatcagttccctgagggcgaacgatattttggccttgaaaactttggcaacacttgctattgtaacagcgttttgcaggcactttatttttgtgtcccatttcgtgaacagctgctagaatattattcaagtcataaaattggtgctgatgctgaagataacctgctgacatgcttggcagatctgtttacacagataaattcacagaagaagaaaacaggtgtcattgctccaaagcgttttgtacagagattgaagaaacaaaatgagcttttccgcagctacatgcaccaggatgctcatgagttcttgaatttcttgctaaatgaacttgttgacatactggagaaagaagatcaagctgcgaaaaaagagggagaaactttgtcaccatctgaaaagactgtaaacgggccaaagaatcctcaggctaatggtgttcaaaaagagcccctggttacctgggtacacaagaactttcagggaatacttaccaatgagacgagatgcttgcgatgtgagacagtgacagcaagagatgaagctttctttgacttgagccttgacattgagcagaacagctcaataactagctgtttgaaaaatttcagttctaccgagacattgaacgctgaggacaaatttttctgtgacaagtgctgcagtttgcaagaagctcagaagagaatgaagataaagaagcctcctcacatcctggttatccatttgaaacggttcaagtacattgagcagcttggccggtataagaagctctcctaccgtgttgtgttcccactcgagctgaaactgagcaatactgtggaagatgcagattctgagtattctctatttgctgtagttgttcacgttggaagtggacctaaccatgggcactatgttagcctggtgaaaagccataaccactggttattttttgatgacgaaaatgtggagatgattgatgagtctgcagttcagacatttttcgggtctgcccaggagtactcaagtaatacagatcatgggtatatcttattttatgaaagcctttgtgcaaacaagagctgagaaaagagggcttcgattttaccatgagtacaggtatccattttcccaaatctcaattttcttgaaccacctatgctttttcttttttcttttgccgattttctcgacatccaatactgtgggaagagccggcagattcatatccgtgagatgtggatcataaaaaaatgtatacttaggtttttgcaatgtacagtggatggtggaagcacactgtcctgtttcttttttttgtttccacaataagagataaaagagagcaatgtgtaatgttgtgagaaaatcagagtttttgtattattcatggttgaatgttccaacattagccatgcatatggattttgctaccggcgcgg

SEQ ID NO: 5025 - DNA, 1916 bp, Gossypium raimondii
cggataaacacgttagaaattcttattgatgacgttagacatcgtaggtggataatttattaattaaattaaattaaatttacaaatcgttatattttatagaagcacttcttcattccttctttatttcgattcctttgtctctcccaaaagccgtctcaaagaaaacgaaacaaagacaaaaggtcctcatttcttatcaatgccccaaactgaatataaaaacaaattgcttttttttttctctcccttcctctaaacgaaccattacacaaatccaaatcaaaactcaagaagagcccatcgtgaatggagagatagaattgctgagttgaattggtcgggagaagatctgagttggacttttagataaagttagttttataaatgggcgccgcgggttctaaacttgagaaagcattgggcgatcagttccctgagggcgaacgatattttggccttgaaaactttggcaacacttgctattgtaacagcgttttgcaggcactttatttttgtgtaccatttcgtgaacagctgctagaatattattcaagtcatgaaattggtgctgatgctgaagataacctgctgacatgcttggcagatctgtttacacagataaatttacagaagaagaaaacaggtgtcattgctccaaagcgttttgtacagagattgaagaaacaaaatgagcttttccgcagctacatgcaccaggatgctcatgagttcttgaatttcttgctaaatgaacttgttgacatactggagaaagaagatcaagctgcgaaaaaagagggaggaacttcgtcaccatctgaaaagactgtaaacggtcctaagaatcctcaggctaatggtgttcaaaaagagcccctggttacctgggtacacaagaactttcagggaatacttaccaatgagacgagatgcttgcgatgtgagacagtgacagcaagagatgaagctttctttgacttgagccttgacattgagcagaacagctcaataactagctgtttgaaaaatttcagttctaccgagacattgaacgctgaggacaaatttttctgtgacaagtgctgcagtttgcaagaagcccagaagagaatgaagataaagaagcctcctcacatcctggttatccatttgaaacggttcaagtacattgagcagcttggccggtataagaagctctcctaccgtgttgtgttcccactcgagctgaaactgagcaatactgtggaagatgcagattctgagtattctctatttgctgtagttgttcacgttggaagtggacctaaccatgggcactatgttagcctggtgaaaagccataaccactggttattttttgatgacgaaaatgtggagatgattgatgagtctgcagttcagacatttttcgggtctgcccaggagtactcaagtaatacagatcatgggtatatcttattttatgaaagcctttgtgcaaacaagagctgagaaaagagggcttcgattttaccatgagtacaggtatccattttcccaaatctcaattttcttgaaccacctatgctttttctttttttcttttgccgattttctcgacatccaatactgtgggaagagccggcagattcatatccgtgagatgtggatcataaaaaaatgtatacttaggtttttgcaatgtacagtggatggtggaagcacactgtctgtccttctgtttcctttttttttttgtttccacaataagagataaaagagagcaatgtgtaatgttgtgagaaaatcagagtttttgtattattcatggttgaatgttccaacattagccatgcatatggattttgcttctaactttaatagttaaatgatcttttttttaccaaaattaaaaaatggaatcaaattttaaa

SEQ ID NO: 5026 - DNA, 1740 bp, Ambrosia trifida
ttgaaagaatcaaagtatgataaaacaataaaaacccgatcaaactgtttcctcacgcatcaatccacacttcttcttcttccaaatatacatcatataaacctaataataataataataagaataatttcttccacaacaactcttgaacacacattaacaacccctttttacaaaatctcatattaatcgctctatttatttacaggagttaaataaaagaaagatttacataaagaaatagaggagttttggtatcttgttgatggtctgatgggggcaacaggttcaaagcttgagaaggctttaggagaccagttccctgaaggcgaacgttattttggccttgaaaactttggtaacacttgctattgtaacagtgtcttgcaggctctatatttttgtgttccatttcgtgaacaactacttgaatattacgggaatattaaaaatccaggagacacagaagaaaatctccttacatgtttagcagaactgtttatgcagattagcacacaaaagaagaaaacaggtgttattgctccaaaacgctttgtacaaagagtgaagaaagaaaacgagctttttcgtggttacatgcatcaggatgcacatgaatttttgaatttcttgttaaacgaactagttgacatactagagaaagaagccaatgcatcaaaaggttcaaaagagcattcctcaccttctgaaaagattcccaacggggtacatgttcctcaggccaacggtgtacgcaaggagcccttggttacttgggttcacaaaaattttcagggtatacttacaaatgaaacaaagtgtttaagatgtgagactgtgactgcaagggatgagacgtttctagatttgagccttgatattgagcagaacagttcaattacaagttgcttaaagaacttcagctccactgaaaccttgaatgctgaggataagtttttctgtgataaatgctgcagtttgcaggaagcacaaaagaggatgaagatcaagaaaccgccacacatcttggttatacacttaaagcggttcaagtacatggaacagctgggcaggtacaaaaagttatcatatcgtgtcgtgtttcctctggagctgaagctgaccaacaccatggaagatgccgactgtgagtactcgttatttgcagtggtggttcatgtcggcagtgggcccaaccatgggcattatgtaagtctagtcaaaagccacaaccactggctgttctttgacgatgaaaatgtagaaatgattgatgagtctgctgttcaaacctcgttcgggtcagcccaagagtatgcaagcaacaccgatcatgggtacatcctgttctacgagagccttgctaccaacagtggtcattaaaaggtattttgtgtttcatggtttttgtggtatcatccatcaaataggggttattagatgagaagaaagttgagacgacgggtttgatgtacagttgatgctgctgctgctataactatttggtttcatctgtttttagttgtaacaataaagatacatatgtggatgatagcgaatgtgtcgctttaaacactaatacaatcatcaaagataacgatgataagtcccttgacagcttgagaaatgttaattcatcttgtttcttgatttgtagcgttatttagcgtttcttgtgttgtggtcgtgtttggaataacaaagctataataagtgttgtatcttgttcaaaaaaagaaa

SEQ ID NO: 5027 - DNA, 1567 bp, Ambrosia trifida
aaactgtttcctttacgcattcaacccacacttcttcttcttccaaatatacatcatataaccctaataatataataataattcttccacaacaactcttcaacacacacaacaacccctttttttacaaaatctcatattaatcgctctattatttacaggagttcatataatataaaaaaaagatttacataagaatagaggagttttggtatcttgttgatggtctgatgggggcaacaggttcaaagcttgagaaggctttaggagaccagttccctgaaggcgaacgttattttggccttgaaaactttggtaacacttgctattgtaacagtgtcttgcaggctctatatttttgtgttccatttcgtgaacaactacttgaatattacgggaatattaaaaatccaggagacacagaagaaaatctccttacatgtttagcagaactgtttatgcagattagtacacaaaagaagaaaacaggtgttattgctccaaaacgctttgtacaaagagtgaagaaagaaaacgagctttttcgtggttacatgcatcaggatgcacatgaatttttgaatttcttgttaaacgaactagttgacatactagagaaagaagccaatgcatcaaaaggttcaaaagagcattcatcaccttctgaaaagattcccaatgggatacatgttcctcaggccaacggtgtacggaaggagcccttggttacttgggttcacaaaaattttcagggtatacttacaaatgaaacaaagtgtttaagatgtgagactgtgactgcaagggatgagacgtttttagatttgagccttgatattgagcagaacagttcaattacaagttgcttaaagaacttcagctccactgaaaccttgaatgctgaggataagtttttctgtgataaatgctgcagtttgcaggaagcacaaaagaggatgaagatcaagaaaccgccacacatcttggttatacacttaaagcggttcaagtacatggaacagctgggcaggtacaaaaagttatcatatcgtgtcgtgtttcctctggagctgaagctgaccaacaccatggaagatgccgactgtgagtactcgttatttgcagtggtggttcatgtcggcagtgggcccaaccatggccattatgtaagtctggtcaaaagccacaaccactggctgttctttgacgatgaaaacgtagaaatgattgatgagtctgctgttcaaacctcgttcgggtcagcccaagagtatgcaagcaacaccgatcatgggtacatcctgttctacgagagccttgctaccaacggtggtcattaaaaggtattttgtgtttttgtggtatcatccatcatataggggaatttgtggttattagatgagaaaaaagttgagatggatttgatgtacagttgatgctgctgctgctataactatttggttcatctgtttttagttgtaacaataaagatacatatgtggatagataagcgaacgtgtacgctttaaaacaccaaataccatcaatcaaaagataaacgatagat

SEQ ID NO: 5028 - DNA, 1387 bp, Arabidopsis thaliana
attattcgcgaggaacagaaatttcagtatcgatcttcttcttcttcttcttcgccaatttcaacactttcgaaatctgagaatcttctgtgtgaatcggaacgaaattaacggtgttacggaggctagggctgatgggcgcggcggggtccaaactcgagaaagctctcggcgaccagttcccggaaggagaacgatacttcggtttcgaaaatttcggcaacacttgttactgtaacagtgttttgcaggctctttatttttgtgctccctttcgtgaacaattgcttgaacattatgcaaataataaagctgatgctgaggagaatctcttgacctgcttggctgacttattttcgcagataagttcccagaagaagaaaacaggagttatcgctccgaagcgctttgtgcaaaggttgaagaaacagaatgagcttttccggagttatatgcatcaggatgcacatgagttcctgaattatttgctaaatgaacttgttgagatcttagagaaagagacacaagccacaaaagcagacaatgaaacttcatcatctcctgaaaagattgcaaatgtactgaaagctcccctggcaaatggtgttcataaagagccaattgttacttgggtgcacaagatttttcagggtatacttaccaacgagacaaggtgtctacggtgtgagacagtaacagcaagagatgaaactttcctagacctgagccttgatattgaacagaacagttcgataactagctgtttgaaaaacttcagctccacagagactctacatgcagaagacaagtttttctgtgacaaatgctgcagtttacaagaagcgcagaagagaatgaagattaagaaaccgccacacatcttagttatacatctgaaacggttcaaatacatggaacagttgggccgctacaagaagctatcgtacagagtcgtcttccctctggaactgaaactcagcaacacagtggatgaatatgtggacattgagtactctctctttgcagtcgtggttcatgtcggaagtggacctaaccacggtcattatgttagcctcgtgaaatcccataaccactggctcttctttgatgatgagagtgtcgaaataattgaagaatctgctgttcaaacattcttcggttcatcgcaagagtactcaagtaatactgatcatggctacatcttgttatacgagagcctcggaacaagatagagaaaaaagcttttagtcatttgacaagaacataacctctcctctcttactctctcttcgaagaacataaccatgtacagttttaatgacaagattactatttggttacataagtttgatttatgtttcaaatatatatcatttaaattagagtc

SEQ ID NO: 5029 - DNA, 1651 bp, Vigna unguiculata
  misc_feature (761)..(761): n is a, c, g, or t
  misc_feature (864)..(864): n is a, c, g, or t
  misc_feature (1015)..(1015): n is a, c, g, or t
cctcaattcctccttaaattttcatctgcattttcgtccttcttcgttttgtttctctctcacgggaaacccttgtttcatttcttgctatcatatctatagagaaaacctgacaccagaaagaggttctttctgcgacaaaccctagcgatccaaacggtcattcagcatttcatggtgcgaatcaccgagttgaatcgcatagcaatctgagtttctgatcggttgacgcggtcatgggtgctgcgggctccaagcttgagaaggctcttggcgaccaattccccgaaggagaacgttacttcggccttgagaatttcggcaacacttgttactgcaacagcgtcttgcaggcactatacttttgtgttccttttcgtgaacaattactggagtattatggaaataacaaaagcatactggatggggaagaaaatcttttgacgtgcttggcggatttgttttcacagataagttcccagaagaaaaagactggtgttgttgctcccaaacgatttgtacagaggctgaaaaaacagaacgaactcttccgtagctatatgcaccaggatgcccatgaattcttgaactttttgctgaatgaacttgttgacattcttgagaaagagagtcaagctgtaaaagctgctgatcaggagacctcaccaccttccgaaaaggctgttaatggccccaagaatggtcaagctaatggtgttcacaaagagccattagttacttgggtacacaaaaattttcanggaatactcaccaatgagacaaggtgcttgcaatgtgaaacagtgacagctcgagatgaaacatttttagacttgagtcttgatattgagcagaacagctcanttacaagctgtttgaaaaatttcagttccactgagacactgaacgctgaagacaaattcttttgtgacaaatgctgcagtttgcaagaagctcagaagaggatgaagataaagaaaccacctcacatcttggtcatccatcttaagcgttntaagtacatggagcagcttggtcgctacaagaagctgtcatatcgggttgtttttcccctggagctgaagctaagtaacactgttgaagatgcagatatagagtattctctatttgcggtagttgtccatgttgggagtgggcccaaccatgggcattatgtgagccttgtgaaaagccataaccactggttattttttgatgacgaaaatgtagagatgattgacgaatctgctgtgcagacgttctttggatcatcacaggaatattcaagtaatacagatcatgggtacattttgttctatgagagccttggctctggtaacaggaattagatggaggagttctacaactcttctgtaatcatttggacttcttcttttcaccaggtttccatatttattttccctttctaccgttttccctttattcaacatcccccagaggattcgggttgtgaaaatttatacttaggtggttgccatgtacagtggatagtgttagcactgtcctttttctttttactctttctcacaataagaacagtatatatatcgggtgaaaatttcaccaaccgatgtgtattcatggttgcaaacgctcaaccaacattagaaacaaatgaaaattgatccta

SEQ ID NO: 5030 - DNA, 1566 bp, Arachis hypogaea
cagagagagagagagaaattggcatttggcattgatggattggtgagttgaatcgaacaagaagatccaagtgagagtgatcggtttgacgcggtgatgggtgctgcgggttccaagctcgagaaggctctcggtgaccaattccctgaaggtgaacgttacttcggcctcgagaatttcggcaacacttgttactgcaacagcgttttgcaggcactgtacttctgtgtcccatttcgtgaacaattgttagattattatgcaaataacaaaagcatggcagatgcagaggaaaatcttttaacttgcctagctgacttattttcacagataagttcccaaaagaagaaaactggtgtgattgctcccaaaagatttgtacagaggttgaaaaaacaaaatgaactcttccgcagctatatgcaccaggatgcccatgaattcttgaactttttgttgaatgaacttgtcgacattttggagaaagaggcccagtctgcaaaagatgatcaagatccattaccgccttctgaaaaggttgcaaatgggcctatagctggtccagttaatggcaccaagaaagagcctttagttacttgggttcataaaaactttcagggaatactcaccaatgagacaaggtgcctacaatgcgaaacagtgactgctagggatgaaaccttttttgacttgagcctcgacattgaacagaacagttcaattacaagctgtttgaaaaacttcagttcaacagagacattaaatgccgaagataaatttttttgtgacaaatgctgcagtttgcaagaagctcagaagaggatgaagataaagaaaccacctcaaatcttggtcatccatctaaaacggtttaagtatattgaacagcttggccgctacaagaagttatcttaccgggttgtcttcccccttgagctgaagctgagtgataccgttgaagatgcagacattgagtattctctgtttgcagtagttgtccatgttggtagtggccctaaccatggccattatgttagccttgtgaaaagccataaccactggttattttttgacgacgaaaatgttgagatgatagatgagtcagccgttcagacattttttgggtcatcacaggaatattccagtaatacagaccatggttacattttgttctacgagagcacagcctctggtcacaagagttagatggaggagttttttagatacctgaatcatttgaacttgtctctttttcctctgtcttctgtttattgttaattaattttcttttttctttttttttttaaaaccattttcccattcaacctgtttgaggagttgttattcatcctcgataggataagggttgtgaaaatgtatacttaaattgatggaatgtacagtggatagtggaagcatggttttttttcccttcccacaataagagtagatagagcagtatatatatggcaagagagtatttcacggaccatgtattcatggtatcaaatgtttaatcgaacattagatacacaattcacaattcaatggcaatttcaactcatg

SEQ ID NO: 5031 - DNA, 1738 bp, Cajanus cajan
cgatcttactttatttatatttcctaattttttcttcaaaattttcatctgcattttcgtcctcctcagttctctctctctatctctggagaaacccttgtttcattccttgctattatatctatatagaaaaccagacaccacaaaagcttcgttctgcgacaaaaccctaacgatccaaacggtcattgagcatttcatggtgcgagtcactgagttgaatcggataggaatctgagtttgtgatcggttgacgcggtcatgggcgctgcgggctccaagcttgagaaggctctcggagaccaattccccgaaggagaacgctactttggcctcgagaatttcggcaacacttgttactgcaacagcgtcttgcaggcactatacttctgtgttccgtttcgtgaacaattattagactattatgggaataacaaaagcctagatgcggaagaaaatcttttaacttgcttagcagatttattttcacagataagttcccagaagaaaaaaactggtgttattgctcccaaacgatttgtacagaggttgaaaaagcagaatgaactctttcgtagctatatgcaccaggatgcccatgaattcttgaactttttgctgaatgaacttgttgacattctggagaaagaggctcaggctgcaaaaactgatcaggagacctcaccaccttctgaaaagattgttaatgggcccaagaatggtcaagctaatggtgttcacaaagagcctttagttacttgggtacacaaaaattttcagggaatactcaccaatgagacgaggtgcttgcaatgtgaaacagtgacagctagagatgaaacattttttgacttgagtcttgatattgagcaaaacagttcaattacaagctgtttgaaaaatttcagctccactgagacgctgaatgctgaagacaaatttttttgcgacaaatgctgcagtttgcaagaagctcagaagaggatgaagataaagaaaccacctcacatcttggtcatccatcttaagcggtttaagtacatggagcagctaggtcgctacaagaagctgtcttaccgggtggtttttccccttgagctgaagttgagcaacactgttgaagaggcagatatcgagtattctctatttgcagtagttgtccatgttgggagtgggcctaaccatgggcattatgtcagccttgtgaaaagccataaccactggttattttttgatgacgaaaatgtagagatgattgacgagtctgctgtgcagacgttctttggatcatcacaggaatattcaagtaatacagatcatggctacattttgttctatgagagccttggctctggtaacaggaattagacggaggagttctacaactcttcagtacttaaatcatttggacttctttttcacctggtttccatatttattttcccttctaccgttttccctttattcaacctgttggaggagctgttacaccctccagaggatacgggttgtgaaaatgtatacttaggtggttggtatgtacagtggatggtgttagcactgtcctttttcctctttctcacaataagaacagtatatatatcgggtgaaaatttcaccagcgatgtgtattcatggttgcgaacgttcaaccaacattagaaacacaatgaaatggaaattggtcccaactcgtgttaggttaatttattttagtttgacgaactctttggttata

SEQ ID NO: 5032 - DNA, 1838 bp, Populus trichocarpa
aaatattaccagtctcttctctctctcagaaaaccatactagacaaacacaaaccctcgttcctttcctttcctttcactaccaacaaaatcataaacaaaattctcatttcccaaacaaaccctaacaaactaactatccaaatccaaacaaagacagggagaattgctcgttaacgaggattgttgaatcggtgagttaaatcgggatctgagttgaatcaatccatgcagtaatgggcgcagcaggttctaaactcgagaaagctttaggcgaccagtttcctgaaggcgaacgatactttggcctcgagaatttcggcaacacttgttactgtaatagcgttttacaggcgctttacttctgtgtaccatttcgagaacacttgttagaatattatggtaacggtaaaagtattggggacgcggaagagaatctcttgacttgcttggcagatctatttactcagataagttcacagaagaagaaaacaggtgtcattgctccaaagcgtttcgtacagagattgaaaaaacaaaatgagcttttccgaagctatatgcaccaggatgctcatgagtttttgaattttttgctaaatgaactggttgacattctggagaaagaggcccaagctgtaaaaagtgatcctgaaacttcttccccacctgaaaaaattgcaaatggaccaaaacatgctcaggcaaatggtgtttcaaaagagcctttggttacttgggtgcacaaaaattttcagggaatacttaccaacgagacaaggtgcttgcaatgtgagactgtgacagcaagagatgaaacgttttttgacttgagccttgatattgaacaaaacagttccattacaagctgcttgaagaattttagttccacagagacgttgaatgcagaggataagtttttctgtgacaagtgctgcagtttgcaagaagcccaaaagaggatgaagataaagaagcctcctcacatcttggtcatccatctgaagaggtttaaatatattgagcagcttggtcggtacaaaaagctgtcttacagagttgtcttcccacttgagctgaagttgagcaataccgtggaagacgcagatatcgaatactcactatttgccgttgtagtccatgtgggaagtggacctaatcatgggcactatgtgagccttgtgaaaagccacaaccactggttattttttgatgatgaaaatgtcgagatgattgatgagtctgctgtgcagacattttttgggtcagcgcaggaatattcaagtaatacggatcatgggtatatcttattttatgagagcattggtgctagtaacaacaagagttgagaggtggttttacaagtaggtatttaaatgattgagactggactcgccttttgtttaatctgttattattgtttttctttcccttttgtccatcaaccaatgggaagagctctcaaatacccacacttgagaagacgatgacgagaacaacaaatgtatacttgggttatttccatgtacaggtggaagcacaccatccttgtgtttttccagaataagaggatagaagagcagtgtatatggtttgaaactttcacagagatggtttctattgttcatggttgagaatatttcaacagcagaaatccaatccaattgggaatttggtcggagctatccgcatgctactgaacttgttctacatcttcgtagatcttgttaggtttgatattggtcattgatcatgcattcatcacaatgtagcattcatgcatgctatagtattcttaacaagcttctaatgtactgttaatccaggctctctttccac

SEQ ID NO: 5033 - DNA, 1978 bp, Populus trichocarpa
aagaaaaagagaacaaatactaataaatattaccagtctcttctctctctcagaaaaccatactagacaaacacaaaccctcgttcctttcctttcctttcactaccaacaaaatcataaacaaaattctcatttcccaaacaaaccctaacaaactaactatccaaatccaaacaaagacagggagaattgctcgttaacgaggattgttgaatcggtgagttaaatcgggatctgagttgaatcaatcgatgcagtaatgggcgcagcaggttctaaactcgagaaagctttaggcgaccagtttcctgaaggcgaacgatactttggcctcgagaatttcggcaacacttgttactgtaatagcgttttacaggcgctttacttctgtgtaccatttcgagaacacttgttagaatattatggtaacggtaaaagtattggggacgcggaagagaatctcttgacttgcttggcagatctatttactcagataagttcacagaagaagaaaacaggtgtcattgctccaaagcgtttcgtacagagattgaaaaaacaaaatgagcttttccgaagctatatgcaccaggatgctcatgagtttttgaattttttgctaaatgaactggttgacattctggagaaagaggcccaagctgtaaaaagtgatcctgaaacttcttccccacctgaaaaaattgcaaatggaccaaaacatgctcaggcaaatggtgtttcaaaagagcctttggttacttgggtgcacaaaaattttcagggaatacttaccaacgagacaaggtgcttgcaatgtgagactgtgacagcaagagatgaaacgttttttgacttgagccttgatattgaacaaaacagttccattacaagctgcttgaagaattttagttccacagagacgttgaatgcagaggataagtttttctgtgacaagtgctgcagtttgcaagaagcccaaaagaggatgaagataaagaagcctcctcacatcttggtcatccatctgaagaggtttaaatatattgagcagcttggtcggtacaaaaagctgtcttacagagttgtcttcccacttgagctgaagttgagcaataccgtggaagacgcagatatcgaatactcactatttgccgttgtagtccatgtgggaagtggacctaatcatgggcactatgtgagccttgtgaaaagccacaaccactggttattttttgatgatgaaaatgtcgagatgattgatgagtctgctgtgcagacattttttgggtcagcgcaggaatattcaagtaatacggatcatgggtatatcttattttatgagagcattggtgctagtaacaacaagagttgagaggtggttttacaagtaggtatttaaatgattgagactggactcgccttttgtttaatctgttattattgtttttctttcccttttgtccatcaaccaatgggaagagctctcaaatacccacacttgagaagacgatgacgagaacaacaaatgtatacttgggttatttccatgtacaggtggaagcacaccatccttgtgtttttccagaataagaggatagaagagcagtgtatatggtttgaaactttcacagagatggtttctattgttcatggttgagaatatttcaacagcagaaatccaatccaattgggaatttggtcggagctatcctcatgctactgaacttgttctacatcttcgtagatcttgttaggtttgatattggtcattgatcatgcattcatcacaatgtagcatgcatgcatgctatagtattcttaacaagcttctaatgtactgttaatccaggctctctttccacggatcctcccttttcatgctttgatttggatgtaacagttgctagattcactgaggcagggccggtgaatcttgatgtttctcgtggaaggtaggggtacaatttcaactattcta

SEQ ID NO: 5034 - DNA, 1756 bp, Nicotiana benthamiana
tggctagtgtacaaacaccgcctctacaagcacgcctttgagaatcgaaacgaacgacaaattcagcccaaaaattcaacactagctcttgctctacaaattcacatcgtcgtctagactcgtagactctacatcatatgtttactgtagatagataaataccccatttgtgattgttgaatttgaagaaaggaaataaagcagaatagagggggagtattggtatttggtagaggaagggccgatgggtgcaacgggttccaagctggagaaggccctcggcgaccaatttcccgaaggcgaacgctactttggcctcgaaaactttggcaatacttgttactgcaacagcgtcttgcaggcgctgtacttttgtgtaccattccgtgagcaactgctagagtattatgcaaataataaaagccctgcagaagcggaggagaatctgttaacttgtttggctgaattgttctcacagataagttcacagaagaagaaaaccggtgttattgctccacgacgctttgtgcaaagagtcaggaagcaaaatgaacttttccgaggttacatgcatcaggatgcccatgagtttttgaacttcttgttaaatgaacttgttgatattttggagaaagagtcacatgcatcaaaaagtttaacggcaagttctcctgaagaagtcgcaaatggatcatgttatggtaagagcaatggtgttaagaaggagccacttgttacctgggtgcacaaaaactttcagggtatattaaccaatgaaacaagatgtttgaggtgtgagacagtcacagcaagggatgagacattttttgatttgagccttgatattgaacagaacagttcaattacaagctgcctaaaaaatttcagttcgacagagaccctcaatgcggaggacaaatttttctgcgacaagtgctgtagcttgcaagaagcacaaaaacggatgaagataaagaaaccgccacacatcctggtcattcatttgaagcgtttcaagtatatggaacaactaggtcgttacaaaaaattgtcttaccgtgtagtgttccctctggagctgaaactcagcaacaccatcgaaaacacggactctgagtattctctatttgctgttgtagttcatgttgggagtgggccaaaccacgggcattatgttagtcttgtgaaaagccacaaccactggttgttctttgatgatgagaatgctgagatcattgatgagtctgctgttcagaccttttttggctcagctcaagagtactcaagcaatacagatcatggctatattctcttctatgagagccttgctgctagcaagagctgataaagagttctcacatgtcgagtcctaactattttgcctgtctcggctcaacttctgtcatgttcagctttcccatggtttactggacttgcttaacaaatgtttatggttccgtgtacaacatacgaggattttctagcacttgacttgttttaacaataaagagatgtaaatcctggtacagaaacttcaaacgagatgttgatattgtattattagatatcaaactgcaaggagtactaatacatttcgttggcagaactccaaaagcaggaataattgtctcctttgtgtaatttcaatttgaaagtatagactgctgctgtgtagcagctttgttttcactgatggaccttggctctagtactatattcttttacttacaactatgtgggtatacgttttcctgag

SEQ ID NO: 5035 - DNA, 1696 bp, Phaseolus coccineus
cgttatttgtttatttatttttcctcaattcctccttaaattttcatctgcatttttgtccttcatcgttttctttctctctcacgggaaacccttgtttcatttcttgctatcatatctatagagaaaacctgacaccagaaagaggttctttctgcgacaaaccctagcgatccaaacggccattcagcatttcatggtgcgagtctccgagttgaatcgcacagcaatctgagtttgtgatccgttgacgcggtcatgggtgctgcgggctccaagcttgagaaggctctcggcgaccaattccccgaaggagaacgttacttcggccttgagaatttcggcaacacttgttactgcaacagcgtcttgcaggcactatacttttgtgttccttttcgtgaacaattactagagtattatggaaataacaaaagcacactggatggggaagaaaatcttttgacttgcttggcggatttgttttcacagataagttcccagaagaaaaaaactggtgttgttgctcccaaacgatttgtacagaggcttaaaaagcagaatgaactcttccgtagctatatgcaccaggatgcccatgaattcttgaactttttgctgaatgaacttgttgacactcttgagaaagagagtaaagctgcaaaaactgatcaggagacctcaccaccttcagaaaaggctgttaatgggcccaagaatggtcaagctaatggtgttcacgaagagccattatttacttgggtacacaaaaattttcagggactactcaccaatgagacaaggtgcttgcgatgtgaaacagtgacagctagagatgaaatatttttagacttgagtcttgatattgagcagaacagctcaattacaagctgtttgaaaaatttcagttccactgagacactgaacgctgaagacaaattcttttgtgacaaatgctgcagtttgcaagaagctcagaagaggatgaagataaagaaaccacctcacatcttggtcatccatcttaagcgttttaagtatatggagcagcttggtcgctacaagaagctgtcatatcgggttgtttttcccctggagctgaagttgagtaacactgttgaagatgcagacattgagtattctctatttgcggtagttgtccatgttgggagtgggcccaaccatgggcattatgtcagccttgtgaaaagccataaccactggttattttttgatgacgaaaatgtagagatgattgacgaatctgctgtgcagacgttctttggatcatcacaggaatattcaagtaatacagaccatgggtacattttgttctatgagagccttggctctggtaacaggaattagatggaggagttctacaactcttctataatcatttggacttcttttcaccaggtttccatatttattttcctttctaccgttttccctttattcaacctgttggaggagctgttacatcccccagaggattcgggttgtgaaaatttatacttaggtggttggcatgtacagtggatagtgttagcactgtcctattttctttttactctttctcacaataagaacagtatatatatcgggtgaaaatttcaccaacgatgtgtattcatggttgcaaacgctcaaccaacattagaaacaaatgaaaattgatcctaactctgttaga

SEQ ID NO: 5036 - DNA, 1732 bp, Phaseolus coccineus
cgttatttgtttatttatttttcctcaattcctccttaaattttcatctgcatttttgtccttcatcgttttctttctctctcacgggaaacccttgtttcatttcttgctatcatatctatagagaaaacctgacaccagaaagaggttctttctgcgacaaaccctagcgatccaaacggccattcagcatttcatggtgcgagtctccgagttgaatcgcacagcaatctgagtttgtgatccgttgacgcggtcatgggtgctgcgggctccaagcttgagaaggctctcggcgaccaattccccgaaggagaacgttacttcggccttgagaatttcggcaacacttgttactgcaacagcgtcttgcaggcactatacttttgtgttccttttcgtgaacaattactagagtattatggaaataacaaaagcacactggatggggaagaaaatcttttgacttgcttggcggatttgttttcacagataagttcccagaagaaaaaaactggtgttgttgctcccaaacgatttgtacagaggcttaaaaagcagaatgaactcttccgtagctatatgcaccaggatgcccatgaattcttgaactttttgctgaatgaacttgttgacactcttgagaaagagagtaaagctgcaaaaactgatcaggagacctcaccaccttcagaaaaggctgttaatgggcccaagaatggtcaagctaatggtgttcacgaagagccattatttacttgggtacacaaaaattttcagggactactcaccaatgagacaaggtgcttgcgatgtgaaacagtgacagctagagatgaaatatttttagacttgagtcttgatattgagcagaacagctcaattacaagctgtttgaaaaatttcagttccactgagacactgaacgctgaagacaaattcttttgtgacaaatgctgcagtttgcaagaagctcagaagaggatgaagataaagaaaccacctcacatcttggtcatccatcttaagcgttttaagtatatggagcagcttggtcgctacaagaagctgtcatatcgggttgtttttcccctggagctgaagttgagtaacactgttgaagatgcagacattgagtattctctatttgcggtagttgtccatgttgggagtgggcccaaccatgggcattatgtcagccttgtgaaaagccataaccactggttattttttgatgacgaaaatgtagagatgattgacgaatctgctgtgcagacgttctttggatcatcacaggaatattcaagtaatacagaccatgggtacattttgttctatgagagccttggctctggtaacaggaattagatggaggagttctacaactcttctataatcatttggacttcttttcaccaggtttccatatttattttcctttctaccgttttccctttattcaacctgttggaggagctgttacatcccccagaggattcgggttgtgaaaatttatacttaggtggttggcatgtacagtggatagtgttagcactgtcctattttctttttactctttctcacaataagaacagtatatatatcgggtgaaaatttcaccaacgatgtgtattcatggttgcaaacgctcaaccaacattagaaacaaatgaaaattgatcctaactctgttagattattttatatttctagtttgtaggcaggtattctt

SEQ ID NO: 5037 - DNA, 3515 bp, Cannabis sativa
tcttactttctttctttctttctttattttcctttctttctctccttccttccttccacttcgtctcgaccgaaaccctcgtcgtcttccaatcttcaatttccgaaccaaaaccctaacaattccaacatctcatagaagacgatactcaccgagacctacaagcgaatcggttcattgccatggtgctagtcgcttagttgattcggagggagccttgaggatctaactcggcggcgattcgattgacttctcccttcggcctgcgctaatgggtgctgcgggttccaaactcgagaaagctctgggtgaccaatttcccgaaggcgagcgatactttggccttgagaatttcggcaacacttgctactgtaatagcgttttgcaggcactatatttttgtgttccatttcgcgaacagttgttagaatactattcgaataccaaaagtattggggatgcagaagaaaatctcttgacgtgtttagctgatttgtttagccagataagttcacagaagaagaaaacgggggtcattgctcctaagcgctttgtacagaggttgaaaaaacaaaatgaacttttccgtagctacatgcaccaggatgcccacgagtttttgaatttcttgctgaatgagcttgttgatatattggaaaaagaggctcaagcaacaaaaagtgataaagaatctttatctcctcctgatacagtagccaatgggccaagaaatggtcaggttaatggtactcaaaaagagccattagtcacctgggtgcacaaaaattttcagggacttctcaccaacgagacaaggtgcttgcggtgtgagacagtgacagcaagggatgagaccttttttgacttgagccttgatatcgagcagaacagttcaataaccagctgtttgaagaacttcagttctactgagacattgaatgccgaggataaatttttctgtgataagtgctgcagtttgcaagaagcacagaaaaggatgaagataaagaagccacctcacatcttggtaatccatctaaagcgtttcaaatatatcgaacagcttggacgctacaagaagctctcttatcgagttgtcttcccccttgagctgaagctgagcaacacagtagaagatgcagactctgagtactccctgtttgctgttgttgtgcatgttgggagtgggccaaaccatggacactacgtcagtcttgtgaagagccataaccactggttattttttgatgatgagaatgttgagatgatagatgagtctgctgtgcaaacattctttggatcagcgcaggaatactcgagtaacacagatcacgggtacatcttgttctacgagagccttggctccagcaataagagctaaagaagaatttgaatttaagagggttaggatattataattattggacacactttactcatgtttttcatattctaatttgtttcctatttctctctttttttttttcctttctcccctttttcaacctgtggaaagagctgtgaagtatcaattgagtttgggttgtcaaaagtgtatacttaggtgacatgtacagcggatggtgaaagcattacttctttttttcttttttcttttttctttttgtcttctctcataataagaggaaaaggagcagtgtacatgttgtgtgagaggtcttcacatagacaagtttgtatttttccatggctcatcagaagtgagaacaacattagaattgcaatgcaattggaatttgctcactattatctaatatctagtagtgagaagagtaaactggagacaatgttacactggacccattttattagatactatattatatgtatattatgctctatttataaatgtataattgtcgtaattgcaattgcaacactaattgtctttttcgacgatcagacttatttttaaagagaaagagtgattgaggatgaagggtaagtaaaattatactatatgatgcatataatttaagttgaaagaattggtgagcaaagtaaaagataatacacgataatcttatcagtactggtgttatattatcaatatcaaatctaacataaatactattttctttacaagggaaaatgaatttgaaggttcgctattgtattgctgtaggcatataagtgtcatcctctaacaatgcttcaatatcaataaggtcatcttcaaaatcaattgttccttctgtattcataacgtcatcatatggaacctgcagataaacaacaagaccagttcaaaatgcaaaacaaaaaaaccaaaaaaaaaaaaataaaaaaaaaatccacaagctaatggagcaaaaggttcccagtaagctttttagtacttcctttttgagctataacttccaataactgctcagcttgttatgaaaggattttgcaagcaatcccatgaattagatttcagtaaaaaataaagaaagcagggaacagtataaacgcactggccaaaaggcactcattaccttcttttcctgtatctcagtgacgacatttagcagcctccggtattgatttctcgcctcagggtattgaaccattgacttcacccgagcgagtgctttttgcattctttcctctgattgtttcctgccttgttttaggaaatcataatcatcatccttggaggacgacggatcctcaatgcttggtacctcaaccaatgcttcagacttaaacccacgtaaaccacttccttttcgtctccaacgcaagataatcttttccacaattcccacagaccagacaaacttcttgtagtttttcctgacctggtgacctcttacaagggccttttaccaagagacctaaaaagttagaagtcgtggatactaagaatcaataactgcagaaaataaagaaacatttacctgaattttgacaatgttctgccgaatactcaaaaattctttacggcccttccagccacggaatttattttgtattctgattgcagcagcattcacatcattattatgttgtccacctttctgtgtcttaacagcaataagagataatgcacgctcgtctgacaatccaaatttatcatcaccgtattcttccaactgcttcctttggaatgattgcaccctgaaaacttgatgaattcgagcagcagcttgggtagcattgcacacagcagctaatgaatccttcagagacagtcgatcaggatcatcatcttttataggagtagctgttctttctgaaacagtttgcacggcatttggagttgatgtgtctgttgctttgcttgccttggcatctagatcaagacatttaaggtgtgcactcaatgcagattccgcaagataaccagaaattcctttatgtccattgtcagacgctagatcagcaggtgttttaccagagggatatttaggacttgggtcggttaacaatcctggagctgcacccagggagatgagggaagcaacggttcgttctctggttaaaagaaagagaatgtgaatgttatc

SEQ ID NO: 5038 - DNA, 1315 bp, Cirsium arvense
acaccaaaccaaaaccatgctcctcctctagctactacttctttactttataaaaaaagatttcatttttaatttcaatttggatgcccaaatgggtgcagctggctccaagcttgaaaaagctttaggcgaccagtttccagaaggcgaacgatactttggtctcgaaaatttcggcaatacatgttactgtaacagtgtcttgcaggctctttatttctgtgttccatttcgtgagcagttgttagagtactattcaaacaacaagagttttgccgatgcagaagaaaatcttttaacatgcctggcagacctgtttacacagataagttcacaaaaaaagaaaactggggtcattgctccaaagcgttttgtacagagattgaaaaagcagaatgagatttttcgcagctatatgcaccaggatgcccatgaatttttgaattatctgttaaatgagcttgttgacatactggagaaggagtcacatgctgcaaagagtgatccagaatcttcttcgtcttctgaacaaattgctaatggactaaagagtgctctcaccaatggtcatatgagagagcctcttgtaacctgggtgcacaagaatttccagggtatacttacaaatgaaaccaggtgcttgcgttgcgagacggtaacagcgagagatgagacgtttctcgacttgagcctcgatattgagcaaaatagctcaattactagctgtttgaagaacttcagttccaccgagactttgaatgctgaggacaagttcttctgtgacaagtgttgcagcttgcaggaagcccagaaaagaatgaagattaagaagccacctcaaatcttagtcatccatctaaaaaggttcaagtacatcgagcagcttggacgctataagaagctatcttatcgtgtagtcttcccacttgagctcaaactcagcaacaccgtagaagatgcagatgcggaatattctttgtttggggtcgtggtccatgtgggaagcgggcccaaccacgggcactacgtgagcctggtgaaaagccataaccattggttgttttttgatgacgaaaatgtagaaatgattgatgagtcggccgtgcaaacgttctttggatcggcacaagagtattcgagcaacacggatcatgggtacatcttgttttatgagagagttgacaccacaagctaagatggtaaaaaagtttgcaattttgaaagtggaaacataactttttgattgttgtttgagttttcattagcataacattgtaatctatgagatgatagtagtactgatatcatatatgat

SEQ ID NO: 5039 - DNA, 1395 bp, Cucumis sativus
ctttgttttcgaccacgcggatgggtgcgactggctctaagctcgagaaggctctcggtgaccagttccctgaaggcgagcgctactttggccttgaaaattttggcaatacttgttactgtaacagcgcactgtatttttgtgttccttttcgtgagcaattgctagattattactcaaacaacaaaagtattggagatgcagaggaaaaccttttaacatgcttagcagatttgttcacccagattagttcccaaaagaaaaaaactggtgtcattgccccaaagcgctttgttcagagattgaaaaagcagaatgagatattccgtagctatatgcaccaagatgctcatgaatttttgaactttttgctcaacgaacttgttgacatactggagaaagaggcacatgctattaaaagtgatgcagaaagttcatcaccgcctgaaaaaatttcaaatggtcccaagactggtcaggcaaatggtgctcaaaaagagccgttggtgacttgggtccataaaaattttcagggtttactaactaacgagacaaggtgtttgcggtgcgagacagttacagctagggatgaaacttttctcgacttgagtcttgatattgaacagaacagctcaataactagctgtttaaaaaatttcagttccactgagacattgaacgcggaggacaagtttttctgtgacaagtgctgcagtttgcaagaagcacagaagaggatgaagattaagaaaccacctcatatccttgtcattcatctgaagcggtttaaatatattgagcagcttggtcgctataaaaagctgttatacagagttgttttccctcttgagctgaagcttagcaacacgatggaggatgcggattctgagtactctttgtttgctgttgtggttcatgttggaagtggacccaaccacggacactatgttagccttgtgaaaagccataaccactggttattttttgacgacgaaaatgtggaaatgattgatgagtctgttgtgcagacattctttggatctgcacaggaatattctagtaatactgatcatggctacatcttattctatgagagcattggcactggcaacaagagctgataattggagaattcccatatcatcagccgtcggattcctccataaccatatcgaggcaaagcacgattagtctaagtctcttcatcttcttcgaatatagctattattttgcttgcttcagaagcacatcagacttcgaccgctttggtttgcattgttcgttcttcttcttcgaataatgccattaaagtagaaattctaaatatgaggaaagaaaagggggaagcgagacacgaagaagtgacatgttgccgtcttctagatacattggtac

SEQ ID NO: 5040 - DNA, 1688 bp, Helianthus annuus
ctcatcttatacaacaattgtggatcttcgacactccatatgatgaacaccaccaccgtatcatagtcaaccgacccaaacaaatcccccatacgtattcgataccaaatcgatcaaattagattcacacacaatcttcttcccaatttctcactcatccaataaaccctaatcgatagcacagtaaacctattcattctctctctcacacacacgtagtgattctaggtttaattttaacaaaccctaggcaatattcaccgacaatttgttacagattgttggattaattgagattgtacgaaagaaattgaggaattttggtatttagtggatggtctcatgggcgctacggggtctaagctcgagaaagctctaggagaccagtttccggaaggcgaacggtatttcggacttgaaaacttcgggaatacttgctattgcaacagcgttttgcaggccctttatttctgtgttccatttcgtgaacagcttcttgaatactatggaaacggtaaaaatacaggagatgtggaagagaatctccttacttgtttagccgaattgttcatgcagattagtacacaaaagaagaaaacaggtgttattgctccaaagcgctttgtacaaagagtcaagaaagaaaatgagctattccgtggttacatgcatcaggatgcacacgagtttttgaacttcttgttaaacgatcttgttgacatactagagaaagaagcagcaaaaggtccagcagaaggtttatcacctcctcaaaagattgttaacgggccacatggtggtcacgtcaacggtgtaaagaaagagcccctagttacctgggttcacaaaaactttcaaggtatactcacgaatgagacaaggtgtttaaggtgcgagaccgtgactgcaagagacgagactttcttagatctaagccttgatatagagcagaacagttcaatcacaagttgtttaaaaaacttcagctccaccgaaaccttgaacgctgaggataagtttttctgtgataaatgctgcagtttgcaggaagcacaaaagaggatgaagattaaaaaaccgccccatattttggtcatacatttaaaacgtttcaagtacatggaacaactcggtaggtacaaaaaactatcgtatcgcgtggtgttccctctggagctaaagctgacaaacaccatggaagacgcagactgtgagtattctttattcgcggtggtggttcatgtcggcagtgggcccaatcatggccattatgtgagtctggtgaaaagccacaaccactggctattttttgacgatgagaatgtggagatgattgaagaatcggctattcagactgcctttggttcagctcaggagtatgcaagtaacactgatcatgggtatattcttttctatgagagccttgctaacaactcgagctgataacgcgtatgttcattatgatataactctgttgtttaattgttctatatttcgtctttagtgggactagatcagagaaagtataatcacattcatgtgggttagatgtacagttgattaatgctctgccatttttcaaagtacctgtaatgcagtggctgctatgatagttttttttttttttttcaatgtttgggacattcaaatttatggaaataatggagattaccgaagttcaaaactgt

SEQ ID NO: 5041 - DNA, 1758 bp, Helianthus annuus
tccgtttccgatataaaccctaaaaaccgattccacatcaaatctcccaattttccccaattaatcgatcaaacacacacctttcgctaaattctctcaaaaaccctaacgaatcgcattcaaatctatcacaattcgttcaatctcattcaatttcgttcaattttgaacatctacaatcctcgttgaatttgttggtgaaattagggtttcgatcgatagatagagagagaaatagaggagttttggtatctagttgatggtctcatgggcgctacggggtctaagctcgagaaagctctaggagaccagtttcctgaaggtgaacggtattttggacttgaaaacttcggtaacacttgctattgtaacagcgtgcttcaggctttatatttttgtgttccatttcgtgagcaattacttgaatattatggaaatgttaaaaatcccggggacgtagaagaaaatctccttacgtgtttggcagaactgtttatgcagattagtacacaaaagaagaaaacaggcgttattgctcccaaacgctttgtacaaagagtgaagaaagaaaatgagctttttcgtggttacatgcatcaggatgcgcacgaatttttgaatttcttgttaaacgaactagttgacatactagagaaagaagccaattcagcaaaagcttcaaaagaactttcgtcacctcctgaaaagattcccaacgggatacatgttgctcatgccaacggtgtacggaaagagcccttggttacctgggttcacaaaaactttcagggtatacttacaaatgaaacaaagtgtttaagatgtgagactgtgactgcaagggatgagacatttttagatttgagtcttgatattgagcagaacagttcgattacaagctgtttaaagaacttcagctccaccgagaccttaaatgccgaggataagtttttctgtgataaatgctgcagtttgcaggaagcacaaaagaggatgaagatcaagaaaccaccacatattttggtcatacatttgaagcgtttcaagtacatggaacagctgggcaggtacaaaaagttatcataccgtgtcgttttccctcttgagctgaagctaaccaacacaatggaagatgcggattgcgagtactcgttatttgcggtggtggttcatgttggaagcgggcccaaccacggacattacgtaagtctggtcaaaagccacaaccactggttgttctttgatgatgaaaacgtggaaatgatcgatgaatccgctgttcaaacctcgttcgggtcggcccaagagtatgctagcaacactgatcacgggtatatcttgttctatgagagccttgctgccaacaatgatcattgaatgggtattttgtcaaatccttttttttcagatttgtgttacttggtttttgtgttatcatcatatacggcaatttgggttattagacgggaagaaacttgtgatggatttgatgtacagttactgctgctatttgagttcatctgttttagttgaaacaataaaggtgcgtatgatatgatgatgatgtggatgaggacgatgattttgatatcggtgatgatggaagcttgttttaagcgtgaacgtgatcatcaaagatgatgttaagttaatgacttgcgtctcgtttgtattggtattaacatttttgtttatttatgaatcgagagctatgatggtgttgtatttttgtttgatttgtgaagaaatggagaattt

SEQ ID NO: 5042 - DNA, 1466 bp, Ambrosia trifida
acgatacatacatagattcacagaaataataacaacaataataatataatagtaggagttttggtattatttggtagatggtgtgatgggggcaacaggttctaagctcgagaaagcgttaggagatcagtttcctgaaggtgaacgctactttggacttgaaaacttcggtaacacttgctattgtaacagcgtccttcaggctttatatttttgtgttccatttcgtgagcaattacttgaatattatggaaatgtcaaaaatcctggagacgtagaagaaaacctccttacgtgtttggcagaactgtttatgcagattagtacacaaaagaagaaaacaggcgttattgctcccaaacgctttgtacaaagagtgaagaaagaaaatgagctttttcgtggttacatgcatcaggatgcacatgaatttttgaattttttgttaaacgaactagttgacatactagagaaagaagcaaattcagcaaaaggttcaaaagagctttcaccacctcctgaaaagattcctaatgggatacatgttgcccatgccaatggtgtacggaaagagcccttgattacctgggttcacaaaaactttcagggtatacttacaaatgaaacaaagtgtttaagatgtgagactgtgaccgcaagggatgagacatttttagatttgagtcttgatattgagcagaacagttcgattacaagttgtttaaagaacttcagctccaccgagaccttgaatgccgaggtataagtttttctgtgataaatgctgcagtttgcaggaagcacaaaagaggatgaagatcaagaagccaccacatattttggtcatacatttgaaacgtttcaagtacatggaacagctgggcaggtacaaaaagctgtcatatcgtgttgttttccctctcgagctgaagctgaccaacacaatggaagatgcggattgcgagtactcgttatttgcagtggtggttcatgttgggagcgggcccaaccacgggcattatgtaagtctggtcaaaagccacaaccactggttgttctttgacgatgaaaatgtagaaatgatcgatgaatctgctgttcaaacctcattcgggtcagctcaagagtatgcaagcaacactgatcatgggtacatcctgttctatgagagccttgctgccaacaatgatcattgagtggtattttatcaaaccctttttttccgattgtgttacttggtttttgtgatatcatcatatagaacaatttggggttcattagatggaaagaaacttgagatgtacagttaatgcttctatttgacttcatctggtttagttttgaactaataaaggtgcatatgatgatgatgttgatgatgacgatgattttgatgatgtgatgatgatgatgaatcgtcgtttaagcgtagagtatgatcatacgaaggtgatgttaaatcaatg

SEQ ID NO: 5043 - DNA, 1546 bp, Nicotiana benthamiana
aacatattacttattttttatttatttgtttcttcatccttcttctccatcggggaaaaagccctcatttttcaccttctccgattcagttttcatcactaaatcgctggttaggaaactcgcagaaaccctattaccaaattatcaaatttagggagatttaggaatgaagtgagagatgggtgcagcaggttccaaactcgagaaagctctaggtgaccaatttcccgaaggagaacgttactttggccttgagaattttggcaatacttgctattgtaacagcgttctccaggctctatatttctgtgttccatttcgagaacaactattggagtatttctcaaatagtaaaaatctcgctgacgcagatgaaaatctcttgacatgccttgctgacctgtttatgcagataagctcgcaaaagaagaaaactggtgtcattgctcccaagcgctttgtacagagattgaagaagcagaatgagattttccgcagttatatgcatcaggacgcgcacgaatttttgaattatttgctgaacgaactggttgacatactggagaaagaagccagtgctgctaaaaccgatcaagaaacttcttccccaactgaaaagattgcaaatggaccaaccagtattcatgttaatggggataaaaaggagcccctggtcacatgggtgcacaaaaatttccagggtatactcacaaatgaaacgaagtgtttgtgttgtgagactgtaactgcaagagatgagacatttcttgatttgagcctcgacattgaacagaacagttcaataactagctgcctgaagaattttagttccacagaaaccttgaatgcggaggataaattcttctgtgacaagtgttgcagcttgcaggaagctcagaagaggatgaagattaaaaagccccctcacatcctggttatccacttgaagagatttaagtacattgaacagcttggtcggtataagaaactctcttaccgtgttgtcttcccacttgagttgaagctaagcaatacagttgaggatgcagatgcagagtattccttattcgctgtggtagtccatgttgggagtggaccaaaccatggacactacgtgagccttgtgaagagtcacaaccactggttgttctttgatgatgagaatgttgagatgattgatgagtcggctgtgcaaactttctttggttcggctcaggagtattccagcaatacagatcatgggtacatcttattttacgagagagtctccaatggaagcactagctgatagaagaaaaatgagtttagcttatttccaattttgaactcaatttctccctctaatcatcaattttattatttgctacttctttgtagtttgttcaaagattttctagtgagttgacatgaaatgtgaagcatacatatctaggttgttgcattgtacagtggatggtggaagcttaccatctatatttccaacaataaaagggaaaaaggatatgtggtgtttgtgataatttaagtttcaaagaccttactcttc

SEQ ID NO: 5044 - DNA, 1584 bp, Cicer arietinum
tctctctctctctctctctctcaaacccttgtttcattcttcttcgataacatccatacgaaattttgtttctctctgcaacaaaccctaacgatcgaagcaatcaagtaagcatttcatggtgcttatcactgagttgaatcggataagaatctgactttatctttgatcggttgacgcgctgatgggtgctgctggttccaagcttgagaaggctctgggtgaccaattccccgaaggagaacgttattttggtcttgagaatttcggcaacacttgttattgcaacagcgttttgcaggcactatacttttgtgttccatttcgggaacaactactggagtattatggaaataacaaaagcataggagatgtggaagaaaatcttttgacttgcttagcggacttattttcacagataagttcgcagaagaagaaaaccggtgtcattgctcccaaacggtttgtacagaggttgaaaaaacagaatgaactcttccgcagctatatgcatcaggatgcccacgaattcttgaactttttgctgaatgaacttgtcgacattctggagaaagaggctcaggctgcaaaaactgatccagagacaccaccgccttctgaaaaggttgcaaatgggttaaagaatggtcatgctaatggacctcagaaagagcctttaattacttgggtacacaaaaattttcagggcatactcaccaatgagacgaggtgcttgcaatgtgaaacagtgacagctagggatgaaacattttttgacttgagccttgatattgagcaaaacagttcaattacaagctgcttgaaaaatttcagttccaccgagacgttgaatgctgaggacaagtttttctgtgacaaatgctgcagcttgcaagaagctcaaaagagaatgaagataaagaaacctcctcacattctggtcattcatctcaagcggtttaaatacatggaacagctgggccgctacaagaagctgtcttaccgtgttgtttttcccctagagctgaagttgagtaacactgttgaagatgcagatagtgagtattctctatttgcagttgttgttcatgttgggagtgggcccaatcatgggcattatgtcagccttgtgaaaagccataaccactggttattttttgatgacgaaaatgtggagataattgatgaatctgcagtgcagacgttctttggatcaccacaggaatattcaactaacacagaccatgggtacattttgttctatgagagccttggccctggtaacaagaattagacggaggtgttgtatgagtcatttaggtactcaaatcatttggacttgtatttttcatctagttcctgtatttattgtcatgttataccattatatccaacctgttggggggagctgttgcatcctttagagcatatgggttgtgttgtgaaaatgtatacttaggtggttggcatgtacagtggatggtggtagcactatccttttttcgtttttccttcatcacaataagagcagtatatatattgtggaaattttgccgacgatgtgtatttatggttgcaagtgtt

SEQ ID NO: 5045 - DNA, 1341 bp, Cirsium arvense
tcgattttgcacatcaaatctttttaatcttctgcgatttacatctatatcttatctcaagaaccctaggcaataacaaacttatcttgaattccaactaaaatttctggatttcgattgaaagaaatagaagaattctggtatttggtggatggtctcatgggggcaacggggtctaagctcgagaaagctctaggagaccagtttcccgaaggcgaaagatattttggacttgaaaactttggtaacacttgctattgtaacagcgttcttcaggctctatatttttgtgttccatttcgtgaacagctacttgaatattatggaaatgttaaaaatccaggagatgtagaagaaaacctccttacatgtttggcggaactgtttatgcagattagtacacaaaagaagaaaacaggtgttattgcaccaaaacgctttgtacaaagagtgaagaaggaaaatgaactttttcgtggctacatgcatcaggatgcacatgaatttttgaatttcttgttaaacgaactagttgacatactagagaaagaaaccaatgcagcaaaaggttcaaaagaacattcatcacctcctgaaaagattaccaatgggctacatgttcctctggccaatggtgtacggaaggagcccttagttacgtgggttcacaaaaacttccagggaatacttacaaacgagacaaagtgtttaagatgtgaaactgtgactgcaagggatgagacgtttttagatttgagccttgatatagagcagaacagttcaattacgagttgtttaaagaatttcagttccaccgagaccttaaatgctgaggacaagtttttctgcgataaatgctgcagtttacaggaagcacaaaagaggatgaagatcaagaaaccgccacatatcttggttatacatttgaagcgttttaagtacatggaacagcttggtaggtacaagaagttatcgtatcgtgttgttttccctctggagctgaagctgaccaacaccatggaagacgccgattgtgaatactctttgtttgcggtggtggtccacgtgggcagtgggccaaaccacggccattatgtcagtctggtgaaaagtcataaccactggctcttctttgatgacgaaaacgcagagatgattgatgaatcggccgttcagacgtcattcggctcagcccaagagtatgcaagcaacaccgatcatgggtatatcctgttgtacgagagccttgctgctaacaacacgagctgaacgctgaatggcatttttcgatagtttttcgcgtttatttcttacgtgttacttgtaattttggcttgaaat

SEQ ID NO: 5046 - DNA, 1583 bp, Solanum lycopersicum
tttattttattacaataatttgtttctttcatcattcttctccatcagaaaagaacagaacagaaaagaaaaaaaaagccatcattttccacctcttgtgattcagttttttcatcagtgtttgtaaatcgttgctgagagaagttgaagaaaccctaattcaccattttatcaaatttgacgtttggaaggagatttaggaatgaactgagatgggtgcagcaggttccaaactcgagaaagctctgggtgaccagtttcctgaaggagaacgttactttggccttgagaatttcggcaatacttgctattgtaacagcgttcttcaggctctatatttctgtgttccatttcgagaacagctactggattattattcaaataacaagagtcttgctgacgcagatgaaaatctcttgacatgccttgctgacctgtttatgcagataagctcgcaaaagaagaaaactggtgtcattgctcccaagcgcttcgtacagagattgaagaagcagaatgagattttccgcagttatatgcatcaggacgcacacgaatttttaaactatctactgaacgaactggttgacatactggagaaagaagccagtccaactaaaagtgatcaagaaacttcttccccaacagaaaaaaatgcaaatggaccaaccagtgttcatgataatggtgataaaaaggagcccctggttacatgggtgcacaaaaatttccagggtatactcacaaatgaaacgaagtgcttgcgttgtgagactgtaactgcaagagatgagacatttcttgatttgagccttgacattgaacagaacagttcaataactagctgcctgaagaactttagttccacagagactttgaatgcagaggataaattcttctgtgacaagtgttgcagcttgcaggaagctcagaagaggatgaagattaaaaagccccctcacatcctagtcatccatttgaagcgttttaagtacattgaacagcttggtcggtataagaagctctcgtaccgtgttgtcttcccacttgagctgaagctgagtaatacagttgaggatgcagacgccgagtattccttattcgctgtggtagtccatgttgggagtggaccaaaccatggacactacgtcagccttgtgaagagtcacaaccactggttgttctttgatgatgaaaatgttgagatgattgatgagtcagctgttcaaacattttttgggtccgctcaagagtattccagcaatacagaccacgggtacatcttattttacgagagagtccccaatggaagcactagttagtagcttaatgagtttagcttattttgtttccaattttgaactcaatttctacctttagtggtcaattttattatttactacattccttgtagtttattcagaaattttctagtgagttgacatgaaatgtgaagaatacatatctaggttggtgccttgtacagtagatggtaaaagctttaccatctatatttccaacaataaaaagggaaaaggatatgtagtgtatgtgatgcttgagtttaggaggctttgttcttc

SEQ ID NO: 5047 - DNA, 1814 bp, Solanum lycopersicum
ttgggtcaaaggtggagagagaaaatagagcccagatggcactgcctctataagcacgcctttgagatgaatgacacattcagcccaaacacaatccaaaattcaaagtcacccccattgcttcctctataaaattgtattacccattttgtgggtgatgaggatttactggatttgaagaccgaaagaaaagagagaatcgtaaaagcagaatagaggagtactggtatttggttgatggtctcatgggtgcgacgggttccaagctcgagaaagccctcggagaccagtttcccgaaggtgaacgatactttggtctcgaaaattttggcaacacttgttattgcaacagcgtcttgcaggctttatacttctgtgtccccttccgtgagcaactgctagagtattatgcaaataataaaggtcctccagaagctgaggagaatctcttaacttgtctggctgaattgttctcacagataagttcacagaggaagaaaacaggtgttatagctccaaggcgctttgtacaaagagttaggaagcaaaatgaacttttccgaggttacatgcatcaggatgcccatgagtttttgaacttcttgttgaatgaactcgttgatatcttggagaaagagtcacatggagcaaaaagttcagcagcaacttctcctgaaaaagtctcaaatggtacatgcaatggtcatgcgaatgacgttaaggaggagccacttgttacctgggtgcacaaaaattttcagggtatattaaccaatgaaacaagatgtttgaggtgtgagacagtcacagctagggatgagacattttttgatttgagccttgatattgaacaaaacagttcaattacaagctgcctaaaaaatttcagttctacagagaccctcaatgcagaggacaaatttttctgtgacaagtgttgtagcttgcaagaagcacaaaaacggatgaagataaagaaacctccacacatcctggtcattcatttgaagcgcttcaagtatatggaacaattaggtcgttacaaaaaattgtcttaccgcgttgtgtttcctctggagctaaaactcagcaacaccactgagaacacagattctgagtattctctatttgctgttgtggttcatgtcggaagtgggccaaaccatgggcattatgttagtcttgtgaaaagccacaaccactggttgttctttgatgatgagaacgcggagatcattgatgagtctgctgttcagaccttttttggctcagctcaagagtactccagcaatacagatcatggctatatcctcttttatgagagccttgcagcaagcaagagctgaaaatagtactcacatgttgagacctaactgttggtgtatgtgtctgctcaacttttgtcgtgtttaactttacggttcaatgttcgagacacaaggggttgctagcgttttgacttgttttaacaataaagagatgtaaatcttggtatagaaactttaattagatgtcgaaactgttttgttagctatgtaactgcaacaacttccagtgaactccattggcagaaggaaagcaggaataagtcaagtttctcctttgtgtaatttcaatctgaaaaacactgcttctgtgttgttttgttttgaggtgctgagatgcacattcatggagtatgactgatgcttgattgctccttttctttcttacaacattccctgtatagagttaatctaacacacttctcttctactctaattctcgattcattcttatcgttactatgctagaataaagtgaaatttaaacac

SEQ ID NO: 5048 - DNA, 1445 bp, Vaccinium corymbosum
ttcctgacgcgaaaacaaaggcgtagcggagatcgaagttctcatcgcttactcaacgacgaagttgcaccaatctctctctctctctctctctctacatatgtacacacagacttatatctatttgtacgatttcatttttctctctctctagcaaaacactaggcaggaaaaacagaaacttgaagccctagcaaggcgacaatcgatgaagctgaagcagtagcagtggtggatagatataggagtatatgtatagatagagagagagagagagagagagatatagacgagttttggtatttggtcgatggtctcatgggcgctacggggtcgaggctggagaaagctctcggagaccaatttcccgaaggcgaacgctactttggactcgagaatttcggcaacacatgctattgtaacagcgtcttgcaggcactttatttctgtgttccattccgtgaacagttattagactattatgcaactaataaaaatcccggggatgctgaagagaatcttcttacttgtttggcagatttatttacacagataaattcgcagaagaagaaaacaggtgtcattgctccaaaacggtttgtacagcgagtgaggaaacaaaacgaggtttttcgagggtacatgcatcaggatgcccatgaatttttgaacttcttgttaaatgagcttgttgacatattggagaaagagtcccatgctgtgaaaacttcaacagaaacttccccaccctctgaaaagatagcaaatggaccaaagaatcacgaggccaatggtgttaagaaagagccacttgttacctgggttcacaaaaattttcagggtattcttaccaatgaaacaaggtgcctaaggtgtgagactgtaacggcaagggacgagactttcttagatttgagccttgatatcgaacagaatagttcaataacgagctgcctaaaaaatttcagttccacagaaactctgaatgcggaggacaaattcttctgtgacaagtgctgcagcttacaagaagcccagaagaggatgaagataaagaaaccgcctcaggtccttgttattcaccttaagcgattcaagtacatggagaacctcggtcggtacaagaagttgtcttaccgcgtcgtgttcccactggagcttaaattgagcaacaccacagaggataacgactccgagtactcattattcgccgtcgtcgttcacgtcggaagtgggcctaaccacgggcactatgtcagcctcgtgaaaagccataaccattggctcttctttgatgatgagaatgtggagattatcgacgagtcagcagttcaaaccttttttggtccgctcaggagtattcgagcaacacggatcatgggtacattctcttctatgagagtcttgctgttaattgtcagaattaggaagggtattttcgtatc

SEQ ID NO: 5049 - DNA, 1320 bp, Ambrosia trifida
ctttgaaacatccatccaatccatccgtatccaaatataaacctaataacataaaataatattaataataataatataatcgatcacacatatcttctgctaaatcctctccacaattttgctaaaattttcaactttatcaaccctaatacgatacatacatagattcacagaaataataacaacaacaataataataataatagaggagttttggtattatctggtagatggtgtgatgggggcaacaggttctaagctcgagaaagcgttaggagatcagtttcctgaaggtgaacgctactttggacttgaaaacttcggtaacacttgctattgtaacagcgtccttcaggctttatatttttgtgttccatttcgtgagcaattacttgaatattatggaaatgtcaaaaatcccggagacgtagaagaaaacctccttacgtgtttggcagaactgtttatgcagattagtacacaaaagaagaaaacaggcgttattgctcccaaacgctttgtacaaagagtgaagaaagaaaatgagctttttcgtgggtacatgcatcaggatgcacatgaatttttgaattttttgttaaacgaactagttgacatactagagaaagaagccaattcagcaaaaggttcaaaagaactttcaccacctcctgaaaagattcctaatgggatacatgttgcccatgccaacggtgtacggaaagagcccttgattacctgggttcacaaaactttcagggtatacttacaaatgaaacaaagtgtttaagatgtgagactgtgaccgcaagggatgagacatttttagatttgagtcttgatattgagcagaacagttcgatcacaagttgtttaaagaacttcagctccaccgagaccttgaatgccgaggataagtttttctgtgataaatgctgcagtttgcaggaagcacaaaagaggatgaagatcaagaagccaccacatattttggtcatacatttgaaacgtttcaagtacatggaacagctgggcaggtacaaaaagctgtcatatcgtgttgttttccctctcgagctgaagctgaccaacacaatggaagatgcggattgcgagtactcgttatttgcagtggtggttcatgttgggagcgggcccaaccacggacattatgtaagtctggtcaaaagccacaaccactggttgttctttgacgatgaaaatgtagaaatgatcgatgaatcagctgttcaaacctcattcgggtcagctcaagagtatgcaagcaacactgatcatgggtacatcctgttctatgaa

SEQ ID NO: 5050 - DNA, 1655 bp, Ambrosia trifida
gaggagttttggtattatttggtagatggtgtgatgggggcaacaggttctaagctcgagaaagcgttaggagatcagtttcctgaaggtgaacgctactttggacttgaaaacttcggtaacacttgctattgtaacagcgtccttcaggctttatatttttgtgttccatttcgtgagcaattacttgaatattatggaaatgtcaaaaatccaggggacgtagaagaaaatctccttacgtgtttggcagaactgtttatgcagattagtacacaaaagaagaaaacaggtgttattgctcccaaacgctttgtacaaagagtgaagaaagaaaatgagctttttcgtggttacatgcatcaggatgcacatgaatttttgaattttttgttaaacgaactagttgacatactagagaaagaagcaaattcagcaaaaggttcaaaagagctttcaccacctcctgaaaagattcctaatgggatacatgtggcccatgccaatggtgtacggaaagagcccttgattacctgggttcacaaaaactttcagggtatacttacaaatgaaacaaagtgtttaagatgtgagactgtgactgcaagggatgagacatttttagatttgagtcttgatattgagcagaacagttcgatcacaagttgtttaaagacttcagctccaccgagaccttgaatgccgaggataagtttttctgtgataaatgctgcagtttgcaggaagcacaaaagaggatagaagatcaagaagccaaccacatattttggtcatacatttgaaacgtttcaagtacatggaacagctgggcaggtacaaaaagctgtcatatcgtgttgttttccctctcgagctgaagctgaccaacacaatggaagatgcggattgcgagtactcgttatttgcagtggtggttcatgttgggagcgggcccaaccacgggcattatgtaagtctggtcaaaagccacaaccactggttgttctttgacgatgaaaatgtagaaatgatagatgaatctgctgtccaaacctcattcgggtcagctcaagagtatgcaagcaacactgatcatgggtacatcctgttctacgagagccttgctgccaacaatgatcattgagtggtattttatcaaatcttttttttttcttttcccgatttgtgttacttggtttatgtgatatcatcatatagaacaatttgggatcattagatggaaagaaacttgagatggatttaatgtacagttaaatgctgctatttgacttcatctggtttagttttgaaataataaaggtggtgcatatgatgaagatgatgatgacaatgattttgatgatggtgatggtgatggtgatggtgatgatgatgaaacctttgttttaagcatgaatatgatcatcaaagatgatgtcaattcaatgacttacgtctcgtttgtattggtattaacatttttgtttgtttatgtatcgagagctacgatggtattgtatttttgtttgatttgtgaagaaatggagattttgctgaatttaggcgtgatttggaccaagttgttgattcgagttgtaacaacataagacaggatcaaaatatcaaaggaaatgttttgcagttttaaaaaagaa

SEQ ID NO: 5051 - DNA, 1276 bp, Flaveria ramosissima
catcactcatacctcttctgctagattctctcaggaaccctaggcaatcgcattccgatttcattttctttattgaattgctgtattattcgctgaatttcgtcgggtttcgattgaagattcagagagaaatagaggagttctggtacctggtggatggtctcatgggggcaacggggtctaagctcgagaaagctctaggagaccagtttcctgaaggcgaaagatattttggactagagaacttcggcaacacttgctattgtaacagcgtcctgcaggctctatatttttgtgttccatttcgtgaacaattacttgaatattatggaaatgttaaaaatccaggggacgtagaagaaaatctcctcacatgtttggcagaactgtttatgcagattagtacacaaaagaagaaaacaggcgttatcgctccgaaacgctttgtgcaaagagtgaagaaagaaaatgagctttttcgtggttacatgcatcaggatgcacatgaatttttgaatttcttgttaaacgaactagttgacatactagagaaagaagccaattcagcaaaaggtttaaaagaacattcgtcacctcctgaaaagattcccaatgggacgcatgttgctcaggccaatggtgtacgaaaggagcccttggttacctgggttcacaaaacttccagggtatacttacaaacgaaacaaagtgtttaagatgtgagactgtgactgcaagggatgagacatttttagatttgagccttgatattgagcagaacagttcgattactagttgtttaaagaacttcagctccaccgagaccttaaatgctgaggataagttcttctgtgataaatgctgcagtttgcaggaagcacaaaagaggatgaagataaagaaaccaccacatattttggttatacatttgaagcgtttcaagtacatggaacaactgggcaggtacaaaaagttatcatatcgtgttgttttccctctagagctgaagctgaccaacacaatggaggatgcggattgtgagtactcactatttgcagtggtggttcatgttgggagcgggcctaaccacggacattatgtaagcctggtcaaaagccacaaccactggttgttctttgatgatgaaaatgtggaaatgattgacgagtctgctgttcaaacttcatttgggtctgctcaagagtatgcaagcaacactgatcatgggtacattctgttctatgagagccttgctaccaacgatgatcattgaatg

SEQ ID NO: 5052 - DNA, 1569 bp, Cirsium arvense
agtcaaactgtttgataacaaaatcgatcaaattggagtcatacactctttcttgattccaattctttactccactattcacgaaatccgtttcccagataaacccccaaatcaatttcaccctaaatccatcctttttctgctatacacacagtataatttgttccaagaaccctaggcaacagaaatttgaaatcaattaggtaattttttttgatttcttttgtagattgttattaggttaagggaagagatttagagatttgagatttgagatttagagatagaaagaaatagaggaattttggtatttggtggatggtctcatgggggcaacggggtctaagctcgagaaagctctaggagaccagtttccggaaggcgaacgatatttcgggctcgaaaactttggcaacacttgctattgcaacagtgttttgcaggctctttatttctgtgttccatttcgtgaacagctgcttgaatactacggaaacagtaaaagtccaggagatgtagaagagaatctccttacgtgtttggctgagttgtttatgcagattagtacacagaagaagaaaacaggtgttattgctccaaagcgttttgtacaaagagtgaagaaagaaaatgagcttttccgtggttacatgcatcaggatgcacatgagtttctgaacttcttgttaaacgaacttgttgacatactggagaaagaaacgggaaaaggtctagtggaaaatttatcacctcctgaaaagatcactaatggaccacatgctggtctggtcaatggtgcaaagaaagaaccattagtgacctgggttcacaaaaactttcagggtatacttacaaatgagacgaggtgtctaaggtgtgagactgtgactgcaagggatgagacattcttagatttaagccttgatatagagcaaaacagttcaattacgagttgtttaaaaaacttcagttccacagagaccttaaatgccgaggataaatttttctgcgataaatgctgcagcttgcaggaagcacaaaagaggatgaagataaagaaaccaccacatattttggttatacatttgaaacgttttaagtacatggaacagcttggcaggtacaaaaagttatcatatcgtgttgttttccctctagagctcaagctaacaaacaccatggaagatgccgactgtgagtattctttatttgcggtggtggttcatgtcggcagtgggcccaaccacggccattatgtcagtcttgtgaaaagccacaaccactggctgttctttgatgacgagaatgtggaaatgattgatgaatcagccgttcagacgtcctttggctcagctcaggagtatgcaagcaacacggatcatggatatatcttgttctatgagagccttgctgccaataagacgagctgaagatcggtgactcggtgagttgactcggataagttggttgcttattatagaacattttgaagtagatgagaaaaagtatgatatgggttagatgtacagttgatggttgcattattattataatggtgcctatttttct

SEQ ID NO: 5053 - DNA, 1565 bp, Flaveria ramosissima
aacacaaaatccgatcaaaccgtttcctcacgcctctcttcgaaatatccgtttcaacgtataaaccctaatcgattccacatcaaatcttccattttcatccagatttatgatcaatcatacgccttctgctagattctctcaacaaccctaggcaatcgcattccgatttcgttttctctattgaattgttgtgttattacgtcgggtctcgattgaagatttagagagaaatagaggagttctggtatctggtggatggtctcatgggggcaacgggttctaagctcgagaaagctctaggagaccagtttcctgaaggggaaagatactttggacttgagaacttcggcaacacttgctattgtaacagcgtcctgcaggctctatatttttgtgttccatttcgtgaacaattacttgaatattatggaaatgttaaaaatccaggggacgtagaagaaaatctcctcacatgtttggcagaactgtttatgcagattagtacacaaaagaagaaaacaggcgttatcgctccgaaacgctttgtgcaaagagtgaagaaagaaaatgagctattccgtggttacatgcatcaggatgcacatgagtttttgaatttcttgttaaacgaactagttgacatactagagaaagaagccaattcagcaaaaggtttaaaagaacattcatcacctcctgaaaagattcccaatgggacgcatgttgctcaggccaatggtgtacgaaaggagcccttggttacctgggttcacaaaaactttcagggtatacttacaaacgaaacaaagtgtttaagatgtgagactgtgactgcaagggatgagacatttttagatttgagccttgatattgagcagaacagttcgattactagttgtttaaagaacttcagctccaccgagaccttaaatgctgaggataagttcttctgtgataaatgctgcagtttgcaggaagcacaaaagaggatgaagataaagaaaccgccacatattttggttatacatttgaagcgtttcaagtacatggaacaactgggcaggtacaaaaaattatcatatcgtgtggttttccctctagagctgaagctgaccaacacaatggaagatgcggattgtgagtactcactatttgcagtggtggttcatgttgggagcgggcctaaccacggacattatgtaagcctggtcaaaagccacaaccactggttgttctttgatgatgaaaatgtggaaatgattgacgagtctgctgttcaaacctcatttgggtctgctcaagagtatgcaagcaacactgatcatgggtacattctgttctatgagagccttgctaccaacaatgatcattgaatggtattttatcagatcctttttacagatctgtgtttcttggttttgtgatatcatcatatggagcattttgggtcattagattgaaagaaacttgagatgggtttgatgtacagttaatgctgctatctgagttcatctgtttttagtagaagcaataaaggtccttatgatgatgacaaaagtgat

SEQ ID NO: 5054 - DNA, 1558 bp, Eutrema parvulum
gagaggctccttcgaaatctgaagaattatccgatcgaatcgaacaatacgcagcagacacggagaagatacttcccctttgagaatctccgagccacaccggacgagtcaggatcaggaaaaaacggtgatacggaggctagttctagggctgatgggcgccgcgggctccaaactcgagaaagctctcggcgaccagttccccgaaggagaacgctacttcggcttcgagaatttcggcaacacttgttactgcaacagcgttttgcaggccctttatttttgtgttccctttcgtgaacaattgctcgaatactattccagtaataaaagcgtccctgacgctgaagagaatcttatgacttgcctggcagacttattttctcagataagttcccagaagaagaaaacgggcgttattgcgcctaagcgatttgtacagaggttgaagaaacagaatgagctgttccggagttatatgcaccaggatgcacatgaattcctgaactacttgctgaatgaagttgttgacatactggagaaagaggcaaaagctacaaaaactgaacatgaaacctcatcgtcatcatctccagacaagattgcaaacggaccaaaagttcctctggcaaatggtgtgcacaaagagccaattgttacttgggttcacaatatttttcagggcatacttaccaacgagaccagatgtttgcgatgcgaaacagtgacagcaagagatgaaactttcctagacctaagccttgatatcgaacagaacagttcgataactagctgtttgaaaaacttcagctccacagagacgcttcacgctgaagacaaattcttctgtgacaaatgctgcagcttacaagaagcacagaagaggatgaagatcaagaagccaccacacatcttagtcatccatctgaaacgattcaagtacattgaacagctaggccgttacaagaagctatcttatcgagttgtcttccctttggagctaaagctgagcaacacggtagaaccatacgcagacgtagagtactccctctttgcagtggtggttcatgtcggaagtggacccaaccatggtcattacgttagccttgtgaaaagccataaccattggctcttcttcgatgatgagaatgttgagatgattgaagaatcagctgtgcaaacattctttggatcatctcaggagtactcgagcaatactgatcatggttacatcttgttctatgagagccttggaccaacgaagtaaaagctgagaaagagaaaatcagaaaaaggacgctcttcagttcccttcttaactactagtaatggtatatgtttgtgacttaaaagtcaattccattgacagttacttttttttctttcttggttgactttgtatgtctctctctctctctctctcccaaagatatttggtgagtttaaattggaaaagtttttttttaactgaaacctgtaaactttgaaaggccatgtacagttaaatggcaaataactccttgtctttgtatcttttttcaaacagaggaaaacgaag

SEQ ID NO: 5055 - DNA, 1512 bp, Ambrosia trifida
atccatccatccatccatccatatgatacgatgagcactaccaccatctcatagtcaaaccattaatcgatcgatcgatcgatagatcatcttattatttatatcctccttcttcttcttctccaatctctctgtctgtttcagcaataaataatccgttgttgaagcaataataataataatataatatataaaaccctaagtaatgaagtaatattaataataataggaaaagaaagaaagaaaggaaagaggaagggaaatagaggagttttggtatctggttgatggtctcatgggcgctgcggggtctaagcttgagaaagctctcggagaccactttcccgaaggcgaacgctatttcggcctcgaaaactttggaaatacttgctattgtaacagcgttttgcaggctctttatttctgtgttccatttcgtgaacagctgcttgaatactatggaaatggtaaaaatacaggagatgtggaagagaatctccttacttgtttagccgaattgtttatgcagattagtacacaaaagaagaaaacaggtgttattgctccaaagcgctttgtacaaagagtgaagaaagaaaatgagctcttccgtggttacatgcatcaggatgcacacgagtttctgaacttcttgttaaacgatcttgttgacatactagagaaagaagcagcaaagggtccagcagaagctttatcacctcctcaaaagatcgttaatgggccacatggtggtcaggtcaatggtgtaaagaaagagcccctagttacctgggttcacaaaaactttcaaggtatacttacgaatgagacaaggtgtctaaggtgtgagactgtgactgcaagagatgagactttcttagatttgagccttgatatagagcagaacagttcaattacaagctgtttaaaaaactttagctccaccgaaaccttaaatgctgaggataagttttctgtgataaatgctgcagtttgcaggaagcacaaaagaggatgaagataaaaaaaccgccccatattttggttatacatttaaagcgtttcaagtacatggaacagctcggtaggtacaaaaaactatcatatcgcgtggtgttccctctagagctaaagctgaccaacaccatggaagacgccgactgtgagtattctttattcgcggtggtggttcatgttggcagtgggcccaaccatggccattatgtcagtctggtgaaaagccacaaccactggctattttttgatgacgagaatgtggaaatgattgaagaatcagctattcagaccgccttcggttctgctcaggagtatgctagtaacactgatcacggttacattctcttctatgagagccttgctaacaacttgagctgataacgggtatgtgattaggatataactctagtttagtttaattgtttctattattctgtccttaaatgactagatcaagagagaactataatatattcatgtagggttaatgtacag

SEQ ID NO: 5056 - DNA, 1234 bp, Humulus lupulus
caattcgaacaccaacaaaatctcacagaagacgatactccaggagaccaccaagtgaatcggttcggtgccatggtgcgagtcgcttagttgaatcggagggggccttgaggatctaactcggcggcgattggattgacttctcctttcggcctgcgctaatgggtgctgcgggttccaaactcgagaaagctctgggcgaccaatttcccgaaggcgagcgatacttcggtcttgagaatttcggcaacacttgctactgtaatagcgttttgcaggcactatatttttgtgttccattccgcgaacagttgttagaatactattcgaattccaaaaatattggggatgcagaagaaaatctcttgacgtgtttagctgatttgtttagccagataagttcgcagaagaagaaaacgggggtcattgctcctaagcgctttgtacagagattgaaaaaacaaaacgaacttttccgtagctacatgcaccaggatgcccatgagtttttgaatttcttgctgaatgagcttgttgatatattggaaaaagaggctcaagcagcaaaaagtgatcaagaatcttcatctcctcctgatacagtagccaatgggccaagaaatggtatggtcaatggtactaaaaaagagccattagtcacctgggtgcacaaaaattttcagggaatcctcaccaatgagacaagatgcttgcggtgtgagacagtgacagcaagggatgagaccttttttgacttgagccttgatatcgaacagaacagttcaataaccagctgtttgaagaacttcagttctacagagacattgaatgccgaggataaatttttctgtgataagtgctgcagtttgcaagaagcacagaagaggatgaagataaagaagccacctcacatcttggtaatccatctaaagcgtttcaaatatatcgaacagcttggacgctacaagaagctgtcttatcgggttgtcttcccccttgagctgaagctgagcaacacagttgaagatgcagactctgagtactccctttttgctgttgttgtgcacgttgggagtgggccaaaccacggacactatgtcagtcttgtgaagagccataaccactggttattttttgatgacgaaaatgttgagatgatagatgagtctgctgtgcaaacattctttggatcagcacaggagtactcaagtaacacagatcacgggtacatctt

SEQ ID NO: 5057 - DNA, 1391 bp, Brassica napus
gagcgagagagagagagagaggggagggctcctggagaattatccgatcgaatcgaatcgaatcgaatcgaaaaataggcagaggagataaggattaggaaacggcagttttgttgagggaggggtgatgggggcggcggggtcgaaactggagaaagctctgggcgaccagttcccggaaggagagcgctacttcggcttcgagaatttcggcaacacttgctactgcaacagcgttttgcaggctctttatttttgtgttccttttcgtgaacaattgcttgaatactataccagtaataaaagcgtcgctgatgctgaagagaatcttatgacttgcctcgctgacttattctctcagataagttcccagaagaagaaaacgggtgttattgcgcctaagcgattcgtgcagaggttgaagaaacagaatgagctcttccggagttacatgcaccaggatgcacatgaattcctcaactatttgctgaacgaagttgttgacatactggagaaagaggctaaagctacaaagactgaacataaaacttcatcatcttcatcgtctcctgaaaagattgccaacggaccaaaagctcctctggctaatggcgtgcacaaagagccagttgttacctgggtgcacaacatttttcagggcatacttacaaacgagacaaggtgtctgcggtgcgagacagtgacagcaagagacgaaacgttcctagacctaagccttgatatcgagcagaacagttccataactagctgtttgaaaaacttcagctccacggagacgcttcactctgaagacaagtttttctgtgacaagtgctgcagcttacaagaagcacaaaagaggatgaagatcaagaagccgccacacatcttagtcatccatctaaaacggttcaagtacatggaacagctaggccgttacaagaagctctcttaccgagtggtcttccctttggagctaaaactgagcaacacggtggagccatacacagacgtcgagtattcgctctttgctgtggtggttcatgtgggaagcggaccgaaccatggccattacgtaagcctagtgaagagccataaccattggctcttctttgatgatgagaacgtggagatgattgaagaatcagcagtgcaaacattctttggatcgtctcaggagtactctagcaacactgatcatggttacatcttgttctatgagagccttggaccaaccaagtaaaggccgagtaagaggcaaccatcagaaaggactttgtttgttccttaactattagtaatggtatatgtttgggacttaaaaagtcaacaattcctttgacagttactctttttgtttgactttctctatgtctctttctcccaaagat

SEQ ID NO: 5058 - DNA, 1595 bp, Centaurea maculosa
  misc_feature (52)..(52): n is a, c, g, or t
  misc_feature (54)..(54): n is a, c, g, or t
  misc_feature (143)..(143): n is a, c, g, or t
  misc_feature (162)..(162): n is a, c, g, or t
  misc_feature (172)..(172): n is a, c, g, or t
  misc_feature (184)..(184): n is a, c, g, or t
  misc_feature (201)..(202): n is a, c, g, or t
  misc_feature (206)..(206): n is a, c, g, or t
  misc_feature (212)..(212): n is a, c, g, or t
  misc_feature (840)..(840): n is a, c, g, or t
  misc_feature (864)..(864): n is a, c, g, or t
  misc_feature (901)..(901): n is a, c, g, or t
  misc_feature (919)..(919): n is a, c, g, or t
  misc_feature (960)..(960): n is a, c, g, or t
gtcaacttgaaagaatcaaagggggtagagaactcgatcaactgtttctgantnctcacgcctctttgaaatatccgtttcgaaaatataaaccctaataatcgattttgcacatcaaatctttctattttttctgcgatttnttacatgaatacatctaanatcttatctnaagaaccctagncaataagtagcttaacnnaatnatcttnaattccaactaaaatttctggatttcgattgaaagaaatagaggaattctggtatttggtggatggtctcatgggggcaacagggtctaagctcgagaaagctctaggagaccagtttcccgaaggcgaacgatattttggacttgaaaacttcggtaacacttgctattgtaacagcgttcttcaggctctgtatttttgcgttccatttcgtgaacaactacttgaatattatggaaatgttaaaaatccaggagatgtagaagaaaatctccttacatgtttggctgaactgtttatgcagattagtacacaaaagaagaaaacaggtgttattgctccaaaacgctttgtacaaagagtgaagaaggaaaatgaacttttccgtggttacatgcatcaggatgcacatgagtttttgaattttttgttaaacgaactagttgacatactagagaaagaaaccaatgcagcaaaaggttcgaaagaacattcatcacctcctgaaaagatgaccaatgggctacatgttcctcacgccaatggtgtacggaaagagcccttagttacgtgggttcacaaaaactttcagggaatacttacaaatgagacaaagtgtttaagatgngaaactgtgactgcaagggatganacgtttttagatttgagccttgatatagagcagaacngttcaattacgagttgtntaaagaatttcagttccaccgagaccttaaatgctgagganaagtttttctgcgataaatgctgcagtttacaggaagcacaaaagaggatgaagatcaagaaaccgccacatatcttggttatacatttgaagcgttttaagtacatggaacagcttggtcggtacaagaagttatcgtatcgcgttgttttccctctggagctgaagctgaccaacaccatggaagacgccgattgtgagtactctttgttcgcggtggtggtccacgtgggcagtgggcccaaccacggccattacgtcagtctggtgaaaagtcataatcactggctcctttttgatgacgaaaatgtagagatgattgatgaatctgccgttcagacctcgttcggttcagctcaagagtatgcaagcaacaccgatcatgggtatattctgttgtacgagagccttgctacaaacaacatgagctgaaaggtggatgacatttttcgatagtttttcacgttgatttcttatgtgttacttgtaattttgggttgaaatagagcattttggattagataagaagaaacttgagatgggtttgatgtacagttgatgctgctatttgagttcatctgtgtttagtaataaagatgcatatgtgaatgcccaaaactcacatgtatttggaa

SEQ ID NO: 5059 - DNA, 1878 bp, Elaeis guineensis
ggggctcccgtaacccgtttcccactaaaacatggctgcagagtctgcggtctgcggagtcaacggaagcgatcaccgagatcgaagaaagagaaggagctggcgataaatccatcaacgcctctccatcgctccgtcgctcgtttcttcgtcgctccctcagcccctggcgcgacggtcggaggcccgaactcgaaaccctccggctccattgcctcctcttccttcccaagaagccggcttcaaaccttagaaggcctgcggcggtggacgggaagcgcccggcggtggtcgcggaaggaggggcggagagggggaaatcgtcggcggttgcgggcttgtggaccgggctgaggtatctggccggggtcgctgggggtggtgggagaagtggatggttatgggaaccgcgggttccaagctcgagaggtctcttggagaccagttccccgaaggtgagcggtacttcggcctcgagaacttcggcaacacttgctactgtaacagcgtcttgcaggcattatatttttgtgtaccattcagggagcaattactggagtattatgcaaataacaagaacataagagagacagaggagaaccttttgatatgtttggcagatttgttcactcagataagttcccaaaagaaaaaaactggtgttatttctccaaagcgttttgtgcagagagtgaagaaacagaatgagtatttccgtagttacatgcaccaggatgctcatgagtttttgaatttcttgctaaatgaacttgttgaagttcttgagaaagagtctgacgctgcagaaggctcccctggaacctcatcaccatcagaaaagtttactaatgcagcacgccaccctctagcaaatggtgtcagtaaagagccacttgttacttgggtccataagagctttcagggtatactgaccaatgaaactagatgcttacagtgtgaaacagtcaccgcaagggatgaagctttttttgacttaagccttgacatcgagcaaaatagttctatcactagctgcctccaaaacttcagttcaacagagactttaaatgctgaagacaagttcttctgtgacaagtgctgcagtttgcaggaagcccagaagaggatgaagatcaagaagcctccacatgtcctggtgattcatctcaagcgcttcaagtatattgagcagcttggccgaaacaagaaactatcttaccgggttgtgtttcccatggaattgaagctcaatgacacagttgatggtgcagactcggagtactctctctttgcggttgtggtccatgttggaagcggtacaaaccatggacactatgtcagccttgttaaaagccataaccactggttgttctttgatgatgaaaatgtggagatgacagatgagtccactgtgcagacattctttgggtctgcacaggagtactcaggcaacacggatcatgggtacatcttattctatgagagccttggtggaagaagttgagagagtggttttcttccgatgaagttatcagctgtcctggcccttgttacctccattattctcccctccaagggccaagtataagttcttggacgtttgtgagatgagatgtgaaatatgcggtctttgggtggtacagcatacggtggatggtggaactgcactctctgtttcttcaacaataaactagaaagtttaatcttcaccagaaagtatttcgtgcgagctctaggaccttttcttgcattgcagcattttttatcaaattttggcaaatgaagaaaaccgagatggaaaattaacctgcagatagttgtggatgtaattaaattgagtcgttggattaatttttaaaatttatttctatgtcaaaa

SEQ ID NO: 5060 - DNA, 1651 bp, Phaseolus coccineus
aaaccctccttctttctttccatcgccacttccattgataacagaaaacaaacttctctgcgcagaaaaccctagcgattcgaagcgacgcgcaaagacaggaacaaccattgaatcatccacgatggcggtgtgcgacgcgactcactgagttgaacgcataaagatctgaatcgcggtgatcggttcgacgcgctcatgggtgcttcgggctccaaactcgagaaagctctcggcgaccaattccccgaaggagaacgttacttcggccttgagaatttcggcaatacttgttactgcaacagcgttttgcaggcactatacttctgtgttccttttcgagaacaattgctagagttttatgcaaataacaagaacttggcagatggtgaggaaaatcttttgtcttgcttagctgacttattttcacagataagttctcagaagaagaaaactggtgttattgctcccaaacgatttgttcagaggttgaaaaaacagaatgagctcttccgtagctatatgcaccaggatgctcacgaattcttgaactttttgctaaatgaacttgttgacattctggagaaagaggccaaaagaaaggaagaagaaacatcaccaccatctgaaaaggctgcaaatggacctaataatggtctacctaatggtgctgaaaaaaagcctttaaaaacttgggtgcacaaaaattttcagggaatactcaccaacgaaactaggtgcctgcgttgtgaaactgtgacagccagggatgaaacattttttgacttgagccttgatattgaacaaaatagttcaattacaagttgtttgaaaaacttcagttcaatggagacattgaatgctgaagacaaattttgttgtgacaagtgctgcagtttgcaggaagctcagaagagaatgaagataaagaaaccaccacacatcttggtcatacaccttaagcggtttaaatacattgaacagctgggacgctacaagaagctgtcttaccgggttgtcttccctcttgagctgaaattaagcgatactgttgaagattcagatattgagtattctctatttgcagtagttgttcatgttgggagtgggcccaaccatgggcattatgtaagccttgtgaaaagccacaaccattggttattttttgatgacgaaaatgttgagatgattgatgagtctgctgttcagacattttttgggtcatcgcaagagtattccagcaatacagaccatggttacattttgttctatgagagcattggctctggtaacaagaactaggtggaggagcctaacgagttttaggtacttgaatcatttgaacttttgtgtttttcatctctttattgttaattattttctttttttgttcaacctgcttgagtagttgttatacacacgattcaacgagaggatacgggttgtgaaaatgtatacttagcggtcgacatgtacagtggatagtgcaagcgctgtcctttttcccctttctttttttagcaataagagcagtgtatatgaatttcgccgacagtgtaatcacgattttaattgttaaatcattagaaacacaatgaaatggcaattcactcataaaatctgctgttttcattcactttctgacctgtat

SEQ ID NO: 5061 - DNA, 2176 bp, Lactuca sativa
ttaagattatactgcatacacaagctttatgttgccctagaccctagccctagccctacacccttccctttgcgcctgaaggacctcaacaaaaatagaagggccccgtcaaaaagacaaactcccctgatttctattttcagccccaacacttatctcctaaccttcatctttcccgtgacgaaaccaccttcaaaaattccccaattccctgtgtatacttggagcaaatgagcattgagtgagggggccacagatacttaagccttaaggtgtgaggttgtcgaacccatgattaaggaccataaaagggtgcgtgccccggtcagtgtttacagcttggcaacaatcatgattcatgagtgacgatagcaaatttctgttttctcccctcaatttccaccaatcgcatctccgattttgtgcttcacatctcatttttcatctttcttgatgaacaaaccatgctcgtctagctactaagggtttggttgattctttcctttttcgctgattaagggtttggatgccttgaacaaatgggtgcagctggctccaaacttgagaaagctttgggcgaccaatttccagaaggcgaacgatacttcggtctcgaaaattttggcaatacgtgttactgtaacagtgtcttgcaggctctttatttctgtgttccatttcgtgagcaattgctagaatattattcaagcaacaaaagctttgctgatgcagaagaaaatctgttaacatgcctagcagacttgtttacacagataacttcacaaaagaagaaaacaggggtgattgctccaaaacgctttgtacagagattgaagaagcagaatgagattttccgtagctatatgcaccaggatgcccatgaatttttaaattatcttttaaacgaacttgtggacatactggagaaagaatcacgtgctgcaaagagtgatccagaatcttgttcatcttctgagcaaattcctaatggaataaagacttctcacatcaatggtcatgtaagagagccactcatcacatgggtgcacaagaatttccagggtatactcacaaatgaaacaaggtgcttgcgatgtgagacagtaacagcaagagatgaaaccttccttgacttgagccttgatattgagcaaaatacctcaattactagttgtttgaagaacttcagttccactgagactttaaacgctgaggacaaattcttttgtgataaatgttgcagcttgcaggaagcccaaaaaagaatgaagatcaagaaaccaccgcaaatcctagtcatccatttaaaaagattcaaatacatcgagcaactcgggcgttacaaaaagctctcataccgtgtggtcttccccctggagctcaaactaagcaacaccgtcgaagacacagatgccgaatattctcttttcgcggtggtggtccacgtcggaagtgggcccaaccacgggcactacgtgagcctcgtgaaaagccataatcattggttgttttttgatgatgaaaatgtggaaatgatcgatgagtcagctgtgcaaacttttttcgggtccgcacaagagtattccagcaacacggatcatggttacatcttgttttacgaaagggtcgatgtaggtaccacaagttgaaaagacggatttaccctcctcccttaagaggaaattttacaattttgaacggatacacttaacatttatttcactgtctttattatatagtacatttttattggactggttctatttttgtaatgtataacaatgggtccgtcccacaaatgacatggaggaggtaacttagtaaggaaagtgattatgtgatcttatttgtgagttttcaccgtgttacttactgttagcgtaaacatgtacagacagtacaacaatggtggaagctaacttatatatatgttcatttagcaccaacagttggcgaacattcaagaaagttgaatgttgcttatatagtagttttaattttgttattagttaacggtaactttggattgacgagtttaagaagattatcgatgatttgccttgtatgattgtattaggtcattaagttgtaagagtgtataaaacttgagggattcatgtgacatctttttttccttttacatcctctatctttacttcactaagatttttgtttt

SEQ ID NO: 5062 - DNA, 1520 bp, Arabidopsis lyrata
ctcttctcttcggctccttggaaatctgaattatccgatcgaatcgaaccatcgcagaggctaaagaagaggtttgagtcaaatcggacgagtcaggaacaggaaaaacggtgatacggaagctagttctagggctaatgggcgccgcgggctccaaactcgagaaagctctcggcgaccagttccccgaaggagaacgctactttggattcgagaatttcggcaacacttgctactgtaacagcgttttgcaggctctttatttctgtgttcctttccgtgaacaattgcttgaatactataccagtaataaaagcgtcgccgatgctgaagagaatcttatgacctgcctggcagacttgttttcgcagataagttcccagaagaagaaaactggtgttattgcgcctaagcgatttgtacagaggttgaagaaacaaaatgagctgtttcggagctatatgcaccaggatgcacatgaattcctgaattatttactgaatgaagttgttgacatactggagaaagaggcaaaagctacaaaaactgaacatgaaacctcgtcatcatcatctcccgaaaagattgcaaatggactgaaagtccctcaggcaaatggtgttgtgcacaaagagcctattgttacttgggtgcacaatatttttcagggcatacttaccaacgagacaaggtgtctgcgatgtgaaacagtgacagcaagagacgaaacattcctagaccttagccttgacattgaacagaacagttcgataactagctgtttgaaaaatttcagctccactgagacgcttcacgctgaagacaaattcttttgtgacaaatgctgcagcttacaagaagcacagaagcggatgaagatcaagaagccaccacacatcctagtcatccatctaaaacgattcaaatacatcgaacagctaggccgctacaagaagctctcatatcgagttgtcttccctttggagctaaaactgagcaacacagtggaaccatacgcagacgtggagtactctctgtttgcagtggtggttcatgtcggaagtggacctaaccatggtcattacgtcagccttgtgaaaagccataaccattggctgttctttgatgatgagaatgttgagatgattgaagaatcagctgttcaaacattctttggatcgtctcaggagtattcgagcaatactgatcatggttacatcctgttctatgagagccttggaccggccaagtaaaagctgagaaagcagaaaaaatgactttcttcgtttttttttctttaactattattagtaatggtatatgtttgtctttaaaagtaaactcaattgacagtaacttttttttttttttttctctctgtctctctctctctctcccagagatatttggtgagttttaaattggaagttttaactggaatttgtatactttgaaaaaggccatgtacagtttatggcaaataacttcccttgtctttgtatcctttttcaaacaaagaa

SEQ ID NO: 5063 - DNA, 1612 bp, Arabidopsis thaliana
tcgctttggacagaaaagaagagaaaaagtttaatagtaaaataatcgatcctcttctcttctcttctctgaggctcgttggaaatctgaattctccgatcgaatcgaaccaatcgcagaggctaagaagaggacctttgagagaatctccgagtcaggatcagaaaaaacggtgatacggaagctagttctagggctaatgggcgccgcgggctccaaactcgagaaagctctcggcgaccagttccccgaaggtgaacgctactttggattcgagaatttcggcaacacttgctactgtaacagcgttttgcaggctctttatttctgtgttcctttccgtgaacaactgctcgaatactataccagtaataaaagcgtggccgatgctgaagagaatcttatgacctgcctggcagacttgttttcgcagataagttcccagaagaagaaaacaggtgttattgcgcctaagcgatttgtacagaggttgaagaaacaaaatgagctgtttcggagttatatgcaccaggatgcacatgaattcctgaattatttgctgaatgaagttgttgacatactggagaaagaggcaaaagctacaaaaactgaacatgaaacctcgtcatcatcatctcccgagaagatagcaaatggactgaaagttcctcaggcaaatggtgttgtgcacaaggagcctattgttacatgggtgcacaatatttttcagggcatacttaccaacgagacaaggtgtctgcgatgtgaaacagtgacagcaagagacgaaacattcctagacctaagccttgatatcgaacagaacagttcgataactagctgtttgaaaaacttcagctccacagagacgcttcacgctgaagacaaattcttttgtgacaaatgctgcagcttacaagaagcacaaaagcggatgaagatcaagaagccaccacacatcctagtgattcatctaaaacgattcaaatacatcgaacagctaggccgctacaagaagctctcctatagagttgtcttccctttggagctaaaactgagcaacacagtggaaccatacgcagacgtggagtactctctgtttgcagtggtggttcatgtgggaagtggacccaaccatggtcattacgtaagccttgtgaaaagccataaccattggctcttctttgatgatgagaatgttgagatgattgaagaatcagctgttcaaacattctttggatcgtctcaggagtattcgagcaatactgaccatggttacatcctgttctatgagagccttggaccgaccaagtgaaagctgagaaagcagaaagaaggactttcttcgttttttttctcttaactattattagtaatggtatatgtttgtcttaaaagtcaaactcaattgacagtaacttttttttttttttggtttttgttctttctctgtgtctctctcccaaagatatttggtgagttttaaaattggaagttttaactggaatttgtatactttgaaaaaggccatgtacagtttatggcaaataactccttgtctttgtatctttagcaaaggaagaaggttacaatatgttgaattactttggct

SEQ ID NO: 5064 - DNA, 1637 bp, Eutrema halophilum
tcgcttttaagaggaaaaattataagaaaaaaaaactttgtgataataataataatcgatccctccctcgttggaaatctgaagaatttatccgatcgaatcgaacaaaaacgcagacgcggaagaggagaatcgcttggagaatctcccgagtcaaatcggatcagaaaaaacggtgatacggaggctacttctagggctcatgggcgccgcgggctccaaactcgagaaggctctcggcgaccagttccccgaaggagaacgctacttcggtttcgagaatttcggcaacacttgctactgcaacagcgttttgcaggccctttatttttgtgttccctttcgtgaacaattactcgagtactataccagtaacaaaagcgtcgccgatgctgaagagaaccttatgacttgcctggcagacttattttcccagataagttcccagaagaagaaaacaggtgttattgcgcccaagcgatttgtacagaggttgaagaaacagaatgagctcttccggagttatatgcaccaggatgcgcatgagttcctgaattatttgctgaatgaagttgttgacatactggagaaagaggcaaaatctacaaaaaccgaacttgaaacttcatcatcatcatctcccgagaagattgcaaatggaccgaaagttcctcagccaaatggtgttcacaaagagcctattgttacttgggtgcacaatatatttcagggcatacttaccaacgagacaaggtgtctgcggtgtgagacagtgacggcaagagacgaaacgttcctagacctaagccttgatatcgaacagaacagttcgataactagctgtttgaaaaacttcagctcgacagagacgcttcacgctgaggataaattcttctgtgacaaatgctgcagcttacaagaagcacaaaagaggatgaagatcaagaaacctccacacatcttagtcatccatctaaagcgattcaagtacattgaacagctaggccgctacaagaagctctcttatcgagttgtgttccccttggagctaaaactgagcaacacggtggaaccatatgctgacgtcgagtactctctctttgcagtggtggtccatgtgggaagcgggcccaaccatggtcattacgttagccttgtgaaaagccataaccattggctcttctttgatgatgagaacgttgagatgattgaagaatcagctgtgcaaacattctttggatcgtctcaggagtattcaagcaatactgatcatggttacatcttgttctatgagagccttggacgaaccaagtaaaagctgaggaagagaatatgagaaaaaaggactttcttcgttttttttctcctttaactatttagtaatggtatatgtttgtgactataaagtcaattcaattgacagttactttttttttgtttggttgactttctctgcgtctctctctcccgaagatatttggtgagagtttaaattggaaaagttgttaactgaaatctgtaaactttgaaaaaacatgtacagttaatggcaaataactccttctctttgtatcttttttcaaacaaagaaaacgaaggaagaagattttacaatacattatgttgaattactttgg

SEQ ID NO: 5065 - DNA, 1364 bp, Cirsium arvense
agagagagagagagagagagagagagcttggttctttcccgaaacgaacaaggtttggatgccgtgaaacaaatgggtgcagctgggtcgaaacttgagaaagctttgggcgatcagtttccagaaggcgagcgatacttcggtctcgaaaattttggcaatacatgttactgtaacagtgtcttgcaggcactttatttctgtgttccatttcgtgagcagttgttagaatattattcaaacagcaaaagcttagctgacgcagaagaaaatctattaacatgcctggcagacctgtttacacagataagttctcaaaagaagaaaactggggtcattgctccaaaacgttttgtacagagattgaaaaagcagaatgagattttccgcagctatatgcaccaggatgcccatgagtttttgaattatctgttaaacgaacttgttgacatactggagaaggagtcacatgctgcaaagagtgatccagaatcttcttcatcttctgaacaaattgctaatggactaaagagtgctcattccaatggtcatatgagagagcctcttgtcacctgggtgcacaagaatttccagggtatacttacaaatgaaaccaggtgcttgcgttgcgagacggtaacagcaagagatgagacgtttcttgacttgagcctcgatattgagcaaaatagctcaattactagctgtttgaagaacttcagttccaccgagactttgaatgctgaggacaaattcttttgtgataagtgttgcagcttgcaggaagcccagaaaagaatgaagattaagaagccacctcagattttagtcatccatctaaaaaggttcaaatacattgagcagcttggacggtataaaaagctatcttatcgtgtagtcttcccactggaactcaaactcagcaatacagtagaagatgcagatgcagaatattctttatttggagtcgtagtgcacgttggaagtgggcccaaccacgggcactatgtgagcctggtgaaaagccataatcattggttatttttgatgatgaaaatgtagaaatgattgatgaatcggccgtgcaaacgttctttggatcagcacaggagtattcaagcaacacagatcatgggtatatcttgttttatgagagagttgacacaggttatacaagctgaatttgtagatggtaaaaaaatttgcaattttgaagtgattttcagtttttacattttgggattggtgtttgattattagaattgggactggttctggttttgtaatctatgatttcatatgatgatcaaaaatgtgaatcatgtacagcaatggcagaaactaactttatctcaaaaaagaaa

SEQ ID NO: 5066 - DNA, 1553 bp, Zostera marina
aaacaacagatcgattgatcgatcaccaccaccaggcattctctctcctcatcgttacttgatctccttacgattctccgaaacagggaaaaccctagatctgatctcatcaggtttggaagaggggattctccgtcacggtccttccggcgaggaatcatcttgtttcgtaattgttgggtgtgtggctgtgtgctgtggatggtaatgggagccgcgggttccaagctggagaaggctctcggagaacagtttccggagggggagaggtatttcggtcttgaaaattttggcaacacttgctactgtaacagcgttcttcaggcactgtatttctgcgtgccattccgagaaaagttacttgaatactattcgaacaacaaaaccccactagatgcagaagataatcttctaacgtgtttggctgatcttttcacacagataagctctcagaagaagaaaactggcattattgctcccaagcgttttgtgcagaaagtcaagaaacaaaatgaactctttcgcagttatatgcaccaggatgcacatgaatttctaaactttctgctaaatgaacttgttgatatccttgagaaagagtcatctaactctgtgaagaattcccttgcggcttcttctgcttcgcaatctgtaaagattgtcaatggaccacagcttcctcttgcaaacagtggtaaaaacgagccgcttgttacttgggttcataaaaatttccagggtacactaacaaatgaaacaaggtgtttgcgatgtgaaacagttactgcaagggatgaaacatttttagatcttagtcttgacattgagcaaaacagttcaattacaagttgcctaaaaaattttagttccaccgagacgttgaatgctgaggacaagttcttctgcgacaaatgttgcagtttacaggaagcgcagaaaaggatgaagataaaaaaccaccacacattctagtgattcatctcaaacggttcaaatacatggagcagctgagtcgacacaagaaattatcatatcgagtcgtctttcctctagatttgaaattgaccgacaccgttgttgatccagatactgaatactctctgtttgcagtagtagtccatgtgggcagcggtccgaaccacggtcactatgtgagcttggttaagagtcataatcactggctgttttttgacgatgagaatgtggagattattgacgagtcaattgtgcagacattttttggttcagcccaggagtattcaagcaacacagaccatggctacatattattctatgaaagtctggttcgtgatggtcaatagaaaatatggagattcttatttgtgtttttagttattgtacagtatcagtggcagtagaaggatgaggaagaaaatcagtggtaagacaagtattgtatgtaaatgtaatactaaatcttcatagtgctaaaataatacatttaatatatttttaggtaaaatactgcaaattgactattgtagattttttgtataaacttttgtaaagcgaaagctttttatagttaattt

SEQ ID NO: 5067 - DNA, 1606 bp, Artemisia annua
aggggaaggggaaatagaggagttttggtatttagtggatgtgggtgagggagtgatgggggcaacaggttcaaagcttgagaaagctttaggcgaccagtttcctgaaggcgaacgttatttcggtctcgaaaactttggcaatacttgctattgcaactctgtcttgcaggctttatatttttgtgttccgttccgcgaacagctacttgagtattatgcgaatgtaaaaaatccaggagatgtagaagagaatctgcttacatgtttggcagaactgtttatgcagattagtacacaaaagaagaaaacaggtgttattgctccaaaacgctttgtacaaaaagttaagaaagaaaatgagcttttccgaggttacatgcatcaggatgcacatgaatttttgaatttcttgttaaacgaactagttgagatactagagaaagaatacaatgcaacaaaagcttcgaaagaacattcaccacctcttgataagatcgccaatgggatacatggtccgcaagccaatggtgtaagaaaggagcccttggttacatgggttcacaaaaactttcagggtatacttacgaacgaaacaaaatgtttaagatgtgagacggtgactgcaagggatgagactttcttagatctgagtctggatatagagcagaacagttcaattacaagttgtctaaagaacttcagctccactgagaccttaaatgctgaggataagtttttctgtgataaatgctgcagtttgcaagaagcgcaaaagaggatgaagatcaagaaaccaccacatattttggtcatacatttgaagcgtttcaagtacatggagcagcttgggaggtacaaaaagctatcatatcgtgttgttttccctcttgagctgaagctgaccaacaccatggaagatgcggactgtgagtactcattatttgctgtggtagttcatgttggaagtgggcccaaccacggtcattatgtcagtctggtcaaaagccacaaccattggctcttctttgatgatgaaaatgtagaaatgattgatgaatctgctgttcaaaccgcatttggttcagcgcaagagtatgcaagcaacaccgatcatggatacatcctgttctatgagagcattgctaccagcaatgataaatagtgacgatcactgttgttgataccatggtaccgataaaacaatgatcaaaatggtattttctaatcttttttttctttttctttttttcttttgacagttgtgtttcttggtttttgtcatatgatatagagcaatttggatattattagatgagaagaaacttgagatgggtttgatgtagagttgatgctgctatttgagatcatctgtttttagttagtaataaaggtggttatgtggatgatgacgaaaatgtcgtattaaaccctattttgatcttaaaaaacaatgacaatggctgcctggacagggtaactaaatgtttatttatctgtcttgtttctctggctgttaaatctttttgtgttgtgggtctttttcgtgttctgaaaataatgaaggtacaattgtgttgtatttttgtttgatgtgtgtagaaat

SEQ ID NO: 5068 - DNA, 1960 bp, Eucalyptus grandis
cgacagagacataaaacccccaaatccagacacgcaggcaagcgccgaggaacaacgaacggcgacgaatccgcggccatggaagccaagctgcgattttgattagtgggttcgattcgattcgatcctattaagaaaacccacaaaggtttgcttgtctccttgtgcggcgcccgtgtcgcggcgaggcggggattcgtggagggaatcggcgggttttgttggggggcggcggggaatcgagggacgacgacacccctggcggctcatcctctctcccagctccgcctgctctcgattcggggtctgagggtcatgggtgcggcggggtccaagctcgagaaggccctcggcgactcgttccccgagggcgagcgctacttcggcctcgagaacttcggcaacacctgttactgcaacagcgtcttgcaggccctctatttttgcgtgccctttcgagaccaactgctcgattactatgcaaataacaaaagccttggagatgaagataacctgttagcgtgccttgcagacctatttacgcagataagttcacaaaagaagaaaaccggtgtcattgctccgaaacgttttgtccaaagattaaagaaacaaaatgagctgttccgaagctacatgcaccaggatgcacatgagtttttgaactttctgctcaatgaaattgtggacactttggagaaagaggctcaagctgcaaaaaatgatcaagaaacatcatcacctgctgagaagactgcaaatgggcctaagaatgcccatgctaacggcggcccgaaggagcaattagatacttgggtgcacaagaattttcagggaatacttacaaatgagacaaggtgtctgcggtgcgagacggtaactgcaagagatgaaactttctttgacttgagtcttgatattgaacagaatagttcaataacaagctgtctaaaaaactttagctcaacggaaacattaaatgctgaggacaaatttttctgtgacaaatgctgcagcttgcaagaagctcagaagaggatgaagataaaaaagccacctcaaatccttgtcatccatctgaagaggtttaagtacatcgagcagctcggtcggtacaagaagttatcttatcgcgttgtgtttccactggagctgaagctaagtaacactgtagaagatgcagattctgaatattccttgtttgctgtggttgtccatgttggaagtgggccgaaccatggccactatgttagcctggtgaagagccacaaccactggttattttttgatgacgaaaatgtagagatgattgacgagtccgcagtgcagacattctttggatcggcacaggaatattcgagtaatacagatcatggttacatcttgttctacgagagacttggcaacgggcatatgagttgagaagagggaattagtatccctaattaggtaatttaaccactctggcctgtttgttattttatgtcctattttattggtctttgccctcctttacaacctctcagggaatcggttcgccagctatcattgagataaaagatgggtcctggaaagtgtatactttgatggtccgtgtacagcttatggtggaagcacactgtcccttttttcttactaataagagggggaaacagcactgtatatgttggctttgaaagaattttacccaggtggtaatttgctgttgattttgccatcattttagagtaaaatgtagtacatggccattctgattctgggttttctcttgagctttcgggcgttgtactttatgagctgcaaaatgtttattgacatcttccggtgggtggtgcaagattaatgccatttgttgagtaggtgttgaaaaagctcaagtgattagttgtagcaataaacctgggcttccttagtcttttatttttacagccaaattaaggttgttttggcaaactccaca

SEQ ID NO: 5069 - DNA, 1509 bp, Flaveria ramosissima
tgatgacgagcaacaaaaaataaaataacacacaatagtcaaccgatcgaaaccaagccccagacaccaaagcaatccaataaaccctaaatcgatagcacagtaatcctcttcttcctctgctatttgcctatatgtggcggtcttatgaaccctagccaatacaatcaacgccggtgactgttggattctgagaagaaagaaattgaggagttttggtatctggttgatggtctcatgggggctacggggtctaagctcgagaaagctctaggagatcagtttcccgaaggcgaacgttattttggccttgaaaacttcggcaacacttgctattgcaacagcgtcttgcaggctctttatttctgcgttccattccgtgaacagctgcttgattactatggaaacgttaaaaatccaggagatgcagaagagaatctccttacatgtttagctgaattgtttatgcagattactactcaaaagaagaaaacaggtgttattgctccaaagcgctttgtacaaagagtgaagaaagaaaatgagcttttccgtggttacatgcatcaggatgcacatgagtttttgaacttcttgttaaatgatcttgtcgacatactagagaaagaaacagcaaaaggtgcagcagaaaatttatcacctccaaaaaagatcgttaatgggctacatggtgatcaagtcaacggtgtaaagaaagagcccctagttacctgggttcacaaaaactttcaaggtatacttacgaatgagacaaggtgtttaaggtgtgagactgtgactgcaagggacgagactttcttagatttgagccttgatatagagcaaaatagttcaattacaagttgtttgaaaaacttcagctccactgaaaccttaaatgctgaggataagtttttctgtgataaatgctgcagtttgcaggaagcacaaaagaggatgaagataaaaaagccaccacatattttggttatacatttaaagcgcttcaagtacatggaacagctgggtaggtacaaaaaactatcatatcgtgtggtgttccctctggagctaaagctgacaaacactatggaagacgctgactgtgagtattctttattcgcggtggtggttcatgttgggagtgggcccaaccatggtcattatgtcagtctggtgaaaagccacaaccactggctgttttttgatgacgagaatgtggaaatgattgaggaatcagccattcagaatgcctttggttctgctcaggagtatgcaagtaacaccgatcatggctacattctcttctatgaaagccttgctaacaatcccggcttataattggtatgttcattatgatacaactctgttgtttaattgttctatattctgtcatcagaactagatcagaaaaactacaatcatattcataacttcatatgggttagatgtacagtagataaatacgctgctattttcctaagtgtcttgtaatgcaattgctgctta

SEQ ID NO: 5070 - DNA, 1565 bp, Brassica rapa
atactgagagagagagaggctccttcgcaatctgaagaatcatccgatcgaatcgaataatacgcagataaggattgagagagagaggatagtttccttattggggaataagcgatcagagaaaacggtgatacggaggctagttctagggctgatgggcgccgcggggtccaaactcgagaaagctctcggcgaccagttccccgaaggcgagcgctacttcggcttcgagaatttcggcaacacttgttactgcaacagcgttttgcaggctctttatttttgtgttccctttcgtgaacaattgctcgagtactataccagcaataaaagcgtcgcagattctgaagagaatcttatgacttgccttgctgacttattttctcagataagttcacagaagaagaaaacaggcgttattgcgcctaagcgattcgtacaaaggttgaagaaacagaacgagctgttccggagttatatgcaccaggatgcacatgagttcctgaactatttgctgaacgaagttgttgacatactggagaaagaggcaaaagctactacaaaacctgaacgtgaaacctcatcatcatcatcccctgaaaagattgcaaacggacccaaagctcccctggcaaatggtgtgcacaaagagcctgttgttacttgggtccacaatatctttcagggcatacttaccaacgagaccaggtgtctacgatgcgagacagtgacagcaagagacgaaacgttcctggatctaagccttgatattgagcagaacagttcgataactagctgtttgaaaaacttcagctcaacagagactcttcacgctgaagacaaattcttctgtgacaaatgctgcagcttacaagaagcacaaaagaggatgaagatcaagaaaccaccacacatcttagtcatccatctaaaacggttcaagtacatggagcagctaggccgatacaagaagctatcttaccgagtcgttttccctctggagctaaaactgagcaacacggtggagccatacacagacgtggagtactcgctctttgcggtggtggttcacgtgggaagcggaccgaaccatggtcattacgtgagcctagtgaaaagccataaccattggctattctttgatgatgagaacgtggagatgattgaagaatcagcagtgcaaacgttctttggatcgtctcaggagtattcgagcaatactgatcatggttacatcttgttctatgagagccttggaccaacaacaaagtgaaacagctgagtaaggggaaaaggacttttcttttggatatttttctttaactacttagtaatggtatatgactctcttatatgtttgtgacttaaaaagtcattcaaattgacagttactttatattgactttctctgtctctctctcccccaaagatacatatttggtgagtttaaattgaaaagttttttttttcttttaaactaaaaaatctgtaaactttgaaaggccatgtactgttaaaaagcaatgaataaaaagaaatatacaatacattatgttgaattacaa

SEQ ID NO: 5071 - DNA, 1324 bp, Brassica napus
actgagagagagagaggctccttcgcaatctgaagaatcatccgatcgaatcgaacaatacgcagataaggattgagagagagaggatagtttcgttttaggggaatcagcgatcagagaaaacggtgatacggaggctagttctagggctgatgggcgccgcggggtccaaactcgagaaagctctcggcgaccagttccccgaaggcgagcgctacttcggcttcgagaatttcggcaacacttgttactgcaacagcgttttgcaggctctttatttttgtgttccctttcgtgaacaattgctcgagtactataccagcaataaaagcgtcgctgattctgaagagaatcttatgacttgccttgctgacttattttctcagataagttcacagaagaagaaaacaggcgttattgcgcctaagcgattcgtacaaaggttgaagaaacagaacgagctgttccggagttatatgcaccaggatgcacatgagttcctgaactatttgctgaacgaagttgttgacatactggagaaagaggcaaaagctactacaaaacctgaacgtgaaacctcatcatcatcatcccctgaaaagattgcaaacggacccaaagctcccctggcaaatggtgtgcacaaagagcctgttgttacttgggtccacaatatctttcagggcatacttaccaacgagaccaggtgtctacgatgcgagacagtgacagcaagagacgaaacgttcctggatctaagccttgatattgagcagaacagttcgataactagctgtttgaaaaacttcagctcaacagagactcttcacgctgaagacaaattcttctgtgacaaatgctgcagcttacaagaagcacaaaagaggatgaagatcaagaaaccaccacacatcttagtcatccatctaaaacggttcaagtacatggagcagctaggacgttacaagaagctatcttaccgagttgtcttccctttggagctaaaactgagcaacacggtggagccatacacagacgtggagtactcgctctttgcggtggtggttcacgtgggaagcggaccgaaccatggtcactacgtgagcctggtgaagagccataaccattggctattctttgatgatgagaacgtggagatgatcgaagagtcagcagtgcaaacgttctttggatcgtctcaggagtattcgagcaatactgatcatggttacatcttgttctatgagagccttggaccaacaacaaagtgaaacagctgagtagggaaaggactttctttggtatatttttctttaactactta

SEQ ID NO: 5072 - DNA, 1427 bp, Brassica napus
gctccttggcaatctgaagaaatcatccgatcgaatcgaatcgaacaataggcagataagaaaggatagttacctttgtggggaatcaccgatcagagaaaacggtgatacggaggctagttctagggctgatgggcgccgcggggtccaaactcgagaaagctctcggcgaccagttccccgaaggcgagcgctacttcggcttcgagaatttcggcaacacttgttactgcaacagcgttttgcaggctctttacttttgtgttccctttcgtgaacaattactcgagtactataccagcaataaaagcgtcgcagattctgaagagaatcttatgacttgccttgctgacttattttctcagataagttcccagaagaagaaaacaggcgttattgcgcctaagcgattcgtacaaaggttgaagaaacagaatgagctgttccggagttatatgcaccaggatgcacatgagttcctgaactatttgctaaacgaagttgttgacatcctggagaaagaggctaaagctactacaaaacctgaacgcgaaacctcatcatcatcatcccctgaaaagattgcaaacggaccaaaagctccccttgcaaatggtgtgcacaaagagccagttgttacttgggtgcacaacatttttcagggcatacttaccaacgagacaaggtgtctacgatgcgagacagtgacagcaagagacgaaaccttcctagatctaagccttgatatcgagcagaacagttcgataactagctgtttgaaaaacttcagctccacagagactcttcacgctgaggacaagttcttctgtgacaaatgctgcagcttacaagaagcacaaaagaggatgaagatcaagaagccaccacacatcttagtcatccatctaaaacggttcaagtacatggagcagctagggcgttacaagaagctctcttaccgagtcgtcttccctctggagctaaaactgagcaacacggtggagccatacacagacgtggagtactcgctctttgcagtggtggttcacgtgggaagcggaccgaaccatggccattacgtgagcctagtgaaaagccataaccattggctattctttgatgatgagaacgtggagatgattgaagaatcagctgtgcaaacgttctttggatcgtctcaggagtattcaagcaatactgatcatggttacatcttgttctatgagagccttggaccaacaacaaagtgaaacagctgagtaagggcaaaaggacttttcttttggatatttttctttaactacttagtaatggtatatgactatatgtttgtgacttgcaagtccttcaaattgacagttactttatattgactttctctgtctctctctcccccaaagatacatatttggtgagtttaaattggg

SEQ ID NO: 5073 - DNA, 1440 bp, Flaveria ramosissima
cttctgctagattctctcaggaaccctaggcaatcgcattccgattttcattttctttattgaattgctgtattattcgctgaatttcgtcgggtttcgattgaagattcagagagaatagaggagttctggtacctggtggatggtctcagtgggggcgaacggggtctaagctcgagaaagctctaggagaccagtttcctgaaggcgaacgctattttggtcttgaaaacttcggcaacacttgctattgtaacagcgttctgcaggctctatatttttgtgttccatttcgtgaacaattacttgaatattacggaaatattaaaaatccaggagacgtagaagaaaatcttcttacatgcttggcagaactgtttatgcagattagtacacaaaagaagaaaacaggtgttatcgctccaaaacgctttgtgcaaagagtgaaaaaggaaaatgagcttttccgtggttacatgcatcaggatgcacatgaatttttaattcttgttgaacgaactagttgacattctagagaaagagccaattcaacaaaaggtacaaaggagcatctatcaccttctgaaagatccccaatgggatacatgttggtcaggccaacggagtacggaaggagcccttggttacccgggttcacaaaaacttccaggggatacttacaaatgaaacaaagtgtttaagatgtgaaactgtgacagcaagggatgagacatttttagatttgagccttgatattgagcagaacagttcgattactagttgtctaaagaacttcagctccaccgagaccttaaatgctgaggataagttcttctgtgataaatgctgcagtttgcaggaagcacaaaagaggatgaagataaagaaaccgccacatattttggttatacatttgaagcgtttcaagtacatggaacaactgggcaggtacaaaaagttatcatatcgtgttgttttccctctagagctgaagctgaccaacacaatggaggatgcggattgtgagtactcactatttgcagtggtggttcatgttgggagcgggcctaaccacggacattatgtaagcctggtcaaaagccacaaccactggttgttctttgatgatgaaaatgtggaaatgattgacgagtctgctgttcaaacctcatttgggtctgctcaagagtatgctagcaacactgatcatgggtacatcctattctacgagagccttgctaccaacaatgatcattgaatggtattatatcatatcctttttttcagatatatgtttcttggttttgtgatatcatcatatagagcattttggggtcattagattataaaaaacttgagatgggtttgatgtacagttaacgctgctatttgagttcatctgtttttaatagaaacaataaaggtgcttatgatgatgac

SEQ ID NO: 5074 - DNA, 1556 bp, Brassica rapa
aattaaatcgatcctctttcgcactgagagagagagagagagagagagagagggctcctggagaattatccgatcgaatcgaatcgaatcgaaaaataggcagaggagataaggattaggatacggcagtcttgttgagggaggggtgatgggggcggcggggtcgaaactggagaaagctctgggcgaccagttcccggaaggagagcgctacttcggcttcgagaatttcggcaacacttgctactgcaacagcgttttgcaggctctttatttttgtgttccctttcgtgaacaattgcttgaatactacaccagtaataaaagcgtcgctgatgctgaagagaatcttatgtcttgcctcgctgacttattttctcagataagttctcagaagaagaaaacgggtgttattgcgcctaagcgatttgtacagaggttgaagaaacagaatgagctcttccggagttacatgcaccaggatgcacatgaattcctcaactatttgctgaacgaagttgttgacatactggagaaagaggctaaagctacaaacactgaacataaaacttcatcatcttcatcatctcctgaaaagattgccaacggaccaaaagctcctctggctaatggcgtgcacaaagagccagttgttacctgggtgcacaacatttttcagggcatacttacaaacgagacaaggtgtctgcggtgcgagactgtgacagcaagagacgaaacgttcctggatctaagccttgatattgaacagaacagttcgataactagctgtttgaaaaacttcagctccacagagactcttcactctgaagacaagtttttctgtgacaaatgctgcagcttacaagaagcacagaagaggatgaagatcaagaagccgccacacatcttagtcatccatctaaaacggttcaaatacatggaacagctaggccgctacaagaagctctcttaccgagttgtcttccctttggagctaaaactgagcaacacggtggagccatacacagacgtcgagtattcgctctttgctgtggtgtttcatgtggaaagcggaccgaaccatggccattacgtaagcctagtgaagagccataaccattggctcttctttgatgatgagaacgtggagatgattgaagaatcagcagtgcaaacattctttggatcgtctcaggagtactcgagcaacactgatcatggttacatcttgttctatgagagccttggaccaaccaagtaaaggccgagtaagaggaaaacatcagaaaggactttgtttgttccttaactattagtaatggtatatgtttgggacttaaaagccaacaattcctttgacagttactctttttgtttgactttctctatctctttctcccaaagatattttggtgagtttttaaattggaaatgtttttatttaaagtgaaacctgtaaactttgaaaggccatgtacagtttactggcaaataatccaggaataataatatacattatattgaatttacttgagttacatattatgttttct

SEQ ID NO: 5075 - DNA, 1795 bp, Sesamum indicum
tcacgggggggcgcttaaatagtggatccccgggctgaggaatcggacgaggatcttcccctgatcttcatcgaaatatagatgatatatcagattttcacctttttctccttttttcgtatatttagaatccttaatttcaatcttttttcgctattttacaactccaattttggttcgaaaatatttttaatctctctcaataaaaccctaaagatccagaagcacaacccgtattacacgcacgaagtcagtttttagttgtatagaaatataggcataggcagatagatatagagagagtagagagggagagagaaagtggaggaggattggatgaagtgagggaagaatgggagcagcgggttcgaaactggagaaagcattgggcgaccaatttcctgaaggcgagcggtattttggtctcgagaatttcggcaatacttgttactgcaacagcgtgcttcaggctctttatttctgcgttccatttcgtgagcagttgcttgagtattattcgaataacaaaaatcctgcagatgtagaagaaaatctcttgacatgcctagcagacttgtttttgcagataagctcgcaaaagaagaaaactggtgttcttgctccaaaacgttttgtacagcgtctgaagaagcaaaatgaaatttttcgcagttacatgcaccaggatgcccatgaattcctaaactatttgctaaatgaactggttgacatactggagaaagaggctcgagcatccaagagtgatcaagaaatttcccataaaattgctaatgggcctacaactatatcttcaaatggtcctcaaaaggagcctctgatcacctgggtgcacaagaattttcagggtatattgacaaatgaaactaggtgcttgcgctgtgagacggtgacagcaagagatgaaacgtttcttgacctgagccttgatatagatcagaacagttcaattacaagctgtctgaaaaactttagctccactgaaactttaaatgctgaggataaattcttttgtgataaatgctgcagcttgcaagaagctcaaaagagaatgaagattaaaaggccacctcagatcctggtcattcatttgaagagattcaagtacattgaacagctaggccgttataagaagctatcataccgagtcgtcttccctcttgaactaaaactcagcaacacagttgaggatgctgacgccgagtattccttgtttgctgtagttgtccatgtggggagtgggcccaaccatggccactatgtcagcctcgtgaaaagccacaaccattggttattctttgatgatgaaaacgtggagatgattgatgagtctgctgttcaaaccttctttggatcagctcaagagtattccagtaatacggatcatggatacatcctattctacgaaagactcgcagccagtagcacaagctaagaggaggctttccaattctcacaggacccagtatttccaattttgagcacattataattcctgttctttcgtgttctttcttgatcttcacccttttgttgctgcattttgatgggaaaaattttctgatgtgtctagcaggttgagatgaaagtggagagtatatttacttagttgttgcccttgtatagtggagagtgcaaggtcactgtcctttattttccaacaataaagggggaagatgtagtgtatatgactctctacctaccacagattgtatatcgtattctgtgtccaaactacagagcccattgtctttaaattttgtcagcaaatgttgcc

SEQ ID NO: 5076 - DNA, 1251 bp, Arnica chamissonis
gcgacggggtctaagctcgagaaagctctaggagaccagtttcctgaaggcgaacgatattttggactagaaaacttcggcaacacttgctattgtaacagcgtcctgcaggctctatatttttgtgtcccatttcgcgagcaattacttgaatattatggaaatattaaaaatccaggggacattgaagaaaatctccttacatgtttggcagaactgtttatgcagattagtacacaaaagaagaaaacgggcgttattgctccaaaacgctttgtacaaagagtgaagaaagaaaacgagcttttccgtggttacatgcatcaggatgcacatgaatttttgaatttcttgttaaacgaactagttgacatactagagaaagaagccaattcatcaaaaggttcaaaagaacattcatcacctcctgaaaagattcctaatgggatacatgttgctcaggccaatggtgtacggaaggaacccttggttacctgggttcacaaaaactttcagggtatacttacaaacgaaacaaagtgtttaagatgtgaaactgtgactgcaagggacgagacttttttagatttgagccttgatattgagcagaacagttcaattacaagttgtctaaagaacttcagctctactgagaccttaaatgctgaggataagtttttctgtgataaatgctgcagtttgcaggaagcacaaaagaggatgaagataaagaaaccgccacgtattttggttatacatttgaagcgtttcaagtacatggaacagctgagcaggtacaaaaagttatcatatcgtgttgttttccctctggaactgaagctgaccaacacaatggaagatgcggattgtgagtactcgttatttgcagtggtggttcatgttgggagtgggcccaaccacgggcattacgtaagtctggtcaaaagccacaaccactggttgttctttgatgatgaaaatgtagaaatgattgatgagtctgctgttcaaacctcattcgggtcagctcaagagtatgcaagcaacactgatcatgggtacatcctgttctatgagagccttgctaccaacaatgatcattgaatggtattttcagattcttgtttcttgggtttttgtgatatcatatgttagagcaatttggggtcactagatgggaagaaacttgagatgggtttgatgtacagttaatgctgctatttgagttcatctgtttttactagaaacaat

SEQ ID NO: 5077 - DNA, 1625 bp, Avena sativa
ccaaaccatccatccaatccaatttcctcctcctgttccaacctccaccgatcccagcggcgataccgatactagcccgcgtcgcaatcgccgagccgagccggcagtgaggccgatccgtcgaagcgcaggggccggcgggcaaatgggagttgctgggcgggggaggcggcggtgatgggcgcggcgagctcgaggctggagaaggcgctgggcgagcagttccccgagggcgagcgctacttcggcctcgagaacttcggcaacacctgctactgcaacagcgtcctgcaggcactttacttctgtgttcctttccgtgagcaattactggagtactatgctaacaataaaagcaccggagatggtgaagagaacatgttaacctgtttagctgacctcttctctcagataagcaaccagaagaagaaaacaggtgtaattgctccaaagcgttttatacaacgattaaagaaacaaaatgagcttttccgcagctatatgcatcaggatgctcatgaatttctgaattttttgcttaatgagctagttgacattcttgagaaagaatgtaatgctgctaaagaacctcctcaaaattcctcctcgaataagaatttgaatggtcctgttaatggtcaagcaaatggtagtcataaagaaccggatactacttgggttcacaaatgcttccagggaatattgactaatcaaacaagatgcctgagatgtgaaaccgtcactgatagagatgaaacatttcttgaccttagcctggatatagagcagaatagttcaatcaccagctgtcttaaaaacttcagttcaacagaaactttaaacgccgaggataagttcttctgtgacaaatgctgtagtttacaagaagcgcagaaaagaatgaagataaagaaaccaccaaacatcctggtgattcatctcaagcgcttcaagtacatcgaacagctcggccgctataaaaagctatcatatcgagttgttttcccactggagcttaaactcatcaacactgtcgataattcagacttggaatattccctttttgctgtgctagttcatgtcggaagtggcccaaatcatggccattacatcagcttggtgaagagccacaaccactggttgttcttcgatgatgagaatgttgagatgactgatgagtccatggtacagacattctttggctcagcacaggagttcagtggtaacaccgataacggctacatactcttctacgaaagtgtagctaaaacaaattgatgccttccacatatctcgtgattagttacacagtttccttttgacaccttcctgctctgggctatatagaagattcggtaaattagaataagttgaatgcaagacaattcaactttagatgttatggtgaaatcagtatttagcaataaactgtggacgacttttctgggcaagtactatagccacagaagcctacagttttcttggttgtcttttgtcatttggtttatggctcaagtttgtaacaatcttggaataatgttgttaagaaacttatcatgtaaagagagacgcctgtatcttcaagccttttggctttgagtgaaattttggttggtagagcttct

SEQ ID NO: 5078 - DNA, 1280 bp, Silene vulgaris
gtgagagagaggataaaggtgggtgaatgaggtggtgatgggtgctgcaggttcgaaacttgagaaagctcttggtgagcaatttccagagggtgaacgttattttggtttagaaaattttggcaatacttgttattgtaacagtgttttacaggctttatatttttgtgtcccgttccgggagcagttgctagaatactatacaagtaacaaaaatacggttgacgctgaggagaatctcctgacctgcttggctgacctgttttctcagataaattcgcaaaagaagaaaacaggggttattgctcctaaacgctttgtccagagattaaagaaacaaaatgagcttttccgcagctatatgcaccaggatgcccatgaattcttgaactttttgctgaatgaacttgttgacatactggaaaaagaggcaaaggctgctaaaagtgatcaagaaactgtctcatctgagaaacttgcaaatggaccaggaagtgtccaggttaatgcccctcagaaggaacctctcgttacttgggtacacaaaaattttcagggaattttgacaaatgaaacaagatgtttgcggtgcgagacagtaaccgcaagggatgaaactttttttgacttgagccttgatattgaacagaacagttccatcacaagctgtctcaaaaatttcagttctactgaaaccttaaatgctgaagacaaattcttctgtgacaaatgctccagtttgcaggaggcacaaaagaggatgaagattaaaaagccaccccatatcctagtcatccatctgaagcgtttcaagtatatcgaacagctagggcgttacaagaaactatcctacagagttgttttccctcttgagctaaaactgagtgaaaccgtggaagacacagatagagaatactcgttgtttgccgttgttgttcatgtcggtagtgggccaaccatggacactatgtaagcttggtgaaagccataaccactggctgtttttgacgtacgagaatgtggagatgatcgatgagtctgctgtacagacgttcttcgggtcatcacaggagtactctagtaacaccgaccatgggtacatcttgttttacgagtcccttgctaatattaacttgagctaggcctagtagttagtattgtcatatttaggactgatttattttctcaaattttgatattattaacactttgtattctgttcttccttttcgacaatcggaaggagataatcataatttttaggctgtggaaatgtatac

SEQ ID NO: 5079 - DNA, 1703 bp, Lactuca sativa
ggcggggacttggaagatcaagggggcagagaggagtgtttgataaaataaagaaacccgatcaaactgtttcggattcttcacgctttctctttgaaatgtccggttttctaatataaaccctaaccgattgcacataaaatctattttccagcgtgtttgtatgttatctcaagaaccctaggcaatagcatttcaatcaataacgaatttctctacaattgcaatatttttaccaaagttttctaggtttgattgaaggggttacgatagatataatagagagggaaagaaatagaggaattctggtatttggtggatggtctcatgggcgcagcggggtcaaagctcgagaaagctctaggagaccaatttcctgaaggcgaacgatatttcggactagaaaacttcggtaacacttgctactgtaacagcgtcctgcaggctctatatttttgtgttccatttcgtgaacaactacttgaatattatgagaaggttaaaaatccagatgtagaagaaaatctccttacatgtttggcagaactgtttacacagattagtacacaaaagaagaaaacaggtgttattgctccaaaacgctttgtacaaagagtgaagaaagaaaatgaacttttccgtggttacatgcatcaggatgcacatgaatttttgaactttttgttaaacgaactagttgatatactagagaaagaaacaaaaggtacaaaagaacattcatcacctcctgaaaagattcccaatggtatacatatgcctcaggccaatggtgtaagaaaggagcccttggttacatgggttcacaaaaactttcagggtatactcacaaatgaaacaaagtgtttaagatgtgaaactgtaactgcaagagatgagacattcttggatctaagccttgatatcgagcaaaacagttccattacaagttgcctaaagaacttcagttccactgagactttaaatgctgaggataagtttttctgtgataagtgctgcagtttgcaggaagcacaaaagaggatgaagatcaagaaacagccgcatattttagtgatacatttgaagcggtttaagtacatggaacagctgggaaggtataagaagctgtcataccgtgttgtgtttccacttgagctgaaactaacaaacaccatggaagatgctgactgtgagtactctttgtttgcggtggttgtccatgttggcagtgggcccaaccacgggcattatgtgagtctggtgaaaagccacaaccactggctcttttttgatgatgagaatgtggagatgattgatgagtcagcagttcaaacttcctttggttcagctcaggagtatgtaagcaacactgaccatggatacattctgttttatgagagccttgctggaaataataacaacatcacctgctgaatcaaattcaatcgtatgtttatttttatttttttgtgtttttgttttttttgtgatatggtaatggtatagaacattttgggttagatgaggatgagaggatggatgggtttgatgtacagttgatatatgctgctgctgctgatatttgacttcatctgttgttagtgacacaataaagctactttgcttgttttcttttttatatgtattatgtacttgagactttaaacccctgcctatcatattcatatcatcatcattgataa

SEQ ID NO: 5080 - DNA, 1526 bp, Papaver somniferum
taagcttgagaaagctttaggtgatcagtttcctgaaggtgaaagatattttggtcttgagaattttgggaacacttgctactgtaactccgttttacaggcgctctatttttgtgttccgtttcgtgaacagttgcttgaatattatgcaaataacaaaaatcctggtgatccagaagagaaccttttgacatgtttggcagatttgttcactcagataagttcacagaagaagaaaactggtgtcattgctccaaagcgctttgttcagagagtgaagaaggaaaatgagctattccgcagctacatgcaccaagacgcacatgaatttttgaacttcttgctgaacgagcttgttgacatactcgagaaagagtcacgcgctgcagctgccaagaattctccagaaacttcttcaccacctgaaaagactgcaaatggtccaaagagcttgcaggtcaatggtgttcacagagaacctttggtcacctgggttcacaaaaattttcaggggatattgaccaatgagacaaggtgcctacggtgtgagacagtaaccgcaagagatgaaacatttttagacttgagtcttgacatcgagcaaaacagttccatcacgagttgtctaaaaaatttcagttccacggagacattgaatgctgaggataaattcttctgtgacaagtgctgcagtctgcaggaggctcaaaagagaatgaaaattaaaaagccacctcaaatccttgttatccatctaaagcgcttcaagtacattgagcaactcagtcgatacaagaaactgtcttatcgtgttgtttttccgttggagctgaagttgagtaatacagtagaggatgcagattcggagtactctctatttgctgtggttgttcatgtaggaagtgggccaaaccatggacattacgtaagtcttgtgaagagccacaaccattggttattctttgatgacgagaatgtagaaatgattgatgagtcagcggttcagacattctttgggtcagcgcaggaatacacaagcaacacagatcatgggtatatattattctatgaaagggttggtactactacaatgtctacaactagttctagccagacatgagaggtgtgaagaattggtcaattcggcgatgtttgtattctcttggttctttattttgagcagaggtggtgtgtttcttatctccatatataaaatcttccagtctcttatactgcttcccttgtttaccctcccattttcttatataacatgcgggattaactctgaaagtctagatgatcagaagagatgtgaagatcaaaatagagaagaagagattcattgaggctattgctggttgttgatctatgtacagttgtggatggtagtggagaagctcactgtcctttgtgtgtacccctacaataagaaaccagaaacaaaagggtgtaaaagtttggtcttgagagagttggaccatgcaatttttattctcttttgtctttcactcttgagattaaactct

SEQ ID NO: 5081 - DNA, 1464 bp, Triphysaria pusilla
aattctgataccctaccaatatatacctaccaatatatacagagagaggagcgaagaggagaggatacgagtgtgtgcgcgtgaaggaggactggatgaagtgaggcaaggatgggagcagctggttcgaagctggagaaagcattgggggaccaatttcctgaaggcgaacggtattttggactagagaatttcggcaacacttgctactgcaatagcgtgcttcaggctctttatttctgtgttccattccgtgagcagcttctggaatattattccaataacaaaactcctgctgatgctgaagaaaatctcctaacatgcctagcagacttgtttttgcagataacctcacaaaagaaaaaaactggtgtccatgctcctaagcgttttgtacagcgactcaagaagcaaaatgagattttccgcagttatatgcaccaggatgcccatgagttcctaaactatttgctaaatgaacttgttgacatactggagaaagaagctcgagctactaagggtgatcaagaagttccccagaagatttctaatgggcctacaaatatatcttccaacagtcctcaaaaggagcctgtgatcacctgggtgcacaagaattttcagggtatactgacaaatgaaacgcggtgcttgtgttgtgagacagtgacagcaagggatgaaacgtttcttgacttaagcattgatatagaacaaaacagttcaattacaagctgtctgaaaaactttagctccactgaaactttaaatgctgacgataaattcttttgtgacaaatgctgcagcttacaagaagctcaaaagaggatgaagattaaaaggccacctcaaatattagtcatccatttgaagagattcaagtacattgaacaactgggccggtataagaagctatcataccgtgtcgtcttcccacttgagctgaagctcagcaacacggttgaagatccagatgctgaatattccttattcgctgtagttgttcacgttgggagtgggcccaaccacgggcactatatcagcctcgtgaaaagccacaaccattggctattctttgacgacgaaaatgtagagatgatagacgagtccgctgttcagacttttttcggatcagcgcaagagtattcaagtaatacggatcatggatacatcttattctacgaaagacttgttgctggcagcccaatctgagaggagaggtcttatgattatgtatttccaattttgacctcattgcttgcattcctgtgttttcttgttcttgtttggtcttcgcctcatggccttatgttcctttcgatggaatttggtgggaaaattttatgatatacaagcagattgatatgaaatttgatgtccttcatatgattatgtgctatataaagattgtgtaattgtatttttatatcgaaagttcgaaactgcgaaaaaaaaaaaaaaaaa

SEQ ID NO: 5082 - DNA, 1577 bp, Raphanus sativus
  misc_feature (28)..(28): n is a, c, g, or t
  misc_feature (89)..(89): n is a, c, g, or t
  misc_feature (232)..(232): n is a, c, g, or t
  misc_feature (831)..(831): n is a, c, g, or t
  misc_feature (873)..(873): n is a, c, g, or t
  misc_feature (953)..(953): n is a, c, g, or t
  misc_feature (1033)..(1033): n is a, c, g, or t
  misc_feature (1382)..(1382): n is a, c, g, or t
  misc_feature (1451)..(1451): n is a, c, g, or t
gggctttataatattccacaagaggggngttaaaatcgatcctccttcctccgcccactctgagagaatcaatcatcggatcgaatcanacaaatacgcagagattacgacgaaatcaatctcctgtcggaccagatcagagaaaacggtgatacggagggtagttctagggctgatgggcgccgcggggtccaaactcgagaaagctctcggcgaccagttccccgaaggngagcgctacttcggcttcgagaatttcggcaacacttgttactgcaacagcgttttacaggctctttatttttgtgttccgtttcgtgaacaattgctcgagtactataccagcaataaaagcgtcgctgatgctgaagagaatcttatgacttgcctcgctgacttattttctcagataagttcccagaagaagaaaactggcgttattgcgcctaagcgattcgtacaaaggttgaagaaacagaatgagctgttccggagttatatgcaccaggatgcacatgagttcctcaactatttgctgaacgaagttgttgacatcctggagaaagaggcaaaagctactacaaaacctgaacgtgaaacctcatcgtcatcgtcccctgagaagatcgcaaacggaccaaaagctccccaggcgaatggtgttgtgcacaaagagccagttgtcacttgggtccacaacatttttcagggcatacttaccaacgagaccaggtgtctgcgatgcgaaacagtgacagcaagagacgaaacgttcctggatctaagccttgacatcgagcagaacagttcgataactagctgtttgaaaancttcagctcaacagagactcttcacgccgaagacaagttctnctgtgacaaatgctgcagcttacaagaagcacagaagaggatgaagatcaagaagccaccacacatcttagtgatccatntaaaacggttcaagtacatggaacagctagggcgttacaagaagctctcttacagagttgtttccctctggagctaaaantgagcaacacggtggagccgtacacagacgtggagtactcgctctttgcggtggtggttcatgtgggaagtggaccgaaccatggtcactacgtgagcctggtgaaaagccataaccattggctcttctttgatgatgagaacgtggagatgattgaagaatcagctgtgcaaacgttctttgggtcgtcgcaggagtattcgagcaatactgatcatggctacatcttgttctatgagagccttggaccaccaacaaagtgaaacagctgagagcagccttggaccaccaccaacaaaggacgacgttcttgggttatttttctttaactactagtgatggtatatgnctctctctatatatgtttgtgacttaaaagtcattcaaattgacagttactttttattgacttactctntctctctctctctcccaaagatacatatttggtgagtttaaattgaaagttttttcctcttttaaactttaaaatctgtaaactttgaaaggccatgtacagttaatggcaaataaatccttgcca

SEQ ID NO: 5083 - DNA, 1404 bp, Utricularia gibba
ggagaatctgatatacatgcggacaggagcgcggtggcgagagagggagagagtgatcggatgaagtgacggttaagtatgggtgcgacgggttcgaagctggagaaagcgttgggcgaccaatttccggagggcgagcgctactttggactagagaattttggaaacacgtgttactgcaacagcgttcttcaggcactatatttctgcgttccatttcgggaacagttgctggagtactattcaactaacaagggtcctagtgacgcagaagaaaacctgttaacatgcttagcagacttgtttttgcagattagtacacagaagaagaaaactggtgttcttgctccaaaacgttttgtacagcgcctgaggaagcaaaatgagatttttcgcagttacatgcaccaggatgctcacgagttcttgaattacttactgaatgagctagtcgacatagtggagaaagaagctggagctgtcaagagtgatcaagaaacttctcaaaatattgccaatgggccgaaaaatggagtatccaatggccatcataaggagccccttattacctgggtgcacaagagtttccagggattattgacaaatgaaacaagatgcttgtgctgtgaaacagtgacagcacgagacgaaacatttcttgacttgagcctcgatattgagcaaaatagttcaattaccagttgtcttaaaaacttcagctccactgaaacattgaacgctgaggacaaattcttctgtgacaaatgctgcagcttgcaggaggcccaaaagagaatgaagatcaaaaggccaccccaaatcctcgtcatacatttgaaacgattcaagtacatagaacagctggggcgctataagaaactctcctaccgtgttgtatttcctatggagctaaaactcagcaacacagttgaagatgcagatgctgagtactccttgtttgctgttgttgtccatgtgggaagcggacccaaccatggtcactacgtcagccttgtaaagagccacaaccactggttgttttttgatgacgaaaacgttgagatgattgacgaatcagccgttcaaacattctttgggtcatcccaggagtactccagtaacacagatcatggctacatcttgctctacgaaaggcttgttgccagtaccagctcatgagaagaggaagcctagccaccccattgtcagcctaattttgaggaatcttgctccatcactatactctttttttctttcctccactgcaagtgcaccttttcaagtggttctttcttttaaatgtgtatgtggagagatctgatgcattcaagctgtgttctttagaaacattgtatagtgaaagatgctgcttcggtttcaaataaagagggaagattgatattg

SEQ ID NO: 5084 - DNA, 1743 bp, Brachypodium distachyon
aggggtttggtctgatgacactccagtcctgtagcggcagcggcacacctttattacatttcgcccgtttcttcccgtcctccaaccatccgtttcctcctccctccctccctcctctgctccagccttccgccgatcccaacccatcgagagcgcccccgcgatactagccgagtcgcatcgcatcggagccaccgacgagccggcggtgacgtccgccgatccgccgcggcgggcaaatgggagttgggcggccgcggtgatgggcgcggcggggtccaggctggagaaggcgctgggcgagcagttccccgagggcgagcgctacttcggcctcgagaacttcggcaacacctgctactgcaacagcgtcttgcaggcactttacttctgtgttcctttccgtgagcaattactggagtactatgcaaacaataaaggcgccggagatggtgaagagaacatgttaacctgcttagctgacctcttctctcagatcagcaaccagaagaagaagacgggggttattgctccaaagcgttttatacaacgactgaagaaacagaatgagcttttccgcagctatatgcaccaggatgctcatgaatttctgaattttttgctgaatgagctagttgacattcttgagaaagaatgtaatgccactaaagaacctcctcaaaattcctccttgcaaaagaattcaaatggccctattaatggtcagcccaatggtagtcacagagaactggatactacatgggtccacaaatgcttccagggaatactgactaatcaaacaagatgtctcagatgtgaaaccgtcactgatagagatgaaacatttcttgacctgagcttggatatagaacagaatagttcgatcaccagctgtcttaaaaacttcagctcaacagaaactttgaatgctgaggataagttcttctgtgacaaatgctgcagtttgcaagaagcacagaaaagaatgaagataaagaaaccaccaaacatcctggtaattcatctcaagcgcttcaagtacattgagcagcttggccgctataaaaaactatcataccgagttgttttccctctggagcttaaactcatcaacactgtcgacaattcagacttggaatattccctttttgctgtgttagttcatgttggaagtgggccaaatcacggccattacatcagcttggtaaagagccacaaccactggttgttctttgatgatgagaatgttgagatgactgatgagtccatggtgcagacattctttggctcagcacaggaattcagtggtaacactgataatggttacatactgttctatgaaagcgtagctaaaacaagttgatgcatttctcacatctcgcaattagttacacagttttccttttgttatcacacttcctactctgggctatatagaagattcagtatattagaataagttgaatgcaagaccgttcaactttagatgttatggtggattcagcatttagcaataataataaactgtggcaagttttgggtaatatagccgcagaactccacagttttgtttttgttttcttgttatttggttcatagtacaagttgtatcaatcttggaataatttttgttaaagacatttatcatgtaaagtgagatgtttgtatctggaagccttttggcttttgagtaaaattttgtccgagagagcctctgacctgatatgcgtggaccttaaaaaa

SEQ ID NO: 5085 - DNA, 1839 bp, Oryza sativa
aacgaagtaggtcggtttttctttctcaaaaaaggaaaagatatatacacgtcagaattcccggacacgggagctcggaaatacgccttttactggtccttccccctctactctcccttcctccccctgaccatccatccgttcctccgatcagttccaacttccaacctccgatcccaacgagaaaaccaatactgacacctctgcctcgcaacgcggcgcgcggccgtgctgcgatcgatcgaccggccggagtccggcatgcaaatgggagctgcctggcgcgggcggcggcggcggtgatgggcgcggcgagctctaggctggagaaggcgctgggcgagcagttccccgagggcgagcgctacttcggcctcgagaacttcggcaacacctgctactgcaacagcgtcctgcaggcactttacttttgtgttcctttccgtgagcaattactggagtactatgcaaataataaaagcaccggagatgtcgaagacaatatgttaacgtgcttagctgacctgttctctcagatcagcaaccagaagaagaaaacaggtgttatcgctcctaagcgtttcatacaacgactgaagaaacaaaatgagatttttcgcagctatatgcaccaggatgcacatgaatttctgaattttttgcttaatgagctagttgacatcctagagaaagaatctaaagttgttgcagaaccttgtgaaaattcctctttgaaaaagaattcaaacgggcctataaatgttcaactcaatggtactaaaaaagaaccagttcctactttggtccacaaatgcttccagggcatattgactaatgaaacaagatgtctaagatgtgagactgtgactgatagagatgaaacgttttttgacctaagtctggatattgaacagaatagttcaattaccagctgtcttaaaaacttcagctcgactgagactctgaatgctgaggataagttcttctgtgacaaatgctgcagtttgcaagaagcacagaaaagaatgaagataaagaaaccaccaaacattcttgtaattcatctcaagcgcttcaagtatattgaacagcttggtcgctacaaaaagctatcatatcgagttgttttccctctggagcttaaacttatcaatactgttgacaactcagacttggaatattccctttttgctgtgctagttcatgttggaagtggaccaaatcatggccactatatcagcttagtgaagagccacaaccactggttgttcttcgacgacgagaatgttgagatgactgatgagtccatggtacagacattctttggctcagcacaagagttcagtggtaacactgataacggctacatactcttctatgaaagccttgctgaaaaaagttgatgtctctctcacatttttcgatagttatacagttatcattttattaccacactgcctgcacctgataatatagaagattcagtaattagaataagttgaatgaaagaccattcaactttagatattatatggtggaatctgcggtaggcaataaaagaaaatgacgagttttgtggaaggtgctatagcggcataaatccacaggtttcttgttttctgtttatttttctgttctttggtttatgcgtacaggttgtaccaatcctgggataatgtttatttaaagtttaccatgtataaaaatatgcttgtactggaagccgtttggctctgagtaatttttttttttgtttagaaacataaagctgatatgcatggtattctccgtcatctttcttttctgactgcttttgcatattcgtttaccgttgtactg

SEQ ID NO: 5086 - DNA, 1344 bp, Pinus pinaster
atattggcctgtatttgcatagaatcgtgcaacatattcgggcaaggatccatacgaatttccaatatataaaacagtggcattggtggcttatgataaatgggtaactccggttcgaaactggagaaggccctaggcgatcaattccccgagggcgagcggtatttcggcctggagaatttcggcaatacctgctactgtaatagcgttcttcaggctctctatttctgccctccatttagagagcatttgttggagtattatggccacaataagacaacggtggaagcagaggaaaatctcctgacatgcttggcagatctcttcactcagatcaactctcagaagaagaagacaggtgttattgctccaaaacgatttgtgcaaagggtgaagaaggaaaacgagctttttcgcagttatatgcaccaggatgcacatgagttcttgaatttcctgttgaatgagcttgttgatattttagagaaagaagctagtgcaaaccaaaaactgtcaggaagtttaacacagccagagaagaaaatgaatggttcaatcaatggcctagcaaatggttcccagcagccacctgttctcacctgggttcataaaatatttcagggaacacttacaaatgaaacaagatgcttgcgatgtgaaactgtaactgctagggacgaaacatttttggatcttagtcttgacatagaacagaacagttccatcacaagctgtctccgtaactttagttcaacatacatgcttaatgctgatgacaagttcttttgtgacaagtgctgcagtttgcaagaagcacaaaaaagaatgaaaattaagatcccccctcgtattcttgttattcacttgaagcgcttcaagtacattgaacaacttgggcgatacaaaaagctctcttatcgtgtggtcttccccatggagctgaagttatgcaatacaaccgatgacgcaccgggttcagattcagagtattcactatttgcagtcgttgttcatgttggcagtggtccaaatcatgggcactatattagccttgtaaaaagccataaccactggctcttttttgatgacgagaatgtagaaatgattgatgagtctgttgtgcaaacattttttggttcagcacaggagtactcaaacaacacggatcatggttatatcttgttctatgagagtctaaacaacaagctttgagacatccttcattggatgaaatttaggggatatatttagctcggagtgccaacgattcaattggttttggatgacttggaaatccgaaagctgcaatacagctcatgtatctttgaattagaattagagttt

SEQ ID NO: 5087 - DNA, 1367 bp, Lactuca sativa
cttaaggtgtgaggttgtcgaacccctgattaaggaccataaaagggtgcgtgccccggtcagtgtttacagcttggcaacaatcatgattcatgagtgacgatagcaaatttctgttttctcccctcaatttccaccaatcgcatctccgattttgtgcttcacatctcatttttcatctttcttgatgaacaaaccatgctcgtctagctactaagggtttggttgattctttcctttttcgctgattaagggtttggatgccttgaacaaatgggtgcagctggctccaaacttgagaaagctttgggcgaccaatttccagaaggcgaacgatacttcggtctcgaaaattttggcaatacgtgttactgtaacagtgtcttgcaggctctttatttctgtgttccatttcgtgagcaattgctagaatattattcaagcaacaaaagctttgctgatgcagaagaaaatctgttaacatgcctagcagacttgtttacacagataacttcacaaaagaagaaaacaggggtgattgctccaaaacgctttgtacagagattgaagaagcagaatgagattttccgtagctatatgcaccaggatgcccatgaatttttaaattatcttttaaacgaacttgtggacatactggagaaagaatcacgtgctgcaaagagtgatccagaatcttgttcatcttctgagcaaattcctaatggaataaagacttctcacatcaatggtcatgtaagagagccactcatcacatgggtgcacaagaatttccagggtatactcacaaatgaaacaaggtgcttgcgatgtgagacagtaacagcaagagatgaaaccttccttgacttgagccttgatattgagcaaaatacctcaattactagttgtttgaagaacttcagttccactgagactttaaacgctgaggacaaattcttttgtgataaatgttgcagcttgcaggaagcccaaaaaaagaatgaaagatcagaaccaccgcaaatcctagtcatccatttaaaaagattcaaatacatcgagcaactcgggcgttacaaaaagctctcataccgtgtggtcttccccctggagctcaaactaagcaacaccgtcgaagacacagacgccgaatattctcttttcgcggtggtggtccacgtcggaagtgggcccaaccacgggcactacgtgagcctcgtgaaaagccataatcattggttgttttttgatgatgaaaatgtggaaatgatcgatgagtcagctgtgcaaacttttttcgggtccgcacaagagtattccagcaacacggatcatggctacatcttgttttacgaaagggtcgatgt

SEQ ID NO: 5088 - DNA, 1250 bp, Mimulus guttatus
gaatgggtgcagcaggttcgaagctcgagaaagcattggggtgaccaatttcctgaaggcgagcggtattttggactcgagaatttcggcaacacttgctattgcaaacagcgtgcttcaggctctttatttctgtgtcccattccgtgagcagttgctagaatattattccaataacaaaaatcctgcagatgcagaagaaaatctcctgacatgcctagcagacttgtttttacagataagctcacaaaagaaaaaaactggtgttcttgctccaaagcgtttcgtacagcgactgaagaagcaaaatgaaatttttcgcagttacatgcatcaggatgcccatgaattcctaaactatttgctaaatgaactggtcgaaatactggagaaagaagctcaagctaccaagactgaaccagaaggttccgagaaaattgctaatggcccgacaaatatatcttccaacggttccccagaggagcccctgatcacctgggtgcacaagaattttcaggcaagtttcggtatattgacaaatgaaacaaggtgcctacgttgtgagacagtgacagcaagggatgaaacatttcttgacttgagcattgatatagaacagaacagttcaattacgagcaatctgaaaaattttagctccactgaaactttaaatgccgatgacaaattcttttgtgacaaatgctgcagcttacaagaagcccaaaagagattgaagatcaaaaggccacctcagatcctagtcatccatttgaagagattcaagtacatcgaacagctgggccgatacaagaagctttcgtatcgtgtcgtgttcccactcgagctaaaactcagcaacacagtcgaagacacagaagcagaatattccctcttcgccgtagttgtccacgtaggcagtggtcccaatcacggccactacatcagcctcgtgaaaagccacaaccattggttgttcttcgacgatgaaaacgttgaaatgatcgacgaatccgccgtgcagaccttcttcggatcagcccaagagtattccagtaatacagatcatgggtacattttattttacgaacgactaattactggtagcacgagctaagagacgaggcatcgatttcttttttttctcgcagaatccaatttattttacaattttgagaatgtttaatgaattttacctacctaatttttaatgttcgttcttgatgaaatttgatgtggaaatctttttggtt

SEQ ID NO: 5089 - DNA, 1651 bp, Mimulus guttatus
ggaaactcaataccctgatcttcctcatttagatatcgatagatacagatacatacattttccccttcttcctctctctctctctctctctctctatctctctctctcatttttccccttttccaattcaaaacccctaatttcaatcaattttttctccattctgaatctaatttgatctctctcagagctaaaccctagaaatcaccctgacgaaaatataggcgtacgtgtatacatacagatagatacagacgcggatgtattggatatagagagaggttcgaatgaagtgaggtaggaatgggtgcagcaggttcgaagctcgagaaagcattggggtgaccaatttcctgaaggcgagcggtattttggactcgagaatttcggcaacacttgctattgcaaacagcgtgcttcaggctctttatttctgtgtcccattccgtgagcagttgctagaatattattccaataacaaaaatcctgcagatgcagaagaaaatctcctgacatgcctagcagacttgtttttacagataagctcacaaaagaaaaaaactggtgttcttgctccaaagcgtttcgtacagcgactgaagaagcaaaatgaaatttttcgcagttacatgcatcaggatgcccatgaattcctaaactatttgctaaatgaactggtcgaaatactggagaaagaagctcaagctaccaagactgaaccagaaggttccgagaaaattgctaatggcccgacaaatatatcttccaacggttccccagaggagcccctgatcacctgggtgcacaagaattttcaggcaagtttcggtatattgacaaatgaaacaaggtgcctacgttgtgagacagtgacagcaagggatgaaacatttcttgacttgagcattgatatagaacagaacagttcaattacgagcaatctgaaaaattttagctccactgaaactttaaatgccgatgacaaattcttttgtgacaaatgctgcagcttacaagaagcccaaaagagattgaagatcaaaaggccacctcagatcctagtcatccatttgaagagattcaagtacatcgaacagctgggccgatacaagaagctttcgtatcgtgtcgtgttcccactcgagctaaaactcagcaacacagtcgaagacacagaagcagaatattccctcttcgccgtagttgtccacgtaggcagtggtcccaatcacggccactacatcagcctcgtgaaaagccacaaccattggttgttcttcgacgatgaaaacgttgaaatgatcgacgaatccgccgtgcagaccttcttcggatcagcccaagagtattccagtaatacagatcatgggtacattttattttacgaacgactaattactggtagcacgagctaagagacgaggcatcgatttcttttttttctcgcagaatccaatttattttacaattttgagaatgtttaatgaattttacctacctaatttttaatgttcgttcttgatgaaatttgatgtggaaatctttttggttcgtttttttagtatgattgtcttttagcaagttgagatgaaaatgtggagagagtgtatacacttagggttgttgtttaccttgtatagtttgatggggt

SEQ ID NO: 5090 - DNA, 1692 bp, Pinus taeda
ggtggtgtcttgcatccatccatcgtcctgacaaattccaccttgttacggccactcttatgtggagggcagacgaatccttaaccgggacattctgatcttgattctgtgaacattcctgctgaacatattggcctgtatttgcatagaatcgtgcaacatatgctggcaaggatccatacgaattcccaatatataaaacagtggtattggtggcttatgataaatgggtaactccggttcgaaactggagaaggcactaggcgatcaattccccgagggcgagcggtatttcggcctggagaatttcggcaatacctgctactgtaatagcgttcttcaggctctgtatttctgccctccatttagagagcatttgttggagtattatggccacaataagacaatggtggaagcagaggaaaatctcctgacatgcttggcagatctcttcactcagatcaactctcagaagaagaagacaggtgttattgctccaaaacgatttgtgcaaagggtgaagaaggaaaacgagctttttcgcagttatatgcaccaggatgcacatgagttcttgaatttcctgttgaatgagcttgttgatattttagagaaagaagctagtgcaaacaaaaaactgtcaggaagtttaacacagccagagaagaaaatgaatggttcaatcaatggcctagcaaatggttcccaccagccatctgttctcacctgggttcataaaatatttcagggaacacttacaaatgaaacaagatgcttgcgatgtgaaactgtaactgctagggacgaaacatttttggatcttagtctcgacatagaacagaacagttccatcacaagctgtctccgtaactttagttcaacatacatgcttaatgctgacgacaagttcttttgtgacaagtgctgcagtttgcaagaagcacaaaaaagaatgaaaattaagatcccccctcgtattcttgttattcacttgaagcgcttcaaatacattgaacaacttgggcgatacaaaaagctctcttatcgtgtggtcttccccatggagctgaagttatgcaatacaaccgatgatgcaccgggttcagattcagagtattcactatttgcagtcgttgttcatgttggcagtggtccaaatcatgggcactatattagccttgtaaaaagtcataaccactggctcttttttgatgacgagaatgtcgaaatgattgatgagtctgttgtgcaaacattttttggttcagcacaggagtactcaaacaacacggatcatggttatatcttgttctatgagagtctagacaacaagttttgagacatccttcattggatcgaatttaggggatatatttagctcggagtggcaacaattcaattggttttggatgacttggaaatccgaaagctgcaatacagctcatgtatcttttgaattagaattagagtttattttttttctggagtgaaagaaagggaatgcccctttatgatttcactgtgaaattgtacatgtgtaattttatatcgggaccgttatgatctttaataaagcccgtcattcaatttggcagataggtctgtttagattgtaagaattattaactgcaaactggaaccaagtcatatgagccagcataaatgattgcaatttgtctgaattaagggtat

SEQ ID NO: 5091 - DNA, 1675 bp, Picea glauca
tctcgtatccatccatcgcccgacaaattccaccttgtttcggcccctctgaagtggtgggcagacaaatcctgaactgggacattctgatcttgattctgtgaacattcctgtggaacaaattggcccgtatttgcataaaatcctgtcacatattcgaataaggatccatacggattcccaatatataaaacagtggcattcgcggcttatgataaatgggtagctccggttcgaaactggagaaggccctaggcgatcaattccccgagggcgagcggtatttcggcctggagaatttcggcaatacctgctactgcaatagcgttcttcaggctctctatttctgtctcccattcagagagcatttgttggagtattatggccacaataagacaacagtggaagcagaggaaaatctcctgacatgcttggcagatctctttactcagatcaactctcagaagaagaagacaggtgttattgccccaaaacgatttgtgcaaagggtgaagaagcaaaatgagctttttcgcagttatatgcaccaggatgcacatgagttcttgaatttcctgttgaatgagcttgttgatattttagagaaagaagccagtgcaaacaaaagactgtcaggaagtttaacacagccagagaagaaaatgaatggctcaatcaatggcctaacaaatggttcccaacagccacctgttctcacctgggttcataaaatatttcagggaacacttacaaatgaaacaagatgcttgcgatgtgaaactataactgctagagacgaaacgtttttggatcttagtcttgacatagaacagaacagttccatcacaagttgtctccgtaactttagctcaacatacatgctcaatgctgatgacaagttcttttgtgacaagtgctgcagtttgcaagaagcacaaaaaagaatgaaaatcaagataccccctcggattcttgttatccacttgaagcgcttcaaatacattgaacaacttgggcgatataaaaagctctcttatcgtgtggtctttcccatggagctgaagttatgcaatacaaccgatgatgcaccgggttcagatgcagaatattcactatttgcagttgttgttcatgttggcagtggtccaaatcatgggcactatgttagccttgtaaaaagccataaccactggcttttttttgatgacgagaatgtagaaatgattgatgagtctgttgtgcaaacattttttggctcagcacaggagtactcaaacaacacggataatggttatatcttgttttatgagagtctagaccacaaattttgagacatccttcattggatcaaatttaggggatatatttagctcgaagtgccaacaattcagttggttttggatgatgtggaagatccgaaagctgcaatacagctcatgtatcctttgaattagagtagagtttatttttttctaaagtgaaggaaagggaatacccctttatgatttcactgtgaaattgtacatgtgtaattttatatctggactgtcatgatcttcaataaaacccgtcattcaatttggcagacaggatgcctttgtttagattgtaagagttattaactgcaaactggaaccaagttatatgagccggcaccaatgattgcatattttgt

SEQ ID NO: 5092 - DNA, 1085 bp, Brassica rapa
gtgtctaataatgggcgtggcgggttcgaaactggagaaagcactgggcgagcagttcccggagggagagcgatactttggcttcgaaaacttcggcaacacttgttactgtaacagtgttttgcaggccctttacttttgtgctcccttccgtgaacagttgcttgaatactactccacaaataataagaatgtggagaatctcttaacctgcttggctgatttgttttatcagataagttctcagaagaagaagacaggagttattgctcccaagcgctttgtacagaggttgaagaaacagaatgtgcttttccggagttatatgcatcaggatgcacatgagttccttaattatttgctaaacgaacttgatgacatcttagagaaagaggcaaaaacggacaatgaaacttcatcaaatggaccgaaacttcttcaggaaaatggtgttcataaagagcctactgttacatgggtgcacaagatttttcagggtatacttaccaacgagacaaggtgtctgaggtgtgagacagtaacagcaagagacgagacattcctcgacctaagccttgatattgaacagaacagttccataactagctgtttgaacaacttctgctccaccgagactctacactctgaagacaaattcttctgtgacaaatgctgcagtttacaagaagcacagaagaggatgaagatcaagaagccgccacacatattagtcatacatctgaaacggttcaaatacattgaacagttgggtcgctacaagaagctatcatacagagtagtcttcccactggaactgaaactggacaacacagtggaagaatacgcagacatcgagtactctctctttgcagttgtggttcatgtcggaaccggtcccaaccacggtcactatgtaagcctcgtgaaatcccataaccattggctcttcttcgatgatgagaatgttgaaatgatcgaagagtctgctgttcaaacattctttggttcgtcacaagagtactccagcaacactgatcatggctacatcttgttctatgagagactcggaacaagatagaggcttt

SEQ ID NO: 5093 - DNA, 1365 bp, Saccharum officinarum
tcgcaacagtttcactgtctcgcaccgccgagccggccagaacagcgacaggcccctcgcgccgatcgccgggcaatgggagctgggcgggggcggtgatgggcgcggcgggctccaggctggagaaggcgctgggcgagcagttcccggagggcgagcgctacttcggcctcgagaacttcggcaacacctgctactgcaacagcgtgctgcaggcactttatttttgtgttcctttccgtgatcaattgctggagtactatgcaaacaataaaaacaccggagatgttgaagagaacatgctaacctgcctggctgatctgttctctcagatcagtaatcagaagaagaaaacaggggttattgctcctaagcgttttatacaacgattaaagaaacagaatgagattttccgcagctatatgcatcaggatgctcatgaatttctgaattttttactgaatgagctagttgacattctagagaaggaacataatgctgcaagagagtctcttcaaaatctctcgttcccaaagaattcaaatggtcctattgatggccaacccaacggtagtcacaaagaattagctgccacatgggttcataaatgcttccagggaatattgactaatgaaacaaggtgtctgagatgtgaaactgtgactgatagggatgaaacattttttgacctgagcctggacattgaacagaatagttcacttaccagctgtcttaagaacttcagctcaacagagactttgaatgctgaggacaagttcttctgtgacaaatgctgcagtttacaggaagcacaaaaaaggatgaagataaaaaaaccaccaaacatcctagtaattcatctcaagcggttcaagtatattgagcagcttcagcgctacaaaaaactatcataccgagtggttttcccactggagcttaaacttcttaacacagttgataatttggacttggaatactccctttttgctgtggtagttcatgttggaagtgggccaaatcatggccactatatcagtttggttaagagccacaatcattggttattctttgatgacgagaacgttgagatgactgatgagtccatggtacaggcattctttggctcaccgcaggagttcagtggtaacactgataatggctacatactcttctatgaaagccttgctgaaagaagttgatgtcctcataccatgtgattagttatacaattttgttttccttccatttctgctggggatatatagaatattcagtgaaaagtagaataagctgaatgagaggccttcagcttcagatgttatggtacaatcaacacttggcaataaaacaagtttcctggagggg

SEQ ID NO: 5094 - DNA, 958 bp, Avena sativa
cgtcccgaggcgaacgctacttcggcctcgagaacttcggcaacacctgctactgcaacagtgtactccaggcacttttatttttgcactccgttcagggagcaattactggaatattatacgaacaacaaaatcctggagatgcagaagaaaatcttttgacttgcttagcggatcttttcatgcaggtaagtcagtccaagaaaaagacaggtgttattgctccaaaacgttttgtccaaagagtgaagaaacagaatgagttgtttcgaagctacatgcaccaggatgcacacgagttcttaaattttctgttgaatgagcttgttgatattctggagaaagaatctagtgctgcgaaggactcaccccaatcatcatctcctgaaaaagttccaaatgggatagttcaacctttggcgaatggagttaggaaagagccacctgttaccttggtccataagaattttcagggcatactgaccaatgaaactagatgcttgagatgtgagacagtaaccgcaagggacgaaacattttttgatctgagtgttgacattgagcagaatagttccatcacaagctgcctgaaaaatttcagctccacagaaactttaaatgccgaggacaaattcttctgtgacaaatgctgcagtttgcaagaagcacagaagagaatgaagatcaagaaggctccccaaatattggtgatccacctaaagcgttttaagtacattgagcagcttggacggtataagaagctctcatatcgtgttgtattccccatggagctgaagatcggtagtacatctgatgatgtagatactgagtactctctctttgctgtcgtggtccatgttggaagtggccccaaccatgggcattatgtcagccccgtgaaaagccacaaccactggttgttctttgatgacgaaaatgtggagatggttgaagagtc

SEQ ID NO: 5095 - DNA, 1854 bp, Setaria italica
gcgttgccgatccgtagcttaatctgagccgtggaattaaagattcagccatgacgaaagaggccggctggacaggccgaaaaccaggcatagcgatgtccacttcggggcatttgtgtctttgggtttggcccatttcttcgttggcttcccccatcctcgtgtgttcttcctcctttctttcctcccctgttccaacctccccaatcgcaacagtttcactgcgccagtacaattcctgccccgcaccgcccgagccaggccagaacagcgacaggccctcgcgccgatcgcgccgagccagccgcgcgggtgccggcgggcaatgggagctgggcggcggcggtgatgggcgcggcgagctccaggctggagaaggcgctgggcgagcagttccccgagggcgagcgctacttcggcctcgagaacttcggcaacacctgctactgcaacagcgtcctgcaggcactttatttttgtgttcctttccgtgatcaattgctggagtactatgcaagcaataaaagcaccggagatgttgaagagaacatgctaacctgcctggctgatctgttctctcagatcagtaatcagaagaagaaaactggagtcattgctcctaagcgttttatacaacgattgaagaaacagaatgaaattttccgcagttatatgcatcaggatgctcacgagtttttgaattttttactgaatgagctcgttgacattctagagaaggaacataatgctgcaagagagtcccttcaaaatctctcattgcaaaagaattccaatggccctattaatggcctacccaatggctgtcacaaagaatcagctgctacatgggtccataaatgcttccagggaatattgactaatgaaacaagatgtctgagatgtgaaactgtgactgatagagatgaaacattttttgacctgagcctggacattgaacagaatagttcaatcacgagctgtcttaagaacttcagctcgacagagactttgaatgccgaggataagttcttctgtgacaaatgttgcagtttacaggaagctcagaaaagaatgaagataaagaaaccaccaaacatcctggtaattcatctcaagcgtttcaagtatattgagcaacttcagcgctacaagaagctatcatatcgagtggttttcccgctggagcttaaacttctcaacactgttgacaactcagacttggaatactccctttttgctgtggtagttcatgttggaagtgggccaaatcatggccactatatcagcttggttaagagccacaatcattggttattcttcgatgatgagaatgttgagatgactgacgagtccatggtacaggcattctttggctcaccacaagagttcagtggcaacactgataatggctacattctcttctatgaaagccttgcagaaaaaagttgatgtgcttctgataccatgtgattagttatatacttttcctttccttccgacgcttccttcgcctgatgatataggatacgcagtgcaaagtaaaaactagaataagcagaatgtgaggccgtttagcttcaaatgttaggttgcaatcaactcttggcaataaaacaagtttcctggaagggctgtaggctataggtgcagaggcccgctagtttgtacttcctatttctttcatctagttctttgcatacaggctgtatcaattccagaataatgcttgttgaaaacttttatagtcatgtaaagagagatgctatcttggaaaccttctggctgaaggtaaaaattttgtttcttgagatgaaaagctcgtaccgatcctcgtgggatcctcaacagcttttc

SEQ ID NO: 5096 - DNA, 1785 bp, Zea mays
gccaaccggcaaccgccatccgattcacgtagtttgatcttaaccgtcggattaagattttgacttgacgaaacggatcggttggacaggccgaaaccgcgacgtccacttcggggcatctgtgtcttttgggtttggcccatttcttcgcttccttccgcaaccgcaaccgtgcgttcctcccccgttccaacccccgacaccccccaatcgcaacagtttcactgcgccacagtacaaatcctgtctcgcaccgccccagccggccagaacagcgacaggcccctcgcgccgatcgccgggcaatgggagctgggcgggggcggtgatgggcgcggcgggctccaggttggagaaggcgctgggcgagcagttccccgagggcgagcgctacttcggcctcgagaacttcggaaacacctgctactgcaacagcgtgctgcaggcactttatttttgtgttcctttccgtgatcaattgctggagtactatgcaaacaataaaaacaccggagatgttgaagagaacatgctaacctgcctggctgatctgttctctcagatcagtagccagaagaagaaaacaggggttattgctcctaagcgttttatacaacgattgaagaaacaaaatgagattttccgcagctatatgcatcaggatgctcatgagtttctgaattttttactgaatgagctagttgacattctagagaaagaacataatgctgcaagagagtctcttcaaaatctctcactccaaaagaattcaaatggccctattgatggccaacccaatggtagtcacaaagaattagctgtcacatgggttcataaatgcttccagggaatattgactaatgaaacaaggtgtctgagatgtgaaactgtgactgatagagatgaaacattttttgacctgagcctggacatcgaacagaatagttcactcaccagctgtcttaagaacttcagctcaacagagactttgaatgcagaggacaagttcttctgtgacaaatgctgcagtttgcaggaagcacaaaaaaggatgaaaataaaaaaaccaccaaacattctagtaattcatctcaagcggttcaagtatattgagcagcttcagcgctacaaaaaactatcatacagagtggttttcccactggagcttaaacttcttaatacagttgataattcggacttggaatactcccttttcgctgtggtagttcatgttggaagtgggccaaaccatggccactatatcagtttggttaagagccacaatcattggttattctttgatgacgagaacgttgagatgactgatgagtccatggtacaggcattctttggctcaccgcaggagttcagtggtaatactgataatggctacatactcttctatgaaagccttgctgaaagaagttgatgtccttctcataccatgtgattagttatacactttcctttcccttccatttctgctggggatatatagaatattcagtgaaaaccagaataagctgaatgagaggccttcagcttcagttggtatggtacgatcaacgcttggcaataaaacaagttacctggaggggctataggctgactagtttgtagttcctactttatctgtttttatgcatatacaggttgtatcaattcctgaataatgtttgttgaagacctttattatcatgtaaagagattctatctaggaagccttttttggattcgagtaaaaaaattgtttcttaaataaatagctcatgccgatcttcattc

SEQ ID NO: 5097 - DNA, 1260 bp, Manihot esculenta
atactttggccttgagaattttggcaacacttgctattgtaacagcgtcttgcaggcactttacttctgtgtaccatttcgagaacaattactagaatattatgctaataacaaaaatactggggatgccgaagagaatctcttgacatgcttagcagacttatttacgcagataagttcacagaagaagaaaacaggtgtaattgctccaaagcgttttgtacagagattgaaaaaacaaaatgagcttttccgcagctatatgcatcaggatgctcatgaatttttaaattttctgctaaatgaacttgttgacatactggagaaggaggctcaagctgcaaaaagtgatccagaaacttcatcccctcctgaaaagattgcaaatgggccaaacaatagtcaagcaaatggtgtttcaaaggagcctttggttacatgggtgcacaaaaattttcagggaattctcaccaatgagacaagatgtctgcagtgtgagactgttacagcaagagatgaaacattttttgacttgagccttgatattgaacagaatagttcaataacaagctgtttgaaaaattttagctccacagagactttgaatgcagaggataagtttttttgtgacaagtgctgcagtttgcaagaagctcagaagaggatgaagataaagaaacccccacacatcctggtcatccatctgaagaggttcaaatacattgagcagctgggtcggtacaagaagctatcttatcgagttgtcttcccacttgagctgaagctgagtaacacaatggaagatgcagatattgaatactcattatttgcagtagttgttcatgttgggagtgggcccaatcatggacactatgtcagccttgtgaaaagccataatcactggctattttttgatgacgaaaatgtggaaatgattgatgagtctgctgtgcagacattttttgggtcagcgcaggaatattcgagtaatacggatcatgggtacatcttgttttacgagagccttggtgctagtagcaagagttgagaagagggagctttggttttacaagtaggcattttaatcatttgaaccagctttatcttttgcttatatttcagttattattgttttcctttgccttttgtccttcaaccactgggactctcgaatttatgtatctgagccgatatgggttgtgaaagagatgtatacttgggttgtttccctgtaaagtggatggtggaagcacatagtcc

SEQ ID NO: 5098 - DNA, 1855 bp, Musa acuminata
catcaacaacggaccgatccgaaataaatagaacgaagagggaaagaaaggaaactacagaaagagccggcgaggaaaccctagtggggacgtttacgatcgaggcacgaattccttcccgtttcagtcgatagagcctctccatcggtgggggcgaaacctcggaaccgacggctgagggagcgatagggggaacgcgacagggttcgggttgcggcgcttggattgctgctgggcggtgagcacgaacggtggatggtgatgggcgccacggggtctaagttggagaaggccctcggcgagcaatttcccgaaggcgagcgctactttggtctcgagaacttcggcaatacctgctattgcaacagcgtcttgcaggtgctttatttttgcatccccttccgtgagcaattgctggattactatgaaaacaacaaaaatgttggggatgcagaggagaaccttttgacatgtcttgccgatctgttctctcagatcagctctcagaagaagaaaactggcgttatatctcctaggcgttttgtgcaaagagtgaagaaacaaaatgaactcttccgcagctatatgcaccaggatgcacatgaatttctgaatttcctgcttaatgagcttgttgatactctggagagagagtctaatgctgcaaattcttcccctgaagcctcatcatcatcatcgtcatcatcatctgagaaggttgcaaatggtccaagcaatcctcctgtcaatggcttacggaaagacccttttgttacttgggttcatgacagttttcagggtattctaaccaatgaaacgaggtgcttgcgttgtgaaactgttactgcaagagatgaaacattttttgacctaagccttgacattgagcaaaatagttcaatcacaagttgtctcaagaattttagctcaacagagactctgaatgcagaggacaagtttttctgcgacaaatgctgcagtttgcaagaggcccagaagaggatgaagattaagaagccaccaagcatcctggtaattcatctcaagcgcttcaagtatattgagcaccttggtcgtaacaagaagctatcataccgggtcgtgtttcccatggagttgaaacttatgaacactgtcgaagatcccgacacagagtattcactctttgcagttgtggttcatataggaactggtccgaaccatggtcactatgtcagtctcgtcaagagtcataaccactggctctactttgacgatgagactgtggagatgattgatgaattgaccatgcacaagtactttggttcttcacaggagtacccgagcaacacagaacatgggtatattttgttctatgagagccttggtaaaagcagctgaggagctcatcatttggggttttgaggcacttttcattttccagccattaatacctttttttccctaatatatattttttagaattgctattcaaattctaggtatagagcttaaccagaggatgtgatatttatagtaaatgcagtgtatagtggatggtggaagcccataatctttttctctaataaggaattttcaggacgtgaaaggttcacaggagagagatatttattgcatgccatggtttgcttggtggatttgctgtatctacataatcaatgtctgccctaattaggtgagtgatttctacgtatttggcccaaaagcaatgattgactttgaatctttgttaggttcatccctcgagaccaaaaaccattgtacctgtgatgcccgccccccaattaattattggtttctttgattttgtattttattgcttgattacaattggatataactttgcatttttctg

SEQ ID NO: 5099 - DNA, 2295 bp, Ceratodon purpureus
ctgcttctgcttctgcttctgctgctgttgctggtgtcgtggtttagcgttgcttgccaccaatgggtccccaatcgccccgctccatcacatgcacatgatcgccgcaccgcaccgcaggcgcttcttctgcacccaaacggacgtaccccgaatcactgcccctcccacgcgatcccccaactccttggccatgctgtgacggagcccccgcgcacgagatcggaagggttttggccacccggggagcagccaccgccgctggcacacatatggtcatgggaagctcgggttcgaagctggagaaggcattgggcgaccaatttcccgagggagagcgctacttcggtctcgagaatttcggcaacacctgctactgtaacagcgttttgcaggctctgtatttctgcgtaccgtttagggatcaattgttggagtactgcggtcagaacaaagctgttcaagaaacagaggagaaccttttgacgtgcttgtcggaattgttcacacagataaactcgcaaaagaagaagactggtgtaattgccccgaagcggtttgtgcaaagggtcaaaaagcagaatgagctgtttcggagttacatgcatcaggatgctcacgagtttctgaactttctgctgaatgagctggtcgacatcctcgaaaaggaggcaaaagcagccaagtccaattcaggtcctcaggcttctccagagaaagctgttgcgaatgggtcggtcaatggattgtccaacggaaaccacaaggaaccgatcgtcacctgggtgcacaagatttttcagggcacactgacaaatgaaacgagatgcttgcggtgtgaaacgatcactgcccgtgatgagactttcttggacctcagcctcgacattgagcagaatagctccatcacgagttgcctccgcaatttcagttccacggaaacattgaacgcagaggacaagttcttctgtgacaaatgctgcagtctgcaggaggctcaaaagaggatgaaaatcaagtcaccgccccgcatcttggcactccacctgaagcggttcaagtacatcgagcagttgggtcgttacaagaagctgtcgtaccgtgtagtattcccgctggaactgaagctgtgtaatacgacggatgacgcacccgggtccgaggcagagtactcgctgttcgccgtggtggtgcatgtggggagcggcccaaaccacgggcattacgtgagcctggtgaagagccacaaccactggctgttcttcgacgacgagaatgtggagattattgatgagtccatcgtacagacattttttggatccactcaagaatattctaacaacacggatcatgggtacattctgttttacgagagcttggaacagaagaactaacacacggaagctaacaacctagttccctctcaagcatagctgccggccgatgacgtatgtaggaggatttgtagtggtagttgttaggtggcactcgggaggagttgcgaaggaacgggcgggacgaattgagctcgtggagttgatttactttgtagagccgacggtgaaggaaagaagcctagagcaagttgggagccggtctggtgtccgtcgtcgtaggaggcgatgggacatgggcagtcccggatgcactaattcacaagcaagtgagagtgctagaggtgtaggaggtggagcaactcggaccctgtggttgccgtgtacactgcgacagacgataaaacatgacgagagcaatctccatcggaactttgtgttaaattgtacgagttgtttgctgtaaatgtgggaggcttgtgtgagataagtcctggatcgttggcttgatgacgattcttgtcacctggcaggagataatgcgagtgcagggctttaatctttcacagcgctctgctggattctacctagcagaagttatctgaaatacggtgtgagagtttatgagtttatggtactgctcgtttacaagtggcaggaaatgtgtgatcgttatctggacacatgaacgtagtccattgtcgtgttaaacatgtgcttaaacatgaacgtagttctgtgtagaccagagtgtacccactcgctttctgtatatttgcacgttcttttctggacgttggagtaggatgatttactgaggcttggatcttgtggagaacatgttctagaaaatcgctagaaaatttcagagagtgacttgtccacgtgtacgtattagaggtcatgtggtaaccgaaggccgtcatgttgtttgtgtcatgtagcttgacagtgtactttc

SEQ ID NO: 5100 - DNA, 1736 bp, Hordeum vulgare
cacgactccttcctccctccctctactctcctctacactctaccaccaccgcagcggtacacacgcacgcacagacacacggacgctcctttttattccgcccgtttcctccaaaccatccgtcctcctgctccaacccccgcccgcccgcccgcccaccgatccccaacccggtacggactgcccgcccccaccccgacgggacgagccgagccggcggtgaggccgatccgtcgcggcgcagcgccggcgggcaaatgggagttgggcggtgatgggcgcggcgagctcgaggctggagaaggcgctgggcgagcagttccccgagggcgagcggtacttcggcctcgagaacttcggcaacacctgctactgcaacagcgtcctgcaggcactttacttctgtgttcctttccgcgagcaattgctggagtactatgcaaacaataaaagcgccagtgatggcgaggagaacatgttaacctgcttagctgacctcttctctcagatcagcaatcagaagaagaaaactggcgttattgctccgaagcgttttatacaacgactaaagaaacagaatgagcttttccgcagctatatgcatcaggatgctcatgaatttctgaattttttgttgaatgagctagttgacattctcgagaaagaatgtaaagccaataaagaaccttctcaaaattcatcttcgaataagaattctaatggccctgttaatggtcagcccaatggtagtcataaagaaccggatactacatgggtccacaaatgcttccagggaatattgactaatcaaacaaaatgtttgagatgtgaaaccgtcactgatagagatgaaacatttcttgacttgagcctggatatagaacagaatagttcaatcaccagctgtcttaaaaacttcagctcaacagaaactttgaacgctgaggataagttcttctgtgacaaatgctgcagtttacaagaagcacagaaaagaatgaagataaagaaacagccaaacatcctggtaatccatctcaagcgcttcaagtacatcgagcagctcggccgctacaaaaagctgacataccgagttgttttcccgctggagcttaaactcatgaacacggtcgacaattcagacttggaatattccctcttcgccgtgctagtccacgttggaagtgggccaaatcacggccactacatcagcgtggtcaagagccacaaccactggttgttcttcgacgacgagactgttgagatgaccgatgagtccatggtacagacattcttcggctcggcacaggagttcagtggtaacaccgacaacggctacatactcttctacgaaagcctcgccaaaacaagctgatgccttcccgcgcatctcgtgatcagcaacacagttttttcctttcatcgccacacctcctgctccgtgctatatagaagattcggtaaattagaataattcgaatggcaaggctgttcaaccttagatgctttttgtggagtcggtgtttagcaataaagaagccgtgacgagttttgcgggtgggtactacagccgccgaagcttgccgccttcttgacgttgttttccgttgtggcacaagcctgaatcgatccggaataatgtttcttaagaggatcttatcatcatatcatgtgaagagatgcttgtatcttgaagccctctggcttagtaaaatgttgccgccgaagcttgcaat

SEQ ID NO: 5101 - DNA, 2027 bp, Hordeum vulgare
gcccgcccgcccaccgatccccaacccggtacggactgcccgcccccaccccgacgggacgagccgagccggcggtgaggccgatccgtcgcggcgcagcgccggcgggcaaatgggagttgggcggtgatgggcgcggcgagctcgaggctggagaaggcgctgggcgagcagttccccgagggcgagcggtacttcggcctcgagaacttcggcaacacctgctactgcaacagcgtcctgcaggcactttacttctgtgttcctttccgcgagcaattgctggagtactatgcaaacaataaaagcgccagtgatggcgaggagaacatgttaacctgcttagctgacctcttctctcagatcagcaatcagaagaagaaaactggcgttattgctccgaagcgttttatacaacgactaaagaaacagaatgagcttttccgcagctatatgcatcaggatgctcatgaatttctgaattttttgttgaatgagctagttgacattctcgagaaagaatgtaaagccaataaagaaccttctcaaaattcatcttcgaataagaattctaatggccctgttaatggtcagcccaatggtagtcataaagaaccggatactacatgggtccacaaatgcttccagggaatattgactaatcaaacaaaatgtttgagatgtgaaaccgtcactgatagagatgaaacatttcttgacttgagcctggatatagaacagaatagttcaatcaccagctgtcttaaaaacttcagctcaacagaaactttgaacgctgaggataagttcttctgtgacaaatgctgcagtttacaagaagcacagaaaagaatgaagataaagaaacagccaaacatcctggtaatccatctcaagcgcttcaagtacatcgagcagctcggccgctacaaaaagctgacataccgagttgttttcccgctggagcttaaactcatgaacacggtcgacaattcagacttggaatattccctcttcgccgtgctagtccacgttggaagtgggccaaatcacggccactacatcagcgtggtcaagagccacaaccactggttgttcttcgacgacgagactgttgagatgaccgatgagtccatggtacagacattcttcggctcggcacaggagttcagtggtaacaccgacaacggctacatactcttctacgaaagcctcgccaaaacaagctgatgccttcccgcgcatctcgtgatcagcaacacagttttttcctttcatcgccacacctcctgctccgtgctatatagaagattcggtaaattagaataattcgaatggcaaggctgttcaaccttagatgctttttgtggagtcggtgtttagcaataaagaagccgtgacgagttttgcgggtgggtactacagccgccgaagcttgccgccttcttgacgttgttttccgttgtggcacaagcctgaatcgatccggaataatgtttcttaagaggatcttatcatcatatcatgtgaagagatgcttgtatcttgaagccctctggcttagtaaaatgttgccgccgaagcttgcaatatctttcctgtttgtagccgctgtttgctaatacgcgaacaaaatttacgcggccttgcttcctttgtcatgctgcatgtattctgatttgggagcttgttccgacttgctaagctcccgaaaatcgtgagatatgtgcaaccacatgttttgtgccatggccaattttcccaacttggttgcaatggaccacatggatgctgcaagtgatcaagtctgtttggcaaggtagcatgaagcccaggtgaggaagcaacacggctggttctgcatttcgtgggtgtgtctgtccgggcagctggacgccgctgttgatctggaccggctgttgtcctccggccacaaagttcttccaagttaccactacaggcaagatatttcccccagaaaccatatgcacgcaagtgcacaagctcaaactggaatcaaacagttc

SEQ ID NO: 5102 - DNA, 1658 bp, Physcomitrella patens
gaggaagcaaaggaaaggcagagagagtgagactcggactgtggccaagctgccctctctctccgacgggggacgacctatggtcatgggagcctcgggttccaagctggagaaggcattgggcgatcaatttcccgagggagagcgctactttggcctcgagaatttcggcaacacttgctactgcaatagcgttctgcaggctctgtacttctgcgtcccattccgggatcaattgttggagcattgcggtcagagcaaacccgtcgctgaagcagaggagaatctgctgacgtgcttgtccgagctgttctcacagataaactcgcagaagaagaagactggggtgatagccccgaagcgattcgtgcaaagagtgaagaagcagaatgagctgttccggagttacatgcatcaggatgcccatgagtttctgaactttctgctgaatgagctggttgacatcctggagagagaggcgaaagcagcgaagtcgaattcagggtgtgagacgtcaccgggcaaggtggtggggaatgggtcagtgagcggcctggcgaacggaacgcacaaggaagcagtggtgacatgggtacacaagatattccaggggatactgacaaacgagacgagatgcttgcgatgcgaaaccatcactgcgcgagatgagacattcttggatctgagcctggacatcgagcagaacagctccataacgagctgcctgcggaatttcagttctacggaaacgctgaacgcggaggacaagttcttttgcgacaagtgttgcagtttgcaggaagcgcaaaagaggatgaagataaagtcggcaccgcggattctagcgctgcacctgaagcgattcaagtacatcgagcagttggggcggtacaagaagttgtcgtaccgggtggtgtttccgttggagttgaagctttgcaacacgacggacgatgcacctgggtcggaggcagagtactcgttgtttgcggtggtggtgcacgtggggagtggaccgaatcacgggcactacgtgagtctggtgaagagccacaaccactggctgtttttcgacgacgagaacgtggagatcatcgacgagtcgatcgtgcagacattttttggatcgacgcaggagtattcgaacaacacggaccacgggtacattctgttttacgagagcttggagcagaagagctaaggttgggaagcggagagggtgaggaaggtaggaatggtggaggaatggttgcgatgaggtgatggcatcccctctctttttttcaggaggatgcgttatggtaggtggtgattaagaggagttggacatgagtgttgttgagagatgaagagtatttgcaaggtaggaacacggccatagtcaactgtttgatttgaccaagtgctatgatacccatcagcttgtgggtttgcacttccaagcgcgaaatttcatgagagtagttaaatattggctgctttgcattagcttgggagttgggaatggagcttccgagaatccgactcgctgtgctgtataggttggagtaaatggtgccgaaatgtctgtatgagtgatgtaccagtacctgcttgggttcttgctgggttcgttttttattttcctcggaatttcagagttgcgaaccattgcttgt

SEQ ID NO: 5103 - DNA, 1953 bp, Picea glauca
acttttctttgttctccatgtgcctttgcagtgctctctctcaagttttcgttgatgagcacttgttctttgtttcacatgtgcctttgcattgtgctgtctctcaagtttagtcatctactcatcactttaatggtgcctttaaccaccgtgcccggctatttcagcggcatttgtgcattgaatttcagacattttttccctcttgtccagtccgcaggcattctcaatttttgaaaggcagacggatccgctggaaggcatgcaaggcattataatggcagttaatataatttcttgaaaatcatgtaattcgtgggcttaaggatccgatctttaaaatcctgacaaaaccccaacaagcagagagagggagagagcgagcatatggtcatgggaaccaccggctcaagactggaaaaggcgctgggagatcagtttccggagggcgaacgctactttggcctcgaaaatttcggcaacacctgctactgcaatagcgtccttcaggctctttatttctgtgttccttttagagagcagttgctggagtattatagtcgtacaaagactgggagagaaatagaggagaatctcctcacatgcttggctgacctatttactcagatttactcacagaagaagaaaactggtgttattgctccaaaacgctttgtgcaacgagtgaaaaaggaaaatgaaaatttccgcagttatatgcaccaggatgcacatgagttcttgaatttccttttgaatgagcttgtggatattctggagaaagaagccaatgcggctgagaaattgtcaggaaatttaaaccaacaagagaaggctataaatggcaaaatcaatggaacaagcaatggaacccaacagcagcctgtcacatgggttcataaaatttttcaggggactcttacgaatgaaacaagatgtttatgctgtgaaactattacagccagagatgaaacgtttctggaccttagtctggacattgaacaaaacagttctattacgagctgtctgcgtaacttcagctctactgagacactcaatgcagaggacaagttcttttgcgacaagtgttgcagcttgcaagaagcacagaagagaatgaagataaagattccacctcgtattcttgtgatccatctgaagcgcttcaagtacatagaacaacttggacgatacaagaagctttcctaccgtgttgttttccctatggagcttaagttatgtaatacaactgatgatgcacccgggtcagatgccgagtactcactttttgcagttgtggtccatgtaggcagtggtccaaatcatggacactatgtcagtctggttaagagccataaccactggctctttttcgatgatgagaatgtagaaatgattgacgagtctgtagtgcagactttttttggctcaacacaggagtattcaaataacacagatcatgggtatattttgttctatgaaagtctagttcagggttcttaaagtattgctaccgttgttggtgttcactttgcggtcctcacctacttttgaccgttgtatatctttgaagtttcttggagatgcggatattcatctgtaattatctagggattcagttcttgccttgctgaagctgcagtatgcagaagctcttctacaattgaaatcaagctagaaaactcttctatgtttgtaatgttgaatgatgaaaacagtagtggcttctttgtgatttgataacaaaaataagatctgcaggattattccattggtggctaagtccccttttatagtttagtagataggaggaagccgtttagttgcttcttgtttctgagcgagtttctaagtgctactggaatgagggacgaattaatgtgaatactctgcaattcattttcccatattttaatatttacacaatttcatggaaggccacttgatttcttt

SEQ ID NO: 5104 - DNA, 1363 bp, Cichorium intybus
gtcgaacttgagaaagctttgggcgaccaatttccagaaggcgaacgatacttcggtctcgaaaattttggcaatacatgttactgtaacagtgtcttacaggctctttacttctgtgttccatttcgagaacagttattggagtattattcaagcaacaaaacttttaccgatgcagaagaaaatctcttaacatgcctggcagacttgtttacgcagataacttcacaaaagaagaaaacaggagtgattgctccaaaacgatttgtacagagattgaagaagcagaatgagatttttcgtagctatatgcaccaggatgctcatgaatttttaaattatctgttaaatgaacttgtggacatactggagaaagagtcacgtgctgtaaagagtgatctagaatcttcttcatcttcagaacaaattccaaatggactaaacaattctcacacaaatggtcatataaaagagcctttagtcacatgggtgcacaagaatttccagggtatactgacaaatgaaacaaggtgtttgcgatgtgagacagtgacagcaagagatgaaacgtttcttgatttgagtattgattgagcaaatagctcgattacagctgtttgaagaattttagttctacagagactttgaatgctgaagataaattcttttgtgataaatgttgtagcttgcaggaagcccaaaaaagaatgaaaatcaagaaaccaccacaaatcctagtcatccatctaaaaaggttcaatacatcgaacaactcgggcgttataaaaagctctcataccgcgtagtcttcccactcgagctcaaactaaccaacacggtagaagacacagacgccgagtattcccttttcgcggtggtggtccatgtcggaagtgggcccaaccacgggcactatgtcagcctcgtgaaaagccataatcattggttgttttttgatgatgaaaatgtggaaatgatcgatgagtcagcagtgcaaacctttttcgggtccgcacaagagtattctagcaacacggatcatgggtacatcttgttttacgagagggttgatgtaggcagcgcaagttaaaaagacggatttaccctcccgtacaattttgaaccgactcgcttacatttcgctatgttttattatacaattttattcgcccggttctatttttgtaatgtataccaatgggtcctatgaatgacagaggtaaatcaaaatgactgaatgtacttgtggattctcgcatgtatagaatggtggaagctaacatatatgttttcttgtagctttaaaaagtggacatatagaaagttaaatgttgcttatgtgatggtttttattttgctatta

SEQ ID NO: 5105 - DNA, 1528 bp, Triticum aestivum
gccggcggtgaggccgatccgtcgccgtgcagcgcgggcgggcaaatgggagttgggcggtgatgggcgcggcgagctcgaggctggagaaggcgctgggcgagcagttccccgagggcgagcgatacttcggcctcgagaacttcggcaacacctgctactgcaacagcgtcctccaggcactttacttctgtgttcctttccgcgagcaattactggagtactatgctaacaataaaagcgccagcgatggcgaagagaacatgttaacctgcttagctgacctcttctctcagatcagcaatcagaagaagaaaacaggcgttattgctccaaagcgttttattcaacgactgaagaaacagaatgagcttttccgcagctatatgcatcaagatgctcatgaatttctgaattttttgttgaatgagctagttgacattctcgagaaagaatgtaaagccaataaagaaactcctcaaaattcatcttcaaataagagttctaatggccctattaatggtcagcccaatggtagtcataaagaaccagagactacatgggtccacaaatgcttccagggaatattgactaatcaaacaaaatgtctgagatgtgaaaccgtcactgatagagatgaaacatttcttgacttgagcctggatatagaacaaaatagttcaatcaccagctgtcttaaaaacttcagctcaacagaaactttgaacgccgaggataagttcttctgtgacaaatgctgcagtttacaagaagcacagaaaagaatgaagataaagaaacagccaaacatcctggtaatccatctcaagcgcttcaagtacatcgagcagcttggccgctacaaaaagctgacataccgagtcgttttcccactggagcttaaactcatgaacacggtcgacaattcagacttggaatactccctctttgctgtgctagtccacgtcggaagtgggccaaatcatggccactacatcagcgtggtaaagagccacaaccactggttgttcttcgatgatgagactgttgagatgaccgatgagtccatggtacagacattcttcggctcggtacaggagttcagtggtaacaccgacaatggctacatactcttctacgaaagcgtcgctaaaacaagctgatgccttcccgcgtatctcgtgattagcaacacagttttttcattttgtccccacacctactgctccgtgctatatagaagattcggtaaaattagaataattcgaatggcaagaccattcaaccttagatgctttggtggagtcagtgtttagcaataaagaagctgtgacgagttttgcgggtgggtgctgtagccgccaaagcttgcagtcttcttgctgttgttttccgttgtggcacaagtttgtatcgatctggaataatgtttcttaagaggatcttatcatgtgaagaagagatgcttgtatcttgaagccttctggctttgtaaaattttgattgggagagcttctgctgattctga

SEQ ID NO: 5106 - DNA, 1396 bp, Physcomitrella patens
gtgagactcggactgtggccaagctgccctctctctccgacgggggacgacctatggtcatgggagcctcgggttccaagctggagaaggcatttggcgatcaatttcccgagggagagcgctactttggcctcgagaatttcggcaacacttgctactgcaatagcgttctgcaggctctgtacttctgcgtcccattccgggatcaattgttggagcattgcggtcagagcaaacccgtcgctgaagcagaggagaatctgctgacgtgcttgtccgagctgttctcacagataaactcgcagaagaagaagactggggtgatagccccgaagcgattcgtgcaaagagtgaagaagcagaatgagctgttccggagttacatgcatcaggatgcccatgagtttctgaactttctgctgaatgagctggttgacatcctggagagagaggcgaaagcagcgaagtcgaattcagggtgtgagacgtcaccgggcaaggtggtggggaatgggtcagtgagcggcctggcgaacggaacgcacaaggaagcagtggtgacatgggtacacaagatattccaggggatactgacaaacgagacgagatgcttgcgatgcgaaaccatcactgcgcgagatgagacattcttggatctgagcctggacatcgagcagaacagctccataacgagctgcctgcggaatttcagttctacggaaacgctgaacgcggaggacaagttcttttgcgacaagtgttgcagtttgcaggaagcgcaaaagaggatgaagataaagtcggcaccgcggattctagcgctgcacctgaagcgattcaagtacatcgagcagttggggcggtacaagaagttgtcgtaccgggtggtgtttccgttggagttgaagctttgcaacacgacggacgatgcacctgggtcggaggcagagtactcgttgtttgcggtggtggtgcacgtggggagtggaccgaatcacgggcactacgtgagtctggtgaagagccacaaccactggctgtttttcgacgacgagaacgtggagatcatcgacgagtcgatcgtgcagacattttttggatcgacgcaggagtattcgaacaacacggaccacgggtacattctgttttacgagagcttggagcagaagagctaaggttgggaagcggagagggtgaggaaggtaggaatggtggaggaatggttgcgatgaggtgatggcatcccctctctttttttcaggaggatgcgttatggtaggtggtgattaagaggagttggacatgagtgttgttgagagatgaagagtatttgcaaggtaggaacacggccatagtcaaccattacaaattgtttgagtttcgatttctttttttt

SEQ ID NO: 5107 - DNA, 1625 bp, Triticum aestivum
cacgcgtccgctgctccaaccccccgcccaccgatccccaagtcggtactggcccgcgtcgcaccgcaccgcaccgcatcgccgagacgagccggcggtgaggccgatccgtcgccgtgcagcgcgggcgggcaaatgggagttgggcggtgatgggcgcggcgagctcgaggctggagaaggcgctgggcgagcagttccccgagggcgagcggtacttcggcctcgagaacttcggcaacacctgctactgcaacagcgtcctccaggcactttacttctgtgttcctttccgcgagcaattactggagtactatgcaaacaataaaagcgccagcgatggcgaagagaacatgttaacctgcttagctgaccttttctctcagatcagcaatcagaagaagaaaacaggcgttattgctccaaagcgttttatacaacgactgaagaaacagaatgagcttttccgcagctatatgcatcaggatgctcatgaatttctgaattttttgttgaatgagctagttgacattctcgagaaagaatgtaaagccaataaagaaactcctcaaaattcatcttcaaataagagttctaatggccctattaatggtcagcccaatggtagtcataaagaaccagagactacatgggtccacaaatgcttccagggaatattgactaatcaaacaaaatgtctgagatgtgaaaccgtcactgatagagatgaaacatttcttgacttgagcctggatatagaacaaaatagttcaatcaccagctgtcttaaaaacttcagctcaacagaaactttgaacgccgaggataagttcttctgtgacaaatgctgcagtttacaagaagcacagaaaagaatgaagataaagaaacagccaaacatcctggtaatccatctcaagcgcttcaagtacatcgagcagcttggccgctacaaaaagctgacataccgagtcgttttcccactggagcttaaactcatgaacacggtcgacaattcagacttggaatattccctctttgctgtgctagtccacgtcggaagtgggccaaatcatggccactacatcagcgtggtaaagagccacaaccactggttgttcttcgacgatgagactgttgagatgaccgatgagtccatggtacagacattcttcggctcggcacaggagttcagtggtaacaccgacaatggctacatactcttctacgaaagcgtcgctaaaacaagctgatgccttcccgcgtatctcgtgattagcaacacagttttttcattttgtcaccacacctactgctccgtgctatatagaagattcggtaaattagaataattcgaatggcaagaccattcaaccttagatgctttggtggagtcagtgtttagcaataaagaagctgtgacgagttttgcgggtgggtgctgtagccgccgaagcttgcagtcttcttgctgttgttttccgttgtggcacaagtttgtatcgatctggaataatgtttcttaagaagatcttatcatgtgaagagatgcttgtatcttggaagccctctggctttgagtaaaattttgcttgagagagctcctgctgattctgaagtctaaa

SEQ ID NO: 5108 - DNA, 1702 bp, Triticum aestivum
ccatccatccgtccgatttcttcctcctgctccaaccccccgcccaccgatccccaagtcggtactggcccgcgtcgcaccgcaccgcaccgcatcgccgagacgagccggcggtgaggccgatccgtcgccgtgcagcgcgggcgggcaaatgggagttgggcggtgatgggcgcggcgagctcgaggctggagaaggcgctgggcgagcagttccccgagggcgagcgatacttcggcctcgagaacttcggcaacacctgctactgcaacagcgtcctccaggcactttacttctgtgttcctttccgcgagcaattactggagtactatgcaaacaataaaagcgccagcgatggcgaagagaacatgttaacctgcttagctgaccttttctctcagatcagcaatcagaagaagaaaacaggcgttattgctcctaagcgttttattcaacgactgaagaaacagaatgagcttttccgcagctatatgcatcaggatgctcatgaatttctgaattttttgttgaatgagctagttgacattctcgagaaagaatgtaaagccaataaagaaactcctcaaaattcatcttcaaataagagttctaatggccctattaatggtcagcccaatggtagtcataaagaaccagagactacatgggtccacaaatgcttccagggaatattgactaatcaaacaaaatgtctgagatgtgaaaccgtcactgatagagatgaaacatttcttgacttgagcctggatatagaacaaaatagttcaatcaccagctgtcttaaaaacttcagctcaacagaaactttgaacgccgaggataagttcttctgtgacaaatgctgcagtttacaagaagcacagaaaagaatgaagataaagaaacagccaaacatcctggtaatccatctcaagcgcttcaagtacatcgagcagcttggccgctacaaaaagctgacataccgagtcgttttcccactggagcttaaactcatgaacacagtcgacaactcagacttggaatattccctctttgctgtgctagtccacgtcggaagtgggccaaatcatggccactacatcagcgtggtaaagagccacaaccactggttgttcttcgacgatgagactgttgagatgaccgatgagtccatggtacagacattcttcggctcagcacaggagttcagtggtaacaccgacaatggctacatactcttctacgaaagcgtcgctaaaacaagctgatgccttcctgcgtatctcgtgattagcaacacagtttttcattttgtcaccacacctactgctccgtgctatatagaagattcggtaaattagaataattagaatggcaagaccattcaaccttagatgctttggtggagtcagtcagtgcttagcaataaagaagctgtgacgagttttgcgggtgggtgctgtagccgccgaagcttgcagtcttcttgctgttgttttccgttgtggcgcaagtttgtatcgatctggaataatgtttcttaagaagatcttatcatgtgaagagatgcttgtatcttggaagccctctggctttgagtaaaattttgcttgagagagctcctgctgattctgaagtctaaaaacgatatctttcttatatgtagccgctgtttgctaattcgcgaacaaatctactgac

SEQ ID NO: 5109 - DNA, 1782 bp, Brachypodium distachyon
acacttttcttgttttaaccaaacagagtccactagagtccagtccgttgagaactaagtcaaatttagatgcacatcaaggcgtcgcccatcaaagcctaattgcattttccgttgaacaaaactaattacccgatagagtcatcggctaacagaaagggctacatcgccgcctcgcctccgatcagccttcgtccgccaccgcttgcttgcgtgggtatccgagacctggatggctaaaccggcgcggtcgccgacggcggatgccccgccgccggccgtggagaggtcccgctcagcggtcggatcggggctccgttcgctcgccagcgccgcctcgggttttctggatcggtggtcggtggtggggaccggcgtctccaggctcgagaaggcgctcggcgaccagttcccggagggcgagcactacttcggcctcgagaatttcggcaacacctgctactgcaacagcgtcctacaggcactttatttttgtattccattccgggagcagttgcttgaatattatgcgaaggacagaaatccaggagatgctgaggaaaatttgttgacctgtttggcagaactttttgcccagataagcctatcaaagaaaaagactggtgttatttctccaaaacgttttgtgcatagggtgaggaaacagaatgaatcattccggagttatatgcaccaggatgcccatgaatttttgaatttcttactgaatgagattgttgatattctggaaaaagagttcagtatgatgaaggattctcctgaaaccacatctcctgaaggagcctcaaatggggatattaaccatttagcaaatggagttggaaaagagccactggttacatgggtacacaaggattttcagggtattttaaccaatgaaacgaagtgcctcatgtgtgagactatcaccgcaaaggatgagacatttttagatttgagcatcgatattgaacagaatagttcactcacaagctgcctaaagaatttcttttccactgaaactttaaatgctgaggacaagttcttctgtgacaaatgctgcagtttgcaagaagcacagaagagaatgaagataaaaaaggcacctcaaatattggtgatccacttaaagcgcttcaagttcgtcgagcagcttagtcggcacaagaaactgtcataccgagtggtatacccaatggagctgaagctgagcagcacatctaacgatgtagattgtgagtactccctctttgctgttgtagtccaccttgggagcggccccaaccagggacactatgtaagccaaattaaaagctgcgaccactggttgtctttcgacgatgacaatgttgagaaaattcaggagtccactctgcaaacgttctacggttcttctcacgaatatgctggcaacacagatcatggctacatcttgttctatgagcgcattgtgaagagctaggaatgttcttttatttagtgttagtgctgatagacgaaataaggtgtacagtgtaaaggatggtagtctgataccttttgttttcaactttttctcagtttatctactgcaccccaatagaatatacttccatcaataaaatatatttttacagaggctgaaaacgtattctgattgaactcctctgtttacctgtttagttttcaggattgatgaagaattaatcagattattgttgtttgtttgggaggtacggagtattttgggaacaccggattgcatatttccgagaaggaatatatgaatgactttacacttga

SEQ ID NO: 5110 - DNA, 1331 bp, Pennisetum glaucum
cgcagaggaaaatcttttgacctgtttggctgacctctttatgcagataagccaagcaaagaaaaaaactggtgttattgctccaaagcgttttgttcagcgagttaagaaacaaaatgagttgtttcgcagctacatgcaccaggatgcacacgagttcttaaattttcttttgaatgaacttgttgatattttggaaaaggagtctagtgctgcaaaggactccccgcaatcttcatctcctgaaaaagctccaaatggtccagttcaacctttagccaatggagttaaaaaggagcctcctgttacactggtccacaagaattttcagggcatattgaccaatgaaacaagatgcttaagatgcgaaacagtaacagcaagagatgaaacatttcttgatcttagtgttgacattgaacaaaatagttctatcacaagctgcctgaaaaacttctgctctacagagactttaaatgcagaggataaattcttctgtgacaaatgctgcagtttgcaagaagcacagaagagaatgaagatcaagaaggctccccacatattggtgatccacctaaagcgcttcaagtacattgagcagcttggccgatataagaaactttcataccgggttgtattccccatggagctgaagctcagtaatacatccgatgacgttgacacagagtactccctcttcgctgttgtggtccacgtcgggagtggccccaaccatgggcattatgtgagcctcgtcaaaagccacaaccactggttgttctttgacgatgaaaatgttgagatggttgaggagcagaccctgcaaacattcttcggctcctcacatgaatactctggcaacactgaccatgggtatatcttgttttatgagggagagttaggttgttttccttggccttccctgttcctttttcaccttttttctctttggagcatgcaagttcactcttgtacctacacagctgctatttcacacctccatggaaaatggccaatcgaagaggttgtatgacatgaggacgccagactttgggtggtttcagtgtacaggggataatggaaatcttgctcccagtgatgcaataaggtgtaaatcattttaagtgcgcctgaccagtttcctctcaggactaacatctttttttttgttaaagaatggaacattgctattgggcacactgtacattagttctagttcagaatcttggatgcatttcccagttctgctgacttttgggatctggaatcatgctacatgtttgggcttgttaactttggccagtctggtggtggtcgttttacatgtcata

SEQ ID NO: 5111 - DNA, 1225 bp, Brassica napus
gctctcggcgaccagttccccgaaggagaacgctacttcggcttcgagaatttcggcaacacttgctactgcaacagcgttttgcaggctctttatttttgtgttccctttcgtgaacaattgctcgaatactataccagtaataaaagcgtcgctgatgctgaagagaatcttatgacttgcctagctgacttattctctcagataagttcccagaagaagaaaacgggcgttattgcgcctaagcgtttcgtgcagaggttgaagaaacagaatgagctgttccgtagttacatgcaccaggatgcacatgaattcctcaactatttgctgaacgaagttgttgacatactggagaaagaggctaaagctacaaagactgaacataaaacttcatcgtcttcaccgtctcctgaaaagattgcaaacggaccgaaagctcctctggctaatggcgtgcacaaggagccagtcgttacctgggtccacaatatttttcagggcatacttacaaacgagacaaggtgtctgcggtgcgagactgtgacagcaagagacgaaacgttcctagacctaagccttgatatcgaacagaacagttccataactagctgtttgaaaaacttcagctccacagagactcttcactctgaagacaagtttttctgtgacaaatgctgcagcttacaagaagcacaaaagaggatgaagatcaagaagccaccacacatcttagtcatccatctaaaacggttcaagtacatggaacagctaggtcgtacaagaagctatcttaccgagttgtctcccctttggagctaaaactgagcaacacggtgagccctatacagacgtcgagtactctctctttgcagtggtggttcatgtgggaagcggaccgaaccatggtcattacgtaagcctagtgaaaagccataaccattggctcttctttgatgatgagaacgtggagatgattgaagaatcagcagtgcaaacattctttggatcgtctcaggagtactcgagcaacactgatcatggttacatcttgttctatgagagccttggaccaaccaagtaaaggccgagtaagaggaaaacatcagaaaggactttgtttgttccttaactattagtaatggtatatgtttgggacttaaaagtcaacagttcctttgacagttactctttttgtttgactttctctattatgtctctttct

SEQ ID NO: 5112 - DNA, 1383 bp, Pseudotsuga menziesii
gaaatagtgccatcggtgggtggcttatgataaatggggagctccggttcgaaactggagaaggccctaggcgatcaattccctgagggcgagcggtattttggtctggagaatttcggcaatacttgctactgtaatagcgttcttcaggctctctatttctgtcttccatttagggagcagttgttggagtattatggccacaataagacaacggttgaagcagaggaaaatctcctaacatgcttggcagatctctttactcagattaactctcagaagaagaaaacaggtgttattgcaccaaaacgatttgtgcaaagggtaaagaaggaaaacgaactttttcgcagttatatgcaacaggatgcacacgagttcttgaatttcctgttgaatgagcttgttgatattctagagaaagaagctagtacaaacaaaaggctgtcaggaaatttaacacaaccagagaagaaaataaatggctcaatcaatggcctaacaaatgggtcccatcaggcgcctgttctcacctgggttcataaaatatttcagggaacactcacaaatgaaaccagatgcttgcgatgtgaaactataactgctagagatgaaacatttttggatctgagtcttgacatagaacagaacagttccatcacaagttgtctccgtaacttcagctcaacatatgtgctcaatgctgacgacaagttcttttgtgacaaatgctgcagtttgcaagaagcacaaaaaagaatgaaaatcaagaccccccctcggattcttggtatccacttgaagcgcttcaaatacattgaacaacttgggcgatacaaaaagctctcttatcgtgttgccttccccatggagctgaagttatgcaatacaacggatgatgcaccgggttcagatgcagaatattcactcttagccgttgtggttcatgttggcagtggtccaaatcatgggcactatgttagccttgtaaaaagccataaccactggcttttttttgatgacgagaatgtagaaatgattgatgagtctgttgtgcaaacattttttggctcagcacaagagtactcaaacaacacggatcatggttatatcttgttttatgagagtcttgaccacaagtcttgagacatcctccattggataagtttaggggatatatctagctgggagtgccaacaattcagttagttatggatgacgtggaacatccgaaagctgcaatgcagctcatgtatcttttgaattagagtagcgttgtttatttttttctaaaagtgaaggaaagggaatgtccctttatgatttcactgtgaaattgtacatgtgtaattttatatcgggactgtcatgatctttaataaa

SEQ ID NO: 5113 - DNA, 1060 bp, Amorphophallus konjac
gaatttcggcaacacgtgctattgcaacagcgtcttgcaggctctttacttttgtgttccttttcgcgagcaactgcttgactattatgcaaataacaagaatccaggagatgcagaagagaatctcttgacgtgcttggctgatctatttactcagatcagttcccagaagaaaaaacaggtgtcattgccccaaagcgttttgtgcaaagagtgaagaaagaaaatgagctcttccgtagttacatgcaccaggatgctcatgaatttttgaattttctgctaaatgaactcgttgatatcctggagaaggagtctaaggctgcaaaaacttctccagaagcgtcatcatcatcagaaaggattgctaatggaccgagtaaccctgtggcaaatggtgttaaagagccattagttacatgggtccacaagatttttcagggaacattaactaatgaaacaaggtgcttgcggtgtgagacagtgacagcaagagatgaaacgtttttggacttgagcctagacattgaacaaaacagttcaatcaccagctgtctaaagaacttcagttcgacagagactttaaatgccgaggataagttcttctgtgacaagtgctgtagtttgcaggaagcacagaagaggatgaagataaagaaactgccacacattctcgtgatccatctcaagcgtttcaagtacattgagcaacttggccgcaataagaagctgtcataccgagttgtgttccctatggagctgaagcttagtaacaccttggatgatgacgatactgagtactccctctttgctgttgtggttcatgtggggagtggacctaaccatgggcactatgtcagcctcgtaaaaagccataaccattggttgttcttcgacgatgaaaatgtggagatgatagatgaatctgcggtacagacattctttggatctgcacaggagtattcgagcaacacggatcatgggtacatcttgttctacgaaagagttactgggacgagttgaaatcaggcatttcctttcttgactcaaaagttggttc

SEQ ID NO: 5114 - DNA, 1343 bp, Silene vulgaris
caaaagtcaaaattcgagagaaggaagaggaattccacggaaaaccttgctaaagatgggtgcagcagggtcaaattggaaaagctctcggcgatcactttcctgaaggtgaacgatatttcggactcgagaatttcggcaatacttgttattgtaacagcgttttgcaggctctctacttctgtgtgccatttcgtgagaaactgctggaatactatgacaagaacaaaaatccggctgatccagaagaaaatttgctaacatgtttggcagatttattcacacagataagtatacaaaagaagaaaacaggtgtaattgctcccaagcgatttgtacagcgagttcgaaaagaaaatgagttgtttcgtggttacatgcatcaggatgctcatgagttcctaaattttttgttgaatgaacttgttgacatcctggagaaagaatcttctgcagctaaagataatacagatggttcatctactgaaacggttccaaatggcccacggaatggcgagaccaatggtgctactgctcaggagccccttgctacatgggttcataaaaattttcagggtatactgacgaatgaaacaaagtgcctgaggtgtgaaactgtaacagccagggatgagactttcttcgatttaagtcttgatattgaacagaacagctctattactagctgcctcaagaattttagctctactgagactctaaatgccgaagataaattcttctgtgacaagtgttgcagtttgcaagaagctcaaaaaagaatgaagatcagaaaaccacctcacatccttgtgatccacctgaaaaggttcaagtacattgagagtctaggtaggtacaaaaagctctcatatcgagttgtgttcccactcgagctcaagttgagcaataccatggaggacgctgactcagaatactccttattcgcggttgttgtacatgtcggtactggtccaaaccacggtcactatgttagcctggtgaaaagccataaccactggttgttctttgatgacgagaatgtcgatataattgacgagtcggctgttcagacattctttgggtcggcacaggagttttctagcaactcggagcacggctatatcttactctatgaacgggttacacccaaattttgatactttgttctcttgtggtgacttgtaatttgtgttgtagtgaaatggttcgagacctcaaaacgctttgctgtacattatgttgggttttatgacaacggactatggtaaatcacacataagttcagagttatgccaaggaatggtagcacgagatttagtggtcaacaataaaaaaaaaaaaac

SEQ ID NO: 5115 - DNA, 1529 bp, Orobanche aegyptiaca
tccacacctcattttctttcgattcaaagggaaaaggctcgagtaaaaaagtgtaacagtgagcaattagcaaaatctagaggtggttatcgtaattgatgaagaaatctgaaaatcgtgaagcagtgataagaagctgagaagcatagaggagtttttgtatatggtgaatggtgttgtcacattcataatgggtgtgacgggttcgaagctagagaaggctttgggagatcaatttccagaaggcgaacgttatttcggtttggaaaatttcggtaacacttgttattgcaacagcgtcctccaggcactatacttttgtgtcccatttcgtgaacagctgctggagtattattcgaaaaaccaaggtgaagcagatgagaatatcttaacatgtcttgcagatcttttctcgcagataagttcacagaagaagaaaacaggtgtaatagctccaaagcgctttgtacacagagttagaagagaaaatgagaattttcgtggatatatgcatcaggatgcccatgaatttttgaatttttgctgaacgaacttgttgatatactggagaaagagtctcacaaggtcacaagtgtgcccatgctccttccgttgagggtgttgaaaatgggccaagcaatggtcagatcaatggtgttaacaaggaaccattagttacgtgggtgcacaaaaattttcagggtattcttacgaatgagacgaggtgtttaaggtgcgagacagtaaccgcgagggatgagacgtttttagatttaagcctcgatatcgaacaaaacagttcgattactagttgcctcaagaatttcagctccacagaaaccctcaatgctgaagataagttcttctgtgatgagtgccgtagtttgcaagaagcccagaaaaggttgaagatcaagaaaccacctcgtattcttgtcattcatctcaagcgcttcaagtacatggaacagcttaaccgacacaagaagttatcctatcgtgtcgtgttcccgttagaactgaaactcagcaacaccgtggaggatgccgactcggagtattctttatttgctgttgtggttcatgttgggagcgggcccaaccacgggcattatgtgagtctcgttaaaagtcacaaccattggctgtttttcgatgacgagaatgtggagatggttgacgagtctgcaatccagacattctttgggtcggcacaagaatattcgggtagtaatgatcatgggtacattctcttctatgagagccttgcatctgacgatgacaaatgctgaacacataagtttatatatttgtttgggtcgtacaattacaatatacttgttttcatgtcgaatttgaataacgtgtgcaaaaaagaaaattgggtatgtaaagtatggattaataatgctccaaagatgaggctcaatagtaaaagctaacttgatcatgtatttgttgcactctgttttttggtattgaaatgtaatggaattctagtgctcggccgtgaaacattttttgtatgt

SEQ ID NO: 5116 - DNA, 1505 bp, Pennisetum glaucum
ctccaggctggagaaggcgctgggcgagcagttccccgagggcgagcgctacttcggcctcgagaacttcggcaacacctgctactgcaacagcgtcctgcaggcactttatttttgtgttcctttccgtgatcaattgctggagtactatgcaagcaataaaagcaccggagatgttgaagagaacatgctaacctgcctggctgatctgttctctcagatcagtaatcagaagaagaaaaccggagtcattgctcctaagcgttttatacaacgattgaagaaacagaatgaaattttccgcagttatatgcaccaggatgctcatgagtttctgaattttttactgaatgagctcgttgacattctagagaaggaacataatgctgcaagagagtcccttcaaaatctctcattgcaaaagaataccaatggccctattaatggcctacccaatggctgtcacaaggaatcagctgctacatgggtccataaatgcttccagggaatattgaccaatgagacaagatgtctgagatgtgaaactgtgactgatagagatgaaacattttttgacctgagcttggacatcgaacagaatagttcaatcactagctgtcttaagaacttcagctcgacagagactttgaatgctgaggataagttcttctgtgacaaatgttgcagtctacaggaagctcagaaaagaatgaagataaagaaaccaccaaacatcctggtaattcacctcaagcgtttcaagtatattgaacagcttcagcgctacaagaagctatcatatcgagtggttttccctctggagcttaaacttctcaacactgttgacaactcagacttggaatactccctttttgctgtggtagttcatgttggaagtgggccaaatcatggccactatatcagcttggttaagagccacaatcattggttattcttcgatgatgagaatgttgagatgactgatgagtccatggtacaggcattctttggctcaccacaagaattcagtggcaacactgataatggctacattctcttctatgaaagcttagcagaaaaaagttgatgtgctttctgataccatgtgattagttatatattttcgtttcacgcttccttcgcctgatgttataggatatgcagtgcaaagtaaaaatctagaataagcagaatgtgaggccgttcagcttccagatgttaggttgcaatcaactcttggcaataaaacaagtttcctgggagggctataggctataggtgcagaggcccacactattttgtacttcctatttctttcatctagttctttgtgtatcaattccagaataatgtttgttggaaacttttatagtcatgtaaagagataagctatcttgaaagcctttttggctgaaggtaaagagggaaaatttttgttctgaggtaaaaaaaaaaaagagagagagagagagatatattattattatttattattattattatta

SEQ ID NO: 5117 - DNA, 1824 bp, Secale cereale
tcagcgcaggcggccgcaccgatttgacggctcctttttatttcgcccgtttccttcctccaaaccatccatccgtcccgtttcttgctcctgctccaaccccccgcccggcccgcccgcccgccgatcccaagccggtactggcccgcgccgcgccgcagggccgtcgatccgccaccgtgcagcaaatgggagttgggcggtgatgggcgcggcgagctccaggctggagaaggcgctgggcgagcagttccccgagggcgagcgctacttcggcctagagaacttcggcaacacctgctactgcaacagcgtcctccaggcactttacttctgcgttcctttccgcgagcaattactcgagtactatgcaaacaataaaagcgccagcgatggcgaagagaacatgttaacctgcttggctgacctcttctctcagatcagcaaccagaagaagaaaacgggcgttattgctccgaagcgttttatccaacgactgaagaaacagaatgaacttttccgcagctatatgcatcaggatgctcatgaatttctgaattttttgttgaatgagctagttgacattcttgagaaagaatgtaaagccaataaagaatcttctcaaaattcatcttcaaataagaattctaatggccctagtaatggtcagcccaatggtagtcataaagaaccggatactacatgggtccacaaatgcttccagggaatattgactaatcaaacaaaatgtctgagatgtgaaaccgtcactgatagagatgaaacatttcttgacttgagcttggatatagaacagaatagttcaatcaccagctgtcttaaaaacttcagctcaacagaaactttgaatgccgaggataagttcttctgtgacaaatgctgcagtttacaagaagcacagaaaagaatgaagataaagaaacagccaaacatcctggtaatccatctcaagcgcttcaagtacatcgagcagcttggccgctacaaaaagctgacataccgggttgttttcccactggagcttaaactcatgaacacggtcgacaactcagacttggagtataccctcttcgcggtgctagtccacgtcggaagtgggccaaatcacggccactacatcagcgtggtaaagagccacaaccactggttgttcttcgacgatgagactgttgaaatgaccgatgagtccatggtacagacattcttcggctcagcacaggagttcagcggtaacaccgacaatggctacatactcttctacgaaagcgtcgctaaaacaagctgatgccttcccgcacgtctcgtgattagcaacaaagttttttcctttcatcgccacacctcctgctccgtgctatatagaagattcggtaagattagaataattcgaatggcaagaccgttcaaccttagatgctttggtggagtcggtgcttagcaataaagaagctgcgacgagctttgcgggtgggtgctatagccgccgaagcttgcagccttcttgctgttgtttttccgttgtggcacaagtttgtatcggtctggaataatgtttcttaaggggatcgtatcatgtgaagagatgcttgtatcttgaagcctttctggcttagtaaaattttgcttgagagagcttctgactaaaagaaaaaaaaaaaaaaaaaagaaaaaaaaaaaaaaaaaaaaaaaaaagaaaaaaaagaaaaaagaaaaaaagaaaagaaaatacagacagactagatactagatactagacgtacacgacacgaagacgagagaggtagagacggagagcaggcagag

SEQ ID NO: 5118 - DNA, 1753 bp, Panicum virgatum
ccatttcttcgttccccacccgtttcttcctcctttcctcccctgttccaatccaaccccccaccccaccccaatcgcaacagtttcactgcgccagtacaatccctgtccccccgcaccgcccgagccacaacagcgacaggcccgtcgcgccgatcgcgccgagccagccgcggcgttgctggcgggcaatgggagctgggcggcggcggtgatgggcgcggcgagctccaggctggagaaggcgctgggcgagcagttccccgagggcgagcgctacttcggcctcgagaacttcggcaacacatgctactgcaacagcgtcctgcaggcactttatttttgtgttcctttccgtgatcaattgctggagtactatgcaagcaataaaaacactggagatggtgaagagaacatgctaacctgcctggctgatctgttctctcagatcagtaatcagaagaagaaaactggagttattgctcctaagcgttttatacaacgattgaagaaacagaatgaaattttccgcagttatatgcatcaggatgctcacgagtttctgaattttttactgaatgagctcgttgacattctagagaaggaacataatgctgaaagagagtctcttcaaaatatttcgttgcaaaagaattcaaatggccctattaatggccaacccaatggtagtcacaaagaattagctgctacatgggtccataaatgcttccagggaatattgactaatgaaacaagatgtttgagatgtgaaactgtgactgatagagatgaaacgttttttgatctgagcctggacattgaacagaatagttcaataaccagctgtcttaagaacttcagctcgacagagactttgaatgctgaggataagttcttctgtgacaaatgttgcagtctacaggaagctcagaaaagaatgaagataaagaaaccaccaaatatcctggtaattcatctcaagcgtttcaagtatattgagcagctacagcgctacaaaaagctatcttaccgagtggttttccctctggagcttaaacttctcaacactgtagacaactcagacttggaatactctctttttgctgtggtagttcatgttggaagtgggccaaatcatggacactatatcagcttggttaagagccacaatcattggttgttcttcgatgatgagaatgttgagatgactgatgagtccatggtacaggcattctttggctcaccgcaggagttcagtggcaacactgataatggctacattctcttctatggaagccttgcagaaaaaagttgatgtgcttctgataccatgtgattgattatatacttctcctttccttccgaagcttccttcgcctaatgatatagaatatgcagtgcaaagtaaaaatagctagaataagcagattgtgagaccatcatcttcaaatgttatggtgcaatcaacgctaggcaataaaaacaagtttccgggaggggctataagctaggtgcagagccccccacttagtttgtagttcctgtttctttcatctagttctttgcatacaggttgtatcaattccagaataatgtttgttgaaaacctttattgtcatgtaaagagagatgttatcttggaagcctggaggtaaaaattttgtttgtaagataaaaagcttctcccaatccttatgggatcctcaactgcctatcttccctgtagcttggggatcattgtgtactgctccag

SEQ ID NO: 5119 - DNA, 1934 bp, Pinus taeda
gttaagcacttgcgctttgttccacatgtgcctttgccttgagcattctctcaagtccactcatcactttaatggttgcctttaaccaccgtgcccggctatttcagcggcagttgtgcattgaatttcagacatttttccctcttgtctagtccgcaggtattctcaaattttgaaaggcagacggatctgctggaagacatgcaaggcactgtaatggcagttagtataatttcttgacaataatgtaattcgtgggcttaaagatccgatctttgaattcctgacaaaaccccaacaatcagagcgcgagagcgagagcgagcatatggtcatgggaaccaccggctcaagactggaaaaggcactgggagatcagtttccggagggcgagcgctactttggccttgaaaatttcggcaacacctgctattgcaatagtgtccttcaggctctttatttctgtgttccttttagagagcagttgctggattattatagtcgtacaaagactgggagagaaacagaagagaatctgctcacatgcttggctgacctctttactcagatttactcacagaagaagaaaactggcgttattgctccaaaacgctttgtgcaacgagtgaaaaaggaaaatgaaaatttccgcagttatatgcaccaggatgcacatgagttcttgaatttccttttgaatgagcttgtggatattctagagaaagaagccaatgcggctgagaaattgtcagggaatttaaaccaacaggagaaggttgtaaatggcaaaatgaatggaacaagcaatggaaaccatcaacagcctgtcacatgggttcataaaatttttcaggggacccttacaaatgaaacaagatgtttatgctgtgaaactattacagccagagatgaaacatttctggaccttagtctggacattgaacaaaacagttctataacaagctgtctgcgtaacttcagctctactgagacactcaatgcagaggacaagttcttttgtgacaaatgttgcagcttgcaagaagcacagaagagaatgaaaataaagattccaccacgaattcttgtgatccatttgaagcgcttcaagtacatagaacaacttggacgatacaagaagctttcctatcgtgttgttttccctatggagcttaagttatgtaatacaactgatgatgcacctgggtcagatgctgagtactcactttttgcagttgtggtccatgtaggaagtggtccaaatcatggacactatgtcagtcttgttaagagccataaccactggcttttttttgatgatgagaatgtagaaatgatcgatgagtccgtagtgcagactttttttggctcaacgcaggagtattcaaataacacagaccatgggtatattttgttctatgaaagtctagttcagggttcttaaagtattgctatcgttgttggtgttcactttgcggtcctgacgtacttttgaccgttgtatatctttgaagtttcttggagatgcggatattcatctgtaattatctaggaattcagttcttggcttgttcaagatgcagtatgcggaagctcttctacaattgaaatcaagctagaaaacccttctatgtttgtaatgttggatgatgaaaaacagtagtggctcctctgtgatttgataacaaaaataaggtctgcatgattattccactggtggctaagttcccttttatagtagataggaggaagccattcggttgcttcttgtttctgagcgagtttctaagtgctactggaatggggggtgaattattgtgaatactctgcaattcattttcctatattttaatatttaaacaatttcacggaaggccacttgatttcttttctgcaatgcaagttgaaactttgtaacaaaaaaaaaaaaaaaa

SEQ ID NO: 5120 - DNA, 1716 bp, Pseudotsuga menziesii
cgtccaatccccaggcattctcaatttttgaaaggcagtcggatccgctggaagacatgcaaggcattataatggcaatttatatactgaacttgttgataatcatgtaattcgtgggcttaaggatccgatctttaaaagtcttgacaaaaccccaacaatcagagagagagagagcgagcatatggtcatgggaaccaccggctcaagactggaaaaggcactgggagatcagtttccggagggcgaacgctactttggccttgaaaatttcggcaatacatgctactgcaatagcgtccttcaggctctttatttctgtgttccttttagagagcagttactggattattatagtcgtgcaaaggctgggagagaatcagaggagaatctcctcacatgcttggctgacctctttactcagattaactctcagaagaagaaaactggtgttattgctccaaaacgctttgtgcaacgggtgaaaaaagaaaatgaaaatttccgcagttatatgcaccaggatgcacacgagttcttgaatttccttttaaatgagcttgtggatattctggagaaagaagccaatgcagctgagaaattgtcaggaaatttaaaccaaccagagaaggttataaatggcaaaatcaatggaacaagcaatggaacccaacaacagcccgtcacatgggttcataagatttttcaggggactcttacgaatgaaacaagatgtttatgctgtgaaacaattacagccagagatgaaacgtttctggaccttagtctggacattgaacaaaacagttctattacaagctgtctgcgtaacttcagctctactgagacgctcaacgcagaggacaagtttttttgtgacaaatgttgcagcttgcaagaagcacagaagagaatgaaaataaagatgccaccacgtattcttgtgatccatttgaagcgcttcaagtacatagaacaacttggacgatacaagaagctttcctatcgtgttgttttccctatggagctcaagttatgtaatactattgatgatgcacctgggtcggatgctgagtactcactttttgcagttgtggtccatgtaggcagtggtccaaatcatgggcactatgtcagtcttgttaagagccataaccactggctctttttcgatgatgagaatgtagaaatgattgacgagtctgtagtgcagactttttttggctcaacacaggagtattcgaataacacagatcatgggtatattttgttctatgaaagtctagttcagggttcttaaataattgctaccattgttggtgttcactttgcggtcctcagcaacttttgaccgttgtatatctttgaagtgtcttggagatgcggataatcatctgtaattatctagggattcagttcttgccttgctcaagctgcagtgtgcagaagctcttctacgattgaaatcaagctagaaaactcttctatgtttgtaatgctaaatgatgaaaacggtgtggcttctctgtcatttcataacaaaaataagctctgcaggataattccattggaggttaagttcccttttatagtttaatagataggaggaagccgtttagttgctctcgtctctgagcgagtttctaagtgctactggagtgagagatgaatttatgtgaatactctgcaaataatttcctatattttaatatttac

SEQ ID NO: 5121 - DNA, 1880 bp, Sorghum bicolor
tgatctgaaccgtcagattatgattctgatgacttgacgagacgggtcggttggacaggccaaaaccaggcatagcgatgtccacttcggggcatctgtgtcttttgggtttggcccatttcttcgcttccttccgcaaccgtgcgttccaacccaacccccaacaccccaaatcgcagcagtttcactgcgccacagtacaattcctgtcgcgcaccgcccgagccggccataacagcgacaggcccctcgcgccgatcgccgggcaatgggagctgggcgggggcggtgatgggcgcggcgggctccaggctggagaaggcgctgggcgagcagttccccgagggcgagcgctacttcggcctcgagaacttcggcaacacctgctactgcaacagcgtgctgcaggcactttatttttgtgttcctttccgtgatcaattgctggagtactatgcaaacaacaaaaacaccggagatgttgaagagaacatgctaacctgcctggctgatctgttctctcagatcagtaatcagaagaagaaaacaggggttattgctcctaagcgttttatacaacgattgaagaaacaaaatgagattttccgcagctatatgcatcaggatgctcacgagtttctgaattttttgctgaatgagctagttgacattctagagaaggaacataatgctgcaagagaacctcttcaaaatctcccattccaaaagaattcaaatggcactattgatggccaacccaatggtagtcacaaagaattagctgccacatgggttcataaatgcttccagggaatattgactaatgaaacaaggtgtctgagatgtgaaactgtgactgatagagatgaaacattttttgacctgagcctggacattgaacagaatagttcactcaccagctgtcttaagaacttcagctcaacagagactttgaatgctgaggacaagttcttctgtgacaaatgctgcagtttacaggaagcacaaaaaaggatgaagataaaaaaaccaccaaacatcctagtaattcatctcaaacggttcaagtatattgagcagcttcagcgctacaaaaaactatcataccgagtggttttcccactggagcttaaacttcttaacacagttgataattcggacttggaatactcccttttcgctgtggtagttcatgttggaagtgggccaaatcatggccactatatcagtttggttaagagccacaatcattggttattctttgatgacgagaacgttgagatgactgatgagtccatggtacaggcattctttggctcaccgcaagagttcagtggtaacactgataatggctacatactcttctacgaaagccttgctgaaagaagttgatgtccttctcataccaagtgattagctatacacttttcttttccttccatttctgctggggatatatagaatattcagtgaaaactagaataagctgaatgagaggccttcagcttcagatgttgtagtacaatcaatacctggcaataaaacaagttaccttgaggggctataggctatagctgaagacgccgactagtttgtagttccaactttatctgtttttatgcacatacaggttgtatcaattccggaataatgtttgttgaagacctttattatcatgtaatattttatctaggaagccttttttggtttcgagtaaagattttgtttcttagatgaaaagatcctgtcgatcttcattaggatcctcacctgctcatcggtagctgacacaagtcctgtacagtttccagattacctcctttgtgttattgtgccctgctcctatggtacataacatatttcagaattttgaagatgga

SEQ ID NO: 5122 - DNA, 1399 bp, Raphanus sativus
  misc_feature (781)..(781): n is a, c, g, or t
  misc_feature (823)..(823): n is a, c, g, or t
  misc_feature (850)..(850): n is a, c, g, or t
  misc_feature (859)..(859): n is a, c, g, or t
ggaagtttcgaaaatctgaaaatctcccgagcgagcgaaagaatccttaacatttgattctccgagtcgagtccggttcagaaaataacggtggtgtttcagaggtctaatggacgtggcgggttctaaactggagaaagctctcggcgagcagttcccggagggagagcgatacttcggtttcgaaaacttcggcaacacttgttactgcaacagtgttttgcaggccctttacttttgtgctccctttcgtgagcagttgctcgattactactccacaaataataaaagtgaggaggagaatcatctcttgacctgcttggctgatttgttttctcagataagtggtcagaagaagaagacaggagttattgctcccaagcgctttgtacagaggttgaagaaacaaaatgtgcttttccggagttatatgcatcaggatgcacatgagttcctcaattatttgctaaacgaacttggtgacatcttagagaaagaggcaaaagctgcaaaaacggacaacaaaacctcatcatctcctgaaaagatttcaaatggaccgaaacttcttcagccaaatggtgctcataaagagcctactgttacatgggtccacaagatctttcagggtatacttaccaacgagacaaggtgtctgcggtgtgagacagtaacagcaagagacgagacattccttgacctaagccttgatattgaacagaacagttccataactagttgtttgaaaagcttctgctccacagagactctacactctgangacaaattcttctgtgacaaatgctgcagtttacaagaagcncagaagaggatgaagatcaagaaaccnccacacatnttagtcatacatctgaaacggttcaaatacatagagcagttgggtcgctacaagaagctatcttacagagtcgtcttcccattagaacttaaactgagcaacacagtggaagattacgcggacaccgagtattctctcttgcagttgtggttcatctcggaaacggtcccaactatggtcactatgtaagcctcgttaaatcccataaccattggctcttctttgatgatgagaatgttgatatgatggaagaatctgctgttcaaacattcttcggctcatcacaagagtgctccagtaatactgatcatggctacctcttgttctatgagagcccccgaacaggttaagagggctttttagtctctcttgacaacaacttaatttctttctttcatgctgttttgtgacttgaaatcaaaaagtctgttttctttttaactaaaaataaactgaaagtttgtatactgatgaaaaccagacatgtacatcttactgacaagaaagattacaccatttgattataagtttatatttgta

SEQ ID NO: 5123 - DNA, 1637 bp, Triticum aestivum
gaggccgatccgtcgccgtgcagcgcgggcgggcaaatgggagttgggcggtgatgggcgcggcgagctcgaggctggagaaggcgctgggcgagcagttccccgagggcgagcgctacttcggcctcgagaacttcggcaacacctgctactgcaacagcgtcctccaggcactttacttctgtgtttcttttcgcgagcaattactgcagtactatgcaaacaataaaagcgccagtgatggcgaagagaacatgttaacctgcttagctgaccttttctctcagatcagcaatcagaagaagaaaacgggtgttattgctccaaagcgttttatacaacgattgaagaaacagaatgagcttttccgcagctatatgcatcaggatgctcatgaatttctgaattttttgttgaatgagctagttgacattctcgagaaagaatgtaaagccaataaagaaactcctcaaaattcatcttcaaataagagttctaatggccctattaatggtcagcccaatggtagtcataaagaaccagagactacatgggtccacaaatgcttccagggaatattgactaatcaaacaaaatgtctgagatgtgaaaccgtcactgatagagatgaaacatttcttgacttgagcctggatatagaacaaaatagttcaatcaccagctgtcttaaaaacttcagctcaacagaaactttgaacgccgaggataagttcttctgtgacaaatgctgcagtttacaagaagcacagaaaagaatgaagataaagaaacagccaaacatcctggtaatccatctcaagcgcttcaagtacatcgagcagcttggccgctacaaaaagctgacataccgagttgttttcccactggagcttaaactcatgaacacggtcgacaattcagacttggaatattccctcttcgctgtgctagtacacgtcggaagtgggccaaatcatggccactacatcagtgtggtaaagagccacaaccactggttgttctttgacgatgagactgttgagatgaccgatgagtccatggtacagacattcttcggctcagcacaggagttcagtggtaacaccgacaatggctacatactcttctacgaaagcgtcgctaaaacaagctgatgccttcccgcgtatctcgtgattagcaacacagtttttcattttgtcaccacacctactgctccgtgctatatagaagattcggtaaattagaataattcgaatggcaagaccattcaaccttagatgctttggtggagtcagtcagtgcttagcaataaagaagctgtgacgggttttgcgggtgggtactatagccgccgaagcttgcagtcttcttgatgttgtttctcgctgtggcacaagtttgtatcaatctggaataatgttccttaagaagatcttatcatgtgaagagatgcttgtatcttggaagccctctggctttgagtaaaattttgcttgagagagctcctgctgattctgaagtctaaaaacgatatctttcttatatgtagccgctgtttgctaattcgcgaacaaatctactgccttcctttctttgtcatttgtatttgtatatactgtatactctgatttggg

SEQ ID NO: 5124 - DNA, 1406 bp, Cephalotaxus harringtonia
ttgatttccatgttattttaaactatctgtggcaaaacaaaaccccattaggagcacgcggtggtcatatggtcatgggaaccaccggctcaagactagagagggcattaggagaccaatttccagaaggcgaacgctatttggcctcgagaattttggaaatacttgttactgcaacagcgtccttcaggccctttatttttgtgttccttttagagagcaattgctagagtattataatcgcacaaagactactggagaagtggatgagaatctcctcacatgcttggctgacctctttacccagatttattcccagaagaagaagacgggtgttattgcgccaaaacgctttgtgcaacgggtgaggaaacaaaatgaactttttcgtagttacatgcaccaggatgcacatgagttcttgaattttctcttgaatgagcttgtggacattttggaaaaggaagccaatgcttctaagaaattgtctggaaatataacccagccagagaaggctataaatggaaaattcaatggaccaacgaatggcacccaacaacaacctgtcacttgggttcacaaaatttttcaggggacacttacaaatgagacgagatgtttatgctgtgagacaattactgccagagatgaaacttttttggatcttagtcttgacattgaacagaacagttctattacgagctgtttgcgtaacttcagctcgactgagacacttaatgccgaggacaagttttttgtgacaagtgttgcagcctgcaagaagcacaaaagagaatgaaaataaagatcccaccacgtatacttgtgatccatttgaagcgctttaagtatatagaacaacttggacgatacaagaagctctcgtatcgtgttgttttccccatggagctgaagttatgtaatacaactgatgatgcaccaggttcagatgccgagtactcactctttgcagttgtggtccacgtagggagtggtccaaatcatggacactatatcagtcttgtcaagagccataatcattggctctttttgatgatgaaaatgtagaaatgattgatgaatctgttgtgcagacattttttggctcaacacaggaatattcaaataacacagatcatggatatattctgttctatgaatgtctagctcagggttcatgaggtgttgctattgttgctgtcgacctttcagtttccacgtggttgttaccaaaatgtatatcttggaagttgctgtgagatgtgtatcggcaggtctatattttcttccattgttcaggttgcactttgcagaagcttttgtacaattgaaatcaagactagcttctgcaatttgcagaaagtaattgtttttaccaggaagggtcagtcaagactggaaaagct

SEQ ID NO: 5125 - DNA, 1527 bp, Lippia dulcis
acacaaccgaacaacattcacttcacagacctaacatcgaacgcctgccgggcctctgattcaagcaagaagattgaagggagttcgttggttatccagagagagctgtgggctgactgtaattgatgaaggaatctgattactcaggaggagtgatagacctagaggaatagaggagttttggtatatggtggatggtgtcacactcgcaatgggtgtggcgggttccaaactagagaaggctttgggggaccagtttcccgaaggcgaacggtatttcggattggagaatttcggcaacacttgctactgcaacagcgtcctccaggctctttacttttgtgttccatttcgtgaacaacttctggagtattattccgacaacaaaaaccagggtgaagtagatgaaaatatcttaacatgtctcgcggaattgttctctcagataagttcacagaagaagaaaacaggtgtgatagctccaaaacgctttgtgtacagaattcggaaagaaaatgagaattttcgaggatacatgcatcaggatgcccatgaatttttgaactatctgctgaatgaacttgttgatatattggagaaagaatctcacaaagtgcccagtctaccacagaattcttctcaagaggttgctgtaaatgggctgagcaatggtcacaccaacggtgttaaggaaccacttgttacttgggtgcataaaaattttcagggtattcttacaaatgagacaagatgtttaaggtgtgagacagtcactgcgagagatgagacattcttagatttgagccttgatattgaacagaacagttcaattactagctgcctcaagaatttcagctccactgaaaccctcaatgctgaagataaattcttctgtgacaagtgttgtagtttgcaagaagcccaaaaaaggatgaagataaagaaaccacctcgtgttctggtcattcatttgaagcgcttcaagtatatggaaaatcgacacagaaaactatcatatcgtgttgttttccctctggaactgaaactgagcaacacaatggaggatgcagactctgaatactctttatttgctgttgtggttcatgtcgggagtgggcccaaccacgggcactatgtcagtcttgtcaaaagccacaatcattggttgtttttcgatgatgagaatgttgagattgttgacgagtcagcaatccaaaccttttttgggtcagcccaggagtactcgagtaacacagatcatggatacattctcttctacgagagtctccaaaacgaaaacaaatgatgaagaaaagtttcattacggggtaattttaaactgttctgtgtgggttgtatagctggtaaactcagttacagtataacatgcttgtttccttgttttctcatctccataacgtgtagttgcagcacaaaagttggcttttgcatgtacagtgaattatactagctccaagctgagtttggacaatagaaaagtggggttcttagtaagataaaaaagaa

SEQ ID NO: 5126 - DNA, 1207 bp, Valeriana officinalis
ccatccacgaatcacagatttctcgtccacacacaatctcgattttctagagactgaaaactagggctcggaagtgttcggatgcattagatgggtgctgccggctccaaactcgagaaagctctcggcgatcagtttcctgaaggtgaacggtactttggactcgagaatttcggcaatacttgttactgcaacagcgttttacaggctctgtatttctgcgtgccatttcgtgaacagctgatagaatattattcgaataacaaaagcctcactgattcagaagagaatctcttgacatgtcttgcagacctatttatgcagataacttctcaaaagaagaaaacaggtgttatagctccaaagcgatttgtacaaagattgaaaaaacaaaatgatgtgttccgcagctatatgcaccaggacgcgcatgaattcttgaactatttgctaaatgaacttgttgacattctggagaaagagttgacgaatgctgcaaagaacaacaatatcaataataattcagaaacaccaccttcgccgcccgaaaatattgcaaatgggcctaagagtgttcatgcaaatggtgttgcgcaaaaagaacctctcgtgacttgggtccacaaaaattttcagggcttactgacaaatgagacaaaatgcttacggtgtgagacagtaaccgcaagagatgaaacttttcttgatttgagtcttgatattgagcaaaacagttctatcactagctgcctcaaaaatttcagctccacggagactttaaatgccgaagataaatttttttgcgacaaatgctgcagtttacaagaagcccaaaagagaatgaagataaagaaatcgcctcaaattttagtgatccacttaaagcggttcaagtacatggagcagcttagccgatacaagaagctctcttacagagttgttttcccactcgagctcaaactcagcagctctgacgccaaagattctgacgcagaatattccctctttgctgtcgttgtccacgtaggcagcgggcccaaccacggccactacgtcagcctcgtcaaaagccacaaccactggctctttttcgatgacgagaacgtcgagatgatcgatgagtcagcagttcagactatttttggatcagctcaggaatattccagtaataccgaccatggttatattttgttctacgagagagttg

SEQ ID NO: 5127 - DNA, 1684 bp, Artemisia annua
atacggccggggcgaccgaaaaaaaaatagaaagtggcatgccatgatgctctctaaaagcaaatacttgtacggtacaaacagtaactgcacataacagatagtacccaaacccaacagcggagtcaaccgaccgtaactaaaaataccaactgttttacacaaacacacatctgttaaatcaaatccaagactgttaggtggtgaatattaggtgacagaaataagaatatatttgattttgattgttaggtttgagatgttctttttgtgagatagatagatagatagatagagtgaaaaggatgggggcacaaggttctaagcttgagaaagttttaggagatcagtttcccgaaggcgaaagatatttcggcctcgaaaactttggaaatacttgctattgtaactctgtcttgcaggctctttatttctgtgtcccatttcgtgaacagctactcgaatactatggaaatgttaaaaatccagcagatgtagaagaaaatctgcttacgtgtttagcagaattgtttatgcagattagtacacaaaagaagaaaacaggtgttgttgctccaaaacgctttgtgcatagagtaaagaaagaaaatgagctcttccgtggctacatgcatcaggatgcacatgagtttttgaacttcttgctaaacgagcttgctgatatactagagaaagaattagcaaaagttccagtggaaaatttgtcaccacctgataagatcactaatgggccagatggtggaccggtcaatgggggaaagaaggagcccttggttacatgggttcacaaaagcttccagggtatacttacaaacgagacaaggtgtttaaggtgtgagactgtaactgcaagggacgagacattcttagatttgagcctcgatatagagcagaacagttcaattacgagttgtttaaaaaacttcagttccactgagaccttgaatgctgaggataagtttttctgtgataaatgctgcagtttgcaggaagcacaaaagaggatgaagataaaaagaccacccaatattttagtcatccatttgaaacgtttcaagtacatggaacacctcagtaggtacaaaaaactatcatatcgtgtcgtattccctctggagctaaaactaacaaacacaatggaagacgccgattgtgaatattcattattcgcggtagtggttcatgtcggaagtggacctaaccatggccattatgtcagtttggtaaaaagccataaccactggctgttctatgatgatgagaatgtggagattattgatgaatctgctgttcagaccgcctttggttctgctcaggaatttgcaagtaatactgatcatgggtatatgctgttttatgagagcattgatactaacaagttgagctgataatccgtatgtttattaagatgaagtttattgataatgggttgccctatattatagaacaattttaagtagtttagaaaggtgtcgccttatgggttagatgttacagatgttggttccagtatgtttccatttctgtttctttatctaaaactacttattgtaaggctatgatcaggttttctgtttttgtttttgaggattgaattatatttgaataaaggccccaaatgatttagcacctgaccaaaaaaaaaaaaaaagtcggactagaa

SEQ ID NO: 5128 - DNA, 1960 bp, Physcomitrella patens
tgttgctcttcctttcgtttccttcctgctgcatcgtgcggctcgtcttgtcgcgtttcatgttcctggcgatggcctgtgttccctctgtcccaggggtgctgctgccgtcttgctcgctcttgtgtttgttccctcaggcgattcgtcgcgcaaagaagagagacgacttttgacgctaagacgaagaaaaagaagaagaagaagcagaagaagcagaggttgatgacgatgtgagaattggcggagtggcgggtggggaggagatttggaggagttattggctgggccaggggagtagcagctagacgaagacgctttttggtcatgggagcctcgagttcgaagctggagaaggtattgggagaccagtttccagagggagaacgatactttgggctggagaatttcggcaacacctgctattgcaatagtgttttgcaggctctgtacttctgcgttccattcagggaacaacttttggagtactgtggtcagaagaaacctgttgcggaatcagaagagaatctgctgacttgcttgtcagagctcttcacacagataaactcacagaagaagaagactggtgtgattgccccgaagcgttttgttcaaagggtgaggaagcagaatgagctatttcggagttacatgcaccaggatgctcacgagtttctgaactttctgctgaatgagctagttgacatcttggtaaaggaggcacaagcggctaattcaaattcaggctctcatacatccccagagaaggtggtgggcaacggggcaacgaatggattggcgaatgggaatcacaaggaaccagttgttacctgggtgcacaagatttttcagggtacgctgacaaatgaaaccagatgcttacggtgtgaaactatcaccgcgcgagatgagacgttcttagatctgagccttgacattgagcagaacagttctatcacgagctgcctgcggaatttcagttccacagaaacactcaacgcggaggacaagtttttttgtgataaatgttgcagtttgcaggaggctcagaagaggatgaaaatcaagtcaccgcctcgcattctagcactccacctgaagcggttcaagtacatcgagcagttggggcgttataagaagctgtcgtaccgtgtagtgttcccactggaattgaagctttgcaacacgacggacgatgcacctgggtcggaggcagaatattcgttgtttgctgtggtggtgcatgttgggagtggaccaaatcatggtcattacgtgagtctggtgaagagtcataaccactggctttttttcgacgatgagaatgtggagatcattgacgagtccatagttcagacattttttggatccactcaggaatattctaacaatacagatcatggatacattttgttctacgagagtttggatcagaagaagtaggattcggaattgggaaagctgacaaaacttagattgtgttgaaagattggttgccgtcggctcctggcatatctttcctttcttttagaacgacgcgtaacggttgtcggtgcttaatgaatatgcacctacaaccattgttggaaatgagtgttctagatggacaaagattactgtcgaataagaatccgcataactctctgtcattttacagctgtaactgactagtataatcactagtctacttgctgatggggcggatgatttcgatcagaggtgaggatggcaatatcttgtgagatatgcaaaaagattatggtttgttttcaaagaaatcttagaggttttgtttgaggacatccattcggtaattaattacaaatttctcacttacaactggagttgtacgtgattgtggtagatggtagaagagccgagcaggaacggcagtaatcaagtattgtatcaactattgtgatgtctctcatggataactcatgtaatttgaaattcttcg

SEQ ID NO: 5129 - DNA, 1740 bp, Abies balsamea
agtctacttatcactttcatggtgccgttcaccactgttctcagctatttcagcggcatttgtgcattgaatttcagacattttttcccccttgtccaattcccaggcattctcaaattttgaaaggcagacggatccgctgcaagacatgcaaggcattatgatggcagttcatataatttcttgataatcatgtaatcgtcggcttaaggatccgatctttaaaatcctgacaaaacccgaacaagcagagagagagaaagcatatggtcatgggaaccaccggctcaagactggaaaaggcgctgggagatcagtttccggagggcgaacgctactttggccttgaaaatttcggcaatacctgctactgcaatagcgtccttcaggctctttatttctgtgttccttttagagagcagttactggattattatattcgtacaaaggctgggagagaaatggacgagaatctcctcacatgcttggctgacctttttactcagatttactcacaaaagaagaaaactggtgttattgctccaaaacgctttgtgcaacgggtgaaaaaggaaaatgaaaatttccgcagttatatgcaccaggatgcacatgaattcttgaatttccttttgaatgagcttgtggatattctggagaaagaagccaatgcagctgagaaattgtcaggaaatttaaaccaacaagagaaggctataaatggcaaaatcaatggaacaagcaatggaacccaacaacagcctgccacatgggttcataaaatttttcaggggactcttacgaatgaaacaagatgtttatgttgtgaaactattacagccagagatgaaacttttctggaccttagtctggacattgaacaaaacagttctattacaagctgtctgcgtaacttcagctctactgagacactcaatgcagaggacaagtttttttgcgacaagtgttgcagcttgcaagaagcacaaaagagaatgaaaataaagattccaccacgtattcttgtgatccatttgaagcgcttcaagtacatagaacaacttggacgatacaagaagctttcctatcgtgttgttttccctatggagcttaagttatgtaatacaactgatgatgcacccgggtcagatgctgagtactcactttttgcagttgtggtccatgtaggcagtggtccaaatcatggacactatgtcagtcttgttaagagccataaccactggctcttttttgatgatgagaatgtagaaatgattgacgagtctgtagtgcagactttttttggctcaacacaggagtattcgaataacacagatcatgggtatattttgttctatgaaagtctagttcagggttcttaaagtattgctaccattgttggtgttcactttgcggtcctcacctactttcgaccgttgtatatctttgaagtttattgaaaacgcggatattcatctgtaattatctagggattgagttcttgccttgctcaagctgcagtatgcagaagctcttctacaattgaaatcaagctagaaaactactcaatgtttgtaacgtcaaacgatgaaaacagtagtggcttctttgtgatttgaataaaccaaaataagatctgacaagattattccattggtggctaacgttccctattatagtttagtagataggaggaagtccgttttggttgtctttcttgtttctgtagtgtagtttata

SEQ ID NO: 5130 - DNA, 1233 bp, Vinca minor
gagaaggccctaggagaccaatttccagaaggggaacgctattttggccttgaaaactttgggaatacttgctattgtaacagtgtcttgcaggcgctttacttctgtgttccgtttcgagagaaactgcttgaatattatgcaaataataacaaaaatccattggaagcagaagagaatctcttaacttgtctggcagaattgttctcccagataagttctcagaagaagaaaactggtgtcattgctccaaagcgctttgtgcagagagtgaggaagcaaaatgaagtttttcgtggctacatgcatcaggatgcccatgaatttttgaacttcttgctgaatgaacttgttgatatactggagaaagaatcccaagcagctaaatgtgcaccttctcgagagaggatggcagatgagaagaataaaatttatgaaaatggcacaaaggagccgttagttacttgggtacacaagaattttcagggtatccttaccaacgagacgaggtgtttaagatgcgagacagttacagcaagggatgagaccttctttgacttgagtctcgatattgaacagaatagttcgattactagctgcctaaaaaacttcagttccacagagactttgaatgccgaagataaatttttctgcgataagtgctgtagtctccaagaagcacaaaagagaatgaagatcaagaaaccacctcaaattctcgtcattcatctgaagcgtttcaagtacatggaacagttgggccgatacaagaagttgtcttatcgtgttgtcttccctctagagctgaaattaaacaacaccatggaaaatgcagacaccgagtactctttatttgctgtcgtcgtacatgttgggagtgggcccaaccacgggcattatgtcagtctcgtgaaaagccacaaccactggttgtactttgacgacgagaatgtggagatgatcgatgagtctagtgtccagactttctttggatctgctcaagaatactctagcaatacagatcacggatatatcctcttctacgagtgcctttctacaaacgacaagaggggataaccaaaagaggtatctaatttacatacaatacattcccattttgcaggaaaatgccgtctcccgagtcatttctgtttgaacttttgttttcctaatgacatgtgattaacaccgacacgagatactttcttatagagtggttgtgtgatgcatact

SEQ ID NO: 5131 - DNA, 1481 bp, Triphysaria pusilla
ggggattattatttttgcggagcattgataagaaaaagcttggagagatagaggagttttggtatatggtggctggtgtcacactcagaatgggtgtggcgggttcgaaactagagaaggctttgggagaccaatttcctgaaggcgaacgttatttcgggttggagaatttcggcaacacttgttattgtaacagcgtccttcaggccctttatttttgtgtcccatttcgcgatcagttgctcgagtattatacgaacaacaaaaaccaaggtgaaacagatgagaatatcttaacatgtcttgcggagcttttctcacagataagttcacagaagaagaaaacaggtgtaatagctccaaagcgctttgtgcacagagttagaagagaaaatgagaatttccgaggatacatgcaccaggatgcccatgaatttctcaactttttgctgaacgaacttgttgatatattggagaaagagtctcggaaactaactagtgccccacaaacctgttccgacgagagcactgaaaatgggccaagcaatggtcatatcaatggtgctgaaaagaaaccactagttacttgggtgcacaaaaattttcagggtattcttacaaatgagacgaggtgtttaaggtgtgagacggttaccgcaagggacgagacattcttagatttaagtctcgatatcgaacaaaatagctcgattactagctgcctcaaaaatttcagctccacagaaactctcaatgccgaagataaattcttctgtgacaagtgccgtagtttgcaagaagcccagaaaaggatgaagataaagaaaccacctcaaatcctggtcatccatctcaagcgcttcaaatacatggaacaacttaatcggcacaaaaagttgtcataccgcgttgtgtttccgcttgaactgaaactcagcaacaccatggaggatgctgattctgagtacactttgtttgctgttgtggttcatgttgggagcgggccaaaccacgggcattatgttagtctcgtcaagagtcacaaccactggctgttttttgacgacgagaatgtggagatggttgacgagtctgcaatccagacgttctttgggtcggcccatgaatactctggtagcaatgatcatggctacattctcttctacgagagctcagcgtctgacgacaaatgctgaatgaaaccactttatgatttgtttgggtcgtacaatatgcttgcttttcaggttcgattttaataacgtgtggtgagctgcacaaagattggtttatatgtacagtatgtgatatggatattgatcgaaagttgagtttcaacaataaaagctaacttgattataggtatttatagcagtttcttttcttggattggaatgttacatggaggtcttgtgtgcgttagactgaaagttagcaaacttgggtgtaaattagtcaaattttgagtgatcaatttagac

SEQ ID NO: 5132 - DNA, 1682 bp, Zea mays
aaataaaactgaaatatcgaggaagggacgggctcggcctctctgcccgaattcccgattgcgcctcctccgactccgagatcccgtcagccatggacgggctcctgtcgaagctccgcagcctggacgcgtaccccaaggtgaacgaggacttctacagccgcaccctctccggcggcatcatcacgctcgtctcctctgctgtcatgctcctcctcttcgtctccgagctccgattatatctccatgcagttactgagacaacactaagggttgatacttcaaggggagaaacacttcgcataaattttgatgtcacctttccagcccttcaatgttctataattagcctggatgcaatggacatcagtggacaggagcacctagatgtgaaacatgatgtattcaagcagcgaattgatgcccatggcaatgttattgcgactaggcaagatgtagttggtgggatgaagatggaggcacctctacaacatcatggtggaaggcttgaacacaatgaaacctattgtggctcttgttatggtgcacaagaatctgatgatcaatgttgtaacacatgtgaagatgttcgtgaagcctacaggaaaaaagggtggggtgtatcgaatccagatttgcttgaccagtgcaaaagggagggctttcttcaaagtataaaggacgaagaaggcgaaggatgcaatatttatggttttattgaagttaataaggttgctgggaatttccattttgctccagggaaaagtttccagcagtcaaatgtgcacgttcatgacttgctcccgttccagaaggacagcttcaatgtcagtcataagataaacagactaagttttggagaatactttccaggtgttgttaatccacttgatggggcaaattgggtgcagcattcatcatatggaatgtatcaatacttcatcaaggttgttcctacagtctacacggacataaatgaacacattattctctctaatcagttctctgtaacggaacattttagaagtggtgagagtggtcggatgcaggcccttcctggtgtgttcttcttttatgacctttctccaatcaaggtcacattcacggaacaacatgtgtcatttttacactttttaactaatgtttgcgctattgttggaggtgtgttcaccgtttctggaatcatagattcgtttgtataccatagtcaaagagcaatcaagaagaagatggaaataggcaaattcaactgatgttgccttactattgctgcaattaagtagctcctgttgcagctccaagatccagaaatgcaatgtggcttttcctcgaactcttggcacagttgcgtagttgacaaacaattgctcatcagataactcttgatgtgcttgccaacttgcttccggcaaagataccagcgagcaagatggtcatcttgtatacttcgatgttacatttttgtacgcttagtctgacaagaaaacattttacttcctcgagctgcaggtgttcgtgtactgttgtaaatttgtggtagagggagcctatctgtagtttttttttacaattatgtgtttgtaccagttttttctgagacatttgtagcttagacaggtaaagattgtttgaaatacatataaaccatttttgaaggaaagcaagcttatcgttgtaacccc

SEQ ID NO: 5133 - DNA, 1849 bp, Panicum virgatum
ggttgcctaactcctgcgaaggcgaaaccccctcgaacaagcccacaatctgaaaaaaaaaacggtatcatgtccctgctccattcccgtatcgatcgagcaaatccgcgaaaataaagcgaaaatagggagaggcagggtccgtctcgtctcccccggttccgcggcgccggcaattcccccgagatcccgtcagccatggacgggctcctgtccaagctccgcagcctggacgcctaccccaaggtgaacgaggacttctacagccgcaccctctccggcggcatcatcacgctcgcctcctccgtcgtcatgctcctcctcttcgtctccgagctccggttatatcttcatgcagttacagagacaacactaagggtggatacctcaaggggcgaacaacttcgcataaattttgatgtcaccttcccagcccttcagtgttctataattagccttgatgcaatggacatcagtgggcaagagcaccttgatgtgaaacatgatatattcaagcaacgaattgatgcccatggcaatgttattgctacgagacaagatgctgttggtgggatgaagatggaaaagcccttacaacatcatggcgggcggcttgaacataatgaaacctattgtggctcttgctatggtgcacaagaatctgatgatcaatgttgtaacacgtgtgaagatgttcgggaagcatacaggaaaaaaggttggggtgtatcgaatccagatctgcttgaccagtgcaaaagggagggcttccttcaaagcataaaggatgaagaaggtgaaggatgcaatatttatggttttattgaagttaacaaggttgctgggaatttccactttgctcctgggaaaagcttccagcagtcaaatgtgcatgtgcacgacttgcttccattccagaaggacagcttcaatgttagccataagataaataagttaagttttggtgattactttcctggtgtggttaatccccttgacggggcgcagtgggtgcagcattcatcatatggaatgtatcaatacttcatcaaggttgttcccactgcctacactgacataaatgatcacatcatcctctcaaatcagttctctgtgacggaacattttagaagtagtgaaagtggtcgcatacaagctcttcctggcgtgtttttcttttatgacctttccccaatcaaggtcacattcacagagcaacatgtgtcattcttgcacttcttaaccaatgtttgcgcaattgttggtggtgtgttcacggtttctggaatcatagattcatttgtataccatggccagagagcaatcaagaagaagatggaaattggcaaattcaactgagttactgagtgttgccttccaattgctgccaataattccatcttcagggcttcctttgggagaactctagctgtggtaaagcaagacggctccaagctcttggtgcacttgcatagtttagaaacacctgctcattgaatatcgcacggtgtgcttgcttgcttcctgcagaagatgccaggaagcaaaatgatcagcttgtacacttcgctgtcattcctctctgtcaaatgaaacattccagaggcactccatttttgtacgctgtagtctaacaggaaaacattttctgtgagatggtgtttgtatcattgtaaatctgtgtaagggggcacaagcctctttgtaggatttcttttttgggttgcgattatgttatttgtaacagattctttttctcagatgtttgtagacttcacagatataaagagtaaaaaaattgtaaagaccatttcaaggaaagaaagtttttcttctttggttttcgttc

SEQ ID NO: 5134 - DNA, 1836 bp, Panicum virgatum
aaaaaaccccccgcctaactccttcgaaggcgaaacccctcgaaccaggcgcaatctggaaaaaaaaccggtatcaacaccatgctccattcccgtttcgatcgagcaaatccgagaaaataaagcgaaaatagggagaggcaaggccggtctcgtctcccccggttccgcggcgccggcaattcccccgagatcccgtcagccatggacgggctcctgaccaagctccgcagcctggacgcctaccccaaggtgaacgaggacttctacagccgcaccctctccggcggcatcatcacgctcgcctcctccgtcgtcatgctcctcctcttcgtctccgagctccgattatatcttcatgcagttacagagacaacactaagggtggatacctcaaggggtgaaatgcttcgcataaattttgatgtcaccttcccagcccttcagtgttctataattagccttgatgcaatggacatcagtgggcaagagcaccttgatgtgaaacatgatatattcaagcaacgaattgatgcccatggcaatgttattgctactagacaagatgctgttggtgggatgaagatggaaaagcccttacaacatcatggtgggcggcttgaacataatgaaacctattgtggctcttgctatggtgcccaagaatctgatgatcaatgttgtaacacatgtgaagatgttcgggaagcatacaggaaaaaaggttggggtgtatcgaatccagatctgcttgaccagtgcaaaagggagggcttccttcaaagcataaaggatgaagaaagtgaaggatgcaatatttatggtttcattgaagttaacaaggttgctggcaatttccactttgctcctgggaaaagcttccagcagtcaaatgtgcatgtgcacgacttgcttccattccagaaggacagcttcaatgttagccataagataaataagttaagttttggagaatactttcctggtgtggttaatccccttgatggggcgcagtgggtgcagcattcatcatatggaatgtatcaatacttcatcaaggttgttcccactgtctacactgacataaatgatcacatcatcctctcaaatcagttctctgtgacggaacattttagaagtagtgaaagtggtcgcatacaagctcttcctggcgtgtttttcttttatgacctttccccaatcaaggtcacattcacagagcaacatgtgtcattcttgcacttcttaaccaatgtttgcgcaattgttggtggtgtgttcacagtttctggaatcatagattcatttgtataccatggccagagagcaatcaagaagaagatggagattggtaaattcaactgagtgttgccttcctattgctgccactaattccatcttcagggcttcctttggaagaactctagccgtggtaaagcaagactgcaagcttttggtgcacttgcatagtttggaaacacctgctcattgaatatcgcatggtgtgcttgcttgcttcctgcagaagatgccaggaagcaaaatgatcagcttgtacacttattccgctgtcaaatggaacatttcagaggcgctccatttttgtacgctctagtctaacaggaaaacatttttcttctgtgagatggtgtttgtatcattgtaaatctgtggaagggggcacaagcctctttgtaggattttttttgggttgcaattctgttatctgtaacagattctttttctcggatgtttgtagacttcacagataaagagtaaaaaaaatgtaaaagaccatttcaaggaaagacaatttttcttctttggttttcgttc

SEQ ID NO: 5135 - DNA, 1830 bp, Setaria italica
cgaatgcgaaacccccacgaacgaggcgtaatccggaaaaagaaaaaaaaccagcaccatctccatgctccattcccgtttcgatcgaggaaatccgcaaaaatagggcgaggcagggccggtctcgtctcccccggttccgcggccccggcagtctccccgagatcccgtcagccatggacgggctcctgtccaagctccgcaacctggacgcctaccccaaggtgaacgaggacttctacagccgcaccctctccggcggcatcatcacgctcgcatcctccgtcgtcatgctcctcctcttcgtctccgagctccgattatatcttcatgcagtcacagagacaacattaagggtggatacctcaaggggagaaaagctacgcataaattttgatgtcaccttcccagcccttcagtgttctataattagtcttgatgcaatggacatcagtgggcaagagcaccttgatgtgaaacatgatatattcaagcaacgaattgatccccatggcaatgttattgcgactagacaagatgctgttggtgggatgaagatggaaaagcccttacaacatcatggtgggaggcttgaacataatgaaacctattgtggctcttgctatggtgcacaagaatctgatgatcaatgttgtaacacatgtgaagatgtccgggaagcatacaggaaaaaaggttggggtgtatcaaatccagatctgcttgaccagtgcaaaagggagggcttccttcaaagcataaaggatgaagaaggtgaaggatgcaatatttatggtttcattgaagttaacaaggttgctgggaatttccactttgctcctggaaaaagcttccagcagtctaatgtgcatgtgcatgacttgcttccattccagaaggacagtttcaatgttagccataagataaataagttaagttttggagaacactttcctggtgtggttaatccccttgacagggcgcaatgggtgcagcactcatcatatggaatgtatcaatacttcatcaaggttgttcccactgtctacactgacataaatgatcgcatcatcctctcaaatcagttctctgtgacggaacattttagaagtagtgagagtggtcggatacaagctcttcctggcgtgtttttcttctatgacctttccccaatcaaggtcacattcacagagcaacatgtgtcattcttgcacttcttaaccaatgtttgtgcaattgttggtggtgtcttcaccgtttctggaattatagattcatttgtataccatggccagagagcaatcaagaagaagatggaaattggcaaattcaactgagtcacaaagtgtcaccttcctattgctgctgctaattccattttcagagcttcctttggaagagctctagctgtgggaagactacagagcaaggctgctccaagctcttggtgcactttctgacttgcatagtttagaaacaactgctcattgaatatcccttggtgttcttgcttgcttcccgcagaagatgccaggaagcaaaatgatcaggttgtacactttgctgttactctgctccagcaaatggaacattttcagaggcgctccatttttgtatgctctagtctgacaggaaaacattttacttttgtgagctggtgtttgtaccattgtaaatttgtgtaagcgggcacaagcctctatgtaggattttttgggggtgcaattctattatctgtaacatgttaattttcctggattttatagatttcacagataagactcaaaatgtaaagaccatttcaaggaaagaaaatctgatctttaacca

SEQ ID NO: 5136 - DNA, 2191 bp, Oryza sativa
ctttttggtctgaagtctaaaccgcagagcaccggctccaacgaggcgcgcacataaggaaaggaaaacctgcaacaactccatggtctcctcccgtttcgatcaaacaaaagaccagaaaataaaagagaaaaaggtaatagtaagcctccgttcccaaactcccccaaaggcctccaagctcgagctcgaccccgaaccggaaacattcctcgtcggcgaggagcggcgagatcccccgggccccggccatggaggggctcctgtccaagctccggagcctggacgcctaccccaaggtgaacgaggacttctacagccgcacgctctccggcggcatcatcacgctcgcctcctccgtcgtcatgctcctcctcttcgtctccgagctccgattatatcttcatgcggtcacagaaacaacactaagggttgatacctcaaggggagaaacacttcgcataaattttgatgtcacctttccagcccttcagtgttctataataagccttgatgcaatggacatcagtggacaagagcaccttgatgtgaaacatgatatattcaagcagagaattgatgtccatggtaatgttattgcaactaagcaagatgcagttggtgggatgaaggtggaacagcccctacagcggcatggcggcaggcttgaacacaatgagacctattgtggctcttgttatggtgcggaagaatctgatgagcagtgttgtaactcgtgtgaagatgttcgagaagcatacaggaaaaaaggttggggtgtatcaaatccagatttgatcgaccagtgcaaaagggaaggcttccttcagagtataaaggatgaagaaggagaaggatgcaatatttatggtttcctggaagttaacaaggttgctggaaatttccactttgctccagggaaaagcttccagaaggcaaatgttcatgtccacgacttgcttccattccaaaaggacagcttcaatgtcagccataaaataaataagttaagttttggacaacgctttcctggtgtggttaatcctcttgacggggcacaatggatgcaacattcatcatatggaatgtaccaatacttcatcaaggttgttcccactgtctacacagacataaatgaacacattattctttcgaatcagttttctgtgacggaacattttagaagtagtgagagcggtcggatacaggctgttcctggagtatttttcttttacgacctttcgccaattaaggtcacattcacggaacagcatgtgtcatttttgcacttcttaactaatgtttgcgctatagttggaggcgtcttcactgtttctggaatcatagattcatttgtataccatggccagagagcaatcaagaagaagatggaaatcggaaaattcaactgaatattgaatgtagccttcctgttggtactacccacaactcattccattttcaggacttacttttgaagaactattgtcacagtagggggcgaggccgctccaagttcaaaaaacgccagtgaaccaacccactaatatttctcatatgctttctgctctgaaactattgattcccgtgcatagtttataaccaactggtcatcaaagtacaagtgacttggctgcttgcttccagcagaagctacctgtaaaggaaatggttcatctggttatactgccctggggcaaacggagcatttcagagatgctcaattttgtacaccataccaggaaacattttgtgtaagctgcatttttttttcttttgttgtaaatcggtgactccgtgttaatgagctcttgcttctttgtagaacagaaaattttcctgactccgtgttttatacatcatattcttttacttacctgtagctttcacatgctaggtaaaagaatgtgtaattatttcgaggaaaagtttcttttctcccttgctccccgttctctacaaagtttactgtaatcggtagaagtcaatgaccattgtattagatataaagtaaccatgtgacggtgtggatggtatcccataatgaatgcaccatgtcttttgctccgtccgtcataaaaaaaagataagtatttatgaatctggatgtctagaacttcatgtttatatattttttatattcaaggatggatgggtgtgctgtatatacttgttgtaattaagaaggggc

SEQ ID NO: 5137 - DNA, 1815 bp, Hordeum vulgare
gagatgagggccttaacacctgggctccacccgtggcggttgggtgatctaccgatcccgcggctgaggaaaaaaaactgaaacagccctcggtcgtccgtccgtccccaacgccccggtctctcaagcaagaccggaaatcctccccgcggcgtcgtcgcggggcagcgccgccccagatcctccggccatggacgggctactgtccaaactccggagcctggacgcgtaccccaaggtgaacgaggacttctacagccgcaccctctccggcggcgccatcacgctcgcctcctccttcatcatgctcctcctcttcgtctccgagctccgattgtatcttcatgcagttacagagacaacactaagggttgatacctcaagaggagaaaaacttcgcataaattttgatatcacctttccagcccttcagtgttctattattagtgttgatgtgatggacatcagtggacaagagcaccttgatgtgaaacatgatgtattcaagcagcgaatcgatgcacatggcaatgttattgcaactaagcaagatgcagttggtgggatgaaggtggaaaaacctttacaacatcatggtggaaggcttgaacacaatgagacctattgtggctcatgttatggtgcacaagaatctcctgaacaatgttgtaactcgtgtgaagatgtccgtgaagcatacagaaagaaaggttggggcgtatcaaatccagattcgatcgatcagtgcaaaagcgagggcttcctacaaacgataaaggatgaagaaggtgaaggatgcaacatttatggctttctggaaattaacaaggttgctgggaatttccactttgctccagggaaaagcttccagcagtcaaatgttcatgttcacgatctgcttccattccaaaaggatagcttcaatctcagccataagataaataaattgagttttggagaaccctttcctggtgtgatcaatccccttgacggggcgcaatggatccagcattcatcatatggaatggctcaatactttgttaaggttgttcccactgtatactctcacataaatgagcaaattattctctccaatcagttttctgtgacagaacattccagaagtggcgatagtggtcgggtacaagctcttcctggcgtgtttttcttttatgacctttcaccaattaaggtcacgtttacggagcgccatgtctcgttcttacacttcttaactaatgtatgcgctattgttggaggtgtgttcactgtttctggaatcatagattcgtttgtctaccatggccagagggcaatcactaagaagagggaactcggcaaattcacctgagttttcaatcaagccttcctattgctgcagtacctccttttgaatgactctagtctgtagctgcagtagaaagagtcttctccgaagtccgaaaagtgtacaactgaaccaacaggccggtatctttgtcacagcttgtgctctggaactcctggtgcgctgcctgctttccggctgaagctgccagcatacaaaatggcttgtctgcgatgttcgtatatcgctcaggcaaatggaacatttcggaggtgctcaatttttgtacacttaagtccacaaggacaaaggttttgtcgttctaaactgcaagtttttgtatttttgtaaatctgtgtaagagtgatgtagactgtacaatactcatgacaggtatttttcttagacatttcgtagctcttacaggccaggttaaaaaaaaacaaaaaaaacgtaaagaccatttgaaggaaactaacttcagtttg

SEQ ID NO: 5138 - DNA, 1972 bp, Hordeum vulgare
caaagcagaagaaagccgagccagccagcgcctgcccggcggctcgtcccccgtgctccattcccgttccgatcagacaactccccgggcaaggctcctcggaaggaaaaaaaaaaactgaaacagccctcggtcgtccgtccgtccccaacgccccggtctctcaagcaagaccggaaatcctccccgcggcgtcgtcgcggggcagcgccgccccagatcctccggccatggacgggctactgtccaaactccggagcctggacgcgtaccccaaggtgaacgaggacttctacagccgcaccctctccggcggcgccatcacgctcgcctcctccttcatcatgctcctcctcttcgtctccgagctccgattgtatcttcatgcagttacagagacaacactaagggttgatacctcaagaggagaaaaacttcgcataaattttgatatcacctttccagcccttcagtgttctattattagtgttgatgtgatggacatcagtggacaagagcaccttgatgtgaaacatgatgtattcaagcagcgaatcgatgcacatggcaatgttattgcaactaagcaagatgcagttggtgggatgaaggtggaaaaacctttacaacatcatggtggaaggcttgaacacaatgagacctattgtggctcatgttatggtgcacaagaatctcctgaacaatgttgtaactcgtgtgaagatgtccgtgaagcatacagaaagaaaggttggggcgtatcaaatccagattcgatcgatcagtgcaaaagcgagggcttcctacaaacgataaaggatgaagaaggtgaaggatgcaacatttatggctttctggaaattaacaaggttgctgggaatttccactttgctccagggaaaagcttccagcagtcaaatgttcatgttcacgatctgcttccattccaaaaggatagcttcaatctcagccataagataaataaattgagttttggagaaccctttcctggtgtgatcaatccccttgacggggcgcaatggatccagcattcatcatatggaatggctcaatactttgttaaggttgttcccactgtatactctcacataaatgagcaaattattctctccaatcagttttctgtgacagaacattccagaagtggcgatagtggtcgggtacaagctcttcctggcgtgtttttcttttatgacctttcaccaattaaggtcacgtttacggagcgccatgtctcgttcttacacttcttaactaatgtatgcgctattgttggaggtgtgttcactgtttctggaatcatagattcgtttgtctaccatggccagagggcaatcactaagaagagggaactcggcaaattcacctgagttttcaatcaagccttcctattgctgcagtacctccttttgaatgactctagtctgtagctgcagtagaaagagtcttctccgaagtccgaaaagtgtacaactgaaccaacaggccggtatctttgtcacagcttgtgctctggaactcctggtgcgctgcctgctttccggctgaagctgccagcatacaaaatggcttgtctgcgatgttcgtatatcgctcaggcaaatggaacatttcggaggtgctcaatttttgtacacttaagtccacaaggacaaaggttttgtcgttctaaactgcaagtttttgtatttttgtaaatctgtgtaagagtgatgtagactgtacaatactcatgacaggtatttttcttagacatttcgtagctcttacaggccaggttaaaaaaaaacaaaaaaaacgtaaagaccatttgaaggaaactaacttcagtttgtcagggtgtttttcgtaacttatcttcctggtaaccttttgaaggtattactgttgaagaatattgctttagtcgtaggtgcttatcgtcatgttttgtagtcgtggtcttgttgac

SEQ ID NO: 5139 - DNA, 2094 bp, Brachypodium distachyon
tttttgtcaattcacgcttaaataagatcagtggccggatcaaaattaaaataaaatagagggttcatttactcatttctttagatgaatttactcttttgatcacaaagcggaagtgcgagcaggaaaaagctagcgcctgctggtctccccgtgctccatctccgttttgatcagacaacttcccgataaacaacttggaaataggaacaggctaggctcggccgtcccctattcccgattcgtcaaccaaagcccgaatcttagccgcctcgccccggcgtcgtcgggggagcgccgagatcctcctgccatggacgggctcatgtccaagctccggaacctggacgcgtaccccaaggtgaacgaggacttctacagccgcaccctctcaggcggcgtcataacactcgcctcttccttcgtcatgctcctcctcttcgtctccgagctccgattgtatcttcatgcagttacagagacaactctaagggttgatacctcaaggggagaaaaacttcgcataaattttgatatcacctttccagccctgcagtgttctataattagtatcgatgtgatggacatcagtggacaagagcaccttgatgtgaagcatgatgtattcaagcagcgaattgatgccaatggcaatgttattgcaactaagcaagatgcagttggtgggatgaaggtggaaaagcccttgcagatgcatggtggcaggcttgaacacaatgagacctattgtggctcatgttatggtgcagaagaacctggtgaacaatgttgtaattcatgtgaagatgtccgcgaagcatacaggaaaaaaggttggggcgtatcaaatccagattcgatcgatcagtgcaaaagggagggtttcctccaaactataaaggatgaagaaggtgaaggatgcaacatttacggcttcgtggaaattaacaaggttgctggaaatttccactttgctccagggaaaagcttccagcagtcaaacgttcatgttcacgatctgcttccatttcaaaaggatagcttcaatgtcagccataagataaataaattaagttttggagaaccctttcctggtgtggtcaatccccttgacggggcgcattggttccaacattcaccatatggaatgtatcaatacttcgttaaggtcgttcccactgtatactctcacataaatgagcagattattctctccaatcagttttctgtgacagaacatgccagaagtagcgagagtgtccgtatgcaagctcttcctggcgtgtttttcttttatgacctttcgccaattaaggtcacattcacggagcgccatgtgtcattcttacacttcttaactaatgtttgtgcgattgttggaggtgtgttcactgtttctggaatcatagattcattcgtctaccatggccagagagcaatcactaagaagagggaaattggcaaattcaactaaatgttcaatcaagccttcctgttgctgccaactattccatcttaggaatcgagtcctctccaggttccaaaagtacgagtgaaccaaccggttggtatctttgtcatagttttcgctctggaacttgtgatgtgcttgcagacaactgtttttcaagtaactgttggtgccttgcttccagcagaagctgctgtcatacaaaatggctcatcttcgcactctggcaaatggaacatttcagaggtgctcctttttgtacactagtctacgaggaaaaacgagttattgttgtaagcagcatgttttttttttgtatatctttgtaaatccgccaagaggactgtagactgtcggtagaatggatatttttggctatgagtaagttataacaggttatatttttcttcatttgcagcccttgcaggccaggttaaaagatgtaaagaccctttgaaggaaattaagtttatatttcttttactgtgtttcctttccaactaagacctgggtactttgttggttgcttgctggctatgcgttgggtaaaatgatttatggaaaataccttggtttgtgaatcaagttactttatatttcaaccgtaacatgatcaggacaaa

SEQ ID NO: 5140 - DNA, 1778 bp, Secale cereale
atcagacaactccccgggcaaggctcctcgaaaaaaaagaaattgaaacagcctcggtcgtccgtccccaccccccggtccctcaagcaagaccggaaatcctccccgcggcgtcgtcgggggcagcgccgcccagatcctccggccatggacggtctcctgtccaagctccggagcctggacgcgtaccccaaggtgaacgaggacttctacagccgcaccctctccggcggcgccatcacgctcgcctcctccttcatcatgctcctcctcttcgtctccgagctccgattgtatcttcatacagttacagagacaacactaagggttgatacctcaagaggagaaaaacttcgcataaattttgatatcacctttccagcccttcagtgttctataattagtgttgatgtgatggacatcagtggacaagagcaccttgatgtgaaacatgatgtattcaagcagcgaatcgatgcacatggcaatgttattgcaactaagcaagatgcagttggtgggatgaaggtggaaaaacctttacaacatcatggtggaaggcttgaacacaatgagacctattgtggctcatgttatggtgcacaagaatctcctgaacaatgttgtaactcgtgtgaagatgtccgtgaagcatacagaaaaaaaggttggggcgtatcaaatccagattcgatcgatcagtgcaaaaccgagggcttccttcaaaaaataaaggatgaagaaggtgaaggatgcaacatttatggctttctggaaattaacaaggttgctgggaatttccactttgctccagggaaaagcttccagcagtcaaatgttcatgttcacgatctgcttccattccaaaaggatagcttcaatctcagccataagataaataaattgagttttggagaaccctttcctggtgtgatcaatccccttgacggggcgcaatggatccagcattcatcatatggaatggctcaatactttgttaaggttgttcccactgtatactctcacctaaatgagcaaattattctctccaatcagttttctgtgacagaacattccagaagtggcgatagtggtcgggtacaagctcttcctggcgtgtttttcttttatgacctttcaccaattaaggtcacgttcaccgagcgccatgtgtcgttcttacacttcttaactaatgtatgcgctattgttggaggtgtgttcactgtttctggaatcatagattcgtttgtctaccatggccaaagggcaatcaccaagaagagagaactcggcaaattcacctgagttttcaatcaagccttcctattgctgcagaacccccttttgaatgactctagtctgtagctgcagtagaaagcgagtcttctccgaagtccgaaaagtgtttaactgaaccaacaggccggtatctttgtcacaacttgtgctctggaacacctggtgcgctgcctgcttacttcccgctgaagctgccagcatacaaaatggctcatctggtgtactgtgatgttggtatatcgctcaggcaaatgggacatttcagaggtgctcaatttttgtacactcaagtccacaaggacaaaggttttgtcgttctaaaccgcaagtttttctatctttgtaaatccgtgtaagcgggctgtagactgtacaatactcatgacaggatttatttctcttagacattttgtagctcttacaggccaggtcaaaaaaagaaaacgtaaagaccatttgaacgaaagtaagttcaa

SEQ ID NO: 5141 - DNA, 1724 bp, Triticum aestivum
gacaactccccgggcaaggctcctcggaaaaaataaattgaaacagcctcggtcgtccgtccccaccttcccggtccctcaaccaagaccggaaatcctccccgcggcgtcgtcgggggcagcgccgcccagatcctccggccatggacgggctcctgtccaagctccggagcctggacgcgtaccccaaggtgaacgaggacttctacagccgcaccctctccggcggcgccatcacgctcgcctcctccttcatcatgctcctcctcttcgtctccgagctccgattgtatcttcatgcagttacagagacaacactaagggttgatacctcaagaggagaaaaacttcgcataaattttgatatcacctttccagcccttcagtgttctataattagtgttgatgtgatggacatcagtggacaagagcaccttgatgtgaaacatgatgtattcaagcagcgaatcgatgcacacggcaatgttattgcaactaagcaagatgcagttggtgggatgaaggtggaaaaacctttacaacatcatggtggaaggcttgaacacaatgagacctattgtggctcatgttatggtgcacaagaatctcctgaacaatgttgtaactcgtgtgaagatgtccgtgaagcatacagaaaaaaaggttggggcgtatcaaatccagattcgatcgatcagtgcaaaagcgagggcttccttcaaacaataaaggatgaagaaggtgaaggatgcaacatttatggcattctggaaattaacaaggttgctgggaatttccactttgctccagggaaaagcttccagcagtcaaatgttcatgttcacgatctgcttccattccaaaaggatagcttcaatctcagccataagataaataaattgagttttggagaaccctttcctggtgtgatcaatccccttgacggggcgcaatggatccagcattcatcatatggaatggctcaatactttgttaaggttgttcccactgtatactctcacctaaatgagcaaattattctctccaatcagttttctgtgacagaacattccagaagtggcgatagtggtcgggtacaagctcttcctggcgtgtttttcttttatgacctttcaccaattaaggtcacgttcacggagcgccatgtgtcattcttacacttcttaactaatgtatgcgctattgttggaggtgtgttcactgtttctggaatcatagattcgtttgtctaccatggccagagggcaatcactaagaagagggaactcggcaaattcacctgagttttcaatcaagccttcctattgctgcagaacctccttttgaatgactctagtctgtagctgcagtagaaagcgagtcttctccaaagtcctaaaagtgtacaactgaaccaacaggcaggtctctttgtcacagcttgtgctctggaactcctggtgcgctgcctgcttacttccggctgaagctgccagcatacaaaatggctcatctggtgtactgtgatgttggtatatcgctcaggcaaatggaacatttcagaggtgctcaatttttgtacacttcagtccacaaggacaaaggttttgtcgttctaaactgcaagtttttgtatctttgtaaatccgtgtaagcgggctgtagactgtacaatactcatgacaggttttatttttcttagacattttgtagctcttacaggc

SEQ ID NO: 5142 - DNA, 1908 bp, Triticum aestivum
ccggtccctcaaccaagaccggaaatcctccccgcggcgtcgtcgggggcagcgccgcccagatcctccggccatggacgggctcctgtccaagctccggagcctggacgcgtaccccaaggtgaacgaggacttctacagccgcaccctctccggcggcgccatcacgctcgcctcctccttcatcatgctcctcctcttcgtctccgagctccgattgtatcttcatgcagttacagagacaacactaagggttgatacctcaagaggagaaaaacttcgcataaattttgatatcacctttccagcccttcagtgttctataattagtgttgatgtgatggacatcagtggacaagagcaccttgatgtgaaacatgatgtattcaagcagcgaatcgatgcacacggcaatgttattgcaactaagcaagatgcagttggtgggatgaaggtggaaaaacctttacaacatcatggtggaaggcttgaacacaatgagacctattgtggctcatgttatggtgcacaagaatctcctgaacaatgttgtaactcgtgtgaagatgtccgtgaagcatacagaaaaaaaggttggggcgtatcaaatccagattcgatcgatcagtgcaaaagcgagggcttccttcaaacaataaaggatgaagaaggtgaaggatgcaacatttatggcattctggaaattaacaaggttgctgggaatttccactttgctccagggaaaagcttccagcagtcaaatgttcatgttcacgatctgcttccattccaaaaggatagcttcaatctcagccataagataaataaattgagttttggagaaccctttcctggtgtgatcaatccccttgacggggcgcaatggatccagcattcatcatatggaatggctcaatactttgttaaggttgttcccactgtatactctcacctaaatgagcaaattattctctccaatcagttttctgtgacagaacattccagaagtggcgatagtggtcgggtacaagctcttcctggcgtgtttttcttttatgacctttcaccaattaaggtcacgttcacggagcgccatgtgtcattcttacacttcttaactaatgtatgcgctattgttggaggtgtgttcactgtttctggaatcatagattcgtttgtctaccatggccagagggcaatcactaagaagagggaactcggcaaattcacctgagttttcaatcaagccttcctattgctgcagaacctccttttgaatgactctagtctgtagctgcagtagaaagcgagtcttctccaaagtcctaaaagtgtacaactgaaccaacaggcaggtctctttgtcacagcttgtgctctggaactcctggtgcgctgcctgcttacttccggctgaagctgccagcatacaaaatggctcatctggtgtactgtgatgttggtatatcgctcaggcaaatggaacatttcagaggtgctcaatttttgtacactcaagtccacaaggacaaaggttttgtcgttctaaactgcaagtttttgtatctttgtaaatccgtgtaagcgggctgtagactgtacaatactcatgacaggttttatttttcttagacattttgtagctcttacaggcgaggtcaaaaaaacataaagaccatttgaacgaaactaagctcaatttgtcagggtgtttttcgtaacttctcttcctggtaaccttttgaaggtattgctatcggaagaatgtcgatttagtcgtaggtgcttatcatcatgttttgtagtcatggttttgttcacagatgacactggttactccacgttttccaccatgattagcataatgctcatgcattgcagtgaagcaaaacaaagggtgagaagtta

SEQ ID NO: 5143 - DNA, 1736 bp, Festuca arundinacea
  misc_feature (23)..(23): n is a, c, g, or t
  misc_feature (52)..(52): n is a, c, g, or t
  misc_feature (80)..(80): n is a, c, g, or t
  misc_feature (124)..(124): n is a, c, g, or t
  misc_feature (187)..(187): n is a, c, g, or t
  misc_feature (278)..(280): n is a, c, g, or t
  misc_feature (858)..(858): n is a, c, g, or t
  misc_feature (1126)..(1126): n is a, c, g, or t
ggcacgagggcggttcgtcaacnaagccccgaaaccgaaagtcctctctggngtggggcagcgccgagatcctctccggncagccatggacgggctgctgtccaagctccggagcctggacgcntaccccaaggtgaacgaggacttctacagccgcacgctctccggcggcctcatcacgctcgcntcctcactcgtcatgctcctcctcttcctctccgagctccgattgtatcttcatgcagctacagagacaacactaagggttgatacctcannnggagaaaaacttcgcataaatttcgatatcaccttcccagcccttcagtgttctataattagcgttgatgtgatggacatcagtggacaagagcaccttgacgtgaaacatgatgtattcaagcagcgaattgatgccaatggcaaggttatttcaactaagcaagatgcagttggtgggatgaaggtggaaaagcccttgcaacatcatggtggcaggcttgaacacaatgaaacctattgtggctcatgttatggtgcacaagaatctgatgaacaatgttgtaactcgtgtgaggatgtccgtgaagcataccgaaaaaaggggtggggtgtatcaaaccctgattcgatcgatcagtgcaaaagtgagggcttccttcaaagtataaaagatgaagaaggtgaaggatgcaatatttatggcttcctggaaattaacaaggttgctgggaattttcactttgctccagggaaaagcttccagcagtcaaatgtccatgttcatgatctgcttccgttccaaaaggatagcttcaatctcagccataagataaataaattaacttttggagaacnctttcctggtgtggttaatccccttgacggggcacattgggtccagccttcatcatatggaatgtaccaataccacattaaggttgttcccactgtatactctcacctaaataagcaaattattctctccaatcagttttctgtgacagaacatgccagaagtggcgacagtggtcggatacaagctcttcctggcgtgtttttcttttatgacctttcaccaattaaggtcacattcacggaacaccataggtcattcttacacttnttaaccaatgtttgcgctattgttggaggtgtgttcactgtttctggaatcatagattcatttgtctaccatggccagagagcaatcactaagaagagggaactcggcaaattcaactgagctttcaatcaagccctccaattgctgccagttattccatcttccgaacttccttttgaattactgtagctgcagtagaaaccgagtcttctccaagctccaaagtacaagtgaaccaaccagcctgtatctgtcacaacattttctctggagctcttggtgtgactcctgcttacttccagcagaagctgccagcagacaaaatggctcatctggtgtactgttatgttatatcacactcagggaaatggaacatttcagaggcgcttcatttttgtacactctagactcaaggccaaatatttgtgcgttctaaatcatgaaagtttttgtatctttgtaaatctgtgtaagaggtctgtagactagaatagttatgacaggtttatttttcttagacatttttgtactccctccgatccatattacttgatagatacatccatttcggcatcaagtaatatggatcagagggaactaggcttattat

SEQ ID NO: 5144 - DNA, 1770 bp, Aristolochia fimbriata
cagcaaagcagccctctcgcctctctgccagggaaaataaaagggtagccgcgaagacctggaaaaacgaaggaagaacgaagaagcggaggcgacgagagagagagagtcagattggtcgccgcgaatccaccatttgctggattcgtttatccgcgcagattccgcggcgtgcatcttattcttcctctgcgacctgtccgtgcgcttctattgctctcgctctgtccggcgggggagggggagggggacatggacggcgtcttcaagaagcttcggactcttgacgcgtacccgaagatcaatgaagatttctatagccgcacgctctccggcggggtgatcaccgtgacttcctccatcgtgatgctcttgctttttctatccgagcttcgcttatatcttcatgcagttacagaaacaaagcttgttgttgacacttcaagaggagaaaccctacgtataaattttgatgtcacgtttccagcccttccatgttctattgtcagtcttgatgccatggacataagtggcgagcagcatctggatgtaagacatgatatattcaaaaggaggattgatgcacatggcaatgtgattgagtccagaccagatggaattggctcaccaaagattgataaacccttgcaaagacatggtggaaggctggaacagaatgaaacatattgcggttcttgttatggtgcagaagcgtctgatgaagattgttgtaactcttgtgaagaagttcgtgaggcatacaggaagaaaggttgggggctatcagatcctgatttaattgaccagtgcaaaagagagggttttctccagcagattaaggaagaagaaggagaaggatgcaatatatatggatatttggaagtcaacaaggtggcagggaattttcattttgctccagggaaaagcttccaacaatcaaatgttcatgtacatgatctgctggcattccagaaggatagttttaatgtaagccacaaaatcaatagattagcttttggagattattttcccggtgttgtcaatcctcttgatggagtggagtggacgcaacagacatcctatgggatgtatcagtatttcataaaggtagttccatccgtatacactgacataaatgggcacaaaatccagtcaaatcagttctctgtaacagagcactttagagggactgaatttggtcgaattcaggcaattcctggagtttttttcttctatgacctttctccaatacaggtgactttcacagagcaacatgtctcgtttttgcactttctgacaaatgtttgtgccattgttggaggtgttttcacggtatctggcattatagattctttcgtatatcatgggcaaagggctgtaaagaagaaaatggaaattggaaagttcagctgagaccaaaagtgcaccgttttcttccttggcgccttcgaaatggttcttggggaagagaggtaactgaaaagatttattattgcgagtgaagctgctgcttcatcctgctgaggggttacctgcgcaagtctttttaaattgatctatgtcattaaaatatttcgctcatgattagggtcaggtcttctaagcagttttagatgtttattttttttcttcattcctgtaaattagcagttgattctcaatatttgtcctggagcgttaaaaatatcaaatcaaaaggaaaatcatatattgttcttccgtggaaactaaaaaaaaaaaaaaaagtcgggtgcgttgttaccactgctt

SEQ ID NO: 5145 - DNA, 1877 bp, Ricinus communis
taaaaatacagtaaaaacagcgagtttgagaattaccatctaataaaacacaaaagaaaggagagagatattttatctgagcagcgtaattaccgcgggaagagaggccattcttctccggcgacgcatctaattggcaggaaacaaattataataaaacaaaaagcaaaaaagaaggaagtcagctaattaaaaagaaaacgaaaataaaatcttaaacgcctcgttgaaacaaggaacagagaaaaaaaaagaataccacagatcgatttctcggtttatttctttcaaattcaacgaggcgtctaagatattaaatcgaattagatactatagttttccaattaatttattcatgtattgacaataacgtcggtttgatcgatcgattttgttttcttaacaaaaaaaagagagtgacgaaatggaagggataatgaataagttaagaaatttagacgcatatccaaaaatcaatgaagatttctatagccgtacgctctccggtggcgttatcactctcgcctcctctattcttatgcttctccttttcatttctgagctccgattatatatacatgctgtaactgaaacaaagcttgcagtggatacttcgagaggggaaactttacgcatcaattttgacgtcacttttccagcccttccatgttctattctcagccttgatgctatggatattagtggagagcaacatcttgatgtgaaacacgatatcatcaagaaaagactggattctcatggcaatgtaatagaagcacgccaagatggtattggtgctcccaagattgaaaaccctttgcagagacatggtggcaggcttgagcataatgagacatattgtggctcctgttatggtgctgaagcatcagatgaggattgttgtaattcctgtgaggatgtccgggaagcatatcggaagaaaggttgggcgttgtcaaatccagatttgattgaccagtgcaagagagaaggtttcctacagaggattaaagatgaagaaggtgaagggtgcaacatttatggattcttggaagttaataaggtggctggtaattttcacttcgcacctggaaagagttttcaacaatcaaatgttcatgtgcatgatctactggcattccaaaaggatagttttaatataagtcacaagattaatcggctagcttttggggattattttcctggtgttgtgaaccctcttgatggtgtgcactggacacaagaaactccaagtgggatgtaccagtattttatcaaggttgtacctactgtttacacagatgttagcggatacacgattcagtcgaaccagttttcagtgactgaacattttaggagtgcagaagcaggtcgccttcaatccctcccaggagtattcttcttttatgatctttctcccattaaggtgactttcacagaggagcacgtgtcattcttgcacttcctaacgaatgtgtgcgctatagttggaggtgttttcactgtttcgggaatactggattcgtttatatatcatggtcaaaaggcaatcaagaagaagatggaaattggtaaatttagttgatggcgttctaattggcctgggttgctgctgtatctggttggttagacagttagtagcttctcaaatagaaatgaattgggctggacaaagtctattttggattggataggggggagcttctttggatcacaactaagaatttgtcgtgaatcgtgatgtatgatacaatgaattagagttatttggtagttcattttatacatgcaatgaaatatgcctctcagctcatttttttccaggttaatgtaatgaaactgttgatatataatggtgtgtgtgaaaggggcttttt

SEQ ID NO: 5146 - DNA, 2277 bp, Ricinus communis
taaaaatacagtaaaaacagcgagtttgagaattaccatctaataaaacacaaaagaaaggagagagatattttatctgagcagcgtaattaccgcgggaagagaggccattcttctccggcgacgcatctaattggcaggaaacaaattataataaaacaaaaagcaaaaaagaaggaagtcagctaattaaaaagaaaacgaaaataaaatcttaaacgcctcgttgaaacaaggaacagagaaaaaaaaagaataccacagatcgatttctcggtttatttctttcaaattcaacgaggcgtctaagatattaaatcgaattagatactatagttttccaattaatttattcatgtattgacaataacgtcggtttgatcgatcgattttgttttcttaacaaaaaaaagagagtgacgaaatggaagggataatgaataagttaagaaatttagacgcatatccaaaaatcaatgaagatttctatagccgtacgctctccggtggcgttatcactctcgcctcctctattcttatgcttctccttttcatttctgagctccgattatatatacatgctgtaactgaaacaaagcttgcagtggatacttcgagaggggaaactttacgcatcaattttgacgtcacttttccagcccttccatgttctattctcagccttgatgctatggatattagtggagagcaacatcttgatgtgaaacacgatatcatcaagaaaagactggattctcatggcaatgtaatagaagcacgccaagatggtattggtgctcccaagattgaaaaccctttgcagagacatggtggcaggcttgagcataatgagacatattgtggctcctgttatggtgctgaagcatcagatgaggattgttgtaattcctgtgaggatgtccgggaagcatatcggaagaaaggttgggcgttgtcaaatccagatttgattgaccagtgcaagagagaaggtttcctacagaggattaaagatgaagaaggtgaagggtgcaacatttatggattcttggaagttaataaggtggctggtaattttcacttcgcacctggaaagagttttcaacaatcaaatgttcatgtgcatgatctactggcattccaaaaggatagttttaatataagtcacaagattaatcggctagcttttggggattattttcctggtgttgtgaaccctcttgatggtgtgcactggacacaagaaactccaagtgggatgtaccagtattttatcaaggttgtacctactgtttacacagatgttagcggatacacgattcagtcgaaccagttttcagtgactgaacattttaggagtgcagaagcaggtcgccttcaatccctcccaggagtattcttcttttatgatctttctcccattaaggtgactttcacagaggagcacgtgtcattcttgcacttcctaacgaatgtgtgcgctatagttggaggtgttttcactgtttcgggaatactggattcgtttatatatcatggtcaaaaggcaatcaagaagaagatggaaattggtaaatttagttgatggcgttctaattggcctgggttgctgctgtatctggttggttagacagttagtagcttctcaaatagaaatgaattgggctggacaaagtctattttggattggataggggggagcttctttggatcacaactaagaatttgtcgtgaatcgtgatgtatgatacaatgaattagagttatttggtagttcattttatacatgcaatgaaatatgcctctcagctcatttttttccaggttaatgtaatgaaactgttgatatataatggtgtgtgtgaaaggggctttttcattgttctcttagctgataactcgtaggaatgcgtagagagaatgaagaaacaatcgcgcctaaattatagttcatatgtttgccgatttggacaaatagaggctccctcatgtattccttctattgttaacaatttagtttgcaatgatataagaaacaaccccaagctataacaatctccattgggagaatggatgtttgtctattggtgcaccagtggaaatggatatggaaataattgcttgggctttgaggtcagagttggaaagtgcgtgggcataggcttagattgtgaattttccattgaggacaggacgacgaggtggatggtttttgtctttctagaattttatctactctaatacatgttccactatctttttttatgtacttttctc

SEQ ID NO: 5147 - DNA, 1637 bp, Populus trichocarpa
atctcaaaaatccttcaacgcctcctccttaataaaccaataagatcgaagaggcgaggcgtataagcagctcataatttagatttgcaccttctcattatacctaaataaatgaaatcttgggtttgtatagaaaaaaaacccatagattaggttacgaataagaaatacaaaaagaagtatcgatctaagtattgagaaaatggaggggttaatgagcaagctaaggaatttggatgcatatccaaaaatcaacgaggatttctacagccgtacgctttccggtggcgttatcactctcgcttcctctgtcgttatgtttctcctcttcttctccgagctccgattatatcttcatgcggtaactgaaacaaaactagtggtggatacttcgagaggagaaactctacgtatcaattttgatgtcacgttccccgctcttccgtgctctattcttagccttgatgccatggatattagtggagagcaacatcttgatgtaaaacatgatataattaagaaaagactagattttcatggaaatgtcatagaagcacggcaagatggaattggtgcccctaagattgaaaagcctttgcagaggcatggtggcaggcttgagcacaacgagacatactgtggctcctgttatggtgcggaagcgtcagatgaagactgctgtaattcttgtgaggacgttcgtgaagcatatcgaaagaaaggttgggcggtgacaaatccggatttaatggaccagtgcaaaagagagggatttctccaaaagattaaagatgaagagggtgaaggatgcaacatttatggattcttagaagttaataaggtggctggaaattttcattttgcacctgggaagagttttcagcaatctggtgttcacgtgcatgatctgctggcatttcagaaggatagttttaatataactcacaagattaataggctgactttcggagaatattttccaggtgttgttaatcctcttgatggtgtgcaatggacacaagaaacaccaagtgggatgtaccagtatttcatcaaggtagtacctactgtatacacagatgtgagtggacacactatccagtcaaatcagttttctgtgactgaacattttaggggcactgacataggtcgccttcagtcccttccaggagttttcttcttttatgacctttctccaattaaggtgactttcacagaagaacatgtttcgttcttacacttcctaacaaatgtgtgtgccatagttggaggtgttttcactgtttctggcatactggatacatttatatatcatggtcaaaaggcaatcaagaagaagatggaaatcggtaaatttagttgatgatgttgacatgtaaacaggcttgggttgttgctgtattgccaaggactggcttctcatatggaattgggtttggacgcctattttgaactggccagtttttataatcatgttcttgcgatcaaggaatttgatttatttcatgggtcattaattctcaaaatggaatgcccgtttgcctctctttttttcgttttttttttctccccttcagtggagtgacaacacttctgatgtgaggacaactgtttcaaaggtatactgcccttctgtg

SEQ ID NO: 5148 - DNA, 1744 bp, Populus trichocarpa
accgcccgcgggacatacgtatccgtatcggtgaaagttgaaggaaagggaaaagaaaagaaacaagagagagatctcaaaaatccttcaacgcctcctccttaataaaccaataagatcgaagaggcgaggcgtataagcagctcataatttagatttgcaccttctccttatacctaaataaatgaaatcttgggtttgtatagaaaaaaaacccgtagattaggttgcgaataagaaatacaaaaggaagtatcgatctaattattgagaaaatggaggggttaatgagcaagctaaggaatttggatgcgtatccaaaaatcaacgaggatttctacagccgtacgctttccggtggtgttatcactctcgcttcctctatcgttatgtttctcctcttcttctccgagctccgattatatcttcatgcggtaactgaaacaaaactagtggtggatacttcgagaggagaaactctacgtatcaattttgatgtcacgttccccgctcttccgtgctctattcttagccttgatgccatggatattagtggagagcaacatcttgatgtaaaacatgatataattaagaaaagactagattttcatggaaatgtcatagaagcacggcaagatggaattggtgcccctaagattgaaaagcctttgcagaggcatggtggcaggcttgagcacaacgagacatactgtggctcctgttatggtgcggaagcgtcagatgaagactgctgtaattcttgtgaggacgttcgtgaagcatatcgaaagaaaggttgggcggtgacaaatccggatttaatggaccagtgcaaaagagagggatttctccaaaagattaaagatgaagagggtgaaggatgcaacatttatggattcttagaagttaataaggtggctggaaattttcattttgcacctgggaagagttttcagcaatctggtgttcacgtgcatgatctgctggcatttcagaaggatagttttaatataactcacaagattaataggctgactttcggagaatattttccaggtgttgttaatcctcttgatggtgtgcaatggacacaagaaacaccaagtgggatgtaccagtatttcatcaaggtagtacctactgtatacacagatgtgagtggacacactatccagtcaaatcagttttctgtgactgaacattttaggggcacagacataggtcgccttcagtcccttccaggagttttcttcttttatgacctttctccaattaaggtgactttcacagaagaacatgtttcgttcttacacttcctaacaaatgtgtgtgccatagttggaggtgttttcactgtttctggcatactggatacatttatatatcatggtcaaaaggcaatcaagaagaagatggaaatcggtaaatttagttgatgatgatgacatgtaaacaggcttgggttgttgctgtattgccaaggactggcttctcatatggaattgggtttggacgcctattttgaactggccagtttttagaatcatgttcttgcgatcaaggagtttgatttatttcatgggtcattaattctcaaaatggaatatgcccgtttgcctctctttttttcgttttttttttctccccttcagtggagtgacaacacttctgatgtgaggacaactgtttcaaaggtatactgcccttctgtgcatatggcattgccctttcttctggccaagaa

SEQ ID NO: 5149 - DNA, 1794 bp, Theobroma cacao
tctttacctaatttcccatgagccaaattgttgtgatgggcggtgggccggtcttattcaaggggggccatagctaaaattatgcttccaggcatcgtatgcatttttcctgaacgaatcaaaggcagattaagggaataattgtataaatcaattgggaaaagaaaaaggataagagttgatggacggaataatgaacaagctcaggaatttagatgcgtaccctaaaataaacgaggatttctacagccgtacactctccggtggcgttatcactctcgtctcctccgttgttatgttctttctcttcttctccgagctccgattatatctgcatgctgtgactgaaacaaagcttgtggtagatacttcaagaggggaaactctacgcatcaattttgatgtcacatttcctgctcttgcatgctcaatcctcagccttgatgcaatggacatcagtggagagcaacatcttgatgtgagacatgacataattaagaaaaggttagatgcacatggcaatgttatagaatcgaggcaagatggaattggtgctcccaagattgagaagcctttacagaggcatggtggcaggctcgagcacaatgagacgtattgtggttcatgttatggtgcggaagcgtctgatgatgattgttgcaactcctgtgaggatgttcgtgaagcatacagaaagaaaggttgggctttgtcaaatccagatttagttgaccagtgtaagagagagggtttccttcagaagattaaggatgaagaaggtgaagggtgtaatatatatggctttttagaagttaataaggtggcagggaattttcattttgcacctgggaaaagctttcagcaatcaaatgttcatgtacatgacttgctggcatttcaaaaggacagttttaatataagtcacaagatcaatagattagcttttggagattacttccctggtgttgtgaatcctcttgatggtgttcattggacacaagaacaaccaagtgggatgtatcagtactttatcaaggttgtacctactgtgtatacagatgtgagtggacacactatccagtcaaatcagttttctgtaacagagcattttaagggtgcagagataaatcgtcttcagtccctcccaggagttttcttcttttatgacctttcacctatcaaggtcactttcacagagcagcatgtctcattcttgcactttctaacaaatgtgtgtgctatagttggaggtgttttcacagtttcgggaatattagactcttttatataccatggtcaaagagcaattaagaagaaaatagaaatcggtaaatatagctgatgatagatctaggtagcatgagttgttgctgttttgtctgccaggaactggtgcttgggaaaaatcaaaccgagtaaatgagaagatgattgcgatgcagtacctggtcagttgttagcttctttgtaatcatgactgaaattttgttttgacgcattccatggttgatttagactgatttatatagtctagttgtggatgatgcctcatcgcaattagtttttgtagccttgaaatcaaagagtcctaaaacaggctttggatatgaatacatgtttgaaatgaaaagggcgagtgttggagaatcagaattcggaaactttgttggtagctagccagctaacatccatcttcagctacttaatagcttgaccttaaggagactttaagactacttgatttcaataacgtttcaagcaatagatagatacatagctagaacaatcttccac

SEQ ID NO: 5150 - DNA, 1721 bp, Tropaeolum majus
cggccggggggatatcaaacataataatagaaaaagaaaacgaaacaaatcaaatacctctgcctaaatcttaaactcctcgtcggaaatcggatcagcttttttctttcaacggggaggtttaagtattaataacatccaatttcatattctttctttctttacatataaaaattgttagattaggttaggttaaggcctacatcgatccattcagatcgatttatatttaaatcttgttgggaattcggtatggacggtataatgaacaagctaaggaatttggatgcttaccctaaaatcaacgaggatttctacagcaggacgctctccggaggcgttattactctcgcctcttccgtcgtcatgttcctgctcttcttctctgagctaaggttatatctccacgctataactgaaaccaagcttattgtagacacttcaagaggagaaacactgcgaatcaattttgacgtgacatttcctgccctcccatgctcaatactaagtgttgatgccatggacattagcggagagcagcaccttgatgtgaggcatgatataatcaagaaaagaatagactcccatggaaatgttatagaggaaagacaagatgggatcggtgctcctaagattgaaaagcctttgcagaggcatggtggaaggcttgagcataatgaaacatactgtggttcgtgttttggtgctgaagcgtcggatgatgaatgttgcaacaattgtgaagaagttcgtgaagcatatagaaagaaaggttgggcagtctcaaatccagatttgattgaccagtgcaaaagagaaggctttctacaaaaaattaaggatgaagaaggagaaggatgcaatatatacggattcttggaagttaataaggtggccgggaatttccattttgctcctggtaaaagctttcagcaatcaggtgttcatgtgcacgatctgcttgcatttcaaaaggatagttttaatataagtcacaagatcaaccgattagcatttggagattacttccctggtgtcgtgaacccacttgacaacgtacaatggacacaagactcaccgagcggaatgtatcaatattttatcaaggtagtacctactgtgtacacagatgtgagtgggcatactattcagtcgaatcagttttccgtaacagaacattttagaaatgcggaattaggtcgccttcaggcccttcccggggttttcttcttttatgacctttctccaatcaaggtgacattcacggaagagcatgtatcattcttgcactttctaacaaatgtttgtgctatagttggaggtgttttcactgtttctggaatactggattcttttgtataccatggtcaaaaggcaataaagaagaagatggaacttggtaaatttagttaattattgatccattagcgtaatacctgaattctgggggaaggattccaaatacaattgaacgaattctggtcattttattttgaagatcaatagttctttctttgccagttttatggattcttgcaattgccatataacattatcgtggatacatctaggaatagatgcaggttttgtttttgatacttcaaagagtaagtaatctcaaatcagtgactttctatgttgctgtattcgaaatattccgtttctttatttgttttgaccatacatttgattttcgttgaatctgattcttatttgttcaa

SEQ ID NO: 5151 - DNA, 1874 bp, Cajanus cajan
gcgcagacaaataacaaaaacattttcgtatgttttttagagtcggaatattttatttggtaaaaaaacacgcacacgcagagataaatatgcttcgtcacaattcaaaccaaaagaattttgattgaacggggtgttttcgatttcaaaacacttctactaatctttctccatattttttttttaatcaaagttaaggtttatatcttagatctttggttttggatccacaacaataatcaccgatttgggggaaattcaatcatggacagcataatgagcaagctccgcaacctcgatgcgtaccctaaaatcaacgaagatttctatagtcgtacgctctccggtggcgtcatcaccctcgcatcctccatcatcatgctcttgctcttcttctctgagctttggatgtatctccatgcggtgacggagaccaagcttattgtggacacttccagaggcgaaacactgcgtatcaattttgatgtgacgtttcctgcacttccatgttccatactcagtcttgacgccatggacattagcggagagcagcatctagatgtcaaacatgatataatcaagaagagattagactctcatggcaatgtgatagaaacaaggcaagaaggaattggtgctcccaagattgaaaagccattgcaaagacatggaggcaggctcgagcacaatgagacttattgtggctcttgttacggtgctgaagcgtcagatgacgaatgttgtaattcttgtgaggatgttcgtgaagcataccgaaagaaaggttgggcactttcaaatccagatttaattgatcagtgcaaaagagaaggattcttacaaagaatcaaggatgaagaaggtgaaggatgcaatgtgtatggtttcttggaagtaaataaggtggcagggaattttcattttgcacctgggaaaagctttcagcaatctggcgtacatgtacatgacctgttggcatttcaaaaggattcttttaatttaagtcaccacatcaacagattagcatttggagagtatttccctggtgttgttaatcctcttgataatgtgcattggacacaagaaacaccaagtgggatgtaccagtactttattaaggttgtgcctacggtatacactgatgtgattgggcatactattcaatcaaaccagttctctgtgacagaacacttcaggactggagatgtaggccgcctgcagtccctccccggagttttcttcttctatgacctttctccaattaaggttacttttatcgaagaaaatgtctcattcttacattttcttactaatgtgtgtgccatagttggaggtgttttcactgtatctggaatactagattcatttgtctatcacggtcagagggctatcaagaagaagatggaacttggtaaatttaactaatgggtgtttttttttgagtaatttcgagggaatggctcttgggagacaatctattcaagaggagatcaggtactgattgaaatgtcccttgggttctcggttcttcggttccaacaaaaggattttgcccttagatgttgtcatcaatgaaggttgaaattctaagattatatcatgtgcaatcaatgccactttgttgtgattcatatgttttgacagaactctgatgttctgaatgttgtgtttcatggaaagtagaggagctttaatgtatagccgtgcaattgttgaactcccatgtagaagcatcaaaaggaaatcttttagaaaaatataaatcaacaatgataatctaaaatgagatgtaactgtctaggtgtctctattttattttgttaggatgtgaaaaaaaaattaagttgtctctgcgtttgtggttttattttgtt

SEQ ID NO: 5152 - DNA, 2001 bp, Glycine max
gcggagatggagttaaaatagaagaattattaccagggtcggttgcgtcgccgttcaggaaaattgaattcaatctgaaacgccctgtggtcatagttccaattccgaaagaatttcggggtgtttccgatttccaaacactcactcacacccatccttctttctttcaccgcaatattttttcctttttgaatcaaacttcggtttcttaatttctcattatcatatcttagatcttcagttttggatccacacaataatttgggggaaattgaattgaagcatcatcatcatcgtcatggatagcataatgagcaagctccgcaacctcgacgcgtaccctaaaatcaacgaggatttctacagccgcacgctctccggcggtgtcatcacgctcgcttcctccatcctcatgctcttgctcttcttctccgagctccggttgtatcttcatgcggtgaccgagaccaagcttgtcgtagacacttccagagccgaaacgctgcgtatcaattttgatgttacgtttcctgcgcttccatgttccatactcagtcttgatgcaatggacatcagcggagagcagcatctagatgttaagcacgatataatcaagaagagattagactctcacggcaatgtgatagaaacaaggcaagaaggaattggtgctcccaagattgaaaagcccttgcaaaggcacggaggcaggcttgagcacaatgagacttattgtggttcctgttatggtgctgaagagtcagatgatgattgttgtaattcctgtgaggatgttcgtgaagcataccgtaagaaaggttgggcactttcaaatcctgatttaattgaccagtgcaaaagagaaggattcttacaaagaatcaaggatgaagaaggtgaaggatgcaatgtgtatggtttcttggaagtaaataaggttgcagggaactttcattttgctcctgggaaaagctttcagcaatctggtgtacatgtacatgacctactggcttttcaaaaggattcttttaatttaagtcaccacatcaacagattagctttcggagagtatttccctggtgttgttaatcctcttgacaacgtgcattggacacaagaaacaccaagtggtatgtatcagtattttattaaggttgtgcctacagtatacactgacgtgagtgggcatactatccagtcaaaccagttctctgtgacagaacacttcaggactggagacgtgggtcgtctgcagtcccttcccggggttttctttttctatgacctctctccaattaaggttacttttacagaagaaaatgtctcattcttacattttcttactaatgtttgtgccatagttggaggtattttcaccgtttctggaatactagattcattcatctatcacggtcaaagggctatcaagaagaagatggagcttggtaaatttaactgatgggatttgagtaatttcgagggaatggctctccagagacaaatctattcaaggttaactactgattaaaattccccttggggttctgagttcttcggtttcaacaaaaggattttgcccttagaccaaggttgaaatgctaagatatcatgtgcaacaaatgccactttgccttgattcatatcttttctgacagctctgatgttgtgaatgttacctgctttatggaaagtagaggggctttcccttgctgaagcatcaaaagggaggaatccattagggaaatataacttcaatgataatctaaaatgagatataactgtttaggtgcatttcttttatctctttggtcgtgaagaagttttctagcatgtttggggtggcagtaaggtgagtcaaaatcaatcatgaagccatggtaaatgtgaagtaacccccatgattttagaaaaatcatggtgacactggttttgaggtagccaccatgattttaaaagatattcaaacatgattttaaaagatattcaaacatgctattagtt

SEQ ID NO: 5153 - DNA, 2068 bp, Glycine max
tattttatttattcatccctaaaaaaaaacacgcggagatggagttaaaatagaagaattattaccagggtcggttgcgtcgccgttcaggaaaattgaattcaatctgaaacgccctgtggtcatagttccaattccgaaagaatttcggggtgtttccgatttccaaacactcactcacacccatccttctttctttcaccgcaatattttttcctttttgaatcaaacttcggtttcttaatttctcattatcatatcttagatcttcagttttggatccacacaataatttgggggaaattgaattgaagcatcatcatcatcgtcatggatagcataatgagcaagctccgcaacctcgacgcgtaccctaaaatcaacgaggatttctacagccgcacgctctccggcggtgtcatcacgctcgcttcctccatcctcatgctcttgctcttcttctccgagctccggttgtatcttcatgcggtgaccgagaccaagcttgtcgtagacacttccagagccgaaacgctgcgtatcaattttgatgttacgtttcctgcgcttccatgttccatactcagtcttgatgcaatggacatcagcggagagcagcatctagatgttaagcacgatataatcaagaagagattagactctcacggcaatgtgatagaaacaaggcaagaaggaattggtgctcccaagattgaaaagcccttgcaaaggcacggaggcaggcttgagcacaatgagacttattgtggttcctgttatggtgctgaagagtcagatgatgattgttgtaattcctgtgaggatgttcgtgaagcataccgtaagaaaggttgggcactttcaaatcctgatttaattgaccagtgcaaaagagaaggattcttacaaagaatcaaggatgaagaaggtgaaggatgcaatgtgtatggtttcttggaagtaaataaggttgcagggaactttcattttgctcctgggaaaagctttcagcaatctggtgtacatgtacatgacctactggcttttcaaaaggattcttttaatttaagtcaccacatcaacagattagctttcggagagtatttccctggtgttgttaatcctcttgacaacgtgcattggacacaagaaacaccaagtggtatgtatcagtattttattaaggttgtgcctacagtatacactgacgtgagtgggcatactatccagtcaaaccagttctctgtgacagaacacttcaggactggagacgtgggtcgtctgcagtcccttcccggggttttctttttctatgacctctctccaattaaggttacttttacagaagaaaatgtctcattcttacattttcttactaatgtttgtgccatagttggaggtattttcaccgtttctggaatactagattcattcatctatcacggtcaaagggctatcaagaagaagatggagcttggtaaatttaactgatgggatttgagtaatttcgagggaatggctctccagagacaaatctattcaaggttaactactgattaaaattccccttggggttctgagttcttcggtttcaacaaaaggattttgcccttagaccaaggttgaaatgctaagatatcatgtgcaacaaatgccactttgccttgattcatatcttttctgacagctctgatgttgtgaatgttacctgctttatggaaagtagaggggctttcccttgctgaagcatcaaaagggaggaatccattagggaaatataacttcaatgataatctaaaatgagatataactgtttaggtgcatttcttttatctctttggtcgtgaagaagttttctagcatgtttggggtggcagtaaggtgagtcaaaatcaatcatgaagccatggtaaatgtgaagtaacccccatgattttagaaaaatcatggtgacactggttttgaggtagccaccatgattttaaaagatattcaaacatgattttaaaagatattcaaacatgctattagttatctacgtttgtggttttattcggttccaaaaaaa

SEQ ID NO: 5154 - DNA, 1903 bp, Phaseolus coccineus
ttttagagctacaataatattttattgatggcaacaaacccaaccaaaacacgcggtgttaaaattgaacaagattaccaaagtggcgtcgcagtttcaggaaattgaaattcaatctgaaacgccccgtcaccgttccaacctccgaagaatttcgattgaacggggtgttctcaatttcaaagcattgtcaccaatttttctcctcaattcaattttaatccaacttaggtttattttttcttagatctttcgttttggatccgccattataatcgtcgatttggggaaaattcaagcatggaaggcataatgagcaagctccgcaacctcgatgcttaccctaaaatcaacgaagatttctacagccgcacgctctccggcggcgttatcaccctcgcttcctctatcatcatgcttttgctcttcttctccgagctccggttgtacctccagtcggtcaccgagaccaagcttgttgtagacacttccagaggcgaaacgctgcgtataaactttgatgtcacgtttcctgcgcttccgtgttccatacttagtctcgatgccatggatatcagcggagagcagcatctagacgttaaacatgatataatcaaaaagagattagattctcacggcaatgtgattgaaacgaggcaagaaggaattggcgctcccaagattgaaaagcccttgcaaagacatggaggcaggcttgagcacaatgagacttattgtggttcctgttttggtgctgaagcgtcagatgatgattgttgtaattcctgcgaggatgttcgtgaagcataccgtaagaaaggatgggcactttcaaacccagatttaattgatcagtgcaaaagagaaggattcttacaaagaatcaaggatgaagatggcgaaggatgcaatgtgtatggtttcttggaagtaaataaggttgcggggaactttcattttgcccctgggaaaagctttcagcaatctggtgtacatgtgcatgacctgctggcctttcaaaaggattcttttaatttaagtcaccacatcaacagattatcttatggagagtattttcctggtgttgtcaatcctcttgacaatgtgcattggatacaagaaacaccaagtgggatgtaccaatattttattaaggttgtgccgactgtttacactgacgtgaatgggcatgctatccagtcaaatcagttctctgtgacggaacacttcaggactggagatgtgggccgtctgcagtccctccctggagttttcttcttctatgacctttctccaattaaggttacttttaccgaagaacatgtctcattcttacattttcttactaacgtgtgtgctatagttggaggtatttttaccgtttctggaatactagattcatttatttatcacggtcaaagggctatcaagaagaagatggaacttggtaaatttaactgatgggttttatttgagtaaaatttcaagcgaatggttcttcagagaccgtatattcaagagaagatcaactactgattgaaattccccttgggggttcgagttcttcggtttcaacagaaggattttgcccttagatgttgtcatcaatgaaggttgaaatgctaagatcatatcatgtgcaacaaatgccactttgccatgattaatatcttttctgacagctctgatgttgttgaatgttacgtgctttatggaaagtagaggggctttcattatagtcgtacacttgctgaagcatcaaaaggaaatcctttagggaaatataaatcaacaatgataatctaaaatgagatataactgtttaggttctcttattttttcttcctgtttggatgtcaatagttttagttatttatctgtgcgtttggtttatgttcagttc

SEQ ID NO: 5155 - DNA, 1897 bp, Phaseolus coccineus
ttttagagctacaataatattttattgatggcaacaaacccaaccaaaacacgcggtgttaaaattgaacaagattaccaaagtggcgtcgcagtttcaggaaattgaaattcaatctgaaacgccccgtcaccgttccaacctccgaagaatttcgattgaacggggtgttctcaatttcaaagcattgtcaccaatttttctcctcaattcaattttaatccaacttaggtttattttttcttagatctttcgttttggatccgccattataatcgtcgatttggggaaaattcaagcatggaaggcataatgagcaagctccgcaacctcgatgcttaccctaaaatcaacgaagatttctacagccgcacgctctccggcggcgttatcaccctcgcttcctctatcatcatgcttttgctcttcttctccgagctccggttgtacctccagtcggtcaccgagaccaagcttgttgtagacacttccagaggcgaaacgctgcgtataaactttgatgtcacgtttcctgcgcttccgtgttccatacttagtctcgatgccatggatatcagcggagagcagcatctagacgttaaacatgatataatcaaaaagagattagattctcacggcaatgtgattgaaacgaggcaagaaggaattggcgctcccaagattgaaaagcccttgcaaagacatggaggcaggcttgagcacaatgagacttattgtggttcctgttttggtgctgaagcgtcagatgatgattgttgtaattcctgcgaggatgttcgtgaagcataccgtaagaaaggatgggcactttcaaacccagatttaattgatcagtgcaaaagagaaggattcttacaaagaatcaaggatgaagatggcgaaggatgcaatgtgtatggtttcttggaagtaaataaggttgcggggaactttcattttgcccctgggaaaagctttcagcaatctggtgtacatgtgcatgacctgctggcctttcaaaaggattcttttaatttaagtcaccacatcaacagattatcttatggagagtattttcctggtgttgtcaatcctcttgacaatgtgcattggatacaagaaacaccaagtgggatgtaccaatattttattaaggttgtgccgactgtttacactgacgtgaatgggcatgctatccagtcaaatcagttctctgtgacggaacacttcaggactggagatgtgggccgtctgcagtccctccctggagttttcttcttctatgacctttctccaattaaggttacttttaccgaagaacatgtctcattcttacattttcttactaacgtgtgtgctatagttggaggtatttttaccgtttctggaatactagattcatttatttatcacggtcaaagggctatcaagaagaagatggaacttggtaaatttaactgatgggttttatttgagtaaaatttcaagcgaatggttcttcagagaccgtatattcaagagaagatcaactactgattgaaattccccttgggggttcgagttcttcggtttcaacagaaggattttgcccttagatgttgtcatcaatgaaggttgaaatgctaagatcatatcatgtgcaacaaatgccactttgccatgattaatatcttttctgacagctctgatgttgttgaatgttacgtgctttatggaaagtagaggggctttcattatagtcgtacacttgctgaagcatcaaaaggaaatcctttagggaaatataaatcaacaatgataatctaaaatgagatataactgtttaggttctcttattttttcttcctgtttggatgtcaatagttttagttatttatctgtgcgtttggtttatgtt

SEQ ID NO: 5156 - DNA, 1880 bp, Fagus grandifolia
gcctctttgggtcttcgctgttatcttcagccagccttcctgagaaaagaaaacaaggcaaaataaaagcagccaggtttcctcgaaaatcttaaacgccccgtttaattcttcccatttcaaatccatcactcggagcagcggggtgtttaaggtcactaatccccgtttagaattctcatattttgctgcttattagtattagtacatataatatataagagagattatatataattatatatttatgaaatagatcgagatcgatcaaaacctccttgtgtttttgtgatcggaaaaaagcaaaagaaacagagaaaatagagaaagagcaatggacaatataatgagcaagcttcggaacctggatgcgtatcccaaaatcaacgaggatttctacagccgtaccctctccggtggcgttatcactctcgcctcctccatcgtcatgctcttgctcttcttttccgagctccgattgtatctgcatgctgtaactgaaactacacttgtagtagatacttccagaggagaaactctacgtatcaattttgatgtcacatttcccgctcttccatgttctatactcagtcttgatgccatggacatcagtggagagcaacaccttgatgtgaaacatgacataatcaagaagagattagatactcatggaaatgttatagaagaaaggcaagacggaattggtggtcctaagattgaaaagccactacagaaacatggtggtaggctggaacataacgagacatactgtgggtcctgttttggtgcagaagcggcagatgaagagtgttgtaattcttgtgaagaagttcgtgaagcatatcgaaagaaaggttgggcactgtcaaaccccgatctaattgaccagtgcaaaagagaaggttttctacaaaggattaaagatgaagaaggtgaaggatgtaatatttatggattcttggaagttaataaggtggcaggaaattttcattttgcacctggaaaaagctttcagcaatcaggtgttcatgtacacgatctgctagcatttcaaaaggatagttttaatatcagtcacaagatcaatagattagcttatggagactatttccctggtgttgtgaatcctttggacggtgtgcaatggacacaacactcaccaagtgggatgtatcagtatttcatcaaggttgtacctacagtgtacacagatttgagtgggtacactatccagtcaaatcagttctctgtaactgaacattttaggaatgcagaaataggcctccttcagtcccttccgggagtgttcttcttttatgatctttctccaattaaggtaacttttaaggaggagcacatctcatttttacactttctaacaaatgtgtgtgctattgttggaggagttttcactgtttcaggaatactagattcatttatatatcatggtcaaaaggctatcaagaagaagatggaaatcggtaaatttagttgatgattgtttcaattagcatttgtttctgttgtatttggttgctgtgccagtaaatggctttatggagagaatcaaattaagagaagatgaactatccaatggactctctccctgtggttggctgggttcttatgatcacaatttacaactgaggaattctcaatatatctttttgatcactgaaggttgaattcctagttgaaagcctcctctttgcctcgttttaccaaattgtaattgattatctgtttgaaagattaatcggggctttcatttcttgctagcaaacttcttagtgagacgtctttagggcaaaaatcaaggttttttgaaagataattgaggattatgttacttgttttctcccagttgaggtgggggaggg

SEQ ID NO: 5157 - DNA, 1655 bp, Tabernaemontana elegans
cctttttcgttttctagggctgttaattttgattttgggatataatttacagaggattggaagcggtaggattgagtggagaagatggataatttaatgagtaaaattcggagtttggatgcatatccgaagatcaatgaggatttctacagcagaacgctatccggcggcgtcataacccttgcctcctccatcgtcatgcttttgcttttcgtttccgagctcagattatatctccattctgtaactgagacaaagcttgtggtagatacttccagaggagaaagattgcgtatcaattttgatgtcacatttccagcacttccttgttccatgcttagtcttgatgcgatggatataagtggagaacaacatcttgatgtaagacatgacatactcaaaaaaagaattgatgcccatggtaatgtaatagaaacaaggcaggacggtattggggctcctaagattgaaagacctttacagagacatggtggtaggcttgaacagaatgaaacatactgtggttcctgttatggagcagaaacgtcagatgatgattgctgcaacaactgtgaagaagttcgtgaagcttaccgtaagaaaggctgggcattgtctaatccagatttaattgaccagtgtaaaagagaaggttttcttgaaaggatcaaagaagaagaaggtgaaggatgcaacgtttatggttttttggatgtcaataaggttgctggaaattttcactttgcacctggaaagagttttcaacaggcaaatgttcatgtccatgatctgctggcatttcaaaaggatagttttaatataagtcacaagatcaatcgattaacttttggagagtatttccccggtgttgtgaatcctcttgatggtgtggaatggacacagcaaacacctaatgggatgtatcagtatttcatcaaggtggtacccactgtttatacagacattagtggacataccatccagtcaaatcagttctctgtaaccgagcattttaagggagcagaagttggtcgtcttcaatctcttcctggggttttcttcttttatgacctttcaccaataaaggttactttcaaggaggagcatgtttcatttctgcacttcctgacgaatgtctgtgctattgttggaggtgttttcactgtttcggggatagttgattctttcgtatatcatggtcagagggcaattaagaagaaaatggaaattggtaaatttagctgataataagtaattgtccctctatcattgcaatgtgccattctgccaagtggaatagctcttttgaaggcctagttgcagaggagaacgaagtccgttgaaatttcttcgaattcagggttgcaggcatcaacaacatctctgggtggttttcacttgttttgttagtttcttaactagttcattttaagcgtttacacttttgtcattagtcattttgtacttacaattgtggatatagctttcaaaagaaaatagggccgtttgacattggtcaggaacctctgaagattccataaagagagagagaaatgcttgtgcagagtagattgatcgctgatcctaaatctttacatatattttcttttggaggtcgactaatcatagatcttgttttcaaatttatttaattg

SEQ ID NO: 5158 - DNA, 1863 bp, Aquilegia formosa
aaggaaacaaagaaagaaaataaagagaaatagaaacgaagagaagagaagagaagaagagagagagagatagaagagaaatcattcgcgtttcttcctttttcaacctgtcttctttcgttgaaatcggtttgatcaaaagaaaataaaaaaattctcagagagtaagaaaagagaagcaaagatttaatcatcaagcttgctcgttctttctctctgagaaattttccatcaaacttctttctctctctttcgtcatcatgaataatcttttctctaaacttcgaaatcttgatgcatatccaaagatcaatgaagatttctatagcagaactttatctggaggtgttattacaatagcttcttcaatagttatgcttttgctcttcatctccgaattaagcttataccttcacgccgttactgaaacacagcttgtagtagatacatctagaggggaaactcttcggatcaattttgatgtcacatttcctgcccttccgtgctcagtagtcagcgtcgatgctatggatatcagtggggagcaacatcttgatgtaagacatgatataattaagaagaggatagatgttcacggaaatgtaattgagactcggcaggatggaattggtggacccaagatagagaagcctttacagagacatggtggtaggcttgaacacaatgagacgtactgcggttcgtgttatggtgcagaagcgtcggatgaagaatgttgtaattcttgtgaagaagttcgtgaagcatatagaaagaaaggatggggcttgcaaaatccagatttgattgaccagtgcaagagagaaggctttctccaaagaatcaaagatgaagatggtgaaggatgcaatgtatacggttccttggaagttaataaggtggctggaaactttcatttcgcccctggaaagagcttccaacaatccggggtccatgtacatgatttgctggcttttcaaaaggacagtttcaatattagtcacaaaatcaataggttgacttttggagcatatttccccggcgttgtgaatcctctagacggggtccaatgggtgcaagaaactcctcatggaatgtaccagtatttcatcaaggttgttcctactgtctacacagatataagtggacacactatacagacaaatcagttctctgtaacagaacattttaggaacacagaattcggacgctctcaagctttgccaggagttttctttttttatgacctttctccgataaaggtgactttctcagagcagcatgtgtcattcttacacttcctcacaaatgtgtgtgctatagttggaggtgttttcacagtttctggcatagtagattcgtttatatatcatggtcaaaaggcaatcaagaagaagatagaaattgggaaatttagctgattttagagccatggaatgatttcgcaatggagtcttctttttgaattcacaaagcagcttctgctcaaggaaatggtcgtatgagagtttatggcttgaatgggcttttctcacaatggagattgcaatgattactcagttgatggagtcgattctctaaacaaattttggtgtttctcttcagttttcagcaatatttgattagttagctccttactgtaaaccaactgtagatcagaatgaaattaatgtatttattacttgcagaggtgggacttcatagtttgtgaggtgaaagtgtagtggaatgaaatgtgaccagcctctgctggcttggtagttggtagtttggtacaaccgtgcaagtcctctgtacaaataatggtgctgctttcaaaactgttgtataactaatgtatcatgctagtttatggagttgggc

SEQ ID NO: 5159 - DNA, 1857 bp, Aquilegia formosa
aaagaaagaaaataaagagaaatagaaacgaagagaagagaagagaagaagagagagagagagatagaagagaaatcattcgcgtttcttcctttttcaacctgtcttctttcgttgaaatcggtttgatcgaaagaaaataaaaaaattctcagagagtaagaaaagagaagcaaagatttaatcatcaagcttgctcgttctttctctctgagaaattttccatcaaacttctttctctctctttcgtcatcatgaataatcttttctctaaacttcgaaatcttgatgcatatccaaagatcaatgaagatttctatagcagaactttatctggaggtgttattacaatagcttcttcaatagttatgcttttgctcttcatctccgaattaagcttataccttcacgccgttactgaaacacagcttgtagtagatacatctagaggggaaactcttcggatcaattttgatgtcacatttcctgcccttccgtgctcagtagtcagcgtcgatgctatggatatcagtggggagcaacatcttgatgtaagacatgatataattaagaagaggatagatgttcacggaaatgtaattgagactcggcaggatggaattggtggacccaagatagagaagcctttacagagacatggtggtaggcttgaacacaatgagacgtactgcggttcgtgttatggtgcagaagcgtcggatgaagaatgttgtaattcttgtgaagaagttcgtgaagcatatagaaagaaaggatggggcttgcaaaatccagatttgattgaccagtgcaagagagaaggctttctccaaagaatcaaagatgaagatggtgaaggatgcaatgtatacggttccttggaagttaataaggtggctggaaactttcatttcgcccctggaaagagcttccaacaatccggggtccatgtacatgatttgctggcttttcaaaaggacagtttcaatattagtcacaaaatcaataggttgacttttggagcatatttccccggcgttgtgaatcctctagacggggtccaatgggtgcaagaaactcctcatggaatgtaccagtatttcatcaaggttgttcctactgtctacacagatataagtggacacactatacagacaaatcagttctctgtaacagaacattttaggaacacagaattcggacgctctcaagctttgccaggagttttctttttttatgacctttctccgataaaggtgactttctcagagcagcatgtgtcattcttacacttcctcacaaatgtgtgtgctatagttggaggtgttttcacagtttctggcatagtagattcgtttatatatcatggtcaaaaggcaatcaagaagaagatagaaattgggaaatttagctgattttagagccatggaatgatttcgcaatggagtcttctttttgaattcacaaagcagcttctgctcaaggaaatggtcgtatgagagtttatggcttgaatgggcttttctcacaatggagattgcaatgattactcagttgatggagtcgattctctaaacaaattttggtgtttctcttcagttttcagcaatatttgattagttagctccttactgtaaaccaactgtagatcagaatgaaattaatgtatttattacttgcagaggtgggacttcatagtttgtgaggtgaaagtgtagtggaatgaaatgtgaccagcctctgctggcttggtagttggtagtttggtacaaccgtgcaagtcctctgtacaaataatggtgctgctttcaaaactgttgtataactaatgtatcatgctagtttatggagttgggc

SEQ ID NO: 5160 - DNA, 1700 bp, Cannabis sativa
tagtaagcactaagcagacttcagaaacaaaatagagtataatagaagtgggtagttgctaaaacgcccccccttaacttttaaaattcccagatcaataatgaaataaatgaactctctgtctattcttctttgatttgatcccaatttcaatctcaatctctaggctaatgctataccaataattaggtctgtagtctcgaatctagatccaccaccaaaaatggataatataatgagcaagctccggaatttggatgcttatcccaaaatcaatgaagatttctacagtcgtaccctctccggtggtgttatcactatcgcctcctccgttgtcatgctcttgctcttcctctccgagcttcggttatatctacatgcagttactgaaacaaagcttgtagtggatacttcaagaggagaaactctacgtatcaattttgatgtcaccttcccggcccttccttgttccatacttagccttgatgccatggacattagtggagagcaacacctggatgtaaaacatgatgtaatcaagaagaggatagattctcatggcaatgtaatagaaactagacaggatggaattggtgctccgaagattgataagccattgcagagacatggtggcaggcttgagcataatgagacatactgtggatcctgctatggtgcagaagcgtcagatgatgattgctgtaataattgcgaagaagtacgtgaggcataccggaagaaaggttgggcattatcaaatccagatatgattgatcagtgcaaaagagaaggtttcctacaaagaatcaaagatgaagaaggtgaagggtgtaacgtatatggattcttggaagttaataaggtcgctgggaattttcattttgcacctggaaaaagtttccaacaatcgaacattcacgtccatgatcttctatcatttcagaaagatagttttaatataagtcacaaaatcaatagattgacttttggggactattttcctggtgtggtgaatcctcttgatggtgtgcaatggtcgcaggccacacctagtgggatgtatcagtattttatcaaggtggtacctactgtttacacagacgtgactggacatgctattcagtctaatcagttttctgtaactgagcattttaggacttcagaatttgggaatcttcagtttcttcctggtgtatttttcttttatgacctttctccaatcaaggtaacttttgctgaggagcatatatcattcttacacttcctcactaatgtgtgtgctatagttggaggtgttttcaccgtttcgggaatcctagattcctttatttaccatggccagaaggcaatcaagaagaagatggaaatcggtaaatttagttgattgcttaagggggaacacattgctgccgagtttgttggttctgccttttggtggcttttaggataccacaacaatgaagaatggtatctttcgatcatgaattaaaattgtcatgatgtttgcctgttctgtgaattgggttaacattcttgaaacaaattcaaacgtgcctaaactgtttagtttgagtgactactaatgtgaacacatatgtgctagttagagaagggcttttttctttttgttgctgatgaatttctatagttaatacttggatatcatggaaaattacatatcttaatgaaattgttcattc

SEQ ID NO: 5161 - DNA, 1993 bp, Vitis vinifera
aaatgcaaatgaagagctgctacacagtaatcatgtaataccgaacggtagatcgtagatcgtaaatactgcggaagaaaagggaggtttgtacggcgcgcctctctctctctctctctctctccctccctccctctatatctctcttacgagaaagagagaaaacagaaaataaaaaaaagcaagaaaatacgatacctttcccttcttaagcgcgtcgtttggagccaatcagctctgattcagcggggcgtttaattgatgagattttcttttcttttcgtttctttttctttttaattttaataactaaaatcgcactagattaataccatcgaacgatcaaacaacaatctgtctacggtggtagccatggacaacataatcaacaagcttcggaacttggatgcttaccctaagatcaacgaggatttctacagccgtacactctccggtggcgttattaccctcgcctcatctatttttatgctcttgctcttcatctccgagctcaggttatatctccatgctgtaacagaaacaaagcttgttgtagatacttcaagaggagaaacactacgtatcaattttgatgtcacttttcctgcccttccatgttccatactcagtcttgatgccatggatataagtggagagcaacatcttgatgtgagacatgacataatcaagaaaagaatagatgcccatggcagtgttatagaagcaaggcaggatgggattggttctcctaagattgaaaagcctttacagaaacatggaggcaggcttgagcataacgaaacgtattgtgggtcatgttatggtgcagaagcgtcagatgatgattgttgtaataactgtgaagaagttcgtgaagcataccggaagaaaggttgggcgatgtcaaatccagatttgattgaccagtgcaagagagaaggttttctgcaaaggattaaagatgaagaaggtgaagggtgtaatatatatggattcttggaagttaataaggttgctgggaatttccattttgcacctgggaaaagctttcaacaatcaaatattcatgtacacgatctgctggcatttcaaaaggatagctttaatattagtcacaagatcaacaggttagcttttggagactatttccctggtgttgtgaatcctctcgatggtgtgcaatggatacaggcaactccaagtgggatgtatcagtatttcatcaaggttgtacccactgtatatacacatgtgagtgggcacactatctcaacaaatcagttctctgttacagaacattttaggaatgcagaactaggtcgccttcagtctcttcctggagttttcttcttctatgacctttctccaatcaaggtgactttcacagaggagcatgtgtcattcttgcacttcctaacaaatgtctgtgccatagttggaggtgttttcactgtttcagggatattagattccttcatataccatagtcaaaaggcaatcaagaagaagatagaaattggtaaatttagttgatgactaattcgttcagcctcctttgctgccgtgtttttggttggtttggagaggacctactttagagaagagaaactgtgaatgactctccctgcagagttggcgggcttcttttgaacacaacttaggtttttccatgtgatctgtttgatcagtgaattatattaattttctgttccgcattaatatttactaccacctctttacctagtgttttcagttatttgtaattgtaccaatgatgtgaatatctgtttggaagataagagagatttatcatttttctcatgatgagaactgctggaaatttcttgattagaaatatcaagaacaataaaggatgggggtgggaggtggttcttttgaaggggaatggagtccagattttgttttgaaaggtgatggcattgaccaggcattgcttgtggctgtatgagccgtggttgttgatgctgccatt

SEQ ID NO: 5162 - DNA, 1972 bp, Prunus mume
aagaaaaagaaaaaataattaaatataaaaatataaaaaacaaatacaagaagtttctgaaaggcgaaagccaaaatcaacttggacgccccgttcgcaattttccttttttttcttcaataaaatttgtgtctctgtctctccttgctttgaattgcgacggggtgtttaggtttcaattctatcaaatttcagaaattgattcaacttcggtttcagagacattagatgagggattagtgtaataaatcgtgaagaaaaatcagatctttgagatagcgacaacaaattgcgcagagaaggaagaccaaaaatggagaatatgatgagcaagcttcggaatttggacgcctaccccaaaatcaatgaagatttctacagtcgcacgctctctggtggcgtcatcactctcgcctcctccattgtcatgctcttgctcttcctctccgagcttcggttatatcttcatgcggtaacggaaacaaggcttgtggtagatacttcaagaggagaaacactacgtatcaattttgatgtaaccttttctgcccttccttgttctatactaagtcttgatgccatggatatcagtggcgagcagcatttggatgtaaagcatgacataatcaaaaaaagattagactcccatggaaatgttatagaatcaaggccagatggaattggtgcacccaagattgagaagcccttacagagacatggtggcaggcttgagcacaacgagacatactgtggttcctgttatggtgcagaagcggctgatgaggattgttgtaattcctgtgaagacgtccgtgaagcttaccgaaagaaaggttgggcaatttcaaatccagatgtgattgaccagtgcaaaagagaaggttttttgcaaagaattaaagatgaagaaggtgaaggatgcaatatatatggattcttagaagtcaacaaggtagctgggaacttccattttgcacctgggaaaagctttcaacaatcaaatgttcatgtgcatgatctgctggcatttcaaaaggatagtttcaatattagtcacacgatcaacagattgtcttttggagactatttccctggtgttgtaaatcctcttgatggcgtgcactgggcacaagcaacaccaagtggaatgtatcaatattttatcaaggttgtacctactgtgtatacagacgtgagtggacacactatccaatcaaatcagttctctgtgactgaacattttaggggtacagaagtaggcaaccttcagtaccttcctggagtttttttcttctacgatctttctccaataaaggtaactttcacggaggagcatatttcattcttgcacttcctgacaaacgtttgtgccatagtaggaggagtttttactgtttctgggatattagattcattcatataccatggtcagaaggcaatcaagaagaagatggaaattggcaaatttagttgaatggttccactggcataatagctgctgctctatttgttggtctgccagtcaatggctttggggacaaaatcaaatctagggatgaggaagcatgtaatgcgctcatcatgtggttgggcagggcatcgtttaaccagagactaaatttttgtgatgaatggcttgatcaagtgaattaggttgaaattccttaatttagacgtgccaagtgccaaaatgttgaaacagttttgtaatcgctgtcttgatgtgcataactgcttgaaagatttttaaaaaagggcttttccatttcttgcgggttatctcattggaaaatcagaaactctctctccctacccctacctaattactctttctttttttaaatttgcttttttcacattggatgaaattgaactcgtgatgcatcatagttctacccatttcttctactgaatttcattttattaatcaatgccataggatttgcatctggttaagtaaactaactaaaac

SEQ ID NO: 5163 - DNA, 1228 bp, Panicum virgatum
ttttgctctttttgggtaaaaaaaaaacccgcctaactccttcgaaggcgaaaccccctcgaaccaggcgcaatctggaaaaaaaaacccggtatcaacaccatgctccattcccgtttcgatcgagcaaatccgagaaaataaagcgaaaatagggagaggcaaggccggtctcgtctcccccggttccgcggcgccggcaattcccccgagatcccgtcagccatggacgggctcctgaccaagctccgcagcctggacgcctaccccaaggtgaacgaggacttctacagccgcaccctctccggcggcatcatcacgctcgcctcctccgtcgtcatgctcctcctcttcgtctccgagctccgattatatcttcatgcagttacagagacaacactaagggtggatacctcaaggggtgaaacgcttcgcataaattttgatgtcaccttcccagcccttcagtgttctataattagccttgatgcaatggacatcagtgggcaagagcaccttgatgtgaaacatgatatattcaagcaacgaattgatgcccatggcaatgttattgctactagacaagatgctgttggtgggatgaagatggaaaagcccttacaacatcatggtgggcggcttgaacataatgaaacctattgtggttcttgctatggtgcccaagaatctgatgatcaatgttgtaacacatgtgaagatgttcgggaagcatacaggaaaaaaggttggggtgtatcgaatccagatctgcttgaccagtgcaaaagggagggcttccttcaaagcataaaggatgaagaaggtgaaggatgcaatatttatggtttcattgaagttaacaaggttgctggcaatttccactttgctcctgggaaaagcttccagcagtcaaatgtgcatgtgcacgacttgcttccattccagaaggacagcttcaatgttagccataagataaataagttaagttttggagaatactttcctggtgtggttaatccccttgatggggcgcaatgggtgcagcattcatcatatggaatgtatcaatacttcatcaaggttgttcccactgtctacactgacataaatgatcacatcatcctctcaaatcagttctctgtgacggaacattttagaagtagtgaaagtggtcgcatacaagctcttcctggcgtgtttttctttatgacctttccccaatcaaggt

SEQ ID NO: 5164 - DNA, 1536 bp, Euonymus alatus
cccaaacttgaccgcctcgttgaaacactgaattgttattatcaattacacggcggggtgtttacagctatccgttatcatcaaattaaataaatatcagatagattttgattagattagtgtattatttagaagcgtcgatcgttgatccatccgtcagatccgagaattttcgtttttcagacgcggccatggaaggacttgtgaacaggctacgaagcttggacgcctaccctaaaatcaacgaggatttctacagccgtactctatccggtggagttatcaccctcacctcctccattgttatgctcttgctcttcgtctccgagctaagattatatcttcatgctgttactgaaacaaagctcgtggttgatacttcaagaggcgaaactctacacatcaattttgatatcacttttccagcccttccatgttctatccttagtcttgacgccatggacataagtggagagcaacatcttgatgtgaaacatgacataatcaagaaaaggttagatgttcatggcaacacaatagaatcaaggcaagatggaattggcgctcccaagattgaaaagcctttacagagacatggcggccggcttgaacacaatgaaacatactgcggttcttgctatggcgcggaatcggcagatgatgattgttgtaattcctgtgaagacgttcgtgaagcatataggaaaaaaggctgggcaatatcaaatccagatttgattgatcagtgcaaaagagaagggtttctacaaagaatcaaggatgaagaaggagagggatgtaacatttacggattcctggaagttaataaagtggctggaaattttcattttgcacctgggaaaagtttccatcaagcaggtgttcatgtacatgatctgctggcatttcagaaggacagttttaatataagtcacaaaatcaatagattgactttcggagaatatttccccggtgttatgaatcctcttgatggggtgcattggacacatgaaacaccaaacgggatgtatcaatattttatcaaggttgtacctactgtgtacacagatgtcagtgggcacaccatccagtcaaatcagttttccgtaactgaacattttaggagcgcagaattcggtcgctttcagtctctaccaggcgttttcttcttttatgacctttctccaatcaaggtgactttcgcagaggagcatgtgtcattcctgcacttcctgactaatatgtgtgctattgttggaggtgttttcactgtttcgggaatactagattctttcgtatatcatggtcaaagagcaatcaaaaagaagatggaactcggtaaattcagttgatctctctgtccagttggcttggtcgaacttacttctggggttgttaccagtttatggcttccggaagagattctatcaggagtagaatcatcagatgagctcgtcaaattagtgagggttagtttctttgggtcaaaagccaagattttgtctgttcatgttcgattatattcaatgatcaact

SEQ ID NO: 5165 - DNA, 1626 bp, Carica papaya
aaggaagagaaacgaaaagaaaacttacagacagacaataggttaggtctcccaaaatcttaaacgcctcgttaagttaccagatcacaaactcatcaatttcaacggggtgtttaagctgcttattacacacaacctagatttttgttgctgtctcttatatatatatatatatattcgctaggttagattagcttaggaggtaacgtcagtctttcaatcaattcatcgttccatccatctatctcgccgagctctgaattgggcatggacggtataatgaacaaactaaggaatttggatgcttaccctaaaatcaatgaggatttctatagtcgtacgctctctggtggcgttatcactctcgcttcctccattgttatgttcttacttttcttctccgagctccgactatacctccatgctgtgactgaaacaaagcttgtagtagatacctcaagaggggaaatattacgtgtcaattttgatgtcacttttcctgccctgccatgttcaatcttgagtgtagatgccatggacatcagtggagaacaacaccttgacgtgaaacatgacattatcaagaaaagaatagattctcatggcaatgtaatagaagctaggcaagatgggattggtgctcctaagattgataaacctttgcaaagacatggaggcaggcttgagcataatgaaacgtattgcggttcctgttatggtgcagaagtgacagatgaggattgttgcaattcatgtgaggaagtgcgtgaagcttatcgaaagaaaggttgggcactctcaaatcctgatttaattgaccagtgcaaaagagaaggttttctgcaaaggattaaggatgaagaaggtgaaggatgtaatatatacgggttcttggaagtcaacaaggtggctgggaattttcattttgctcctgggaaaagctttcagcagtcaggtgtccatgtacatgatctgttggcatttcaaaaagacagttttaatataagtcacaaaatcaatagattggcttttggagattattttcccggtgttgtaaatcctcttgatggtgtacactggacacaagaaacgccaagtgggatgtatcaatattttatcaaggttgtacctactgtgtacacagatgtgagtggacatacaattcagtcaaatcagttctctgtaacagaacattttaagaatgctgaagtaggtcgccttcaatctctaccaggagtatttttcttctatgacttgtctccgatcaaggtgactttcacagaggagcatgtgtcattcttacacttcttgacaaatgtttgcgccatagttggaggtgttttcaccgtctctggaatactagattcttttatataccatggtcaaaaggcaatcaagaagaaaatggaacttggtaaattcaattgatgtagctgctcctgctcgtgagtatctgttaataaattggctattgggaggaaaaggtaaaacaggcaactgggaacccaacaaaggacgaagtctacggtgttgacagattggattctacaatcacaatctgagactaattttgtagttcatctatatttgctagatgcctagtgtctcagttttatcagtcatctg

SEQ ID NO: 5166 - DNA, 1626 bp, Prunus persica
cttagacgccccgttcgcaattttccctttttttcttcaataaaatctgtgtctctgtgtctccttgctttgaattgcgacggggtgtttaggtttcaattctatcaaatttcagagattgattcaatttctgtttcagagacattaggtgagggattagtgtaataaatcgtgaagaaaaatcagatctttgagatagcgacaacaaattgggcagagaaggaagaccaaaaatggagaatatgatgagcaggcttcggaatttggacgcctaccccaaaatcaatgaagatttctacagtcgcacgctctctggtggcgtcatcactctcgcctcctccattgtcatgctcttgctcttcctctccgagcttcggttatatcttcatgcggtaacggaaacaaagcttgtggtggatacttcaagaggagaaacactacgtatcaattttgatgtaaccttttctgctcttccttgttctatactaagtcttgatgccatggacatcagtggcgagcagcatttggatgtaaagcatgacataatcaaaaaaagattagactcccatggaaatgttatagaatcaaggccagatggaattggtgcacccaagattgagaagcccttacaaagacatggtgggaggcttgagcacaacgagacatactgtggttcctgttatggtgcagaagcggctgatgaggattgttgtaattcctgtgaagacgtccgcgaagcttaccgaaagaaaggttgggcaatttcaaatccagatgtgattgaccagtgcaaaagagaaggttttttgcaaagaattaaagatgaagaaggtgaaggatgcaatatatatggattcttagaagtcaacaaggtagctgggaacttccattttgcacctgggaaaagctttcaacaatcaaatgttcatgtgcatgatctgctggcatttcaaaaggatagtttcaatattagtcacacaatcaacagattgtcttttggagactatttccctggtgttgtaaatcctcttgatggcgtgcactgggcgcaagcaacaccaagtgggatgtatcaatattttatcaaggttgtacctactgtgtatacagacgtgagtggacacactatccaatcaaatcagttctctgtgactgaacattttaggggtacagaagtaggcaaccttcagtaccttcctggagtttttttcttctacgatctttctccaataaaggtaactttcacagaggagcatatttcattcttgcacttcctgacaaacgtttgtgccatagtaggaggagtttttactgtttctgggatattagattcattcatataccatggtcagaaggcaatcaagaagaagatggaaattggcaaatttagttgagtggttccactggcataattgctcctgctctatttgttggtctgccagtcaatgactttggggacaaaatcaaatctagggatgaggaagcatgtaatgcgctcatcatgtggttgggcagggcatcgtttaaccagagactaaagttttgtgaatggcttgatcaagtgaattaggttgaaattccttaatttagacatgccaagtgccaaaatgttgaaacagttttgta

SEQ ID NO: 5167 - DNA, 1822 bp, Musa acuminata
gtcttagtaaaccccaaattcacaaaataatgctcgagagagagagagagagaggatctaaatatagatagatcgggtcgagaaatcttccgccgaggctcacaatcttttcttgccttccgttccatcccgtgtcgacttctcgatctgtgcctctctcttgggatcgatagaatggagggcctcttcgggaagctgcggaacctggacgcctaccccaagatcaacgaggatttctatagtcgaacactttccggtggcatcatcaccatcgtctcttccatcgtcatgttcctcctgttcatctccgagctccgattgtatcttcatgctgttacagaaacaaagctcatagttgatacctcaagaggagaaacccttcggatcaattttgatgtcacctttcctgccctttcatgttctatgctcagtcttgacgcaatggatattagcggggaagagcaccttgatgtcagacatgacataattaagaagaggctagattctcatggcaatattattgaatctagacaagatggaattggttcacctaagattgaaaagcctttgcaaagacatggtggaagacttgaacataatgagacatactgtggttcttgctatggtgcagaagtgtctgatgaagattgttgcaactcttgtgaagaagttcgtgaagcctacagaaagaaaggttggggcctttcagaccctgaaataattgaccagtgcaaaagagaaggttttcttcaaaggatcaaggatgaagatggtgaagggtgcaacatctatggtttcttggaagttaaaaaagtggcaggaaattttcactttgcccctggtaaaagctttcagcagtcaaatatgcatgtgcatgacttgttgccattccaaaaagagagttttaatataagtcacaaaattaacagattatcttttggagaatattttcctggtgccatcaatcctcttgatggagttcagtgggtgcaacacgcaccatatggaatgtaccaatactttatcaaggttgttcctactgtttacactgacataaggggtcgtaccatccagtccaaccagttctctgtaaccgaacatttcaggagtgatgatattggtcgattacaatatcttccaggagtgtttttcttttatgacctttctccgattaaggttacattcacggagggacatgtatctttcttacacttcttgactaatgtttgtgcaatagttggaggtgtttttactgtttctgggatattagattcattcatctatcatggtcaaagagcaatcaagaagaagatagagattggtaaattcagctgattttgtctatggtgtaaactctcattgccaatctgaaggacattcacacaagggggaacttgttaatatatcagagaaaggtagtctactcacaattccatttgcaagtaatattgagttgcttgacagtgtcacgctgggttatttcttggtttagtctctctctgcaccctgagttggtcgatgtaattgatttcacactctgcttaaagacttccgactccgaattcaagtaatgtaagcatgagcccgagtgctgatgaaagaccatttgtgagcaaaaattcagacggtgttgatagggagtataaactgatcattttgacagtcatggctaaggctttctcctaagttttgtttagcaggaaatggtatagacaaactgtgacacatgattcattgtcgtgttacaaatacgagttgagctgcttacgttgaaaaatctcaactttctcatttttgatattttagtgcaattgttctgctt

SEQ ID NO: 5168 - DNA, 1960 bp, Malus domestica
aaataaatagcgaaaaaaaatattaaagagcaaaaacaacaagttcctgaaaccaaaagaaatcaacttggacgccccgttcgtaaaatcgtccccccttttttttcttccaataaaaaatctgcgtttctgtctcgattttgctttcgatttggaagaacggggtgtttaggtttgaatttcaataaataatctgcagattttgtaatttaattttttatttcagagacatttagatgagatattatcagatcaaatcttagagattaccgagcgaagaaaatcaaggcaacaaaaaaaaaatggagaatataatgagcaagcttcggaatttggatgcttacccaaaaatcaatgaagatttctacagtcgtacactctccggcggcgttatcaccctcgcttcctccatcgtcatgctcctgctcttcctctccgagcttcggttatatctccatgcggtaacggaatcaaagcttgtggtagatacttctagaggcgaaaccttacgaatcaattttgatgtgacttttgctgccttgccttgttctatactaagtctcgatgccatggacatcagtggcgagcagcacctagatgtaaaacatgacattatcaaaaaaagattagactcccatggaaatgtgatagaatcaaggccagatgttattggtgcacccaagattgataagcccttacagagacatggtggcaggcttgagcacaatgagacatactgtggttcatgttatggtgcagaagcggctgacgaggattgttgtaattcatgtgaagatgtccgtgaagcttaccgaaagaaaggttgggcaatatcaaatcccgatttgattgaccagtgcaaaagagaaggctttctgcaaagaattaaagatgaagaaggggaagggtgcaatatatatggattcttggaagtcaacaaggtagctgggaacttccattttgcaccagggaaaagctttcaacaatcaaatgttcatgtacatgatctgttggcatttcaaaaggatagtttcaatataagtcacacgatcaacagattgtcttttggagactatttccctggtgttgtaaatcctcttgatggtgtgcactggactcaagacaacccaagtgggatgtatcaatactttatcaaggttgtacctactgtgtatacagacgtgagtgggcacactatacagtcaaatcagttctctgtgaccgaacattataggggtacagaaatgggcaaccttcagttccttcctggagtgtttttcttctatgatctttctcctataaaggtaactttcacggaggagcatatttcattcctgcacttcctgacaaatgtttgtgccatagtcggaggtgtttttacagtttcggggatactagattcatttatataccatggccagaaggcaatcaagaagaagatggaaattggcaagtttagttgagcggttctattagcatatggtgctgctccatttgtttggtccgcctgtcaacgactttgtgcgcgacagaatcgatctaggaaagaggaagcttgtagtgcactctcatgaccatgtggttgggcagaggcatcatcgtttaatcggtgacgtaaaagaactaggttgacattccttaattcagacatatgccaaatgcccacaatgttaaaacagttttgtaatcgctaaatcgtgatgtgaatctctgtttgaaagccgaaagaagggcttcttcgtttcctccgggacattcgattctcaatggagatccaggcacttttactccctcccgaattaatctctcgttttcttttccttcttccgacattcgacgatttcgaactcatagtcctactctttttttggggtcttggttagtggttacttgtcttgctctttggtttggtactaatgtttgattgacagataaaattagtgaatacaaattattgcgg

SEQ ID NO: 5169 - DNA, 1800 bp, Gossypium hirsutum
ggaaatagaaataagcttcgccttctttctcattttccaaccttaggagacacagaaaagaagaaaaaacgacttcctccctggaaatcttaaactcctcgtttcaaaactcttaactataaatattctattaataccaacgaggtgtttaagtaatttgttcaattggtttatgttcttttaatttcttgttagatttgtttttctgttttggattttaggttaagaagagcaggaattgttttataaatcaattgaaaaagaaaagaaaggatagaatcaatggatggaataatgaataagataaggaatttagatgcataccctaagataaacgaggatttctacagccgtacgctttccggtggcgttatcactgtcgtctcctccgttgtaatgttcttgctcttcttctccgagctccgattatatcttcatgctgcaaccgaaacaaaactcgtggttgacacttcaagaggggaaactcttcgcatcaattttgatgttacatttcctgctcttgcatgctcaatcgttagcgttgatgcaatggatataagtggagagcaacatcttgatgtgaaacatgacataatcaagaaacggttagatgcacatggcaatgttatagaatcgaggccagatggaattggtgctcccaagattgaaaagcctttacagaggcatggtggcagacttgagcacaatgagacttattgtggttcatgttatggtgcagaagcggctgatgatgattgttgcaattcctgtgaggatgttcgtgaggcatacagaaagaaaggttgggcgttgtcaaacccagatttgattgatcagtgcaagagagagggttttcttcagaagattaaggatgaagaaggtgaggggtgtaatatatatggctttttagaagttaataaggtggccgggaactttcattttgcacctgggaaaagctttcagcaatcgaatgttcatgtacatgacttgctagcttttcaaaaggacagttttaatctaagtcacaagatcaatagattagctttcggagattacttccccggggtcgtgaatcctcttgatagtgttcattggactcaagaacagccaagtgggatgtaccagtactttctcaaggttgtccctaccgtgtacacagatgtgagtgggcacactatccaatcaaatcagttttctgtaacggagcattttaagggtgcagaagtaggccggcttcaatccctccctggagttttcttcttttatgacctttctcctatcaaggtgacttttacagagcagcatgtctcgttcttgcactttctaacaaatgtttgtgctatagttggaggtgtttttactgtttcgggaatattagactcttttatataccatggtcaaaaagcaatcaagaagaagatggaaattggtaaacttagttgaagattggggctgctgcttcatgttccagtaagaggtgcttggggaaaaatcaaactaagcgagaagaccacgcagcaatgtaccgtacgtattcctgttcagtcagatttcttggtaatcatgaatatggttggaatgatttcatagttcatttacgagtcttagttgtctttgagactgaccgaaatcgacagagtccaagcttgagtttgaatttatctactcctttattatgcgttactcaaatggtatgatttgtatcttttaacaagaattagaaaagaaatggaagcgattttggtttaagaggaaatgataaaatatctaataatctaaaattgattgaattgtagctta

SEQ ID NO: 5170 - DNA, 2449 bp, Gossypium raimondii
atttttttaaagaccaaaataaaaaaaattctattttagggtgctgccagcccccttagttttgctccttattagattatgtttcaaggtgaataatcgtttgcctttcttttattttttagaaattgataagaagaaaagaaagaaagaagaaaaagaaaaaaaaaatcatgtttaaattatttctaattaaaatcttacaaaaggataatattagtaatcaaaatggagcaatgatcaaaacaaaaatttaaccaaacaataatgactatttttatagtttacccttcaaaaaatttgtcttaaattataggagaaagacccctttaccgtaaaagccgggtggggaaatagaaataagcttcgccttctttctcattttccgaccttaggagacacagaaaagaagaaaaaacgacttcctccctggaaatcttaaactcctcgtttcaaaactcttaactataaatattctattaataccaacgaggtgtttaagtaatttgttcaattggtttatgttcttttagtttcttgttagatttgtttttctgttttggattttaggttaagaagagcaggaattgttttataaatcaattgaaaaagaaaagaaaggatagaatcaatggatggaataatgaataagataaggaatttagatgcataccctaagataaacgaggatttctacagccgtacgctttccggtggcgttatcactgtcgtctcctccgttgtaatgttcttgctcttcttctccgagctccgattatatcttcatgctgcaaccgaaacaaaactcgtggttgacacttcaagaggggaaactcttcgcatcaattttgatgttacatttcctgctcttgcatgctcaatcgttagcgttgatgcaatggatataagtggagagcaacatcttgatgtgaaacatgacataatcaagaaacggttagatgcacatggcaatgttatagaatcgaggccagatggaattggtgctcccaagattgaaaagcctttacagaggcatggtggcagacttgagcacaatgagacttattgtggttcatgttatggtgcagaagcggctgatgatgattgttgcaattcctgtgaggatgttcgtgaggcatacagaaagaaaggttgggcgttgtcgaacccagatttgattgaccagtgcaagagagagggttttcttcagaagattaaggatgaagaaggtgaggggtgtaatatatatggctttttagaagttaataaggtggccgggaactttcattttgcacctgggaaaagctttcagcaatcgaatgttcatgtacatgacttgctagcttttcaaaaggagagttttaatctaagtcacaagatcaatagattagctttcggagattacttccccggggtcgtgaatcctcttgatagtgttcattggactcaagaacagccaagtgggatgtaccagtactttctcaaggttgtccctaccgtgtacacagatgtgagtgggcacactatccagtcaaatcagttttctgtaacggagcattttaagggtgcagaagttggccggcttcaatccctccctggagttttcttcttttatgacctttctcctatcaaggtgacttttacagagcagcatgtctcgttcttgcactttctaacaaatgtttgtgctatagttggaggtgtttttactgtttcgggaatattagactcttttatataccatggtcaaaaagcaatcaagaagaagatggaaattggtaaatttagttgaagattggggctgctgcttcatgttccagtaagaggtgcttggggaaaaatcaaactaagcgagaagaccacgcagcaatgtaccgtacgtattcctgttcagtcagatttcttggtaatcatgaatatggttgaattggaatgatttcatagttcatttacgagtcttagttgtctttgagactgaccgaaatcaacagagtccaagcttgagtttgaatttatctactcctttattatgcgttactcaaatggtatgatttgtatcttttaacaagaattagaaaagaaatggaagcgatttttgtttaagaggaaaagataaaatatctaataatctaaaattgattgaattgtagcttataataaagttcaaccgtgataaaatattttgtaattctcttatcattttcatataccgtatatggttttatgaggtaactgaaataaagtctctggttattaatgctccacacttcgaaaaaaaaaacatttatgctaaattattgacattttataagtttggattctcgtggttcgggttggggtatttcttcaatctggattttgaacaagttattttgtaattttaattttgatgttacttgtattattatttaataaataaaaaggtatttaaatgtaattataaaataatgta

SEQ ID NO: 5171 - DNA, 1491 bp, Humulus lupulus
tggatggtataatgagcaagctccggaatttggatgcttatcccaagatcaatgaagatttctacagtcgtaccctctccggtggcgttatcaccatcgcctcctccattgtcatgctcttgctcttcctctccgagatccggttatatctacatgcagttactgaaacaaagcttgtagtggatacttcaagaggagagaccctgcgtatcaattttgatgtcaccttccccgcccttccttgttccatactcagtcttgatgccatggacataagtggagagcaacacctggatgtaaaacatgacgtaatcaagaagaggctagattctcatggcaatgtaatagaaactagacaggatggaattggtgccccgaagattgataagccattacaaagacatggtggcagacttgagcataatgagacatactgtggttcttgctatggtgcagaagcgtcagatgaagattgttgtaataattgtgaagaagtccgtgaagcataccggaagaaaggttgggcattgtcaaatccagatatgattgatcagtgcaaaagagaaggtttcctgcaaagaatcaaagatgaagaaggtgaagggtgtaatgtatatggattcttggaagttaataaggtagctgggaattttcattttgcacctgggaaaagtttccaacaatcaaatattcacgtccatgatcttctgtcgtttcagaaagatagtttcaatataagtcacaaaatcaatagattggcttttggggactattttcctggtgttgtgaatcctcttgatggtgtgcagtggacgcagcaaacacctagtgggatgtatcagtattttatcaaggttgtacctactgtttacacagatgtgactggacatgctattcagtcgaatcagttttctgtaactgagcattttaggacttcagaatttggaaaccttcaatttcttcctggtgtatttttcttttatgatctttctccaatcaaggtaacttttgctgaggagcatatatcattcttacacttcctcactaatgtgtgcgctatagttggaggtgttttcacggtttcgggtatcctagattcttttatatatcatggccagaaggcaatcaagaagaagatggaaatcggtaaatttagttgattgcttatgggggtgggggggcacacattgctgccgagtttgttggttctgcctttcagtggcttttaggacaccaaaaaaagaaatggatggtatcttttgatcacgaactaaaattttgtcatgatgtttgtctgttctctgaattgggctaacattcttgataaagatttaaacgtgcgtaagctgttcagttcgcttaactactaatgtgaacacctgtgtgctagttataggagttttttctttttgttgctgatggatttatacaattaatgtttggatatcatgtaaaattacatatctaaatgaacattgctcattcgtcgca

SEQ ID NO: 5172 - DNA, 1916 bp, Glycine max
tcagattgtgagtatcatccatttagttgacagatgaagagagaaagtgagctgatgaaaagatcctgaatcaacaaagaagagacgacacgacacacacacacacaaaaaaaaaagcaaacaagctgactcggagttaaaatagaagaaaggattatcagagtcgcattgtcgattcagagaaaaaaaaattgaattcaatctgatagatcctatcacagcaaaaaaaattggattgaataaggtgtttccgatttcaaaaacaatcacacaaatggttaataaaagttaggtttcttaatttctgcttcttattacatcatcttaaatctttggttttggatccatccaataatcatggagagcataataagcaagctccgcaacctagacgcctaccctaaaatcaacgaggatttctacagccgcacgctctccggcggtgtcatcactctcgcttcctccattctcatgctcttgctcttctactccgagctccggttgtatcttcacgctgtcaccgagaccaagcttgtcgtcgacacttccagagccgaaacgctgcgtatcaattttgatgttacgtttcctgcgcttccatgttccatactcagtcttgatgccatggacatcagcggagagcagcgtctagatgttaaacacgatataatcaagaagagattagactctcgtggcaatgtgatagaaacaaggcaagaaggaattggtgctcccaagattgaaaagccattgcagaggcatggaggcaggctcgagcacaatgagacttattgtggttcctgttatggttctgaagtgtcagatgatgattgttgtaattcctgtgaggatgttcgtgaagcataccgtaagaaaggttgggcactttcaaatcctgatttaattgaccagtgcaaaagagaaggattcttacaaagaatcaaggatgaagaaggtgaaggatgcaatgtgtatggtttcttggaagtaaataaggttgcagggaattttcattttgcacctgggaaaagctttcagcaatctggtgtacatgtacatgacctgctggcttttcaaaaggattcttttaatttaagtcaccacatcaacagattaactttcggagagtatttccctggtgttgttaatcctcttgacaacgtgcattggacacaagaaacaccaagtgggatgtaccagtattttattaaggttgtgcctacagtatacactgatgtgagtgggcatactatccagtcaaaccagttctctgttacagaacacttcaggactggagacatgggccgtctgcagtcccttcccggagttttctttttctatgacctctctccaattaaggttacttttacggaagaaaatgtctcattcttacattttcttactaatgtttgtgccatagttggaggtattttcaccgtttctggaatactagattcattcatctatcacggtcaaagggctatcaagaagaagatggaacttggtaaatttaactgatgggtgctatttgagtaatttcgagcgaatggctctccagagacaatctattcaagagaaggtcgactactgattgaaattccccttggggttctgagttcttcggttacaacaaaaggattttgcccttagatcaaggttgaaatgcctagatatcatgtgcaacaaatgctactttgccttgattcatatcttttctgacagctctgatgttgtgaatgttatgtgttttatggaaagtagaggggcttttccttgcagaagcatcaaaagggaatccattagggaaaaatataactcaacaatgatagtctaaaatgagatataactgtataggtgcatttttttctctttggtagaagttttaattatctgcgtttgtggttctattctgttcc

SEQ ID NO: 5173 - DNA, 2122 bp, Glycine max
gaaacacttaacggatgcaattggaatttagacattaaaattgtagaattaagtcattaatttaacaaatacaaaatgttatcaaattattcaggtgtaagtttttaatgttagaaacttccccaactcagattgtgagtatcatccatttagttgacagatgaagagagaaagtgagctgatgaaaagatcctgaatcaacaaagaagagacgacacgacacacacacacacaaaaaaaaaagcaaacaagctgactcggagttaaaatagaagaaaggattatcagagtcgcattgtcgattcagagaaaaaaaaattgaattcaatctgatagatcctatcacagcaaaaaaaattggattgaataaggtgtttccgatttcaaaaacaatcacacaaatggttaataaaagttaggtttcttaatttctgcttcttattacatcatcttaaatctttggttttggatccatccaataatcatggagagcataataagcaagctccgcaacctagacgcctaccctaaaatcaacgaggatttctacagccgcacgctctccggcggtgtcatcactctcgcttcctccattctcatgctcttgctcttctactccgagctccggttgtatcttcacgctgtcaccgagaccaagcttgtcgtcgacacttccagagccgaaacgctgcgtatcaattttgatgttacgtttcctgcgcttccatgttccatactcagtcttgatgccatggacatcagcggagagcagcgtctagatgttaaacacgatataatcaagaagagattagactctcgtggcaatgtgatagaaacaaggcaagaaggaattggtgctcccaagattgaaaagccattgcagaggcatggaggcaggctcgagcacaatgagacttattgtggttcctgttatggttctgaagtgtcagatgatgattgttgtaattcctgtgaggatgttcgtgaagcataccgtaagaaaggttgggcactttcaaatcctgatttaattgaccagtgcaaaagagaaggattcttacaaagaatcaaggatgaagaaggtgaaggatgcaatgtgtatggtttcttggaagtaaataaggttgcagggaattttcattttgcacctgggaaaagctttcagcaatctggtgtacatgtacatgacctgctggcttttcaaaaggattcttttaatttaagtcaccacatcaacagattaactttcggagagtatttccctggtgttgttaatcctcttgacaacgtgcattggacacaagaaacaccaagtgggatgtaccagtattttattaaggttgtgcctacagtatacactgatgtgagtgggcatactatccagtcaaaccagttctctgttacagaacacttcaggactggagacatgggccgtctgcagtcccttcccggagttttctttttctatgacctctctccaattaaggttacttttacggaagaaaatgtctcattcttacattttcttactaatgtttgtgccatagttggaggtattttcaccgtttctggaatactagattcattcatctatcacggtcaaagggctatcaagaagaagatggaacttggtaaatttaactgatgggtgctatttgagtaatttcgagcgaatggctctccagagacaatctattcaagagaaggtcgactactgattgaaattccccttggggttctgagttcttcggttacaacaaaaggattttgcccttagatcaaggttgaaatgcctagatatcatgtgcaacaaatgctactttgccttgattcatatcttttctgacagctctgatgttgtgaatgttatgtgttttatggaaagtagaggggcttttccttgcagaagcatcaaaagggaatccattagggaaaaatataactcaacaatgatagtctaaaatgagatataactgtataggtgcatttttttctctttggtagaagttttaattatctgcgtttgtggttctattctgttccaaaaaaatcataattgtttcgttgaaatctcaaatatagaagttgcattttaaaggaggaaaaattcaaagttagaaaa

SEQ ID NO: 5174 - DNA, 1290 bp, Amsonia hubrichtii
gatagtgtaatgggtaaaatccggagtttggatgcctatccgaagatcaatgaggatttctatagcagaacgctatcgggcggcgtcataacccttacctcctccatcgtcatgcttttgctcttcgtttccgagctcagattatatctccattctgtaactgaaacaaagcttgtggtagatacttccagaggagaaagattacgtatcaattttgatgtcacatttccagcgcttccttgttccatgcttagtcttgacgccatggatataagtggagagcaacatcttgatgtaagacatgacatcatcaagaaaagaatcgatgcccgtggtaatgtaatagaaacaagacaggacggtattggagctcctaagattgaaaaccctttacagagacatggtggtaggcttgaacacaatgaaacgtactgcggttcatgttatggggcagaagcgtctgatgatgattgctgcaacaactgtgaacaagttcgtgaagcataccgtaagaaaggctgggcaatgtctaatccagatttaattgaccagtgtaaaagagaaggttttcttcaaagaatcaaagatgaagaaggtgaaggatgcagtgtgtatggtttcttagatgtcaataaggtggctggaaattttcattttgcacctggaaagagttttcaacaggcaaacgttcatgtccatgatctgctggcatttcaaaaggatagttttaatataagtcacaagatcaatcgattaacttttggagagtatttccctggtgttgttaatcctcttgatggtgtggaatggattcagcaaacacccaatgggatgtatcagtatttcatcaaggtggtacctactgtttacacagacattactggacacactatccaatcaaaccagttctctgtaaccgagcattttaagggagcagatataggtcgtcttcaatctcttcctggggtcttcttcttttatgatctttcgccaataaaggttactttcaaggaggagcatgtttcatttctacacttcctgacaaatgtctgtgctatagttggaggtgttttctactgtttcggggataattgattctttcatatatcatggtcagagggcaattaagaagaaaatggaaattggtaaatttagctgataaatgagtaatagtgcctctcttattttcatgctccattctgccaagtggaatggctcttttggaagactgaatgaagaggtgaacgaagtctttggaaatgaccaaattcagggttgcaggcatcagtt

SEQ ID NO: 5175 - DNA, 1721 bp, Linum usitatissimum
gaaaaattgggcgggccggaagaaagtaacagctgcggagagattgatcgacgcaaattccaaagcacctccgttggaatcaatctacgtcaattgatattccttcgttcctttcatcagcgagttgaatcccggtcgtccaatcgaaatcgggggaagagagattcggtctgtgatttattcaccgtcagtgaatctcaatctttgattagattcaggttcagggacaatcgcaggtaggggagaagaggaaatccccaattcgatccagctcaaggggttttcgccatggacggcatgatgagcaagctgaggagcttggacgcttacccgaagatcaatgaagatttctacagccgtacgctttccggcggtcttattaccctcgcctcatctgtcgtcatgcttctccttttcatctccgagctacgattgtatctgcatactgtcacagaaacgaagctcgtggttgatacatcaagaggagaaactcttcggatcattttgatgtgagtttcccggccctcccttgctcaattctcagtatttgatgccatggacataagtggagaacaacatcttgatgtgaaacatgacataatcaagaagagactagactcacatggcaatgtaatagaagcacggcctgatggaattggtgctcctaagattgaaaagcctttgcaaaaacatggtgggaggcttgaccacaatgagacatattgtggttcatgctttggcgctgaagagtcagatgaccattgttgtaattcttgtgaggatgttcgtgaagcatatcgtaagaagggctgggcactctctaatccagatcttatcgaccagtgtaaaagagaaggctttcttcagaaaatcaaagaggaagaagggaaagggtgtaatgtgtatggattccttgaggttaataaggtggctggtaatttccattttgcaccagggaagagttttcaacaatcaggagttcatgttcatgatatcctggcttttcagaaagacactttcaatgttagtcaccatattaacaggctatcatttggagaatactttcccggggctgtaaatcctcttgatggtgtactttggactcaagaatctccaagtggcatgtatcagtactttatcaaggttgtgcccactgtgtacactgatgtaagcgggcacacaatccaatcaaatcagttctctgtaactgaacattttaggagtgcggatgctggtcggcttcagtccctcccgggagtgttcttcttctatgatctttctccaattaaggttacattcatggaggagcatgtgtccttcttgcacttcttaacaaatatgtgtgctatagttggaggagttttcacggtatctgggattttggattcgttcgtgtaccacagtcaaaaggcaatcaagaagaagatggagcttgggaaatttagctgatgatagcagcaaccgcagcagtctcttactgtctcgtggcatccaagtttgtcgtgctgaggcgccggaatcgaaatggagggagtggttcgagctactcggaggactaagagtcctcagcatttgtggaccttttgttccaaatagtatgtatcgtcggacaaatggttgccaagattggccatggttgagttcattacatttaatattagaagcttcttatttattcaatttgcgaactaaagcatttaagcatttaacaacttgttaag

SEQ ID NO: 5176 - DNA, 1812 bp, Fragaria vesca
accaaaccaaaccaaaaggaaggccaaaacttgagacgccccgttcgtcaaattttcccctctcaataataaaatcccagtaggtctctccctttctctttcaatttcaacggggctctctatcccttagttttattttcattttcaatttcaatttcaattagatttcattaggttttcttagatcgagaacaacaagatcgcaagctcgattgttagggtatagcagagaccatggagaatatgatgagcaagctccggaatttggacgcctatcccaaaatcaacgaagatttctacagccgtaccctctccggcggcgtcatcaccctcgcctcctccgtcgttatgctcctcctcttcctctccgagctccaattatatctacatgcggtgacggaaacgaagcttgtggtggatacttcgagaggagaaaccctgcgtatcaatttcgatgtaacttttgctgcgcttccttgttctatactcagtcttgatgctatggacatcagtggagagcagcaccttgatgtaaaacatgacattataaaaaaagaatagattcccatggaaatgttatagaatcacggccggatggaatcggtgctcccaagattgacaagcctttgcagagacatggtggcagacttgagcacaacgagacatactgtggttcctgttatggtgctgaagcgaatgatgaggactgctgtaataactgtgaagaggtccgtgaagcttaccgaaagaaaggttgggccatttcaaatccagatttgattgaccagtgcaaaagagaaggatttatgcaaaggattaaagatgaagaaggtgaaggatgcaatatatatggattcttggaagtcaataaggtggctgggaactttcattttgcacctgggaaaagctttcaacaatcaaatgttcatgtacatgatttgctggcgtttcaaaaggatagctttaatataagtcacacaatcaacagattgtcttttggagactacttccctggtgttgtcaatcctcttgatggggtgcactggacacaggacaacccaagtgggatgtatcaatattttatcaaggttgttcctactgtgtacacagatgtcagtgggcacactatccagtcaaatcagttctctgtcactgaacattataggggtacagaaataggcaaccttcagttccttcctggagtgtttttcttctatgacctttccccgataaaggtaactttcacagaggagcatatttcattcttacacttcttgacaaatgtgtgtgccattgttggaggtgtttttaccgtgtctggaatattggattcatttatataccatggtcagaaggctattaaaaagaagatggaaattggcaaattcagttgaatggagctgttgccgtaaattgctgctgtaattttcaatggccttctggacagagacgggatagaaacgaggaagcatgtaatggattcatcaaagtggattgggctggcatcatatgaccacaaactaaagttttgtcatgaatgggtttgatcatatggattagaatgaaattttcttaatttagagatgccaaatgccacaatagaacagttttgtaaccgcagtcatgatgtgaatatgcttcaaagattaaagtacggcttccatttgttgcaggatattcaacaaactgaaattaaaaggaaggaaacggttatgtcgcccggtccttgcttttgaaattcaagagttacactcctgctttcttgtggcaacttgcccttagattagtttatcaattcttaatttgaattcg

SEQ ID NO: 5177 - DNA, 1809 bp, Gossypium hirsutum
gggaaatagaaataagcttcgccttctttctcattttcctaccttagttaggagacacagaaaagaagaaaaaacgacttcctccctggaaatcttaaactcctcgtttcaaaactcttaactataaatattctatttatatcgacgaggtgtttaagtaatttgttcaattggtgtatgttcttttagtttcttgttagatttgtttttctgttttggattttaggttaagaagagcaggaattgttttataaatcaattgaaaaagaaaagaaaagatagaatcaatggatggaataatgaataagataaggaatttagatgcgtaccctaagataaacgaggatttctacagccgcacgctttccggtggcgttatcactgtcgtctcctccgttgttatgttcttgctcttcttctccgagctccgattatatcttcatgctgcaaccgaaacaaaactcgtggttgacacttcaaggggggaaactctacgcatcaattttgatgttacatttcctgctcttgcatgctcaatcgttagcgttgatgcaatggatataagtggagagcaacaccttgatgtgaaacatgacataatcaagaaacggttagatgcacatggcaatgttatagaagcgaggccagatggaattggtgctcccaagattgaaaagcctttacagaggcatggtggcagacttgagcacaatgagacttattgtggttcatgttatggtgcagaagcggctgatgatgattgttgcaattcctgtgaggatgttcgtgaggcatacagaaagaaaggttgggcgttgtcgaacccagatttgattgaccagtgcaagagagagggttttcttcagaagattaaggatgaagaaggtgaggggtgtaatatatatggctttttagaagttaataaggtggcagggaactttcattttgcacctgggaaaagctttcagcaatcgaatgttcatgtacatgacttgctagcttttcaaaaggagagttttaatctaagtcacaggatcaatagattagctttcggagattacttccccggggtcgtgaatcctcttgatagtgttcattggactcaagaacagccaagtgggatgtaccagtactttctcaaggttgtccctaccgtgtacacagatgtgagtgggcacactatccagtcaaatcagttttctgtaacggagcattttaagggtgcagaagttggccggcttcaatccctccctggagttttcttcttttatgacctttctcctatcaaggtgacttttacagagcagcatgtctcgttcttgcactttctaacaaatgtttgtgctatagttggaggtgtttttactgtttcgggaatattagactcttttatataccatggtcaaaaagcaatcaagaagaagatggaaattggtaaattcagttgaagattgaggctgctgcttcatgttccggtaagaggtgcttggggaaaaatcaaactaagcgagaagaccacgcagcaatgtaccgtacgtattcctgttcagtcagatttcttggtaatcatgaatatggttgaattggaatgatttcatagttcatttacaagtcttagttgtctttgagactgaccgaaatcaacagagtccaagcttgagtttgaatttatctactcctttattatgcgttactcaaatggtgtgatttgtatcttttaacaagaattagaaaagaaatggaagcgatttttgtttaagaggaaatgataaaatatctaataatctaaaattgattgaattgtagctt

SEQ ID NO: 5178 - DNA, 2066 bp, Quercus alba
ccgtaaataccggtacagcgaacggcaatctcgtaaaagggtctcctagctcttgtatttgtctccagaaaagcaaagaaaacaaaacaagattaaaaggtaggcagccccaactccaagattaaacgcccccgtttagttcttccagatcaaaaattcgtttactatcgagcggggtgtttagttttgaaggtagatattgattaattttaaaaattagagagattagagattttagatataaataaatagatcgagatcaaaatctaagaggagcaacaatggataatataatgagcaagcttcggagcctggacgcgtatccgaaaatcaacgaggatttctacagccgtacactctccggtggccttatcactctcgtttcctccatcgtcatgctcttgctcttcttctccgagctccgattgtatctacatgctgtaactgacacaacacttgtagtagatacttccagaggagaaacgctacgtatcaattttgatgtcacatttcctgcccttccatgttctatactcagtcttgatgccatggacatcagtggagaacaacaccttgatgtgaaacatgacataatcaagaagagattagatactcatggagatgttatagaagaaaggcaagatggaattggttctcctaagattgaaaaaccactacagaaacatggtggcaggctcgagcataatgagacatactgtggctcctgttatggtgcagaaacgtcagatgaagaatgttgtaataactgtgaagatgttcgcgaagcatatcggaagaaaggttgggcactgtcaaaccctgatgtgattgaccagtgcaaaagagaaggttttctacaaaggattaaagatgaagaaggtgaaggatgtaatatatatggattcatagaagttaataaggtggcaggaaattttcattttgcgcctggaaaaagctttcatcaatcaggtgttcatgtacacgatctactagcatttcaaaaggatagttttaatgtaagtcacaagatcactagattatcttttggagactatttccctggtgttgtgaatcctttggacaatgtgaaatggatacaagaaacaccaagtgggatgtatcagtatttcatcaaggttgtacctacagtgtacacagatgtgagtgggcacacaatccagtcaaatcagttctctgtaactgaacattttaggaatgcagaaataggccaccttcagtcccttcctggagtgttcttcttctatgatctttctccaattaaggtgacttataaggaggaacacacctcatttttacacttcctaacaaatgtgtgtgctatcgttggaggagttttcactgtttcaggaatactagattcatttatatatcatggtcaaagggctatcaagaaaaagatcgaacttggtaaatttagttgatgattgattcaatttttgttctgttgtatttggttgctgtgcgagtaaatggctttatggagagaatgatattaagagaaaaggaactatctaatcgactctctccctgtggttgactgggctcttatgatcacaatcaacgactgaggaattctcattatatcgttttgatcacagaaggttgaattcctagctgacagctcctctttcccaagttataatcaaattgtaactgctttgttgatgtgattgtcttttttctaagattaattggagcttacatttcttgctagcaaacttacaaaagtatcttagttaaagacagaaatcaagctttttggaaagataatttatattatattatttgatttctccttgttgagggggggaagggacaaatgacgaactattctttctactttgttaacctttgcctgaccttgatcactcgtattcttaggcattgatataagtcttatcttatgagaaatatggtctgtaacccagacagaattaaaatatattgttgctactcggatttggagtcaaatatatggctgcatctgggactccaattgtaaaattacaactgtcatgatttcagttatgctagttctatcttct

SEQ ID NO: 5179 - DNA, 1574 bp, Populus trichocarpa
aacaaagtaaaaggaagatttactgaattcaattgcattaatctcattccaaacagggaacgtgaattccaaatcaatagatttcagttttactgtcaaaaatgatttcaatttcatcgtggaaatggttccaaacgtggcgttagattttccctttctctttatatctagataaattaaatttgtatagtaaaaaccatggattaggccacgaacaagaaccaggaaaaagaaaaacaagaaaattattgatctgattgttgagaaaatggacgggttgatgagcaagctaaggaattttgatgcatatccaaaaatcaacgaggatttctacagccgtacactttccggtggcgtcatcaccctcgcttcctctattgttatgtttctcctcttcttctccgagctccgattgtatcttcatgcggtaaccgaaacgaaactagtagtggatacttcaagaggagaaactctacgtatcaattttgatgtcactttccctgctcttccgtgttctatacttagcctcgatgcaatggatattagtggagagcaacatcttgatgtaaaacatgatataatcaagaaaagactagattctcacgggaatgtaatagaatcacggcaagatggaatcggtgcccctaagattgaaaaacccttgcagaggcatggtggcaggcttgagcacaatgagacatactgtgatgaagattgttgtaattcttgtgaggaagttcgcgaagcatatcaaaagaaaggttgggcagtgacaaatccggatttaatggaccagtgcaaaagagagggatttctccaaaggattaaagatgaagaaggtgagggatgcaacatttatgggttcttggaagttaataaggtggctggaaattttcattttgcacctgggaagagttttcagcaatctggtgttcatgtacatgatctgctggcatttcagaaggacagttttaatacaagtcacaaaattaataggctggcttttggagaatattttcctggtgttgttaatcctcttgatggtgtgcaatggacacaagaaacaccaagcgggatgtaccagtatttcatcaaggtagtacctactgtatacacagatgtgagtggacacactatccagtcaaatcagttttctgtaactgaacattttaggggggcagacataggtcgccttcagtcccttccaggagttttcttcttttatgacctctctcctattaaggtgactttcacagaggaacacgtttctttcttacacttcctcacaaatgtgtgcgccatagttggaggtgttttcactgtttctggcatactggattcatttatatatcatggtcagaaggcaatcaagaagaagatggaaatcggtaaatttagttgatgacttattgacaggcttgggtcgttgctgtattgccagtaattggcttctcaaatggaattgggttcggacgcctattttgaactggccagttagaatcaaaactaatgtttgtgtcataatttataatgtctgttaaggaattagatttatttcatagttcattggtatt

SEQ ID NO: 5180 - DNA, 1651 bp, Populus trichocarpa
aagggtaatatttaaaaaattcaaaagcttatttgtttattgtttaatatcaaacaaagtaaaaggaagatttactgaattcaattgcattaatctcattccaaacagggaacgtgaattccaaatcaatagatttcagttttactgtcaaaaatgatttcaatttcatcgtggaaatggttccaaacgtggcgttagattttccctttctctttatatctagataaattaaatttgtatagtaaaaaccatggattaggccacgaacaagaaccaggaaaaagaaaaacaagaaaattattgatctgattgttgagaaaatggacgggttgatgagcaagctaaggaattttgatgcatatccaaaaatcaacgaggatttctacagccgtacactttccggtggcgtcatcaccctcgcttcctctattgttatgtttctcctcttcttctccgagctccgattgtatcttcatgcggtaaccgaaacgaaactagtagtggatacttcaagaggagaaactctacgtatcaattttgatgtcactttccctgctcttccgtgttctatacttagcctcgatgcaatggatattagtggagagcaacatcttgatgtaaaacatgatataatcaagaaaagactagattctcacgggaatgtaatagaatcacggcaagatggaatcggtgcccctaagattgaaaaacccttgcagaggcatggtggcaggcttgagcacaatgagacatactgtgatgaagattgttgtaattcttgtgaggaagttcgcgaagcatatcaaaagaaaggttgggcagtgacaaatccggatttaatggaccagtgcaaaagagagggatttctccaaaggattaaagatgaagaaggtgagggatgcaacatttatgggttcttggaagttaataaggtggctggaaattttcattttgcacctgggaagagttttcagcaatctggtgttcatgtacatgatctgctggcatttcagaaggacagttttaatacaagtcacaaaattaataggctggcttttggagaatattttcctggtgttgttaatcctcttgatggtgtgcaatggacacaagaaacaccaagcgggatgtaccagtatttcatcaaggtagtacctactgtatacacagatgtgagtggacacactatccagtcaaatcagttttctgtaactgaacattttaggggggcagacataggtcgccttcagtcccttccaggagttttcttcttttatgacctctctcctattaaggtgactttcacagaggaacacgtttctttcttacacttcctcacaaatgtgtgcgccatagttggaggtgttttcactgtttctggcatactggattcatttatatatcatggtcagaaggcaatcaagaagaagatggaaatcggtaaatttagttgatgacttattgacaggcttgggtcgttgctgtattgccagtaattggcttctcaaatggaattgggttcggacgcctattttgaactggccagttagaatcaaaactaatgtttgtgtcataatttataatgtctgttaaggaattagatttatttcatagttcattggtattcaaaatgggtaatgtctctttgctt

SEQ ID NO: 5181 - DNA, 1905 bp, Arachis hypogaea
cataaaaacctctcagcacctaatgaaaacaagagtcagaggtcataggttcgtagaaattaggggaaaacattgagaaactgattccgattgaagacgccccgaaacaaatccgaaatcggaagaacattgattcaacggggtgtttaactcggaacaaacaatcaccattgttttccttttcacacctatgacctttggatcttagatttttggtacttatttcgaaaaaaaaaaggaaaggaaaagtcgaaattgggatcaacaatggatagcataatgagcaagcttcgtaatcttgacgcttaccctaaaatcaatgaggatttctacagcagaacactttccggcggcgtcattacccttgcttcctccgttctcatgatcttgctcttcatctccgagcttcgattgtatctgcatgcttcaactgagaccaagcttattgtggatacttctagaggtgaaacgctgcgtatcaattttgatattacttttcctgccctaccatgctcgatgctcagtgttgatgcaatggacattagtggagagcaacatctcgatgtaagacatgatataatcaagaaaaggttagatactcaaggcaatgtaataggtacaaggcaagatggaattggttctcccaagattgaaaatcccttgcaaaagcatggaggcaggctagagcacaatgagacttattgtggttcctgctatggggcagaagagtcagatgatgattgttgtaattcctgtgaggatgttcgtgaagcatatcggaaaaaaggttgggcagtctcaaatccagatttaattgatcagtgcaaaagggaaggattcttgcaaagaatcaaggaagaagacggtgaaggatgcaacatatatggcttcttggaagtaaataaggtggcaggtaattttcattttgctccgggcaaaagctttcagcaatctggtgtacatgtacatgatctgctggcttttcaaaaggactcgtttaatttaagtcaccacatcaacagattagcttttggtgattattttcctggtgtagtgaatcctcttgatcgtgcacattggactcagaaaacaccaagtgggatgtatcaatattttattaaggttgtgcctactgtttactctgatgtgagaggacatactatccaaacaaaccagttctctgtgacagaacacttcaagactggggatgtgggccgattccagtcccttcccggagttttcttcttctatgacctttctccaattaaggttacctttacagaagaacctgtctcattcttgcatttccttactaatgtctgtgccatagttggaggtgtttacactgtatctggaatactagattcatttatctatcacggtcaacgggctatcaagaagaagatggaacttggtaaatttaactgataagcacgtcccttaaatgttgtatcaccactttgcagtgcatggttcttcccaagacaatctattgcagagaagatcaactgttgaatagaattcccctcggggttccatgagtactgtcactttcagcaaaaaggattttgcacttggatcatgtcatcggttgaaatgcaatgcttgaacatgacatgtgcggcaaatgccacattgccaatgaattatgtctttcttgaaacagctgtgatgatgtgaataactgaatattgcatattttgtggaaagtattggggtttatacccgggttgttttgagtttggagttccgagggaggggaagggagggaaatagccaaataggggggttggcattcttttatctcattttcccaaaacaatctaattcaatcaaccgtctttggaaaactattaattcagcattgatgatctaaaatgaggaaggcggtgaagcctgttcttt

SEQ ID NO: 5182 - DNA, 1658 bp, Rhizophora mangle
gacttttgttcgcatctgcgacggagcttggagttcaacgtttcctcgttctttcttccttacttctattttcagctcgcagtatcgttgttccattccgcactttatttttaaacgtatatagacgttcatacgtatatatacatattagtataataatacaaattcagagactaggtttctgtgggaaaaaaaataaataaataaggaaggaagaaaaacgaagtagaaatcagtgataatattgaatcgaatggacggaattatgaataggctgagaaatattgacgcgtatccgaaaatcaacgaggatttctacagccggacgctgttcggcggcgtcatcaccctcgtctcctccttcgtcatgctcctcctcttcatctccgagctccgattatacctccatgctgtaactgaaacgaagctcgtggttgatacttcaagaggagaaactttacgtatcaattttgatgtcaccttttctgcccttccatgttctattctcagcctcgatgcaatggacatcagtggagagcaacatcttgatgtgaaacatgatataatcaaaaggagattggattctcatggcaatgtaatagaagcacggcaagatggaattggtgctcctaagattgaaagtcctttgcagagacatggaggccgacttgagcacaatgagacatattgtggttcctgctatggtgctgaagcatcagatgaggattgttgtaattcctgtgaggacgttcgtgaagcatataggaaaaaaggttgggcactgtcaaatccagatttgattgaccagtgcaaaagagaaggttttctacaaagaatcaaggaagaagatggtgaagggtgcaacatttatggcttcttagaagttaataaagtggcaggaaattttcactttgcacctgggaagagttttcaacagtcaaatgttcatgtgcatgatctgctggcatttcaaaaggatagttttaatataactcacaagattaataggctaacatttggagaatatttccctggtgttgtgaatccacttgatggtgtgcaatggacacaagaagcacctaatggcatgtaccagtactttatcaaggtcgtacctactgtatacagtgatgtcaatgggaacaccattcagtcaaatcagttttctgtgactgaacattttagaagttctgaagccggtcactttcagtacgtacctggagttttcttcttttatgacctgtctccaattaaggtgacttttacagaggagcatgtgtcattcttgcactttctaacaaatgtttgtgctatagttggtggtgttttcactgtgtcgggaatgctggattcatttatatatcacggtcaaagggcaatcaagaagaagatcgaacttggtaaatttagttgatattgtattctatcagtatcacaacttgctactctgcggttttgtaagaaaaaggcttgacaaatagagtgaggtttgataactccatttttagctgatcagccttggattggaacataatgctctttcacgattcatgaggtttggcaattcggctgatcaatgattaacatttcttccgtgattcaaaattgtaccctaaacttgaaatgcattaatcctagcttcatgcaactttgttgta

SEQ ID NO: 5183 - DNA, 1767 bp, Amborella trichopoda
aggggagaatgaaaaactagatagaggaaagagcgagaaaatagagagagagagagagagaggtgtggccaaatataatattcgagatctaaagagagaaaggggaggcggcagggtaattatatttagaaagttagagaaagaaagaggggggttggttgcagaaacagagtccaaaaggagaaggaaacaagacgagaagggccgaatatcgagcctatggaatcctaggattgaattggacatgttgaacctcccacccttcttcttctgattcaaaaccctaatttgttgtttcctcaatggacgtcctcaataagcttcggcacctcgatgcttaccctaagatcaacgaagatttctatagtcggaccttatcaggaggcctaatcacgatattctcatccatttttatgctcttgctcttcttctctgagctcagattgtatcttcatgcagctacagaaactaagctgatggtagatacttcaagaggtgaaactcttcgtatcaattttgatgttactttccctgcacttccatgttcgattctcagtctcgatgctatggacatcagtggagagcagcaccttgatgtgaaacatgatataataaagaagaggatcgatgctcatggtaatgtaattgaggctagggcagatggaattggtgcaccgaagattgagaagcctttacagaggcatggtggaaggcttgaacaaaatgaaacatactgtggttcttgttatggtgctgaagggtctgatgatgaatgttgtaactcatgtgaagaggttcgtgaagcatataggaaaaaaggttggggtcttacaaatcccgatttgattgatcagtgtaaaagagagggttttctccaaaggattaaagaggaagatggtgaaggatgcaacatctatgggttcctggaagtgaataaggttgctggaaattttcatttcgctcctgggaaaagcttccaacaatcacatattcatgtgcatgatttattggcatttcagaaagacaattttaatataagccacaaaataaatcgactggcttttggagattattttccgggtgcagtcaatcctcttgatggggttcattgggagcaaaaagcaccatctggaatgtaccagtacttcataaaggtggttcctactgtctacactgacatcaaggggaataccatccagtcaaatcagttttcggttactgagcacttccggaattcagaatttggtcatggtcaaactcttcctggagttttcttcttttatgacctctctccaattaaggtgacttttgtggagacgcacgtttcgttcttgcacttcctgacaaatgtttgtgctatagttggaggtattttcactgtttctggtataattgattcattcatataccatggccaacgagcaatcaagaagaaaatggagattgggaaattcagctgaaattcattttcctggtgtggccccttttctgtatgcaatggaatagctttggcctgaaattggtcgagaaaatctggtaatcgttttttgagagtggagctaagttatcgcatagattcatttaacatactttttatagccaatgttttttttcccggcatgtacaaaccatttaattttcatatattgtatcattattactgtaggtcactttgcctttctgataagagttcgacctaaattattgtgaaagcaaaattaatgattataagaggagccattgtgaaagcaatcttacttattctaa

SEQ ID NO: 5184 - DNA, 1520 bp, Musa acuminata
tctgggatcgacggaatggagggcgtgttcggtaagctacgcaacctggacgcttaccccaagatcaacgaggatttctacagcaggaccctctccggcggcatcatcacaatcgtctcctccatcgtcatgttccttctcttcatctccgaactccgattgtaccttcatgctgttacagaaacaaagcttgtagttgatacgtctagaggggaatcacttcggatcaattttgatgttacttttcctgccctttcatgttctatgctcagtcttgatgccatggatataagtggagaagagcaccttgatgtaagacacgacataattaagaagaggctggattcccatggaaacgttattgaaactagacaagatggaattggttcacctaagattgaaaagcctttacaaagacatggtgggagacttgaacataatgagacatattgtggttcttgctatggtgcagaagcgtctgatgaggattgttgcaactcatgtgaagaagttcgagaagcctatagaaagaaaggttgggggctgtcaaaccctgatttggttgaccagtgcaaacgagaagggttccttgaaaagatcaaaaatgaagagggtgaaggatgcaatgtctatggtttcttggaagtcaaaaaggtgggtggaaattttcattttgcccctggtaaaagcttccagcagtcaaatatgcatgtgcacgacctgcttccattccaaaaagaaagttttaatattagccacaaaattaacaaattagcttttggagaatactttcctggtgttgtcaaccctcttgatggagttcagtgggtgcaacacacaccaaatggaatgtaccaatacttcatcaaggttgtccctactgtttacactgacataaatggccgtactatccagtccaaccagttttcggtgacagagcatttcaagagtgatgacactggtcgactacaatctgtccccggagtgtttttcttctatgatctttccccaattaaggttaccttcatggagggacatgtatctttcttacacttcttgactaatgtttgtgcaattgttggaggtatttttactgtttctggaatattagattcatttatctatcatggtcaaagagcaatcaagaagaagatggagattggcaaattcagttgattatgtttctggtgtaaactccagttctgctgattaaaagtcacaaggggaatttgttgcagagatccaagattgtatacacccacagttccatctacaagtaattgagttgtttgatgggttaagttcaggtacttctttctttaccatccctctgcaccccaagtgttttggtgcacacaatatcacgctgtgcttaaagattctcaactttgtgcgtgaacacaagtctgtgctgatgaaagaccatctgtgggcagttgaaaacagctttcctgataattgtgatggagaactacagatgatgtggagttcataggaatcacaactgattaatttgacta

SEQ ID NO: 5185 - DNA, 1810 bp, Olea europaea
ccggcgagtctttttcttttgtcctcttcctcttccttgataaattcttcttttctacaaattgcattcacagattcactaaatcgctttctggtacattctacatggatatatacgtatcagcatacatataagaatcgtacaactcggtcttcgataactccggtattcaacggggggccttttgttaaactaacatttgtaggagttctatctttcgttctgtttagtgctgctttctatttaataatttgaatagtgctggacgatggagagtttatttggtaaaattcggaatctcgacgcttaccctaagatcaatgaggatttctacagcagaaccctctctggaggtctcataactatcgcttcctccatcttcatgctccttctcttcatatccgagctcagactatatcttcatgctgtgactgagacaaagttagtggtagacacatcaagaggagaaagactccggatcaatttcgatgtgacttttccagcacttccatgctccatactcagtgttgatgccatggatataagtggagagcaacatcttgatgttagacatgacatcatcaagaaaaggatcgatgctcatggtaatgtaatagaaacaaggcaggatggtattggtcatcccaagatcgaaaagcctttacagagacatggaggaaggcttgaccacaatgaaacatattgtggatcatgttacggtgcagaagcgtcagatgatgattgttgtaactcctgtgaagaagtacgcgaagcatatagaaagaaaggctgggcaatgtccaacccagatctgattgaccagtgcaaaagagaaggttttcttcaacagattaaagaggaagaaggtgaaggttgtaatatatatggattcttggacgtcaataaggtagctggcaattttcattttgcacctgggaagagtttccaacagtcgaacgtgcatgttcacgatctgctggcatttcagaaggacagttttaatataagtcacaagatcaacagattagcatttggggactactttcctggcgtaataaatccattggatggtgtgctatgggtacaacaaacaccaaatgctatgtatcagtattttctgaaggtggtacctaccgtattcacagatgttaatgggaataccatccagtcaaatcagttctctgtaactgaacatgttaggggatcagaagtgggtcaccttcaatctcttccaggagttttcttcttttatgacctgtcaccaataaaggtgactttcacagagacgcacgtttcattcttgcacttcctaaccaatgtttgcgccattgttggaggtgttttcactgtttcggggataatagactcgtgtgtttatcatggtcaaaaagcgatcaagaagaagatggagattggcaagtttagctgatgattgatgctcctccaatgttatcgctctttctcgcttcttacccatcagcaacatctttcttggaagggaacagaaaatttggatcggaatgtccttgtagggtagagtggtttatggacatattaatgattttattgcgatgtgtttgttagtgaatcaactaacctctatagttcattttttagcgaagtctttttgaggatttacaaagatatctgtacttgcatactactaatgccaatcctatgaggtgattgtctcttttttcacatttcatggcagaatttttaatttgtagacaagttaccttcaaatttgaattggaaaatttgtctttgaatatcttgccatgtatgtcttgtgactcctttcgttcaa

SEQ ID NO: 5186 - DNA, 1540 bp, Mimulus guttatus
gagagagaaagagagcgtagatgcagccagcctaagaaacagcgctgacctcttctccgatgatgatggaaagtattattgggaaactgcggagcctggatgcgtaccctaaaatcaatgaggatttctatagcagaaccctctccggcggtgttataacccttgcttcctccattgttatgctcctcctcttcatctccgagctcagattatatcttcattcggtaactgagacaaaattagtggttgatacgtcgagaggagaaaggcttcgcattaattttgatgtgacttttccagcacttgcatgttctatggttagtcttgatgccatggatatcagcggagagcaacacttggatgtcagacatgacattatcaagaagaggattgatgctcatggtaatgtcatagaaacaaggcctgatactattgggggtcccaagattgaacgacctttacaaagacatggtggaagactcgaacacaacgaaacctattgtggttcatgttttggtgcagaaacgtcagaagatgaatgttgtaacaattgtgaagaagttcgtgaagcgtatagaaagaaaggttgggcattatcaaatccggatttggtcgatcagtgcaaaagagaaggttttctccaaatgatcaaagatgaagatggggaaggatgtaacatatatggattcttggatgtcaataaggtagctggtaatttccattttgcccctggcaagagtttccaacagtccaatgtgcacgttcatgacctgctagcctttcaaaaggacagttttaatataagtcacacgatcaacagattagcattcggagactacttcccgggtgtagtcaatcctctcgatggtgtggaatggatacaacagacaccaaatgcaatgtatcagtatttcctcaaggttgtgccaactgtattcacagatgtcaatggacatgctatccagtcgaatcagttctctgtaaccgaacatgttaaaggatcagaattgggtcgacttcaaactcttcccggagcattctttttttacgacctttcaccaattaaggtaactttcacagagacgcacgtttcgttcttgcacttcttgacgaatgtctgtgccattgttggaggtgtattcacagtatcgggaatcatcgactcgttcgtatatcatggtcaaaaagcaattaaaaagaaaatggaaataggtaagttcagctgattattgatgcttgtacaatgtcgcatggtgcttttgggatcgaaattcgcttgccagagaaaaccattcccttcaaaaacagaacggtactcgtacaacggtacaggtttttccctgctaagtgttatcgaacaacttcacggtcgcagctacattagttttgtgatatttgttaattgaatagattaataattgtagcaattgtttcatagtttctggttctgtcttattttggcaatagatttttgtgactgtatttatactagttttgatatttaatctcatttaatctgcttcagaagcaactttgataa

SEQ ID NO: 5187 - DNA, 2124 bp, Cicer arietinum
gaccccaaacgtgaacaaatagaaatgctcgcaaaattaaataaataaaagaaaataaataaatacctcgccaacagcttcaaggaaatcgaaggcaacgcgaaacgccccgttacagttcgaaagagcagagcgaataacaaattggattgaacggggtgtttttttgatttccaaaacactagataattgattattgaccattatcatcctataaacaatcatcaagtactttaaattagatctttgatttggatcttcatttttgaatctacaaaaataataatcatcaatttagggattcatttcaaccatggatagcataatgagcaaacttcgaaatctcgacgcgtatcctaaaatcaacgaagatttctatagtcgcacgctttcaggcggtgtcatcactctcgcttcttccattctcatgctcttgcttttcttctccgagcttcggttgtatcttcatgccgcaactgaaactaagcttattgtagatacttctagaggagaaacgctgcgtatcaattttgatgttacatttcctgcactagcgtgttctatacttagtcttgatgccatggacataagcggggaacagcatctagatgtaagacatgatataatcaagaaaagaatagactctcatggcaatgtgatagaaacaaggcaagacggaattggttctcccaagattgaaaagcccttgcaaagacatggaggtaggcttgagcaaaatgagacttattgtggatcctgttatggtgctgagttgtcagatgaggaatgttgtaattcatgtgaagaagttcgggaagcatatcgaaagaaaggttgggcgctctcaaatccggatgtaattgatcagtgcaaaagagaaggattcttacaaagaatcaaggaagaagaaggtgaaggatgcaatgtatatggcttcttggaagtaaataaggttgcaggcaatttccattttgctcctgggaaaagctttcagcaatctggtgtacatgtacacgacctgctggcttttcaaaaggagtcctttaatttaagtcaccacatcaacagattagcctttggagactatttccccggtgttgtgaaccctcttgaccgtgtgcattggacgcaagaaacaccaactgggatgtatcagtattttattaaggttgtgcctactgtgtacactgacgtgagtgggcatactatccagtcaaaccagttctctgtgacagaacacttcaggacaggagatgttggccatttccagtccctccctggagtttttttcttctatgacctttctccgattcaggttacttttacagaagaacatgtctcattcttacattttcttactaatgtgtgcgccatagttggaggtatattcacagtttctggaatactcgattcatttatctatcatggccaaaaggctatcaagaagaaaatggaacttggtaaatttaactgatagttcttctctcagcacgtaccttgctgttgttgtactttccactgaatcgctctgaaaaatctattcaagagaagatcaaccagtgaatgaaattccctgtggggttcccttttgtccttagatgttgtcatcaatgaaggttgaaatgcgtaatcatatcgtgtacaacaaagggcactttgccatgattcaaatattttctgaaacagctctgatgacgtggttcatgtgaaattgtgaatgttacatactttttggaaagtaaagggactttcatttatagccatgtacttgcagaactcctttccagaaccattaaaaggaaatgcaataggaaacttttaatggaaaatgattatctaaagagcgatagttatgcagctgcactttatttgatgttttgatgtgaagaagcttttgttatctttgcgcttgtggttttactcttccaaaaaaattgttgttatttacttcgattctagagtataggagttgcctttaaaacgaacggtacgaagtattctaaattcgtttctagataaaatctgaaagaaaaagaaaagaactttaatgggtcatgacactaaatattaattacattgtgcatattgcgctattttaatagagaaattcttgactgaataatc

SEQ ID NO: 5188 - DNA, 1767 bp, Brassica rapa
tagagaagacggcaaacgcgaacgtgtttacgactaggtaaaccgtaaacgcttctccgtccgacggtgacgaaaccaaaggaaaaaaaaaaacaactcaatccatctctctctctctcttcgaacgcatcgtcggaagaatttcgcctccgaacgtttcgctcgtctgatttatctccgggcacaatcgtcttgttttttttgagccgagtaaggattcgaactgaatctgggaatctcaatccccagaaatggcggggatcctgaataaattgcggaatctggatgcttatccaaagatcaacgaggacttttacagccgtacgttatccggcggcgttatcaccctcgtctcctccgttgttatgttccttctcttcttctccgagctacgattatatcttcatagcgttaccgagacgaagctcgtggtggatacttctagaggagagacgttacgcatcaattttgatatgacttttcctgctctagcatgttccattctaagtgttgatgctatggatattagtggagagctgcatcttgacgtgaaacatgatgtcgttaagagaagactagattctcatggtaacattatagaatcaagacaggacggtataggcgctgctaagattgagaagccactgcagaaacatggtggtaggctggaacataatgagacttactgtggttcttgctatggtgctgaagcggaagagcatgactgctgcaattcatgtgaggatgttcgtgaagcatatagaaaaaaaggctggggtgttacaaatccagatttgattgatcagtgtaaacgagaaggtttcttacaaagagtaaaggatgaagaaggtgaaggatgtaatatctatgggttcttggaggtgaataaagtggcgggaaacttccactttgctcccgggaaaagctttcatcaggggggcgttcacgttcatgatcttcttgcttttcagaaagacagttttaacataagtcacaagatcaatcgactgacttttggggactactttcctggtgtcgtgaaccctcttgacaaagtccagtggagtcaagacacacccaatgctatgtaccaatattttatcaaggttgtaccaacagtatacacagatatcagtggacacacaattcaatcaaatcagttctcagtgaccgaacatgttaagagctcagaagcaggtcaactgcaatccttaccaggagttttcttcttctatgatctctctccaatcaaggtaaccttcacagaggagcatatatcgttcttgcacttcttgactaatgtctgtgccatagttggaggtgttttcacggtgtctgggataatagatgcgtttatatatcatggtcaaaaagcaatcaagaagaagatggaaattggtaaatttagctgatgcttttaatcatgttgtggtttcactttttgttcaaatggggttggtctctcttattcgttttgcgacgttaatctattcatttgaggcttaatgaaagttgaacaatagaatattcaccctaatgaactcaaatcaaatcaacttgtcagccaatttattttgttgataaaatatttgccacgcggagagggtttaaagttttcacttgccggactttctgttgttgtaaatgatagaatgccactaatcattgttgttgtaaatgatagaatgccactaatcattggactgtgtagaatgttctctctactttagtcttctaagaccatctacattggttagtatattcagc

SEQ ID NO: 5189 - DNA, 2000 bp, Citrus sinensis
cgtagttttaggtctgcaaaatcctaaacgccttgttgacgcgcagcgtcagatcgaaaacagaaccgagggagggcggggtgtcttagagccgattagctttggaacgaatttcgtttaatagacggatagacagatagatagatttaggttttaaaatttatttgattaacgaagtaaaaagtattatcagccgatcaattgaatcgcagctgatacctgtgggcttgtgtatggacgctataatgaacaagattaggagtctggacgcgtatcccaaaatcaatgaggatttttacagccgtacattctccggcggcgttatcactctcgtttcttccatcgtcatgctcttgctcttcttctccgaactccgattatatctcaatgctgtgacagaaacgaagcttctggtagatacttctagaggagaaactctacgtatcaattttgatgtcacatttcctgcccttccatgttcaatactaagtgtggatgccatggacattagtggggagcaacaccttgatgtaaaacatgacattttcaagaaaagattggatagtcagggcaatgttattgaatcaaggcaagatgggattggtgctcctaagattgacaagcctttgcaaagacatggtggcaggcttgaacacaatgagacatactgtggttcctgttacggtgcagaatcttcagatgaagattgctgtaataactgtgaggaggttcgtgaagcataccgaaagaaaggttgggctttgtcaaatccagatctgattgaccagtgcaaaagagaaggatttttacaaagaatcaaggaagaagaaggtgaagggtgtaacatatatggattcttggaagtcaataaggtggctgggaatttccactttgctcctgggaaaagctttcatcagtcaggtgttcatgtacacgacatactagcatttcagagggatagttttaatataagtcacaagatcaacaaattggctttcggagaacattttcccggtgttgtgaatcctcttgacggtgtgcgttggactcaagaaaccccaagtggaatgtaccagtactttatcaaggttgtacctacagtatacaccgatgtgagcgggcacactatccagtcaaatcagttctctgtaactgaacattttaggagttcagaacaaggtcgacttcagacccttcctggagtcttcttcttttatgacctttctccgatcaaggtgactttcacagaggaacacgtttcattcctacacttcctaactaacgtatgtgcaattgttggaggtgttttcacagtttcgggaataattgatgcatttatataccatggccaaagggcaatcaagaagaagatagaaattggtaaatttagttgagaattcatctgtttggccaccgtaattgccgtattttggttagtccaccagtgggctggcctgtgagagaaaatcagttgaagaaaatgggaaccatgaaatggactctcccagttggtttgatcggctctttttagtcataacaagtctgtttcattactgaattagactaatttcttagttcattttgaatgtcaaagctgcctctgtgaattttatctgcaactgcattgatgattgtatttgttggaaaaaagatacagaggttcctcattttttgccgctaaacttgctggagcttgttaaggggggttatagtagtatacttgtaattataacccattaagtgtcatgtcctgctgcaagattcaatttcatgtgtattattattttaaaaaaaaatgagtacacattctgcatgtctctccgggtaccaaaataggtctatgtgctttgactatccggcttggtttttgatgaaccattataagtagtacagggaaaataatgcaaagaatcatttgttgtttttctttttttcattattcaaaattgttaaatatgttctagagaagaactcaatattcagaaaagtaaaagaccagc

SEQ ID NO: 5190 - DNA, 1440 bp, Rosa hybrid cultivar
ggccaaaagtttagacgccccgttcgtcaaatttttccactttctcattaataccattctctctctctctctctttcaatttcaacggggtgtttaagtttccttccaatttcaatttccgtttcagaataattttgactcaggtttcagacccatagattttcattaggtttttacagatcgagaagaagaagaagatcccaaaatcgattctttggtagcagagagcacaatactatggagaatatgatgagccgcctccgcaatttggacgcgtaccccaaaatcaacgaagatttctacagccgtaccctctccggtggcgtcatcaccctcgtctcctccatcgttatgctcctgctcttcctctccgagctccagttatatctacatgcagtgacggaaacgaagcttgtggtggatacttcaagaggagaaaccctgcgtatcaatttcgatgtaacctttgctgcgcttccttgttctatactcagtcttgatgccatggacattagtggagagcagcaccttgatgtaaaacatgacattatcaagaaaagaatagactccaatggaaatgttatagaatcaaggccggatggaattggtgcccccaagattgacaagcctttacagagacatggtggcaggcttgagcacaatgagacatactgtggttcttgttatggggcagaagcgaatgatgaggattgttgtaataactgtgaagaggtccgtgaagcttaccgaaagaaaggttgggccatttcaaatccagatttgattgaccagtgcaaaagagaagggtttttgcaaaagattaaagatgaagaaggtgaaggatgcaatatatatgggttcttggaagtcaataaggtggccgggaactttcattttgcacctgggaaaagctttcaacaatcaaatgttcatgtacacgatttgctggcatttcaaaaggatagttttaatataagtcacacaatcaacagattgtcttttggagactatttccctggtgttgtcaatcctcttgatggggtgcactggacacaggacaaccccagtgggatgtatcaatattttatcaaggttgttcctactgtgtacacagatgtcagggggcacactatccagtcaaatcagttctctgtcactgaacattataggggtacagaaataggcaaccttcagtttcttcctggagtgtttttcttctatgacctttccccaataaaggtaacttttacggaggagcatatttctttcttacacttcctgacaaatgtgtgtgccattgttggaggtgtttttaccgtgtctggaatattggattcatttatataccatggtcagaaggcaattaaaaagaagatggaaattggcaaattcagttaaatggttctgttggcgtaagttgctgctgtaattgttgatttg

SEQ ID NO: 5191 - DNA, 1758 bp, Cicer arietinum
cgaaacgccccgttacagttcgaaagagcagagcgaataacaaattggattgaacggggtgtttttttgatttccaaaacactagataattgattattgaccattatcatcctataaacaatcatcaagtactttaaattagatctttgatttggatcttcatttttgaatctacaaaaataataatcatcaatttagggattcatttcaaccatggatagcataatgagcaaacttcgaaatctcgacgcgtatcctaaaatcaacgaagatttctatagtcgcacgctttcaggcggtgtcatcactctcgcttcttccattctcatgctcttgcttttcttctccgagcttcggttgtatcttcatgccgcaactgaaactaagcttattgtagatacttctagaggagaaacgctgcgtatcaattttgatgttacatttcctgcactagcgtgttctatacttagtcttgatgccatggacataagcggggaacagcatctagatgtaagacatgatataatcaagaaaagaatagactctcatggcaatgtgatagaaacaaggcaagacggaattggttctcccaagattgaaaagcccttgcaaagacatggaggtaggcttgagcaaaatgagacttattgtggatcctgttatggtgctgagttgtcagatgaggaatgttgtaattcatgtgaagaagttcgggaagcatatcgaaagaaaggttgggcgctctcaaatccggatgtaattgatcagtgcaaaagagaaggattcttacaaagaatcaaggaagaagaaggtgaaggatgcaatgtatatggcttcttggaagtaaataaggttgcaggcaatttccattttgctcctgggaaaagctttcagcaatctggtgtacatgtacacgacctgctggcttttcaaaaggagtcctttaatttaagtcaccacatcaacagattagcctttggagactatttccccggtgttgtgaaccctcttgaccgtgtgcattggacgcaagaaacaccaactgggatgtatcagtattttattaaggttgtgcctactgtgtacactgacgtgagtgggcatactatccagtcaaaccagttctctgtgacagaacacttcaggacaggagatgttggccatttccagtccctccctggagttttttcttctatgacctttctccgattcaggttacttttacagaagaacatgtctcattcttacattttcttactaatgtgtgcgccatagttggaggtatattcacagtttctggaatactcgattcatttatctatcatggccaaaaggctatcaagaagaaaatggaacttggtaaatttaactgatagttcttctctcagcacgtaccttgctgttgttgtactttccactgaatcgctctgaaaaatctattcaagagaagatcaaccagtgaatgaaattccctgtggggttcccttttgtccttagatgttgtcatcaatgaaggttgaaatgcgtaatcatatcgtgtacaacaaagggcactttgccatgattcaaatattttctgaaacagctctgatgacgtggttcatgtgaaattgtgaatgttacatactttttggaaagtaaagggactttcatttatagccatgtacttgcagaactcctttccagaaccattaaaaggaaatgcaataggaaacttttaatggaaaatgattatctaaagagcgatagttatgcagc

SEQ ID NO: 5192 - DNA, 1852 bp, Zea mays
atcgccgttctgttttcccagttcgctcctcccatggcggcgtcgcccgctctcgtctcgctgactcccgccgtctccaggcatccccacctcctcttctgctccccttgccccccgccgcgccacatccgcctcgcccctccaaccgccacacccgcctcggacggaaacggcctcggccccggccccggccccggtgtcttcctatcgccgcgcgcgctctcgcagctcgacgagctcgcggccttccgctacgagcacgccttcccgcacggcctcctcactgtgcgcgccctctcgcgcggccccgacgacgacgccgtggccgaggcgctcgtccgcctcctcgcctcctccttctccgagaccgtgcgctgggccccggcccagcggtacgcgcagctcctcacgttcgtcatccgcaggtacctccacgaccgccgcgggctcgctccgcacgccgcggtgctcgtggggttctaccgccccgccgacgccgacgccggcgccgacaacgccaacgccgccccggaggacgacgaaggggagggtggggatgaaggggagatggcgtgcaccgcggaggtgtcgtttgacgcggtgggcgcaccaggggccccgcccacgcccactccgccgctcaacttcccctacatctgcaacatgactgtgaagacgccactgagaaggagaggaattggaaagcaacttcttaaggcatgcgaggatctggttttcaagatgaatgccaaaagacgtgtataccttcactgtagaataattgaccaagtcccattcaacatgtacacgaaagctggatacagtattgtccagactgacagtatattggtctggctgagccttcaaaagcgcaagtacttgatgagcaaggaattaccccaagcttctgttgttagtgagacttcaaccaaaaactttgagtgataatatttgacaagctgaatgtgccacgggaccaacagttgttcaagttattgagcgctgatctaagtgccatctgaacagctgaagtgacatcgaagcttgtaatgttatcctctgagcagtatatgcatattgcatccaatgagtttcccacctttatacagatatttcccccctgaataactatcaggaacttcatatgactaagatattgatctcaagcaagtctgcagctaatatttcatcaagtttgtccaggtgtatgtcatgcatttcaacttatgtgacattgatctctctttctgattcttctactagaaatttggtctacaatgccatcagtgtaaaattgtgggatctaaagtgccaagtgaaaactttatctttactgtgactgtaaactttggttggagtttccaccatgggagttaacatcatgctgatgagccactttggcctattgtagcctctagatcacttaaccatatgaatcaggctatgtgaagatctgaggatactaggatatcacctaatggagatgatataactgaatatcaatccaaattgactttcttgtgttcatatccttagtgatgcaaggcaattttcaacatgggaaactttcagttgctgacttcaatgataatcttgtcaaagaacactggtctactctatagagtctatactatgtcaatttgtcactggtgactaagggtacattgctacttgtcattagcatctcacactctcacagagctaaaacacaggttgctcgcaaagcagtgattccatctggttccgtccaattgaatatgcagcgaacgccggccgccagggtcttccctcggaaaatatttaactgctgaggttcaaaccttaccatgtcacaatcatatgagtatatgac

SEQ ID NO: 5193 - DNA, 1212 bp, Panicum virgatum
aaaaatccaaaagaaaaatcgcccctcgagttcccggccttcccattctgctccgcactggcatcggcatccccgatggcggcgtcgcccgccctcctctcgctgactcccgccgtctccgggcacccccacctcctcttctcgcgttgcccctcgccgcgccacctccgcctcgcccctcccgccgcctcccccaccccggggggcagccccggccccggcgtcttcctatcgccgcgcgcgctctcgcagctcgacgagctcgcggccttccgctacgagcacgccttcccgcacggcctcctcaccgtgcgcgccctcacccgcggccccgaagacgacgccgtggccgaggcgctcgtccgcctcctggcctcctcgttctcagagaccgtccggtgggccccggcccagcgctacgcgcagctcctcacgttcgtcatccgcaggtacctccacgagcgccgcgggctcgcgccgcacgccgcggtgctcgtggggttctaccgccccgccgacgcgggcgcggccgacgccacgggggatgacggagacgagggcagcgacgatgggggaggtaaagatgaaggggagatggcgtgcacggcggaggtgtcgttcgacgcggtgggcgcgcccggggccccgcccacgcccaccccgccgctcgacttcccgtacatctgtaacatgactgtgaagacggcattcaggaggagaggaatcgggaaacaacttcttaaggcatgtgaggatttggtcatcaaaatggatgcaaaaagacgtgtatatcttcattgtcgaattatcgatcaagtgccattcaacatgtacaggaaagctggatataacattgtcgagactgacaatattttggtttggctgagccttcaaaagcggaagtatttgatgagcaaggaattacctcaagcttctgttgttgagtcttcaaccaaagacttcgatgataatattttgacacgctaaacgttcaacaggatcaacaggtacacatgaggttgaattttgtgtataaatgtatggttctgttcgttgcatattttcacaacttccattcattaattggctatcaccaaattatttagttaaatatgattgacattgcttgtaactgatgttgattcaataatatggcccatatgctcactaatctcatcagcatgagttcacagtttaagcgtttgtagcata

SEQ ID NO: 5194 - DNA, 1128 bp, Panicum virgatum
gctccgcaccgcactggcatcggtattcccgatggcggcggcgcccgccctcctctcgctaactcccgccgtctccaggcacgcgcacctccacttctcccgttgcccctcgccgcgccacctccgcctcgcccctcccgccgccgcccccaccccggggggcagccccggccccggcgtcttcctgtcgccgcgcgcgctctcgcagctcgacgagctcgcggccttccgctacgagcacgccttcccgcacggcctcctcaccgtgcgcgccctcacccgcggccccgaagacgacgccgtggccgaggcgctcgtccgcctcctggcctcctcgttctccgagaccgtccggtgggccccggcccagcgctacgagcagctcctcacgttcgtcatccgcaggtacctccacgagcgccgcgggctcgcgccgcacgccgcggtgctcgtggggttctaccgccccgccgacgcggtggacgcggccgacgccacggaggatgacggagatgagggcagcgaagatgggggaggtaaagatgaaggggagatggcgtgcacggcggaggtgtcgttcgacgcggtgggcgcgcccggggccccgcccacgcccaccccgccgctcgacttcccgtacatctgtaacatgactgtgaagacggcattgaggaggagaggaatcggaaaacaacttcttaaggcatgtgaggatttggtcatcaaaatggatgcaaaaagacgtgtacatcttcattgtcgaattatcgatcaagtgccattcaacatgtacaggaaagctggatataacattgtcgagactgacaatattttggtttggctgagccttcaaaagcggaagcatttgatgagcaaggaattaccccaagcttctgttgttgagccttcaaccaaagactttgatgataatattttgacacgctaaacgttcaacaggatcaacaggtacacatgaggttgaattttgtgtataaatgtatggttctgatcgtcacatattttcacaactgccattcattaattggctatcacaaaattatttagttaaaatgtgttaacaatgcttgtaaccgatgttgattcaataatatggcccatacgctcact

SEQ ID NO: 5195 - DNA, 1187 bp, Setaria italica
ccgctccgcactggcatccgcgttccccatggcggcgttgcccgccctcgtctcgctgactcccgccgtctcgaggcactcctacctcctcttctcccgctgcccctcgccgcggccgcgccacctccgcctcatccttcccgccgccgccgccccctccccgggcggcagccccggccccggcgtcttcctatccccgcgcgcgctctcgcagctcgacgagctcgcggccttccgctacgagcacgccttcccgcacggcctcctcaccgtgcgcgccctcacccgcgggcctgaagacgacgccgtggccgaggcgctcgtccgcctcctggcctcctcgttctccgagaccgtgcggtgggccccggcccagcggtacgcgcagctcctcacgttcgtcatccgcaggtacctccacgagcgccgcgggctcgcgccgcacgccgcggtgctcgtggggttctaccgccccgccgacgccgcggccgactccacgggggatgacggagatgagggcggcgaggatggggagggtaaagatgaaggggagatggcgtgcaccgcggaggtgtcgttcaacgcggtgggcgcgcccggggccccgcccacgcccaccccgccgctcgacttcccgtacatctgtaacatgactgtgaagacggcattgaggaggagaggactcgggaagcaacttctcaaggcatgtgaggatttggtcatcaaaatggatgcaagacgatgtgtatatcttcattgtagagttatcgatcaagtgccgttcaacatttacaggaaagctggatataacattgtccagactgacagtattttggtttggctgagccttcaaaagcggaagtatttgatgagcaaggaattaccccaagcttctgctgttagtgagtctacaaccaaagacttcgatgataatattttgacatgctaaacattcaacaggatcaacaggcacacaagaggttaaattttgtgtataaatgtatggttctgtttcatcacacattttcgctgttgtatagcttgtgaggaaatcaactgccattcattgattgtctatcacaaaattatttagttgaaaatgagttgacaaatgcttgtaacatatattgattcaataatatagcccataggctcactaattatgtagtttaagcatttataacata

SEQ ID NO: 5196 - DNA, 446 bp, Saccharum officinarum
agcaagctcaagttcaccaaagagcgtgtggggtgctacctgctggagatcctggtcatctgcctcctcatcggcgtcctcttcggcctcggcgtcttcaggcacggctacgacaggatcaaagacctcggccgcaaccacacctgcttcgactgcaacacaacagccaggtaccaactgactgactgagccacaaggcaggcatgccctgcatctgcctgcctgggggatcttggtcagcgccgctcggtgcaggcgtgtgtgtaaagacgtgctagctcctccgtggaggcagcagagcagtagcagacgctgtaaattacttgatcggtctgtaagtttctgctgtagagtgtagtagactacaagttcaaacaattccatggtgactttggcaccaactcttcatttttgtttgtctgcttaatcggatctatatcttggcc

SEQ ID NO: 5197 - DNA, 833 bp, Panicum virgatum
ttcattcgtgcagttggagaaaaagagggagggagggatccatgtgtcgtgggtcagtccatacagcccgccagccccgcgattcgattcttatcacggcgcaaaggcggaaaggcgccgcagcatcactcgctctctctctctctcgcactcgcactcgcacagccctgcccctgggcctggctgtagcttcactagcagagcgataccgtcgccataccgccgaggtgacagggcgacaattgcctggcagccttgcaccgataagaggccgcgcgagaggttttgcatcaaccaccagagagagagatagagggagagggaggccggaaccccggaggcggtcgaccaggcagccaccggccatgtgcaagctcaagttcaccaaggagcgggtggggtgctacctgctggtcatcctagtgatcgtgctcatcatcggcgtcctcttcggcctcggcgtcttccgccacggctacgaccgcatcaaggacctcggccgcaaccacacatgcttcgactgcaacaggtactgactgcccggaggaggcacggcgccttcaggcatggcatgctgcgtcctgtagcaaacctgttggtcggacctagtataccttagcagggcagcaggcagatgctgtaaattagtattacctagctgatcggtgtgtagccaagtttctgctgcttggtgtgtagagcgtagacaacaggttcgtcatgttctttcttattattagggacaattattattattattattattatcttgctgccctcttacagtcgagttcacgatgcttttgcctccaaatctattcggttttgtttct

SEQ ID NO: 5198 - DNA, 512 bp, Zea mays
ttcccgacaccgtcgccataccgacgaaaggacatggcgacagacacttgcctagataagaacccccctgccgaacagtcagtcagacacccacccagagaggcagccatgtgcgagctcaagttcaccaaggagcgggtggggtgctacctgctggtggtcctggtcatcgtcctcctcgtcggcgtcctcttcggcctcggcgtcttcaggcacggctacgacaggttcaaggacctcggccgcaaccacacctgcttcgactgcaacaccacaggtaccaaccgagtctgatcactggccgagaggagccaccaggcctgcctggggatcttggtctgcgccgctcggtgcaggcgcgtgcgtgcctgcgtgcgtgcttagctagctcctccgtggtcgtggaggcagcggagtagtagcagacgctgtgaatattgtaaaaattgcttgatcgctgtgttaagtttctgtgttgcgactacaagttcaaacaattctatgatgatttt

SEQ ID NO: 5199 - DNA, 808 bp, Panicum virgatum
agagcgataccgtcgccataccgccgaggtgacagggcgacaattgcctggcagccttgcaccgataagaggccgcgcgagaggttttgcatcaaccaccagagagagagagagagagagatagatagagggagagggaggccggaaccccggaggcggtcgaccaggcagccaccggccatgtgcaagctcaagttcaccaaggagcgggtggggtgctacctgctggtcatcctagtgatcgtgctcatcattggcgtcctcttcggcctcggcgtcttccgccacggctacgaccgcatcaaggacctcggccgcaaccacacatgcttcgactgcaacaggtactgactgcccggaggaggcacggcgccttcaggcatggcatgctgcgtcgtgtagcaaacctgttggtcggacctagtcactgcgttcggcatgctggagctggagtggtatgagagaaaaacactgttacctggctggtggctggagcgacgtgagagaaaaactgtagcgctggagggctggagaccagtcagtataccttagcagggcagcaggcagatgctgtaaattagtattacctagctgatcggtgtgtagccaagtttctgctgcttggtgtgtagagcgtagacaacaggttcgtcatgttctttcttattattagggacaattattattattatcttgctgccctcttacagtcgagttcatgacgcttttgcctccaaatctattcggttttgtttctctggctggtctaccttggcatctattccgtggaacgaatgttattcggctc

SEQ ID NO: 5200 - DNA, 600 bp, Panicum virgatum
caaccaccagagagagagatagatagagggagagggaggccggaaccccggaggcggtcgaccaggcagccaccggccatgtgcaagctcaagttcaccaaggagcgggtggggtgctacctgctggtcatcctagtgatcgtgctcatcatcggcgtcctcttcggcctcggcgtcttccgccacggctacgaccgcatcaaggacctcggccgcaaccacacatgcttcgactgcaacaggtactgactgcccggaggaggcacggcgccttcaggcatggcatgctgcgtcgtgtagcaaacctgttggtcggacctgtcactgcgttcggcaggctggagctagagtggtatgagagaaaaacaccgttacctggctggtgactggagcgacgtgagagggaaaaactgtagcgttggagggctggagaccagtcagtataccttagcagggcagcgggcagatgctgtaaattagtattacctagctgatcggtgtgtagccaagtttctgctgcttggtgtgtagagcgtagacaacaggttcgtcatgttctttcttattattagggacaattattattattatcttgctgcc

SEQ ID NO: 5201 - DNA, 1646 bp, Saccharum officinarum
ggaatcgtcgaatccattaacgggcggcagtcaccgtgtggcctgccaaaccgtccccccggcccgcctgcgccatccatcccttcgcttccacgcaccaatcttgtcccggcgcccgcctgacaaatccagcaaggccacatccccgaggcagggcagcaggaagagcgagagagcagttgagcactagcagcagcacccgctgacaatggcggcttcttcgggaacgcgctccgtgcgcctgctgctgctctccctgctcgggttctgcgtcgcgctgagccaccaggagtcgtcgtcgtcgacggactcgtgcaccacggccaaggtcgccgtcgccagcctcgtgcccttcgactccacgtccttccactgcaccgccgcctggaagcagcaggacttcgtcctcaggtacaagaacacggggcccagcgagtggagcttcatcctctcggcgccggacaagggctcgtacgtggcggtcggcttttccggcaagggcgccatggtcgggagcagcgccgtcgtcgggtgggcgtccaacggcaggggcaccgtcaagcagtactacctcggcgggaagagccccgaggactgcgccccgaacaagggactcctcaagctcgtcaggaacaggtccgtcgtcgtctcgcgctccggccgcctctacctcgccttccagctcagcaccgactacccgcagccgtacctgatcttcgccgtcgggccggacggcaacctgccgcagtccgactccctgcggctgccgatgcaccagagcatggcctcccgctccttcaactacacctccgggatgtcttacaacaccgccggctccggcggcgacgcggcgttcccgacggagaggaagcacgggctgctgggcatgatggggtggggcgtgctgatgcccatcggcatgatcaccgcgcgctacttccggcagctggacccgtgctggttctacacccacatggccatccaggtgtccggctacgccgtcggcatcgcgggcgtcgtcctcggcttccgcctcaacgaggacgggctcaagaacgtggacgtgcacaaggcgctcggcatcgccatcttggccatggcgtctcttcaggtgctggcgatcctggcgcggccggacaagacgtccaaggtgcggcggttctggaactggtaccaccacaacatcgggcgcgcgacgatcctgctggccatcggcaacatcttcctgggcctctccatcgcgcaggagatcagcgcctacatcgtctcctacggcgtgttcgtcgccgtgtgggtggtcgccgtcgccgccttcgagatgaagcggtgctacgccgacgacgactgatcgagcgtacgtgggacggtaacggcgaaacgtacagtcagttcgttccgagaacagctagctggtcataggacgacgaagtcgatgacgtacattaagcgttcacgaacagtgacgtgacagtgtgacacacatacaccattcttgttccgtagctcgcagctggacagtgcattcgggtttggttggctaaacattgttttttggggcccggtataggatgtgaaaaagggccggactactgtgttctagccttactggacgctctgattcatatatttttggtaccttgggaaca

SEQ ID NO: 5202 - DNA, 1935 bp, Zea mays
gagcatactcctgtattacttactgtgtctgggtaaaaagagcacgagaggacctcgttttctataccaagttgaaggccgtcacgattagaaccggcaattcgttgattgccgccatgtgcgctctccaggtgaacagaacacggagcatcaccaccaaccagagcacacttccacattgtgatacatatatacacacacgcacacgcacagacgcttccgaggacagtagcagtagcaagtagcagcatactctcctacgcgaatcgattaacgggcggcactcacccaccgtgtggcctgccaaactgtcccctaggccccggccccgcccgcgcctggccagtggccatccatcccttcccttcgcttcgacgcaccaatcttgtcccggcgcctgccaaatccagcaaggccacacagcccgaggcaggaagggcagcgcaggaacagggagcgagcagcgcacgggcaatggcggcttcttccgggacgcgctccgtgcgcctgctggtgctgctgctctgccttctcgggttctgcgtcgcgctgagccaccaggagtcggcggcggactcgtgcgccagggccaaggtcgcggtcgccagcctcgtgcccttcgactccacgtccttccgctgcaccgccgcctggaagcagcaggacttcgtcctcaggtacaagaacacggggcccagcgagtggagcttcatcctctcggcgccggacaggggctcgtacgtggcggtcggcttctcgggcaagggcgccatggtggggagcagcgccgtcgtcgggtgggcggccaacggcaggggcaccgtcaagcagtactacctcggcgggaagagccccgaggagtgcgcccccaacaggggcctcctcaagctcgtcaggaacaggaccgccgtcgcctcgcgctccggccgcctctacctcgccttccagctcagcaccgactacccgcagccgtacctgatctacgccgtcgggccggacggcagcctgccgcagtccgactcgctgcggctgccggcgcaccagaacatggcctcccgctccttcaactacacctccgggctgtcgtacaacgtcgccgggtccggcgacgccgcgttcccgccggagaggaagcacgggctgctgggcatgatggggtggggcgtgctgatgcccatcggcatgatcaccgcgcgctacttccggcagctggacccgtgctggttctacacccacatggccatccaggtggctggctacgccgtcggcatcgcgggcatcgtcctcggcttccgcctcagcgaggacgggctcaggaacgtggacgtgcacaaggcgctcggcatcgccatcttggccatggcgtctcttcaggtgatggcgatcctggcgcggccggacaagacgtccaaggtgcggcggttctggaactggtaccaccacaacatcgggcgcgcggcgatcctgctggccatcggcaacatcttcctgggcctctccatcgcgcaggagaccagcgcctacatcgtctcctacggcgtgttcgtcgccgtctgggtgctcgccgtcgccgccttcgagatgaagcgctgctacgccgacgacgactgatgagctagcgacacgtaagagtcacagttcggtcccaacagctgacggcgaagtttggtgtcgttaaactgagcgttccacggccagctgggacgtgacagacacacgagcgccgagcgcgcgcgcgcgcacacacacaccattcttgttgttccgtagctcgcagctggacagtgcattattggttcgaggagggcgtgctttggttggctaattaaaaaaaaaatgtttttttttttaggtataggatgtgaggaaggggacggtctgctgtttctaggctagctggacgctctgattcataaatttgtacattgattggta

SEQ ID NO: 5203 - DNA, 1823 bp, Setaria italica
atgggcatggtgatacttatatatacacgcgcgcgcgcaggggcttccggccccgggagacagtacagtacatacgcgaggcgagccggcgaggggaaatcgagtaacgggcgccgggcggcaccgtctgacctgccaaattgtccgaccccccgggccccggggctctcgccgttttttccctttcctttgaggtcccttggccatcccatcccttcgcttccacgcaccaatcttgtcccggcgcctgccaagtccaggaacaggttacaggtgtggggggagccgggcagagcagcagaagcactagcgggcagcagcgcttgccgactgacgccaatggcggctccttccgcgcgcctgctgctgctctccctgctcgggttctgcgtcgcgctcagccaccaggagtcgtcgtcctcgtcgtcgacggactcgtgcggcgcggcgaagctcgcggtcgccagcctcgtgcccttcgactccacggccttccgctgcgtcgccgcctggaagcagcaggacttcgtcctcaggtacaagaacacggcgccgagcgagtggagcttcgtcctctcggcgccggacaagggctcgtacgtggcggtcggcttctcggggaagggcgccatggtcgggagcagcgccgtcgtcgggtgggcgtccaacggcaagggcaccgtgaagcagtactacctcgacgggaagagccccgacgacgtcgccccgaacaggggcctcctcaagctcgtcaagaacaagtccgtcgtcgtctcccactccggccgcctctacgtcgccttccagctcagcaccgactacccgcagccgtacctgatcttcgccgtcgggccggacggcaacctgccgccgtccagcaccctgcggctgccgatgcaccagaacatggcctcccgcgccttcaactacacctccgggatatcttccaacgccggcggctccggcgacaacgcggcgttcccgccggaggggaagcacgggctgctggccatgatggggtggggcgtgctgatgcccatcggcatgatcaccgcccgctacttccggcagctggacccgtgctggttctacacccacatggccatccaggtgtccggcttcgccatcggcatcgcggccgtcgtcctcggcttccgcctcaacgaggacgggctcaagaacgtggacgtgcacaaggcgctcggcatcgccatcctggccatggcgtcgctccaggtgatggcgattcttgcgcggccggacaagacgtccaaggtgcggcggttctggaactggtaccaccacaacatcgggcgcgcggcgatcctgctggccatcggcaacatcttcctgggcctctccatcgcgcaggagaccaacgcctacatcgtctcctacggcgtcttcgtcgccgtgtgggtggtcgccgtcgccgccttcgagatgaagcgctgctacgccgacgacgactgatcccgtcgcgcgctcgctccaccccggcagcagcggtaccggtacatgacattctgaacaagtggccataggacgaaactgatggacgtacgcaaaaaagaaaactaagcgttcacgaccagtgaagtgaagtgacacacacagacacacacacacctgttcttgttccttagctcacaactggacagtgcattcggaaggcgtgcttggtcggctaaaatttgtgggtttttttttgggggggggggggtggggggggggggggggttttggatgtgaagcagggggggcggactgcctgtttctagcctagctggacgctctgattcatatttgtacattggtacatg

SEQ ID NO: 5204 - DNA, 1747 bp, Pennisetum glaucum
gcgaaggcaaaccggggagagtaacggccggcgccgagcggcatcgtctgacctgccaaactgtccgaccaccccccgggcccgggggggctctcggctcgccgtttttttcccttccctttgagaggtccggtccctgcttggccatcccatcccttcgcttccacgcaccaatcttgtcccggcgcctgccaattcgaggaacgggtgcgggggaagccgggcactggcactggcacgggcaccggcacagcagcagagaagcactagcagggcaggcagcagcgctcgtcgccgactgacgccaatggcggctccttccgccgcgcgcctggtgctgctcaccctgctcgggttctgcgtcgcgctcagccaccaggaggactcgtgcggcgcggcgaagctcgcggtcgccagcctcgtgcccttcgacaccacggccttccgctgcgccgccgcctggaagcagcaggacttcatcctcaggtacaagaacacggcgccgagcgagtggagcttcgtcctctctgcgccggagaagggctcgtacgtggcggtggggttctcgggaaagggcgccatggtcgggagcagcgccgtcgtcgggtgggcttccaacggcaagggcacggtgaagcagtactacctcgacgggaagagccccgacgacgtcgcccccaacaggggcctcctcaagctcgtcaagaacaagtccgtcgtcgtctcccactccggccgcctctacgtcgccttccagatcagcaccgactacccgcagccgtacctcatcttcgccgtcggcccggacggcaacctgccgccgtccagcaccctgcggctgcagatgcaccagagcatggcctcccgcgccttcaactacacctccgggatgttgtactccaacaacgccggcggcggctccggcgacaacgcggcgttcccggcggagaggaagcacgggctgctgggcatgatggggtggggcgtgctgatgcccatcggcatgatcaccgcgcgctacttccggcagctggacccgtgctggttctacacccacatggccatccaggtgtccggcttcgccatcggcatagcgggcgtcgtcctcggcttccgcctcaaccaggacgggctcaagaacgtggacgtgcacaaggcgctcggcatcgccatcctcgccatggcgtcgctccaggtgatggcgatcctggcgcggccggacaagacgtccaaggtgcggcggttctggaactggtaccaccacaacatcgggcgtgcggcgatcctgctggccatcggcaacatcttcctgggcctctccatcgcgcaggagaccaacgcctacatcgtctcctacggcgtcttcgtcgccgtctgggtggtcgccgtcgccgccttcgaggtcaagcgctgctacgccgacgacgacgactgatttacccccggccgtcgcgcggcgagctcgctcgatccaccccagctgctggtagccgcgcggtaaatgacattttctgaacaagtggccataggacgaaatactgatggacctacggctacggggaacaaaaactaagcgttcacgaccagtgtaaaagtgacacacacacatacacacacctggacagtggattattcgggatttaggcgtgcttggtcggctaaaatttgtgggtttcattttttggggggtataggaaggaggatgtgaagcagagggggcggactgctgtttatttctaggctagct

SEQ ID NO: 5205 - DNA, 1655 bp, Panicum virgatum
atcccttcgcttccacgcaccaatcttgtcccggcgcctgccgagtccaggaacagtcgggcgagcagcagagcggagccactagctagcggccagcaagctagcgcacgccaatggcggcttcttccggagcgtcgtcgccctccgcacgcctcctgctgctgctctccctgctcggcttctgcgtcgcgctgagcagccaggagtcgtcgtcgtcgtcgtcgacggactcgtgcggcgcggcgaagctcgcggtcgccagcctcgtgcccttcgacaccgcgggattccggtgcgccgccaactggaagcagcaggacttcgtcctcaggtacaagaacacggggccgagcgagtggagcttcgtcctgtcggcgccggacaagggctcgtacgtggcggtcggcttctcggggaagggcgccatggtcgggagcagcgccgtcgccgggtgggcgtccgacggcaggggcaccgtcaagcagtactacctcgccgggaagagccccgacgaggtcgcccccaacaggggcctcctcaagctcgtcagggacaagtccgccgtcgtctcccactcgggccgcctctacctcgccttccagctcagcaccgactacccgcagccgtacctgatctacgccgtcggcccggacggcaacctgccaccgtccagcaccctgcagctgccgatgcaccagagcatggcctcacgcgccttcaactacacctcccgggatgtcctccggcggcggctccagcgacgggacgttcccgccggagcggaggcacgggctgctgggcatgatggggtggggcgtgctgatgcccatcggcatgatcaccgcgcgctacttccggcaactggacccgtgctggttctacacccacctggccatccaggtgtccggctacgccatcggcatcgcggccgtcgtcctcggcttccgcctcagcgaggacgggctcaagaacgtggacgtgcacaaggcgctcggcgtcgccatcctcgccatggcgtcgctccaggtgctggcgatcctggcgcggccggacaagacgtccaaggtgcggcggttctggaactggtaccaccacaacatcgggcgcgcggcgatcctggtggccgtcggcaacgtcttcctgggcctctccatcgcgcaggagaccaacgcctacattgtctcctacggcgtcttcgtcgccgtctgggtggtcgccgtcgccgccttcgaggtcaagcgctgctacgccgacgacgactgatccgccggccggctcgaccacctggcaggcaggcaggcaggcaggcaggcagcgataccgtacggcagagtcgttctggacaaactggccatgggacgaaactgacggacggacgcaggatgaagcgttcacgaccagtgacgtgacacgcatacacacacctgttcttgttccttagctcacaactggacagtgcatttgggaaagttcttggttggctaaaatttgaattttttttttgttttgggtataggatttgaagcaagggccggactgctgctgtagcctagctggccggacgctctgattcatatttgtacattggtacatggtcgtgtttgtgctgtacttgtatccttttggacgatagtttttgttgttcgccccttctt

SEQ ID NO: 5206 - DNA, 1605 bp, Setaria italica
gggttggactagtgctcaattggcatctgatccgttgtaggagtacactttttactcgtatacgcactacaaggctagtcccggctccggtagactggtacagtggctggacaggaacgctacagcctacaggctttgccgagcccacgcagtcccagcgagatccgaatattccgcggtgcgcgacgccgttaaatgggcgcctccccagcctgcggggatggaactatcccgaaaccaacgggccgcgaagcgaaacggatctatgagtgagcagctgaagcgcgactacgaaatcggcgaggagatcggccgcggccgcttcggcgtggtccaccgctgcgtctcccgcgccacgggcgagccctttgccgtcaagtccgtcgaccgctccgccctcgccgacgacctggaccgcgcgctggcggagctggagcccaagctggcgcagctggccggcgccgggggcgccaacccgggcgtcgtgcaggtgcgcgccgtgtacgaggacgacgcctggacgcacaccgtcatggacctctgcacggggcccgacctgctcgactgggtccgcctccgccgcggcgcgcccgtgccggagcccgacgctgcgcgcgtcgtcgcccagctcgccgaggcgctcgcggggtgccaccgcgccggggtggtccaccgcgacgtcaagcccgacaacgtcctcctcgacctggacgacgaccccgccggggagggtgcgcccccgcgggtgcggctcgcggacttcgggtccgccgcgtggctcggcggcggcggcggcgagggcgcgcggcgcgggagcgtcgaggggctcgtgggcaccccgcactacgtggcgcccgaggtggtggccggcggcgagtacggcgagaaggtggacgtgtggagcgccggggtggtggcgtacgtgctgctctccggcggcgcgctcccgttcggcggcgagacgcccgcggaggtgttcgcggccgtgctgaggggcagcctcagattcccgcccgcgctcttcgcgggggtctcgccggcggccaaggacctgatgcgccggatgatgtgccgcgacgcctccagaaggttctccgccgagcaggtcctcaggcacccgtggatccagagcggaggtggcgcccgagaggtggtgcagccgacctgaatccatgccgaagccgacctgatggatcgtgtgttcatcgacctggaatttttagtatcctacgagttttgtccatatcagtcgacgtctttgtatatccagtacgcgacctgcgtcgaggagtggtgcggagaccgccgcttcgctgcgcgtccgggagtgacggtgatggcttcacctggcccgtttttctctttcgcttttgggccttttttcggccgccctatctgcttgagagagcaagcaccttgcagtagttttaagaacgtgaggcgatgatgtgtgttcgtatgtgtaacagcgcatgtaaaaatgaataagaagtgctagtggatttgagcttcctcaatggtttgacctccgtcggttgcggacttatggttcagtagtggcagttttgaaacgccaaagtagaggtgtttctcgtgatacatttt

SEQ ID NO: 5207 - DNA, 1242 bp, Zea mays
atcacgaaacggaacgccaaaccaaatccatgactgaacaactgaaccgggagtacgacatcggcgacgagatcggccgcgggcgtttcggcgtggtccggcgctgtgtctcccgcgccacgggtgacgccttcgccgtgaagtccgtggaccggtccctcctcggcgacgacctggaccgcgcgctggcggagctggagccgaagctggcgcggctcgcggggggcgagggcgacgggaacccgggcgtcttgcaggtgcgcgccgtctacgaggacgacgcctggacgcacacggtcatggacctctgcacggggcccgacctgctggactggatccgcctccggcgcggcgcgcccgtgcccgagcccgacgccgcgcgcgtcgtcgcgcagctggccgaggcgctcgcgggctgccaccgccgcggcgtcgtccaccgcgacgtcaagcccgacaacgtgctcctggacgtggaccccgccggcgaggcgcccccgcgggtccggctcgcggacttcggctccgccgcgtggctcggcgagggcgcgcggggccgcgccgaggggctcgtgggcaccccgcactacgtcgcgcccgaggtggtggccggcggcgagtacggcgagaaggtggacgtctggagcgccggggtggtgatgtacgcgctgctctccggcggcgcgctgcccttcggcggcgagacggccgcggacgtgttcgcggccgtgctacgcggcagcctcaggttcccgcccgctctgttcgccggggtctcgccggcggcgaaggatctgatgcggcggatgatgtgccgcgacgtctcgcgaaggttctccgccgagcaagtcctcaggcacccgtggatccagagcggaggcggaggccgagagctggtgcggccaacctgagcagccatatatcgaacgagacctgaaccgatcgagtatcatcgtagcagtccggtgggtgtgtactcccccgatgagtgttgtgcagacgtctctgtatatccagtaagcaggcggcggcggcggcggcgagtgtgagactggagatcgtcgtttcgccgcacctcgcccgtgtgtgtgtgtgtgtgatggtgacctgggccgttttcctcttttgccttgtgggccttttttcgggccgccctctttgcttgggagttaaacgtcgtgcgacgatgatctgttatgtccaaccgtccatgtacaaatgaagtttgagctttctcgatga

SEQ ID NO: 5208 - DNA, 1295 bp, Panicum virgatum
cggccccggacggacaggaggagcgctggagcccacgcagtccccgcgagatccgaatattctgcggcgcgcggcgccgttaaataggcgcctccccgggctgccgggatggaactatcccgaaaccaacggaccgcgacgacgaggaaacggatctatgagtgagcagctgaggcgcgagtacgagatcggcgaggagatcggccgcggccgcttcggcgtggtccgccgctgcgcctcccgcgccacgggcgagcccttcgccgtcaagtccgtggaccgctccgcgctcgccgacgacctcgaccgcgcgctggcggggctggagcccaagctggcgcgtctggcgggcgccgggggcgccaacccgggcgtcgtgcaggtgcgcgccgtgttcgaggacgaggcctggacgcacaccgtcatggacctctgcacggggccggacctgctggactgggtccgcctccgccgcggcgcgcccgtgccggagcccgccgcggcccgcgtcgtggcgcagctcgccgaggcgctcgcgggatgccaccgcgccggggtggtccaccgcgacgtcaagctcgacaacgtcctcctcgacctggacgacgacgaccccgccggcgaggaggacgcggcgccgcgggtgcggctcgcggacttcggctccgcctcgtggctcggcgccggcgccggcgggcggggcgccgccgaggggctcgtgggcaccccgcactacgtggcgcccgaggtggtggcgggcggcgaatacggcgagaaggtggacgtgtggagcgccggggtggtggcgtacgcgctgctgtccggcggcgcgctgccgttcggcggcgagacccccgcggaggtgttcgcggccgtgctgaggggcggcctcaggttcccgcccgcgctgttcgccggggtgtcgccggcggccaaggacctgatgcggcgcatgatgtgccgcgacgtctccagaaggctctccgccgagcaggtcctccggcacccgtggatccagagcggagggggcgcccaggaggcggtgcagccgacctgaatccaggcagaagccgagaccaatcggcgagtgttctccggagcccgacgagtttttgtccatatcgatcgacgtctctgtatatccaggtacgcgaccgcggcgaggagcggtgcggaggagagcgtcgcttcgctgcgcgcctgcgcctgcgcctgcgatccccgcaggggaggggagtgacagtggtggctttcgcctgggccgtgttttctctttgcttttgggtctttttttc

SEQ ID NO: 5209 - DNA, 1681 bp, Panicum virgatum
agtttctgagaattttccatctttgccaaacaatgtactactgggagtattttaatgtacacataaaaaacatggctgcgctagttgtagtgctcaactggcatccgatccgttttgctcgtactcacttaacacaagcccagctgagcggccggaccggacggacaggagcgctggagcccacgcagtccccgcgagatccgaatattctgcggcgcgcggcgccgttaaataggcgcctccccgggctgccgggatggaactatcccgaaaccaacggaccccgacgacgaggaaacggatctatgagtgagcagctggggcgcgagtacgagatcggcgaggagatcgggcgcggccgcttcggcgtggtccgccgctgcgcctcccgcgccacgggagagcccttcgccgtcaagtccgtcgaccgctccgcgctcgccgacgacctcgaccgcgcgctggcggggctggagcccaagctggcgcggctggcggccgccgggggcgccaacccgggcgtcgtgcaggtgcgcgccgtgtttgaggacgaggcctggacgcacaccgtcatggacctctgcgcggggcccgacctgctggactgggtccgcctccggcgcggcgcgcccgtgccggagcccgccgcggcccgcgtcgtggcgcagctcgccgaggcgctcgcggggtgccaccgcgccggggtggtccaccgcgacgtcaagcccgacaacgtcctcctcgacctggacgaggacggccccgccggcgagggtgcggcgccgcgggtgcggctcgcggacttcggctccgccgcgtggctcggcgccggcgggcggggcgccgccgaggggctcgtgggcacccctcactacgtggcgcccgaggtggtggcgggcggcgagtacggcgagaaggtggacgtgtggagcgccggggtggtggcgtacgcgctgctgtccggcggcgcgctgccgttcggcggcgagacccccgcggaggtgttcgcggccgtgctgaggggcggcctccggtttccgcccgcgctgttcgccggggtgtcgccggcggccaaggacctgatgcggcgcatgatgtgccgcgacgtctccagaaggctctccgccgagcaggtcctccggcacccgtggatccagagcggagggggcgcccaggaggcggtgcagccgacctgaatccacgccgatgccgagacgaaacggcggcgagtgttcgccggtggcagacgagtttttgtccatatcgatcgacatctctgtatatccaggtacgcgaccgcggcgaggagcggtgcggcggagaagagcgtcctcgctgcgatcccccgggagtgggggaagtgacggcggtggctttcacctgggccgtgtttttctctttttcttttgggcctttttttttcggccgccctctttgctttgtttgggaaagagagagagagggcaccaagcagttttaataaatttgttgtgatgtgatgcgatgatgtatgtagttacggatgcctaaccgctcatgtacaaatgaataacaagggcttgcagctgctagtagatttgtctataactttatccgtgccggctttgaaatgaaaattttgagggggttcggatgatgcatcccgtggatatgtgtagccggccgccttatttgtgtctgc

SEQ ID NO: 5210 - DNA, 1100 bp, Triticum aestivum
ccacgcgtccggagaaaagcactgcgagagggtaaaaaaaaacacagatctgcccatgagtgaggaactcgagcgggactacgagatcggggaggagatcgggcgcggccgcttcggcgtcgtccgccgctgcgcgtcccgctccaccggcgacctctacgccgtcaagtcggtcgaccgctcgctcctcgccgacgacctcgaccgcggcctggccgagctggagcccaagctggcgcagctggccgccgcgggcaaccccggggtcgtgcaggtgcacgcggtgtacgaggacgacgcgtggacgcacgtggtcatggacctctgcgccgggcccgacctgctcgactgggtccgcctccgccacggcgcgcccgtcccggagcccgaggccgccgccgtggccgcgcagctcgccgaggccctcgcgatctgccaccgccgcggcgtcgcgcaccgcgacgtcaagccggacaatgtgctcctcgacgcccccgacggcgggggtgagggccccgtgcgcgcccggctcgccgacttcgggtcggcggcgctggtcggcggcggggagggcgcgcgggggctggtgggcacgccgcactacgtggcgcccgaggtggtggcgggcggcgagtacggggagaaggccgacgtgtggagcgccggggtggtcctgtacgtgctcctcaccggcggcgcgctgcccttcagcggcgagacggcgtcggacgtgttcgccgccgtgctgcgcgggagcccccggttcccgccgaggctgttcgccggggtgtcgccgctggccaaggacctgatgcggcgcatgatgtgccgcgacgtctcccgaaggttctccgcggagcaagtcctccggcacccgtggatcgtgagcggagggggcgcccgagaggcggtgcagccaacctgaggagcccgtagcaggcccacgtacgtcgactcttcccgtggagacaacgtgtccagcgtctttgtatatacgacgagagtgtgcgaagtagcagtagtagagagcttggggtaccattgtacgtataaatccagagtgccgaggagccagccagggtttggctctaggagctatc

SEQ ID NO: 5211 - DNA, 1437 bp, Oryza sativa
gaatattccgctggagcgtcgttaaatagaccaccaatcggtgggatggagtttacccccaaaatcacaggaaaaactactagcatgagtggagagctgaagagagactacgagattggcgaggagatcgggcgcggccgcttcggcgtggtccaccgctgcacgtcgcgcgccaccggcgaggccttcgccgtcaagtccgtcgaccgctcgcagctggccgacgacctcgaccgggagctcgcggagctcgagcccaagctggcccagctggccgccgcgggcaacccgggcgtcgtccaggtgcacgccgtgtacgaggacgacgcgtggacgcacatggtcatggacctctgctccggccccgacctgctcgactggatccgcctccgccgcggcgcgcccgtcccggagcccgtcgccgccgccgtcgtcgcgcagctcgcggaggcgctcgcgcactgccaccgccgcggggtcgcccaccgcgacgtcaagcccgacaacatcctcctcgacgtcgtcgacgacgggatcgacggcggcggcacgccgcgcgcgcggctcgcggacttcgggtcggccgcgtgggtcggggagagcggcggcagcgccgagggcctcgtggggacgccccactacgtggcgcccgaggtcgtcgccggcggggagtacggcgagaaggccgacgtgtggagcgccggggtggtcctctacgtgctcctctccggcggcgccctccccttcggcggcgagaccgccgccgaggtgctcgcctccgtcctccgtggcagcgtcaggttcccgcctaggctgttcgccggcgtgtccccggcggccaaggacctcatgaggcgcatgatgtgccgcgacacctggaggcgcttctccgccgagcaagtcctcggtcacccgtggatcgtgagcggcggaggagcccgagcgatggagcagccaacctgaacggcggccgcgtccacgtcaagagggggcagacagaggcagcgaatcagtcggtgccacgtgtcgccgtagtcctagggagatacggcgatattttacagccgtagtctatacggttttgtatatacgacgagacggtagagagagatccctgcagcggatccgctgtagggtgtcgcggtattgcagatctgcagtagagagaataatcagagtattgattgaagaagaagctcgtgcagtcatgctaggcttcttttttctttcacggttccaggtttgctctgtctctagagagatcagagagccttaattttcgctttgtttttttttgtatgatgatgagtcaggttgtatatacgctaacgtaagtactaagcttttgtacaaatcgatcggagttgaataaaaatcgggcttgtgctctgcttcggcttccgtttttttcttctcaatcattttcgtccggttggc

SEQ ID NO: 5212 - DNA, 1253 bp, Oryza sativa
ctcagatcaaactgtttttccgaaaagatcgcgaggcaaaagaccaaccgcctgtgctatgagtgaggaactgaagcgcgacttcgagatcggcgaggagattgggcgcggccgcttcggcgtcgtccaccgctgcgcctcccgctccaccggcgaggcctacgccgtcaagtcggtcgaccgctcccgcctctccgacgacctggaccgctcgctcgccgcgctcgagcccaagctggcccggctcgccgccgcgggcaacccgggcgtcgtgcaggtgcacgccgtctacgaggacgacgactggacgcacacggtcatggacctctgcacgaggcccgacatcctcgactgggtccgcctccgctgcggcaagcccgtgccggagcccgacgccaccgccgtcgtcgcgcagatcgccgaggccctcgcgctctgccaccgccgcggcgtcgcgcaccgcgacgtcaagcccgacaacgtcctcctcgacgccaccggggacgggccgccacgggtgcgcctcgccgacttcggctccgccgcgtgggtcggcgacgggatcagcgccgaaggggctcgtggggacagccgcactacgtcgcgcccgaggtggtcgccgggggcgagtacggggagaaggccgacgtgtggagcgcgggggtggtcatgtacgtgctcctcaccggcggcgcgctcccgttcggcggcgagacggcctccgacgtgttcgccgccgtcctgcggggcaacctgaggttcccgccgaggctgttctccggcgtgtcgccggctgccaaggacctgatgcggcggatgatgtgccgcgacgtctacaggaggttctccgccgagcaagtcctgaggcacccgtggatcgtgagcggaggaggagcacgcgatgtgcagccgacctgaagaatccgtatcagatttccaaataatacggcttcttgtgtatacgcctttgtaaatgcgagtacgcctacgagagaggaagatgcattggtagaagaagtagagagtggagagtagtaacactgtatacatccaaccaggagtggtgaggaggaggaggtcgctagcctctgtgtttttttcgctctttcttaagccctttttagttgccgctttttgcctgagagaagaacgcttgcttgtgtaatgggagtgctgctgtgaatactaaccctgcttgtataattaagatcgttaataaaaatgagagtggtctctccaatcttttgatgggt

SEQ ID NO: 5213 - DNA, 1393 bp, Triticum aestivum
atggtccggtcgagcaggatccgcatattcggcggcagcccgaagttggggcgccccgttaaataggcggccaccggttcgcgaaccaactatcctccgagaaaagcactgcgagagggtaaaaaaaaacagatctgcccatgagtgaggaactcgagcgggactacgagatcggggaggagatcgggcgcggccgcttcggcgtcgtccgccgctgcgcgtcccgctccaccggcgacctctacgccgtcaagtcggtcgaccgctcgcgcctcgacgacgacctggaccgcggcctggccgagctggagcccaagctggcgcagctggccgccgcgggcaacccgggcgtcgtgcaggtgcacgcggtgtacgaggacgaggcgtggacgcacgtggtgatggacctctgcgccgggcccgacctgctcgactgggtccgcctccgccacggcgcgcccgtcccggagcccgaggccgccgccgtggccgcgcagctcgccgaggccctcgcgatctgccaccgccgcggcgtcgcgcaccgcgacgtcaagccggacaatgtgctcctcgacgcccccgacggcgggggtgagggccccgtgcgcgcccggctcgccgacttcgggtcggcggcgctggtcggcggcggagagggcgcgcgggggctggtgggcacgccgcactacgtggcgcccgaggtggtgacgggcggcgagtacggggagaaggccgacgtgtggagcgccggggtggtcctgtacgtgctcctcaccggcggcgcgctgcccttcagcggcgagacggcgtcggacgtgttcgcggcggtgctgcgcgggagccccaggttcccgccgaggctgttcgccggggtgtcgccgctggccaaggacctgatgcggcgcatgatgtgccgcgacgtctcccgaaggttctccgcggagcaagtcctccggcacccgtggatcgtgagcggagggggcgcccgagaggcggtgcagccaacctgaggagccgtagcaggcccacgtacgtcgactcttcccgtggagacaacgtgtctagcgtctttgtatatgcgacgagagtgtgcgaagtagtagcaacagagtttgtataaatccagagtgccgaggagccagccagggtttggctctaggagctatcttttttcttctcctttttttctttctgggctttttttgctgccttggttagagaacgcctgcctgttcggtttctgcgtgtgacgggatatgctgctgctcatgtacaaactaacctgcttgcttgtataaaatctactataaataagtgtgatctttgttctgtttttccgttatgtgatcagtatacttggttcatcatctaatccacttccgcatgggcacaa

SEQ ID NO: 5214 - DNA, 1985 bp, Zea mays
agcgtgatggcgtctccaatcttaatccatccgatccttgccctgtcctgtgctctcaaatcttcaatccattcggaaaggttcatccaccttcaggcagagcacagtcctcactcctcagtctacactccacactccacactccacacgcaagcacgcacggcgggcggcggtcgcccacctggacctggtaccggaacaccagagctcaaggtcggccatggattcgccactgctgagcacacccgctctgctggcgctgtccctgctccttctagcgctctacatcgctcgccggcgccgcggcggtggcaagaaccggaactaccctcccgtggcgggcaccgtgttccaccagctgctccacttcaggcggctgatggagtaccagacggagctcgcccacaggtaccgcacgttccgcatgctcaccccgacctgcaactacgtgtacaccgtggagcccgccaacgtggagtacatcctcaagaccaacttcggcaactacggcaagggggcgatgatccacgacgtgatggaggacctcctcggcgacggcatcttcaacgtggacggcgccaggtggcggcaccagcggaaggtggcgagccacgagttctccacgcgggtgctgcgcgactacagcagcggcgtgttccgcgacacggccgcggagctcgctgggatcgttgcggtggcggcgcggggcgccgggcccggggagaggccgctggacgtcgcggacctcctgatgcggtcgacgctggactccatgttcaaggtcgggttcggggtcgacctgggctcgctgtccggctgcggcgacgacgagggcgcggcggcgttcgccagggcgttcgacgacgccagcgagcaggtcctgtaccgcttcttcgacccgtcctggaaggtcaagaggctcctcggtgtctcgtcggagggggccatgaaggggtcgatccgcaccatcgatcaattcgtgtacggcgtcatcgacaggaagatcaagcagatgggcagggaccaagaattcgccaagaaagaggacatcttgtcaaggttcctgatggagcgggagagcgaccccggctgcttcgacaacaagtacctgcgggacatcatcctcaacttcgtgatcgccggccgcgacaccacggcgggcaccctgtcgtggttcctctacgtgctctgcaggaaccagcacgtccaggacagggtcgcgcgggaggtgcgtgccgccgccacgggcgaccgcgacgacgtcggcgtgcaggagttcgtcacgtgcttaaccgaggacgccatcagcaggatgcggtacctgcacgcggtgcttaccgagacgctccggctgtacccggctgtgcccatcgatgtgaagtattgcttttcggatgacacgttaccggacggctacgctgtcaagaaaggtgacatggtgaactaccagccgtaccaaatgggcaggatgaagttcctgtggggcgcggacgccgaggagttcaggccagagaggtggatcaacgacgacggcgtgttcgtcaacgagagccccttcaagttcacggctttccaggcggggcctcgcgtctgcttgggaaaggagttcgcgtacaggcagatgaagatcttcgcagcggtgctggtctacgccttcaggtttgagatgtgggaagccaatgctaccatgggctaccggcccatgctcacgctcaaaatggacggcccgctgtatgttcgggcatcgctccggcaatgaggtgtgggcgactgggcggcggccacgaagtcaaaatacgttgcgtactgttatgatactatcttagatattaaacttgttaaaataaatattttattttatcttagctaaaagactgaaaataatacgagttgaagagaaactcaacctttttgttatagctcgctcgatctctcgtcatctttcaactagcgaaatggtattatatgaaagtgttgtactatgt

SEQ ID NO: 5215 - DNA, 1926 bp, Setaria italica
gcccccccttacttcaaatcctggctccgcccctgggccagaccacacgcaaaagcacgcacggctgccacccaccttgggccgagacaacatctgtgctcaccggcgtcaccgccgggcatggactcgccactgagccaacctgcgctgctcgcgctatccttgctcttcctcctcgcgctccacctcgcgcgtcggcgccgcggcagaggcaggaaccggaactacccgccggtggccggcaccgtgctgcaccagctgctcaacttcgggcgcctggtggagtaccaaaccgagctcgcccgccggtaccgcaccttccgcatgctcaccccgacctgcaactacgtctacaccgtcgagcccgccaacgtggagtacatgctcaagaccaacttcgccaactacggcaagggggcgacgatgcacgacgttctggaggacctcctcggcgatggcatcttcaacgtggacggcgccaggtggcggcaccagcggaaggtcgccagccacgagttctccacccgggtgctgcgcgactacagcagcggcgtgttccgcgacaccgccgcggagctcgcgggtatcgtggccgccgccgcgcggggcgacggggggatcagggtggacatcgcggacctgctgatgcggtcgacgctggactccatcttcaagatcgggttcggcgtcggcctgggctccctgtccgggtgcagcaaggagggcgcggcgttcgccagggcgttcgacgacgccagcgagcaggtgctgtaccgcttcttcgacgtgttctggaaggccaagaggctcctcaacgtctcctcggaggcggccatgaagcactcggtccgcaccatcaacgacttcgtgtacgccgtgatcgacaggaagatcgagcagatgggcagaaaccatcaggaattcgccaagaaagaggacatcctgtcgaggttcctgctcgagcgcgagcgagatcccggctgcttcgacaacaagtacctgcgggacatcatcctcaacttcgtcatcgccggccgcgacaccacggcggggactctggcctggttcctctatatgctctgcaggaacctgcacatccaggaaaagatcgcgctggaggtgcgcgccgccaccacgggcgaccgcgacgtcggtgtgcaggagttcgtcgcgttcctgaccgaggacgccatcagcaagatgcagtacctgcacgccgcgctgacggagacgctccggctctacccagccgtgcccatcgatgtgaagtactgcttctcggacgacacgttgccggacggctacgcggtgaggaaaggggacatggtgaactaccagccgtaccccatgggcaggatgaagttcctgtggggcgtggacgcagaggagttccggccggagaggtggctcgacgacgatggcgtgttcgtccccgagagccccttcaagttcacggctttccaggcggggcctcgcatctgcttgggaaaggagttcgcgtacaggcagatgaagatcttcgcggccgtgctgctctacctattcagattcgagatgtgggatgccagcgccatcatgggttaccggcctatgctgacgctcaagatggatggcccgctctacgttcgcgcgtcgctccggcgatgagatgcggttggaggttagcctgatgccctgatgccaaaacgtcaacgcctccgtgtgtcccatggtctgatcgtgtctactttggaaagtaggatttgaaaatgagatatttccatctgttggtatcctcgagaacgtggggttcagcagctgtgcatagtattatattggatgattattgtaatagagtaggatcaagctgatcaaaacaaataaagttgccagatttgcacagtctgaagtggctcactctgaaatttaaaataacagtatttatcc

SEQ ID NO: 5216 - DNA, 1976 bp, Panicum virgatum
cggatcgcttcgcaatacatgcgttggtgatctttgcactctcaagtctcaagtcctgagcccaccatagaaaaatccaaaggtgatatcattttttaacccaaaggtacaaccaccttcttccgctggaggccagccacaagcccacgacacacgcaaccaaagcacggttgctacccacctcgcaccgagacaacagcagtgctcaccgccgggcatggactcgccgctgggccggcctgcgctgctcgcgctatccgtgctcctcctcgtcgcgctctacctcgcgcgccggcgccgcgcccgcggcaagaaccggaagtacccgccggtggccggcaccgtgctgcaccagctgctcaacttcgaccgcctggtggagtaccaaaccgagctcgcccgcaggtacggcaccttccgcatgctcaccccgacctgcaactacgtctacaccgtcgagcccgccaacgtggagtacatcctcaagaccaacttcgccaactacggcaagggggtgatgacgcacgacgtgctggaggacctcctcggcgacggcatcttcaacgtggacggcgccaagtggcggcaccagcggaaggtggccagccacgagttctccacgcgggtgcttcgcgactacagcagcgccgtgttccgcgacacggccgcggagctcacgggcatcgtggccgccgcggcgcggggcgacggggagagggtggatatcgccgacctgctgatgcgctcgacgctggactccatcttcaagatcgggttcggggtcaaccttggctccctgtccgggtgcagcaaggagggcgcggcgttcgccagggcgttcgacgacgccagcgagcaggtgctgtaccggttcttcgacctgttctggaaggtcaagaggttcttcagcatctcgtcggaggcggccatgaagcgctcggtccgcaccatcaacgatttcgtgtacgccgtcatcgacaggaagatcgagcagatgggcagaaaccatcaggaattcgccaagaaagaggacatcctgtcgaggttcctgctcgagcgggagcgagatcctggctgcttcgacaacaagtacctgcgggacatcatcctcaacttcgtcatcgccggccgcgacaccacggcggggaccctggcctggttcctctacgagctctgcaggaaccagcgcatccaggaaaagatcgcggaggaggtgcgcgccgccaccgtcacgggcgacggcggcgtcggcgcgcaggagctcgtggcgtgcctgaccgaggacgccatcggcaagatgcagtacctgcacgccgcgctgacggagacgctccggctctatccggccgtgcccatcgatgtgaagtactgcttctcggacgacacgttgccggacggctacgcggtgaaccaaggggacatggtgaactaccagccgtaccccatgggcaggatgaagttcctgtggggcgcggacgccgaggagttcaggccggagaggtggctcggcgacgacggcgtgttcgtccccgagagccccttcaagctcacggctttccaggcggggcctcgcatctgcttggggaaggagttcgcgtacaggcagatgaagatcttcgcggccgtgctggtctacctcttccgattcgagatgtgggatgccgacgccacggtgggctaccggcctatgctgacgctcaaaatggacggcccgctctacgtgcgcgcgtcgctccggcggcgatgagatgggccttgtgcaaaaaggaaaaggtcaaccgcgcgtctggttgtcaagtcggatttgaaaaaatacgatgtctccatctagtagtgtcatactagtagtactgcatcggattatttcaagctgatcgacgcaaataaaagttctcagattaactcttgtacagtcaagtgctcactcaaaaaactaaatgcaagggtttcttctgatccagctatgatcctatgtc

SEQ ID NO: 5217 - DNA, 1847 bp, Panicum virgatum
ccaccttcttccgctggaggccagccacaagcccacaacacacgcaaccaaagcacggttgctacccacctcgcaccgagacaacagcagtgctcaccgccgggcatggactcgccgctgggccggcctgcgctgctcgcgctatccgtgctcctcctcgtcgcgctctacctcgcgcgccggcgccgcgcccgcggcaagaaccggaagtacccgccggtggccggcaccgtgctgcaccagctgctcaacttcgaccgcctggtggagtaccaaaccgagctcgcccgcaggtacggcaccttccgcatgctcaccccgacctgcaactacgtctacaccgtcgagcccgccaacgtggagtacatcctcaagaccaacttcgccaactacggcaagggggtgatgacgcacgacgtgctggaggacctcctcggcgacggcatcttcaacgtggacggcgccaagtggcggcaccagcggaaggtggccagccacgagttctccacgcgggtgcttcgcgactacagcagcgccgtgttctgcgacacggccgcggagctcacgggcatcgtggccgccgcggcgcggggcgacggggagagggtggatatcgccgacctgctgatgcgctcgacgctggactccatcttcaagatcgggttcggggtcaaccttggctccctgtccgggtgcagcaaggagggcgcggcgttcgccagggcgttcgacgacgccagcgagcaggtgctgtaccggttcttcgacctgttctggaaggtcaagaggttcttcagcatctcgtcggaggcggccatgaagcgctcggtccgcaccatcaacgatttcgtgtacgccgtcatcgacaggaagatcgagcagatgggcagaaaccatcaggaattcgccaagaaagaggacatcctgtcgaggttcctgctcgagcgggagcgagatcctggctgcttcgacaacaagtacctgcgggacatcatcctcaacttcgtcatcgccggccgcgacaccacggcggggaccctggcctggttcctctacgagctctgcaggaaccagcgcatccaggaaaagatcgcggaggaggtgcgcgccgccaccgtcacgggcgacggcggcgtcggcgcgcaggagctcgtggcgtgcctgaccgaggacgccatcggcaagatgcagtacctgcacgccgcgctgacggagacgctccggctctatccggccgtgcccatcgatgtgaagtactgcttctcggacgacacgttgccggacggctacgcggtgaaccaaggggacatggtgaactaccagccgtaccccatgggcaggatgaagttcctgtggggcgcggacgccgaggagttcaggccggagaggtggctcgacgacgacggcgtgttcgtccccgagagccccttcaagctcacggctttccaggcggggcctcgcatctgcttggggaaggagttcgcgtacaggcagatgaagatcttcgcggccgtgctggtctacctcttcagattcgagatgtgggatgccgacgccacggtgggctaccggcctatgctgacgctcaaaatggacggcccgctctacgtgcgcgcgtcgctccggcggcgatgagatgggccttgtgcaaaaaggaaaaggtcaaccgcgcgtctggttgtcaagtcggatttgaaaaaatacgatgtctccatctagtagtgtcatactagtagtactgcatcggattatttcaagctgatcgacgcaaataaaagttctcagattaactcttgtacagtcaagtgctcactcaaaaaactaaatgcaagggtttcttctgatcc

SEQ ID NO: 5218 - DNA, 1911 bp, Panicum virgatum
ccacaacacacgcaaccaagcaccggtagccacccacctcgcaccgagacaacagctgtgctcaccgccgggcatggactcaccgctgagcaggcctgcgctgctcgcgctatccttgctcctcctcgcgctctacctcgcccgccggcacctcgcccgcggcaagaaccggacgtacccgccggtggccggcaccgtgctgcaccaggtgctcaacttcggccgcctggtggagtaccaaaccgagctctcccgcaggtaccccaccttccgcatgctcaccccgacctgcaactacgtctacaccgtcgagcccgccaacgtggagtacatcctcaagaccaacttcgccaactacggcaagggggtgatgacgcacgacgtgatggaggacctcctcggcgacggcatcttcaacgtggacggcgccaagtggcggcaccagcggaaggtcgccagccacgagttctccacccgggtgctgcgcgactacagcagcgccgtgttccgcgacacggccgcggagctcgcgggcatcgtggccgccgcggcgcggggagccggggagaggctggacatttcggacctcctgatgcgctcgacgctggactccatcttcgagatcggtttcggcgtcaaccttggctccctgaccggatccagcgaagagggcgcggcgttcgccagggcgttcgacgacgccagcgagcaggtgctgtaccgcttcttcgacctgttctggaaggtgaagcggttcttcagcatcgcgtcggaggcggccatgaagcgctcggtccgcaccatcgacggtttcgtctacgccgtcatcgacaggaagatcgagcagatgggcagaaaccatcaggaattcgccaagaaagaggacatcctgtcgaggttcctgctcgagcgggagcgagaccccggctgcttcgacaacaagtacctgcgggacatcatcctcaacttcgtgatcgccggccgcgacaccacggcggggaccctggcctggttcctctacgagctctgcaggaaccagcgcgtccaggaaaagatcgcggaggaggtgcgcgccgccaccgccacgggcgaccgcgacgtcggcgcgcaggagctcgtggcgtgcctgaccgaggacgccatcggcaagatgcagtacctgcacgccgcgctggcggagacgctgcggctctacccggccgtgcccatggatgtgaagtactgcttctcggacgacacgttgccggacggctacgcagtgaaccaaggggacatggtgaactaccagccgtaccccatgggcaggatgaagttcctgtggggcgcggacgccgaggagttcaggccggagaggtggctcaacgacgacggcgtgttcgtccccgagagccccttcaagttcacggctttccaggcggggcctcgcatctgcttggggaaggagttcgcgtacaggcagatgaagatctttgcggccgtgctgctccacctcttcagactcgagatgtgggatgctgatgccacggtgggctaccgccctatgctgacgctcaaaatggacggcccgctctacgtgcgcgcgtcgctccggcggccatgagatgggggtgaagccttgtgccaaaaggtcaaccgcgcatgtcccatggtctggccgtcgagtcggacttaaaaatacgatctttccatctgttagtgtcatttatcgataacgtgggggttcagcagccgtgcatcagtgcataccgttgaaatttagcaccgaagctatatagtattgggacctataaaaataaatgggcagcgctactcatatgtcctgtctattcaggctactagtactacgcaggagtgtacttcagcagcatccataaataaatatattgctgtttaatatttggcaccatagcc

SEQ ID NO: 5219 - DNA, 2076 bp, Panicum virgatum
cacatcagttggtgatcattaatttgcactccactcgtgaagaaaaatccaaaggtgctatcattatattataacccaaaggtacagccaccttcttccgctggaggccacaacacacgcaaccaagcaccggtagccacccacctcgcaccgagacaacagctgtgctcaccgccgggcatggactcaccgctgagcaggcctgcgctgctcgcgctatccttgctcctcctcgcgctctacctcgcccgccggcacctcgcccgcggcaagaaccggacgtacccgccggtggccggcaccgtgctgcaccaggtgctcaacttcggccgcctggtggagtaccaaaccgagctctcccgcaggtaccccaccttccgcatgctcaccccgacctgcaactacgtctacaccgtcgagcccgccaacgtggagtacatcctcaagaccaacttcgccaactacggcaagggggtgatgacgcacgacgtgatggaggacctcctcggcgacggcatcttcaacgtggacggcgccaagtggcggcaccagcggaaggtcgccagccacgagttctccacccgggtgctgcgcgactacagcagcgccgtgttccgcgacacggccgcggagctcgcgggcatcgtggccgccgcggcgcggggagccggggagaggctggacatttcggacctcctgatgcgctcgacgctggactccatcttcgagatcggtttcggcgtcaaccttggctccctgaccggatccagcgaagagggcgcggcgttcgccagggcgttcgacgacgccagcgagcaggtgctgtaccgcttcttcgacctgttctggaaggtgaagcggttcttcagcatcgcgtcggaggcggccatgaagcgctcggtccgcaccatcgacggtttcgtctacgccgtcatcgacaggaagatcgagcagatgggcagaaaccatcaggaattcgccaagaaagaggacatcctgtcgaggttcctgctcgagcgggagcgagaccccggctgcttcgacaacaagtacctgcgggacatcatcctcaacttcgtgatcgccggccgcgacaccacggcggggaccctggcctggttcctctacgagctctgcaggaaccagcgcgtccaggaaaagatcgcggaggaggtgcgcgccgccaccgccacgggcgaccgcgacgtcggcgcgcaggagctcgtggcgtgcctgaccgaggacgccatcggcaagatgcagtacctgcacgccgcgctggcggagacgctgcggctctacccggccgtgcccatggatgtgaagtactgcttctcggacgacacgttgccggacggctacgcagtgaaccaaggggacatggtgaactaccagccgtaccccatgggcaggatgaagttcctgtggggcgcggacgccgaggagttcaggccggagaggtggctcaacgacgacggtgtgttcgtccccgagagccccttcaagttcacggctttccaggcggggcctcgcatctgcttggggaaggagttcgcgtacaggcagatgaagatctttgcggccgtgctgctccacctcttcagactcgagatgtgggatgctgatgccacggtgggctaccgccctatgctgacgctcaaaatggacggcccgctcttcgtgcgcgcgtcgctccggaggccatgagatgggggtgaagccttgtgccaaaaggtcaaccgcgcatgtcccatggtctggccgtcgagtcggacttaaaaatacgatctttccatctgttagtgtcatttatcgataacgtgggggttcagcagccgtgcatcagtgcataccgtttaaatttagcaccgaagctatatagtattgggacctataaaaataaatgggcagcgctactcatatgtcctgtctattcaggctactagtactacgcaggagtgtacttcagcagcatccataaataaatatattgctgtttaatatttggcaccatagccatagcctgttcttgtcttactcctcatttttctaacaccacatgaagttagcattgct

SEQ ID NO: 5220 - DNA, 1984 bp, Panicum virgatum
gcaagtgtgtgaagacaaagccacgaagtgtcatgtttcgtgagtgctcgcttcaagaccgtctctccccaactccaatccaaggacaaaattcagacaccgtgcttggctatcttacctgatctgatatttgtggagtccgacagtccgtcaacgcaagtgattttttaatcgagccgctcaggcgctcaccgtcaccgccgggcatggactcgccaccgatccaacccgctctgctcgccctgacccttgttctcctcttagcagcgctctacatcgcgcgccggcgccgcgcccgcggcgataaccggaagtacccgccggtggccggcaccgttctgcaccagctgctcaacttcggccgcctggtggagtaccaaaccgagctctcccgcaggtaccgcaccttccgcatgctcacccccgcctgcaactacgtctacaccgtcgagcccgcaaacgtggagtacatcctcaagaccaacttcgccaactacggcaaggggagcacgctgcacgacctcgccgaggacctcctcggcgacggcatcttcaacgtggacggcgccaagtggcggcaccagcggaaggtggccagccacgagttctccacgcgggtgctgcgcgactacagcagcgccgtgttccgcgacacggccgcggagctcgcgggcatcgtggccgccgcggcgcggggcgccggggagaggctggacatttcggacctgctgatgcgctcgacgctggactccatcttcaaggtcgggttcggggtcagcctgggcgtgctgtccggatccagcgaagagggcgcggcgttcgccagggcgttcgacgacgccagcgagcaggtgcttcaccgcttcttggacccgttctggaaggccaagaggttcctcaacctctcgtcggaagcggccatgaagcgctcgctccgcactttcaatgactttgtctacgccgtcatcgacaggaagatcgagcagatgggaagagaccagcaagaatttgccaagaaagaggacatcttgtcgaggtttctgctcgagagggagcgagaccccggatgcttcgacaacaagtacctccgggacatcatcctcaacttcgtgatcgccggccgcgacagcacggcggggactctggtgtggttcctctatgtgctctgcagtaacgaggctgtccaggaccggatcgcggaggaggtacgcgccgccgccacgggcgaccgcgacgtcggcgcccaggagctcgccgcgagcctgaccgaggacgccatcggcaagatgcagtacctgcacgccgcgctgacggagaccctccggctctaccccgccgtgcccgtcgatgtgaagtgttgcttctcggacgacacgttgccggacggctacgctgtcaacgaaggggacatggtgcactaccagccgttccccatgggcaggatggagttcctgtggggcgcggacgccgaggagttcaggccggagaggtggctcgacggcgacggcggtgtcttcgtccccgagagctccttcaaattcacggctttccaggcggggcctcgcgtctgtctgggaaaggagttcgcgtacaggcagatgaaggtcttcgcggctgttcttctctacctcttcaggtttgagatgtgggatgccaacgccaccattggttaccgggctatgctcactctcaaaatggaccgcccgctgtacgttcgcgcgtcgctccggcgatgatgtgcctgatgcgaagaggccaggcacgtttgtgactttgagcatgtccccatgcatcctctttacgttgaaacgcaggataccatatttttacttctttatgacatcaataacatggagctcattacattattatattgaagtatcttatgagaagtttagcaagcttatctacgcaaataaaattgtcagcgttaattgttgtactatcattggtgataagtggggaaaaagatctcaaatgtgag

SEQ ID NO: 5221 - DNA, 1544 bp, Setaria italica
ccgaaaatggactcgctaccgctgagcctcacggtgctgctccccctttcgcttgccctgctgctagcgctccacctcgcgcgccagcgccgcggcgccggcggcaagaaccggaagtacccgcccgtggccggcaccgtgctacaccagctgctcaactacgaccgcttgatggagtaccagaccgagctctcccgcaggcaccgcaccttccgcgtgctcaccccgaccggcaacgacgtctacaccgtcgaccccgccaacgtggagcacgtcctcaagaccagcttcgccgactacggcaagggggcgacgatgcacgacgtgatggaggacctcctcggcgacggcatcttcaacgtggacggcgacaagtggcggcaccagcggaaggtcgccagccacgagttctccgtccgggtgctgcgtgactacagcagcggcgtgttccgcgacaccgccacggagctcgcggggatcgtggccgccgcggcgcggggcgacggggggatcagggtggacatcgcagacctgctgatgcggtcgacgctggactccatcttcaaggtcgggttcggcgtcaacctgggttcgctgtccgggtgcagtaaggagggcgcggagttcgccagggcgttcgatgacgccagcgagcaggtgatgtaccggttcttcgacttgctctggaaggccaagaggctcctcaacgtctcgtcggaggcggccatgaagcgctcggtccgcacgatcaacgacttcgtgtacgccgtcatcgacaggaagatcgagcagatgagcagcgaccaacaagaattcgccaagaaagaggacatcttgtcgaggttcctgctcgagagggagcaagaccccggctgcttcgacaacaagtacctgcgggacatcatcctcaacttcgtcatcgccggccgcgacaccacggcggggactctggcctggttcctctacgtgctctgcaggaaccagcacatccaggaaaaggtcgcgcgggaggtgcgcaccgccgccgccacaggcgaccgcgacgtcggcgcccaggagttcgtcgcgagcctgacggaggacgccatcagcaagatgcagtacctgcacgccgcgctgacggagaccctccggctgtacccggccgtgcccatcgatctcaagtgctgcttctcggacgacacgttgccggacggctacgctttgaagaaaggggacgcggtgcactaccagccgtacgccatgggcaggatggatttcctatggggcgcggacgctgaggagttcaggccggagaggtggctcgacgacgatggcgtattcgtccctgagagccccttcaagttcacggtttttcaggcagggcctcgcatctgtttgggaaaggaattcgcgtacaggcagatgaaaatcttcgcggctgtgcttctctacctcttcagatttgaaatgtgggatgccaacaccaccgagggctaccggcctatgctcacgcttaaaatggacgggccgctctatgttcgtgcgtcgccccggcgggcatc

SEQ ID NO: 5222 - DNA, 1775 bp, Triticum aestivum
acaaggcggcttccggaaatcaggtgcaccgcactcgcatccaagccttcactctccacaatccacactgcacacgccggcacgacgccccgcgacgcacccggcgtcctccgcaccgtgacccagcggcgtctcacggccatggactcaccgctgagccagcagcccacgctgctggcgctgtcgctgctcctcctggccctctacctggcgcgccgcgccctgctcggcaagcggcggaactacccgcccgtggccggcaccatgctccaccagctcctcaacttcggccgcctggccgagtaccagacggagctctcccagaggtaccgcaccttccgcatgctcaccccgacctgcagctacgtgtacaccgtggagcccgccaacgtggagtacatcctccgcaccaacttcgctaactacggcaagggcaccatgacccacgacgtgctggaggacctcctcggcgacggcatcttcaacgtcgacggcgccatgtggcggcaccagcgcaaggtcgccagcttcgagttctccacccgggtgctccgcgagtacagcagcggcgtgttccgcgacacggccgccggctcgcgggcatcgtggccgccgccgccgccgccggggagagggtcgacatgcacgacctgttcatgcggtcgacgctggactcgatcttcacgatcgggttcggagtcaacctcggcgggctgtcccagtccagccaggagagcgcggcgttcgcccgggcgttcgacgacgccaacgagcaggtgctgtaccggttcttcgacccgctctggaaggccaagaggctgctcaacgtctcgtcggaggcggccatgaagcggtcggtgcgcaccatcaacgacttcgtgtacgctgtcatcgacaagaagatcgagcagatgagcaaagatgaacacgaattcgccaagaaagaggacatcctgtcgagattcctgctggagagggagaaagacccgggctgcttcgacaacaagtacctccgggacatcatactcaacttcgtgatcgccggccgcgacacgtcggcggggacgctgtcgtggttcctctacgtgctgtgcggcaaccagcgcatccaggacaagatcgcgagggaggtgcgggaggccaccaccgccggcgaccgggacgtcggcgtccaagaactcacggcgtgcctcacagaagacgccatcagcaacatgccgtacctccacgccgcgctgacggagacgctccggctgtacccggcggtgcccatcgatgtcaagtactgcttctcggatgacacgctgccggacggccacgccgtgaggaaaggggacatggtgaactaccagccgtacccgatgggcaggatgaagttcctgtggggcgacgacgccgaggagttcaggccggagcggtggctcgacggcgacggcgtgttcgtcccggagagcccctacaagtttacggcattccaggcggggcctcggatctgcctggggaaggagttcgcgtacaggcagatgaagatatttgcggctgttcttctctacctctacaggtttgagatgtgggagcgcgactccacggtgggataccgcccgatgctcaccctcaaaatggatggtccgctccatgttcgtgcgttgccccggcgagcaagcgggtagcgtgcttgctataagactagatgcagatgtgtgctttgctgcgccgtcttacttgtaaatggggatacaatgccagactatttgtatgcaatgaagatcttttaa

SEQ ID NO: 5223 - DNA, 1884 bp, Zea mays
acgcggccgacttcactttccaacggagtacaagtccagaaccagaagtataggtaccaaaccaaacgcgcactacggtgctcaccgctgaccatggactcgccaccgctccaacccacggtgttctccctgatacttgctctcgttctagtgttatacttggcgctccggcgccgcggcggcggcaagaaccggagctacccgccagtggctggcaccgtgctgcaccagctgttcaacttcggccgcctgatggagtaccaaaccgcgctctcccgcaggtaccgtaccttccgcatgcttaccccgacctgcagctacatctacaccgtggagcccgcgaacgtggagtacatcctcaagaccaacttcggcaactacggcaaggggagcacgctgcacgagctgagcgaggacctcctcggcgacggcatcttcaacgtggacggcgccaagtggcggcaccagcggaaggtcgccagccacgagttctccacgcgggtgctgcgcgactacagcaccggcgtgttccgcgacacggcggcggagctcgcgggcatcgtggccgccgccgccgccgcgggggagaagctggacatgcaggagctgctgatgcggtcgacgctggactccatcttcaaggtcgggttcggggtcaacctgggcgtgctgtccgggtccagcgaggaaggcgccgcgttcgccaaggcgttcgacgacgccagcgagcaggtgctgcaccgcttcttggacccgttctggaaggccaagaggttcctgaacttgtcgtcggaggcggccatgaagcgctcgctccgcaccatcaacgacttcgtctacgccgtcgtcgacaggaagatcgagcagatgggaagagaccaacaggaatttgccaagaaagaggacatcctgtcgaggttcctggtggagcgggagagcgatcccggctgcttcgacaacaagtacctgcgggacatcatcctcaacttcgtgatcgccggccgcgacacgaccgcggggaccctgtcgtggttcctctacgtgctctgcaagaaccagagcatccaggacaggatcgcgcaggaggtgcgcgccgccacctcgggcgacggcggcggcctcggcgctccagagctcgtcgcgtgcctgaccgaggacgccatcagcaagatgcactacctgcacgcggcgctgacggagaccctccggctctacccttccgtacccatcgacgtcaagtgctgcttttcggacgacacgttgccggacggctacgctgtcaagaaaggggacatggtgaactaccagccgtaccaaatgggcaggatgcggttcctgtggggcgcggacgccgaggagttcaggccggagaggtggctggacgacgccggcgtcttcgtccccgagagccccttcaagttcacggctttccaggcgggccctcgcgtctgcttgggaaaggaattcgcgtacaggcagatgaagatcttcgcggctgtgcttctctacctgttcaggtttgagatgtgggatgccaacgctaccgtgggttaccgggccatgctcaccctcaaaatcgatcgcccgctgtatcttcgtacgtcgctccggcgatgaggtgaggcgggcggcatgcctcgtgtcaagcggtcagacacgtctgtgaatttaggaaaacaacatctccaaacatccgcatagtcttcgggccacgattggcccttttagaaattggtatgttgacatgtgattgtactgacccttgccaccggcgcaccccgaacagcgagacgtacgcgagacggtagtagaaccggaagaagatcacggtggggagatagaaactgacacaaggtgcgattctcttttccttctgttatttct

SEQ ID NO: 5224 - DNA, 1782 bp, Secale cereale
gactcgtcgaccaacccatctcaatgatctggtttccgtcttgaagcgaggagacgaacacaaggcccactcggatggtgcacgcactcgcatccaagccttcattctcctcaatccagacggcacacgccagcacgcccggcgtcctcgcaccgtgacccagcggccatggattcaccgttgaaccagcagcccacgctgctggcgctgtcgctcctcctcctagccctgtacctggcgcgccgcgccctgctcggcaagcgacggaactacccgcccgtggccggcaccatgctccaccagctgctcaacttcggccgcctggccgagtaccagacggagctctcccagaggtaccgcaccttccgcatgctcaccccgacctgcaactacgtgtacaccgtggagcccggcaacgtggagtacatcctccgcaccaacttcgccaactacggcaagggcaccatgacccacgacgtgctggaggacctcctcggcgacggcatcttcaacgtcgacggcgccatgtggcggcaccagcgcaaggtcgcgagcttcgagttctccacccgggtgctccgcgagtacagcagcggcgtgttccgcgacacggccgccgagctcgcgggcatcgtggccgccgccgccggcgccggggagagggtggacatgcaggatctgttcatgcggtcgacgctggactcgatcttcacgattgggttcggggtcagcctgggcgcgctgtccgggtccagccaggagagcgcggcgttcgccagggcgttcgacgacgccaacgagcaggtgctgtaccggttcttcgacccgctctggaaggccaagaggctgctcaacgtctcgtcggaggccgccatgaagcggtcggtgcgcaccatcaacgacttcgtgtacgccgtcatcgacaggaagatcgagcagatgggcagagatgagcacgaattcgccaagaaagaggacatactgtccagattcctgctggagagggagaaagacccgggctgcttcgacaacaagtaccttcgggacatcatactcaacttcgtgatcgccggccgcgacacgacggcggggacgctgtcgtggttcctctacgtgctgtgcagagaccagcgcatccaggacaaggtcgcgagggaggtgcgggaggccaccaccggcgaccgccaggacgcgggcagcgtgcaagagttcgtggcgcgcctgaccgaagacgccatcggcagcatgcactacctccacgccgcgctcacggagaccctccggctgtacccggcggtgcccgtcgacgtcaagtgctgcttctccgatgacacgctgccggacgggcacgccgtgagcagaggggacatggtgaactaccagcccttcgcgatgggcaggatgaagttcctgtggggcgacgacgccgaggagttcaggccggagaggtggctcgacgacgacggcgtgttcgttccggagagcccctacaagttcaccgctttccaggcggggcctcgaatctgcttgggaaaggagttcgcctacaggcaaatgaagacatttgcagccactcttctctacctcttcaggtttgagatgtgggaccgcggctcgacggtggggtaccgtccgatgctcacgctcaaaatggacggcccactctatgttcgtgcgtcgccccgtcgatctaccgggaactagcgcgtggatgttcccctgctcagttgtgctgagatttgacactatgactagtgagaataataacataaactctaggag

SEQ ID NO: 5225 - DNA, 1912 bp, Hordeum vulgare
acaaggcgccttcctgaaattgtgtgcatctcacccgcagtctcgcacccaagccttgatcctcctcaatccacacggcacacgccacgcgccagcacgcccggcgtcctcgcaccggtgacccgtcacggccatgggttcaccgttgagccagcagcccacgctgctggcgctgtcgctgctcctcctggccctctacctggcgcgccacgccctgctcggcaagcggcggaagtacccgcccgtggccggcaccatgctccaccagctcttcaacttcggccggctggccgagtaccagacggagctctcccagaggtaccgcaccttccgcatgctcaccccgacctgcaactacgtctacaccgtggagcccgccaacgtggagtacatcctccgcaccaacttcgccaactacggcaagggcaccatgacccacgacgtgctggaggacctcctcggcgacggcatcttcaacgtcgacggcgccatgtggcggcaccagcgcaaggtcgcgagcttcgagttctccacccgggtgctccgcgagtacagcagcggcgtgttccgcgacacggccgcccagctcgcgggcatcgtggccgccgccgccgccgccggggagagggctgacatgcaggacctgttcatgcggtcgacgctggactcgatcttcaccatcgggttcggggtcagcctgggcgcgctctccgggtccagccaggagagcgcggcgttcgccagggccttcgacgacgccaacgagcaggtgctgtacaggttcttcgacccgctctggaaggccaagaggctgctcaacgtctcgtcggaggccgccatgaagcggtcggtgcgcaccatcaacgacttcgtgtacgccgtcatcgacaagaagatggagcagatgggcagagatcaacaagaattcgccaagaaagaggacatcctgtcgaggttcctgctggagagggagaaagaccccggctgcttcgacaacaagtacctccgggacatcatactcaacttcgtgatcgccggccgcgacacgtcggcggggacgctgtcgtggttcctctacgtgctgtgcagcaagcagcgcatccaggacaagatcgcgagggaggtgcgggaggccaccaccggcgaccggcacgtcggcgcgcaagaactcacggcgtgcctcacagaagacgccatcagcaacatgccgtacctccacgccgcgctgacggagaccctccggctgtacccggctgtgcccatcgatgtcaagtactgcttctcggatgacacgctgccggacgggcacgccgtgaggaaaggggacatggtgaactaccagccgtacccgatgggcaggatgaagttcctgtggggcgacgacgccgaggagttcaggccggagaggtggctcgacggcgacggcgtgttcgtcccggagagcccctacaagttcacggccttccaggcggggcctcggatctgcttggggaaggagtttgcgtataggcagatgaagatatttgcggcagttcttctctacctcttcaggtttgagatgtgggagggcgagtcgacggtggggtatcgccccatgctcacgctcaaaatggatggcccgctcaacgttcgtgcgtcgccccggcgagcaagcgggtagcgtgcttgctatcaagatgtccaatctcgaaagtttgtgcatgtttcggtgttccattctgtttgaacttcgataatatgatgatgtgcatataacaatgcggcctctttttgtaatccaagcacttcataagctgtacatataacaatggcatacagttcagaagttgttcatgcacttatttatacccgagcagttgtacgctctatagactctactcaaatagttgatgcaaggttcggcaagttaacc

SEQ ID NO: 5226 - DNA, 1797 bp, Setaria italica
caaactcctccagtgcgtcgacaccttccagcagcctcgcaccgggacgccagcgctcaccgccgggcatggactcgccaccgagccaacccgcgctgctcgccctgacccttgtcctcctcctagcgctctacctcgcgcgccggcgccgcgccgccggcaagaaccggaagtacccgccggtggccggcaccgtgctccaccagctgttcaacttcggccgcttggtggagtaccagaccgagctcgcccggaggcaccgcaccttccgtatgctcaccccgaccagcaactacatctacaccgtcgagcccggcaacatagagtacatcctcaagactaacttggccaactacggcaaggggagcgcgctgcacgaactggccgaggacctcctcggcgacggcatcttcaacgtggacggcgcgaagtggcggcaccagcggaaggtcgccagccacgagttctccacccgggtgctgcgcgactacagcagcgccgtgttcggcgacacggccgcggagctcgcggggatcgtggccgccgcggcgcggggcgccggggagaggctggacatctcggacctgctgatgcggtcgacgctggactccatcttcaaggtcgggttcggtgtcagcctgggggtgctgtccgggtccagcgaggagggggtggcgttcgccagggcgttcgacaacgccagcgagcaggttctacaccgcttcttggacccgttctggaaggccaagaggctccttaacttctcgtcggaggcggccatgaagcgctggctccgcaccatcaatgccttcatctacgccgtcatcgacaggaagatcgagcagatgggaagagaccaacaagaattcgccaagaaggaggacatcttgtcgaggtttctcctggagagggagcgagatcccggctgcttcgacaacaagtacatccgggacatcatcctcaacttcgtgatcgccggccgcgacacaaccgcggggactctgtcgtggttcctctacgtgctctgcaggaaccaggccatccaggacaggatcgcggaggaggtacgcgccgccgccacgggcggtcgcgacgtcggcgcccaggagctcgtcgcgtgcctgaccgaggacgccatcggcaagatgcactacctccacgcggcgctgacggagaccctccgtctctaccccgccgtgcccgtcgatgtgaagtgctgcttctcggacgacacgttgccggacggctacgcggtcaacaaaggggacatggtgaactaccagccgttccccatgggcaggatggagttcctgtggggcgcggacgccgaggagttcaggccggagaggtggctcgacggcgacggtgtcttcgtcaccgagagccccttcaagttcacggctttccaggcggggcctcgcgtctgcctgggaaaggaattcgcgtacaggcagatgaagatcttcgtggccgtgcttctctccatgtacaggtttgagatgtgggatgccgacgccaccgtgggttaccgtgctatgctcactctcaaaatggatcgcccgctgtatgttcgtgcgtcgctccgacgatgatatgggcaatttgtgtatgtccccatcctctggggatgatagcaggattcgaatatgccatctttttgctttttatgataacgtggagctcattagttgtgtatattatattggattgtcttttagaaagctgatgtacgcaaatagaattttgtgcacagattgttggacaatcctcggtttttcacttaaaaaagaactaaat

SEQ ID NO: 5227 - DNA, 2051 bp, Sorghum bicolor
cgcgcaacatgatccctagtctttttaatcggccgcgcgcgccacactttcctacgcaccacacaagtactgctaccccacacggccacaaccaaacgcgcacggctcccaggtcccagccgcctcgcaccgagacgcggacgccagcgctctccagtctcaactgaccatggactcgccgccgggccaacccacggtggtcaccctgatacttgctctcctcctagttctatacctcgcgctccggcgccgcgccggcgccggcggcgccaagaaccggagctacccgccggtggccggcaccgtgctccaccagctgttcaacttcggccgcctgatggagtaccacactgagctctcccgcaggtaccgtactttccgcatgctcaccccgagcagcagctacatctacaccgtcgagcccgccaacgtggagtacatcctcaagaccaacttctccaactacggcaaggggagcaaggtgcacgaggtgggcgaggacctcctcggcgacggcatcttcagcgtggacggcgccaagtggcggcaccagcggaaggtcgccagccacgagttctccacgcgggtgctgcgcgactacagcaccggcgtgttccgcgacacggccgcggagctcgcgggcatcgtggccgccgacgccggggagaaggtggacatgcaggacctgctgctgcggtcgacgctggactccatcttcacggtcgggtttggggtcagactgggcgttctctccgggtctagcaaggaaggcgccgcgttcgccaaggcgttcgacgatgccagcgagcaggtgttacaccgcttcttggacccgttttggaaggccaagaggttcctaaacttctcgttggagacggccatgaagcgctcggtccgcaccatcaacgacttcgtctacgccgtcgtcgacaagaagatcgagcagatgggaagagaccaacaagaatttgccaagaaagaggacatcctgtcgaggttcttggtggagcgggagagcgatcccggctgcttcgacaacaagtacctgcgggacatcatcctcaacttcgtgatcgccggccgcgacaccacggcggggacgctgtcgtggttcctctacgtgctgtgccggaaccagcacatccaggacaaggtcgccgaggaggtgcgcgccgccgccacctccggcgacggcgacctcggcgccccggagctcgtcgcgtgcctgaccgacgacgccatcggcaagatgcactacctgcacgcagcgctgacggagaccctccggctctaccctgctgtgcccatcgatgtcaagtgctgcttttcggacgacacgttgccggacggctacgccgtcaacaaaggggacatggtgcactaccagccgtaccaaatgggcaggatgcagttcctgtggggcgccgacgccgaggagttccggccggagaggtggctcgacgacggcggggtgttcgtccccgagagccccttcaagttcacggctttccaggctggccctcgcgtctgcttgggaaaggaattcgcgtacaggcagatgaagatcttcgcggccgtgcttctctacctgttcaggtttgagatgtgggatgccaacgccaccgtgggttaccgggccatgctcactctcaaaatggatggcccgctctatgttcgtgcgtcgctccggcggtgaggagggcggacggcaagcggcatataagatgcctcaagtcaaacggccagtcgtgtggaagtatacatgcgtgtagctatgtacttgctgtatatcggtcttgtataggatatatgcacttgctgtatatctattataaagtcaatgaccggctgaccgttgttttctttaacatttacaagtcggtcagacacgtctgtgtatccgccgtcctctttgtgtactttttttttgaaagatctggaaccatggtttccagcgtgtatattaataataagaagagaatgatccattttaaaaggaaaaacccaaggccaaaaatcataaacatttttctttttaacaaaaacataaa

SEQ ID NO: 5228 - DNA, 1876 bp, Brachypodium distachyon
cacgcacatgcgggtcttcgctctcgtcgaaccacacagcggagaagaggggcaaagcacgccccggcgacacaccggcctccttgcaccggggcaccagtccatttcacggccatggactcgctgctcgcgctgtcgctcctcctcctagcactctacctcgcgcgccgcgccctgctcggcaacaagggacggaagaactacccgcccatcgccggcaccgtgctccaccagctgctcaacttcggccgcctggtggagtaccagacggagctctcccgcaagcaccgcacctaccgcatgctcaccccgacctgcagctacgtctacaccgtggagccggccaacgtggagcacatcctccggaccaacttcgccaactacggcaagggcgccatgacccacgacgtgctggaggacctcctgggagacggcatcttcaacgtcgacggcgccaagtggcggcaccagcggaaggccgccagcttcgagttctccacccgcgtgctccgcgagtacagcaccggcgtgttccgggacacggccgccgagctcgcgggcatcgtggccgtggcggcggcgcgcggggaacgggccgtggacatgcaggatctgctgatgcggtccacgctggactcgatcttccagatcgggttcggggtcaggctgggcgcgctgtccgggtccaacgaggagggcgcggcgttcgccagggcgttcgacgacgccagcgagcaggtgctgtaccgcttcttcgacctgctctggaaggccaagcgactcctcaacgtctcgtcggaggcggccatgaagcggtccgtccgcaccatcaatgacttcgtctacgctgtcatcgacaagaagatcgagcagatggccagagatcagcacgaattcgccaagaaagaggacatactgtcgagattccttctggagagggagaaagacccgggctgcttcgacaacaagtacctgcgggacatcatactgaacttcgtgatcgccggccgcgacacgtcggcggggacgctgtcgtggttcctctacgtgctgtgcaacaaccagcacatccaggacaaggtcgccagggaagtgcgggaggccaccggcaccggcgacagtgacgccgctcccgccggcgtccaagagttcatcgagtgtctagacgaagacgccatcagcaaaatgcagtacctccacgcagctctgacagagaccctccggctgtacccggcggtgcccatcgatgtgaagtactgcttctccgatgacacgctgccggacgggcacgccatcaggaaaggggacatggtgaactaccagccgtaccccatgggcaggatgaagttcctgtggggggacgacgccgaggagttcaggccggagaggtggctcgacgacgacggagcgttcgtccccgagagcccctacaagttcacggctttccaggcggggcctcgcatctgcttgggaaaggagttcgcgtacaggcagatgaagatatttgcggctgttcttctctacctgttccggtttgagatgtgggaacgtaactccacgatgggtttccggcccatgctcacgctcaaaatggatggcccgctcaacgtccgtgtgttaccccggcgaccaagtgggcagcttgcttgatacacgataacacgaagaagccagaagtcaaaagtgtgcgcatgttctagtaaccaattctgtgtagcttcgataatgtaagaacctgtatacacaattctgccgctttccatgactgttgatactacggtcctgtaattgtacatattgtgtactcttttttctcaagtactaaatccgtttcataattcttgtctcaaaattgaccaaaaataaatgtatttat

SEQ ID NO: 5229 - DNA, 2703 bp, Zea mays
ctcatcttcacaacccagattattaatgataccatttacatcctctctctctctctctctcctctcacacacgcatgcttcagtgaatgttgatgcggcgaaacagcgtcagcagcaaatctctaggccccgctaataaactatctcgccattagcagtaggcggcggcgcggcagcagcagcccgcaggcatgcaacagctgcagcggcacggggagaaaaaggtgggcaaaagcgggcacgaaaccgaagcgctcgccgacccacccaccgcaccgctctcccatcccacccaaatcgccgaccgataggagagaactcgagctgaggagagagagagcagcaggcggcggcgcggagtaacacgcggaggggaatgcgcagcccgtgtgagcctctcgcccccgcgaaaccccaccgattctgattccgccggcgaaatcgggcgcctcgcggctcggccggctaagcggtggacggcggcgccgaggggttcgttcgatacggtgagggtgaggccgtgaggagcagcagccacggcgacggggatgatgaagggagggggcgggaaggagacgctcaccgcctccttcctccgcttcctcctcctgctcctcctccccctcaccgccctctacttcttctacacgctgcacctcctcctcacctcggcgtcgtcggccgcctccaactgcgcgcctgacgccgtctcggtctcccggatgtctgccaacctcacggcggtggcggagaagcagctgcccccttccaccgtggctgggtccacgtcgacaacgctgcagcacgtagtgttcggcatcgcggcgtcgtcgcggttctgggacaagcgtaaggagtacatcaaggtgtggtggcgcccgcgcggcgccatgcggggctacgtgtggctggaccgcaaggtgcgcgagtccaatatgtccacggcgcgcacggggctcccggccatcaggatctcgtccgacacgtccgccttcccctacacgcaccgccgcggccaccgctccgccatccgcatctcccgcatcgtctccgagacgttccgcctcggcctccccggcgtgcgctggttcgtcatgggcgacgacgacaccgtcttcttcccggacaacctcctcaccgtgctcaacaagttcgaccaccgccagccctactacatcggctccctctccgagagccacctgcagaacatctacttctcctacgggatggcgtacggcggcggcggcttcgccatcagccggccgctggccgaggcgctcgcgcggatgcaggatggctgcctccgccggtacccggcgctgtacggcagcgacgaccggatccaggcgtgcatggcggagctgggcgtgccgctcaccaaacacccggggttccaccagtacgacgtgtacggcgacctcctcggcctcctcgcgtcccacccggtggcgccgatcgtgacgcttcaccacctcgacgtcgtgaagccgctgttcccggacgcgaggtcgcgcccctcggcggtgcggcggctgttcgacgggccagtgaagctggacacggcggggctgatgcagcagtccatctgctacgacagcgcgaaccgctggacggtgtccgtggcgtgggggttcacggtgctggtggcgaggggcataatgtcgcctcgggagatggagatgccggcgcgcacgttcctcaactggtaccgccgcgccgactacacagcgtacgccttcaacacgaggccgctggcgcgcagcccgtgccagaagccggcggtgtactacctatcgtcggcgcgacgcgaggccttgcgcggcggggagacgacggtgacgcgatacgagcggtggcgccatccgaacgagacgcggcccgcgtgccggtgggacataaccgacccggacgctcatctcgatcacatcatcgtgctcaagaagcctgaccccgggctctgggaaaggtctccgaggcgaaattgctgcagagtggtgtcttcgcccaaggatgggaagagcggggagaagacgatgaccatcgatgtaggcgtatgcagggaaggcgagttcagccaagtagcaggagcatgagcttttattagagatagatgaagataggaagatttcaaattcttttcttcttcctttttcttgtacgagtccgttcctcggagagtatgaacttgtctcgtttcaaatcccaccttttttgcatggcgctttgcgcgtgtgtaactacagttcgcaaagcgacagaaggccaagacttgaagttttggccgggggtcccgccatggcgacggcaagtcaacccgctgcccccacgcccaacggctacggcggtggtattttggctggcggagacggggtgcacggcactgcacggcgtcagatcagtctgggtcactgtgagcctgtgtcgcagcactgctgctgttgcactgcggtagtgcggtggggctattgtcaaagcgtggctcggcacccgcgcgagcagggcagccatcactcatcatcgcaggacatggcggtggagtggctacatagaaatctgtcctggtctgggcctgtgcaggcctgtcagtactcttacgttcagcatggtaaaacagcggtggaatctatcctggggcatgcaagtccaagtcctcaggaatgttcagtgtcaaacacgaattgcttcaagatggtcacctattag

SEQ ID NO: 5230 - DNA, 2411 bp, Zea mays
gcaaatggcaatggtgcatcgaaaaacccaaatttcagcaaaagtatgcctacaagccaaaacgagctccgaatccgtttcaaccactatcaaatctccgcttcggattttttggttaagacttaagaatgagacatccactccctcctctcccacacgcgtgcttcttgaatgctggacgcggccaaacagcgccagcagcaaatctccaggctgcacagcagcagcagcgaccgcccgcaggcatgcaacagcagcagcggcacggggagaaaaaggtgggccaaaccgggcacgaaaccgaagcgctcaccgtccctcacccaaatcgccgaccgtgaggagagaagccgagctgaagagagggagggcagcaggcggcagcgcggaggggaaatggggaatgcgcgaccagtgtgagcctctcacccccgcgaaatcccaccgcttctgattccgccggctaaattagctgggctaaacggtggacggcggcttcgagaggttcgttcgagacagtcagggtgaggttgtgaggagccacggcgacggggatgatgaagggagggggcgggaaggagacgctcaccgcctccttcctccgcttcctcctcctgctcctcctccccctcaccgccttctacttcctctacacgctgcagctcctcctcacctcggcatcgtcggccgcctccaactgcgtcccggacgccgtctcggtctcccgggtgtccgccaacctcacggcggcggagaagcagctgccccctccggccgcagctgtgtccacggcgacgacgctgcagcacgtggtgttcggcatcgcggcgtcgtcgcggttctgggacaagcgtaaggagtacatcaaggtgtggtggcgcccgcgcggcgccatgcgtggttacgtgtggctggaccggaaggtgcgcgagtccaacatgtccacggcgcgcacggggctcccggacatcaggatatcgtccgacacctccgccttcccctacacgcaccgccgcggccaccgctccgccatccgcatctcccgcatcgtctccgagacgttccgcctcgacctccccggcgtgcgctggttcgtcatgggcgacgacgacaccgtcttcttcccggacaacctactcaccgtgctcaacaagttcgaccaccgccagcactactacatcggctccctatccgagagccacctgcagaacatatacttctcctacgggatggcgtacggcggcggcggcttcgccatcagccggccgctggccgaggcgctcgcgcggatgcaggacggctgcctccgccggtacccggcgctgtacggcagcgatgaccggatccaggcgtgcatggcggagctgggcgtgccgctcaccaagcacccggggttccaccagtacgacgtgtacggcgacctcctcggcctcctcgcgtcccacccggtcgcgccgattgtgacgctgcaccacctcgacgtcgtgaagccgctgttcccggaggtgaggtcgcgcgccgcagcggtgcggcggctgtttgacgggccggtgaagctggacacggcggggctgatgcagcagtccatctgctacgacggcgccaaccgttggacggtgtccgtcgcgtgggggttcacggtgctggtggcaaggggcataatgtcgcctcgggagatggagatgccggcgcgcacgttcctcaactggtaccggcgcgccgactacacggcgtacgcgttcaacacgaggcccctggcgcgcagcccgtgccagaagcccgccgtgtactacctgtcgtcggcgcggcgtgcggccttgcgtggcggggtgaccacggagacgcggtacgaccggtggcgccacccgaacgagacgcggcccgcgtgccggtgggacataaccgacccggacgcgcatctcgatcacatcgtcgtgctcaagaagcctgaccccgggctctgggacaggtctccaaggcgaaattgctgccgagtggtgtcttcgcccaaggatggcaagaacggggagaagacgatgaccatcgatgtaggcgtatgcagagaaggcgagttcagccaagtagccggagcgtgaactttcatatagagatagatgaagataggaagcttcaaattcttttcttttcttgcgcgaatccattcttcttgtagggcatgaactagtcgaaacacctctctttgcgcctcacgggcgtctagctgtaactgcagttcacaaaacgccagaaggccaggactagaagttttggccgggcgttccggcatggtgacggcagtcaacccgccgccctacgcgcaactagcgacggctacggtgcctagattttgggtatagtatgtgctaaacttggcctttttattatggaaacaaaatatttcagccttttgc

SEQ ID NO: 5231 - DNA, 1959 bp, Setaria italica
cacactccccggaggagagagagagagggaagcaggcaggaggtggcggtgcggagcaacacacggagaggaatgcgcgacccggtgtgaggctctctcgcccccagcgaaatcccaccgattctgaatccggcggcgaaatcgggcgcatcgcggcccggccggccggccagcggggaagtgtgggggcgacggagttgtgggggctgaggcggtgagggttgaggagcggcggcggccacggcgaccgggatgaagggagggggcgggaaggagacggtcaccgccaccctcctccgcttcctcctcctcctgctgctccctctcaccgctctctacttcttctacacgctccacctcctcctcacctccgcctcctcgtcggccgcctccaactgcatgcctgactccaccgctgccgccgccaccaccgcctccgtatcggtgtcccggatgtccgccaacctcacggcggcggcggtggaggcggagaagcggcccaccgccgccgccgcggcgtccacggcgacgacgctgcagcacgtggtgttcggcatcgcggcgtcgtcgcggttctgggacaagcgcaaggactacatcagggtgtggtggcgcccccgcggcgccatgcgcggctacgtgtggctggaccgcgcggtgcgcgagtccaacatgtccaccgcgcggacggggctcccggccatcaggatctcgtccgacacctccgccttcccctacacgcaccgccgcggccaccgctccgccatccgcatctcccgcatcgtctccgagacgttccgcctcggcctccccggggtgcgctggttcgtcatgggcgacgacgacaccgtcttcttccccgacaacctcctcgccgtgctcaacaagttcgaccaccgccagccatactacattggctccctctccgagagccacctgcagaacatctacttctcctacgggatggcctacggcggcggcggcttcgccatcagccgcccgctcgccgaggcgctctcgcggatgcaggacggctgcctccgccgctacccggcgctctacggcagcgacgaccggatccaggcgtgcatggcggagctgggcgtgccgctcaccaagcacccggggttccaccagtacgacgtgtacggcgacctgctgggcctcctcgcgtcgcacccggtggcgccgatcgtgacgctgcaccacctcgacgtcgtcaagcccctgttcccggacgcgaggtcgcggcccgcggcggtgcggcggctgttcgacgggccggtgaagctggacgcggcggggctgatgcagcagtccatctgctatgacggcgccaaccggtggacggtgtccgtggcgtgggggttcgcggtgctggtggcgaggggcgtaatgtcgccgcgggagatggagatgccggcgcgcaccttcctcaactggtaccggcgcgccgactacacggcgtacgcgttcaacaccaggcccctggcgcgcagcccgtgccagaagcccgcggtgtactacctgtcgtcgtcggcgcggcgcgcggccgagcgcggcggcggggagaccacggtgacgcggtacgagcggtggcgccacccgaacgagacgcggccggcgtgccggtgggacatcgccgacccggacgcgcatctcgatcacatcgtcgtgctcaagaggcccgaccccgggctctgggacaggtccccccggcgaaattgctgtagagtggtgtcgtcgcccaaggaggggaagaacggggagaagacgatgaccatcgacgtaggcgtatgcagggaaggcgagttcagccaagtagccggagtataaacttcattagacacacagatgaagataggaacattcagatttttttcttcttctttgcttgtagtacgaatctattcgtctcggagggaacgggtcccgtttcacggtttcagcgtctctttc

SEQ ID NO: 5232 - DNA, 2016 bp, Panicum virgatum
agaaaaggtgggcaaaagcgggcacgaaaaaccgaagcgctcgccgacccacccaccgaaccgatcccccacaccacaccacactccccggcctcggacccgagcggaggagagagagaagggggcgggaggaggaggaggtggcggcgcggagcgacacgcggagaggaatgcgcgacccggtgtgagcctctctcgccccctgcgaaatcccattgattttgattccgattccgccggcggcgaaatcgggccgggcggcgagcgggcaagttggggagggagcgacggtgttgttggggagggggtgagacggtgaggttgttgaggagcggcggccacggcgaccgggatgaagggagggggcgggaaggagacggtcaccgccaccttcctccgctccctcctcctgctcctgctccccctcaccgcgctctacttcttctacacgctccacctcctcctcgccaccgcgtcgccggccgcctccaactgcccgcctgactcctccgtgtcggtctcccgggcgtccgccaacctcacggccgcggcggaggagaagcgccccggttccgccgccgcggcgcccgcggcgacgacgctgcggcacctggtgttcggcatcgcggcgtcgtcgcggctctgggacaagcgcaaggagtacatcaaggtgtggtggcgcccgcgcggcgccatgcggggctacgtgtggctcgaccgcgccgtgcgcgagtccaacatgtccactgcgcggacggggctcccggccatcaggatctcctccgacacctccgccttcccctacacgcaccgccggggccaccgctccgccatccgcatctcccgcatcgtctccgagacgtcccggctcggcctccccggggtgcgctggttcgtcatgggcgacgacgacaccgtcttcttccccgacaacctcctcaccgtgctcaacaagttcgaccaccgccagccctactacatcggctccctctccgagagccacctgcagaacatctacttctcctacggcatggcgtacggcggcggcggcttcgccatcagccgcccgctggccgaggcgctcgcgcggatgcaggacggctgcctccaccgctacccggcgctctacggcagcgatgaccggatccaggcgtgcatggcggagctgggcgtgccgctcaccaagcacccggggttccaccagtacgacgtgtacggcgacctgctgggcctcctcgccgcccacccggtggcgccgctcgtgacgctgcaccacctcgacgtcgtcaagcccctgttcccggacgcgaggtcgcgccccgcggcggtgcggcggctgttcgacgggccggtgaagctggacacggcggggctgatgcagcagtccatctgctacgacggcgacaaccggtggacggtgtccgtggcgtgggggttcgctgtgctggtggcgaggggcgtaatgtcgccgcgggagatggagatgccggcgcgcacgttcctcaactggtacccccgcgccgattacacggcgtacgcgttcaacacgaggcccatggcgcgtagcccgtgccagaagcccgcggtgtactacctgtcgtcggcgcggcgcgcggccgaccgcggcggcggggagaccacggtcacgcggtacgagcggtggcgccacccgaacgagacgcggccggcgtgccggtgggacatcgccgacccggacgcgcatctcgatcacatcgtcgtgttcaagaggcctgaccccgggctctgggacaggtctcccaggcgaaattgctgcagagtggtttcgtcgcccatggaggggaagagcggggacaagaagatgaccatcgatgtaggcgtatgcagggaaggcgagttcagccaggtagcagcggtataagcttcattagatacagatgaagatagggggattcggattttttctttctttgtcttctttgcttgtacgaatctattcttctcggagggagggtatcagagagtcttcgtttcagc

SEQ ID NO: 5233 - DNA, 2053 bp, Zea mays
agccgtgccacagcatcggtcgtgcgacgaggcgtacgagccgcagcgtcggtcatgcgacgtgcgcgggcggagcactctctggagagaaccgctcgccgacccacccaccgcactgctctcccacccaaatcgccgaccgataggagagaacccgagctgagaagagagagggcagcaggcggcggcgcggagtaacacgcggaggggaatgcacagcccgtgtgagcctctcgcccccgcgaaaccccaccgattctgattccgccggcgaaatcgggcgcctcgcggctcggccggctaagcggtggacggcggcgccgaggggctcgttcgacacggtggggtgagctcgtgaggagcagcagccacggcgaaggggatgatgaagggagggggcgggaaggagacgctcctccgcttcctcctcctgcttctccaccccctcaccgccctctacttcttctacacgctgcacctcctcttcacctcggcgtcgtcggccgcctccaactgcgcgcctgacgccgtctcggtctcccggatgtctgccaacctcacggcggtggcggagaagcaactgcccccttccgccgtggctgggtccacgtcgacaacgctgcagcatgaagttttcggcatcgcggcgtcgtcgcggttatgggacaagcgtaaggagtacatcaaagtgtggtggcgctcgcgcggcgccatgcggggctacgtgtggctggaccgcgaggtgcgcgagtccaacatgtccacggcgcgcacgaggctcccagccatcaggatctcgtctgacacgtccgccttcccctacacacaccgccgtggccaccgctccgccatccgcatctcccgcatcgtctccgagatgttctgcctcggcctccccggcgtgcgctggttcgtcatgggcgacgacgacaccgtcttcttcccggacaacctcctcaccgtgctcaacaagttcgaccaccgccagccctactacatcggctccctctccgagagccacctgcagaacatctaattttcctacgggatggcgtacggcggcggcggcttcgccatcagccggccgctggctgaggcgctcgcgcagatgcaggatggctgcctccgccggtacccggcgctgtacgacagcgacgaccggatccaggcgtgcatggcggagctgggcgtgccgctcaccaagcacctggggttccaccagtacgacatgtacggcgacctcctctgcctcctcgcgtcccacccggtggcgccgattgtgacgcttcaccacctcgacgtagtgaagccgctgttcccggatgcgaggtcgtgcccctcggtggtgcgacggctgttcgacgggccggtgaagctggacacggcggggctgatgcaacagtccatctgctacgacagcacgaaccgctggacggtgtccgtggcgtgggggttcacggtgctggtggtgaggggcataatgtcgcctcgggagatggagatgctggcgcgcacgttcctcaactggtatcgccgcgccgactacacgacgtacgccttcaacacgaggccgctggcgcgcagcccatgccagaagccggcggtgtactacctatcgtcggcgcgacacgaggccttgcgcggcggggagacgacggtgacgcgatacgagcggtggcgccatccgaatgagacgcggcccgcgtgccggtgggacataaccgacccggacgcgcatctcgatcacatcatcgtgctcaagaagcctgaccccgggctctgggaaaggtctccgaggcgaaattgctgcagagtggtgtcttcgcccaaggatgggaagagctgggagaagacgatgaccatcgatgtaggcatatgcagggaaggcgagttcagccaagtagcaggagcattagcttttattagagatagatgaagataggaagatttcaaattcttttcttcttcctttttcttgtacgaattcgttcctcttggagagtatgaacttgtatcgtttcaaatccctctttttgcatggtgctttgcacct

SEQ ID NO: 5234 - DNA, 1576 bp, Zea mays
ccacggcgacggggatgatgaagggaggggcgggaaggagacgctcaccgcctccttcctccgcttcctcctcctgcttctcctccccctcaccgcccctctacttcttctacacgctgcacctcctcctcacctcggtgtcgtcggctgcctccaactgtgcgcctgacgccgtctcggtctcccggatgtctgccaacctcacggcggtggcagagaagcagctgcccccttccgccgtggctgggtccacgtcgacaacgctgcagcacgaagttttcggcatcgcggcgatgtcgtggttatgggacaagcataaggagtacatcaaggtgtggtggcgccggcgcggcgccatgcggggctacatgtagctggaccgcgaggtgcgcgagtccaacatgtccacggcgtgcacggggctcctggccatcaggatctcgtctgacacgtccgccttcccctacacgcaccgccgcggcaaccgctccgccatccgcatctctcgcatcatctttgagacgttccgcctcggcctccctggcgtgcgctggttcgtcatgggcgacgacgacaccgtcttcttcccggacaacctcctcaccgtgctcaacaagttcgaccaccgccagccctactacatcggctccctctccgagagccacctgcagaacatctacttttcctacgggatggcatacggcggtggcggcttcgccatcagccggccgctggccgaggcgctcgtgcggatgtaggatggcagcctccgccggtacccggtgctgtacggtagcgacgaccggatccaggcgtgcatggcggagctgggcgtgctgctcaccaagcacctggggttccaccagtacgacgtgtacggcgacctcctcggcctcctcgcgtcccacccggtggcgccgatcgtgatgcttcaccacctcgacgtagtgaagccgctgttcccggacgcgaggtcgcgcccctcggcggtgcggcggctgttcgacgggccggtgaagctggacacggcggggctgatgcagcagtccatctgctacgacagcgcgaaccgctggacggtgtccgtggcatgggggttcacggtgctggtggtgaggggcataatgtcgcctcgggagatggagatgtcggcgcgcacgttcctcaactggtaccgccgcgctgactacacggcgtacgccttcaacacgaggccgctggcgcgcagcccgtgccagaagccggtggtgtactacctatcgtcggagcaacgcgaggccttgcacggcggggagacgacagtgacgcgatacgagcggtggcgccatccgaatgagacacgacccgcgtgccggtgggacataaccgacccggacgcgcatctcgatcacatcatcgtgctcaaaaagcctgaccccaggctctggtaaaggtctccgaggcgaaattgctgcagagtggtgtcttcgcccaaggatgggaagagcggggagaagacgatgaccatcgatgtaggcgtatgcagggaaggcgagttcagccaagtagcaggagcattagcttttattagagatag

SEQ ID NO: 5235 - DNA, 3207 bp, Oryza sativa
tttttttttttttttttcgaatttcgatccttagttgttttagcctatattaaaaattagagtattaatgttttatgatatgggcagggactagccattttttcttttagttcagcgctgagtttggtcatattatggtttgtttgtcatatccccttcaacggattgctggctggaaacacatcacatattggattgctttcggctcctaacattaaccttgagttatgacgtctagcaggcactggcgggtgcataactagctagtctaaacaccttttatgttaataaaaaaaatctccttagagcaggtacaatagcaggctattagccatccgtaaatatattttaatgagataaaggatgagagagaagggcagcgggctacaaatctatagccagctacagcacggactccaagtcataatgtgtgtatgacatgtggaactagatattaatagtattgtaagcaactatggtataaattggctattagattggctatagatgaattagagttagtagtggactatactattaaacttgggctatactattaaactttctcttatctatagaagatctatctaaattcgttaatatcattatccggtggctatatttcgaaaagaattaagtatacgcaacgaattttttttcgagggagtatgaatcgattttgacaggaaccgacgtcgttagcagcaaatccgcagcagcagccgcattaattaaacgatccgccattacccgcacaagcaccggcacgcgaaaataaaaaaggggaaaaagcgaacccaaaaaggccaaaaccgcggccctcccctccgccgagccacccgaccacccaaaccccaactcgccgaacggaggagaggtcgagagaaggaagagggaagagggaaacggagcaagacgaggccgaacgctttagcaaacacgcggagaaggagaatgcgcgcaacctcgcgcgccacgccgcccgtgtaaatctattggtgggattttcccttcggttccccaagaggcggaaggaagattggccggataagccggaggccacggaggggcggtgacgagcagagcggccacggcggccggaatgaagggcggcggcggtggcggcaaggaggccgtcaccgcctccatcctccggttcctcctcctgctccttctccccctcaccgccctctatttcttctacacgctgcacctcctcctcgcctccgccgcctcgtcatcctcctcctcctgcccacctgacgctgcctcctcctcctcctccgtgcgcttgtcgaccaatggcaccagcgcgggtgctgctgcggtgacggtggcggcagggaagaaggcccccgccgcggcctccacggagacgacgctgcagcatgtcgtgttcggcatcgcggcgtcgtcgcggttctgggacaagcggaaggagtacatcaaggtgtggtggcggccccgcggcgccatgcgtgggtacgtgtggctggaccgcgaggtgcgcgagtccaacatgtccacggcgcggacggggctcccggccatcaggatctcgtcggacacctcgggcttcccctacacgcaccgccgcggccaccgctccgccatccgcatctcccggatcgtctcggagaccttccgcctcggcctccccggcgtgcggtggttcgtgatgggcgacgacgacaccgtcttcttcccggacaacctcctcaccgtcctcaacaagttcgaccaccgccagccatactacatcggctccctctccgagagccacctgcagaatatctacttctcctacgggatggcgtacggcggcggcggcttcgccattagccggccgctcgcggaggcgctcgcgcggatgcaggacgggtgcatacgccggtaccccgcgctgtatggtagcgacgaccggatccaggcgtgcatggcggagctgggcgtgccgctcaccaagcacccgggtttccaccagtacgacgtgtacggcgacctcctcggcctcctcgccgcccacccggtggcgccgatcgtgacgctgcaccacctcgacgtcgtgcagcccctgttcccgaacgccaagtcgcgccccgccgcggtgcgtaggctgttcgacgggccgatcgagctggacccggcggggataatgcagcagtccatctgctacgacggcggcaaccgatggacggtgtcagtggcgtgggggttcgccgtgctggtgtccaggggagtaatgtcgccgcgggagatggagatgccggcgcggacgttcttgaactggtaccgccgtgccgactacacggcgtacgcgttcaacacgaggcccctggcgcgaagcccgtgccagaagccggcggtgtactacctctcatcggcgcggcgcgcggccgccctgcgcggcggggacaccacggtgacgcggtatgagcggtggcgccgcgccaacgagacgcggcccgcgtgccggtggaatatcgcggatccggacgcgcatctcgatcacatcgtcgtgctcaagaagcccgaccccgggctatgggacaggtctccaaggagaaattgctgtagggtgctatcttcgcccaaggaagggaagaagggaggggacaagacgatgaccatcgacgtgggagtatgcagggatggcgagttcagccaagttgtgtaatactgtaacctagccaaagtgaaataggatgattcaattttttttctcttctgttcttgtattcttctcggaagattacaaacttgtcatctcctgccgcgtcttcttttcgcctcacgagtcaccaactacaaagaactcgaaattttggccggaccttttccactatacatttgctgcccccacggctacgggccatggctactccggtccggtctacagtgacggaggcggggcacagaagagtgcactagtggatgctcagcgtgcttctgctgtgtatagtagactttgtgctgcagttgcagacttgcagtagtgctgtaaactgtggggctgcaacttggaccttgtgaaagcgcggcctagcattacgatttacgagctccatgtgaccacggcgcaggacagcagacaacagtcgccacgcgtcgtgggatggaaacggaaacgagggtctcgcctctgttctgggggcatggtctactcgtgaaatcttacccgcggcaatacatttcccccttcgtttt

SEQ ID NO: 5236 - DNA, 2192 bp, Triticum aestivum
ctcaatcccagtccaagccgctacgctagaacaagcgaagagagtgagattgagaaccagaagcagagcaacacgcggaggggatgggcgacctggcacactcccgtggctgctgcccacgcgacccgcccatgtaaatctcccaaatctcactcgccagaaccccactcccgataccagtcggtcagcataccccagtccccgccaaggacgaggcattgcgaggtcgggcccggcggcggcggcggcgcggagcagccacggcgccaggaatgaaggggggcagcggcggcggcaaggagtccgccaccggctccttcctccgcttcctcctcctgctcctcctccccctcaccgccctctatttcttctacacgctccacctcctcctcgcctccgccgcctcctcgtccgccgcctcctgcccgccggaccccaccgcggtctcctcccgcgtctccaccaaccgcaccgccgcggcggtggtcgacaataaggccgcccccgcggcggcggcggcgtccacggccacgacgctgcagcacgtggtgttcggcatcgcggcctcgtcgcggttctgggacaagcgcaaggagtacatcaaggtgtggtggcgcccgcgcggcgccatgcgcggctacgtctggctggaccgcgaggtgcgggagtccaacatgtccacggcgcggacggggctcccggccatcaagatctcctccgacacctccgccttcccctacacgcaccgccgcggccaccgctccgccatccgcatctcccgcatcgtctccgagaccttccgcctcggcctccccggcgtgcgctggttcgtcatgggcgacgacgacaccgtcttcttccccgacaacctgctcaccgtcctcaacaagttcgaccaccgccagccctactacatcggctccctctccgagagccacctgcagaacatctacttctcctacgggatggcgtacggcggcggcgggttcgccatcagcaggccgctggcggaggcgctcgcgcggattcaggacggctgcatcagccgctacccggcgctctacggcagcgacgaccggatccaggcgtgcatggcggagctgggggtgccgctgaccaagcacccggggttccaccagtacgacgtctacggggacctcctgggcctcctcgcggcgcacccggtggcgccgatcgtgacgctgcaccacctggacgtcgtgcagccgctgttccccaacgcgcccgcgcgccctgcggcggtgcggaggctgttcagcgggcccgtgaagctggacccggcggggataatgcagcagtccatctgctacgacggggcgaaccggtggacggtgtcggtggcgtgggggttcgccgtgctggtgtcgaggggggtgacctcgccgcgggagatggagatgccggcgcggacgttcctcaactggtaccggcgcgccgactacacggcgtacgcgttcaacacgcggcccctggcgcgcacgccgtgccacaagccggccgtgtactacctgtcgtcggcgcgcagcgcggaggccgcccgcggcggggagacaacggtgacgcggtacgagcggtggcgccccgcgaacgagacgcggcccgcgtgccgttggaacatcaccgacccggacgcgcatctcgaccacatcgtcgtgctcaagaggcccgaccccgggatatgggaccggtcaccgaggaggaactgctgtagggtgctgtcgtcgccgaaggtggggaaggaggggaagaagacgatgaccatcgacgtgggcgtgtgcagggacggcgagttcagccaagtagtctaggtctagcctagcctgttaggagaacactgtaggacgattcaatattttttttctctcttcttgtattcttgctggaaggtataacaaacgagagcctcgttcggtcatctcctgcctgcgtacctaccgtgctggtgctttgcgcctcacgggccatcaccaggcacgagaaggactcgaagctgtggccggacttcctcagcatcgtgccactgctgcccccacaacagttgaaggggacgtggcatggcatgcatgaatgcaggcgggttcgctgtgctaaaaggcgtgtggggctactgggatttggacttggggaaagcttggcttcagcctttggtggcaagatccaggcgttcggcc

SEQ ID NO: 5237 - DNA, 2139 bp, Hordeum vulgare
caggcaggcaggcagtgcagcaccggcacgggagaaacctcgaaaaggcgccgccccacccaccccaccgcacccgaaacccccactcaatcccagtccaaggccaagccgatgctagaacaagagagaaggagaagagagtgagacagagattgcggcgagggagagatagatacacaaggaagggaaccagaagcagagcaacacgcggaggggatgggcgacctggcacactcccgtggctgctgcccacgcgacccgcccatgtaaatctcccaaatctcactcgccagaaccccactcccctccccgatacctgtcgcggtcagcatatcccacccggaccgccgaggaaggaagaggaggtcagcattgcgaggtcgggcacggcggcgccaggaatgaaggggggcggcggcggcggcggcggcaaggagaccgtcaccggctccttcctccgcttcctcctcctgctcctcctccccctcaccgccctctatttcttctacacgctccacctcctcctcgcctccgccgcctcctcgtcctccgccgcctcctgcccgccggactccgccgcggtcacctcccgcgtctccaccaaccgcaccgccgcggccgtggtcgacaacaaggccgcggcgtccacggccacgacgctgcagcacgtggtgttcggcatcgcggcgtcgtcgcggttctgggacaagcgcaaggagtacatcaaggtgtggtggcgcccgcgcagcgccatgcgcggctacgtctggctggaccgcgaggtgcgggagtccaacatgtccacggcgcggacggggctcccggccatcaagatctcctccgacacctccgccttcccctacacgcaccgccgcggccaccgctccgccatccgcatatcccgcatcgtctccgagaccttccgcctcggcctccccggcgtgcgctggttcgtcatgggcgacgacgacaccgtcttcttcccggacaacctgctcaccgtcctcaacaagttcgaccaccgccagccctactacatcggctccctctccgagagccacctgcagaacatctacttctcctacgggatggcgtacggcggcggcgggttcgccatcagcaggccgctggcggaggcgctcgcgcggattcaggacggctgcatccgccgatacccggcgctctacgggagcgacgaccggatccaggcgtgcatggcggagctgggggtgccgctcaccaagcacccggggttccaccagtacgacgtctacggggacctcctgggcctcctggcggcgcacccggtggcgccgatcgtgacgctgcaccacctggacgtcgtgcagccgctcttccccaacgcgcccgcgcggccggcggcggtgcggaggctgttcaacgggcccgtgaagctggacccggcggggataatgcagcagtccatctgctacgacggggccaaccggtggacggtgtcggtggcgtgggggttcgccgtgctggtgtcgaggggggtgacctcgccgcgggagatggagatgccggcgcggacgttcctcaactggtaccggcgagccgactacacggcgtacgcgttcaacacgcggcccctggcgcgcacgccgtgccacaagcccgccgtgtactacctgtcgtcggcgcgcggcgcggaggccgcgctcggcggggagacaacggtgacgcgctacgaccggtggcgccccgcgaacgagacgcggcccgcgtgccgttggaacatcaccgacccggacgcgcatctcgatcacatcgtcgtgctcaagaggcccgaccccgggatatgggaccggtcgccgaggaggaattgctgtagagtgctgtcgtcgccgaaggtggggaaggaggggaagaagacgatgaccatcgacgtgggcgtatgcagggacggcgagttcagccaagtagtctagcggactagcctgttaggaaaatactgtaggacgattcaatatcatttttttctctcttcttgtattcttgctggaggtacgtataacaaacaagggcctcgtttggccatctcctgcctaccgtgctgctgctttgagcctcacgagtcaccaggcacgagaagaactcgaagctttggctagactt

SEQ ID NO: 5238 - DNA, 2229 bp, Brachypodium distachyon
cgcaagagaaaaggcggacctagatatagaaccaggccccctccccaccgtcagccgcccaactacccaccccaccgcacccagcagcagagggggcggcgagaaaatcccactcacttaacttggaagaagagaagagaagggagtgagatactagatttagcgcaagaaccagaacccagagcaacacgcggggggaatgggcgacctggcactctcccgcggctgaccacgcacccccgcccgggtaaatctccaagcccccaactcctttccagactcgatcgatacctgtcagtccacccgccggctgaggaggcagtagagtaggaggaggactatttgccgccgaccgatttgtaaggaagtcgtcgaatacggcggcgggcggcggcgagcagcagcagccacggcgccaggaatgaagggcggcggcggcggcggtaaggagaccgccaccggctccttcctccgcttcctcctcctgctcctcctccccatcaccgccctctacttcttctacacgctccacctcctcctcgcctccgccgcttcctcttccgcgtcctcgtcttcctcctcctgcacgcccgattccctcgccatctcccgccgtaccttcaccaaccgcaccgcgtcggagaatgacaaggccgcccccgccgccgcggccgcggcgtccatggcgcccacgacgctgcagcacgtggtgttcggcatcgcggcgtcgtcgcggttctgggacaagcgcaaggagtacatcaaggtgtggtggcggccccgcggcgccatgcggggctacgtgtggctggaccgcgaggtgcgagagtccaacatgtccacggcgcggacggggctcccggccatcaagatctcctcggacacctccgccttcccctacacgcaccgccggggccaccgctccgccatccgcatctcccgcatcgtctccgagacgttccgcctcggcctgcccggggtccggtggttcgtcatgggcgacgacgacaccgtcttcttccccgagaacctcctcaccgtgctcaacaagttcgaccaccgccagccctactacatcggctccctctccgagagccacctgcagaacatctacttctcctacgggatggcgtacggcggcggcgggttcgccatcagcaggccgctggccgaggcgctcgcgcggatccaggacggctgcatccgccgctacccggcgctctacggcagcgacgaccggatccaggcgtgcatggcggagctcggcgtgccgctcaccaagcacccgggcttccaccagtacgacgtctacggcgacctcctgggcctcctcgccgcgcacccggtcgcgcccatcgtgacgctgcaccacctcgacgtcgtgcagccgctgttccccagggcggcgtcgcgcccggcggccgtgcggaggctcttcaacgggcccgtgaggctggaccagtcggggataatgcagcagtccatctgctacgacggcgccaaccgctggacggtgtcggtggcgtgggggttcgccgtgctggtgtccaggggcgtcacctcgccgcgggagatggagatgccggcgcggacgttcctcaactggtaccggcgcgccgactacacggcctacgcgttcaacacgaggcccctggcgcgcaccccgtgccacaagcccgccgtgtactacatgtcgtcggcggcacggagcgcggcgggcgcgggcggcggggagaccacggtgacgcgctacgagcggtggcgccccgcgaacgagacgcggcccgcgtgccgttggaatatcaccgacccggacgcgcatctcgatcacattgtcgtgctaaagaagcccgacccagggatttgggaccggtcacccagaagaaattgctgtagggtgctgacgtcgcccaaggagggtaagaagacgatgaccatcgacgtgggtgtatgcagggaaggcgagttcagccaagtagtctaggcagaggaaaataggactattcaattttttttccctccacttgtattattcttcttggaagataacaaacgagcctcgttggtcatctccggccgtgctgttttgcgcctcacgagtcacataggtagaagaagaactcgaagttttggccggacttgattttcggtcacatcattgctgctcgcctgccccaatgcgccgcgtctactccggtctcgtgttcggagctgacggcgacggggctg

SEQ ID NO: 5239 - DNA, 1785 bp, Zea mays
gctccctcctccctcctccctctctcttgtcttctcccttgcggcgatccggattccgccgcaacggcccctctcgccttctccctcgcggcgctcgatccctccggattggcgcgtggaggggacagtggtttagaggagagaaacaagtgccgattgacaccaatagggtattcttaccattttcagatcagctggttcaacaaaactagtaaagatggcatcagaagggaacaaagacgtacctcatgaagctttgaccgtggatcactcatcgatttcgggttcaaagcgcaagcgtggccgcccaaggaaatatgagtatcctgtaaatgaactaccacagaaggtacagcccatccagagcgccccacctcttcttcactgcacacaagatggctcaagtctggccagccatgcatctggtggcggtgctcatggtaattggtccgctcaacctaggaattcagctaatgcttctcttcaaggtaattctggcaaagatgactttcttggcaagcattttgtgggcaagctgaccaagaaagttcctgggttttcgctcattacggtaaaagtgaaggacaatcaggtgctcaaaggttgggttccagatgaaattaatctccgcccaataacacctaaggatgaccttgccccagagctacccatgctgcgaccgagtcaagttcgaaagcgagcatcagcgatccatatgcaacctgctcttcctgtgccaatgcacttggagaatgttacacttgcaaagcctctgcagatgaggagacctgttgagaaaactattgctaagcatgctgtgcctcttgcttctaggccttacattagttctggtgttgttgcagcaatacctatatcggttgctcccatcaatcctgaaatgagaacttcggccaggcaggatgctgaacttgtgatcccacaatcatcagtttctgcagtgccaataaaatttgtttgtcctgcctcggtaccatgcaagcaactggctaatcaaaatgagtttactggaaataagtctgttgatgaggttcagaaagattcggaatctccaaatgtaaccaaggaatcaccagtgaaagctgaaaaaccaaacattgctcttgtggatgtagtggccaaggattctctaggggaagggcaacaacttaatgatcaagtaacggatgtagttagggatttttctggtcaaactcaaaatgttgatgtgacaatgtctgatgagatcaagatagcatcaggtgccagagataagccaaattctgcaaattgtgaacagcagagttctaaggaaccatcagacatcacagaacaatctgagcagctcaagacagagaccgatgtccagaaaggagttgatgcctcagatgacattcatcctgcgcatgatgaacaataaatcaaggttgtcggtaagtgaaaatagagatcaagattcaacgaacacaacacagatcctgatgtttagtggaagtttgctgcctgtaatgtttctgtcaggcttattgggatgtggagctggaattttagcatggaccaatgctttaggtgtataggtgagagattaagtagagttacataaacccaaaaaaaatcacctaggacgtagcagttatagcacagagagaatacttgatggacttctcatttttaggaagatgacccggcttaaagttattttgaactcctggtcttgtaatatgcctttttaatattttaagctctattcacagacatatggaaacatgatgctatacaggaaaactt

SEQ ID NO: 5240 - DNA, 1262 bp, Zea mays
tccactccgctccatcctcactccctcccgatgccttccacttccctcgccgtccccaccggcgccgtcggcgtcgccggctctcgccgctatccattcatcagcaaccgatcagcctcaagcgccccgcgcctccgccgcgcgccccggctcgtcatggtctccgcctcggcgtctctcgaggccctcatctttgattgcgacggcgtcatactggagtcagagcacctccaccgccaggcctacaacgacgcgttcgcgaacttcggggtgcgctgcccgccgggctccgccgacctgctgtactgggacgaggccttctacgacaacctacagaaccgcatcggcggagggaagcccaagatgcggtggtactttggggaaaatgggtggcctccttcaaagatctttgagacaccaccttcgactgactctgataaggagaagctggttgatataattcaggattggaaaacagagagatacaaagaaataataaactctggaactgtgaagcctagacctggtgtcttgcagttgatggatgaagtaaaggatgcgggtatcaagcttgctgtttgctctgcagcaactaaaagttcagtcataatgtgccttgaaaaccttattggacttgagcgatttaatggcctggattgcttccttgctggtgatgatgttaaactaaagaagcctgatccaacaatatatataacagcatcagagaaattaggtgtggaaagcaagaactgccttgtggttgaggatagtgtcattggattacaggctgcaaaaggagcaggaatgtcatgtataataacatatacaccttcaactgctagccaagatttcaaggatgcaattgctacctatcctgaccttaataatgtcaggcttgaggacctcaagctattactccagaaaactcttgttactggatagcaaagtgtcttgttttccccaaagaatacattgaaaattttcttgatgcatgataatccacgctattattccctggatgttgaacagttggtgatgagtgttgaacagtagatgaatccaaacatacatcttgttgaacagttggtgctggatggtggaaggcatgattactcagatagataattaatgcaactagaaagatagatagttacgattgttaaaacttttgttgtgaagagtgatacaattgttgtgtatcgaaaaacaattttatcttacattttggagagaaaaattattatctcggggtgcccctcaca

SEQ ID NO: 5241 - DNA, 1604 bp, Panicum virgatum
acatcgtaaatataggtagagagaagaccatttacgaatatgcacaagattccctcccctcaaaattcgacaagtaagaaagaaacgaaggcgagaagcgctagataagcggccgttctcgaaccaaccccgcctactccagctccagtccgtccatccgatgcctccgactacgatggcttccacctcgctcttcctccccaccaccgccggcgcggccaccgctcgccgccaccccttctccagcctccgcaccacccactatcaggtgcccagcacacgcctccaccgcgcaccccggctcgtcgtcgtctccgctgcggcctcaccggcctcgcccgcgtcgtcgctcgacgcgctcatcttcgactgcgacggcgtcatactggagtccgagaacctccaccggcaggcctacaacgacgcgttcgcgcacttcggggtgcgctgcccgccggcctccgccgacccgctgtactgggacgaggccttctacgacgagctacagaaccgcatcggcggcgggaagcccaagatgcggtggtactttggggaaaatgggtggccttcttcaaagatttttgagacgccaccttcaactgactctgataaggagaagttggtcgacataattcaggactggaaaacagagagatacaaagaaacaataaagtctggaactgtggagcctagacctggtgttttgcggctgatggatgaagtaaagggtgcgggtatcaagcttgctgtttgctctgcagcaactaaaagttctgtgataatgtgccttgaaaaccttattgggcttgagagatttaatggcctggattgcttcctcgctggcgatgatgttaaactaaagaagcctgatccaacaatatatattacagcagcagagaaattaggtgtagaaagcaagaactgccttgtggtggaggacagtgttattggattactagcggcaaaaggagcagggatgtcatgtataataacatatacaccttcaactgctagccaagatttcacggatgcaattgctacctatcctgacctgagtaacgtgaggcttgaggaactcaagctgttactccagaaaactcttgttactggatagtaaaacgttttgttttcctcaagagatacattgacatttttttttatgcacggtaagccatgatgtcattccctggtggaacagcaggtgaatccaagcaggcatcttgttgaatagttggtgttggatgtaggaacccatgcttggttcctcagatatgtcatctgatacttcaaaccctgtccgtccgcgtttgctggttgcgtgcataggatgattaatgtaatcagcaagccgtcaaatagtgagttgcaattgttgaaacttttgttgtcgaatgaaataaaattgtcaaaatatatcgttgtattgaaaaagataaaatgtttcccgcacacatcaaaagtgatagaacctactctctttattagctgactagtagttgttttggtttgtggcttctttattttgcttcattacaaggttagaccaagctgacatgtacttattattgacaattacttgatatcctgaacatttggagtttagt

SEQ ID NO: 5242 - DNA, 1218 bp, Panicum virgatum
agaaacggcggcgagaagcgccagataagtaagcggccgttctcaaaccaatcgcgcctactccagtccatccatccgatgcctccgactgcgatggcttccacctccctcttcctccccaccgccgccggcgcgtccaccgctcgccgccgccccttctccagcctccgcaccccctatcaggtgcccaccgcacgcctccaccgcgcaccccggctggccgtcgtctccgctgcggcctcaccggcctcgcccgcgtcgtcgtcgctcgacgcgctcatcttcgactgcgacggcgtcatactggagtcggagaacctccaccggcaggcctacaacgacgcgttcgcgcacttcggggtgcgctgcccgccggcctccgccgacacgctgtactgggacgaggccttctacgacgagctacagaatcgcatcggcggcgggaagcccaagatgcggtggtacttcggggaaaatgggtggccttcttcaaagatttttgagacaccaccctcggctgactctgataaggagaagttgatcgacataattcaggactggaaaacagagagatacaaagagataataaagtctggaactgtggagcctagacctggtgttttgcagctgatggatgaagtaaagggtgcgggtatcaagcttgctgtttgctctgcagcaactaaaagttcagtgataatgtgccttgaaaaccttattgggcttgagcgatttaacggcctggattgcttcctcgctggcgatgatgttaaactaaagaagcctgatccaacaatatatattacagcagcagagaaattaggtgtagaaagcaagaactgccttgtggtggaggacagtgttattggattactagcggcaaaaggagcagggatgtcatgtataataacatatacaccttcaactgctagccaagatttcacggatgcaattgctacctatcctgacctgagtaacgtgaggcttgaggacctcaagctgttactccagaaaactcttgttactggatagtaaaatgttttgttttcctcaagaaatacatcgacaattattttatgcacagtaagccatggtaagtttgttgctatatctatgattcattttcactattagagattcctatctggtattgcatctgtcaacaatatatttgtaatattttagtgtgggttaatttatacgcagacatatgcaaaa

SEQ ID NO: 5243 - DNA, 1300 bp, Setaria italica
ccactccagtccatccatccgatgcctccgactacgatggcttggacctccctcttcctccccaccaccgccggcgccaccgccgcggccaccggtagccgccacccctccttcagccaccgatcccactgccgcgttcccatgacgcgcctccgtcgcgcgccccggctcgtcgtttccgcttcagcctcaccggcctctcccgcgtcgtcgctcgacgcgctcatcttcgactgcgacggcgtcatactggagtcggagcacctccaccggcaggcctacaacgacgcgttcgcgcacttcggggtgcgctgcccgccggcctccgccgacccgctgtactgggacgaggccttctacgacgagctacagaaccgcatcggcggcgggaagcccaagatgcgatggtactttggggaaaatgggtggccttcttcaaatatcttcgagacaccaccttcgactgactccgataaggagaagttggtcgacataatccaggactggaaaacagagagatacaaagaaataataaaatctggaactgtggagcctagacctggtgttttgcggctgatggatgaagtaaagggtgcgggtatcaagcttgctgtttgctctgcagcaactaaaagttcagtgataatgtgccttgaaaaccttattggacttgagcgatttaagggcctggactgcttccttgcaggcgatgatgttaaactaaagaagcctgatccaacaatatatgttacagcagcagagaaattaggtgtgcaaagcaagaactgccttgtggtcgaggacagtgttattggattactagcggcaaaaggagcggggatgtcatgtataataacatatacaccttcaactgctagccaagatttcacggatgcaattgctacctatcctgaccttagtgatgtgaggctcgaggacctcaagctgttactccagaaaactcttgttactggatagtaaagcatcttgttttcctcaagaaatacattgacagatttttttcgtgcatgataaactttgtggtcattccctggtggaacagcagggtgaatccaagatgacattgttgttggatgtaggaacacttgattaatcagatatgtcatgtgatactgcaaaccttgcccacgttgttggttgctgtgcataggatgattaatgcaaccagaattttttaccatccttacgaacggtcaatattcaaatgccaattttagaaatgctcctacatatttgccatgggaaagagaagaattcttatatttttaccaaattcgca

SEQ ID NO: 5244 - DNA, 1323 bp, Festuca arundinacea
  misc_feature (987)..(987): n is a, c, g, or t
  misc_feature (1230)..(1230): n is a, c, g, or t
ggcacgagggcaatctcgaaccattcgcgcctattcgttccatctcctgatctccgttcgaatatccgatgcctccaatggcttccacttcccttttcatcccggcatccttcgccccggccaccgcagtcgcctcagctcgccgcagcttctccagccaccgctcctctccctccaccgtcccctcggtccgcctccgccgtgcgtcgtcctcgctcgtcgtctttgcctcggcttccccgccgcggtcgctcgacgccctgatcttcgactgcgacggcgtcatactggagtcggagcacctccaccggcaggcctacaacgacgccttcgcgcacttcggtgtccgctgcccgcccgcggccaacgcgccgctggactgggacgaggccttctacgatatcctccagaaccgcatcggcggcgggaagcccaagatgcgatggtactttggggaaaatgggtggccttcttcaaatatatttgagacaccgccttcaagcgactcagataaggagaaattagttgacattattcaggactggaaaactgagagatacaaagaaataatcaaatctggaactgtggagcctagacctggtgttttgcggctgatggatgaagttaggggtgcgggcatcaagcttgccgtttgctctgcggcaactaaaagttctgtggtgttgtgccttgaaaaccttattggacttgaacgattcactggtctggactgcttcctcgccggtgatgatgttaaacagaagaaacctgatccatcaatatatgttacagcagcaaagaaattaggtgtggaaagcaaaaactgccttgtagtagaagacagtgtcattggactacaagcagcaaaaggagcaggcatgtcatgtataataacatatacaccttcaactgctaaccaagatttcaaggatgccatagcaacctatccagaccttagtaatgcgaggcttgaggacctcaagctantgctccaagaatctctcatcactggatagtgaagtttcttgcttcctcaagaaaaacattgactgattttttcatgcagatacaccatggtaaatattcaaagtttcataattagtcatcttcgtttggcctcctggcatcttcagatcaactgaaatatttgggaacaaagattaagtgaggacattctggtacattctttgggaatctcagcgtagtttgtaaataaaggcggattcaacntttgtttcagctgaagtggatggtacagctggtgaacccaaatgttgaaccgtcgattggaagatacatatatacaacaaaacattatactta

SEQ ID NO: 5245 - DNA, 1586 bp, Triticum aestivum
gtttccctcctctcatacgcgataagaaagacaccacggcttaaaagtggcgggtagataagcagccattctcgaaccattcgcgcctattccgttccatccgctgatctctgttcgcatcaccgatgcctcccatgggcatggcttccacttcccttctcgtccccacctccttcaccccggccgccgtcgccgccacggctcgccgcagcttcttcagccaccgccccccttccagcctccccgcggtccgcctccgcctcccccgtacgtcctcgctcgtcgtctccgcctcggcttccccgccgcggtcgctcgacgccctcatcttcgactgcgacggcgtcatactggagtcggagcacctccaccggcaggcctacaacgacgccttcgcgcacttcggggtccgctgcccgcccgcggccgacgcgccgctgtactgggacgaggccttctatgacgacctccagaaccgcatcggcggcgggaagcccaagatgcgatggtactttggagaaaatgggtggccttcttcaaagatattggagacagcaccttcaagcgacgaagacagggagaagttagttgacgttattcaggactggaaaacagagaggtacaaagcaataatcaaatctggaactgtggagcctagacctggtgttttgcggctgatggatgaagttaagggtgcgggcatcaagcttgctgtttgctctgcggcaactaaaagttcagtggtgttgtgtcttgaaaatcttcttggacttgaaagattcaatggtctggactgcttcctcgccggcgatgatgttaaagtgaaaaaacccgatccatcgatatatattacagcagcaaagaaattaggattagaaagcaagaactgccttgtggtagaagacagtgtcattggactacaagcagcaaaaggagcagggatgtcatgtataataacatacacaccttcaacttctaaccaagatttcaaggatgcaattgcaacctatcctgatctcagtaatgtgaggcttgaggacctgaagctactgctccaagaatctctcgtcactggatagtggaatttcctgctttcggcaggccttattcggttggtggcgatccaatccacagaggggttgggtgatcccgcccctcacccaatccccgctaattcctccacacacacaatccctctactaaatcactgctcggttaaacctcttgcccctcggggagatttgaattgtgcatagctgttacaatgcagcggcaacagtaaaatatttggagtcacagcttacaacagcgacatgccaaactgaatttacagtagaacacatgtactgacaggggcacatacccagcatttcatacgcagagaaagtgatttgaaaaggaaagtgaaaaaaaaaaaacttaacattgcagctgttgctgatgtttccagctgattacggtgatactgtttgcagtgaatcatgatcaatctgttgaggcaatgttaagtctgttgtcacgcaaccactatcatctcattctcagcagtcaattttccacttccgagccgctctctcccgagaaac

SEQ ID NO: 5246 - DNA, 1614 bp, Brachypodium distachyon
ctgaatttagcatttcatatctgctccgtttccctcctctcgtacgcgataagaaaagggaaagagataagcagccactttactcttgaaccattcgcgcctattccgtccccctccatctcctgatctctattctccaatggcaccaatggcgtcgacatcccttctcacccccgtctccttccccacggccgccgccacagctcgccgcagcttctccacccaccgctccccctccggcgccctcccccgcctccgcctccgcccccgctcccgccgcgcgtccgggctcgccgtctccgcatcggcggcctccccgccgctgtcgctcgacgccctgatcttcgactgcgacggcgtcatacttgagtcggagcacctccaccggcaggcctacaacgacgccttcgcgcacttcggggtccgctgcccgcccgcggccgacgcgccgctcgactgggacgaggccttctacgacgacctccagaaccgcattggcggtgggaagcccaagatgcgatggtactttggggaaaatgggtggccttcctcaaagctatttgagacgccaccttctagcgactccgataaggagaagttagttgacattattcaggactggaaaacagaaagatacaaagaaataatcaaatctggaacggtggagcctagacctggtgttttacgtctgatggatgaagttaagggtgcgggcatcaagcttgctgtttgctctgcggcaactaaaagctcagtggtactgtgcctagaaaaccttattggacttgaacgattcaatggtctggactgcttccttgctggcgatgatgttaaactgaagaaacctgatccatcaatatatattacagcagcaaagaaattaggtgtggaaagcaagaactgccttgtagtagaagacagtgttattggactacaagcagctaaaggagcagggatgtcatgtataataacatatacaccttcaactgctaaccaagatttcaaggatgccattgcaacctatcctgaccttagtaatgtgaggtttgaggacctcaggctgctgctccaagaagctgttgtcactggatagtgcagtttcttgctttcctcaggaaatgcattgaccgttttttcatgtgtgatgcaccatggtcaatattcaagctgcattgttatccatcttatttgggcctcctggaatcttcaagacccaccaaagtatttgggaacaaagatcaagtgagcatactccggtacattaattcttcgtgaatctcggtatactttgtaaataaagacggagcaaacatttgtttcggctgcggtggttggtagtactgctggtgaaccaaaggctgtcattttgttgaatacttaatggttgatgttagatacagacaaaaaatatactttgattaccaatggatattagcttccaaaacattggccagactgctctattgtgcataggatgtttcaagcaactagcaagtggtcaactacaggctgcaactgctggggaaccaatgttgtgtgaagtaaaaatacaattgttggcacaaaatattttcttaaagtgaagaaggttatatgattttgcttatgcggtcg

SEQ ID NO: 5247 - DNA, 505 bp, Sorghum bicolor
ccatggatatactgctaggttccgggagattcttggcgcgacggcttcctcccctcgcgctcgtccctcgctgctctcgaggctccccggacaaaagcggcagcgacaaaggtaagcacaacctctactgactgggacaaggcatgggctagctttaagaataaagggaagaggaccctcttttctgatttctcaccaaacaagtacgtgacctggaacccacggcgcagcgagtatccattgtcagaagaggttgatccaatcaagagaactgaaagatctaacttgatgctgtggacaagtccccagtttaccttggtgggggcaattatcatcgtcttgacattactaatctatacactagttgttcctcccaagtaactgcagaggtgacagctaggaggtgagctgtaaactaatatttctactgggaagtatgtattgtacatttttacatgtattaaaccaactatagcagtattgcttcaattgcaatcaagtagat

SEQ ID NO: 5248 - DNA, 654 bp, Saccharum officinarum
gccgtagtgcggcagcgcagtacgactgtttttccgttcacgcaagcgcaccctgctcattggggtgtctcagatccccgccacgcctcctcgcccaccagtcgagataagaggaacagaaaccacgcggcgagaggaacacgagtgagtaaaaaaaaaaatctctgatcgagattcctgcccggctgatagaatctcggcagccagccccagccatggatatactgctaggttccgggagattcttggcgcgacggcctcccctcgcgctcgtccctcgctgctctcgaggctccccggacaaaagcggcagcgacaaaggtgaaacctctactgactgggacaaggcgtggactacctttaagaacaaagggaagaggaccctcttttctgatttctcaccaaacaagtatgtgacctggaacccacggcgcagcgagtatccattgtcagaagaggttgatccaatcaagagaactgaaagatctaacttgatgctatggacaagtccccagtttaccttggtgggggcaattatcatcgtcttgacattactaatatatacactagttgttcctcccaagtaactgcagaggtgacagctaggaggtgagctgtaaataaagatttcaactgggaggtctgtattgtaca

SEQ ID NO: 5249 - DNA, 725 bp, Pennisetum glaucum
gaatctgggatcgggaggcctgccaggctagtagaatcttgaaagggaggcaaccatggatatactgctaggatccgggagattcttggcgcgacggccgcccctcgcgctcgtccctcgctgctctcgaggcacgcctgataaaggaggcagcgacaaaggtgaaacttctacggactgggacaaggcttggtcttcgtttaagaacaaagggaagaggaccctattttcagatttctcaccaaacaagtatgtgacctggaacccacggcgcagtgagtatccattgtcagaagaggttgatccaatcaagagaactgaaagatctaacttgatgctgtggaccagtccccagtttaccttggtgggggcaattatcatcgtcttgacattactaatctatactttagttgtccctcccaagtaactgcagaagtggcagcttggaggtaagctgtgagacaagacttcaactgggaagtttgtattgtacattttgtgtgtactgtacaaattatataagtattgcttcaactgcaatcaattagtgtatggtagcacatccgttccattttggaggtttttcttcacttctatattcagtggttgctcttgggaagaatattaaatatttgggtcaggtagaataatgatatgttgaatgatatcatgatatgttgatcagtattcaataatcatagttcatgtcgatgctcctgaaaaaa

SEQ ID NO: 5250 - DNA, 678 bp, Triticum aestivum
gacctggagttcggtgctagctgctcctccgtcgccactcaacacaacggcacctactgcatctcctccaacgcgccgttggagttggagtcgcactctcctttccctcaatcgcgcccaggcctagtggtgccgtagtgcggcagtgcagtacgactgttctcgcaccttccgttcacgcaagcgcaacctttgctcctgtcgttgtctcagaacccctgcgccacgcctcccccctgcaaccgggataagaagaagggaaaagaaaatctctgatcgagattcctgcccggctgatagaatctttggcagccacatccatggatatactgctaggttccgggagattcttggcgcgacggcttcctcccctcgcgctcgtccctcgctgctctcgaggctccccggacaaaagcggcagcgacaaaggtgaaacctctactgactgggacaaggcatgggctagctttaagaataaagggaagaggaccctcttttctgatttctcaccaaacaagtacgtgacctggaacccacggcgcagcgagtatccattgtcagaagaggttgatccaatcaagagaactgaaagatctaacttgatgctgtggacaagtccccagtttaccttggtgggggcaattatcatcgtcttgacattactaatctatacactag

SEQ ID NO: 5251 - DNA, 1451 bp, Setaria italica
cacgcaagcaacctgctcatctcgctgtcccagaaccgcgcggctctacctgccacgcctcttcctaggccaccagcctccactgcaaccaggataagacggggccgcgcggcgaaagaaacgggactgaagaaagaatctgggatcgggaggcctgccaggctagtagaatcttgaaagggaggcagccatggatatactgctaggatccgggagattcttggcgcgacggccgcccctcgcgctcgtccctcgctgctctcgaggcacgcctgacaaaggcggcagcgacaaaggtgaaacttctacggactgggacaaggcttggtctacatttaagaacaaagggaagaggaccctattttcggatttctcaccaaacaagtatgtgacctggaacccacggcgcagtgagtatccattggcagaagaggttgatccaatcaagagaactgaaagatctaacttgatgctgtggacaagtccccagtttaccttggtgggggcaattatcatcgtcttgacattactaatctatacgatagttgtccctcccaagtaactgcagaagtggcagctaggaggagctgtaagccaagacttcaactgggaagtctgtattgtacattttgcgtgtactatacaaactatagaagtattgcttcaattgcaatcaattagtatataatagcacatccgttccattttggaggtttttcttcactcgtatattaaatggctgctcttgagtcttgattcttcactcgtatagcgaagaaatatttgggtcaggtagaataatgatatgttgatcagtattcaataatcatagtccatgtcgatgctcctgatgtgagttttgtgtattctcagtaactgcaatgtgtgatcaccaaatattagctgtattaataagtggcaggtagtttgtagtgttgggactgcttgggcaagtggacatgtgcaaaatttcagttagaaactgatggagcccatgagaatcacgtttctcattacagacaaattcaagtcaaagacgacagatcattttcttcttacaataataagccctaggcagacaggaatcttgcttagatgtaaagcaatgtaacaaacttttcctaggccccagataattggcatatgtctcttgtattggaggcaccagatggggtgtctcaacatcctgttgagtacatagagaaatgcaattctaaataacatgttagggctctcaagttatcttcagtgacttggtcgttgcatctttctattcagcatcttggatctagtcaaacagtggttttcatccttcagacttgaatagtctccaagtttggactcccttatgggttgctgcagtgttggtctagtgaagagagattggtttgattctaaaatcaaagcctataagttttagcatttctaagacagtagaatgttgagagtat

SEQ ID NO: 5252 - DNA, 835 bp, Panicum virgatum
gacgacactacgactcgccttgcccccctcgcgttcacgcaagcaacctgctcctctcgctgtccaagaaacgcgcggctctcccctgccacgccgcctcctcggccaccagtctcccctgcaaccgggataagaagggaagggaagccgcgcggcgaaagaaacaggagtgacaaaaagaatctgggatcgggaggcctgccaggctaagtagaattttgaaagggaggcagccatggatatactgctaggttccgggagattcttggcccgacggcctcccctcgcgctcgtccctcgctgctcccgaggcaccccggacaaaggccccagcgacaaaggtgaaacctctaccgactgggacaaggcttggtccacatttaagaagaaagggaaaagaaccctattttcagatttctcaccaaacaagtatgtgacctggaacccccgacgcagtgagtatccactgtcagaagaggttgatccaatcaagagaactgaaagatctaacttgatgctgtggacaagtccccagtttaccttggtgggggcgataatcatcgtcttgacattactaatctatacgctagttgtcccacccaagtaactgcagaagtaacaactaggagtgggctgtagccgagacttcaactgcgaagtctgtattgtacattttgagtgtactataccaactatagctgtattgcttcaaatgcaatcaagtcgtgtataatatcacattcattccatttctgatatttggatcttgattcatccattgtaacggagaaatatttgggtcagtagaataataatatgttgatcagtattcata

SEQ ID NO: 5253 - DNA, 597 bp, Panicum virgatum
aaacaggagtgacaaaaagaatctgggatcgggaggcctgccaggctagtagtagaatcttgaaagggaggcagccatggatatactgctaggttccgggagattcttggcgcgacggcctcccctcgcgctcgtccctcgctgctcccgaggcaccccggataaaggccccagcgacaaaggtgaaacctctaccgactgggacaaggcttggtcaacatttaagaagaaagggaaaaggaccctattttcagatttctcaccaaacaagtatgtgacctggaacccccggcgcagtgagtatccagtgtcagaagaggttgatccaatcaagagaactgaaagatctaacttgatgctgtggacaagtcctcagtttaccttggtgggggcgataatcatcgtcttgacattactaatctatacactagttgtcccacccaagtaactgcagaagtaacagctaggagtgggctgtaagccaagacttcaactgcgaagtatgtattgtacatttcgagtgtactataccaactatagctgtattgcttcaaatgcaatcaagtcgtatataatatcacattcgttccatttctg

SEQ ID NO: 5254 - DNA, 1786 bp, Panicum virgatum
acatagtcgtctgaaaacatcattgctttcaggcacccaacatttagctgcacccttccgtataaacatttgtgttggaataatcgtgctagctgcaagcctgcaacccaaaggtaaacggtgtcagatcctgccaaatcagatcgataaatttcaagaaaaacaaatgattctaccaaacttcagcaaactctcagattttcgcagtttctcatctgaaaaacaacgaataggacactggagtttcccctgcgctgccgttgcccaaggcacggttctctcatacagtcagagccacacgctgcggcgcagcgcagtacgacactacgactcgccttgcccccctcgcgttcacgcaagcaacctgctcctctcgctgtccaagaaacgcgcggctctcccctgccacgccgcctcctcggccaccagtctcccctgcaaccgggataagaagggaagggaagccgcgcggcgaaagaaacaggagtgacaaaaagaatctgggatcgggaggcctgccaggctagtagtagaatcttgaaagggaggcagccatggatatactgctaggttccgggagattcttggcgcgacggcctcccctcgcgctcgtccctcgctgctcccgaggcaccccggacaaaggccccagcgacaaaggtgaaacctctaccgactgggacaaggcttggtcaacatttaagaagaaagggaaaagaaccctattttcagatttctcaccaaacaagtatgtgacctggaacccccgacgcagtgagtatccagtgtcagaagaggttgatccaatcaagagaactgaaagatctaacttgatgctgtggacaagtccccagtttaccttggtgggggcgataatcatcgtcttgacattactaatctatacgctagttgtcccacccaagtaactgcagaagtaactaggagtgggctgtagccgagacttcaactgcgaagtctgtattgtacattttgagtgtactataccaactatagctgtattgcttcaaatgcaatcaagtcgtgtataatatcacattcattccatttctgatatttggatcttgattcatccattgtaacggagaaatatttgggtcaggtagaataataatatgttgatcagtattcaataatcatagcccgtgtcgatgatcctggtttcgtttttgcatattctcggtgcaatgtgtgataataaaatattagctgtattaatcagtgacaggtagtttgtagtgttggaactgcttgggcaagtgggcatgtgcaaattttcggttagaaactgattgagcccatgcgaatcacgtttcttattacagacaaactcaagtcaaaaaggacagatcattgtgttcatacaataataagccctagacagacaggaatcttgcttagatgtaaagcaatgtaactaaccttgttttcaaggccctaaataattgccatatgtctgttgtgttggaggcaccaggatggcgtgtctcgaaatctttttgagtggatagagtaaatgcacttctaaataacatgtcagggatctcaccttatcttaagtggcttggttgatgcatctttatattcagcatcatggatcaagtcaaacagtggcgttttcaaccttcagacctacaatcccccaagttttgactctcttatgggctgttgcagacttgcagtgttggtctagtgaagagagactggtctgatactaaaattaaaaccaagtttcagcattttgaaggtggtagattgttgagagcat

SEQ ID NO: 5255 - DNA, 1068 bp, Zea mays
gttttatccgcagccacaagttttgctctgcgtctcccaagttcccgatctcggccgcgcgagtcagtgcaccccgtgcgtgatcaacaggtccttcctgctgccgcggccgcctcccacttcgactgctcccgcacctttcgttcacgcaagcgcaacctgcttctcccgctggctgtctcggacaccccctccctcctgccacgcatcctccccgcccacgagtctcccccgcaaccggataataaggaagaggaagagaaaccgtgcggtgcggcgaaaggaacagtgaaaaaggaagaatctctctgatcgaggttcctgtccggcttgcagaatcttggcggacagccatatatggatgtactgctaggttccgggaggttcttggcgcgacggcctcccctcgcgctcgtccctcgctgctctcgaggctccccggacaaaagcggcagcgacaaaggtgaaacctctgctgactgggacaaggcatggtctgccttcaagaagaaagggaagaggaccctgttttctgatttctcaccggacaagtacgtgacctggaacccacggcgcagcgagtatccattgtcagaagaggtcgatccaatcaagagaactgaaagatctaacttgatgttgtggacaagcccccagttcaccttggtcggggcgattatcatcgtcttgacattgctaatctatacactagttgttcctcctcccaagtaactgcagaggtgacaactactggggggggggggggggggtgagctgtaaactagtactatttcaactgggaagtctgtattgtacatttttacgtgtactatggcaactcactatagcagtattgattcaattgcaatcatgtagatacaacaccactgtccattccattctggaggtttttcttcaattgtgtgctaaatggctgctgtctgagtcttatattcacttgttataatgaagaaatatttggggtcaggtagaattatatgttggtcgactcctgatgtgtgtttctaaacagcaacttaccaatcctatctcccaccacatacatat

SEQ ID NO: 5256 - DNA, 557 bp, Panicum virgatum
gtagaattttgaaagggaggcagccatggatatactgctaggttccgggagattcttggcccgacggcctcccctcgcgctcgtccctcgctgctcccgaggcaccccggacaaaggccccagcgacaaaggtaagcgatctctaccgactgggacaaggcttggtccacatttaagaagaaagggaaaagaaccctattttcagatttctcaccaaacaagtatgtgacctggaacccccgacgcagtgagtatccactgtcagaagaggttgatccaatcaagagaactgaaagatctaacttgatgctgtggacaagtccccagtttaccttggtgggggcgataatcatcgtcttgacattactaatctatacgctagttgtcccacccaagtaactgcagaagtaactaggagtgggctgtagccgagacttcaactgcgaagtctgtattgtacattttgagtgtactataccaactatagctgtattgcttcaaatgcaatcaagtcgtgtataatatcacattcattccatttctgatatttggatctt

SEQ ID NO: 5257 - DNA, 1619 bp, Zea mays
atccagctcatggtatctgtccgactcaccaaatgttcagatcaaacatagagaaatatcaaatatcgggagccactaaatcctactagttaaagaatggttttacagagtgttgacatgctccgccaaattttaccagacctccacagcttcccaccttcccatttggaaaacaacgaactgcagtttccctgcactggcgttacccaaggcgtgacggatggtttctctcgtacagcgagagccacacacacactgcgacctcctaggcagtgagtgcagacgtgcagtatgactcctctcgctccttccattcacgcaagcgcaagtgcgcaacttgctgctctcgctgtctcagattccctgctacgccgcctcctccgcggctccgccaccagtctcccctgcaaccgggaatccgggataagaggaagagaaaccgcgcggcaaaaggaaaggagtacaggagcgagaaaagaatctctgaccggagtcctgccaggctgatagattcctggcagccatggatatactgctaggttctgggagattcttggcgcgacggactcccctcatgctcgtccctcgctgctctcgaggctcccgggacagaagcggcagcgacaaaggtgaaacctctgctgactgggacaaggcatgggctaagttcaagaagaaagggaagaggaccctcttttctgatttctcaccagacaagtatgtgacctggaacccacggcgcagcgagtatccgttgtcagaagaggttgatccaatcaagagaactgaaagatctaacttgatgctttggacgagtccccagttcacgttggtgggggcgattatcatcgtcttgacattactaatctacacactagtcgttcctcccaagtaactgcacaagtgacagctaggagcccacacggctctccagtccccagattcccgcgccttcctgagcaagaagacacccgcggcgacgatggagcggctgccgccgcaccaggagaaggcggcgaggcggacccttcctcggcgcgggcagatcaaggcgggcatcttcgcgagcctgttccggtgcatcgtcgcccccgaggcacccgcgcgcaaggaaggcggcacgaacaaagatggcagcagcagccaccaccgcggctgcaagaacaaagatggcggcagccaccgccgcgtctcccccggtggctgatgcggttcgaaggagtcaaggtataaataacagggagagttgacgatgtgggggttgcgatgatccccgttgtgaaacgctgcagcctgcggcgccggtcgttgaactcgcggagcggaggagggtcttcggggggtggtatcgggttagctgaatctgtataatggtatggggttcagagttcagacagggtcagggcagtgaattgtctggactttctgtggtcggatggggtctctgaactccggcttcagctggagtgctatgtaaatatgtaatgcacgctcttgtctgtgttctttagcggcaacttcagtgccttagccctttggtgtttcctttccaggtcaccactgtcttgtggatattattgctcttgttggttaatgaatcttctcagtgttcttacttc

SEQ ID NO: 5258 - DNA, 1286 bp, Zea mays
atggagaagagaaatcggattctcgacctgcaggacctcctctctgacgcggacttcggcccactactcgcccgacagctactgtctccgttcgtgcggcggccacctacctacctcgtagcaagacaccatatcttaagtgctgccatggatttgcacctagagctctacattggtcgccggcgccgcggcggaggcaagagtcagaagtaccctctcccatgggaggcaccgtgttccagctgctccacttctgtcggcttgatggagctcctgatggatggagaggagaggagctcgcccaacagccacaagttttgctctgcgtctcccaagttcccgatctcgtacccgcgcgagtcagtgcaccccgtgcgtgatcaacaggtccttcctgctgccgcggccgcctcccacttcgactgctcccgcacctttcgttcacgcaagcgcaacctgcttctcccgctggctgtctcggatcggaccccctccctcctgccacgcatcctccccgcccacgagcctcccccgcaaccggataataaggaagaggaagagaaaccgtgcggtgcggcgaaaggaacagtgaaaaaggaagaatctctgatcgaggttcctgtccggcttgcagaatcttggcggccagccatatatggatgtactgctaggttccgggaggttcttggcacgacggcctcccctcgcgctcgtccctcgctgctctcgaggctccccggacaaaagcggcagcgacaaaggtgaaacctctgctgattgggacaaggcatggtctgccttcaagaagaaagggaagaggaccctgttttctgatttctcaccggacaagtacgtgacctggaacccacagcgcagcgagtatccattgtcagaagaggtggatccaatcaagagaactgaaagatctaacttgatgctgtggacaagcccccagttcaccttggtcggggcgattatcatcgtcttgacattgctaatctatacactagttgttcctcctcccaagtaactgcagaggtgactactactaggggggggggggggggtgagctgtaaactagtagtatttcaactgggaagtctgtattgtacattttttacgtgtgctatggcaactatagcagtattaattcaattgcgatcatgtagatacaacaccactgtccattccattctggaggttttcttcaattgtgtgctaaatggctgctgtctgagtcttatattcacttattataatgaagaaatatttggggtcaggtaga

SEQ ID NO: 5259 - DNA, 1236 bp, Zea mays
gtcggcgaaaatccctttcaacattcgtgggcggggcggatgacctggagctggaggttcgtggtagcggccgccgccggccatggagaagagaaatcggattctcgacctgcaggacctcctctctgacgcggacttcggcccactactcgcccgacagctactgtctccgttcatgcggcggccacctacctacctcgtagcaagacaccatatcataagtgctgccatggatttgcacctagagctctacattggtcgccggcgccgcggcggaggcgagactcagaactcagaagtaccctcccatgggagtccacttctgtcggcttgatggagcacctgatggatggagaggagctcgcccaacagagtgaatggaacggagcgtgactgtgagagcgggatgggaacggagcggctccgtccggttgatttttttggagcggaatggtccttcctgctgccgcggccgcctcccacttcgactgctcccgcacctttcgttcacgcaagcgcaacctgcttctcccgctggctgtctcggacaccccctccctcctgccacgcatcctccccgcccacgagtctcccccgcaaggccgcaaccggataataaggaagaggaagagaaaccgtgcggtgcggcgaaaggaacagtgaaaaaggaagaatctctgatcgaggttcctgtccggcttgcagaatcttggcggccagccagccatatatggatgtactgctaggttccgggaggttcttggcgcgacggcctcccctcgcgctcgtccctcgctgctctcgaggctccccggacaaaagcggcagcgacaaaggtgaaacctcagctgactgggacaaggcatggtctgccttcaagaagaaagggaagaggaccctgttttctgatttctcaccggacaagtacgtgatctggaacccacggcgcagcgagtatccattgtcagaagaggtcgatccaatcaagagaagtgaaagatctaacttgatgctgtggacaagcccccagttcaccttggtcggggcgattatcatcgtcttgacattgctaatctatacactagttgttcctcctcccaagtaactgcagaggtgacaactactaggggggtgagctgtaaactagtagtatttcaactggggagtctgtattgtacatttttacgtgtactatggcaactatagcagtattaattcaattgcgatcatgtagat

SEQ ID NO: 5260 - DNA, 650 bp, Cynodon dactylon
ccggggaggagtaaaaaaatctcgggtcggaaggcctgcctggttgggggaatctaggaggcgagacgatcatggatatactgctaggttccgggagattcctggcgcgccggacgccccttgcactcgtccctcgctgctccaagggccgcccggataaaggcggcagagacaaaggtaacacatctactgactgggacaaggcttggaccacgttcaaaaataaaggaaaaaggacccttttttcagatttttcaccggacaagtacgtgagctggaacccgaggcgtagcgagtatcccttatcagaagaggtcgatccaattaaaagaacagaaaggtctaacttgatgctatggacaagtccacaatttaccttggttggggcgattatcatcgtcttgacattactaatctatacactggttgtcccacccaagtaactgcagaagtggcagataggtatccaaagattccactggaaagtttgtattgtacattttttgtatgatatcagttatagctgtatattcttcaatttccaatcaagtagatataatagcccattctgtcaatttcagaggtttcgttcagttttatgcatttggctgctcctattcctccactgtaacagagaaataattggacca

SEQ ID NO: 5261 - DNA, 1660 bp, Sorghum bicolor
gcaaaattttagcagactttcacagcttcataccttcccatttgaaaaacaacggactgcagttttccttgcgctggccttacccaaaggcgtaacggacggttctctcgtacacagcgagagccacacactgcgagctgcggcagtgcagtttgactcgtctggctcctttctttcacgcaagcgcaagtgcaagtgcgcaccctgctcctctcgctgtctcaggtcccctgctacgccttctccgccaccagtctcccctgcaaccgggataagaggaaaagaatccgcgaggcgaaaggaataggaataaaggagtgaaaaaagaatctccgatcgggagtcctgccaggttgataaaatcttggcaggcatggatatactgctaggttctgagagattcttggcgcgacggactccactcgtgctcgtccctcgctgctctcgaggctccccggacaaaagcggcagcgataaaggtgaaaacctctgctgactgggacaacgcatgggctacgtttaagaagaaagggaagctcttttctgatttctcaccagacaagtatgtgacctggaacccacggcgcagtgagtatccattgtcagaagaagttgatccaatcaagagaactgaaagatcttacttgatgctgtggacaagtccccagtttaccttggtaggggcgattatcatcgtcttgacattactaatctatacactagttgttcctcccaagtaactgcagaagtggcagctagtatgtgagctgtaaatcaatatttcaaatgggaagtctgtattgtttcaatatagtactactactacaccaactatagtagtattgcttcaagtgcaatcaagtagtatataacaccacatccattccattccggaggttttcttcacttgtatactgagtctttattcctccattataacgatgaaatatatttgagtcaggtagaataatatgttggtcggtattcaatactaaatcataattcataatacatgttgatactcctgatgtaatttctgtgcatggtctcacttctcagcaactacaatgtgtgatcatcgaatattagctgtattaacagtgaactgtagtttgtagtgttaggactattgggcaagtggacatgtggaaagtatcaatgggagactgatgtacacatgagaatcatgtttcttgttacagacaaattcaagtcaaaaaagacagatcattgtcttcatacaataataagccctaggcagacaggaatcttgcttagatgtaaagctatctaactaaccttgtttcctagccctaattaattggcttatgtctcttgtgttgctgtgttggaggcatcaggatagtgtgcttttaacatcttgttttgaatatataacatatagaggaagtgcaattctaaaatagcatttctgagctctcacattatattgaagaatttgatcgttacatctttatatgcagcatcttggatcaagtcaaacttcagacttctcatccttcaggcttgaacagtttccaagttttgactcttgtgggttgttgcagtgtcggtctaataaaaaagagattggttcggttctgaaattacaaaccataattttagcattcttaagataccaggctgtttagagcatctg

SEQ ID NO: 5262 - DNA, 752 bp, Triticum aestivum
ccacgcaagcagccaggcgactccaagcgctctctcagccacgcctcctcctttcctcgccccgcccccaccgcgataagcagagaggccgcgcggggaaagaatccttcctgatcggcagaatctcgaacggggaggggccatggggatactactggtttccgggagattcttggctcgacggcctccactggcgctcgcccctcgctgctcccgaggctccccggacaagcgcggcagggacgaaggtgacacatcatcaactgactgggataaggcttggtctacctttaagaagaaagggaagaagaccctattctcagagttctcaccgaacaaatatgtgacctggaacccacggcgcagtgagtatccattgtcagaagaagtcgatccaatcaaaagagctgagaggtctaacttgatgttgtggacaagcccaagatttaccttggtaggggcgattatcatcgtttcggcattgctaatctatacattggttgtcccacccaagtaactgctgaagtgacagataacaggtgagccgtaggccgaagattctacttggaagtctgtattgtacatttagtttgtactatacgaagtatatcatggttctgtattgcttcaagcacattctaatagatcataatagagtactccttcattttggtgattttcttcacctgtacatcaattggatcctctttaatcttccattataaccatgaaatactgggtcacctagaata

SEQ ID NO: 5263 - DNA, 689 bp, Triticum aestivum
gcccccaccgcgataagcagagaggccgcgcggggaaagaatccttcctgatcggcagaatctcgaacggggaggggccatggggatactactggtttccgggagattcttggctcgacggcctccactggcgctcgcccctcgctgctcccgaggctccccggacaagcgcggcagggacgaaggtgacacatcgtcaaccgactgggataaggcttggtctacctttaagaagaaagggaagaagaccctattctcagagttctcaccgaacaaatatgtgacctggaacccacggcgcagtgagtatccattgtcagaagaagtcgatccaatcaaaagagctgagaggtctaacttgatgttgtggacaagcccaagatttaccttggtaggggcgattatcatcgtttcggcattgctaatctatacattggttgtcccacccaagtaactgctgaagtgacagataacaggtgagccgtaggccgaagattctacttggaagtctgtattgtacatttagtttgtactataccaagtatatcatggttctgtattgcttcaagcacattctaatagatcataatagagtactccttcattttggtgattttcttcacctgtacatcaattggatcctctttaatcttccattataaccaagaaatactgggtcacctagaata

SEQ ID NO: 5264 - DNA, 1643 bp, Oryza sativa
gctccacccaaaatcgagagccacacacacacagtccagcgccgcggtcgccgtcgtcctctcctctcctctgcgtccacgcaacgggaggcgatttttgcatcgcgaagccttcccggcgagtcactctccctcagagaccgcacgcctctgcctctccccagccactacccctcccctcccctctcctctcttccccacgcaaccggggataaaaaaaggggagcttgaacgggacgaggcattcaggcatggatactctgctgggctccgggagattcttggcgcggcggcccccgctcgcgctcgcccctcgctgctcgcgaggatccccggagaaaggcggcggcagcgacaaaggtgacacatcatccactgactgggacaaagcttggtctacatttaagaagaaagggaagaagaccctattttcggagttctcaccaaacaagtatgtgagctggaacccacgacgcagcgagtatccattatcagaagaggttgatccaatcagaagaacggagaggtctaacctaatgttgtggacaagtccgaaatttaccttggtaatggcgattgtcatcgtctcgacattgctaatctatacaatagttgttccacccaagtaactgaagaagtgacaggcatgagttgaactgtaagagaaacattctacttgcatgtttgtactgtacatttgtttgtactagtattagacaactatagcgtttctattggcctgttgctttaattgcatgcagatggaccatgatagtgcatccttcacttctctttgttggttttcttcactttgtgtttcaattggctcctctctagaaaatctttttgttaaggaactcctcactagaattttatcacagcccagaattatggggagggactaagtagaatattatgttgatcagtattcagttagaatatataagccacgctactgatgtgtgttagtatcagaaaaaatctcagttactgtgtgatcgttggatagtaagtagttgtaaaaatgttgtatgaatcaatggtgtgtagtatttattgttggggttgcttgggcaagtgggcatgtgcaaaatgtctagtgctgtatgtaatacatactgattcagcccataagaagcacgtttttcattacagccaatttgaagtcaaaaaagccagttcattagcttcgtataatagtaatgcctagataaacaggaatcttgcttagatgtaaagctatttaattaaccttcccgtccactgaataattagcgtctgtcgcttatattggaggcatagaaaatagtctgtcaatatcttatagttaaacgattcgatggaatgcgaatctgaataaacatggtcagggcatcacatgtaatcttgaagacttggtcgtgacatctttatattcagcatccgggattaaatccgacgatggatttgtcatctttgtgtataataaaaaggatttttttttctttttttataattgaacaatgcccaagttttataggttgtggcactgtttgtccagtgaattcattgttcaggggctctggatggattttgtgttgtctgtactgaaccttcggagaatattttgtccagcgaattcattgtttacattttcagcaaaa

SEQ ID NO: 5265 - DNA, 558 bp, Triticum aestivum
agcttgaacgggacgaggcattcaggcatggatactctgctgggctccgggagattcttggcgcggcggcccccgctcgcgctcgcccctcgctgctcgcgaggatccccggagaaaggcggcggcagcgacaaaggtgacacatcatccactgactgggacaaagcttggtctacatttaagaagaaagggaagaagaccctattttcggagttctcaccaaacaagtatgtgagctggaacccacgacgcagcgagtatccattatcagaagaggttgatccaatcagaagaactgagaggtctaacctaatgttgtggacaagtccgaaatttaccttggtaatggcgattgtcatcgtctcgacattgctaatctatacaatagttgttccacccaagtaactgaagaagtgacaggcatgagttgaactgtaagagaaacattctacttgcatgtttgtactgtacatttgtttgtactagtattagacaactatagcgtttctattggcctgttgctttaattgcatgcagatgtaccaaaaaaaaaaaaaa

SEQ ID NO: 5266 - DNA, 601 bp, Triticum aestivum
cccctctcctctcttcccccgcaaccggggataaaaataggggagcttgaacgggacgaggcattcaggcatggatactctgctgggctccgggagattcttggcgcggcggcccccgctcgcgctcgcccctcgctgctcgcgaggatccccggagaaaggcggcggcagcgacaaaggtgacacatcatccactgactgggacaaagcttggtctacatttaagaagaaagggaagaagaccctattttcggagttctcaccaaacaagtatgtgagctggaacccacgacgcagcgagtatccattatcagaagaggttgatccaatcagaagaactgagaggtctaacctaatgttgtggacaagtccgaaatttaccttggtaatggcgattgtcatcgtctcgacattgctaatctatacaatagttgttccacccaagtaactgaagaagtgacaggcatgagttgaactgtaagagaaacattctacttgcatgtttgtactgtacatttgtttgtactagtattagacaactatagcgtttctattggcctgttgctttaattgcatgcagatgtaccaaaaaaaaaaaaaa

SEQ ID NO: 5267 - DNA, 1088 bp, Brachypodium distachyon
catgctgggagagccacacgtagcccagcaccgcagtaccatgtcgccgtcctccttgcgtccacgcaagcaaccaggcggacggcaagccctctctcagccacgcctcctcctcctgacctcgcctagccctaccgtggtgaagcagagacgccgcgcggggaaataatcaggagtaagaaaatccgccctgatttatagaatcttgaaggggaggtggtgccatggggatactactggtttccgggaaattcttggcgcggcgacctcccctctcactcgcccctcgctgctcccgaggctcccctgacaagggcggcagcgataaaggtgacacatcatccaccgactgggacaaggcttggtctacctttaagaagaaaggaaagaagaccttattttccgagttctcaccgaacaagtatgtgacctggaatccacagcgcagcgagtatccattgtcagaagaggttgatccaatcaaaagagctgagaagtctaacttgatgctgtggacgagtccaacatttaccttggtaggggcgattatcatcgtcttggcattgctaatctatacactggttgtgccagccaagtaactgctcaagtgacagataggagacacctatgaatctgaatggaaaaattgtccatattgagagcgaagacttttcttccttgtgaacagaataagattggtcagtggtcgcaagctcagtgtggaattcaagtcaacagctccctggacgtacatatagttatcttgtaacatctctgtccatctgctgctgtattttagttcgctgattatgtaccgttgtacagcttaacctgcagattttacttattttatacttgtgtttcgacacttgttgtgtccatggccaacaaagagaacctgacctgcataatttaagtactgaacagtgctggaagatgtggtccagaaaatcagtattttcttctcagtgccatgtctggaggccatggtcatgggtagattaatgcttaagttatgtatccctcaccatgggcaggtagataatgacatgctttggtattaccaggccagctggaatgttgaaccc

SEQ ID NO: 5268 - DNA, 658 bp, Secale cereale
cgcgcggggaaagaatccttcctgatcgctagaatctcgaacggggaggggccatggggatactactggtttccgggagattcttggctcgacggcctccactggcgctcgcccctcgctgctcccgaggctccccggacaagcgcggcagggacgaaggtgacacatcatcaaccgactgggataaggcttggtctacctttaagaagaaagggaagaagaccctattctcagagttcacaccaaacaaatatgtgacctggaacccgccgcgcagtgagtatccattgtcagaagaagttgatccaatcaaaagagctgagaggtctaacttgatgttgtggacaagcccaagatttaccttggtaggggcgattatcatcgtttcggcattgctaatctatacattggttgtcccacccaagtaactgctgaagtgacagatagcaggtgagctgtaggacgaagattctacttggaagtctgtattgtacatttagtttgtactatgccaagtatataatggttctgtattgcttcaagcacattctatgattctaatagatcataatagagtactccttcgttttggtgattacacctgtacatcaattggatcctctttaatcttccattataaccaagaaatattgggtca

SEQ ID NO: 5269 - DNA, 752 bp, Secale cereale
gcgtccacgcaagcaaccaggcgactccaaccgctctctcagccacgcctcctcctctcctcgccccgcccagcccccaccgcgataaccagagaggccgtgcggggaaagaatccttcctgatcggtagaatctcgaacggggaggggccatggggatactactggtttccgggagattcttggctcgacggcctccactggcgctcgcccctcgctgctcccgaggctccccggacaagcgcggcagggacgaaggtgacacatcatcaaccgactgggataaggcttggtctacctttaagaagaaagggaagaagaccctattctcagagttcacaccgaacaaatatgtcacctggaacccaccgcgcagtgagtatccattgtcagaagaagtcgatccaatcaaaagagctgagaggtctaacttgatgttgtggacaagcccaagatttaccttggtaggggcgattatcatcgtttcggcattgctaatctatacattggttgtcccacccaagtaactgctgaagtgacagatagcaggtgagctgtaggccgaagattctacttggaagtctgtattgtacatttagtttgtactataccaagtatatcatggttctgtattgcacattctaatagatcataatagagtactccttcattttggtgattttcttcacctgtacatcaattggaccctctttaatcttccattataaccaagaaatattggatcacgtacaa

SEQ ID NO: 5270 - DNA, 579 bp, Hordeum vulgare
accgcgataagcagagacgctgcgcggggaaaggatcctccctgatcggtagaatctccaacggggaggggccatggggatactactggtttccgggagattcttggctcgacggcctgccctcgcgctcgcccctcgctgctctcgaggctccccggacaagcgcggcagggacgaaggtgacacatcatcaaccgactgggataaggcttggtctacctttaagaagaaagggaagaagaccctattctcagagttcacaccgaacaaatatgtgacctggaacccacggcgcagtgagtatccattgtcagaagaagtcgatccaatcaaaagagctgagaggtctaacttgatgttgtggacaagcccaaggtttaccttggtaggggcgattatcatcgtttcggcattgctaatctatacaattgttgtcccacccaagtaactgctgaagtgacagataacaggtgagctgtaggccgaagattctacttggaagtctgtattgtacatttagtttgtactataccaagtataatcatggttctgtattgcttcaaacacattctaatagat

SEQ ID NO: 5271 - DNA, 760 bp, Triticum aestivum
ccacgcaagcagccaggcgactccaagcgctctctcagccacgcctcctcctctcctcgccccgccccgccccgcccccaccgcgataagcagagaggccgcggggaaagaatccttcctgatcggtagaatctcggacggggaggggccatggggatactactggtttccgggagattcttggctcgacggcctgccctcgcgctcgcccctcgctgctcccgaggctccccggacaagcgcggcagggacgaaggtgactcatcgtcaaccgactgggataaggcttggtctacctttaagaagaaagggaagaagaccctattctcggagttctcaccgaacaaatatgtgacctggaacccacggcgcagtgagtatccattgtcagaagaagtcgatccaatcaaaagagctgagaggtctaacttgatgttgtggacaagcccaaggtttaccttggtaggggctattatcatcatttcggcattgctaatctatacattggttgtcccacccaagtaactgctgaagtgacagataacaggtgagctgtaggccgaagattctacttggaagtctgtattgtacatttagtttgtactataccaagtatatcatggttctgtattgcttcaagcacattctaatagatcataatagagtactccttcattttggtgattttcttcacttgtacatcaattggatcctcttttatcttccattataaccaagaaatactgggtcacctacaata

SEQ ID NO: 5272 - DNA, 754 bp, Avena sativa
ggaaggcgtgacgattctcccgttcagggagagccacaagctacccagcaccacagtaccatgtcgccgtcctccttccgtccacgcaagcaaccaggcgactccaagcgccctctcagccacgcctcctcctcacctcgcccccaccgtagaggccgcgcgcgggggaaagaaccgggagtaagaaaaatcctccctggttggtagaatctacgaaattgcagggggcaccatggggatactgctggtttccgggagattcttggcgcgacgcccttccctcgcgctcgcccctcgctgctctggaggctccccggacaagcgcggcagggacgaaggtgacacatcgtccacagactgggacaaggcttggtctacgtttaagaagaaagggaagaagactctattttcagagttctcaccgaacaaatatgtgacctggaacccgcggcgcagtgagtatccactgtcagaagaggtcgatccaatcaaaagagctgagaggtctaacttgatgctgtggacaagtccaagatttaccttggtaggggcgatcatcatcgtcttggcattgctaatctatacaatccttgtgccagccaagtaactgttcaagtgaggtaggaggtgagctgtaggccaaatattctacctgtaagtctgtattgtacatttagtttgtaatatgccagctatagcatgcatatgtattgcttcgaccgcattctaacagatggtaatagagcatcccttt

SEQ ID NO: 5273 - DNA, 1160 bp, Saccharum officinarum
gtcctgcctagcggtatcaatacctggctgcagctcaccaccaccaaccacaccacagttcccagttcccatataaccatcgatcagcagcaactcaagactggctggggagtttggagtgcggctacaccatagcatacctctagcagcctcgtctctgtacgcagagtgtgtcgttgcagagggggaagagggccggccatggcgacctccttccaggggacgaccaccaagtgcaccgcctgcgacaagacggtgtacctcgtcgacaagctcaccgccgacaaccgcatctaccacaaggcctgcttccgctgccaccactgcaagggcaccctcaagcttgccaactacaactccttcgagggagtgctctactgcaggcctcacttcgaccagctgttcaagaggaccgggagtttggacaaaagctttgaaggaactccaaaggttgtcaagccagaaagaaacgctgggaatgagaatgctgttaaagtctcaagcgcctttgctggcaccagagagaaatgtgttggatgcagcaagacagtctatccaattgagagggttactgtcaacaacactatgtatcacaagagctgcttcaagtgctgccatggaggatgtaccatcagcccttctaactacattgcgcacgaggggaagctctactgcaagcaccaccacattcagctgatcaaagagaagggaaacttcagccagcttgagaacgatcacgagaagacatcacaggctgggtcactggaggatgaagaagagtattagtcactgagcaccaccacagatgaataattaatctttgcatttgcttagagcactatatatttctgtggcatggttcgatttcaattttaccaatggaggtcatgtgcgttcagagaacaatgatattattgtcttgtatctgcatgtaaaccttgttatctttgagtcaaatactctacctggtttcaccagtttcattgatcagaagataacacttaccataattatatatatggctgtcgctttaaagatcctaggctacttgcgcaggttgccaccttttaatcttttattgggcacctaaatcaatatacttggctctcgtttgtcacgtctttattggaacaaaccttttcttaccaaataaatagctt

SEQ ID NO: 5274 - DNA, 1225 bp, Zea mays
atcatggtggtatggcggcattcgtgcaggaccgacccccacctccacctcgtatgctctctctctctctctctccttcccatggctgatgcctgacacggtgacacccccaacattctccctcactagctagctgtgtcctgcctacctagcggtatcaatacccggctgcagctcaccaccaccaccaaccaaccaacccacagttcccatataggcagccatcggctacacagcctcgcctccgtaagcagagtgtgtcgttggaagagagacgacggcggccatggcgacctccttccaggggacgaccaccaagtgcaccgcctgcgacaagacggtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaagagcttcgaaggaactccgaaggttgtcaagccagaaagaaacgttgggaatgagaatgctactaaagtctcaagcgcctttgctggcaccagagagaaatgtgttggatgcagcaagacagtctatccaactgagagggtcactgttaataacactatgtaccacaagagctgcttcaagtgctgccatggagggtgcaccatcagcccttctaactacattgcgcacgaggggaagctgtactgcaagcaccaccacatccagctgatcaaggagaaggggaacttcagccagcttgagaatgaccacgagaagacatcacaggctgggtcactggaggaggatgaacaagagtattgatcactgagcacaaccacagatgaataatgaatcctcttgcatttgcctagagcactatgtatttctgtggcgtggttcgatttcagttttaccaatggaggtcatgtgtgttcagagaacaatgatattgttgtcttgtatctgcatgtaaacgttgttatctttgagtcagatactctacctggtttcaccattttcattggtcagaagatgcctctgcacctacaagacacagaactgttagctcttggcttggtccatcttttgtttaagatgatatttggctaaaggatgcataacaatagaaaaaaaaatatagagaatccaaacaaacaaaaataaaaggaaaaa

SEQ ID NO: 5275 - DNA, 1244 bp, Setaria italica
cgcgccggacgagccggtcggcccccccccacctcgtacgtacacacccctccccctcccgggctcccctgctccttcacccccagcccaactcagctgatctgccaggccgcgtgccacccccaacattccccatccatcacgagctgtgtcctgtcctgcccagcggtgtcaatacctggctgcaccccgccagccaccaaccaccccgccacaccgttcccatatagccagccaccaccagcagcctttgcctctgctgtaggaagagagcgtgttgttgcaggggaggaagagggggaagacggcaatggcgacctcgttccaggggacgaccaccaagtgcaccgcctgcgacaagacggtgtacctcgtcgacaagctcaccgccgacaaccgcgtctaccacaaggcctgcttccgatgccaccactgcaagggcaccctcaagcttgccaactacaactccttcgagggggtgctctactgcaggcctcacttcgaccagctcttcaagaggaccgggagtctggacaagagcttcgaagggactccaaaggttgtcaagccagaaagaaatgttgagaatgagaatgctattaaagtctccagcgtctttgctggcaccagagagaaatgtgttggatgcagcaagacagtctatccaattgagagggttactgtcaacaacactatgtatcacaagagctgcttcaagtgctgccatggaggatgcaccatcagcccttccaactatatcgcgcacgaggggaagctctactgcaagcaccaccacattcagctgatcaaggagaaggggaacttcagccagctcgagaatgatcatgagaagacatcacaggctgggtcgctggaggatgaagaagcagagtattaatctttgagcattgttccacagatgaataatgaatcttcttgcatttgctcaagagcactatatcttcctgtggcatggttccatttcagtttcaccaatggaggtcatgtgcattcagagaacaatgatacatcatcttgtatctgcatgcaaaccttgttatatttgagtcaaaatatatctacctggtttcccctttttcattgcttcgaagatgcatttcagcatttgcgtatgcaagacagagagctgtaaattcttgatccaccttttgttgtaatgaatttgactaaagtatgcataaaaacagaaaagaagggaaagaagcaaactctgaacaagcaaa

SEQ ID NO: 5276 - DNA, 645 bp, Saccharum officinarum
attcactagtgattgagctcgtcgacatggcgacctccttccaggggacgaccaccaagcgcaccgcctgcgacaagacggtgtaccttgtggacaagctcaccgccgacaaccgcatctaccacaaggcctgcttccgctgccaccactgcaagggcaccctcaagctcgccaactacaactccttcgagggagtgctctactgcaggcctcacttcgaccagctgttcaagaggacagggagcttggacaagagcttcgaaggaactccgaaggttgtcaagccagaaagaaacgttgggaatgagaatgctactaaagtctcaagcgcctttgctggcaccagagagaaatgtgttggatgcagcaagacagtctatccaactgagagggtcactgttaacaacactatgtaccacaagagctgcttcaagtgctgccatggagggtgcaccatcagcccttctaactacattgcgcacgaggggaagctgtactgcaagcaccaccacatccagctgatcaaggagaaggggaacttcagccagcttgagaatgaccacgagaagacatcacaggctgggtcactggaggaggatgaacatgagtattgatcacctcgagtgaaatcgaattcccgcggcc

SEQ ID NO: 5277 - DNA, 1101 bp, Panicum virgatum
tcactggctgtgtccagtgtcctgcccagcgaggtgtcaatgcctggctgcatcccgccagccaccaaccactcgcccacgccgttcccagctcccatatagccagccagccaccaccagcagcctgggagcgctggcatcactcggagccttgcctctgtaggtagagagtgtgttgtttgcagggggaagaagggaagagggcaatggcgacctccttccaggggacgaccaccaagtgcaccgcctgcgacaagacggtgtacctcgtcgacaagctcaccgccgacaaccgcgtctaccacaaggcctgcttccgctgccaccactgcaagggaaccctcaagcttgcgaactacaactccttcgagggggtgctctactgcaggcctcacttcgaccagctgttcaagaggacggggagtctggacaagagcttcgaaggaacccccaaggttgtcaagccagaaagaaagaatgagaatgctattaaagtctccagtgcctttgctggcaccagagagaaatgtgttggatgcagcaagacagtctatccaattgagagggtaactgtcaacaacactatgtatcacaagagctgcttcaagtgctgccatggaggatgcaccatcagcccttcgaactacatcgcgcacgaggggaagctctactgcaagcatcatcacatccagctgatcaaggagaaggggaacttcagccagctcgagaatgatcatgagaagacatcacaggctggatcgctggaggacgaagaagcagagtactaatctttgagcatttccacagatgaataatgaatctccttgcatttgctcgagagcaatatacctttctatggcacggtttggtttcagttttaccaatggaggtcatgagcactcagagaacaatgatacgtcatcttgtatcttcatgtaaaccttgttatatctgagtcaaattctctacccagttttcaccattttcattgcttattagaagatgcatctgctacacaagatagaccgatagaactgttaattactgatccacacttttgttttaaaaatatttggctaaaggatgcatagcaacagaaaa

SEQ ID NO: 5278 - DNA, 911 bp, Pennisetum glaucum
gcctcctctgctactgtatagggagagagtgtgttgtagtgtgttgtgttgcaggggaggatcggaagagggggaaagacggcagcaatggcgacctccttccaggggacgaccaccaagtgcaccgcctgcgacaagacggtgtacctcgtcgacaagctcaccgccgacaaccgcgtctaccacaaggcctgcttccgctgccaccactgcaagggcaccctcaagcttgccaactacaactccttcgagggggtgctctactgcaggcctcacttcgaccagctcttcaagaggaccgggagtctcgacaagagcttcgaagggactccaaaggttgtcaagccagaaagaaatgttgacaacgagaatgctattaaagtctccagcgtctttgctggcaccagagagaaatgtgttggatgcagcaagacagtctatccaattgagagggttactgtcaacaacactatgtatcacaagagctgcttcaagtgctgccatggaggatgcaccatcagcccttccaactatatcgcgcacgaggggaagctctactgcaagcaccaccacatccagctgatcaaggagaaggggaacttcagccagctcgagaatgatcatgagaagacatcacaggctgggtcgctggaggatgaagaagcagactactaatctttaagagcattgttccaaagatgaataatgaatcttcttgcatttgctccagagcactatatctttctgtggcacggttccatttcagttttaccgatgaaggtcatgtgcattcagagaacaatgatacatcgtcttctatctgcatgtaaaaccttgttatatttgagtcaaaatatatctacctggtttccccattttcattgctttgaagattcatttcagcatttgca

SEQ ID NO: 5279 - DNA, 967 bp, Panicum virgatum
gggagcgctggcatcactcggagccttgcctctgtaggtagagagtgtgttgtttgcagggggaagaagggaagagggcaatggcgacctccttccaggggacgaccaccaagtgcaccgcctgcgacaagacggtgtacctcgtcgacaagctcaccgccgacaaccgcgtctaccacaaggcctgcttccgctgccaccactgcaagggaaccctcaagcttgcgaactacaactccttcgagggggtgctctactgcaggcctcacttcgaccagctgttcaagaggacggggagtctggacaagagcttcgaaggaacccccaaggttgtcaagccagaaagaaagaatgagaatgctattaaagtctccagtgcctttgctggcaccagagagaaatgtgttggatgcagcaagacagtctatccaattgagagggtaactgtcaacaacactatgtatcacaagagctgcttcaagtgctgccatggaggatgcaccatcagcccttcgaactacatcgcgcacgaggggaagctctactgcaagcatcatcacatccagctgatcaaggagaaggggaacttcagccagctcgagaatgatcatgagaagacatcacaggctggatcgctggaggacgaagaagcagagtactaatctttgagcatttccacagatgaataatgaatctccttgcatttgctcgagagcaatatacctttctatggcacggtttggtttcagttttaccaatggaggtcatgagcactcagagaacaatgatacgtcgtcttgtatcttcatgtaaaccttgttatatctgagtcaaattctctacccagttttcaccaaaaaaaaaaaaaaaaagggcggccgccgtggcgtacgtggtgcgcggccggcgcggcgcggcggtccagctcggctcctccccgtgagccgcagcctagctagcgggaccc

SEQ ID NO: 5280 - DNA, 1830 bp, Panicum virgatum
agggggaaggaaggagcggcgacggcgcggggttggccgctggagcagggggggtggcgggtgtaaagaacggtgtctcgttttttaactttcactttgagtagaggcagccagtgaagacacaaggctgcagacacgtcaaggctctggttcagtgcacatggtgtggtctggcaccatgttccaatcaagcagagatccccagaaccggtttcacccgaggaatacaaagccttgccagggtcacaagctacggtgattcaaggacaaagaattttctgctgctatcatataatattcacctctatttggtgataaataaaccacctgtctctcttttttttcttttgccttctcagatatttacccaccactccacctctggaaccccaagatagaaaacaagctggttttcgcccacccgcattctcctgttctgaaaacacgcacccaaatcatctctttctctctctaattattgacacaaactgttttctcgctcccttttctgtcactgtcggtctcatttgccgccggattttgcttcgcccctccgcaaattttccacaaccaccgcaccaccatttcctcccgtccatgccggacggacccggccccccccctctcgtccgtgcacccctccctctccctcccgtgctcctccacccctactccgccgatctgccaggcccccaacattccctgcccccctactcactagctgtgtccagtgtcctgcccagcgaggtgtcgatgcctggctgcagcccgccagccaccaaccacccggccacgccgttcccagctcccatatagccagccagccaccagcagcagcctgggactgggagcgctggcatcactaggagtcttgcctctgtaggtagagactgttgttgcaggggaagagaccagaagaggggaagagggcaatggcgacctccttccaggggacgacaaccaagtgcaccgcctgcgacaagacggtgtacctcgtcgacaagctcaccgccgacaaccgcgtctaccacaaggcctgcttccgctgccaccactgcaagggcaccctcaagctcgcgaactacaactccttcgagggggtgctctactgcaggcctcacttcgaccagctgttcaagaggacggggagtctggacaagagcttcgaaggaactcccaaggttgtcaagccagaaagaaagaatgagaatgctattaaagtctccaccgcctttgctggcaccagagagaaatgtgttggatgcagcaagacagtctatccaattgagagggttactgtcaacaacactatgtatcacaagagctgcttcaagtgctgccatggaggatgcaccatcagcccttcgaactacatcgcgcacgaggggaagctctactgcaagcatcaccacatccagctgatcaaggagaaggggaacttcagccaactcgagaatgatcacgagaagacatcacaggctggatcgctggaggacgaagaagcagagtattaatctttgagcatttccacagatgaataatgaatctccttgcatttgctcgagagcaatatatctttctggggcacggtttggtttcagttttaccaatggaggtcatgtgcactgagaacaatgatacatcgtcttgtatctgcatgtaaaccttgttaaatctgagtcaaattctctaccggtttcaccattttcattgcttattagaagatgcatctgctatacaagatagactgatagagctgttaatcattgatccacccttttgttttaaagatatttgactaaaggatgcataacaacagaaaactaacaa

SEQ ID NO: 5281 - DNA, 1033 bp, Panicum virgatum
gccaggcccccaacattccctgcccccctactcactagctgtgtccagtgtcctgcccagcgaggtgtcgatgcctggctgcagcccgccagccaccaaccacccggccacgccgttcccagctcccatatagccagccagccaccagcagcagcctgggactgggagcgctggcatcactaggagtcttgcctctgtaggtagagactgttgttgcaggggaagagaccagaagaggggaagagggcaatggcgacctccttccaggggacgacaaccaagtgcaccgcctgcgacaagacggtgtacctcgtcgacaagctcaccgccgacaaccgcgtctaccacaaggcctgcttccgctgccaccactgcaagggcaccctcaagctcgcgaactacaactccttcgagggggtgctctactgcaggcctcacttcgaccagctgttcaagaggacggggagtctggacaagagcttcgaaggaactcccaaggttgtcaagccagaaagaaagaatgagaatgctattaaagtctccactgcctttgctggcaccagagagaaatgtgttggatgcagcaagacagtctatccaattgagagggttactgtcaacaacactatgtatcacaagagctgcttcaagtgctgccatggaggatgcaccatcagcccttcgaactacatcgcgcacgaggggaagctctactgcaagcatcaccacatccagctgatcaaggagaaggggaacttcagccaactcgagaatgatcacgagaagacatcacaggctggatcgctggaggacgaagaagcagagtattaatctttgagcatttccacagatgaataatgaatctccttgcatttgctcgagagcaatatatctttctgtggcacggtttggtttcagttttaccaatggaggtcatgtgcactgagaacaatgatacatcgtcttgtatctgcatgtaaaccttgttaaatctgagtcaaattctctaccggtttcaccattttcattgctt

SEQ ID NO: 5282 - DNA, 1023 bp, Zea mays
ccctcactagctagaggctagagctgtgtcctgactgcagctcagctcaccaccaccaaccaaccacaccttcttcccatataaccatccatcgatcagcagcagcaactcaaggccggccgctggggagtctggaacatacctctagcagcctcgcctctgtagctaggcattgtagtagaggggggaaagaagaagactagaagaaaagggccatggcgacctccttccagggaaccaccaccaagtgcaccgcctgcgacaagacggtgtacctcgtcgacaagctcaccgccgacaaccgcgtctaccacaaggcctgcttccgctgccaccactgcaagggcacactcaagctcgccaactacaactccttcgacggagtgctctactgcaggcctcacttcgaccagctcttcaagaggaccgggagcttggacaagagcttccaaggaaccccaaaggttgtcaagccagaaagaaacgttgggaatgagaatgctactaaagtctcgagcgccttcgctggcaccagggagaagtgtgtcggatgcagcaagacagtctatccaattgagagggttactgtgaacaacaccatgtaccacaagtgctgcttcaagtgctgccatggaggatgcaccatcagcccttctaactacatcgcgcacgaggggaagctctactgcaagcaccaccacgtccagctgatcaaggagaaagggaacttcagccagctcgagaatgaccacgagaagacatcgcaggctgggtcgctggaggacgacgaagaagaagagtattaattaatcgctgagcaaaaatacataccaccagaagaataattaatcttccttcttgcactatatatttctgtgccatttcagtcttaccaatggagatcatatgtgcgttcagagaactacgatatcgttttcttgtatctgcatgtaaaccacgtctactacctgatttcaccatttgcattgatcaggtggtaatctagaccctgtttggaacttt

SEQ ID NO: 5283 - DNA, 1309 bp, Triticum aestivum
cccctcaaatccccaagatggaaatcagctgccatttaccttcacccaaatgctttctctccctgccacgtcatcaccagtcaccacgtggattttgcttagcccctccgcaattccacaaccacacctccttttcgtttccttgagctgctacaatctcattcccacttgactactactactcgttctggctctttgcttccacctccaacattattccctgtctcacccaagctgtcctgccccgcctcgcggcagcaaacagcaatacctgcagctgccggccaccaccaaccgcgccacgccatttaccaccatataatcatcactcaccccaaggcttgtcgggagcgaagccaagccagtcttgtgttggaagaacagagcagcagcttgcagatcgagagttcgggagaggcaatggcgacttcgttccaggggacgaccaccaagtgcaacgcctgcgacaagacggtgtacctcgtcgacaagctcaccgccgacaaccgggtctaccacaaggcctgcttcaggtgccaccactgcaagggcaccctcaagctcgcaaattacaactcgttcgaaggagtgctctactgcaggcctcactttgaccagctcttcaagaggaccgggagcctggacaagagcttcgaaggcactccaaaggttgtcaagccagaaaggaatgttgggaatgagaatgctactaaagtctccagcgcatttgctggcactagagagaaatgttttggatgcagcaagacagtctatccaattgagagggttactgtgaataacactatgtaccacaagagctgcttcaaatgctgccatggagggtgcaccatcagcccttcgaattacatcgcgcacgagggcaagctcttctgcaagcaccaccacacccagctgatcaaagagaagggtaatttcagccagctcgagaacgaccacgacaagacatcacagagtgccgggtcagtggatgatgaagactcggagtattagtcagtccttgaggatatccagagatgaataacgagcccttctgcatttgcaccagagcagtatatctttctgctgtgtggttcttttgagtttttccaatcgagatcaagtgcattccgaagacaattatgttattgccttgtacgcatgtaaaccttgttatatccgagtcaaaatatctctacctggttcgacgacgtctatgcgcatacaagcaagagaattgtaagttgatttatcatttgtctaaagaataggtaataggggtaaaacatttatgtttaaaaagaataaaact

SEQ ID NO: 5284 - DNA, 1048 bp, Hordeum vulgare
cggcacgaggctcgttctggcgctgccacccccgacattattccctgtctcgcccaagctgtcctgccctgcaatagccaccaccaaccgcgccacgccatttaccaccatataatcatcactcaccccaaggctaaggcttgtcgggagcgaggtactcaccatcaccatcaaccgtctatcggagcagcagcttgcagatcgagagggggaggcaatggcgacctcgttccaggggacgacgaccaagtgcaacgcctgcgacaagacggtgtacctcgtcgacaagctcaccgccgacaaccgggtctaccacaaggcctgcttcaggtgccaccactgcaagggcaccctcaagctcgcgaattacaactcgttcgaaggggtgctctactgcaggcctcactttgaccagctcttcaagaggactgggagcctcgacaagagcttcgaagggactccaaaggttgtcaagccagaaaggaatgttgggaatgagaatgctattaaagtctcgagcgcatttgctggcaccagagagaaatgttttggatgcagcaagacagtctatccaattgagagggttactgtcaataacaccatgtaccacaagagctgcttcaaatgctgccatggagggtgcaccatcagcccttcgaattacatcgcccacgagggcaagctcttctgcaagcaccaccacacccagctgatcaaagagaagggaaatttcagccagctcgagaacgatcacgacaagacgtcacaaagtgccgggtcagtggatgatgaagactcggagtattagtccttgaggatatccagagatgaataacgagcccttctgcatttgcaccagagcagtatatctttctgctgcgtgcttcttttgagtttttccaatcgagatcaagtgcatttccaaagacaattatgttattgccttgtcgcatgtaaaccttgttatatctgagttgaaatatctctacctggttcgaagacgtctaatgcgcatacaagcaagagaactgtaagttgatttatcatc

SEQ ID NO: 5285 - DNA, 1175 bp, Hordeum vulgare
ccgctcctcgttctggcgctgccacccccgacattattccctgtctcgcccaagctgtcctgccctgcaatagccaccaccaaccgcgccacgccatttaccaccatataatcatcactcaccccaaggctaaggcttgtcgggagcgaggtactcaccatcaccatcaaccgtctatcggagcagcagcttgcagatcgagagggggaggcaatggcgacctcgttccaggggacgacgaccaagtgcaacgcctgcgacaagacggtgtacctcgtcgacaagctcaccgccgacaaccgggtctaccacaaggcctgcttcaggtgccaccactgcaagggcaccctcaagctcgcgaattacaactcgttcgaaggggtgctctactgcaggcctcactttgaccagctcttcaagaggactgggagcctcgacaagagcttcgaagggactccaaaggttgtcaagccagaaaggaatgttgggaatgagaatgctattaaagtctcgagcgcatttgctggcaccagagagaaatgttttggatgcagcaagacagtctatccaattgagagggttactgtcaataacaccatgtaccacaagagctgcttcaaatgctgccatggagggtgcaccatcagcccttcgaattacatcgcccacgagggcaagctcttctgcaagcaccaccacacccagctgatcaaagagaagggaaatttcagccagctcgagaacgatcacgacaagacgtcacaaagtgccgggtcagtggatgatgaagactcggagtattagtccttgaggatatccagagatgaataacgagcccttctgcatttgcaccagagcagtatatctttctgctgcgtgcttcttttgagtttttccaatcgagatcaagtgcatttccaaagacaattatgttattgccttgtcgcatgtaaaccttgttatatctgagttgaaatatctctacctggttcgaagacgtctaatgcgcatacaagcaagagaactgtaagttgatttatcatctggctggctgcgtttggattcaatgtattgtaatacagaggtgtcagatttacacccgtattatactggtcaacactgatttctagtggaaaatgaaaccgacgggcggaggcctgtaatttttacaggtg

SEQ ID NO: 5286 - DNA, 1348 bp, Brachypodium distachyon
ctctcctttgcacatgtcatcatcagtcatcgccatcagggcagcaggtctgctacagcatgtgtgtgtgctggattttgcttagcccctccgcaacattccggcaaccaccagcaaatccttcggtccttccctttccttctcagttctcaaccccctcgttttgccacccccaacccaaatattccttcccattctctcgcccccaagctgtcctgcctgtcctgcaggagcaatacctgcagctgcaggccacaccaccaccaaccacgccagtacgccacgcactgcctttcaccatatagctagccatcactgcccccccaaaggcttgttgggagcttacaacgcaagcgcgtgctaatttctctcctttcagcagcgctcttgtagatcgagagggaagaacagaggaggcaatggcgacttcattccaggggacgaccaccaagtgcaacgcctgcgataagaccgtgtaccttgtcgacaagctcaccgccgacaaccgggtctaccacaaggcctgcttcaggtgccaccattgcaagggcaccctcaagcttgcgaattacaactcgtttgaaggagtgctctactgcagacctcactttgatcagctcttcaagaggactggaagcttggacaagagcttcgaaggaactccaaaggttgtcaaaccagaaaggaatgttgaaaatgagaatgctattaaagtctcgagcgcatttgctggcaccagagagaaatgtgttggatgcaacaagacagtctatccaattgagagggttactgtcaataacactatgtaccacaagagctgcttcaagtgctgccatggaggatgcaccatcagcccttcaaattacatcgcgcacgaggggaagctcttctgcaagcaccatcatatccagctgatcaaagaaaagggtaatttcagccagctcgagaatgacagcgagaagacatcacaaagtgctgggtcagtggacgatgaagaatcagattattaaccgtcgagaatatcagaaataccctgccctcttcatgaggttcgtcaataaaagaatatccagagatgaatcatgagtcttcttgcatttgctccagagcagtatatctttctgtggcgctgttcttttcgattattttttttcaaacggagatcgtttgcattcagagaacaatgatattattgtcttgtaagcatgtaaaccttgttgtatttcgagtcaaaatatctctggctggtttgaaccacttgatcattacttgcaagacctttcattgtatttacaagcaagagaactgtaagttcttgactacagaaactgacctgttctatttcatt

SEQ ID NO: 5287 - DNA, 1292 bp, Oryza sativa
tggccaatttgtgctggctggattttgcttagccactccgcaaaagaatttccacaaccaccacaccactatgccctttctcccgttcatgtcaggccggccggcccccacacctcgcaccaccctactctcctctcctctcctacacaccccatcctgacacccccaatattccctgtctaccaagctgtccttgcctgtgcctgcttgcgttcgctgtcctcctcctcctcctcctcctccctgcaggatcaatgactgcaggccaggacaccaccaaccacgacaccattcacatataaccataaggagctcaagggctgaggggtcgtttttcttggacactgaaagcacaagcagagagggagagggagagagagggaagaagaaggtgagggagctgggcaatggcgacttcctttcaggggacgacgaccaagtgcatggcgtgcgacaagacggtgtacctggtcgacaagctcaccgccgacaacagggtctaccacaaggcctgcttccggtgccaccattgcaagggcaccctcaagctcgcgaactacaactcgtttgaaggagtgctctactgcaggcctcactttgatcagctgttcaagaggactggaagtttagacaagagctttgaaggaactccaaaggttgtcaagccagaaaaaacagttgagaatgagaatgctattaaagtctcgagcgcatttgctggcacgagagagaaatgcgtgggatgcaacaagacagtctatccaattgaaagggttactgtcaataacaccatgtatcacaaaagctgcttcaagtgctgtcatggaggatgcaccattagcccctcaaattacatcgcacacgaagggaagctctattgcaagcaccaccatattcagttgatcaaagagaaggggaacttcagccaacttgagaatgaccatgagaaggcatcacaatctggatctgtagaggatgaagattcagaatattagtcctttgagaaatttccagagataaataatgatcttcttgcttttgctccagagcaccatgtctttctttgcgcggtctttacagttttttcccaatgaaggtcatgtgcattcagagaacaataatattatttggcttgtatccgcttgtaaaaccttgttatattggagtcagaatgtctacctggtttgaacctttacttgtgagatgcttgcgtgcatacaagcaagaaaaagtaggttattgtttcatctatcgaatagatgatatttgtccaaacaagtagcataagaaaa

SEQ ID NO: 5288 - DNA, 1115 bp, Triticum aestivum
ccatttaccaccatataatcatcactcgcccccaggcctgtcgggagcgaagccaagccagtcttgtgttggaagaacgcctcgccatcaccccatctatcagagcagcagcttgcagatcggaagaggcaatggcgacttcgttccaggggacgaccaccaagtgcaacgcctgcgacaagacggtgtacctcgtcgacaagctcaccgccgacaaccgggtctaccacaaggcctgcttcaggtgccaccactgcaagggcaccctcaagctcgcgaattacaactccttcgaaggagtgctctactgcaggcctcactttgaccagctcttcaagaggaccggcagcctggacaagagcttcgaaggcactccaaaggttgtcaagccagaaaggaatgttgggaatgagaatgctactaaagtctcgagcgcatttgctggcaccagagagaaatgttttggatgcaccaagacggtctatccaattgagagggttactgtgaacaacaccatgtaccacaagagctgcttcaaatgctgccatggagggtgcaccatcagcccttcgaattacatcgcgcacgagggaaagctcttctgcaagcaccaccacacccagctgatcaaagagaagggcaatttcagccagctcgagaacgaccacgacaagacgtcacagagtgccgggtcagtggatgatgaagactcggagtattagtcagtccttgaggatatccatagatgaataacgagcccttctgcatttgcaccagagcagtgtatccttctgctgcgtggttcttttgagattttccaatcgagatcaagtgcattccaaagacaattatgttattgccttgtacgcatgtaaaccttgttatatccatgtcaaaatatctctacctggttcgaagacgtctgtgtgcatacaagcaagagaaatgtaagttgatttatcatttggctaaagaagaataggtaataggggcaaaacttattttatgtctaaaagaagaaaactctgaacaactttaatctttccacagaaaagaaatgagctggtgccccaaaaagaactggcacagatttggaggcccattaattaatcagt

SEQ ID NO: 5289 - DNA, 800 bp, Triticum aestivum
gtcttgtgttggaagaacgcctcaccatccatcagagcagctcggcttgcagatcgagagtgagggagtgagaggcaatggcgacttcgttccaggggacgaccaccaagtgcaacgcctgcgacaagacggtgtacctcgtcgacaagctcaccgccgacaaccgggtctaccacaaggcctgcttcaggtgccaccactgcaagggcaccctcaagctcgcgaattacaactcgttcgaaggagtgctctactgcaggcctcactttgaccagctcttcaagaggaccgggagcctggacaagagcttcgaaggcactccaaaggttgtcaagccagaaaggaatgttgggaatgagaatgctactaaagtctcgagcgcatttgctggcaccagagagaaatgttttggatgcaccaagacagtctatccaattgagagggttactgtgaacaacaccatgtaccacaagagctgcttcaaatgctgccatggagggtgcaccatcagcccttcgaattacatcgcgcacgagggcaagctcttctgcaagcaccaccacacccagctgatcaaagagaagggcaatttcagccagctcgagaacgatcacgacaagacgtcacagagtgccgggtcagtggatgatgaagactcggagtattagtcagtccttgaggatatccagagatgaataacgagcccttttgcatttgcaccagagcagtatgtctttctgctgtgtggttcttttgagtttttccaatcgagatcaagtgcattccaaagacaattatgt

SEQ ID NO: 5290 - DNA, 857 bp, Pseudoroegneria spicata
gttggaagaacgcctcaccatcaccatctatcagagcagcagcttgcagatcgagagtgagggagaggcaatggcgacttcgttccaggggacgaccaccaagtgcaacgcctgcgacaagacggtgtacctcgttgacaagctcaccgccgacaaccgggtctaccacaaggcctgcttcaggtgccaccactgcaagggcaccctcaagctcgcgaattacaactctttcgaaggagtgctctactgcaggcctcactttgaccagctcttcaagaggactgggagcctggacaagagcttcgaagggactccaaaggttgtcaagccagaaaggaatgttgggaatgagaatgctattaaagtctcgagcgcatttgctggcaccagagagaaatgttttggatgcaacaagacagtctatccaattgagagggttactgtcaataacaccatgtaccacaagagctgcttcaaatgctgccatggagggtgcaccatcagcccttcgaattacatcgcgcacgagggcaagctcttctgcaagcaccaccacacccagctgatcaaagagaagggcaatttcagccagctcgagaacgatcacgacaagacgtcacaaagtgccgggtcagtggatgatgaagactcggagtattagtcagtccttgaggatatccagagatgaataacgatcccttctgcatttgcaccagagcagtatacctttctgctgcgtggttcttttgagtttttccaatcgagatcaagtgcattcgaaagacaattatgttattgccttgtacgcatgtaaaccttgttatatccgagtcaaagtatctctacctggttcgaag

SEQ ID NO: 5291 - DNA, 987 bp, Triticum aestivum
ctgtcctgccccgcctcgcggcagcaaacagcaatacctgcagctgcaggccaccaccaaccgcgccacgccatttaccaccatataatcatcactcgcccccaggcttgtcgggagcgaagccaagccagtcttgtgttggaagaacgcctcaccatccatcagagcagctcggcttgcagatcgagagtgagggagtgagaggcaatggcgacttcgttccaggggacgaccaccaagtgcaacgcctgcgacaagacggtgtacctcgtcgacaagctcaccgccgacaaccgggtctaccacaaggcctgcttcaggtgccaccactgcaagggcaccctcaagctcgcgaattacaactcgttcgaaggagtgctctactgcaggcctcactttgaccagctcttcaagaggaccgggagcctggacaagagcttcgaaggcactccaaaggttgtcaagccagaaaggaatgttgggaatgagaatgctactaaagtctcgagcgcatttgctggcaccagagagaaatgttttggatgcaccaagacagtctatccaattgagagggttactgtgaacaacaccatgtaccacaagagctgcttcaaatgctgccatggagggtgcaccatcagcccttcgaattacatcgcgcacgagggcaagctcttctgcaagcaccaccacacccagctgatcaaagagaagggcaatttcagccagctcgagaacgaccacgacaagacgtcacagagtgccgggtcagtggatgatgaagactcggagtattagtcagtccttgaggatatccagagatgaataacgagcccttctgcatttgcaccagagcagtatatctttctgctgtgtggttcttttgagtttttccaatcgagatcaagtgcattccaaagacaattatgttattgccttgtacgcatgtaaaccttgttatatccgagtcaaaatatctctacctct

SEQ ID NO: 5292 - DNA, 1149 bp, Triticum aestivum
cgcccaagctgtcctgccccgcctccgcctcgcggcagcaacagcaatagcagcaatacctgcagctgcagcccaccaccaaccgcgccacgccatttaccaccatataatcatcacccgcccccaggcttgtcgggagcgaagccaagccagtcttgtgttggaagaacgcctcaccatccatcagagcagctcggcttgcagatcgagagtgagggagtgagaggcaatggcgacttcgttccaggggacgaccaccaagtgcaacgcctgcgacaagacggtgtacctcgtcgacaagctcaccgccgacaaccgggtctaccacaaggcctgcttcaggtgccaccactgcaagggcaccctcaagctcgcgaattacaactcgttcgaaggagtgctctactgcaggcctcactttgaccagctcttcaagaggaccgggagcctcgacaagagcttcgaaggcactccaaaggttgtcaagccggaaaggaatgttgggaatgagaatgctattaaagtctcgagcgcatttgctggcaccagagagaaatgttttggatgcaccaagacagtctatccaattgagagggttactgtgaacaacaccatgtaccacaagagctgcttcaaatgctgccatggagggtgcaccatcagcccttcgaattacatcgcgcatgagggcaagctcttctgcaagcaccaccacacccagctgatcaaagagaagggcaatttcagccagctcgagaacgatcacgacaagacgtcacagagtgccgggtcagtggatgatgaagactcggagtattagtcagtccttgaggatatccagagatgaataacgagcccttttgcatttgcaccagagcagtatgtctttctgctgtgtggttcttttgagtttttccaatcgagatcaagtgcattccaaagacaattatgttattgccttgtacgcatgtaaaccttgttatatccgagtcaaaatatctctacctggttcgaagacgtctgtgtgcatacaagcaagagaaatgtaagttgatttatcatttggctaaagaagaataggtaataggggcaaaacttattttatgtctaaaagaagaaaactctgaacaactttaatctttccacagc

SEQ ID NO: 5293 - DNA, 994 bp, Secale cereale
cgcccaagctgtcctgccccgcctcgcggcagcaacagcaatagcacccgcaggccaagcccaccaccaaccgcgccacgccatttaccaccatataatcatcactcaccccaaggcttgtcgggagcgaagccaagccagtcttgtgttggaagaaggcctcaccatctatcagagcagatcgagagggaggtcgggagaggcaatggcgacttcgttccaggggacgaccaccaagtgcaacgcctgcgacaagacggtgtacctcgtcgacaagctcaccgccgacaaccgggtctaccacaaggcctgcttcaggtgccaccactgcaagggcaccctcaagctcgcgaactacaactcgttcgacggagtgctctactgcaggcctcactttgaccagctcttcaagaggactgggagcctggacaagagcttcgaaggcactccaaaggttgtcaagccggaaaggaatgttgggaatgagaatgctattaaagtctcgagctcatttgctggcaccagagagaaatgttttggatgcaccaagacagtctatccaattgagagggttactgtcaacaacactatgtaccacaagagctgcttcaaatgctgccatggagggtgcaccatcagcccttcgaattacatcgcgcacgagggcaagctcttctgcaagcaccaccacacccagctgatcaaggagaagggcaatttcagccagctcgagaacgatcatgacaagacgtcacaaagtgccgggtcagtggatgatgaagactcggagtattagtcagtccttgaggatatccagagatgaataacgagcccttctgcatttgcaccagagcagtatatctttctgctgcatgcttcttttgagtttttccaatctgagatcaagtgcattccgaagacaattatgttattgccttgtatgcatgtaaaccttgttatatccgagtcaaaatatctctacctggttcgacga

SEQ ID NO: 5294 - DNA, 863 bp, Eragrostis curvula
  misc_feature (74)..(74): n is a, c, g, or t
  misc_feature (116)..(116): n is a, c, g, or t
  misc_feature (355)..(356): n is a, c, g, or t
  misc_feature (413)..(413): n is a, c, g, or t
  misc_feature (824)..(824): n is a, c, g, or t
  misc_feature (833)..(833): n is a, c, g, or t
ggcggggggatctgcaagccatatcatttatatacagcaagcagccttggctttgtcggcagagggagaggganagtagtgcagggaggcgaaggcaatggcgaccaagatccagnggacgaccaccaagtgcacggcctgcgacaagacggtgtacctcgtcgacaagctcaccgccgacaaccgcatctaccacaaggcctgcttcaggtgccaccactgcaagggcaccctcaagcttgcgaattacaattcctttgagggagtgctctactgcaggcctcacttcgaccagctcttcaagaggacagggagcctggacaagagctttgaaggaactccaaaggttgtcaanncggaaagaactgttgagaatgagaatgctattaaagtctcgagcgcatttgctggcnccagagagatatgtgttggatgcagcaagaaagtctatccaattgagagggttactgttaacgggactatgtatcacaaaagctgcttcaaatgttgccatggaggatgcaccatcagcccttcaaattatatcgcgcatgaaggaaagctctactgcaagcaccaccatatccagttgatcaaagagaaggggaacttcagccagcttgagaatgatcaggagaaggcatcacaggctggatcactggaggatgaagaatcagactattagtccatgagtgtttccaagagataaataataaatcttcttgtgattgcgccgagcagcatattttctgttgcacgttccttttcagtttttaccaacggaggtcatgtggattaagagaacaatgataatattgtcttgnacatgcaantctactgtaaaccttgttatattcgagtcc

SEQ ID NO: 5295 - DNA, 663 bp, Festuca arundinacea
  misc_feature (10)..(10): n is a, c, g, or t
  misc_feature (12)..(13): n is a, c, g, or t
  misc_feature (94)..(94): n is a, c, g, or t
  misc_feature (220)..(220): n is a, c, g, or t
  misc_feature (259)..(259): n is a, c, g, or t
  misc_feature (367)..(367): n is a, c, g, or t
  misc_feature (415)..(415): n is a, c, g, or t
  misc_feature (424)..(424): n is a, c, g, or t
ggcacgaggnanngacaccatatcagtggcacttgctctctctctctctctctctgtgcagcagatcgagagtgaagagtagaaggcaatggcnacttcattccagggaaccaccaccaagtgcaacgcctgcgacaagacggtgtacctcgtcgacaagctcaccgccgacaaccgcgtctaccacaaggcctgcttcaggtgccaccactgcaagggnaccctcaagcttgccaactacaactcgttcgaaggagtnctctactgcaggcctcactttgatcagctcttcaagaggactgggagcttggacaagagctttgaaggaactccaaaggttgtcaagccagaaagaaatgttgagaangagaatgctattaaagtctcgagctcatttgctggcaccagagagaantgttttggntgcagcaagacagtctacccaattgagagggttactgtcaataacaccatgtaccacaagagctgcttcaaatgcagccatggagggtgcaccatcagcccttcaaattacatcgcacacgagggcaagctcttctgcaggcaccatcatactcagctgatcaaggagaaggggaatttcagccagctcgagaacgaccacgagaagtcatctcaaagtgcagggtcagtggatgatga

SEQ ID NO: 5296 - DNA, 806 bp, Avena sativa
ggaattgggacacacacacacacaaaactctctctgcagcagatcgagaggggaggagaaggcaaatggcgacctccttccaggggacgaccaccaagtgcaacgcctgcgacaagacggtgtacctcgtcgacaagctcaccgccgacaaccgggtctaccacaaggcctgcttccgctgccaccactgcaagggcaccctcaagcttgccaactacaactccttcgaaggagtgctctactgcaggcctcactttgatcagctcttcaagaggactgggagcttggacaagagcttcgaaggaactcccaaggttgtcaagcctgaaagaaacctcgagaacgagaatgctattaaagtctcgagctcatttgctggcaccagagagaaatgctttggatgcagcaagacagtctacccgattgagagggttaccgtcaataacactatgtaccacaagagctgcttcaagtgcagccatggagggtgcaccatcagcccttcaaattacatcgcacacgagggcaagctcttctgcaggcaccatcatactcagctcatcaaggagaaggggaatttcagccagctcgagaatgaccaagagaagtcatctcaaagtgctggatcagtggatgaggaagaatcagagtactagtccttgagaatattcagagattgaaataatgagtcttctttctgaagcggaacttttcagtttttccaatgccattatgtgcaattagaggacaattatattattgtcttttgtacgcatgtaaaccttgttatatttgaggcgagatgc

SEQ ID NO: 5297 - DNA, 1454 bp, Cynodon dactylon
gccattcccagctcccatataaccataaccaaaccactcaaggccagcttgggagtgctgctgtgccaatatttctatagcagctttggcattgtcggcagagagcgcgtagggaagaaagaaatggcgacctccttcaaggggacgaccaccaagtgcacggcctgcgacaagacggtgtacctcgtcgacaagctcaccgccgacaaccgcgtctaccacaaggcctgcttcaggtgccaccactgcaagggctccctcaaaggaattgtaatttgcaagcttgagggtgtgctctactgcaggccgcacttcgaccagctgttcaagaggaccgggagcctggacaagagcttcgaaggaactccaaaggttgtcaagccagaaagaaatgttgagaatgagaatgctattaaagtctcaagcgcatttgcgggcaccagagagatatgtgttggatgcaacaagaaggtctatccaattgagagggtaactgttaacgggacaatgtaccacaagagctgcttcaaatgttgccatggaggatgcaccatcagcccttcaaattatgtcgcacatgagggaaagctctactgcaagcaccaccatgtccagttgatcaaagagaaagggaacttcagtcagctcgagaatgaccatgagaaggcttcacaggctgggtcaatggaggacgatgaagaatcagaatactaatgtgggattttttccaaaaataatgagttttcttgtgtttgcattgaacaacctattttccgtggcatgttccttttcagcttatacaagtggaaggccatgtggaatcagagaaaaatgataagattgtcttgcgtatgcagttctgcacgtaaaccttattatttcgagttaaattgtctctagtcggtgtgaaccatttgatcgttacaagatgcctctgaagcaggtcacagattcaatatttttggctatatatgctatttggcattttggcagcatgatgagtagcaagagaaacacaagtggttaaaaagaaaaggaaataagcatgcaaatgttgtacaacctaatctttcagatactgaaataattggttagctggcacctcatcaaaaggtactgatccaaaccaaattaataaatcacactgaaatagaccatgcaacaagctgtaaagcaaacatagttttattctgtgaggtagaataaagctttcagcaggtggaaagaaagacgacagatcaattctgaccatattgaatgttggattattctggatatcaaatgcactctcaagattatatccttgttaaatacatttgaaggatttcaaatcatggtaaccatcatgacgtatttcttatgataaatgcgttagttacaaagagttcaatgcggtcagagtcctgtgagtttaattttgaagtatcatcagtgaacgagcaaatatgcagtga

SEQ ID NO: 5298 - DNA, 601 bp, Musa acuminata
agagcagcttctcttggggatcggagggcaggcaatggcgttccaggggacgaccaccaagtgcatggcatgcgacaagacggtgtacttggtcgacaagctcaccgccgacaaccgcgtctaccacaaggcctgctttaggtgccaccattgcaagggcaccttgaagctgggaaactataattcctttgagggagtcctgtactgccgacctcactttgatcagctcttcaagatgaccggcagtctggacaaaagctttgaagggaccccaaaggttgtcaaaccagagaagtatgtcgataacgagaacgcaaacaaagtctccagtgctttcgctggcacccaagagaagtgcgttggatgcagcaagactgtttatccgattgaaagggtgacggtcaacggaactgcgtaccacaagagctgcttcaaatgctgccatggcggatgcgtcatcagcccttcgaactacatcgcgcacgagggaaagctgtactgcaagcatcaccacatccagctgttcaaagagaaggggaactacagccagcttgagaacgatgaagcagaagctaagtcagaatcctctgctgcgtaattg

SEQ ID NO: 5299 - DNA, 1074 bp, Musa acuminata
attaagctcggcgacaaacctgtcgcttcccatcaactcttacctgtctccccatgcatcttcatcattaccccccctcctccccactcctttatttgcttgcctccaccgcaattgtctgcagctgacgtcttccctctctccgggccttgccgacgcctgagggagctcggcggtaacacgagaacgggtggtgagtcgaggagggtgcgcgcaagtaggagtgggagaagagccatggcgttccaggggacgacgactaagtgcacggcgtgcgacaagacggtgtacttggtcgacaagctcaccgccgacaaccggatctaccacaaggcttgcttcagatgccatcactgcaaggggaccttgaagctgggaaactacaactccttcgagggagtcctgtactgcagaccccattttgatcagcttttcaagatgaccggcagcctggacaaaagctttgaagggacaccgaagattgtcaaaccggaaaaacatgtcgagaacgagaatgcaagcaaggtttcaagtgcttttgctggcaccagagagaagtgtgttggatgcaacaagactgtttatccgatcgaaagggtcacggttaacggcactgcatatcacaagagctgcttcaaatgttcccgtggaggatgtgtcatcagcccttcgaactacattgcgcatgagggaaggctgtactgcaagcatcaccacatccagctcttcaaagagaagggaaactacagccaacttgagaacggcgaagagaagatttcatgcgaggcaacagcctgcgcggaagcatctgcggcgtgatcaaattccaatctttcgtctgctatccgactggttcatccctttatgagtggtgtcctttttcttgttctctcttcttgatgcagtgtcgaccataagaagatgtgttctaccgcgtcttatgtttcatgagatatgcatgctcttaaaagaaactactatttcgatgccggtatccgcttgtaaaactttcttacttggaacatatggagttggaatgcttcaaattccaggagcccttttctgtgctaatgc

SEQ ID NO: 5300 - DNA, 1032 bp, Musa acuminata
ccaccgccatttgctcgttcctccgcgattctctgcacctgacctcttcctttttcttcctgcccttccgcctcgcagctcccccacctcccatttgcctccggccttgcgcaggccctgtgggtggctgtgggcgctcaccaatcccattcccatcaacaccggctgctgcttgtagaagaagaagaacaagagtaaggtagcctctgttcggtcttgaggtttccccactggtcggacgggacgaggagcgatggcgttccaagggacgacgaccaagtgcacggcgtgcaccaagacggtgtacttggtcgaaaagctcaccgccgacaaccgggtctaccacaaggcctgcttcaggtgccaccattgcaagggcacattgaagctgggaaactataattcctttgagggagtcctgtattgcagacctcattttgatcaaatctacaaatcaactggcagtctggacaaaagctttgaagggaccccaaaggttgtcaaaccggaaaagtttgtcgataacgagaatgcaaacaaggtatcaagtgcttttgctggcaccagagagaagtgtgttggttgcaagaagactgtatatccaatcgaaagggtcacggtcaatggcaccgcatatcacaagagctgctttaaatgttctcatggaggatgcaccatcagcccttcaaactacattgcacatgaggggacgttatactgtaagcatcaccacatccagctaatcaagcagaaagggaattacagcaaacttgaggatgagaaagagaagacttcggatgaggcagcatctcctccccaagaggaagaatctgatgcatgatcgatctccacaaatgctgtctctttttgctttcttttttactgctgcatcccttcgagagcgatatccttggtttttggatgaaatgctgttgatcacaaaatttgtactactgtgtcttgtcttccacaatatatgcaggctttgaaagaaactattagttgatgtggtttctgctatcaactttctta

SEQ ID NO: 5301 - DNA, 1047 bp, Phalaenopsis aphrodite
tacaactgccagccctctctgaccccatacgcacatccctcatcatatcctcgcatccctttgcttctcccctccgctgtctctcctctttctagctgttccctgtcctgtttcctccttgtttgaaggaaagcggaggggaggcagagataaagaaagggggaggaagaacagagaggcgaggagaaagagataaagagatcagaggttgaaagaatggcgtttgcaggtactacgcagaagtgcatggcctgcgataaaaccgtttatttggttgacaaactcaccgccgacaatcgaatctatcacaaagcttgctttcgatgccaccattgcaagggcactctcaagcttggaaattacaattcatttgatggagttctatactgcaaacctcactttgatcagatctttaagagaactggcagccttgagaaaagctttgaaggcacaccaaaggttgtcaaaccagagaaacatgttgataacgagaaaccaacggctagtaaagtatcaagcgcttttgctgggaccagagagaaatgtgttggatgcaacaagactgtttatccaattgaaagggtgaccgttaatggaactccttatcacaagagctgcttcaagtgctcttatggcggctgtgtcatcagcccttcaaactatatagcacatgaagggaagctctactgcaagcaccaccacgttcagctgattaaggagaaaggcaacttgagccagctggagaatgatcatggtaagctggttgtggaaacctctgtcagcccaacggctatggaagcatgaaggtgtttcatggatgttttcaggaagcttcatcttgtgtttcagtatgctgtgctttaatttcttctttcatcttcttgaggattgtgagttgtatgattacagtataatttgcgttaattttcttgtgtgcttgaggggaaaaggatccagagttgggttccttaacctactgtgtttcctccttgaaccaataaaatgtaatcggatttataatgagtttaaatttatcacaaggtgttc

SEQ ID NO: 5302 - DNA, 1078 bp, Theobroma cacao
aattcactgcagcccacgcttccttctccccattggtttttgttaccattttacctattaataaacgcctacaaggagagaatctaattgaagaacaagagaggaaaggaggaaccagtcaatgaaaattggttcaggaagaaaataatcaaaagtaataacgaggtttactgtctttgcctttcggttcttgctcttccccaaaggttggtagtgtgtttgatatatagccttggaagcagaaaaatggcgacctttgcagggactcaacagaaatgcatggcatgcgacaaaactgtctacttggttgataagctaacagcagataaccgggttttccacaaggcttgcttcagatgccaccattgcaagggtactctcaagcttagcaactacaactcttttgaaggagtgctatactgcaggcctcactatgatcaactcttcaagagaactggcagtctggacaagagttttgaaggaacaccaaagattgtcaaacctgaaaaacatatagaaaatgagaatgcacagaaagtcgtgaacttgttcggtggcaccagagaaaaatgtgtaggatgcaataagactgtctatccaattgagaaggttacggtgaatgggacaccataccacaagagctgcttcaagtgcacccatggaggttgtaccattagtccatcaaactacattgcacatgaaggaaaactttactgcaaacatcaccacatccaactcttcaaggagaaaggaaactacagccagcttgagagtgaccgcgagaaaaccccaatgaatgagaaacttacctccatggaaattgctgctgaatcatagttttactgccggaattcaactcctcttatttccatcactcttatgcctctccgaccatccatgtcgtcgctgtgtcggtttctcttatgggtttttttggttttttttcttttcttttctttcctactattagttcacaacctcccttgcaagatgaagattttcatgatgtgccattgggttattttcctaagtggagtgagcttttgaaaataagactagtcatatggttggtttcggc

SEQ ID NO: 5303 - DNA, 1055 bp, Lotus japonicus
actgacattataattgttaggaagtctgctttactctccgcaattttcttcctttcactttatccttgtctcctcttcaatcttcattgtcctgttctttccccacttgtgacaaaacaagactcatagaaacagaacaagaatagatcatagactgcttgctacttggtaaggtaagaacaagataagaaaaaatggcatttgcaggaacaacccagaagtgtatggcttgtgacaaaacagtttatctggttgataagttgactgcggataaccgagtgttccacaaagcttgcttcagatgccaccactgcaaaggaaccctcaagctcagcaactacaactcttttgagggagttctttattgcaggccacacttcgatcaactgttcaaaagaactggtagccttgacaaaagctttgaagggacaccaaaagttgccaaaccggaaagaaatattgataatgagaaacctgcagcagccaaagtctcaagcatgtttggtggaaccagggataaatgtgcaggttgtcagaaaacggtgtatcctactgagaaggttactgtgaatggaactccttaccacaagagttgtttcaaatgctgccatggaggttgtgttatcagtccttccaattacatagcacacgagggaaaactctactgcaaacaccaccacatccaactgattaaggagaagggaaatttaagccagctggagggtgaccatgagaagaatgtagtgcaaggggaaattaatggtgacaaagttgcggcttaaacatgataagagagtcttgagtctcagaattctcaattctcaagttatgcaccatatgtttctatcatctcttaccattacatgtagtccgggaagctccttacccgtgacaaatatcgcattcaacatttgttagttgaagtgtgtggttttcatcatttgtttttggttgttgtgagtgtttgattcagaatttgtgattcagaagtacttgctacagcacttgttaagactctcaatgacttcatattgatatcctacacggacgtcaca

SEQ ID NO: 5304 - DNA, 1062 bp, Elaeis guineensis
tttctctcttcttttccctgccttcctgtcatcccattccctgtcttccattttagctggcttgtcctctgggctttgtggaagagcaaagaaagcccagcaatataaattaagtcctaacatatggaagaggtggtggtgaaaggataggagaagaagagaggggcttcccttttggtgtattcttctattgttgttgctccattcgtttagaaggctccgaaaggacaagtaaccaagagcaatggcattccaagggacacagaccaaatgtacggcttgcagcaagacggtctacctggtggacaagctcaccgccgacaaccgaatctaccacaaggcctgttttagatgccaccactgccagggaaccttgaagctgggaaattataattcattcgagggagtcctctactgcaggcctcactttgatcagcttttcaagaggactggcagcctggacaaaagctttgaagggaccccaaaggttgtcaagccagaaaaacctgttgatactgagaaaccagcagccaacagagtctcaagtcaatttgcgggaaccagagagaagtgttttggatgcaagaagacagtatatcccattgagagggttacagttaatgggactgcatatcacaagagctgcttcaaatgcactcacggaggatgtgtgattagcccttcaaattacattgctcatgagggaaggctctactgcaagcaccaccacattcagctgtttaaggagaaggggaactacagccagcttgaaaccgaccaagagaagatggggaatgaggcaccaaccagtgcagaagaattagagtcataattcatgaagacagatgcagctatcctatttctctttcctgcatgtttcttcatcaccttaagagccgtgattcactgaaatttcaatgtatggaccgttaaaattgttcggttgtgttttcattgggattttctatgatatttgctggctttgaaaggactctggactgaattcatatctgcttgtaagacttattaccgggttctcatggagtttgaatgcagttcttt

SEQ ID NO: 5305 - DNA, 952 bp, Vigna unguiculata
ccttgtctcctctccaatcttcattcttctgttcttctcttggtgtgaaaccaagactgataacacacccacagagatcatagcttgtgtctgtaaggtgagaagataaagatataatggcatttgcaggaacaacccagaagtgtatggcttgtgacaaaactgtttatctggttgataagttaactgcagataaccgagtgttccacaaagcttgcttcagatgccaccactgcaaaggaaccctcaagcttagcaactacaactcttttgagggagttctttactgcagaccacactttgatcaactgttcaaaagaaccgggagccttgacaaaagctttgaagggacaccaaaagttgcgaagccagagaaaaatttggaggagaaacctggagcagccaaagtgtcaagtatgtttggtggaacaagggataaatgtgctggttgtcagaaaacagtgtatcccactgagaaggttactgtgaatggaacaccttaccataagagttgtttcaaatgctgccatggagggtgtgttatcagtccttccaattacatagcacacgagggaaaactctactgcaaacaccatcatatccaattgatcaaggagaagggaaatttaagccaactcgaaggtgatcatgagaagagtgaaaataatgggaaaatcaatggtgaagaagttgctgcggaggcatgatgaaagattcttgaatcccagaactttgttttttcaagttccatatttgtgcaccatatgtttctgcgtctctcatcttttaccattgcttgcagtttcgttagttgaagtgtgcggatctttatcatatgtttttggttgttgtgagcgtttgattcagaatgtgattcagaagtacatgttactgcactttttgaaactctcatgcacttccaattgatattgaatatacatatgttactata

SEQ ID NO: 5306 - DNA, 955 bp, Vigna unguiculata
  misc_feature (35)..(35): n is a, c, g, or t
  misc_feature (95)..(95): n is a, c, g, or t
ccttgtctcctctccaatcttcattcttctgttcntctcttggtgtgaaaccaagactgataacacacccacagagatcatagcttgtgtctgtnaggtgagaagataaagatataatggcatttgcaggaacaacccagaagtgtatggcttgtgacaaaactgtttatctggttgataagttaactgcagataaccgagtgttccacaaagcttgcttcagatgccaccactgcaaaggaaccctcaagcttagcaactacaactcttttgagggagttctttactgcagaccacactttgatcaactgttcaaaagaaccgggagccttgacaaaagctttgaagggacaccaaaagttgcgaagccagagaaaaatttggaggagaaacctggagcagccaaagtgtcaagtatgtttggtggaacaagggataaatgtgctggttgtcagaaaacagtgtatcccactgagaaggttactgtgaatggaacaccttaccataagagttgtttcaaatgctgccatggagggtgtgttatcagtccttccaattacatagcacacgagggaaaactctactgcaaacaccatcatatccaattgatcaaggagaagggaaatttaagccaactcgaaggtgatcatgagaagagtgaaaataatgggaaaatcaatggtgaagaagttgctgcggaggcatgatgaaagattcttgaatcccagaactttgttttttcaagttccatatttgtgcaccatatgtttctgcgtctctcatcttttaccattgcttgcagtttcgttagttgaagtgtgcggatctttatcatatgtttttggttgttgtgagcgtttgattcagaatgtgattcagaagtacatgttactgcactttttgaaactctcatgcacttccaattgatattgaatatacatatgttactatactc

SEQ ID NO: 5307 - DNA, 933 bp, Saccharum officinarum
gcatccccgcccagccaatcttcctcgttccgccgctcccactccggaggcgccggcggccggcgaggcgaggatctccccagcggcctcgcctaccaacgtccaggagcaatggctctgtctgcctcgctacggatttctctcatcgtcgcgttctttgggattctggcgttcatactcggtgtcattgccgaaaacaaaaagcctgcttctgggactcctattccaggaaaggatgtcgtcatctgcaagtttccaagtgatccaactcttgcaatgggaagcctgtccattgtggcacttgtggtagctgccattgtaggccatgttgctatctttttcccatactcgggcaagtcagttcctcgcggggcactgtttcaaagcaccagcttgtcagtgttctttgttgttgctgagcttgtctcagccctggcttttgcaatgttgttgtgggcaactgtcaccgagggacttcaccgcagcaagaacatccaccacgacatgaattaccagtgccctactgcaaagacaggcctgtttggtggtgccgctttccttgcccttgacgctgctctcttctggcttgtttgccagatgctggccctcaatgcaagggctgactacctggatgaggatgacaacaagggcgaatatggccaggtttacgctgctgaagtcgatggctcgaaggtctgagcctatgcggccatgctcatcagggttctatgattagtgtcacttaaatatattatgtcatcaacaaagtcgctttagctctcgtaaatttgtatataagttgcaaagtcttacataaggctggtggttattctgcattttcaggtttcagtgtgaccaataaacagtattgtcagtacaattggtttgctacttcccatagtaaactttatccttgtgctatgacgctcttct

SEQ ID NO: 5308 - DNA, 1044 bp, Panicum virgatum
tccattatttaggctacctgttctcttgatctcaatgggctattcacttgttcttcaggagcaatggctctgtcttcgccgatacggatttctctcatcgtttccttcttcgggattctggcattcgtgcttggtgtcattgcggaaaataaaaaacccgctgctgggactcctatcccaggaaaggatgtcgtcatctgcaagtttccaagtgatccgactcttgcaatgggtagcctgtccattgtggcgcttgtggtagttgccattgtagggcatgttgctatcttttttccgtactcaggcaagtctgttcctcgtggagcactctttcaaagcaccagcttgactgtgttcttcgttgttgctgagcttgtctcaggcctggctattgcaatgttgctctgggcaactgttaccgagggccttcaccgcaccaataccatccatcatgacatgaattaccagtgccctactgcaaagactggactgtttggtggcgccgctttccttgccctagacgctgctctcttctggcttgtttgccagatgctggccctcaatgcaagggctgactacctggatgaggatgacaacaagggcgaatatggccaggtttacgctgctgaagttgatgcctcgaaggtctgagcccatgtggtcatcgcttgtcagggttttatgattagtgccacttaactatattatgttgtcaacaaagtcgcttttagctcttaaatctgtatatagtgttatgctggttgcaaagtcataagtaaggctgttacttattctacattttcagattcagtgtgaacaataagctgcattctcaatgcaattggtttggtcatcgctcgtcagggttttatgattagtgccacttaactatattacgctgtcaacaaagtcgcttttagctctctttaatctgtatatagtgttatgctggttgcaaagtcaggctgttattctacattttcagattcagtgtgaacaataaactgcgttctcaatgcaattggtttgctacttccttaagtg

SEQ ID NO: 5309 - DNA, 1020 bp, Setaria italica
gcccgtgccttgcaacccatccatccccgcttcccccaacaaaccgtgcgtcttcccccctccgctggcgacggcggcgaggtgaggcgactgaccaccgaaatcgggccctctccggcgaccgccaccccggcttccagccaggagcaatggctctgtcttcgccgatacggatttccctcattgtttcgttctttgggattctggcgttcgtgcttggcgtcatcgcggaaaacaaaaagcctgctgctgggactcctatccaaggaaaggatgttgtcatctgcaagtttccaagtgatccaactattgcaatgggaagcctgtcccttgtggcgctcgttgtagctgccattgtaggacacgttgctatctttttcccgtactcgggcaagtcagtacctcgtggagcgctctttcaaagcaccagcttgactgtgttcttcgttgttgcagagcttgtctcggccctggctattgcaatgttgctctgggcaactgttactgagggccttcaccgcagcaacacaatccaccacgacatgacttaccagtgccctactgcaaagactggcctgtttggtggcgccgctttccttgccctagatgctgctctcttctggcttgtttgccagatgctggccctcaatgcaagggctgattacctggatgaggatgacaacaagggtgaatatggccaggtttacgctgctgaagttgatggctcgaaggtctgagcccgtgtgatcatcacatcgtcagagttttatgattagtgccacttaactgtattatgtcgtcaacaaagtcactgtagctctcttaaatttgtatatacgtgtgatgctggctgcgaagtcgtaaggctattacttattctgcattttcagatttcagtgtgaacaataaactgcattctcaatacaattggtttgctacttcccaaagtgaacttaaccttgctataccgctctgttttatgctgagactgtaatcctgggagcttgttccaaatatcag

SEQ ID NO: 5310 - DNA, 1012 bp, Panicum virgatum
aaaataaataaataaataatactacccaactaactcgccgtgcgcccgtgccttgcaatccatccccgccaaactaatcgtcgtctcgttcctctcccctccgcccctccgctggcagcggcgaggcgaggcggctgaccaccgatcgggccctctccggcgaccgccgcgcccctgcttcaggagcaatggctctgtcttcgccgatacggatttctctcatcgtttccttcttcgggattctggcattcgtgcttggtgtcattgcggaaaataaaaaacccgctgctgggactcctatcccaggaaaggatgtcgtcatctgcaagtttccaagtgatccgactcttgcaatgggtagcctgtccattgtggcgcttgtggtagttgccattgtagggcatgttgctatcttttttccgtactcaggcaagtctgttcctcgtggagcactctttcaaagcaccagcttgactgtgttcttcgttgttgctgagcttgtctcaggcctggctattgcaatgttgctctgggcaactgttaccgagggccttcaccgcaccaataccatccatcatgacatgaattaccagtgccctactgcaaagactggactgtttggtggcgccgctttccttgccctagacgctgctctcttctggcttgtttgccagatgctggccctcaatgcaagggctgactacctggatgaggatgacaacaagggcgaatatggccaggtttacgctgctgaagttgatgcctcgaaggtctgagcccatgtggtcatcgcttgtcagggttttatgattagtgccacttaactatattatgttgtcaacaaagtcgcttttagctcttaaatctgtatatagtgttatgctggttgcaaagtcataagtaaggctgttacttattctacattttcagattcagtgtgaacaataagctgcattctcaatgcaattggtttggtcatcgctcgtcagggttttatgattagtgccactta

SEQ ID NO: 5311 - DNA, 1047 bp, Panicum virgatum
ccgaaccaactcgccgtgcgcccgtgccttgcaatccatcaccgcccaactaatcgtcgtctcgttcctctcccctccgctggccgcggcgaggcgaggcggctgatcaccgaacgggccctctccggcgaccaccgcgccccggcttcaggagcaatggctctgtcttcgccaatacggatttctctcattgtttccttcttcgggattctggcgttcgtgcttggtgtcatcgcagaaaacaaaaagcccgctgctgggactccaatcccaggaaaggatgtcgtcatctgcaagtttccaagtgatccgactcttgcaatgggtagcctgtcccttgcggcccttgtggtagctgccgttgtagggcatgttgctatcttttttccctactcgggcaagtcggttcctcgtggagcactctttcaaagcaccagcttgactgtgttcttcgttgttgctgagcttgtctcaggcctggctattgcaatgttgctctgggcaactgttactgagggccttctccgcagcaataccatccatcacgacatgaattaccagtgccctactgcaaagactggactgtttggtggtgccgctttccttgccctagacgccgctctcttctggcttgtttgccagatgctggccctcaatgcaagggctgactacctggatgaggatgacaacaagggcgaatatggccaggtttacgctgctgaagttgatgcctcgaaggtctgagcccatgtggtcatcgctcgtcagggttttatgcttagtgccactatattatgccgtcaacaaagtcgcttttagctctcattaatctgtatatagtattatgctggttgcaaagtcataagtaaggctgttacttattctacattttcagatttcagtgtgaacaataaactgcattctcgatgcaattggtttgctacttccctaagtgaatctaaccttgtgctatactgctctgttttatgctgtgactgttatcctgggagcttgttccaaataccagagttcctgcatctgaggggg

SEQ ID NO: 5312 - DNA, 977 bp, Panicum virgatum
ctcgccgtgcgcccgtgccttgcaatccatcaccgcccaactaatcgtcgtctcgttcctctcccctccgctggccgcggcgaggcgaggcggctgatcaccgaacgggccctctccggcgaccaccgcgccccggcttcaggagcaatggctctgtcttcgccaatacggatttctctcattgtttccttcttcgggattctggcgttcgtgcttggtgtcatcgcagaaaacaaaaagcccgctgctgggactccaatcccaggaaaggatgtcgtcatctgcaagtttccaagtgatccgactcttgcaatgggtagcctgtcccttgcggcccttgtggtagctgccgttgtagggcatgttgctatcttttttccctactcgggcaagtcggttcctcgtggagcactctttcaaagcaccagcttgactgtgttcttcgttgttgctgagcttgtctcaggcctggctattgcaatgttgctctgggcaactgttaccgagggccttctccgcagcaataccatccatcacgacatgaattaccagtgccctactgcaaagactggactgtttggtggtgccgctttccttgccctagacgccgctctcttctggcttgtttgccagatgctggccctcaatgcaagggctgactacctggatgaggatgacaacaagggcgaatatggccaggtttacgctgctgaagttgatgcctcgaaggtctgagcccatgtggtcatcgctcgtcagggttttatgcttagtgccactatattatgccgtcaacaaagtcgcttttagctctcttaaatctgtatatagtattatgctggttgcaaagtcataagtaaggctgttacttattctacattttcagatttcagtgtgaacaataaactgcattctcgatgcaattggtttgctacttccctaagtgaatctaaccttgtgctatactgctctgtttt

SEQ ID NO: 5313 - DNA, 936 bp, Pennisetum glaucum
tccatccatccccgctgcccccccaacaaaccgtgcgtcttctcctccccgactcccccctccgctggcgaaggcggcgagccgaggcgactgaccgccggaatccggccctctctccggcgaccgccacctcggcttccatccaggagcaatggctctgtcttcgccgatacggatttccctcattgtttcgttcttcgggattctggcgttcgtgctcggtgtcgtcgcggagaacaaaaagcctgctgctgggactcctatccatggaaaggatgttgtcatctgcaagtttccaagtgatccaactattgcaatgggaagcatgtccctcgtggcgctcgtggtagctgccattataggacatgttgctatctttttcccttactcgggcaagtcggtacctcgtggagcgctctttgaaagcaccagcttgactgtgttcttcgttgttgcagagcttgtctcagccctggctattgcaatgttgctctgggcaactgttactgagggccttcaccgcagcaatacaatccaccacgacatgacttaccagtgccctactgcaaagaccggcctgtttggtggtgccgctttccttgccctagacgctgctctcttctggcttgtttgccagatgctggccctcaatgcaagggctgactacctggatgaggatgatgacaagggcgactatggccaggtttacgccgctgaagttgatggctcaaaggtctgagctcatgtgatgatcacatcatcagggtttattagtgccacgtgactatatattatgtcgtcaacaaagtcattgtagctcttttaaatttgtatatacatgttatgctggttgtaaagtcgtaaggctggtacttattctgcattttcagatttcagtgtgaacaaaaaactgcattctcaatacaattggtttgc

SEQ ID NO: 5314 - DNA, 835 bp, Cynodon dactylon
gccgggggtgtgaaagagaatcaattaaactgcctctgcgcctcacgagattaacgaccaaccaacgaactcgcccccttcattccgtcaccactcaccacccccaggcgcggcggcggcaacgacgaccaatcgatccagacctctccaaccaccgcctcttctcgtgatctcgtctcgtcagagcaatggctctatcttcgccacagaggattgctctcatcgttgctttctttggcattctggcatttgtgcttggggtcgtcgcagaaaataaaaagcctccttatggaactcctatcaagggaaaggatgttgtcatctgcaagttcccaagtgacccaaccattgccatgggaagcctgtccattgtggcgcttgtctttgctgctatcgttgggcatgtctctatcttccattcgtactcgggcaagtcggttcctcgcggagcattgtttcaaagcaccagcttgtctgtgttcttcgttgttgctgagcttgtctcagccctagcttttgcaatgttgctctgggcaacagtcaccgagagccttcaccgcaccaacaacatccacaaagacatggaataccagtgccccactgcaaagactggactgttcggtggtgctgctttccttgcccttgatgcctctcttttctggcttgtttgccagatgttggccctcaacgcaagggcagactatctggatgaggatgacaacaagggtgaatatggccaggtttacgctgctgaagtcgatggctcgaaggtctgagttcatgtagtatctacttaactacgttatttcatcaacaaagtcgctttagctctctt

SEQ ID NO: 5315 - DNA, 930 bp, Eragrostis curvula
gggatcccaacaactaatcctctccttcccacttgcggccatcggcggcgacgaccagcagatcgagctctctccggccggcgaccgcaccactgccacctcgttccctcatctcggctcctcggagcaatggctctatcttcgccacaacggatcgccctcatcgtcgcattctttggccttctggcgttcgtacttggtgtcatcgcagaaaataaaaagcctgcttatggaactcctatccaaggaaaggatgttgtcatctgcaagttcccaaatgacccaaccattgccatgggaagcctgtccattgtggcgcttatattagctgctatcataggacatgttgctatctttcatccgtactcgggcaagtcggttccccgcagagcattgtttcaaagcactagcttgtctgtgttcttcgttgttgctgagcttgtctcagccttggcttttgcaatgttgctctgggcgacagtcactgagagccttcaccgaagcaatagcatccaccacaacatggactacaagtgccccactgcaaagaccggactgtttggtggcgctgctttccttgcacttgatgcttccctcttctggcttgtttgccagatgttggcactcaacgcaagggctgactatctagatgaggatgacaccaagggtgaatatggccaggtttacacttctgaagccgatggctccaaagtctgagcccatgtggcctagcttttcagggttttatgattagtgtctactttgctatattatttcatcaacagtcgttttagctctcttagatttgtatatatgtgttgcaccagtgccaaagtggtctgtaaggttgccgttcattgtgcatttcagattccagtgtaaacaataaactgcacccgcaatataattggtttgctgctttgctaagtt

SEQ ID NO: 5316 - DNA, 1184 bp, Brachypodium distachyon
aacaaacaaaccttccttccttccttccgacctctcgcccgcagccgcagggactggacgacgctgggagaagagaagagaatcgcccgatccacgcgcggcggagctagggtttccgcccctcggcgccgcggagcgatggctacgtcggctcaacggatcgctctcaccgtctccctgtttggtgtcttggccttcctgcttggtgtcattgcagaaaacaaaaagcctccttatggaactcctatcaaaggaaaggatgttgtcatctgcaagttcccgagtgacccaaccattgcaatgggaagcctgtcccttgtggcacttgtattagctgctatcattggacatgttgccatcttttacccgtacaagggcaagtcagttcctcgtggagcactatttcagagcaccagcttgtctgtattcttcgtcgttgctgagctagtgtcagctctggcttttgcgatgttgctctgggcgacaatcacggaggggcatcatcgcaccagtaacatccaccatgacatggatacccagtgccctaccgcaaagactggcctctttggaggtgccgctttcctggcccttgatgctgctctgttctggcttgtttgccagatgctggccctcaatgcaagggctgactatctggatgaggatgatgatgataagggtgaatacggccaggtttatgctgctgatgctgagggctcaaaggtctgagttggtcatccgcaggacttcataattagcgtcagtcagatatatttagatacattatgtcttcgtgaaagccggtttggctcaaaaagttgtagatatgtcatgtcagtctctcagtcgtacataagattattgctcatcccgatatcagatctcggattgaacaataaactgcactctggtttgctacttccttcagtgaagtaaagtatggtgtgatcgatcaattgttttactgctccaatttatgttcggtttgtctgggattgtaattctggaaggttgtttccagataccagtgattctgaatctgcgtgctgcttaggaagcaactgggttactttacattctctacacaatgcaatggttgtacattgaggtgccaagcgtagaaagcaactacatttgacatgcagggaaaccaccgcttaaagaattgaatgttagttacttacatt

SEQ ID NO: 5317 - DNA, 723 bp, Festuca arundinacea
  misc_feature (296)..(296): n is a, c, g, or t
ggcacgaggcatccgtcccaccgcagcgcagcgcagcgcaggagtggacgcggagcgatccgcggccgccggagctcatccccctcttgctcctcccgccgccgtccgtctctgcggagcgatgggcttcacttcggctcaacggatcgctctcaccgtctccctgttcggcatcctcgcgtttctgctcggcgtcatcgcggagaacaaaaagcccccatatgggacacctatcaagggaaaggatgtcgtcatctgcaagttcccgagtgacccgaccattgcaatgggaagcntctccattgtggcgctcgtgttagctgctatcatcgggcacgtttccatctttttcccgtacaagggcaagtcggttcctcgtggagcattattccagagcaccagcctgtcggtgttcttcgtcatcgcggagctggtgtcagctctggcttttgcgatgctgctctgggcaacgatcacggagagtcaccatcgcaccagcaacatccaccatgacatggacacccagtgccctaccgcaaagactggcctttttggaggtgccgctttcttggcccttgacgctgctctgttctggcttgtttgccagatgctggccctcaatgcaagggctgactatctggacgaggacgacgacaagggtgaatatggccaggtttatgctgcgggtggtgatggctccaaggtctgagtcacttatctgca

SEQ ID NO: 5318 - DNA, 1093 bp, Pseudoroegneria spicata
  misc_feature (144)..(144): n is a, c, g, or t
  misc_feature (147)..(147): n is a, c, g, or t
  misc_feature (190)..(190): n is a, c, g, or t
cgggaaagcccaaccgtgtgccgtccgaagcgggccgccggccccactcgcagcctcacaccgcacactgctatatccgcccgtggcccgtggggtggagttgaccacagaccttccttccttccttccaccatcctcccaccncancgcaggagtggcggacgcggggggagaagagaggagagattcncgcgcggcggagccagggttcccggccggccacctccttccgacgtctccgcccacggagcgatggctttgacttcggcgcaacggatcgccctcacggtctccttgtttggcctcctcgcgtttctgctcggcgtcgtcgcagaaaacaaaaagcctccttatggaactcctatcaagggaaaggatgttgtcatctgcaagttcccgagtgacccaacgattgcaatgggaagcctgtccattgtggcacttgtcttagctgctttcattgggcacgttgccatcttttacccgtacaagggcaagtcggttcctcgtggagcgttatttcagagcaccagcttgtctgtgttctttgttgttgctgagctggtgtcagctctggcttttgcaatgctgctctgggcaacgatcacggagggtcaccatcgcaccagtaacgttcaccacgacatggacaccctgtgccccaccgcaaagaccggcctctttggaggcgccgctttcctggcccttgacgctgctctgttctggcttgtttgccagatgctggccctcaatgcgagggctgactatctggatgaggatgaggatgacaagggcgaatatggccaggtttatgctgctgatgccgatggcacgaaggtctgagtcggttaactgcaggatttcaaaactagcaccgtttagatatattttagattcattatgcgtctttgaaaaggtcggtttagttctccaaaaaattgtagatatgtcgtgccattcccgtagtcgtacataaggtcatttcctcattccagtttcagacttcagagtgaacaataaattgtgttcttgtttgctacttccctttctgaattaaagtatcgtgttatctgtgaatgtttgatgtctccaa

SEQ ID NO: 5319 - DNA, 1058 bp, Hordeum vulgare
tggggagaagagagattcgcgcgcggtggcgctagggttcccggccggccacctccttccgacgtctccgcccgcggagcgatgggtctgacttcggcgcagcggatcgccctcaccgtctccttgtttggcctcctcgcgtttctgctcggcgtcgtcgcggaaaacaaaaagcctccttatggaactcctatcaagggaaaggatgttgtcatatgcaagttcccgagtgacccaacggttgcaatgggaagcctgtccattgtagcacttgtattagctgcgatcattgggcacgtggccatcttttacccgtacaagggcaagtcggttcctcgtggagcgttatttcagagcaccagcttgtccgtcttctttgttattgctgagctggtgtcagctctggcttttgcaatgctgctctgggcaacgatcacggagggccaccatcgcaccagtaacgttcaccatgacatggataccctgtgccccactgcaaagaccggcctcttcggaggcgccgctttcctggcccttgatgctgctctgttctggcttgtttgccagatgctggccctcaatgcaagggctgactatctggatgaggatgaggatgacaagggcgaatatggccaggtttatgctgctgatgccgatggcacaaaggtgtgagtcagttacctgccagaaagttagcaccgtttagttatatatatattccctccgatcacaaatattagatgttttggatattttaatatgaactacatacggactgaaatgagtgaacaaacacactaaaatgcgtctatatacattcaaatcagaaagctggaacatcttataatagtgaacggagggagtatattttagatacatcatgtctttgagaaggtctgtgtttagttctccaaaaattgtagatatgtcgtgtcattcgcatagtcgttcataaggtcatttggtcattccagtttcagacttgagattgaacaataaacatattctggtttggttcttcccttggtgaaattatcatgttatctgtgaatgtttaa

SEQ ID NO: 5320 - DNA, 1768 bp, Hordeum vulgare
atatccctccgtgacctgtggggcggagttgaccacagaccttccttccttcctccatcgtcccacagactggggagaagagagattcgcgcgcggtggcgctagggttcccggccggccacctccttccgacgtctccgcccgcggagcgatgggtctgacttcggcgcagcggatcgccctcaccgtctccttgtttggcctcctcgcgtttctgctcggcgtcgtcgcggaaaacaaaaagcctccttatggaactcctatcaagggaaaggatgttgtcatatgcaagttcccgagtgacccaacggttgcaatgggaagcctgtccattgtagcacttgtattagctgcgatcattgggcacgtggccatcttttacccgtacaagggcaagtcggttcctcgtggagcgttatttcagagcaccagcttgtccgtcttctttgttattgctgagctggtgtcagctctggcttttgcaatgctgctctgggcaacgatcacggagggccaccatcgcaccagtaacgttcaccatgacatggataccctgtgccccactgcaaagaccggcctcttcggaggcgccgctttcctggcccttgatgctgctctgttctggcttgtttgccagatgctggccctcaatgcaagggctgactatctggatgaggatgaggatgacaagggcgaatatggccaggtttatgctgctgatgccgatggcacaaaggtgtgagtcagttacctgccagaaagttagcaccgtttagttatatatatattccctccgatcacaaatattagatgttttggatattttaatatgaactacatacggactgaaatgagtgaacaaacacactaaaatgcgtctatatacattcaaatcagaaagctggaacatcttataatagtgaacggagggagtatattttagatacatcatgtctttgagaaggtctgtgtttagttctccaaaaattgtagatatgtcgtgtcattcgcatagtcgttcataaggtcatttggtcattccagtttcagacttgagattgaacaataaacatattctggtttggttcttcccttggtgaaattatcatgttatctgtgaatgtttaatggcttgattttttgttctgttgtgctattatgctattgtaattctggaggatgtgtgatctgaatctatgtgtgtggtttgtaagcaacaaaatatgttagattgtacataatgaaatggctgcgcattgcggaaatgcagtaacaaattacatttgacatcatgtttctacaagtgaggtttggtcggcaggagaatcaaagaatcaattgctacttacattacggctgcaccaggcatagtattgctaagttacatgcatgacgtacgtaccatcatgtctaggacaagctaaatcttatgaacagctaacatccatgacaaaaactgcctcacaataggtggtcgccgacttagcatcacctgtcaccataaccttctgcttcagaaggaacctatagcatttggattttgtaacttatcaattcaggcatcaggcatctatgtcatgccttgagcatcaatcttggtcacaatcagcttgattgttatcaaattcaccgacaaatgcagacagttacttgcgctgttgcattatgcaaactttgaacaaatggtgcatgttgcttctttctatactcagtcatggctggcggatagtgagtgaaccatgctgcatcgagagaaaggaaacggctt

SEQ ID NO: 5321 - DNA, 903 bp, Leymus cinereus x Leymus triticoides
ctccgaccgtattgaaggagtggcgggcgcggggggagaagagagattcacgcgcggtggggttcccggccggccacctccttcgcctccgaccgacgtctccgcccacggagcgatgggtttgacctcggcgcaacggatcgccctcagcgtctccttgtttggcctcctcgcgtttctgctcggcgtcgtcgcagaaaacaaaaagcctccttatggaactcctatcaagggaaaggatgttgtcatctgcaagttcccaagtgacccaactattgcaatgggaagcctgtccattgcggcacttgtattagctgctatcattgggcacgttgccatcttttacccgtacaaggggaagtcggttcctcgtggagcgttatttcagagcaccagcttgtctgtgttctttgttgttgctgagctggtgtcagctctggcttttgcaatgttgctctgggcaacgatcacggagggtcatcatcgcaccagtaacgttcaccacgacatggataccctgtgccccaccgcaaagaccggcctctttggaggcgccgctttcctggcccttgacgctgctctgttctggcttgtttgccagatgctggcactcaatgcgagggctgactatctggatgaggatgatgatgacaagggcgaatatgaccaggtttatgctgctgatgctgatggcacaaaggtctgagtcagttaactgcaggatttcaaaactagcaccgtttagatatattttagatacattatgtgtctttgaaaaggtcggtttagttctccaaaaaattgtagatatgtggtgccattcgtgtagtcgtacataaaggtcatttcctcattccagtttgagacatcagattgaacgataaattgtgttctggtttgcta

SEQ ID NO: 5322 - DNA, 982 bp, Triticum aestivum
agattcacgcgcggcggagcccggccacctccttccgacgtctcctccgcccacggagccatgggtttgacatcggcgaaggggatcgccctcaccgtctccttgtttggcctcctcgcgtttctgctcggcgtcatcgcggaaaacaaaaagcctccatatggaactcctatcaagggaaaggatgttgtcatctgcaagttcccgagtgacccaacgattgcaatgggaagcctgtccattgtggcacttgtgttagctgctttcattgggcacgttgccatcttttacccgtacaagggcaagtcggttcctcgtggagcgttatttcagagcaccagcttgtctgtgttcttcgttattgctgagctggtgtcagctctggcttttgcaatgctgctctgggcaacgatcacagagggtcgccatcgcaccagtaacattcatcatgacatggataccctgtgccccaccgcaaagaccggcctctttggaggcgccgctttcctggcccttgacgctgctctgttctggcttgtttgccagatgctggcccttaatgcgagggccgactatctggatgaggatgaggatgaggatgacaagggcgaatacggccaggtttatgctactgatgccgatggcacgaaggtctgagtcggctaactgcaggatttcaaaactagcaccgtttagatatattttagattcattatgcgtctttgaaaaggtcggtttagttctccaaaaaattgtagatatgtcgtgccattccgtagtcgtacataaggtcattttctcattccagtttcagacttcagattgaacgataagttgtgttctggtttgctacttccctttctgaattaaagtatcatgttatctgtgaattttttatgtctgcattctgttgttctgctatttgtaaatctggaggtgtcttcagatatcagtgtgttcagtgaaatgtactaacaattac

SEQ ID NO: 5323 - DNA, 1024 bp, Secale cereale
cctcacaccgcacaccgctatatccgtccgtggcctgtggggtggagttgaccacagaccttccttccttccttcctccatcctcccaccgcagcgcaggcaggagtggcggacgcgcggggagaagagaagattcacgcgcggcggagccagggttcccggccggccgcctccttccgacgtctcctccgcccacggagcgatggctttgttgacttcggcgcagcggatcgccctcaccgtctccttgtttggcctcctcgcgtttctgctcggcgtcattgcagaaaacaaaaagcctccttatggaactcctatcaagggaaaggatgttgtcatctgcaagttcccgagtgacccaacgattgcaatgggaaccctgtccatcgtggcacttgtgttagctgctttcattgggcacattgccatcttttacccgtacaagggcaagtcggttcctcgtggagcgttatttcagagcaccagcttgtctgtgttctttgttattgctgagctggtgtcagctctggcttttgcaatgctgctctgggcaacgatcacggagggtcaccatcgcaccagtaacgttcaccatgacatggataccctgtgccccaccgcaaagactggcctctttggaggcgccgctttcctggcccttgacgctgctctgttctggcttgtttgccagatgctggccctcaatgcgagggctgactatctggacgaggatgaggatgacaagggcgaatacggccaggtttatgctgctgatgctgatggcacgaaggtctgagtcagtaactgcaggatttcaaaactagcaccgtttagatatattttagatcacattatgcgtctttgaaaaggtcggtttagttctccaaaaaattgtagatatgtcgtcgtgccattcccgtagtcgtacataaggtcatttcctcattccagtttcagacttcagattgaacgataaattgtgttctggtttgctacttccctttctgaagtaaagtatcatgtt

SEQ ID NO: 5324 - DNA, 989 bp, Secale cereale
tggcggacgcgcggggagaagagaagattcacgcgcggcggagccagggttcccggccggccgcctccttccgacgtctcctccgcccacggagcgatggctttgttgacttcggcgcagcggatcgccctcaccgtctccttgtttggcctcctcgcgtttctgctcggcgtcattgcagaaaacaaaaagcctccttatggaactcctatcaagggaaaggatgttgtcatctgcaagttcccgagtgacccaacgattgcaatgggaaccctgtccatcgtggcacttgtgttagctgctttcattgggcacattgccatcttttacccgtacaagggcaagtcggttcctcgtggagcgttatttcagagcaccagcttgtctgtgttctttgttattgctgagctggtgtcagctctggcttttgcaatgctgctctgggcaacgatcacagagggtcaccaccgcaccagtaacgttcaccacgacatggataccctgtgccccaccgcaaagactggcctctttggaggcgccgccttcctggcccttgacgctgctctgttctggcttgtttgccagatgctggccctcaatgcgagggctgactatctggatgaggatgaggatgacaagggcgaatatggccaggtttatgctgctgatgctgatggcacgaaggtctgagtcgggtaactgcaggatttcaaaactagcaccgtttagatatattttagatcacattatgcgtctttgaaaaggtcggtttagttctccaaaaaattgtagatatgtgccattcccgtagtcgtacataaggtcatttcctcattccagtttcagacttcagattgaacgataaattgtgttctggtttgctacttccctttctgaagtaaagtatcatgttatctgtgatttttttatgtctgcatttttatgttccgttgttctgatatttataaatctggaggtgtcttcagata

SEQ ID NO: 5325 - DNA, 979 bp, Avena sativa
ttcatccgtcccaccgcaccgcagctgtcgacgccggggagaagacgagggaggagcttcgtccgtcgatccgcgcgcgccggagctagcgttccggtcgcccccccccccctgtttccctcctcctcgcctgctcctccggccgccgtccgtctccgcggtgccatggctttgttgacgtcggctcaacggatcacattcaccgtctccctctttggcctcctggcgtttctgctcggcgtcatcgcggagaacaaaaagcctccttacgggactcctatcaagggaaaggatgtcgtcatctgcaggttccccagtgacccgacggtcgcgttgggaagcgtgtccattgtggcgcttgtgctagccgctatcattgggcacgtttccatcttttacccgtacaagggcaagtcggttcctcgcgaagcattgtttcagagcaccagcttgtccgtgttctttgtcattgctgagctggtgtcggctctggcgtttgcaatgctgctctgggcaacgatcacggagagccaccatcgcacaagcaacattcaccacgacatggatacccagtgccccaccgcaaagactggcctctttggaggtgccgctttcctggcccttgacgctgctctgttctggctcgtttgccagatgctggccctcaacgcaagggctgactacctggatgaggatgatgacaagggtgaatatggccaggtttatgctgctgatgctgatggctccaaggtctgagctagttatctgcggggtttcataattagcatcggttagatatatatcttagttacattatgtcttcgacaaagtcggtttagctctccaaaaaagtgtagatatgtcgtgcctccattcacgtagtcctacataagattatttgttcattccagtttcagacttcagattgaacgataaactgcaccccagatttgctacttcttttattgaagttaaagaa

SEQ ID NO: 5326 - DNA, 1137 bp, Oryza sativa
atcggggaagcctatcggttagttaggagttgagttgaccaacttaactacctttcgccgagctcgcggagagaagaagggattccagtggagcacgcgatttcccatctgctcgatcccctcctcctcctagggtttcctgctcctccgcccgcctcgccttgctgctgccgttgttggttggtgcgatggctctcacttcggctcaacggattgctctcactgtctctttctttggccttctctccttcttacttggtgtcatcgcagaaaacaagaagcctccttatggaactcctatcaaaggaaaggatgttgtcatctgcaagttcccaagtgacccaactattgcaatgggaagcctctccgtggtgtcacttgtgttaaccaccatcgtagggcatgccgctatcttctatccatacaagagcaagtctgttcctcgcggagcattatttcgaagcgccagcttatctgcgttcttcgttattgctgagcttgtctcagctctggcgtttgcaatgttgctctgggcaacggtcaccgagggtcttcaccgaagcaacaacatccaccatgacctggatacccagtgccctactgcgaagactggcctctttggaggagccgctttcctggcccttgatgctgctctcttctggcttgtttgccagatgctagctctcaatgcaaggtctgactatctggatgaggatgacaagggcgattatggccaggtttttgcttctgatgttgatggcacaaaggtctgaggctttgactgggcagggtttcatatttagtgtcacttagctatattatcttatcgacaaagctggttcgattagctctctaaaatctgtagatatgtgctatgccagttgcaaagtcgtatatataagggtatttgctcattgcacgtttaagcttacgttgtgaaacaataacagtattctcagtatggtccgtctgttagtaatctccgtggagctaagtgtcctactattaatttttctggtgttactctgtgtttttctgtgacgctgattcttgaagtataaatctaacattgtgggaggtatagatatatagataggtaaagataaatgaagtacttttttttccggttgcttaaaa

SEQ ID NO: 5327 - DNA, 1080 bp, Triticum aestivum
cctttcttcctccatcgtcccaccgccgtgaattgcaggagtggcggacgcggggggagaagagaagagaagagaagagaagagagattcacgcgcggcggagcccggccacctccttccgacgtctccgcccacggagccatgggtttgacttcggcgaaggggatcgccctcaccgtctccttgtttggcctcctcgcgtttctgctcggcgtcatcgcagaaaacaaaaagcctccttatggaactcctatcaagggaaaggatgttgtcatctgcaagttcccgagtgacccaacgattgcaatgggaagcctgtccattgtggcacttgtgttagctgctttcattgggcacgttgccatcttttacccgtacaagggcaagtcggttcctcgtggagcgttatttcagagcaccagcttgtctgtgttctttgttattgctgagctggtatcagctctggcttttgcaatgctgctctgggcaacgatcacggagggtcaccatcgcaccagtaacgttcaccacgacatggataccctgtgccccaccgcaaagaccggcctctttggaggtgccgctttcctggcccttgacgctgctctgttctggcttgtttgccagatgctggcccttaatgcgagggccgactatctggatgaggatgaggatgaggatgacaagggcgaatatggccaggtttatgctgctgatgccgatggcacgaaggtctgagtcagttaactgcaggatttcaaaaatagcaccgtttagatatattttagattcattatgcgtctttgaaaaggtcggtttagttctccaaaaaattgtagatatgccgtgccattcccgtagtcgtacataagatcatttcctcattccagtttcagacttcagattgaacgataagttgtgttctggtttgctacttccctttctgaattaaagtatcatgttatctgtgaattttttatgtctgcattttgatgttccgttgttctgctatttgtgaatctggaggtgtcttcagatatcagtgtgttcagtgaaatgtactaaacaaattaacttaac

SEQ ID NO: 5328 - DNA, 1163 bp, Triticum aestivum
cccccccccctgccccaccccgcccccgccagccgcgaccgggccccctctcccatcccccaccgccgtgaattgcaggagtggcggacgcgcggggagaagagaagagaagagaagagaagagagattcacgcgcggcggagcccggccacctccttccgacgtctccgcccacggagccatgggtttgacttcggcgaaggggatcgccctcaccgtctccttgtttggcctcctcgcgtttctgctcggcgtcatcgcagaaaacaaaaagcctccttatggaactcctatcaagggaaaggatgttgtcatctgcaagttcccgagtgacccaacgattgcaatgggaagcctgtctattgtggcacttgttttagctgctttcattgggcacgttgccatcttttacccgtacaagggcaagtcggttcctcgtggagcgttatttcagagcaccagcttgtctgtgttctttgttattgctgaactggtatcagctctggcttttgcaatgctgctctgggcaacgatcacggagggtcaccatcgcaccagtaacgttcaccacgacatggataccctgtgccccaccgcaaagaccggcctctttggaggtgccgctttcctggcccttgacgctgctctgttctggcttgtttgccagatgctggcccttaatgcgagggccgactatctggatgaggatgaggatgaggatgacaagggcgaatatggccaggtttatgctgctgatgccgatggcacgaaggtctgagtcagttaactgcaggatttcaaaaatagcaccgtttagatatattttagattcattatgcgtctttgaaaaggtcggtttagttctccaaaaaattgtagatatgccgtgccattcccgtagtcgtacataagatcatttcctcattccagtttcagacttcagattgaacgataagttgtgttctggtttgctacttccctttctgaattaaagtatcatgttatctgtgaattttttatgtctgcattttgatgttccgttgttctgctatttgtgaatctggaggtgtcttcagatatcagtgtgttcagtgaaatgtactaacaattaacttaactaatttagactaacctattgtttactaagttgtaggtttagaaat

SEQ ID NO: 5329 - DNA, 1390 bp, Saccharum officinarum
ccctccctcaccacgcacgcacaaagcagagcaggcaacggcacagcacagtagagagagaaagagaagcgcagagccaagaagcagagcaacaacagcaggtcgaggaagaagggaagagaaggccaggaggcagcagtcaagaacagcaagaggaagggggagagcaagagagcaagaggcgggcaagatgctgcgcgggggcacgagcatgctggggatcgtcaacttcatcaccttcctgatctcgatcccgatcctgggcggcggcatctggctggcgtcgcgggccaactccaccgactgcatccgcttcctgcagtggcccatcatcatcgtggggctcgtcctcatggtcatctccctcatgggcttcgccggcgcctgctaccgccagacctggctcctccgcctctacctcttcgccatgttcttcgtcgtcctcgcgctcctcttcttcatcgtcttcgccttcgccgtcaccgaccgcggcgacggccaggtcgtcatgaaccgccgcttccccgagtaccagctctccgactacggcggctggctccgcgaccgcgtcgccgacccgcagtactgggccaccatcagcgcctgcctccgcgacggccacgcctgcgccggcatgaagcgcctcgcgcgggaccccaacaccggcatgctcgtgccggagacgcccgccatgttctacggccgcaacctctccccgattcagtctggatgctgcaagccaccgacatcatgtgccttcacctacatgaacgagacgtactggacacaaaaccctggtgtcccgactgtgatcaatgatcctgactgcagcaggtggagcaacgaccagcagatgctatgcttccagtgcgactcgtgcaaggctggcgtcctagcgggcatcaagaagagctggcgcaaggtggccatcctgaacattgtggtgttgatcatccttgtgattgtctatgtcgcgggctgtgccgcgttccgcaatgccaagaggatcgagaatgacgagccaatcggcatggcgcggatgaccaagtcccatccaagcaggttccagttctaggcagctgctgctgcgggttcggaagcttttgccttgtacaaatgaccagtgggtggtgctaaggcttgggctttgttatatcttactgaaatgtggattctactgcatttggtggtgaaagggggaagttcagtgtggtttggcttgtgtttgctttagtgtttagggtagcctattatgtggtaggggtacaatctgagatctgcaagaaacaagagaagttaaatcatctaggagctgttttgtattggagatttttaaattctgggggatagttgtatgatggtgccagccatgatggaacattttctgaat

SEQ ID NO: 5330 - DNA, 1381 bp, Zea mays
ggcttatgctgccttgcatctgctctcccgtacagccgcagcgtgctcctcgacctcgctaaaaaccaaccgccctgtctccctccctcactcaccacgcacgcacaaagcagagcaggcaacggcacagcccagcacaggtagagagagaaagagaagcgcggagtcaagaagcggagcaacaacagcaggccgaggaagagaagagaaggccaggaggcagcagccaggaggaagagcaagagcaagatgctgcgcgggggctcgagcgtgctggggatcatcaacttcatcaccttcctgatctcgatcccgatcctgggcggcggcatctggctggcgtcgcgggccaactccaccgactgcatccgcttcctgcagtggcccatcatcattgtggggctcgtcctcatggtcatctccctcatgggcttcgccggcgcctgctaccgccagacctggctgctccgcctctacctcttcgccatgttcttcgtcgtcctcgcgcttctcttcttcatcgtcttcgccttcgccgtcaccgaccgcggcgacggccaggtcgtcatgaaccgccgcttccccgagtaccagctctccgactacggaggctggctccgcgaccgcgtcgccgacccacagtactgggccaccatcagcgcctgcctccgcgacggccacgcctgcgccggcatgaggcgcctcgcgcgggaccccaacactggcatgctcgtgccggagacgtccaccatgttctacggccgcaacctctccccgatccagtctggatgctgcaagccaccgacgtcatgtgcgttcagctacatgaatgagacgtactggacacaaaaccccagcgtcccgacggtgaccaacgacccagactgcaaaaggtggagcaacgaccagcagacgctgtgcttccagtgcgactcgtgcaaggctggcgtcctcgcgggcatcaagaagagctggcgcaaggtggccgtcctgaacatcgtggtgctgattatccttgtgatcgtctacgtcgcgggctgcgccgcgttccgcaacgcgaagaggatcgagaacggcgaggcggtcggcatggcgcggatgaccaagtcccatccgagcaggttccagttctaggccgctgctccgctgccactgcgggttcgaaagctcttgccttgtacaaatggcctgtggggtgtggtcctaaggcttgggcttcgctatgtcttgctgaattgcggattctactgcatttggtggtggaaatggaaagtccagtgtagtttggggttgtgtttgtttgagtgtttagggtaggcctattatgtggggttggctggggtacaatatgagatctgcaagaaacaagagaagttgaatc

SEQ ID NO: 5331 - DNA, 1686 bp, Setaria italica
ctcctcccccgttactccccccgtacagcagcagcgtgctgcttcgccaatcgccagccagcatcgtcgacctcgctaaaagccaacccaaccgccctctgcggctctgcccctccccctctctctccctcccgtctccacacgcacaaacaaagcaggcaacggcacagccaggttgggagagagagaaagagaagcaggcagagccaagaaacagagcagcagcaggagctggttcgaggaggagaagaggagaggaaggagaagggcggcggccaagaagaagaggaggaggaagggcaagatgctgcgcggcgggacgagcgtgctggggatcgtcaacttcatcaccttcctgatctcgatcccgatcctgggcggcggcatctggctggcgtcccgggccaactccaccgactgcatccgcttcctgcagtggcccatcatcgtcgtggggctcgtcctcatggtcatctccctcatgggcttcgccggcgcctgctaccgccagacttggctcctccgcctctacctcttcgccatgttcttcgtcgtcctcgcgctcctcttcttcatcgtcttcgccttcgccgtcaccgaccgcggcgacggccaggtcgtcatgaaccgacgcttcctcgagtaccagctctccgactacagcggatggctccgcgagcgcgtcgccgacccccagtactgggccaccatcagcgcatgcctccgcgacggacacgcctgctccggcatgaggcgcttcgcgcgcgaccccaacaccggcatgcgcgtgccggagacgccggacatgttctacggccgcaacctctcccccatacagtctggatgctgcaagccaccatcatcatgtgcgttcacctacaataacgagacatactggacaccaaaccccggtgtcccagttatcagtgatcccgactgcaacaggtggaacaacgaccagcagacactctgcttccagtgtgactcgtgcaaggcgggtgtcctggcgggcatcaagaagagctggcgcaaggtggcgatcctaaacattgtggtgctgatcatccttgttatcgtctatgtcgcgggctgtgctgcatttcgcaatgccaagaggatcgagaatgacgagccaatcggcatggcacggatgaccaagtcccagccaagcaggttccagttctaggctgcagtggcgggttcggaagcttttgcattgtacaaatgaccacagtgggtgatgctaaggcttggcctttgttagatcttactgaaacgtaggatcagctgcatttgggtggtgaacagggaagaagttcgcttatcaaaaagttccggtgtggtttagttttgtgcttgccttagtgtttagggtaggtctattatgtattgggtgcaaccaaagatgggatctgcaagaaacaagagaaattacttcaattaggagtgtattgttctgtatgggagatttttatatgtcatcttgtgcgttttagaagatagtgctctgatggaatgttatctgaatttctgtgattgtatggcaatacgagagctttcagtatgacagggtcgctaaatgtcaatgtttcagttgttccaggaccaggagggagcgtgtgtttagcgtcattatatgatctgttttctatgaaatttcacaagccttgacagtgtctgcacgat

SEQ ID NO: 5332 - DNA, 1378 bp, Pennisetum glaucum
agaaacagagcagcagcagccagcaggaggagctggttcgaggagaagaagagggaggaaggagaaggggcggcggctaagagcccaagaagaagaagaagaggaggaagggcaagatgctgcgcggcgggtcgagcgtgctggggatcgtcaacttcatcaccttcctgatctcgatcccgatcctgggcggcggcatctggctggcgtcgcgggccaactccaccgactgcatccgcttcctgcagtggcccatcatcgtcgtcgggctcgtcctcatggtcatctccctcatgggcttcgccggcgcctgctaccgccagacctggctcctgcgcctctacctcttcgccatgttcttcgtcgtcctcgcgctcctcttcttcatcgtcttcgccttcgccgtcaccgaccgcggcgacggccaggtcgtcatgaaccgccgcttcctcgagtaccagctctccgactacagcggctggctccgcgagcgcgtcgccgacccccagtactgggccaccatcagcgcgtgcctccgcgacggccacgcctgctccggcatgaggcgctacgcgcgcgaccccaacaccggcatgctcgtgccggagacgccggacatgttctactcccgcaacctctcccccatccagtccggatgctgcaagccaccatcatcatgtgcgtacacctacaataacgagacgtactggacacaaaaccctggtgtcccggttatcagcgatcccgactgcaacaggtggagcaacgaccaacagacactctgcttccagtgcgactcgtgcaaggcaggtgtactggcgggcatcaagaagagctggcgcaaggtggcgattctaaacattgtggtgctgatcatccttgttattgtctatgtcgcgggctgtgctgcattccgcaatgccaggaggatcgataacgacgagccaatcggcatggcacggatgaccaagtcccacccaagcaggttccagttctaggcttcagtgtcgggttcggaagcttttgcattgtacaaatgaccacagtgggtgatgctaaggcttgggctttgttagatcttactgaaatgtaggatcagttacatttgggtggtgaacaagaagttcaaaaggttcctgtgtggtttcattttgtgcttgccttagcgtttagggtaggtctattatgtattgggtgcaaacaaagacgagatctgcaagaaacaagagaaattgcttcaattaggagtgtattgttctgtatgggagattttacatgtcatcttttgcgttttagaagatagtgctatgatggaatgttctctgaatgtctgattgtatggcaatacaagagctttcattatgacagggtcgctaaa

SEQ ID NO: 5333 - DNA, 1439 bp, Panicum virgatum
cgtctctctcccccctgtggcccctccctctcccacgcgcaaggcacaacacaaggcaggcaacggcacatcacttggtggagcagctagccagttgggaagagagaaagagaagcagagcaggaggggggagaagaggagggaggagagaagagcggcagccaagaagaggagaggaggggcaagatgctgcgtggcggcacgagcgtgctggggatcgtcaacttcatcaccttcctgatctcgatccccatcctgggcggcggcatctggctggcgtcccgggccaactccaccgactgcatccgcttcctgcagtggcccatcatcatcgtggggctcgtcctcatggtcatctccctcatgggcttcgccggcgcctgctaccgccagacctggctcctccgcctctacctcttcgccatgttcttcgtcgtcctcgcgctcctcttcttcatcgtcttcgccttcgccgtcaccgaccgcggcgacggccaggtcgtcatgaaccgccgcttcctcgagtaccagctctccgactacagcggctggctccgcgaccgcgtcgccgacccggagtactgggccaccatcagcgcctgcctccgcgacggccacgcctgctccggcatgaggcgatacgcgcgcgaccccaacaccggcatgcgcgtgccggagacgcccgacttgttctacgcccgcaacctctcccccattcagtctggatgctgcaaaccaccatcatcatgtgggttcacctacaataacgagacatactggacaccaaatcccggtgtcccggcgatcagcgatccggattgcaacaggtggagcaacgaccagcagacgctctgcttccagtgtaactcgtgcaaggcgggtgtcctggcgggcatcaagaagagctggcgcaaggtggccatcctaaacattgtagtgctgatcattctcgttatcgtctatgttgctggctgtgctgcgttccgtaacgccaagaggatcgagaacgatgagcccatcggcatggcgcggatgaccaagtcccagccgagcaggttccagttctagactgccgtgggaggttcggaagtttttgccttgtacaaatgaccacactgggtggtgctatggcttggcctttgttagatcttactgaaatgtggggtcaactacatttgggtggtgaacagggaaggagttcgcttatcaaaaagtttaagtgtggtttatttttgtgcttgccttagtgtttagggtaggtctattatgtattgggtgcaaaaaagatgggatctgcaagaaacaagagtacttcacttaggaatgtattgttctgtatgggagatttttatgtcatctttcctagaagaatttgtcatcttctgcattctagaagatagtgttacgatggtaccatgatggaatgtactctgaatttc

SEQ ID NO: 5334 - DNA, 1593 bp, Panicum virgatum
cggctaatttcggctggtaagctggctgattcaataatgttatacgagagaaaataagttaaaacaatcggaataaactgaaaaagagaaaccgaacagaattttagattatgatcactctgcggatggaaggaaatcatgcgggcctcgcttttgccacacccgcttagcgctcgtcgaatccggaatcccctccccaactccaacctgctgcggctctctgcttcagctcgccagccagcctcctcgagctcgctaaaaaccaacccaacagcccactctgtcctctcccctctggcccctccctctcccacgcgcaaggcacaacacaaggcaggcaacggcacaacacttggtggagcaaccagccagagagaaagagaagcagagcaggaggaagaagaaagagggagaagaagagcggcagccaagaagaggaggagcaagatgctgcgcggcggcacgagcatgctggggatcgtcaacttcatcaccttcctgatctcgatccccatcctgggcggcggcatctggctggcgtcccgggccaactccaccgactgcatccgcttcctgcagtggcccatcatcgtcgtggggctcgtcctcatggtcatctccctcatgggcttcgccggcgcctgctaccgccagacctggctcctccgcctctacctcttcgccatgttcttcgtcgtcctcgcgctcctcttcttcatcgtcttcgccttcgccgtcaccgaccgcggcgacggacaggtcgtcatgaaccgccgcttcctcgagtaccagctctccggctaccgcggctggctccgggaccgcgtcgccgacccgcagtactgggccaccatcagcgcctgcctccgcgacggccacgcctgctccggcatgaggcgattcgggcgcgcccccaacaccggcatgctcgtgccggagacgtcggacatgttctacgcccgcaacctctcccccattcagtctggatgctgcaaaccaccaacatcatgtgggttcacctacaataacgagacatactggacgccaaaccctggagtcccgatcagcgatgcagactgcaacaggtggagcaacgaccagcggacgctctgcttccagtgtgactcgtgcaaggcgggtgtcctggcaggcatcaagaagagctggcgcaaggtggccatcctaaacattgtggtgctgatcatcctcgttatcgtctatgttgctggctgtgctgcgttccgtaacgccaagaggatcgataacgacgagccgatcggcatggcgcggatgaccaagtcccagccgagcaggttccagttctagactgctgtggcgggttcgcaagcttttgccttgtacaaatgaccacactgggatacgcggatacttcgcaaaactcaagtaccggtatcggataccgtatcggatacccgtactccatggatattcccgaatacgtattccgtaagtatcggactatttagatattttcaaataataaaaataaatcggatactcgtgggatacctgtccaataccttcaaatcctaacaacaccactcgatcgcttcgtataaaggttctccgatc

SEQ ID NO: 5335 - DNA, 1269 bp, Panicum virgatum
ctccctctcccacgcgcaaggcacagcacaaggcaggcaacggcacaacacttggtggagcaaccagccagagagaaagagaagcagagcaggaggaagaagaaagagggagaagaagagcggcagccaagaagaggaggagcaagatgctgcgcggcggcacgagcatgctggggatcgtcaacttcatcaccttcctgatctcgatccccatcctgggcggcggcatctggctggcgtcccgggccaactccaccgactgcatccgcttcctgcagtggcccatcatcgtcgtggggctcgtcctcatggtcatctccctcatgggcttcgccggcgcctgctaccgccagacctggctcctccgcctctacctcttcgccatgttcttcgtcgtcctcgcgctcctcttcttcatcgtcttcgccttcgccgtcaccgaccgcggcgacggacaggtcgtcatgaaccgccgcttcctcgagtaccagctctccggctaccgcggctggctccgggaccgcgtcgccgacccgcagtactgggccaccatcagcgcctgcctccgcgacggccacgcctgctccggcatgaggcgattcgggcgcgcccccaacaccggcatgctcgtgccggagacgtcggacatgttctacgcccgcaacctctcccccattcagtctggatgctgcaaaccaccaacatcatgtgggttcacctacaataacgagacatactggacgccaaaccctggagtcccgatcagcgatgcagactgcaacaggtggagcaacgaccagcggacgctctgcttccagtgtgactcgtgcaaggcgggtgtcctggcaggcatcaagaagagctggcgcaaggtggccatcctaaacattgtggtgctgatcatcctcgttatcgtctatgttgctggctgtgctgcgttccgtaacgccaagaggatcgataacgacgagccgatcggcatggcgcggatgaccaagtcccagccgagcaggttccagttctagactgctgtggcgggttcggaagcatttgccttgtacaaatgaccacactgggtggctatgatacacggatatttcgcaaaactcacgtactggtatcggataccgtatcggatacccgtactccacgaatattcccggataaaaataaatcggatactcgtgggatacctgtggatgcctgtccgataccatcaaaccctaacaaccccactcaatcgctttgtataaaggtcctccgttcccc

SEQ ID NO: 5336 - DNA, 1629 bp, Oryza sativa
ctctccgcgcttctgttgctgctgccgctggagctgaagctgcagctgctcctctcgctaaaaaccaaccccccaaccgcctctcccctctcctctcctctccccctcgcatttgcagttgcagagcaagaagcagagagagaagaagaggaagcagaggaggaggagtccaagaattgaagcaggagaagaggaggtggtggtttgattcaagaagaaggagaagagcaagagcaaggatgttgcgaggagggacgagcttgctggggatcgtcaacttcgtgacgttcctgatctcgatcccgatcctggggggaggaatctggctggcgtcgagggccaactccaccgactgcatccgcttcctgcagtggccgatcatcgccatcgggctcgccgtcatggtggtgtccctcatggggttcgcgggggcgtgctaccgccagacgtggctgctccgcctctacctcttcgccatgttcttcatcgtcgtcgccctcctcttcttcatcgtcttcgccttcgccgtcaccgaccgcggcgacggccaggtggtgatgaaccggcggttcctcgagtaccagctctccgactacaacggatggctccgcgaccgcgtcgccgaccccgcctactgggccaccatcagcgcctgcctccgcgacggccgcgcctgcgccgccatgcgccgcttcgcccgcgaccccaacaccggcatgctcgtccccgagaccccctccatgttctacgcccgcgacctctcccccatccagtctggatgctgcaagccaccaacatcgtgtgcatacaactatgttaacgaaacgttctggaccgcaaaccctggcgttccgaccgtcgtgaatgatgtggactgcagcaagtggagcaatgaccagcagacgctttgcttccagtgtgactcctgcaaggcaggcgtcctcgctggcatcaagaagagctggcgtaaggttgccatcctcaacatcgtcgtgctgatcatcctcgtcatcgtgtatgttgctggctgtgccgctttccgcaacgccaggaggatcgaaaacgacgagccgtttggtatggcaaggatgaccaagactcaacctagcaggttccagttctgagatagtgaagaactgggagcctttgcccctttgcctgtacaaaaagaccacaattggtggtgctaaggctctgtctgaatctcttatatattatttactggaatgtggaatcagctacactttgggtggtgaaaaaggaaagtagttcttgtttcagaatgttcagtctggtttggttttgtgcttgctatagtgtttagggttaggtctgttgtgtactgggtacaagatgagatctgcaagaaacaagagtagttccctcatttagcaatgtattgtgctgtaccattggagattttgatttggcataatcttagatgaatatgttatcatcatgtacatgatgaatgtattgctctgtagttccttctctctctctctctctctctctctctttcttttactttgtttccattattaaaaattaaaatggttgaccatgttatgatgattgctgatcaggtattgcgcaatatgatgatcttagatcgtctaacaactgcac

SEQ ID NO: 5337 - DNA, 1515 bp, Brachypodium distachyon
tgctatctacggagtatctatctatctatacactctgctctgcttcttctgctgctcgctaaaagccggccctttttctctcccaagaggccaagacacacacacatcaagcagcggcagagagacagagagagagaggacaagagctccagaactcaagaagcagagccaagaaacagaggaggaagaagaagatgcggcacggggggacgagcgtgctgggggtggtgaacttcgtgacgttcctggcgtcgatcccggtcctgggcggcggcatctggctggcgtccagggccaactctacggactgcatccgcttcctgcagtggcccatcatcatcatcgggctggccgtcatggtggtctccctggcgggcttcgcgggcgcctgctaccgccagacctggctgctccggctctacctcttcgccatgttcttcgtcgtcgtcgcgctcctcttcttcatcgtcttcgccttcgccgtcaccgaccgcggcgacggccaggtcgtcatgaaccggcgcttcctcgagtaccagttctccgactacaacggctggctccggaaccgcgtcgccgacccggagtactgggccaccatcagcgcctgcctccgcgacggccacgcctgcgaagggatgaagcgccgcgcccgcgaccccaacaccggcatgctcgtccccgagcccccatccatgttcttcggccgcaacctctccccgattcagtctggatgctgcaagccgccaacatcctgcgcattcacctatgtgaatgagacatactggaccccaaatcctggagtccagaccgtggtgtccgaccctgactgccagaagtggaacaatgaccagcagacgctctgcttccagtgcgactcgtgcaaggcaggcgtcctcgctgggatcaagaagagctggcgcaaggtcgccatcatcaacatcgtcatgctgatcatccttgtcatcgtctatgtcgcgggctgcgccgctttccgcaacgccaagaggatggacaatgacgagccttacggcatggcgaggatgaccaagtcccagccaagcaggttccagttctaggccgcgactgaactggaagccttagcctgtacaaaaaaggcttgtcctgaaattatatttcttactgaacatttggaaatgatcacctgcagctgggtggtgaaaaaaaatgaattttcttgtatcagaaatctagtgtgctgtttggttccgtgcctgccttgtagtgttagggttagatctattctgtactgtggtacaagatgaggtctggaatgaacaagaaacttgagttgcctcatttaggagttattgtatgcaattactttgatttgccatcttcctgagaagattatgctatggtgactgaactactgaagggtgtgccaagtcatcaactcttaaaatatcatactcctatgtcaatatggaggtataattttgctaatactggagcaaatgtgtccagtgcaatttgtcagatgtgtaacctaga

SEQ ID NO: 5338 - DNA, 1537 bp, Triticum aestivum
gccgtatatacggacgaaagcaaccgcccaaatactactgctacggatatggacaccgccgcgtacacgtgacccacactctgcttccgcttcttctgctgccgttgctgctgctcctcagctcgctaaaagccagcccaatcccctcccctctctctcccccacgcccacaccaaacggcagcaccagtagcagagccagagagagagaggacaagaagcaggggacctccgaggagcagagcggagccaagaaagaggctcggagagagtcgtcggaggaggaagaaggcgaggatgcacggcggcgggtcgaagatgctgggggtggtgaacttcatcaccttcctggcgtcgatcccggtgctggggggcggcatctggctggcgtcccgggccaacaccaccgactgcatccgcttcctgcagtggcccatcatcatcatcggcctcgccgtcatggtcgtctccctcatgggcttcgccggcgcctgctaccgccagacctggctcctccgcatctacctcttcgccatgttcttcatcgtcgtcgcgctcctcttcttcatcgtcttcgccttcgccgtcacggaccgcggggagggccaggtggtcatgaaccgccgcttcctcgagtaccagctctccgactacaacggctggctccgcaaccgcgtcgccgacccggagtactgggccaccatcagcgcctgcctccgcgacggccgcgcgtgcgcctccatgcggcgccccgcccgcgaccccaacaccggcatgctcgtcaccgagccccccgtcatgttctacggccgcaacctctccccgattcagtccggatgctgcaagccaccgacatcgtgcgccttcacctacaacaacgagacgtactggagcgcgaaccccggcgtccccaccgtggtgaccgaccccgactgcctcaaatggagcaacgaccagcagacgttgtgctttcagtgcgactcgtgcaaggccggcgtcctggccggcatcaagaagagctggcgcaaggtggccatcatcaacattgttgtgctcatcatcctcatcatcgtctacgtcgctggctgcgccgcgttccgcaacgccaagagggacgacaacgacgagtcgtacggcatggccaggatgaccaagtcccggccgagcaggttccagttctagacctcaggcgaaaaaccgggaaaacctttgactgtacaaaaggccactcactgtgggtggtggtgttaagactttggcctgaactatatttcttgctgaactgtgtggatgatgatgatgatcaccctgtagtgggtggtgtggaagggaaggtgttcttggaccgaatgtttggtgtggtgtttgggttctgtggtgtttagggtaggtctattctgtatttggtggtacaagatgaggtctgcaaggaacagaaggggctgtctcattttaggattgtattgttctgcacttggtgattttgatctgtcatcttccttactagttcatgctattattatgattgccatcactct

SEQ ID NO: 5339 - DNA, 1392 bp, Triticum aestivum
gccgttgccgccgctgctgcccctcagctcgctaaaagccagcccaatcccctcccccctcctctctcccccacgcccgcaccaaacggcagcagagagaggacaagaagcagcaggggacctccgaggagcagagacctccaagaatcagagcaagaaaccagggagagagtcggaggaggaggaggaaggagagcgagaggatgcacggcggcgggtcgaagatgctgggggtggtgaacttcatcaccttcctggcgtcgatcccggtgctggggggcggcatctggctggcgtcgcgggccaactccacggactgcatccgcttcctgcagtggcccatcatcatcatcggcctcgccgtcatggtcgtctccctcatgggcttcgccggcgcctgctaccgccagacctggctgctccgcatctacctcttcgccatgttcttcatcgtcgtcgcgctgctcttcttcatcgtcttcgccttcgccgtcaccgaccgcggggagggccaggtggtcatgaaccgccgcttcctcgagtaccagctctccgactacaacggatggctccgcaaccgcgtcgccgacccggagtactgggccaccatcagcgcatgcctccgcgacggccgcgcatgcgcctccatgcgccgccccgcccgcgaccacaacaccggcatgctcgtcaccgagccccccgtcatgttctacggccgcaacctctccccgattcagtccggatgctgcaagccaccgacatcgtgcgccttcacctacaacaacgagacgtactggagcgcaaaccccggcgtccccaccgtggtgaccgaccccgactgcctcaaatggagcaacgaccagcagacgctatgcttccagtgcgactcgtgcaaggccggcgtcctggccggcatcaagaagagctggcgcaaggtggccatcatcaacatcgtcgtgctcatcatcctcatcatcgtctacgtcgccggctgcgccgcgttccgcaacgccaagagggacgacaacgacgagtcgtacggcatggccaggatgaccaagtcccggccgagcaggttccagttctaggcttgcgagcggcgaaaaccggtagctcgctctttgcgtgtacaaaaggccactcactgtgggcggtggtgttaagactttggcctgaactatatttcttactgaaccgtgtggatgatggtcgctgtagttggggggtgtgaaagggaagatgttcatggatcgaatgtttagtgtggtgtttagggtaggtctattctgtatttggtggtacaagatgaggtctgcaaggaacaggaggggctgtctcattttaggaatgtattattctgcacttggtgattttgatctgtcatcttcctta

SEQ ID NO: 5340 - DNA, 1441 bp, Triticum aestivum
gccgttgccgccgctgctgcccctcagctcgctaaaagccagcccaatcccctcccccctcctctctcccccacgcccgcaccaaacggcagcagagagaggacaagaagcagcaggggacctccgaggagcagagacctccaagaatcagagcaagaaaccagggagagagtcggaggaggaggaggaaggagagcgagaggatgcacggcggcgggtcgaagatgctgggggtggtgaacttcatcaccttcctggcgtcgatcccggtgctggggggcggcatctggctggcgtcgcgggccaactccacggactgcatccgcttcctgcagtggcccatcatcatcatcggcctcgccgtcatggtcgtctccctcatgggcttcgccggcgcctgctaccgccagacctggctgctccgcatctacctcttcgccatgttcttcatcgtcgtcgcgctgctcttcttcatcgtcttcgccttcgccgtcaccgaccgcggggagggccaggtggtcatgaaccgccgcttcctcgagtaccagctctccgactacaacggatggctccgcaaccgcgtcgccgacccggagtactgggccaccatcagcgcatgcctccgcgacggccgcgcctgcgcctccatgcgccgccccgcccgcgaccacaacaccggcatgctcgtcaccgagccccccgtcatgttctacggccgcaacctctccccgattcagtccggatgctgcaagccaccgacatcgtgcgccttcacctacaacaacgagacgtactggagcgcaaaccccggcgtccccaccgtggtgaccgaccccgactgcctcaaatggagcaacgaccagcagacgctgtgcttccagtgcgactcgtgcaaggccggcgtcctggccggcatcaagaagagctggcgcaaggtggccatcatcaacatcgtcgtgctcatcatcctcattatcgtctacgtcgccggctgcgccgcgttccgcaacgccaagagggacgacaacgacgagtcgtatggcatggccaggatgaccaagtcccggccgagcaggttccagttctagacctgctgcgtcgaaaaaccgggaaaacctttgcctgtacaaaaggccactcactgtgggcggtggtgttaaggctttggcctgaactatatttcttactgaaccgtgtggatgatggtcgcctgtagttggggggtgtggaagggaagatgttcatggatcgaatgtttagtgtggtgtttagggtaggtctattctgtatttggtggtacaagatgaggtctgcaaggaacaggaggggctggctcattttaggaatgtattattctgcacttggtgattttgatctgtcatcttccttagtagtagtccatgctattattatgattgccatcactctcaatatatcatgt

SEQ ID NO: 5341 - DNA, 1420 bp, Secale cereale
ccccacgcccacaccaaacggcagcagcagaggcagagagatttgacaagaatcggggagggacctccgacgagcagagcggagccaagaaagaagctcggagggagccggaggaggaggaggaaggagaagatgcacggcggcgggtcgaagatgctgggggtggtgaacttcatcacgttcctggcgtcgatcccggtgctggggggcggcatctggctggcgtcgcgggccaactccacggactgcatccgcttcatgcagtggcccgtcatcatcatcggcctcgccgtcatggtcgtctccctcatgggcttcgccggcgcctgctaccgccagacctggctgctccgcatctacctcttcgccatgttcttcatcgtcgtggccctgctcttcttcatcgtcttcgccttcgccgtcaccgaccgcggggagggccaggtggtcatgaaccgccgcttcctcgagtaccagctctccgactacaacggctggctccgcaaccgcgtcgccgacccggagtactgggccaccatcagcgcctgcctccgcgacggccgcgcctgcgcctccatgaggcgccccgcccgcgaccccaacaccggcatgctcgtcaccgagccccccgtcatgttctacggccgcaacctctccccggttcagtccggatgctgcaagccaccgacgtcgtgcgcgttcacctacaacaacgagacgtactggagcgcgaaccccggcgtacccaccgtggtgaccgaccccgactgcctcaagtggagcaatgaccagcagacgctctgcttccagtgcgactcgtgcaaggccggcgtcctggccggcatcaagaagagctggcgcaaggtggccatcatcaacatcgtcgtgctcatcatcctcatcatcgtctacgttgccggctgcgccgcgttccgcaacgccaagagggacgacaacgacgagtcgtacggcatggccaggatgaccaagtcccggccgagcaggttccagttctagacctgcggcgaaaaaccgggaaacctttgcctgtacaaaaggccactcgctgtgtgggtggtggtgttaagactttggcctgaactatatttcttgctgaactgtgtggatgatgatgatgatcaccctgtagtgggtggtgtggaagggaaggtgttcttggaccgaatgtttagtgtggtgtttgggttctgtggtgtttagggtaggtctattctgtatttggtggcacaagatgaggtctgcaaggaacaggaggggctggctcattttaggaatgtattattctaaagaacaaaacaaaaaaaaaaaaaaaaaaaaaaaaaaaaaaacaaaaacaaaaaaaaaaaaagaaaaaaaaaaaaaaaaaaaaaaacaaaaaaaaaaaaaataaaaaataaaa

SEQ ID NO: 5342 - DNA, 1263 bp, Secale cereale
ccaaacggcagcagcagaggcagagagatttgacaagaatcagggagggacctccgacgagcagagcggagccaagaaagaagctcggagggagccggaggaggaggaggaaggagaggatgcacggcggcgggtcgaagatgctgggggtggtgaacttcatcacgttcctggcgtcgatcccggtgctggggggcggcatctggctggcgtcgcgggccaactccacggactgcatccgcttcatgcagtggcccgtcatcatcatcggcctcgccgtcatggtcgtctccctcatgggcttcgccggcgcctgctaccgccagacctggttgctccgcatctacctcttcgccatgttcttcatcgtcgtcgccctgctcttcttcatcgtcttcgccttcgccgtcaccgaccgcggggagggccaggtggtcatgaaccgccgcttcctcgagtaccagctctccgactacaacggctggctccgcaaccgcgtcgccgacccggagtactgggccaccatcagcgcctgcctccgcgacggccgcgcctgcgcctccatgaggcgccccgcccgcgaccccaacaccggcatgctcgtcaccgagccccccgtcatgttctacggccgcaacctctccccggttcagtccggatgctgcaagccaccgacgtcgtgcgcgttcacctacaataacgagacgtactggagcgcgaaccccggcgtccccaccgtggtgaccgaccccgactgcctcaagtggagcaatgaccagcagacgctctgcttccagtgcgactcgtgcaaggccggcgtcctggccggcatcaagaagagctggcgcaaggtggccatcatcaacatcgtcgtgctcatcatcctcatcatcgtctacgttgccggctgcgccgcgttccgcaacgccaagagggacgacaacgacgagtcgtacggcatggccaggatgaccaagtcccggccgagcaggttccagttctagatttcaccgggaaaacatttgcctgtacaaaaggccactcactgtgggtggtggtgttaagactttggcctgaactatatttcttgctgaactgtgtgaatgatgatgatgatgatcaccctgtagtgggtggtgtggaagggaaggtgttcttggaccgaatgtttagtgtggtgtttgggttctgtggtgtttagggtaggtctattctgtatttggtggcacaagatgaggtctgcaaggaacaggaggggctggc

SEQ ID NO: 5343 - DNA, 1386 bp, Secale cereale
ggaggaggaaggagaggatgcacggcggcgggtcgaagatgctgggggtggtgaacttcatcacgttcctggcgtcgatcccggtgctggggggcggcatctggctggcgtcgcgggccaactccacggactgcatccgcttcatgcagtggcccgtcatcatcatcggcctcgccgtcatggtcgtctccctcatgggcttcgccggcgcctgctaccgccagacctggctgctccgcatctacctcttcgccatgttcttcatcgtcgtggccctgctcttcttcatcgtcttcgccttcgccgtcaccgaccgcggggagggccaggtggtcatgaaccgccgcttcctcgagtaccagctctccgactacaacggatggctccgcaaccgcgtcgccgacccggagtactgggccaccatcagcgcctgcctccgcgacggccgcgcctgcgcctccatgaggcgccccgcccgcgaccccaacaccggcatgctcgtcaccgagccccccgtcatgttctacggccgcaacctctccccggttcagtccggatgctgcaagccaccgacgtcgtgcgcgttcacctacaacaacgagacgtactggagcgcgaaccccggcgtacccaccgtggtgaccgaccccgactgcctcaagtggagcaatgaccagcagacgctctgcttccagtgcgactcgtgcaaggccggcgtcctggccggcatcaagaagagctggcgcaaggtggccatcatcaacatcgtcgtgctcatcatcctcatcatcgtctacgttgccggctgcgccgcattccgcaacgccaagagggacgacaacgacgagtcgtacggcatggccaggatgaccaaatcccgaccgagcaggttccagttctagacctgcggcgaaaaaccgggaaacctttgcctgtacaaaaggccactcactgtgggtggtggtgttaagactttggcctgaactatatttcttgctgaactgtgtggatgatgatgatgatcaccctgtagtgggtggtgtggaatggaaggtgttcttggaccgaatgtttagtgtggtgtttagggtaggtctattctgtatttggtggcacaagatggggtctgcaaggaacaggaggggctggctcattttaggaatgtattattctgcacttagtgagtttgatttgttattttcctgagtagttcatgctattattatgattgccatcgttctcagtatatcatttgcaatagtggtaggtttgttgtcatagaaaaactaaaaaaaaaaaaaaaaaaaaagaaaaaaaaaaaaagaaaaaaaaaagaaaaaacaaagaagaaaaaaaagagagagagagagagagagagagagacac

SEQ ID NO: 5344 - DNA, 1300 bp, Pseudoroegneria spicata
  misc_feature (530)..(530): n is a, c, g, or t
  misc_feature (1179)..(1179): n is a, c, g, or t
  misc_feature (1181)..(1181): n is a, c, g, or t
  misc_feature (1199)..(1199): n is a, c, g, or t
  misc_feature (1230)..(1230): n is a, c, g, or t
  misc_feature (1253)..(1253): n is a, c, g, or t
gcaccagcagcagagagagaggacaagaagcaggggacctccgaggagcagagcggagtcaagaaagaagctcggagagagtcggaggaggaggaagaagaagaagatgcacggcggcgggtcaaagatgctgggggtggtcaacttcatcaccttcctggcgtcgatcccggtgctgggcggcggcatctggctggcgtcgcgggccaactccaccgactgcatccgcttcctgcagtggcccatcatcatcatcggcctcgccgtcatggtcgtctccttcatgggcttcgccggcgcctgctaccgccagacctggctcctccgcatctacctcttcgccatgttcttcatcgtcgtcgctctgctcttcttcatcgtcttcgccttcgccgtcaccgaccgcggggagggccaggtggtcatgaaccgccgcttcctcgagtaccagctctccgactacaacggctggctccggaaccgcgtcgccgacccggagtactgggccaccatcagcgcctgcctccgcnacggccgcgcctgcgcctccatgaggcgagccgtccgcgaccccaacaccggcatgctcgtccccgagccccccagcatgttctacggccgcgacctctccccgattcagtccggatgctgcaagccaccaacatcgtgcgcgttcacctacaacaacgagacgtactggagcgcgaaccccggcgtccccactatggtgaccgaccccgactgcctcaagtggagcaacgaccagcagacgctctgcttccagtgcgactcatgcaaggccggcgtcctggccggcatcaagaagagctggcgcaaggtggccatcatcaacattgtcatgctgatcatcctcgtcatcgtctacgttgccggctgcgccgccttccgcaacgccaagagggatgacaacgacgagtcgtacggcatggccaggatgaccaaatcccagccgagcaggttccagttctagacctgcggcgaaaaaccgggaaaatctttgcctgtacaaaaggccactcactgtgggtggtggtgttaagactttggcctgaactatatttcttactgaactgtgtggatgatgatgatcaccctgtagtggacggtgtgaaagggaaggtgttcttgaactgaatgtttagtgtggtgtttgggctntntggtgtttagggtaggtntattctgtatttggtggtacaagatgaggtntgcaaggaacagaaggggctgtntcattttaggaatgtattattctgcacttggtgattttgatctgtca

SEQ ID NO: 5345 - DNA, 1443 bp, Hordeum vulgare
cagcagcagcaccagcagcagcagcagcagcagagagagagagagagagagagaggacaagaagcagggcggagccaagaaagaagctcgcttgggagggaggggagagggggcggaggaggaggaaggaggagatgcacggaggggggtcgaagatgctgggggtggtgaacttcataacgttcctggcgtcgatcccggtgctggggggcggaatctggctggcgtcgcgggcgaacaccacggactgcatccggttcctgcagtggccaatcatcatcatcgggctcgccgtcatggtcgtctccctcatgggcttcgccggcgcgtgctaccgccagacctggctgctccgcatctacctcttcgccatgttcttcatcgtcgtcgccctcctcttcttcatcgtcttcgccttcgccgtcaccgaccgcggggagggccaggtggtcatgaaccgccgcttcctcgagtaccagctctccgactacaacggctggctccgcggccgcgtcgccgaccccgactactgggccaccatcagcgcatgcctccgcgacggccacgcctgccgctccatgcgccgccccgtccgcgaccccaacaccggcatgctcgtcctcgagcccgccgtcgtcttctacggccgcgacctctccccgattcagtctggatgctgcaagccaccgacgtcatgtgcgttcacctacaacaacgagacgtactggagcgcgaaccccggcgttcccaccgtggtgaccgaccccgactgcctcaaatggagcaacgaccagcagacgttgtgcttccagtgcgactcgtgcaaggctggcgtcctggccggcatcaagaagagctggcgcaaggtggccatcatcaacatcgtcgtgctcatcatcctcgtcatcgtctacgtcgccggctgcgccgcgttccgcaacgccaagagggacgacaacgatgagtcgtacggcatggccaggatgaccaagtcccggccgagcaggttccagttctaggcttgcccgcagcgaaaagccgggaaaacctttgcctgtacaaaaggccactcgttgtgggtggtggtgttaagacttttggcctgaactatatttcttgctgaactgtgttgatgatgatgatgatgattgatcaccctgtagctgggttgtgtgaaagggaaggtgttcttggatcgaaatgtttagtgtggtgtttgggttctgtggtgtttagggtaggtctattctgtatttggtggtacaagatgaggtctgcaaggaacaggacgggctggctcatttttaggaatgtattattctgcacttggtgattttgatctgtcatctgccttaagtagttcatgctattattatgattgtcaccagtctcagtatatcatgtgcaatatgcaggtttgatgtcaaaaaaaaacagaaaaaa

SEQ ID NO: 5346 - DNA, 1617 bp, Hordeum vulgare
cggaatgccgtatatacggacgaaagcagccgcccaaatactaccacggatatggacgccgccccgtacacgtgacccacactctgcttccgcttcttctgctgccgttgctcctcagctcgctaaaagccggcccaatcccctcctccctctctcccacgcccaccaccagacagcaccagcagcagcagcaccagcagcagcagcagcagcagagagagagagagagagagagaggacaagaagcagggcggagccaagaaagaagctcgcttgggagggaggggagagggggcggaggaggaggaaggaggagatgcacggaggggggtcgaagatgctgggggtggtgaacttcataacgttcctggcgtcgatcccggtgctggggggcggaatctggctggcgtcgcgggcgaacaccacggactgcatccggttcctgcagtggccaatcatcatcatcgggctcgccgtcatggtcgtctccctcatgggcttcgccggcgcgtgctaccgccagacctggctgctccgcatctacctcttcgccatgttcttcatcgtcgtcgccctcctcttcttcatcgtcttcgccttcgccgtcaccgaccgcggggagggccaggtggtcatgaaccgccgcttcctcgagtaccagctctccgactacaacggctggctccgcggccgcgtcgccgaccccgactactgggccaccatcagcgcatgcctccgcgacggccacgcctgccgctccatgcgccgccccgtccgcgaccccaacaccggcatgctcgtcctcgagcccgccgtcgtcttctacggccgcgacctctccccgattcagtctggatgctgcaagccaccgacgtcatgtgcgttcacctacaacaacgagacgtactggagcgcgaaccccggcgttcccaccgtggtgaccgaccccgactgcctcaaatggagcaacgaccagcagacgttgtgcttccagtgcgactcgtgcaaggctggcgtcctggccggcatcaagaagagctggcgcaaggtggccatcatcaacatcgtcgtgctcatcatcctcgtcatcgtctacgtcgccggctgcgccgcgttccgcaacgccaagagggacgacaacgatgagtcgtacggcatggccaggatgaccaagtcccggccgagcaggttccagttctaggcttgcccgcagcgaaaagccgggaaaacctttgcctgtacaaaaggccactcgttgtgggtggtggtgttaagacttttggcctgaactatatttcttgctgaactgtgttgatgatgatgatgatgattgatcaccctgtagctgggttgtgtgaaagggaaggtgttcttggatcgaaatgtttagtgtggtgtttgggttctgtggtgtttagggtaggtctattctgtatttggtggtacaagatgaggtctgcaaggaacaggacgggctggctcatttttaggaatgtattattctgcacttggtgattttgatctgtcatctgccttaagtagttcatgctattattatgattgtcatcagtctcagtatatcatgtgcaatatgcaggtttgatgtcatgctaaagg

SEQ ID NO: 5347 - DNA, 1227 bp, Avena sativa
aagatgatgcgcgggggcacgaacatgctggggatcgtgaacttcatcaccttcctggcctccatcccagtcctcggcggcggcatctggctggcctcccgggccaactccaccgactgcatccgcttcctgcagtggcccatcatcgtcatcggcctcgccgtcatggtcgtctccctcatgggcttcgcgggcgcctgctaccgccagacctggctcctccgcgtctacctcttcgccatgttcttcatcgtcgtcgcgctcctcttcttcatcgtcttcgccttcgccgtcaccgaccggggcgaagggcaggtggtcatgaaccgcaggttcctcgagtaccagctctccgactacaacggctggctcaggagccgcgtcgccgacccgcagtactgggccaccatcgccgcgtgcctccgagaagggcgagcctgcgccgggatgaagcggatggggcgcgacccctacaccggcatgctccagcccgagacgcccgccatgttcttcaaccgggacctctcgccgattcagtctgggtgctgtaagccaccgtcatcatgcggatataactacattaacgagacagcctggtcctcggtcaccaataccccgatggccgaccctgactgctacaagtggagcaacgaccagcagacgctctgcttcgggtgcgactcgtgcaaggcgggcgttctcgcgggcatcaagaagagctggcgcaaggtcgccatcatcaacatcgtcgtgctgatcatcctcgtcatcgtgtacgtcgccggctgcgccgccttccgcaacgccaagaggatggacaacgacgagtcgtacggcatggcaaggatgaccaagtctcggccgagcaggttccagttctaggtcaccacgaaactggaaagaagcctttgcctgtacaaaagaccagattgggtggtgtcaaggcttggcctgaattatatttcttgctgaaatggaggaatgctgtgtggtgaacacctgcaggtgtgtggtggttgctgtattaaaattttagggtggtgttctggttttgtgactgctttgggtgtttaggataggtgtattctgtattattctgcacttagagatgtattattacgactgctttggtacaagatgaggttgcaaggaacaagatgagttgcctcagttagagatgtattattctgcacttggagattttaatcgtcaacttcctttgaagcc

SEQ ID NO: 5348 - DNA, 2083 bp, Zea mays
actgttttccctaaagaaagactggttaggtgtattagtaagtgtggtatactggtaacccatctttttggtcattcaacagtgctcatcgatctcatctcatcaatgtacactataattagctagtagtgggacggttaattagggctccaatgccgatcttatattagtctatatatatagaggagaagcctaccaaaacttctcctaaaatctaaaatatgtacatagtataaatttaatatatattttatggtttttatcgtttatagatattttaatataatactattatatatatatatatatgtctattgtaaatgatttattaacattatgttgtaatagtttagttcagtctcttctaaagtttttactaactccgtccctgtttagcaccgatggagttccttgttcaaagagaagaaaataaataaagatattaagccaatacgtacagtgtaaaaactcacctaatctcgtagaaaattcagagcctgtggccgcttccattttctagatgtcggcaagaatctgtctcagcgagctagctataaacccccttgtgcgatacccagccatgctcatcatgcatcagcagcagcagcacgaaaccctgtagtagcctgccatgactacgcgctgctgcctggtcgtcgccactctcctcgcggcgctgctctcggtcagtgccagcctcgagttcggtttctacaacaagacgtgccccagcgccgagaccatcgtgcagcagaccgtggccgccgcgttcaccaacaactccggcgtcgctccggcgctcctccgcatgcacttccatgactgcttcgtcagaggctgcgacggctcggtgctgatcgactccacggccaacaacaaggcggagaaggactcgatccccaacagcccgagcctgaggttcttcgacgtggtggaccgcgccaaggcgtccctggaggcgcggtgccccggcgtggtgtcctgcgccgacatcctcgccttcgcggccagggacagcgtcgtgctcaccggcggcctcggctacaaggtgccgtccggacgccgtgacggccggatatccaatgccacgcaggccctgaacgagctgcccccgcccttcttcaacgccacccaactcgtcgacaacttcgcctccaagaacctcagcctcgaggacatggttgtcctctccggcgcacacaccatcggcgtctcgcactgcagcagcttcgccggaattaacaacacaggcgaccggctctacaacttcagtggctcatccgacgggattgatcctgcgctgagcaaagcctacgcgttcctcctcaagagcatttgcccgtcaaacagcggccggttcttccccaacacgacgacgttcatggacctcatcacgccggccaagttcgacaacaagtactacgtcggcctcaccaacaacctgggcctcttcgagtcggacgcggcgctgctgaccaacgcaaccatgaaggcgctggtcgactccttcgtgcgcagcgaggccacgtggaagaccaagttcgccaagtccatgctcaagatggggcagatcgaggtgctcacggggacgcagggcgagatcaggcgcaactgcagggtcatcaaccctgctaatgccgccgccgacgtcgtccttgcccgtcagccaggttcatcaggatccactggagtggctacaagctaaccatatctcggtgtgtctgcagtgtgtttggtgtgggatgtgatatagtatattgcaataatctagaaaactgaagaagaagcaggtgatgaccacactctgtagtgcatcacgcggtgcgtgttcatttaaccgtggcgtttgattgtgaggatgaaataaaacacatgtatgaccacatctgattattagtgatacaaaaaaaacttgattgaacatgtgctttgaccaaaagaatcgtcggcaaatcgttctacgaagcccttgcagattggacgtcatactcaattcatcagttactatccaacctaagaccaagaaaaaatatctgcgcagcatatgacacccttatcctaaaagtatatgcaaaaaaaaaga

SEQ ID NO: 5349 - DNA, 1804 bp, Sorghum bicolor
ctcaaccaccaaattagtatcacagatttcaatatgccttattgtttgattaaatgtcgatccattgagtgacaaaattgacctagcgatgaaaaaagaattcaacaagctgaagaaaaaacagacaactcacctgttttgggcgaatatatattcagagtgctgattcgacgatttgaaaaccccactctgtctctatcaagtgtcttcctgtgaattgcactgccattttttttccctacggaccggcaaagcatcctaacatcctataaaactcccccgtgcctcaccaagccatgcatcagagtccagagactagaagagcagcaacaggccggacgagctccacgtacagctagccatgacgacggcgacgacgacgacgatgaagcgccgcttcttacggttcgccaccgtcctggcgtcgctcctctcggccaccgcctgcctcgacgtcggcttctacgaccagacgtgccccaccgccgagaccgtcgtgcagcagaccgtggccgccgcgttcaccaacaactccggcgtcgctccggcactcatccgcatgcactttcatgactgctttgtcaggggctgcgacggctcggtgctgatcgactccacggcgaacaacacggcggagaaggacgcgccacccaacaacccgagcctccggttcttcgacgtggtcgacagcgccaaggcggcgctggaggcgcagtgccccggcgtggtctcctgcgccgacgtcctcgccttcgcggcgagggacagcgtcgtgctctccggcggcctcggctaccaggtgcccgccggacgccgtgacggcctgatatccactgccactgaggccctcaacaacctgcctccgccgttcttcaacgccacccaactggcagccagcttcgcctccaagaacctcaccgttgaggacctcgtcgtgctctccggcgcccacaccctcggtgtctcccattgcagcagcttcgccggagttggcaacctgggcgaccgtctctacaacttcagcggctcatctgacgggactgacccggcactgagcaaagcctacgcatttctgctcaagagcatctgcccgtccaacagcagccagttcttccccaacacgacgacgttcatggacctcatcacgccggaaaagttcgacaacaagtactacgtcggcctgacaaacaacctggggctcttcaaatcagatgtggcgctgctgaccaacgcaacgatgaaggcgctggtcgactccttcgtgcgcagcgaggcgactttcaggaccaagttcgccaggtccatgctcaagatggggcagatcgaggtgctgaccgggacgcagggagagatcaggctcaattgcagggtcatcaaccctgctaatgctgctgctgatgttcttgccgatcaatcgggttcttcaggattcactggagtggctgcaagctaatagtcgattgtcagtacatgtatgtgcattgtgcacagtgacgtccagtgtgaatgtgtgaaagtgcaataagtaatgagcagacttccttggtaagcttgattgttacattggttgggagaaatcatgcaatctatatgactgaacaaaaatgacagcatgatcactcttgtactctgttgtgagttgctttgttgttcatttgtgcatggagtttgattgtgaggaagaagtggatctgtgcgaccgtgccaaaattagttctacaaaatccatgcaaaccttattgtcaatactaaccgggtggccaaccctccttgtccagttattatccaaaattaagaaaatctg

SEQ ID NO: 5350 - DNA, 1368 bp, Zea mays
atagcgatcacatattctacgggccggctagctagcatctaaacagcctataaaactccccgcgtcccagacaagacgagcagcaacagccatgacgacgacgaagcggcactgcttgcgcttcaccaccgtcctggcgacgacgcttctctccgccaccgccgcctgcctcgacgtcggcttctacgacaggacatgccccactgccgagaccatcgtgcagcagaccgtggcggccgcgttcaggaacaactccggcgtcgctccggcgctgatccgcatgcacttccatgactgctttgtcaggggctgcgatggctcggtgctgatcgacacggtaggcaacctgacggcggagaaggacgcgccacccaacaaccccagcctccggttcttcgacgtggtcgaccgtgccaaggcgtcactggaggctcagtgccccggcgtggtctcctgcgccgacgtgctcgccttcgcggccagggacagcgtcgtgctctccggtggcctcggctaccaggtgccggccggacgccgtgacgggcggatatccaatgacaccgaagccctcaacaacctgcctccgccgttcttcaacgccaccgagctggcagacaggttcgcctccaagaacctcactatcgaggacctggtcgtgctctccggcgcgcacaccatcggcgtctcgcactgcagcggcttcgccggcccgacagacctgaacggccccgttgaccggctctacaacttcagctcgcctgacgggattgacccgacgctgagcaaagcctacgcatttcttctcaagagcatctgcccggccaacaccagccagttcttcccgaacacgacggtgttcatggacctcatcacgccggaaaggtttgacaacaagtactacgtcggcctgaccaacaacctgggcctcttcaagtcagacgtggcgctgctgaccaacgcgacgatgaaggccctggtcgactccttcgtgcgcagcgaggcgactttcaggaccaagtttgccaggtccatgatcaagatggggcagatcgaggtgctgacggggacgcagggcgagatcaggcgcaactgcagggtcatcaaccccgttagtgccaccgatgatgtcgtcctcgcccgcccatcaggattcactggagtggctgcgagctagctaaccaactgtcggttcatgcacatgcgttgtgcacagtgtgtgatgtctagtgtgagttgatgtgtgaaattgtaataagtaatgagcagattatcttggtaagctcgcttgttactgtggcaaaagttgttttgttgcatgacaaaaatgtatactcatcggattattgaaaacaaaactgatatttgttc

SEQ ID NO: 5351 - DNA, 1737 bp, Zea mays
gccgccttgccgtgtatcgggttcggcttctcccacgcgcgtgttgttggatcaagctgagcatggcgtcggtcaggccgtgcgtgtccgtgaagcccgccgtgcgcccggtcaggtacagatccacgagggctgggccggccggcttgggaaggctgcgcgtatgttcctgctccctggcgctcggcggcgacggtggctgcacccgcagcagcgggaggagcgtcgacgtcagtggtgccggtctcggcttgctcggcggcgatggactgaggatccacaggcggggcgggcgggaggtcctcgccatgtgcagcgcaagcttcgacggggtccgccccgccgccgtggcgagcgccgttcagcccgtgccggcgttccccgaacgggccaaggtggtgtcgctggtggcggctatcatgctgctctgcaacgccgaccgggtcgtcatgtccgtcgccgtcgtgccgttcgccgcgcagtatggatggtccagctccttcgtcggcatcgtccagtcttcatttttatggggatatgttttgtcatccatggttggaggagctttggcagacaaatacggcgggaagaaggtgatggcaggtgctgctgcactctggtccttggccacaattctcactccttgggctgcctcccgctccaccatcatgttgcttgctgtacgtgcactctttggccttgcagaaggtgttgcgtttccgacaatgagcactttcctaccaaagtggttcccaacgcatgagcgtgccactgctgtcgccatttccatgggtggattccatcttggaaatgtcataagcttcctagcaacaccgatcatcatgtcacacataggcctctcgggaacatttgccttcttcgcatcgcttggttatttgtggctctctgtatggatgatgaacgtagaaagtgatcctattgacagccatactataagcaagtctgagttgcaattaattctagatgggagaattggatctaaagtccaaggaagtaaattcccatccctaagagaattgttctcaaagactcaattcttggctgtcactttggccaatgtggtcaacaactggggctattttgtcctattgtcatggatgcccgtgtatttcaatacggtttataacatcaatctgaaacaagcagcgtggttcagtgccataccttgggcagtcatggctatgtccggttatgttgcaggagcctctgcagattttcttatcaaatctggtttctctattggactagttcgaaaaattatgcagtccattggttttatggggccttgcgtgtcattgctgtgcttaaggtttgcccaaactccatcagttgctgcagtcctcatgaccattgcgctgagcttgtgttcttttagccaagccggatacatgtgtaacatacaggacattgctccaaagtatgctggatccttgcacgggctgacgaacggcatagggacggtggcagccatagttagcaccatcgggatcggctacttcgtccagtggctagggtccttccaggccttcctcacgctcacggcggcgctctacttcagcgccaccatcttctacaacgtctacgcaaccggcgacctgatttttgactgaggaaaaatgcttttgtgcacacgcagaatcccaaagtgtaccaacattttaattgtatctccccaagcatggaataaaataggggtttagggtttaggtgcgccgg

SEQ ID NO: 5352 - DNA, 1962 bp, Setaria italica
cgctcgcaaccccctgcctcacttgccatgggcttgactcaccgcgcgacgcgctctccgatccccgccgtggacctctgactaggctcgctcgttcctgcttccgtgcttcgccgccgcgtattcaggcccaggctatcagctcctcccacgggccggtagttggatcaagcttggcgatggcgccggtcaggtcgtgcgtgtccgtgaagaccgccgtgagcccggtcaggtacagatccacgagagtcggggcggccggcctgggggcgccgggaaggctgcggatatgttcctcgtccgtggcgtcggcagccgacgctcgcggggatggcggttgcgccgccagcagcagcgggaggggcgtcgtcgtcaatggcggcctcggcgtgctcggcggcgacgggccgaggatcaggcggcgggatgtcgtcgccacgtgcagcgcgagcttcgacggggtccggcccgtccccgccgccgccgctgccgtggcgagcgccgtgcagcccgcggtggcgtcgtcgtcggcgttcccggagcgggccaaggtggtggcgctggtggcggccatcatgctcctctgcaacgccgaccgggtcgtcatgtccgtcgccgtcgtgccgatggccgcgcagtacgggtggtccagctccttcgtcggcatcgtccagtcatcatttttatggggatacgtttgttcatccatggttggaggagctttggcagacaaatatggcgggaagaaggtgatggcaggtgctgctgcactatggtccttggctacaatcctcactccttgggctgcctcccgctccaccaccatgttgcttgctgtgcgtgcactctttggcctagccgaaggtgttgcatttccgacaatgagcaccttcttaccaaagtggtttccaacacaagagcgtgccaccgctgtcggcatttcaatgggtggattccatcttggaaacgtcataagcttcctagcaacaccgatcatcatgtcacacataggccttactggaacatttgccttcttcgcatcgcttggttacttgtggctatctgtatggatgtttaatgtagaaagcgatcctattgacagccgtaccataagcaaatctgagctgcaatttattctagatggaagaagcggatctaaagtcaaaggcagtaaaggcccatcccttagggaattgttctcgaaatttgagttcttggctgtcactatagccaatgtggtcaacaactggggctactttgtcttattgtcgtggatgcctgtgtacttcaaaacggtttataatgtaaatctaaaacaagcagcatggttcagcgccataccttgggcagtcatggctatgtccggttacgttgcaggagcctctgcagatttcctgatcaaatctggtttctctataggactagttcggaaaattatgcagtctattgggtttatggggcccggagtgtcattgctatgcttaagatttgcccaaactccatcagttgctgcggttctcatgacgatagccctgagcttgagttccttcagccaagctggatacttttgcaatatacaggatattgctcccaaatatgctggatccttgcacgggctgacgaacggcattgggacagtggccgctatagttagcaccatcgggaccggctacttcgtgcagtggctagggtccttccaggccttcctcacccttacggccgcgctctacttcagcgccaccatcttctacaacgtctacgcgaccggcgacctgatttttgactgacatacaaaaattttgctaagattcttttgtgcggaatcccaaagtgtaccaacatttatttgtatctccccaagaatggaataagatataggttgttcgcttacctcgtgtggaaccgtgcgcaagcattgttagcttgcggggaaattccagaagaacattgggaaggacgtgc

SEQ ID NO: 5353 - DNA, 2230 bp, Zea mays
accaaccaaacagttccttcgccgatttaagccacgtgactgccaatccggccaggctctccgtgcactacttgtctcctccctcgctccgtccgatgtgcctgctggcacagcgccacctaccaccctcagctcgacccaactccctcgtcagtcgtcgccccgcgtcgcgtggtcctaatttaagccaccaactgccgatcaacggcgctcgcccgcccgcccgcccgccagcccgcgcacgccgctcgctccccactcactgccatgggcctggctcgccgcgcgacgctcccgtcgatccctgccgcgctcctctgatagtcacagctagccaggcggccccgcttgccgtgtgtcgggctcggcttgtcccacgcgcgggcgcggagcgggttgttggatcaagctgaccatggcgtcggtcaggtcgtgcgcgtccgtgaagtccgccgtgaggagtcctgtcagttacagatccacgagggccgtggcggccggctcgggaaggctgcgcgtacgctcctcgtcgctgcaggcgctcgccggctgcgccagcggcggcggcggcttcggcttgctcggcagcgatgatgggccgagggtcaggcggggcgggcgggaggtcctcgccacgtgcagcgcgagcttcgacggggtccgccccgccgtcgtggcgggcgccgccgctcagcccgggtcggcggcgttccccgagcgggccaaggtggtggcgctggtggccaccatcatgctgctctgcaacgccgaccgggtcgtcatgtccgtcgccgtcgtgccgctcgccgcccagcacggatggtccagctccttcgtcggcatcgtccagtcatcgttcttatggggatatgttttctcatccatggttggaggagctttggcagacagatatggcgggaagaaggtgatggcaggtgctgctgcgctatggtccttggctacaatcctcactccgtgggcagcctctcgctccaccatcatgttgcttgctgtacgtgcactatttggcctcgcggaaggtgttgcatttccgacgatgagcaccttcttaccgaagtggttcccaacacatgagcgtgctactgccgttggcatttccatgggtggattccatcttggaaatgtcataagcttcctagcaacaccaatcatcatgtcacacataggcctctcgggaacatttgccttcttcgcatcgcttggttatttgtggatctctgtatggatgatgaacgtagaaagtgacccacttgacagccatactataagcaagtctgagttgcaattaattctagctggaagagctggatctaaagtccaaggcagtaataaattcccatcccttagggaattgttctcaaggactgaattcttggctgtcactttggccaatgtggtcaacaactggggctattttgtcctattgtcgtggatgcctgtgtacttcaaaacggtttataacgtcaatctgaaacaagcagcgtggttcagcgccataccttgggcagtcatggctatgtccggctatgttgcaggagcctctgcagatttcctgatcaaatctggtttccccataggactagttcggaaaattatgcagtccattggttttatggggccttgcgtggcattgctatgcttaaggtttgcccaaactccatcagttgctgcagttctcatgaccattgccctgagcttgagttctttcagccaagccggatacttttgcaatatacaggacattgctcccaaatacgctggatctttgcatgggatgacgaacggcatagggacggtggccgccatagttagtaccatcgggaccggctacttcgtccagtggctagggtccttccaggcattcctcaccctcacggctgcgctctacttcagcgccaccgtcttctacaacgtctacgcaaccggagacctgatttttgactgagacaagacatgctaatgctaggattctttcgtgtagacgcagaatcccaaagtgtaccaatatttattatttatttgtacctcccaaggatggaataaaatagaggctgattgtttgccaagcttaaaattcgtgtgcaaaccagggtttacaaaagcagtcggttttgccggtaaagcggtcagttttggcggtaaagcgatgggccggggtttcggttaaccaccgttttttcaaaattcgtccgaaattcaaaatatttga

SEQ ID NO: 5354 - DNA, 2045 bp, Panicum virgatum
cactgccagtgccacctaccgcacctcgtgtcctcgtcagccgtgatcaccagttcgccacctaccgcacacccccgagctcactgccatgggctcgtctcgccgcgcgccgcgctctccgatccccgcccttgtcctctgagagcgagagctctctcgttcccgctttgccgccacgccgtgcgtccaggctctcacgatcagcttctcccacggcccacgggcaggtaattggatcaagctcgacgatggcgccggtcgtcaggtcgtgcgtgtccgtgaaggccgccgcgagcccggtcaggtacagatccacgagggtcggggcggcgggcttgggggcgccgggacggctgcgggtatgctcctcgtccgtggcgctcggcggcgacgcctgcggcgatggcggtcgcgccgccagcatcagcgggaggggcgtcgtcgtcagtggcggtaccggctcgctcggcggcggtgggccgagcgtcaggcggcgggacgtcgccgcctcgggcagcgcgagcttcgacggggtccggcccgtccccgtccccggcgccgctgccgtggcgagcgccgtccagcccgcggtggcgtcggcgttcccggagcgggccaaggtggtggcactggtggcggccatcatgctgatctgcaacgccgaccgggtcgtcatgtccgtcgccgtcgtgccgatggccgcgcagtacggatggtccagctccttcgtcggaatcgtccagtcatcatttttgtggggatacgttttctcatccatggttggaggagctttggcagacaaatatggcggcaagaaggtgatggcaggtgctgctgcactctggtccttggctacaatcctcactccttgggccgcctcccgctccaccatcatgttgcttgctgtgcgtgcactctttggcctagcagaaggtgttgcatttccgacaatgagcaccttcttaccaaagtggttcccaacacaagagcgtgccacggctgttggcatttctatgggtggatttcatcttggaaacgtcatcagcttccttgcaacaccgatcatcatgtcacacataggcattactggaacatttgccttctttgcatcgcttggttacttgtggctccttgtatggatgtttaatgtagaaagcgatcctgttgacagccgtaccataagcaaatctgagctgcaatttatcctagctggaagaagtggatctaaagctaaaggcagtaaatgcccatccctaagggaattgttctcaaaacttgagttcttggctgtcactgtagccaatgtggtcaacaactggggctactttgtcctactgtcgtggatgcctgtgtacttcaaaacggtttataatgtaaatctcaaacaagcagcatggttcagcgccataccttgggcagtcatggctatgtctggttatgttgcaggagcctctgcagatttcctgatcaaatctggtttctccataggactagttcggaaaattatgcagtccattggttttatggggccgggtgtgtcattgctatgcttaagatttgcccaaaccccatcagttgctgcagttctcatgaccactgccctgagcttgagttctttcagccaagccggatacttctgcaatgtacaggacattgctcccaaatacgctggatccttgcacgggctcacgaacggcatcggaacggtggcagccatagttagcaccatcggggccggctacttcgtgcagtggctagggtccttccaggccttcctcaccctcacggcggcgctctacttcagcgccaccgtcttctacaacgtctacgcgaccggcgacctggtttttgactgagaaacaaaattggttagattctttggtgcagaatcccaaagtgtaccaacatttatttgtatctccccaggaaaggaataagatagaccctcttattcgctttcaatatataaagcggacttttcgccgtcaaaaaaaaaaagaaagcgtgtaacttgcgaggaaatcacagaggaacattgggaaagg

SEQ ID NO: 5355 - DNA, 2732 bp, Oryza sativa
cgcgctattttccgtatgtaccgtagccggttggaaaccagcgtctgcgaacacaccctgaatgaaggaggactgggcggcggtcacaactccagagtccacaccaagcagccccccggcgcgctgctggtcgcacacgacaagggtgcgcgcgcgtgtatcaccggctgcactcggccagtccgccacctcctcctgacctccccactcagaaacgtaggtaagactaacaaagaccagtccaccacctggccggtcttacattctcagtttctcaccacggtcacgccgaacgaacgagacggcggtctcgctcgctcgctcgctcttcgttcggcctcggccgcgcgaggtaggtggcgcgactcggcgcggctcggctaccgatcgcgcgtccccgcaatccttgaccctttccaaatcccaccaacacgagccctcgttttaaatctactcgtgctacgcttacttgcttacacttgacgaaccaacctcactttctccccgtagctggctgggctgtggctcgctgctctctcatccgccacctaccgccaccaccttccccccacggtccagctcctcaccgtcgtcgttcgtcctcgccgagtcctaatttataccaacccatccaccgggcgatcacacgcacgcacgcacatggtcgattggttagctctctttcccattgccatgggccgccgcctctgatccccctcgcctctcgctaccgagttgctggccattggttggttggtggatcgggtttgtctcgccggggcgcgggggggggggggggggggggccccatggcgtcaatcaggtcgtgcgtgtcggtgaacccggcggcggcggtgaccccggtcaagtacaaatccgcgagggtcggggcggccgggttggacccaaaaggcctgaggatatcttgctcttcgtcttcctcgtccttggccgcaggtggtggtgatgggtgcagggatgccgggtgcgccagtagcagcggcaggggcagcggtgtcgttggttcggttggcgatggttggtgggggaggaggggcgggcagcgggagcgggccgtcgccgccatgtgcagcgccggcatggagggggtccggcacggcgccgccgccgtggccagcgtgccggcggcgtcggcgtcggcgttgccggagcgggccaaggtggtggcgctggtggcggccgtgatgctgctctgcaacgccgaccgggtcgtcatgtccgtcgccgtcgtcccgttcgccgcgcagtacggctggtccagctccttcttgggcatcgtccagtcatcttttctttggggatatgttttctcatccatggttgggggagctttggcagaccgatatggagggaagaaggtgatggcaggtgctgctgccctctggtccttggccactttcctcactccatgggctgcttctcaatccacaattatgttgcttgccatacgtgctctctttggccttgcggaaggtgttgcatttccaacaatgagcactttcttaccaaagtggttcccaacacatgaacgtgctactgctgttggcatttctatgggaggattccatcttggaaatgtcataagtttcttagcaacaccgatcatcatgtcacatataggcctcgccgggacatttgccttctttgcatcacttggttacttgtggctttctgtatggttgttcaatgttgaaagtgaccctcttgacagtcgtacaataagcaaatctgagctgcaattaatcctagccggaagaagtgcatcaaaaattcagggtagcaaattcccatccttacgagaaattctgtcgaagatcgaaatgtgggccatcattgtagctaatgtggtcaacaactggggctattttgtactactatcatggatgcctgtctactttaaaacggtttataatgtcaacttaaaacaagcagcatggttcagtgccataccttgggcagtcatggctctgtctggttacgtcgcaggagcttctgcagatttcctgatcaaatctggtttctctgttgcattagttcggaagattatgcagtccatcggttttatcgggccaggcgtttcactgctttgcttaagatttgcccagacgccatcagttgcagcagtcctcatgaccatcgccctgagcttgagttccttcagtcaagctggatacttctgtaatgtacaggacattgctcccaaatacgctggatctctgcacggactgacgaacggcatcgggacagtggccgccatagttagcaccataggaacaggctacttcgtgcagtggctaggatccttccaggccttcctcaccctcacggcggtgctttacttcagcgccaccgtcttctacaacacctacgccacaggcgacctaatttttgactgagatgatgacattacccctcgtgtaaaatctcgaagtgtagtacttccaccattgtttctctcctagtcctatggctgagccaggaaaccaataaacagatgttgattgaaattgattgattgactgccatttttggtgtaaaattgagtgcaaccgcggttacttttgaggaagcaaatcgttaatacaggaaaaaggggtggagccgctcatacgcggttcaggtgttcgacgaaattaccgagccacgcgcgcggaaggaagcgccggggaggggcatggagcggcggtacccccatggcgcgcgcgcgcgcg

SEQ ID NO: 5356 - DNA, 2229 bp, Hordeum vulgare
acaaccccgcccgctcccacatcttctgggatccgcaacctaccacctttcgtcctccccgaggtcccaaatttataccaccaaccaacccagttggtcaatcgtactaccacttgtctgcctcgtactccttaattaccatggcatacaccaagcatcttccggtctctgctccgcctctctgagcacgcccggtcagctccagtcacctcctcgcgcggatcatggcgtcggtgagatcctgcgtgtccgtcaagccggccgctggcccggccaggtacagatccgccagggtcggggccgtcagcctggagccgacaaggctgcggatatccgcttcttcttcttcttcgttgggctcggccgcggatggctgcggcagaggcgtcggctgtgccactgccagtagcagcggcaggggcgacgccgttgtcggtttggttggggatggcgggagggcgaggaggcggggcggacgggaggtcgtcgccacgtgcagcgccagcctggagggggtccgccatggcggcgcggccgccgccgtggccagcgtgccggcgctgcccgagcgggccaaggttgtggcgctcgtggcggccgtcatgctgctctgcaacgccgaccgggtcgtcatgtccgtcgccgtcgtgccgctcgccgcgcagcacggctggtccagctccttcgtcggcatcgtccagtcatcatttctatgggggtatgttttctcatccatggttggaggagctttggcggaccgatacggggggaagaaggtgatggcaggtgctgctgcactctggtccttggccactttcctcactccatgggccgcctctcaatccgccactatgttgcttgctgttcgtgtgctttttggcgttgcagaaggtgttgcatttccgacgatgagcactttcttaccaaagtggttcccaacacatgaacgtgccactgctgttggcctttccatgggaggattccatcttggaaacgtcgtaagcttcctggcaacaccgatcatcatgtcacatataggcctcgccggaacatttgccttcttcgcatcacttggttacttgtggctctctgtatggctgttgaatgtagaaagtgaccctatcgacagccgtactataagcaaatctgagctgcaactaattctagctggacgaagtaaatcaaaagtcaaaggcagcaaatccccatctttaagagaagttttctcaaagatggaaatgtgggccatcattgtagctaatgtgataaataactgggggtattttgtcctactatcatggatgccggtgtacttcaaaacggtatataatgtcaatttgaaacaagctgcatggttcagcgccataccttggggcgtcatggctctatcaggatatgttgcaggagcttctgcagatttcatgatcaaatctggcttatctattgtgcgagtccggaaaattatgcagtcaattggttttattgggccaggtgtgtcgttgctatgtttaagatttgcccaaacaccatcgattgcggcagttatcatgacggccgccttgggtttgagttcctgcagtcaagctgggtacttctgtaatgtacaggacattgcccctaaatacgctggatccctacacggaatgacgaacggcattgggacggtggccgccatagtaagcacggtaggagcaggatacttcgtccagtggctgggatccttccaggccttcctcaccctaacggcggtgctctatttcagcgccactgtcttctacaacatctacgcaacaggagacctgatttttgactgagctgaaaattattttttccgtctataatgtcaaaatgtagaatacagcttgtaaaatgtctctctgcgcccaccgcgcagagcaaagaaacgaatataatcccaccgcgcagagcaaagaaacgaatataatcaaaattgattggttggttcattcatattagactgaccgcaaccatggtggctttgtatcagtagaaaaagtatggaatgcaagagaatcttttcaacaaaattatctttctctttcttttagtagcaagaaaatgtacgagcaattggtaaccatgttgccccttacactactttcactcattcttccattcaggttacagagttcaatagtctgaactcaacaatcaggcaatatttcaggctttatatataaagccgggcatgtgcattccgtttacgag

SEQ ID NO: 5357 - DNA, 1654 bp, Zea mays
gctgcgctcctcgattcgacccccgcttccctccaactcgcctccgcgctcggcagtcggcacccacccctcttcctcctctctgccggcaacaggacgcaggcgcataaaaaatagcaccgccaccaccacgctccacacgctgcagtttctggaaggccaccccctctgtccgctttaaggcgccgtccgcaccggtcgcctccctcccccactagcgctgccgcggccctcgcccatatacagcgcggccgcgcccaatcgttcgttccgttccgctccgccacagcggctccgcaccaaatacaggcgtgtccaccgcgctcgccccctgctggtctgcgctgctctcgtcttgctcgccctcttattccctctcctccccgctccgaactcccaaagcctccacccgaggaggaggcctgccaggttcgttgccggccgtgtgttgttcgcccggccggccggcccgaccgaggggaagctgcagcctgctcgctcgctcgagctattgcgtaggccgttgacgatgtcatgtggcccctgtgcgtcatctccgagaagctcttcaggatggcgggcgacgacggcgcgcagggggcggcgggctcgccgtaccccgacgggcggatttcactagcacgccgatcgtactacatcgatgttccgcatgtgcagcaggccttcacctgggactgcggcctcgcttgcgtgctcatggtgctcaggacgctagggattgattgctgcgacggcattgccgatctagagaggctctgccgcaccacaagcatttggacggttgacttagcatatctgttaaacaagttttcagtcagcttttctttctgtaccgtgacccttggagcaaatccacaatattctgctgaatccttttatagggagcaattgcaagaagacatcgatcgagtggatgagctatttgggaaggcgctcgatgctggaattagcattcaatgcaggtccatcaccgcatacgacattgcttttctactgttatctgggcactgcattgctattgctttagtggacaaatcgaagctaaatttgccctgcatgagtgatcatgatgtacaacagcacaacgatgagcctgactacatgggacactatgtcgtaatatgtgggtatgatgctgatgattgtgaatttgagataagagatcctgccagttccaggaaacgcgaacgggtgacaatgaagagcttggacgaggcccggaaatcctttgggacagacgaggacattctcttggtctctttaacaggaaagagtgggatgaagctgtcgcgtaagctacttgcctgctccatgtagataaataaataggtcactagcaaccttgtgaatacgctgtacatgtccctgtagtagttatgactgtcgagtgccagccctgtacgtagctgagaacgttctcgcagttaccgctgataacagcagtgtggtagtgagcttagtaggcaccctgtatgttggcccatgccgtcgccaaaccatggccgcgcaaaggggttcagcggcagcaaaaggctctgctgaccttgtaaacgagcaagtgttctatgtacgattgttaactgaacgtgtacagatctccggaaataagaattaaaatcgtgctcctctctgc

SEQ ID NO: 5358 - DNA, 1599 bp, Setaria italica
cccagcccgccccgcgccttctcctcctttctaccggcagcccagcagagtacagactagagtgccgaggcgcacaaaaaaatagcaccgccaccaccacacgcagcagtttctggaaggcccccgcgtgcccttaaaggcgccgcgcgcgccggtcgcctccccctggcctctcgcccgttttaatcaccgtccagcccggtggcagttaagccggccgcgcccaatcgcccgttccgccaccaccgcggctccgctcccatccaggcgcgccctgctgtgctcaacctgctgctcttcctcttattccctccccacagggaggggtctgccaggttcagtcgccggccgtgctcgcctgatcctcttcctcgcccggttctgagagagccgggggagcgggagcgggaagcccccgctcgatcgagcttcgttgccgcgggcgtttgacgatgtcatgtggcccctctgcatcatctccgagaagctcttcaagatggcgggcgacgacgacggcggcgggcaggggccgggctcgccgtccgccgacggccagattcctctagcacgccgatcgtactacgtcgatgttccacatgtgcagcaggccttcacctgggactgcggcctcgcttgcgtgctcatggtgctcaggacgctggggatcgattgctgcgacggcattgccgatctcgagaggctctgccgcaccacaagcgtttggacagtcgacttggcgtatctgttaaacaaatttgctgttagcttttctttctttactgtgactattggagcaaatccgcaatattctgctgaaaccttctatagggagcaattggaagaagacatcgaccgggtcgatgagctattcgggaaggcacttgatgctggaattagtattcaatgcagatccatcagcgcatatgaaattgcctttctactgttatcagggcactgcattgccattgcattagtggataagtcaaagctaaattcgtcttggatgaatggtgtacatgatgtgcaacagctcaatgaggattcagattacatggggcattacgtcataatctgcgggtatgatgccgatgattgtgaatttgagataagggatcctgccagttccaggaagcgcgaaagggtgacaatgaagagcttagacgaggcccgcaagtcctttggaaccgatgaggatattctcttggtctccttaaccggaaagagtgggatgaagctcacccgtaaattcctcgccggctccatgtaaatagctcaccgcgccagcctcgcgcaaccttgtgtatacgctgtacattttcccctgtagttatgattgtcgattgccagccttgtacgtaaccttactgccgataggaagagctagtcaccaagctgtagccacgaagggttcagcggcagcaaaaactgctgctcttgtgtagctgcaaatgatcaatgatgcagcagcagcagcaaacagttctgctgctcctataacaaagaaaagctatacgatcatagctgaacgtgtacagatctgcttgaatgaattgtgatcctctgcaacatatcccgtctgttctgctgctggaatgtttg

SEQ ID NO: 5359 - DNA, 1819 bp, Panicum virgatum
cgggtcgcggttcggaaagcgaattctccgtcggcatcctcctccgcctccccctggatcgagccgccaatccctatccatgcccgcgcctccactcctcgatcgccccccggcttcgcttccctccaactccacccctcccccttcctcctccccgtacagcagcagagcagagcgcgaggcgcataaaaaatggcaccgccaccaccacgcaagcagcagtttctggaagccgcccgcgtgcccttaaaggcgccgcgcgcgccggtcgcctcccctccccacccgctggcgccggcgctggcgctcgcccgttttaaatcaccgtccagcccggcagcagctaggccggccgcgcccaatcacccgttccgccaccgggggctccgctccgcactgctggtggtgctcaccctcacctgctgctctccctttcttccttattccctccctccctccctccccctctccggcctcggaacagggagggctctgcctctgccaggtttagttgccgttgccggccggggggagcgggaacccccccgctcgatcgagctcctcgcgcgggcgttttgaccatgtcatgtggcccctctgcgtcatctccgagaagctcttcaggatggcgggcgacgacggcgggcacggcccgggctcgccttccgccgactacgcccagattcccctagcgcgccgatcgtactgcgtcgatgttccacatgtgcagcaggccttcacctgggactgcggcctcgcctgcgtgctcatggtgctcaggacgctggggattcattgctgccacggcattgccgatctcgagaggctctgccgcaccacaagcatttggacagtcgacttggcgtatctcttaaacaagttttcagttagtttttctttctttacggtgactcttggagcaaatccgcaatattctgctgaaagcttttatagggagcaattgcaagaagatattgatcgagtcgacgagctatttgggaaggcacttgaagctggaattagtattcaatgcagatccatcagtgcatatgatattgcttttctactgttatccgggcactgcattgccattgcattagtggataagtcaaagctaaattcctcttggatgaatgatgtacatgatgtacaacagctcaatgaggattcagattacatggggcattatgtcgtaatatgcgggtatgatgctgatgattgtgaatttgagataagggatcctgccagttccaggaagcgcgaaagggtgacaatgaagagcctagatgaggcccgcaaatcctttggaaccgatgaggatattctcttggtctccttaacaggaaagagcggaatgaaggtcacgcgtaaattcctcgccggctccatgtaaatagctcgccaagcctccagcccccttgtgtatacgttgtacatgcccctgtagctatgattgtcgattgccagccttgtaattttactgccgataggaacagtgtgccaggaaaggtagttagcttcggttttatggtttattggctcatggcatcaccaaagtccagctgcgaagggttcagcagcggcggcagcaaaaattgctgctcttgtgtagttgcaaatggaatggtgccgtagcagccagaaatgctgctcttgtgtagtttaccgctggcagcagctgcaaacagttctgccgatcttgtaacgagcaaaagctatacgatcatatctgaacgtgaacagatcttccttggagtgttccgcagtctgaatctcgccgatcattcgagctcgtggccgccggacccaaccggcgtcg

SEQ ID NO: 5360 - DNA, 1641 bp, Panicum virgatum
cttctcctcctttccaccggcagcagcagcagcagcagcagctgagcggagcgcgaggcgcataaaaaatagcaccgccaccgccacgcagcagcagtttctggaagccgcccgcgtgcgccgcgcgcgccggtcgcctccccgcccgcaccccgctggcgctcgcccgttttaaatcaccgtccagcccggcagcagctaggccggccgcgcccaatcacccgttccgccaccgcgcgctccgctcctcctgctggtggtgctcaccctcacctcacctgctgctctttttctttcttattccctccctccctccccctctccggcctcggaacagggagggctctgcctctgccaggtttagttgccgttgccggccggggggagcgggaacccccccgctcgatcgagctcctcgcgcgggcgttttgaccatgtcatgtggcccctctgcgtcatctccgagaagctcttcaggatggcgggcgacgacggcgggcacggcccgggctcgccttccgccgactacgcccagattcccctagcgcgccgatcgtactgcgtcgatgttccacatgtgcagcaggccttcacctgggactgcggcctcgcctgcgtgctcatggtgctcaggacgctggggattcattgctgccacggcattgccgatctcgagagcctctgccgcaccacaagcatttggacagttgacttggcgtatctcttaaacaagttttcagttagtttttctttctttacggtgactcttggagcaaatccgcaatattctgctgaaagcttttatagggagcaattgcaagaagacattgatcgagtcgatgagctatttgggaaggcacttgaagctggaattagtattcaatgcagatccatcagtgcatatgatattgcttttctactgttatctgggcactgcattgccattgcattagtggataaatcaaagctaaattcctcttggatgaatgatgtacaacagctcaatgaggattcagattacatggggcattatgtcgtaatatgcgggtatgatgctgatgattgtgaatttgagataagggatcctgccagttccaggaagcgggaaagggtgaaaatgaagagcctagatgaggcccgcaaatcctttggaaccgatgaggatattctcttggtctccttaaccggaaagagcggaatgaaggtcactcgtaaattcctggccggctccatgtaaatagctcgccaagcctctatcccccttggcccttgtgtatacgttgtacatgtccctgtagttatgattgtcgattgccagccttgtaattttactgccgatacgaacagtgtgccaggaaagttagttagctttggttttatggtttgtgggctcatggcatcaccaaagtccagatgcgaagggttcggcagcggcagcggcaaaaaattgctgctcttgtgtagttgcaaatggtgcagcagcagcagccggaaatgctgcttttgtgtagtttacctatggcggcagcagctgcaaacagttctgctgctcttgtaacgagcaaaagctatagtacgatcatatctgaacgtgtacagatcttccttgatgaaagtatgatccttgatcctttgcaccgt

SEQ ID NO: 5361 - DNA, 2514 bp, Panicum virgatum
gccacgcagcagcagttctggaagccgccgcgtgcccttaaagacgccgcgcgcgcacggtcgcctccccgcccgcaccccgctggcgctcgcccgttttaatcaccgtccagcccggccgcagctaggccggccgcgcccaatcacccgttccgccaccgcgcgcgccctgctggtggtggtgctcaccctcacctcacctgctgctcttcccctttcttattccccctgcccccctctccgggctcgggatagggaggagggctctgcctctctgccaggtttagttgccgccggccgcgtttcctctgctccgggagccggggggaggagcgggagccccccgccgcgcgatcgagctcctcgcgcgggagttctgacgatgtcatgtggcccctctgcgtcatctccgagaagctcttcaggatggcgggcgacgacggcgggcacggcacgggctcgccgtccgccgactacgcccaggttcccctagcgcgccgatcgtactgcgtcgatgttccacatgtgcagcaggccttcacctgggactgcggcctcgcctgcgtgctcatggtgctcaggacgctggggattcattgctgccacggcattgccgatctcgagagcctctgccgcaccacaagcatttggacagttgacttggcgtatctcctaaacaagttttcagttagtttttctttctttacggtgactcttggagcaaatccgcaatattctgctgaaagcttttatagggagcaattgcaagaagacattgatcgagtcgatgagctatttgggaaggcacttgaagctggaattagtattcaatgcagatccatcagtgcatatgatattgcttttctactgttatctgggcactgcattgccattgcattagtggataaatcaaagctaaattcctcttggatgaatgatgtacaacagctcaatgaggattcagattacatggggcattatgtcgtaatatgcgggtatgatgctgatgattgtgaatttgagataagggatcctgccagttccaggaagcgggaaagggtgaaaatgaagagcctagatgaggcccgcaaatcctttggaaccgatgaggatattctcttggtctccttaaccggaaagagcggaatgaaggtcactcgtaaattcctggccggctccatgtaaatagctcgccaagcctctatcccccttggcccttgtgtatacgttgtacatgtccctgtagttatgattgtcgattgccggccttgtaattttactgccgatacgaacagtgtgccaggaaagttagttagctttggttttatggtttgtgggctcatggcatcaccaaagtccagatgcgaagggttcggcagcggcagcggcaaaaaattgctgctcttgtgtagttgcaaatggtgcagcagcagcagccggaaatgctgcttttgtgtagtttacctatggcggcagcagctgcaaacagttctgctgctcttgtaacgagcaaaagctatagtacgatcatatctgaacgtgtacagatcttccttgatgaaagtatgatccttgatcccttgcaccgtattccgtctattctgcttctggagtgtttcgctgtctgaatctcgccgatcattcgagctcgttgccgccggacccaaccggcctttccagcgattgcacttggagaagcaaacaaaaaaaaaactagagctaagtgattagggagcagacatctccttgtcaatgagcagcgtgcaccgtgcgtgcgcatgtcgtccttgttaaaagcaactttatttaaaaaagaaggtactccttgtcaatgaacagagtagctacaattactcgagacaaacggagttctgctagtatttctattcctacggagtactgtacatccgtgtatgaaggttggaggcccatctgttcaccgatgctgcaacacctacacacctggccaagaaagtttgagaagacggcagagtctgtgagataatagtagacgacagttgaaggcagacaagtaagctcacgggttcagagaattgcgttgtattcagtcactgccaaaaacattgcgtaacgagtcggcttccactgcctcctcctagtagctgatccattcagtagtaaagctaggtggttacggaaaatgtcgctgctgaatggaatggctcccgtgaaccgcccgcctgttcaccgaacgcaaacgcgacgggcaagccgcgcgccgccgccagatttccccggagttgcaaccgcggaggaaaccgaagcgtcacgccggcgacgggggacgcgagctcgcgtgacagcgacgggcctccgccgtcgcccggtcggtctcgccggagtgcagatcgcggtttgaaatgcactccggagatcaagacaggtcgctccacttgccgcagcaggaaggaacaagaaaagtcgtacccgtaccggtgccattataagaactcaggccctgttttggtgaaaagttgttagttttgatactat

SEQ ID NO: 5362 - DNA, 1715 bp, Brachypodium distachyon
agagtaacacaacggcgagaggccttctacgggatacggctatacgggcccccgattcccctacgcgcgtcttcctccccaatcctcgtcgtcctttcttccctccagctcgtccttgcccgccgtacaaacacctaaaaatcaacacacggcggcttctcttctggaagggaagggctctattaaagccgccgctcccgttcccatcccaccgattcttctggtgcccgcccgcccgccgccgccgcgcgcgttccccccgctttataatcaatcatccagccagccaccagcccaatcaatcattccgccatcgcgccatatccaagggttcttctcgctgctcctcctcctcctccttcttcctcctcctcgggctccggacggcgaggagaattgtctgcctgcgtctcctgattctcgcccgagccgctggtgcccgcgtgctttgtttgcgtttcatggtgtgtcatgtggcccctctgcttcatctctgacaagctgttcaaggtggccggagacgactgcggcgagggccccggtgcggcgctgccccccggcagccaaattccactcgcacgccggtcctaccgcgtcgatgttccgcatgtgcagcaggcattcacctgggactgcggcctcgcttgcgtgctcatggtgctcaggacgctaggggttgattgctgcgacggcattgccgatctcgggaagctctgccacaccacaagcatttggacagtcgacttggcatatctattacacaagtttcgagttagtttttcgttctttactgtgactattggggcgaatcctcaatattctgcagaaaccttttatagagagcaattgcaagaagacatcgatagagtggacgaactatttggaaaagcagttgatgctggaatcagtattcaatgcagatccatcagtgcgtatgatattgcttttctactgttatccgggcactgcatcgccattgcgctagtggacaaatcaaagttaatttcctcttggatgaatgatgtgcatgacgtgcaacagttcaacgaggactcagattacatggggcattatgttgtcatatgtggctatgatgctgatgcttgcgaatttgagataagggatccggccagttctaggaagcgtgaaatggtgcccatgaagagcttagaagaagcccgcaaatcctttggaactgatgaggatattcttttggtctccttaactggaaaaaacgggatgaagctatcgcgcaaacttccagacagctctctgtaaactgctcacaagcctccagtctccttgtgtatacgctttacatgcccgtgtagttacgcttaccatttgtcaagtcaggtatgtagtgtgtagtgtgagagcattcttgcaaccgataggaacagtttcctagtgaagttagatagacgaaattagtaaggcttataggtcgacgggggctcacccacactggagctacaaagggagcagcagcagccgcagcaactctgctcagcaagagctgcttttgtacacagaaactgcctctgcccccagcgatcatagctggacagagacgtcgcatatgtacagatatccatgaataaatggtgaccaagtcatatacacactgtatcttcttcaaatcctttctggatatgcgtcgtaaaactccggccggcaacggcgtcgctgtccactgtcgtaggattggcggg

SEQ ID NO: 5363 - DNA, 1454 bp, Hordeum vulgare
cgattcttccgctgcccgtgccggtgcccgtgcccgccgccgccgccgcgcgcccccctccccgtccccgcctctttataatcaaccgtccagtccccagcccagccagcccaatcgttccgccacggccagcccgcgattcccatcccgccccacctcaccgcccaccgcccaccgccacgccacgccacgcgctccccgtgttcccgggctttacccgagggcctctcttcctgctcttcttcttcctcctcctcctcctaacggcgtcgtccgaacggacggcgaggaggagaacccttcgcctggcctggcctggcctgagtctcgcccggcctctctggcggttgatgatgtcatgtggcccctctgcttcatctcggacaggctgttcaaggtgccgggagacgacggcggcgagggcccgggcgcgccgctgccccccgacggccggattccgctagcgcgccgatcctacttcatcgatgtcccgcatgtgcagcaggccttcacctgggactgcggcctcgcttgcgtgctcatggtgctaaggaccctcggccttgattgctgccacggcattgccgaactcgagaagctctgccgcaccacaagcgtctggacagtcgacttagcatacctgttacacaagttttcagttaatttttcgttctttactgtgactatcggagcaaatccacaatattctggagaaaccttttatagggagcaattgcaagaagacattgatcgagtggacgagctgtttggcaaagcacttgatgctggaatcagtattcaatgcagatccatcagtgcgtatgatattgcttttctactcttatctgggcactgcatagcaattgcactagtggataaatcaaagttaaattcctcttggatgaatgatgtacatgatatgcaacagtttgatgaggattcagattacatggggcattatgttgtaatatgtggctacgatgctgatacttgcgagtttgagataagggatccagccagttctaggaagcgtgaaatggtgcccatgaaaagcttagatgaggcccgcaaatcctttggaactgatgaggatattctcttggtctccttaactggaaagaacgggacgaagctgtcgcgtaaactgccggccggctctccatagactgctcaccagcctccagcctcacacctgtgtatactctgtacatgtcccctgtagttatgattaccgcttgtcaagtccggtatgtagtttgagaacattcttacagccgataggaagatagaagaacccagcaaggcctaagcttctgcaaacggcgcagcagcgacaccgtggagcacgaactgcttcgagcacaagtttcgtgccatcatggccgggcagagatgtagcatatgtacagatacatccacgaataaaatggtggcctcgtggtgccatgtattcc

SEQ ID NO: 5364 - DNA, 1461 bp, Triticum aestivum
ccccaccgcaccgccacgcgccccgcgtgttctcttcgaggcttttcccctgctcttcctcctcctcctcctcggggcccgaacggccggcgagggcaagaattctctgccctgccctggtctgaacctggcacgattcttgcccggtccgggtgacggcctgctggccccgccggcggttgatgatgtcatgtggcccctctgcttcatctcggacaggctgttcaaggtgccgggagacgacggcggcgacggcgacggcccgggcgcgccgctgccccccgacggccgaatcccgctagcacgccgatcctacttcatcgatgtccctcacgtgcagcaggccttcacctgggactgcggcctcgcttgcgtgctcatggtgctgaggaccctggggcttgattgctgccacggcattgccgaactcgagaagctctgccgcaccacaagcgtctggacagtcgacttagcatatctgttacacaagttttcagttaatttttcgttctttactgtgactattggagcgaatccgcagtattctgcagaaaccttttatagggagcaattgcaagaagacattgatcgagtggatgagctgttcggcaaagcacttgatgctggaatcagtattcaatgcagatccatcagtgcgtatgatattgcttttctacttttatccgggcactgcattgcaattgcactagtggataaatcaaagttaaattcctcttggatgaatgatgtacatgatatgcaacagtttgatgaggattcagattacatggggcattatgttgtaatatgtggctatgatgctgatgcttgcgagtttgagataagggatccagccagttctagaaagcgtgaaatggtgcccatgaaaagcttagatgaggcccgcaaatcgttcggaactgatgaggacattcttttggtgtccttaactggaaaaaacgggacgaagctgtcgcgtaaactcccggtcggctctccatagactgctcaccagcctccagtctctccttgtgtatactctgtacatgcccctgtagttatgcttaccacctgtccaagttcggtatgtagtttgagaaggttcttacagccgataggaacagtgtctagtgaagatagaagaacatgcttatgagttcaggtatcacatcactgaagcttctgcaaccggcgcggcggcagcagcgttgctgctcggcatgaactgtaaacaggaaccgccgccgcctccgcttcgacctggagcacaagcttcgcaccatcatagccgggcagagatgtagcatatgtacaaatatatccacgaataaaatggtggcctcggtgtgccatatattcgtatcccatttcaatcatttctggtacctgaaccacgatctcattcttgtctgttgtaagcccaccttttctttcactgttcggcagctcgtcacatttggg

SEQ ID NO: 5365 - DNA, 1365 bp, Leymus cinereus x Leymus triticoides
cgtccagcccagcccagccaacccaatcattccgacatcgcgaacccgcgattcccatcccgccccaccgcacctccacgccacgcgctccgcgtgttcgcgcctttatccgagggggctctcttcctgctcttcgtcctcctcggggtccgaacggacggcgaggacaagaattctctgccctgccctggcctgacccttacctgattctcgtccggtccgggtgacccgctggcctttctggcggttgatgatgtcatgtggcccctctgcttcatctcggacaagctgttcaaggtgccgggagacgacggcggcgagggcccgggcgcgccactgccccccgacggccgaattccgctagcacgccgatcatacttcatcgatgtccctcatgtgcagcaggccttcacctgggactgcggcctcgcttgcgtgctcatggtgctaaggaccctcgggcttgattgctgccacggcattgccgaactcgagaagctctgccgcaccacaagcgtctggacagtcgacttagcatatctgttacacaagttttcagttaatttttcgttctttactgtgactattggagcaaatccgcagtattctgcagaaaccttttatagggagcaattgcaagaagacattgatcgagtggatgagctgtttggcaaagcacttgatgctggaatcagtattcaatgcagatccatcagtgcgtatgatattgcttttctactcttatccgggcaatgcattgcaattgcactggtggataaatcaaagttaaattcctcttggatgaatgatgtacatgatatgcaacagtttgatgagaattcagattacatggggcattatgttgtaatatgtggctatgatgctgatgcttgcgagtttgagataagggatccagccagttctagaaagcgtgaaatggtgcccatgaaaagcttagatgaggcccgcaaatccttcggaaccgatgaggatattcttttggtgtccttaactggaaaaaccgggacgaggctgtcgcgtaaactcccggtcggctctccataaactgctcacctgcctcatatgtatactctgtacatgaccctgtagttatgcttaccacctgtccaagttcggtatgtagtttgagaacgttcttacagccgataggaactttgtctagtgaagatagaagagccaagcaaggcttatgagctcaggtttcacctcactggagcttctgcaaccggcgcggtggcggcagcagcagcagcaacgtttcgtaccatcatagccgagcagagatgtagcatatgtacagatatatccacgaataaaatggtggcctcgttgtgccgtgtgtta

SEQ ID NO: 5366 - DNA, 1753 bp, Triticum aestivum
gcctcctcactccagcttggcctcgcgcggcacctaaaaaaggcggcagcttctggagaggagcgggccgttataaaggcgccgcgcccccgttcccatcccgccgattcttctggtgccagccgccgccgcccctccttccctccccgcttcttctttataatcaatcctccagcccagccaacccaatcattccgaacccgcgattcccatccccaccgcaccgccacgggccccgcgtgttctcttcgcggcttttcccctgctctgcctcctcctcctcctcctcggggtccgaacggccggcgagggcaagaattctctgccctgccctgccctggccctggccctggcacgatcctcgcccggtccgactgacggcctgctggcccctccggcggttgatgatgtcatgtggcccctctgcttcatctcggacaggctgttcaaggtgccggaagacggcggcggcgacggcccgggcgcgccgctgccccccgacggccgaatcccgctagcacgccgatcgtacttcatcgatgtccctcacgtgcagcaggccttcacctgggactgcggcctcgcttgcgtgctcatggtgctcaggaccctggggcttgattgctgccacggcattgccgaactcgagaagctctgccgcaccacaagcgtctggacagtcgacttagcatatctgttacacaagttttcagttaatttttcgttctttactgtgactattggagcaaatccgcagtattctgcagaaaccttttatagggagcaattgcaagaagacattgatcgagtagatgagctgtttggcaaagcacttgatgctggaatcagtattcaatgcagatccatcagtgcgtatgatattgcttttctacttttatccgggcactgcattgcaattgcactagtggataaatcaaagttaaattcctcttggatgaatgatgtacatgatatgcaacagtttgatgaggattcagattacatggggcattatgttgtaatatgtggctatgatgctgatgcttgcgagtttgagataagggatccagccagttctagaaagcgtgaaatggtgcccatgaaaagcttagatgaggcccgcaaatcgttcggaactgatgaggacattcttctggtgtccttaactggaaaaaatgggatgaagctgtcgcgtaaactcccggtcggctctccgtagactgctcaccagcctccagtctctccttgtgtatactctgtacatgcccctgtagttatgcttaccacctgtccaagttcggtatgtagtttgagaaggttcttacagccgataggaacagtgtctagtgaagatagaagaacatgcttatgagttcaggtatcacctcactgaagcttatgcaaccggcgcggcggcagcagcgttgctgctcggcatgaactgcttctgtaaacaggaaccgccgccgcctccgcttcgacctcgagcacaagattcgcaccatcatagccgggcagagatgtagcatatgtacagatatatccacgaataaaatggtggcctcggtgtgccatatattcgtatcccatttcaatcatttctggtacctgaaccacgatctcaatcttgcctgttgtaagcctaccttttctttcactgttccgcagctcgccacatttgggatgccaccgatctccacccatggctcaaaacgaaaaaagtaaaaccggaacctacgcgtggccgcgtccg

SEQ ID NO: 5367 - DNA, 2011 bp, Oryza sativa
ccaggtcctgacccccctgaccaatcccggcccctccgcgagcctctcgggttatactagatcgacatcaatccccaccccgcccggtggccgatggatagagcaaaaatcctctgccaatccctatcctctcttttccccgacgcaaacacacgctggctgcgctgctgctcctcctcccaccggcaaaggccatacagcccaacgacacctaaaaattacggcggcttctggaaggcgaggcgacgagggcccccgtttttttttttaaaggcgccgcgctccggcgctccacatccctccaccgattcttctggtgacgcggacccccgtttttttaataatcccaccacgcaccggagcgagaagaagaagaacccaatcatttccctccctccctcccaccgtcgtctcgtcgcgaacccgcgagaatcccaacctcctcctccgctttccctcctttctccttcccacccgcgctaccgagcagagcactgcttggctcggctggctcttgcggttcgaggtcagtcgcctggcgccgcgcgcggcgggcgagggggtcggttgatggtgccatgtggcccctggggttcttctccgagaggctgttcaaggtcgcgggggaaggggacggcggcgagggggcggacgactcgccgccggcccctgacggccgtgtccctctagcccgccgctcgtactacgtcgatgttccgcatgtccagcaggccttcacgtgggactgcggcctcgcttgcgtgctcatggtgctcaggacactcgggatggattgctgcgacggcattgccgatctcgagaagctctgccgcaccacgagcatatggacagttgacttggcatatctgttaaacaggttttcagtttgtttttccttcttcactgtgactctaggagcaaatccgcaatattctgctgaaaccttttatagggagcaattgcaagaagacattgatcgagtggatgagctctttggcagagcccttgaagctggaattagtattcaatgcagatccatcagtgcgtatgatatagcttttctactgttatctgggcactgcattgctatcgcactagtggacaaaacaaaattgaattcctcatggagcaatgatctacaagatatgcaacagttcagtgaggattcagattacatggggcattatgttgtaatatgtgggtatgatgctgatgcttgcgaatttgagataagggaccctgccagttcgagacagcgtgaaagggtgtcaatgaagagcttagatcaggcccgcaagtcctttggaactgatgaggatattattttggtttctttaactggaaaaattggaatgaagctctcacgtaaactcctggtgggctccttgtgaaaacctcaactccctggttccatgtgtatatacgttgtacatgccactgtagttatgattgtcatctgttaagtcatgtatgtagttcaagatcattcttacagctataggaactgtgagctagtgaagtacccagttaggtttgttagctcatggctcatcacactgaagctgcaaaggacgcagcaggcagcagcaacaatgctgcgcaggaactactcttgtaagcaagagcagcttctgtagcgagcaaaagtcataccgttatagccggacagagatgtatcatatgtacatatatccttgcatctgtggccatgtgtatcctactccctgaatcctcttctgtaaattccaaaccatctcgcgtgctcgcctgcctttctctgaatgattcttaatgcaatgtaagaagggatgttgcccgcgtatgggtgtgtttagttcacgctaaaattgaaagtttggttgaaattggaacgatgtaacggaaaagttaaaagtttatgtgtgtaggaaaattttgatgtgatagaaaagttggaagtttgaagaaaatttttggaactaaacttggcctatatctattgaacttgcattagagaaacatgcaccaaggc

SEQ ID NO: 5368 - DNA, 1622 bp, Triticum aestivum
gcctcctcactccagcttggcctcgcgcggcacctaaaaaaggcggcagcttctggagaggagcgggccgttataaaggcgccgcgcccccgttcccatcccgccgattcttctggtgccagccgccgccgcccctccttccctccccgcttcttctttataatcaatcctccagcccagccaacccaatcattccgaacccgcgattcccatccccaccgcaccgccacgggccccgcgtgttctcttcgcggcttttcccctgctctgcctcctcctcctcctcctcggggtccgaacggccggcgagggcaagaattctctgccctgccctgccctggccctggccctggcacgatcctcgcccggtccgactgacggcctgctggcccctccggcggttgatgatgtcatgtggcccctctgcttcatctcggacaggctgttcaaggtgccggaagacggcggcggcgacggcccgggcgcgccgctgccccccgacggccgaatcccgctagcacgccgatcgtacttcatcgatgtccctcacgtgcagcaggccttcacctgggactgcggccttgcttgcgtgctcatggtgctcaggaccctggggcttgattgctgccacggcattgccgaactcgagaagctctgccgcaccacaagcgtctggacagtcgacttagcatatctgttacacaagttttcagttaatttttcgttctttactgtgactattggagcaaatccgcagtattctgcagaaaccttttatagggagcaattgcaagaagacattgatcgagtggatgagctgttcggcaaagcacttgatgctggaatcagtattcaatgcagatccatcagtgcgtatgatattgcttttctacttttatccgggcactgcattgcaattgcactagtggataaatcaaagttaaattcctcttggatgaatgatgtacatgatatgcaacagtttgatgaggattcagattacatggggcattatgttgtaatatgtggctatgatgctgatgcttgcgagtttgagataagggatccagccagttctagaaagcgtgaaatggtgcccatgaaaagcttagatgaggcccgcaaatcgttcggaactgatgaggacattcttttggtgtccttaactggaaaaaacgggacgaagctgtcgcgtaaactcccggtcggctctccatagactgctcaccagcctccagtctctccttgtgtatactctgtacatgcccctgtagttatgcttaccacctgtccaagttcggtatgtagtttgagaaggttcttacagccgataggaacagtgtctagtgaagatagaagaacatgcttatgagttcaggtatcacctcactgaagcttctgcaaccggcgcggcggcagcagcgttgctgctcggcatgaactgcttctgtaaacaggaaccgccgccgcctccgcttcgacctcgagcacaagattcgcaccatcatagccgggcagagatgtagcatatgtacagatatatccacgaataaaatggtggcctcggtgtgccatatattcgtatcccatttcaatcatttctggtacctgaaccacgatct

SEQ ID NO: 5369 - DNA, 1036 bp, Pennisetum glaucum
gcgggcaggggctcgagtcgccgtccgccgacggactgattcctctggcacgccgatcgtactacgtcgacgttccacatgtgcaacaggccttcacctgggactgcggcctcgcttgcgtgctcatggtgctcaggacgctggggattgattgctgcgacggcattgccgatctcgagaggctctgccgcaccacaagcgtttggacagtcgacttggcgtatctgttgaacaagtttgcagttagcttttctttctttaccgtgactctcggagcgaacccgcaatactctgctgaaactttttacagggagcaattggaagaagacatcgaccgagttgatgatctgttcgtgaaggcacttgatgctggaattaatattcaacacagatccatcagcgcatatgaaattgcttttctactgttatcagggcactgcattgccattgcattagtggataagtcaaagctaaattcatcttggatgaatgatgtacatgatgtgcaacaggtcaatgaggattcagattatatggggcattatgtcataatatgtgggtatgatgccgatgattgtgaatttgagataagggatcctgccatttccaggaagcgcgaaagggtgacaatgaagagcttagacgaggcccgcaaatcctttggaaccgatgaggatattatcttggtctccctaaccggaaagagtgggatgaagctcacacgtaaattcctcgccggttccatgtaaatagcttcacggcgccagactccttgcgaccttgtgtatacgctgtacatttctccctgtagttatgattgtcgattgccagccttgtatgtaaccttactgccgataggaagagctagtcaccaagctgtagccacgacgaagggttcagctgcagcaaaaactgctgctcttgtgtagctgcaaatggtcaatgatgcagcagaagcaaacaggagctgctcctgtaacaaagaatagctatacgatcatagctgaacgtgtacagatcgagctgcttgaatgaa

SEQ ID NO: 5370 - DNA, 1964 bp, Triticum aestivum
aggcctcggcgcatccggcaaccaccgcatgattgccatcgcgtcccgtcccgtcgcggcaaacaacgtacgtactacgtactccgtccccaatacgcgcctcccacgacgccgttcgtcgtcctcctcctcccccctcccaatccccgccccctccgcctccgcctcctcactccagcttggcctcgcgcggcacctaaaaaaggcggcagcttccggagaggagcgggccgttataaaggcgccgctcccccgttcccaccccgccgattcttctggtgcccgtccgtgccagccgccgccgcccctccctccctccccgcttctcctttataatcgatcctccagcccagcctagcccagccaacccaatcattccgaccccgcgattcccaccccgccccaccgcaccgccacgcgccccgcgtcttctcttcgcggctttacccgagccgctcttcctcctcgtcggggtcccaacggccggcgaggccaagaattctctgccttaccgtgccctggcctgaacctggcacgattcttgcccggtccgggtgacggcctgctggcccctccggcggttgatgatgtcatgtggcccctctgcttcatctccgacaggctgttcagggtgccgggagacgacgccggcgacggcgacggcccgggcgcgccgccgccccccgacggccgaatcccgctagcacgccgatcctacttcatcgatgtccctcacgtgcagcaggccttcacctgggactgcggcctcgcttgcgtgctcatggtgctcaggaccctgggccttgattgctgccacggcattgccgaactcgagaagctctgccgcaccacaagcgtctggacagtcgacttagcatatctgttacacaagttttcagttaatttttcgttctttactgtgactattggagcaaatccgcagtattctgcagaaaccttttatagggagcaattgcaagaagacattgacagagttgatgagctgtttggcaaagcacttgatgctggaatcagtattcaacgcagatccatcagtgcgtatgatattgcttttctaatcttatctgggcactgcattgcaattgctctagtggataaatcaaagttaaattcctcttggatgaatgatgtgcatgatatgcaacagtttgacgaggattcagattacatggggcattatgttgtaatatgtggctatgatgccgatgcttgcgagtttgagataagggatccagccagttctagaaagcgtgaaatggtgcccatgaaaagtttagatgaggcccgcaaatcctttggaaccgatgaggacattcttttggtgtccttgactggaaaaaacgggacgaagttgtcgcataaactcccggtcggctctccatagactgctcaccaccctccagtctctccttgtgtatactctgtacatgcccctctagttatgcttaccacttgtcgagtccggtatgtagttggggaacattcttacagctgatagaaacagtgtctagtgaagatagaggaacccagtaaggtttacgggctcaggtctcgccccactggagcttgtgcaaccggcgcggcggcagcagcaacgctgctcggcatgaactgcttctgtaaacaggaactgccgccgccgcctccgcttcgacctcgagcacaggttccttaccatcttggccatcttggccgggcagagatgtacagtagcatatgtacagatatatatattcccgaataaaatggtggcctcgttgtgccatgtattggtatcacattcgaatcctttgtggcacctgaaccgccatctcattcttgtctgttagaagttgcaaccggccgagcacaagcaggcgacctgtaaattgatgtttggtactgtactgactactacagtactagtattttgcagtatatggactgcaatgccggccgccggc

SEQ ID NO: 5371 - DNA, 1394 bp, Secale cereale
ccgcaccgccacgcgccccgcgtgttctgctcgcggctttacccgaggctcctcctccccggggcccgaacggccggcgaggccaagaattctctgccctgccctggcacgacgattctcggccggtccgagtgacggcccgctggcccctctggcggttgatgatgtcatgtggcccctctgcttcatctcggacaggctgttcaaggtgccgggagacggcggcgacgacgacggcccgggcgcgccgctgccccccgacggccgaatcccgctagcgcgccgatcctacttcatcgatgtccctcacgtgcagcaggccttcacctgggactgcggcctcgcttgcgtgctcatggtgctcaggaccctgggccttgattgctgccacggcattgctgagctcgagaagctctgccgcaccacaagcgtctggacagtcgacttagcatatctgttacacaaattttcagttaatttttcgttctttactgtgactattggagcaaatccgcagtattctgcagaaaccttttatagggagcaattgcaagaagacattgatcgagtggatgagctgtttggcaaagcacttgattctggaatcagtattcaacgcagatccatcagtgcgtatgatattgcttttctaatcttatctgggcactgcattgcaattgctctagtggataaatcaaagttaaattcctcttggatgaatgatgtgcatgatatgcaacagtttgatgaggattcagattacatggggcattatgttgtaatatgtggctatgatgctgatgcttgcgagtttgagataagggatccagccagttctagaaagcgtgaaatggtgcccatgaaaaatttagatgaggcccgcaaatcctttggaactgatgaggacattcttttggtgtccttaactggaaaaaacgggacgaagctgtcgcgtaaactcccggtcggctctccatagactgctcacaagcctccagtccctgtgtataccctgtacatgcccctgtagttatgcttaccacctgtccaagttcggtatgtagtttgagaaccttcttacagccgataggaacagtgtctagccaagatagaagaacatgcttatgagttgaggtatcaactcactggagcttctgcaacctgcgcgacaacggcggcggcagcagcagcagcaaggctgctcggcacgaactgcttctgtaaagaggaaccgccgcctcctcttcgagctcgagcacaagtttcgcaccatcatagccgggcagagatgtagcatatgtacagatatatcaacgaataaaatggtggcctcattgtgccatatgttaggtaataaccaaaaaaaaaaaaaaactaagaagactagacgacga

SEQ ID NO: 5372 - DNA, 1412 bp, Triticum aestivum
ccccaccgcaccgccacgcgccccgcgtgttctcttcgcggcttttcccctgctcttcctcctcctcctcggggtcccaacggccggcgaggccaagaattctctgccttaccgtgccctggcctgaacctggcacgattcttgcccggtccgggtgacggcctgctggcccctccggcggttgatgatgtcatgtggcccctctgcttcatctccgacaggctgttcagggtgccgggagacgacgccggcgacggcgacggcccgggcgcgccgccgccccccgacggccgaatcccgctagcacgccgatcctacttcatcgatgtccctcacgtgcagcaggccttcacctgggactgcggcctcgcttgcgtgctcatggtgctcaggaccctgggacttgattgctgccacggcattgccgaactcgagaagctctgccgcaccacaagcgtctggacagtcgacttagcatatctgttacacaagttttcagttaatttttcgttctttactgtgactattggagcaaatccgcagtattctgcagaaaccttttatagggagcaattgcaagaagacattgacagagttgatgagctgtttggcaaagcacttgatgctggaatcagtattcaaatccatcagtgcgtatgatattgcttttctaatcttatctgggcactgcattgcaattgctctagtggataaatcaaagttaaattcctcttggatgaatgatgtgcatgatatgcaacagtttgacgaggattcagattacatggggcattatgttgtaatatgtggctatgatgccgatgcttgcgagtttgagataagggatccagccagttctagaaagcgtgaaatggtgcccatgaaaagtttagatgaggcccgcaaatcctttggaaccgatgaggacattcttttggtgtccttgactggaaaaaacgggacgaagttgtcgcataaactcccggtcggctctccatagactgctcaccaccctccagtctctccttgtgtatactctgtacatgcccctctagttatgcttaccacttgtcgagtccggtatgtagttggggaacattcttacagctgatagaaacagtgtctagtgaagatagaggaacccagtaaggtttacgggctcaggtctcgccccactggagcttgtgcaaccggcgcggcggcagcagcaacgctgctcggcatgaactgcttctgtaaacaggaactgccgccgccgcctccgcttcgacctcgagcacaggttccttaccatcttggccatcttggccgggcagagatgtacagtagcatatgtacagatatatatattcccgaataaaatggtggcctcgttgtgccatgtattggtatcaaaaaaaaaaaaaaaacga

SEQ ID NO: 5373 - DNA, 3581 bp, Zea mays
tcccggcccttcctttccttctcgcgcgcgaccaaataactcctcactaaaaccctagggctcccggccgccactgcctacgccgtcgccatggagaccctcaagcgcaaggccgtggacagccccggagacgcctaccaggcctcttctctcaagccgccgctcgccgccgccgccgtggagcctcgcgctccgaccaccctcgcggccgccgaaccagtcgcttgcgtgcacgacgtctcctaccccgagggctacgacccatccgcctctacgtcccgcgccattgccggcggagctgatgcctctgagccagcaaagaagtttcctttccagctcgaccccttccaggccgaggccatacgctgcctcgacaatggtgaatccgtcatggtttcagctcatacgtcagcgggaaagacagtagtcgcgttgtatgcaatagcgatgtctttgcgcaaccaacagcgggtcatttatacatctccaatcaaggcactgagcaaccaaaagtacagggagttcaaagaagagttctctgatgttggtctcatgactggggatgtcacaattgagccgaatgcctcctgtctggtcatgaccacagaaatttggcggagcatgcaatacaagggatctgaggtcatgagggaagttgcctgggttatatttgatgaggtgcattacatgcgggatagagagagaggagtggtttgggaggagagtatagtgatggctcccaagaattcacgctttgtcttcctctcggcaactgtacctaatgccaaggagttcgctgattgggtagctaaggtacataagcaaccctgtcatatagtatacaccgactatagacctacacctcttcagcactatgtatttccttctggaggggacggattataccttgtagtggatgagaagggcaagttcagagaggacagttttcagaaagcattgaacgcccttgtccctgctagcgacagtgccaagaagaaggaaaatgggaagcggcagaaatttaccatggcaggtacatctagtgaggaaagtgacatattcaagatggtgaagatgataattcagcgccaatatgatcctgtaatactttttagctttagcaaaagggaatgcgaatttcttgctatgcagatggctaagatggacttgaatgaggatgatgagaaggcaaacatcgaaacaattttttggagtgctatggatatgctttctgatgatgacaaaaagcttcctcaggtttcaaacatgctccccttactgaaacgcggcattggcgtgcatcattctggtctgttgcctattttaaaggaagtcattgagatactctttcaggagggcctcatcaagtgtttgtttgccacagaaacattcagtattggtttgaacatgcctgcaaagactgttgtgtttaccaatgtgcgaaaatttgacggagaccgattcagatggttgtcgagtggagagtacatccaaatgagtggccgtgctggtcgtcgaggtattgatctgcgtggtatctgtatactgatggtagacgagaaaatggaaccttcaactgccaaaatgatgctgaaaggaagtgcagatagtttgaacagtgcctttcatctgagctacaatatgctgttaaatcaaatgcgatctgaggatggggatccagaaaagctcctccggcattcattttatcaatttcaggctgaccgttctcttcctgatcttgagaagcaaatcaaggaactggaatcagagagaaattccatggtaattgaggaagcggagagcttgaaggattattacgatctcttacagcagcacaggagtttaaagaaggatgtccatgatattgttctctctcccaaacatgtgctgcctttcttgcaacctggaaggcttgtccgcattgaatatagtacagatgagccagctaacttttccattgatgaaaatgtcacatggggaattataattaacttcgaaaaagtgaagtcacatggtgaagataagaggcctgaggattctgattacacggttgatgtccttaccagatgttctgtaactaaggacaacagtggtaagaaaacaatgaaggttgttcctctgaaagcgcgtggagaaccagttgtagtttcattgtcactttcacagattgatggactaagcagcatacggatgtacatacctaaggatcttatacctgtagaagttcgagaaaacaccttgaggaaagttgaagaagtccttttaaggtttgctaaagatggtgtgcctctattggatccagaagaagatatgaaagtacaatcgaaatcatttcggaaagctaccagacgaatagaagctcttgagagcttgtttgagaagcacgatatccgtaactctccacatatccagcaaaagctgaaagtctttcatgctaagcaagaactatcagccaaaataaagtccataaagaaaacaatgcggtcttccaccgctttagctttcaaggatgaactcaaggcccggaaacgtgttcttcgcaggctggggtatgttacgagtgatgatgttgtggaagttaagggcaaagtggcgtgtgagataagttcagctgatgagcttacattgacagagcttatgtttagtggtgctctgaaggatgctacagtagagcaggtggtggcactgctctcttgctttgtttggcaggagaagctccaggatgctccgaagccaagagaggagctcgatttgctcttctaccagctgcaggagacagcaagaagggttgctaaccttcagcttgaatgcaagatccagatcgatgtggaaagttttgtgaattctttccgacccgacataatggaagcggtgtattcatgggccagagggtcgaagttctaccaaatcatggagatgacccaagtgttcgaaggaagcctgatcagggccatcaggaggctggaggaggttctgcagcagctgattctggcatccaagtccattggggaaacggagttagaagcaaaactcgaggaggcggtcaacaagatcaagagggacatagtgtttgcagcatctttatacttgtagtgtcttggatgtctggttttatgtcaggggctaggtcaaaagctcatagggatttaaattaatcttaaattgctgttcatgttgagtgttgttggcatgatgaagctgtctgatttgctgttagcggtgacatggcagtgaaagttttgttaggtttcttcaccgtgtagggtctatttgacattcaagaattttgtaggaagcaatacaattctggcagacctcacattaacagccttagcatgtacgatagatagctatttatctcatctgtcaggaatagcccagagatactgcgtgtttgtggagtataagcagtgtaagttaagtgatcgtgcttgtgtttgtaagtgcagttcaaagcaagtcggccgatggagatgtccctggatgaaaacttgtagtatttgtcttgcactcttgcttgtttgaatgttattggccggctgatggtcacgtgcatgcatgcgtgaataattcatctctgt

SEQ ID NO: 5374 - DNA, 3513 bp, Setaria italica
ggccccaaacttccacttcctcgcgcgcgcgaccaactcctcctccttaaaccctagcagccgccgccgccggcccgccgcccacgccgtcgccatggagaccctcaagcgcaaggcccaggacggccctgcggctgccgacaacgcctccccgctcaaggctgcgcgctccgacgccacggagcctcccgcccgcaccaccctcgccgccgcggagcccgtcgcctgcgtgcacgacgtctcctacccggaaggttacgacgcgtccgcctctgcctcacgcttgctcgccggcggcgctgagggctctgagcccgccaagaagttccccttccagcttgatccgttccaggccgaggccatacgatgcctcgacaacggcgaatccgtcatggtttcagctcatacatcagccggaaagacagttgttgccttgtatgcaatagcaatgtctctgcgcaaccaacagcgtgtcatctatacatctccaatcaaggcattgagcaaccaaaaatacagagagttcaaagaagagttctcagatgttggtctcatgactggggatgtcacaatagagcctaatgcctcctgcctggtcatgaccacggaaatttggcggagcatgcagtacaaagggtccgaggtcatgagggaagttgcttgggttatatttgatgaggtgcattacatgcgggatagagagagaggagtggtgtgggaggagagtatagtgatggctcccaagaactcacgcttcgtgttcctctcagctaccgtacctaatgcgaaggagtttgctgattgggtagctaaggtacataagcaaccttgtcatatagtatacaccgactaccgacccacacctctccagcactatgtatttccttccggaggggatggattatatctggtagtggatgagaaggggaagttcagagaggacagttttcagaaagcattgaatgcccttgtccctgctagtgacagtgacaagaagaaggagaatgggaagtggcaaaaagctattatagcaggcaaatctagcgaggaaagtgacatattcaagatggttaaaatgataattcagcgtcaatatgatcctgtgatacttttcagctttagcaaaagggaatgtgaatttcttgctatgcagatggctaagatggacttgaacgaggatgatgagaaggcaaacatcgaaacaattttttggagtgctatggatttgctttctgatgatgacaaaaagcttccgcaggtttcaaacatgctccccttgctgaaacgtggcattggcgtgcatcattctggtctgttgcccatcttgaaggaagtgatcgagattctcttccaggagggcctcattaagtgtttgtttgctacagaaacattcagtattggtttgaacatgcctgcaaagactgttgtgtttaccaatgtgcggaaattcgatggagatcgattcagatggttgtcgagtggtgagtacatccagatgagtggccgtgctggtcgtcgaggtattgatcagcgtggtatctgtatcctgatggtagacgagaaaatggagccttcaactgccaaaatgatgctgaaaggaagtgctgatagtttgaatagtgcctttcatctgagctacaatatgctgttaaatcaaatgcgatctgaggatggagatccagaaaagcttcttcggtattcattttaccaattccaggctgatcgagctctccctgatcttgagaagcaaatcaaggaactggaattggaaagaaattccatggttattgaggaagaggagagcttgaaggattactatgaactcttacagcagtacaaaagtttaaagaaggatgtccgtgatattgtcctctctccaaaacatgttctgcctttcttgcaacctggaaggcttgtccgtcttgaatatagtacagatgagccagctaccttctccattgatgaaaatatcacatggggaattattataaactttgaaaaagtgaaatcccatggtgaagataggaggcctgaagattctgactatacagttgatgtccttaccaggtgttctgtaagtaaggacagcagcggaaagaaagcaatgaagattgttcctctgaaagagcgtggagaaccagttgtaatttcattgccactttcacaggttgatggactaagcagcattcggatgtatatacctaaggatcttttgcctgtagaagctcgagaaaacaccttgaggaaagttgaagaagtgctttcaaggtttgctaaagatggggtacctctgttggatccggaagaggatatgaaagtacaatccaaatctttccggaaagctaccagaagaatagaagctctcgagagcttatttgagaagcatgacatacgcagttctccacatatccagcaaaaactgaaagtcttgcatgctaagcaagaattatcagctaaaataaagtccatcaagaaaacaatgcggtcctccactgctttagctttcaaggatgagctcaaggcccggaagcgggttcttcgcaggctgggatatgttacaagcgacgatgttgtggaagtgaagggcaaggtggcttgcgagataagctcggctgatgagctaacattgacagagcttatgtttagtggcactttgaaggatgctactgtggaacagatggtggcgctgctttcttgctttgtttggcaggagaagctccaggatgccccaaagccaagggaggagcttgatttgctcttctaccagttgcaggagacggcaagaagggtcgctaaccttcagcttgagtgcaagatccaaattgacgtggaaagttttgtaaattctttccgacctgacataatggaagcggtgtattcatgggccaaagggtcaaaattctaccaaatcatggagatgacccaagtgttcgaaggcagcttgatcagggccatcaggaggctggaggaggttctgcagcagctaattctggcatccaagtcgattggggaaaccgaattggaagcgaaacttgaggaagcagtcagcaagatcaagagggatatagtgttcgctgcatctttgtacttgtaacatgtcttgacggcgtcatggtttaggaagagctccaaagcaaatagagaattaaatcacttttagctcttgttcaagtgctgttggcctgatgaagcttcctggtggtaacatggagcagtgatgcggcaggcaaagttttgttagtgttgttgagcttgtagagggcctatttaatttggaatggaagacgcaagagttttgcaggaactgatactattctgccagaaattctggagaatcacaggaatcgttgtagcttgtacaagtaaattagataggaatggtccatggacagaaatctgtactgatttttgcactgtacacaatcacagatgcactgaaatccattatctgccagaaatgagtgtaagagggccggtcaatttcagatgatgatattttttttgtgtgtgctt

SEQ ID NO: 5375 - DNA, 3596 bp, Panicum virgatum
ggcccaacttcctcctcgcgcgcgcgaccaactccccctttaaaccctagtagcgccgccgccgccgcccacgccgccgccatggagaccctcaagcgcaaggccccggacggacctgcgcctgccgacaacgcctcccctctcaaggcgccgcgcgcagacgccgcggagcctcccgcccgcagcaccctcgccgccgcggagcccatcgcctgcgtgcacgacgtctcctacccggaaggctacgacgcggccgcctctgcctcccgcgtgctcgccggcggtgctgagcgctctgagcccgccaagaagttccccttccagctcgacccgttccaggccgaggccatacgctgcctcgacaacggcgaatccgtcatggtttcagctcatacatcagctggaaagacagtggtcgccttgtatgcgatagcaatgtctctgcgcaaccaacagcgtgtcatctatacgtctccaatcaaggcattgagcaaccaaaaatacagagagttcaaagaagagttctctgatgttggtctcatgactggggatgtcacaattgagccgaatgcctcctgcctggtcatgaccacggaaatttggcggagcatgcagtacaaaggatctgagatcatgagggaagttgcttgggttatatttgatgaggtgcattacatgcgggatagagagagaggagtggtgtgggaggagagtatagtgatggctcccaagaactcacgtttcgtgttcctctcagctactgtaccaaatgcaaaggagtttgctgattgggtagctaaggtacataaacaaccttgccatatagtatacaccgactaccgacccacacctctccagcactatgtatttccttcaggaggggatggattatatctggtagtggatgagaagggcaagttcagagaggacagtttccagaaagcattgaatgcgcttgtccctgcaagtggcggtgacaagaagaaggaaaatgggaagtggcagaaaggtatcgtggcaggcaaatctagtgaggaaagtgacatattcaagatggttaaaatgataattcagcgtcaatatgatcctgtgatacttttcagctttagcaaaagggaatgcgaatttcttgctatgcagatggctaagatggacttgaacgaggatgatgagaaggcaaacattgaaactattttttggagtgctatggatttgctatctgatgatgacaaaaagcttcctcaggtttcaaacatgctgcccttactgaaacgcggtattggcgtgcatcattctggtctgttgcccatcttgaaggaagtgattgagattctcttccaggagggcctcatcaagtgtttgtttgccacagaaacattcagtattgggctgaacatgcctgcaaagactgttgtgtttaccaatgtgcgaaaatttgatggagaccgattcagatggttgtcgagtggtgagtacatccagatgagtggccgtgctggtcgtcgaggtattgatcagcgtggtatatgtatcctgatggtagacgagaaaatggagccttcaactgccaaaatgatgctgaaaggaagtgctgatagtttgaacagtgcctttcatctgagctacaatatgctgttaaatcaaatgagatctgaggatggagatccagaaaagcttcttcggttttcattttaccaattccaggctgatcgagctctccctgatcttgagaagcaaatcaaggaactggagtcggataggaattccatggttattgaggaagaggagagcttgaaggattactatgatctcttacaacagtacagaagtttgaagaaggatgtccgtgatattgtcctatctccaaaacatgttctgcctttcttgcaacctggaaggcttgtccgtattctatatagtacagatgggtcgtccaccttctccattgatgaaaatgtcacatggggaattattataaactttgaaaaagtgaaatccagtggtgaagataggaggcctgaagattctgattatacagttgatgtccttaccagatgttctgtaatgaaggatagcagcggaaagaaaacaatgaagattattcctctgaaagaacgtggagaaccagttgttatttcacttccactttcacagattgatggactaagtagcatccggatgtacatacctaaggatcttctgcctgtagaagctcgagaaaacactttgaggaaagttgaagaagtgctttcaaggtttgctaaagatggggtacctctattggatccagaagaggatatgaaggtacaatcaaaatcttttcggaaagccaccagaagaatcgaagctctggagggcttattcgagaagcatgatatccgtagttctccacatatccagcaaaaacttaaagtcttgcatgctaagcaagaattatcagctaaaataaagtccatcaagaaaacaatgcggtcttccactgctttagctttcaaggatgagctcaaggcccggaaacgggttcttcgcaggctgggatatgttacaagcgatgatgttgtggaagtgaagggcaaggtggcctgtgagataagctcagctgatgagctgacattgacagagcttatgtttagtggcactttgaaggatgctactgtagaacagatggtagccctgctttcttgctttgtttggcaggagaagctccaggatgccccgaagccaagggaggagcttgatttgctcttctaccaattgcaggagacagcaagaagggttgctaaccttcagctagagtgcaagatccaaattgatgtggaaagctttgtgaattctttccgacctgacataatggaagcggtgtattcttgggccaaagggtcgaaattctaccaaatcatggagatgactcaagtgtttgaaggcagcttgatcagggccatcaggaggctggaggaggttctgcagcagctaattctggcatccaagtcgattggggaaaccgaattggaagcaaaacttgaggaggcagtcagcaagatcaagagggatatagtattcgctgcatctttgtacttgtaacatgtcttgatggcgtcatgatttcgtaagagctccaaagcatagagaaattaaatcacactttgctcaagtgctgttggcctgatggagctgtctggtcgaaacatggagcagtgatatggcaggcaaagttttgttagtgttgttaaccttgtagggcatgtttggattgcaagatgtaagaattttgcaggaacctttacaattctaccagaaattctggagaaccacaggaatcgatgtagcttgtacaagtaaattagttaggaatagtccatggacggaaatctgtactgattttttgccctgtacacaatcagagacgcactgaaatccattgtttttattttgtcagaaacgagtgtaagagagcaggtcaatttcagattattttgggtgtgtatattattgcaaagctcaatgtcacttgctatgtgttggtttggatgttattggccggctgaaggtcacgggctactatatcgctgcttttggacaattatcatcatttgaaa

SEQ ID NO: 5376 - DNA, 3343 bp, Brachypodium distachyon
tctctcgcgcgcggctcctctactctagtcccctccttaaaccctagccctccgccgccgccgccgccatggagaccctcaagcgcaaggctccggaagtacccgccgcccgggccaactcacctaccaaggcgccgcgggacgacgacgcccccgccgcaccggccgcctccgagcccgtcgcctgcgtgcacgatgtctcctacccggaaggctacgacgcctccacctcctcgcggatcgtcgccggcggcggcgagggcgtagcgccagcaaagacgttccctttcaagctcgaccctttccagtccgaggccatccggtgcctcgacaacggcgagtccgtcatggtttcggctcacacgtcagcagggaagacggtggttgcgctgtacgtgatagcaatgtctctacgcaaccagcagcgggtcatctacacgtccccgatcaaggccctcagcaaccaaaagtacagggaattcaaggaggagttctccgatgtcggtctcatgaccggagatgtcacgattgagcccaatgcctcttgtttggtcatgaccacggagatctggcgcagcatgcagtacaaagggtccgaggtcatgagggaagtcgcttgggttatatttgacgaggtccattacatgcgcgatagggagagaggagttgtgtgggaggagagtatagtaatggctcccaagaactcgcgctttgtgttcctctcagcaactgtaccaaacgccaaggaatttgctgattgggttgccaaggtacataagcaaccgtgtcatatagtatacaccgactatcgacctacacctctccagcactatgtatttccttctggaggtgatggcttatacctggtagttgatgaaaatggcaagttcagagaggacagtttccagaaatctttgaatgtccttgcccctgctagtggcggtgacaagaagagggaaaatgggaagcggcaaaaagggatatcggcaggcaaacctggtgaggagagcgacatattcaagatggtgaaaatgataattcagcgtcaatatgaccctgtgatacttttcagctttagtaaaagagagtgtgaatttcttgctatgcagatggccaagatggacttgaatgaggatgatgagaaagtaaacattgaaacaattttttggagtgccatggatttgctgtcagatgatgacaaaaagcttcctcaggtttcaaatatgcttccgttattgaaacgcggcattggtgtgcatcattctggcctattgcccattttgaaggaggtgatcgagatacttttccaggagggcctcatcaagtgtctgtttgccacagaaacattcagtattggattgaacatgcctgcaaagactgttgtgtttaccaatgtacggaaatttgatggggatcgattcagatggttgtcaagtggagagtacatccagatgagcggccgtgctggtcgtcgaggtattgatgaccgtggtatctgcatattgatggtagatgacaaaatggaaccgtcaactgccaaaatgatgctaaaaggaggtgctgatagtttgaacagtgcctttcatctgagctacaacatgttattaaatcaaatgcgctgtgaggatggtgatccagaaaagcttcttcgacattcattctaccaattccaagcagatcgagctctcccggaccttgagaagcgagtcagggaactggaaatagagagaaattccatggttattgatgaagaggagagcttgaaggactactatgatctcctagaacagtacaaaactttaaagaaggatgtacgtgatattgtactttccccaaaatatgttttgcctttcttgcaatctggaaggcttgttcgtgttcagttcagtacagatgagcaacccaccttctccattgatgaaaatgtcacatggggaattataataaactttgaaaaggtgaagacccaagctgaagacagaaaacctgaggattgtgattacgctgttgatatcctcaccagatgttctgtaaacaaggacataagtggaaagaagaccatgaagattattcctctcaaagaccgtggagagcctgttgttatttcgttgccactttcccagatcgatggactgagcagtgttcggatgtacatacctaaggatcttttgcctgtagaagctcgagaaaataccttgaggaaagtcgaagaagtgatttccaggtttgctaaagatgggattcccctattggatccagaagaagatatggaagtaaaatcaagctcctaccggaaagccaccagaagaatagaagctctggagagcttatttgagaagcatgacgtccgtaattctccccatatccaacaaaggcttaagatctttcatgctaagaaagaaatatctgccaaaataaagtccatcaagaaaaccatgcgggcttcaactgctctagccttcaaggatgagcttaaggcccggaaacgagttcttcgtaggctgggatacatcacaagtgaggatgttgttgaagtgaagggcaaagtggcatgtgagatcagctcagctgacgaactaacattgacagagcttatgttcagcggtgctttgaaggatgctaccgtagagcagatggtggctctgctctcttgctttgtttggcaggaaaagctccaggatgcaccaaagcctagggatgagctcgacttgctcttttaccagctgcaggagacggcacgtagggttgctaaccttcagctcgaatgcaagatccagatcgatgtggagactttcgtgaattcgttccgaccagatgtaatggaagccgtgtattcatgggccagagggtccaagttccaccagatcatggagatgacccaggtgtttgaaggcagcttgatcagggccatcaggaggctggaggaggtcctgcagcagctgatcctggcatccaagtcgatcggcgagaccgagctagaagcgaagctagaggaagctgttagcaagattaagagggacatcgtgtttgcggcatctctgtacttgtaacacgaacatttttgctggcgccacaaagaactctcatttgtctgaatggcagatactctacaattttgtcactgtagtagtcactttgtagctttgtacaatcaagtgctaattgaattaattggatgaaaaattcgaaggatgcaaaattgtattcgtttccttatgtatacagaaactatgtcaagaatggctgtaaacaggccagtgaagtctcagataaatcttgtaatgttttgatttcacctgaaggggtgtcagtgagtgtctgatgcaagttgggtccatgacca

SEQ ID NO: 5377 - DNA, 3464 bp, Oryza sativa
agaaaaaaagggagaaaaatggcatcgtcgcgtggtctcgctaacctctcccttcgcgcgcaactccttaaaccctagccgccgccgccgccgccgtcgtcgccgtcgccgtcgccgccgccgcgcgccatggcgaccctcaagcgtaaggccgattccgcggccgccgagctcgcgtcccctcctcccaaggccccgcggggctcggaagcactcgctgaatcgccttccctcgccggcgggggcagcgagcccgtcgcctgcgtgcacgacgtctcctacccggaaggctatgacccgtccgcccccgccacccacctgctcaacggcgtcggcggcgccgagggtgctgggcctgccaagaccttcccgttccagctcgaccccttccaggccgaggccatccgatgcctcgacaacggagaatccgtcatggtctcagctcacacatcagctggaaagacagtggttgcattgtatgcaatagcaatgtctttgcgtaatcagcaacgtgtcatctatacatctccaatcaaggctttgagtaaccaaaagtacagggaattcaaagaagagttctctgatgtcggcctcatgactggggatgttactattgagccaaatgcatcttgtttggtcatgaccacggaaatttggcgtagcatgcagtataaaggatcagaagtcatgagggaagtcgcttggattatatttgatgaagtacactacatgcgtgatagagagagaggagtggtgtgggaggaaagtatagtgatggctcctaagaactcacgttttgtgttcctctcagctaccgtgcctaatgccaaggagtttgctgactgggtggctaagagagtgctttatttctcaggtacataagcaaccttgtcatatagtatacactgactaccggcctacacctctccaacactatgtatttccttctggaggtgatggtttatatctggtagttgatgagaagagcaagttcagagaggatagttttcagaaaggtttgaatgcgcttgtccctgctagtgagaatgacaaaaagagggaaaatgggaagtggcagaaaggtctcttgacaggaaaacctagtgaggacagcgacatattcaagatggtgaagatgataattcagcgtcaatatgacccagtgatacttttcagctttagcaaaagggagtgtgaatttcttgctatgcagatggctaagatggacttgaatgatgatgatgagaaggcaaacattgaaacaattttttggagtgctatggatttgctttcagatgatgataagaagcttccccaggtttcaaacatgcttcccttgttgaaacgtggcattggtgtacatcattctggtcttttgcccattttgaaggaagtgattgagatactcttccaagagggccttatcaagtgcttgtttgccacagaaacattcagtattggtttgaacatgcctgcaaagactgttgtgtttaccaatgtgcgaaaatttgacggtgatcgattcagatggttgtcaagtggagaatacatccagatgagtggccgtgctggtcgccgaggtattgatcagcgtggtatctgtatattgatggtagatgagaaaatggaaccttcaactgccaaaatgattctgaaaggaagtgctgatagtttgaacagtgcctttcatttgagctacaatatgttgttaaatcaaatacgctgtgaagatggtgatcctgaaaagcttcttcggcactcattttaccaatttcaagctgatcgagttctccctgatcttgagaagcaagtcaaggagctggaactagagagaaattccatgattattgaggaggaggagaacctaaagagttattatgatctcttgcagcagtacaaaaatctaaagaaggatgtccgcgatattgttcattctcctaaatatgttctacctttcttgcaaccaggaaggcttgctcgcgttcagtacagtactgatgagcaatccaccttctctattgatgaaaacatcacttggggagttacaataaactttgaaaaggtgaaaacccatagtgaagataggaggcctgaggattccgattacacagttgatgttctcacaagatgttctgtaagcaaggacaaaagtggaaagaagacaatgaagattattcctctgaaagaccgtggagaaccagttgtgatttccttgccactttctcagattgatggactaagcagcattcggatgcacataccaaaggatcttttgcctgtagaagctcgagaaaacacattgaggaaagttgatgaagttatttccaggtttgctaaagatgggatccctttattggatccagaagaggatatgaaagtacaatcaagctctttccggaaagcttccagaagaatagaagctcttgaaagtttatttgagaagcacgatgtccacaattctccacatattaaacaaaagctaaaagtgttgcatgctaagcaagaattatcaaccaaaataaaggccattaaaagaacaatgcggtcttccactgctttagccttcaaggatgagctcaaggcccgaaaacgggttcttcgtagactgggatatattacaagtgaggatgttgtggaagtgaagggcaaagtagcatgcgagataagttctgctgatgagctaacattgacagagcttatgtttagcggcactctgaaggatgctacagtagaacagatggtagcgctgctttcttgctttgtttggcaggaaaagcttcaggatgccccaaagccaagggaggagctcgacttgctgttcttccagttgcaggagacagctagaagggttgctaaccttcagcttgactgcaagatccaaattgacgtggagagttttgtgaactctttccggcctgatataatggaagcggtgtattcatgggccaaaggatccaaattctatcaaatcatggagatgacccaagtatttgagggcagcttgatcagggccatcagaaggcttgaggaggtcctgcaacagctaattctggcatcgaaatccatcggtgaaacccaattggaagcaaaacttgaggaggctgtcagtaagatcaagagggatatagtgtttgcagcatctttatacctgtaaaatagcttgatggtctcctgagcatgtgaaggctatcaaagtcactctttctgttgagctgcctgattactgttgaaggggagcaggtccttggcagagaaattttgttgttactaccccagtaggcgctaactaaattaattggaattttctaaaggaatccagatatgtacccattttttcatgtgtacaaattacagatgtattggaaccttgtttatcatttgaaaatctaggtttgaggtaaacggtgtaatttgacgctatgtttctccttcaatctatcatgggttggtatgatgtggctggc

SEQ ID NO: 5378 - DNA, 3058 bp, Secale cereale
gactgccatccgctgcctcgacaacggcgagtccgtcatggtctcggcgcacacgtcggcggggaagacggtggtggcctgtacgcgatagcaatgtccctgcgcaaccagcagcgggtcatctacacgtcgcccatcaaggccctcagcaaccagaagtacagggagttcaaggaggagttctccgacgtcggcctcatgaccggggacgtcaccatcgagccaaacgcctcttgcttggtcatgaccacggagatttggcgcagcatgcagtacaaagggtccgaggtgatgagggaagttgcctgggttatcttcgatgaggtgcattacatgcgtgacagggagagaggagtggtgtgggaggagagtatagtgatggctcccaaaaactcgcggttcgtgttcctctcggccactgtacccaatgccaaggagtttgctgattgggttgccaaggtacataagcaaccttgtcatattgtatacaccgactaccgacctacacccctccagcactatgtatttcctgctggaggtgatggcctatacctggtcgttgatgaaaatggcaaattcagagaggacagctttcagaaatccctgaatgtccttgcccctgctagtggcagtgacaagaagagggaaaacgggaagcggcaaaagggcctcgtctcggcaggcaaaactaacgaagaaagcgacatattcaagatggtgaaaatgataattcagcgtcaatatgaccctgtgatacttttcagctttagcaaaagagagtgtgaatttcttgctatgcagatggccaagatggacttgaatggggatgatgagaaagtgaacattgaaacaattttttggagtgccatggatttgctttcagatgatgacaaaaagcttccccaggtttcgaatatgcttccgttattgaaacgaggcattggagtacatcattctggtctgttgcccattttgaaggaagtgattgagatacttttccaagagggcctcatcaagtgtctgtttgccacagaaacattcagtattggattgaacatgcctgcaaagactgttgtgtttaccaatgtacgtaagtttgacggagatcggttcagatggttgtcaagtggagagtacatccagatgagcggccgtgctggtcgtcgaggtattgatcagcgtggtatctgcatattgatggtagatgagaaaatggaaccttcaactgccaaaatgatgcttaaaggaggtgctgatagtttgaacagtgccttccatttgagctacaacatgttgttgaatcaactgcgctctgaggatggtgatccagaaaagcttcttcggcattcattctaccaattccaagcagatagagctcttcctgatctcgagaagcaagtcagggaactggaaattgaaagaagttccatggttattgaagacgaggagagcgtgaaggattactatgatctcttacagcagtacagaactttaaagaaggatgtccgtgatattgtactttcgccaaaatatgttctgcctttcttgcaatccggaaggcttgttcgtgttcaatacagtacagatgagtccaccttctctattgacgaaaatgtgtcatggggaattataataaattttgagaaggtgaaaatcaatgctgaagaaaggaggcccgaggattgtgattacactgttgatgtcctcaccagatgttctgtaatcaaggacataagtggaaagaagacaatgaaggttattcctctcaaatcccgtggagaaccagttgttatttcgttgccactttctcagattgatggactaagtagtgtccggatgtacataccgaaggatcttctgcctgtagaagctcgagagaacaccttgaggaaagttgaagaagtgctttcaaggtttgctaaagatggggttcctctattggatccagaagaagatatggaagtaaaatctagctcctaccggaaagctgccagaagaatagaagctctcgagagcttatttgagaagcatgacatccgtaatgctccccatatccaacagaagctgaatgtcttgcatgctaagcaagaaataaaagccaaaataaagtccataaagaaaacaatgcgggcttcgactgctctagcctttaaggacgagctcaaggcacgaaaacgagttcttcgtaggctgggatatatcaccagtgaggatgtggtagaaataaagggcaaagtggcatgtgagatcagctcagccgacgaactgacattgaccgagcttatgttcagtggtactttgaaggatgctactgtggagcagatggtggccctgctttcttgctttgtttggcaggaaaagcttcaggatgccccaaagccaagggaggagctcgacctgctcttctaccagctgcaagagacggcacgacgggtcgcgaacctccagcttgaatgcaagatccagattgatgttgagagtttcgtgaactctttccgccctgacgtgatggaggccgtttactcgtgggccagagggtccaagttccaccaaatcatggagatgacacaggtgttcgaaggcagcctgatcagggccatcaggcggctggaggaggtccttcaacagctgatcccggcgtcccagtcgatcggcgagacccagctcgaagccaagcttgaggaggcggtcagcaagattaagagggatatcgtgttcgccgcgtctctgtacttgtgacatctcctgcgtggtttaattccgtcacaggagctcatgcggtgggatagagtggttatcattgtctgctgttcttgtccagcgccatcgacatggacacggtcgagctcccttcactggtttgctttaacacggagcggcatgttgtcgccatggcggggatacaattttgtaggttgtagaagcagtaagtcgtgattgaattgattagggttttggtccaaggactaccatttttcttcttccctatacagaggacagaattgaactagagatgtacctgaattgatatgccgagaatgatgagtgtctgatagta

SEQ ID NO: 5379 - DNA, 3742 bp, Eucalyptus grandis
acgcagagtgcattacggccggggagaagcgcgctcattctcctctcgcagcgccccctctctctcactccccgccgccgccgccgccgccgcgtagctcgtcgtagaccaccgtcgtctctccgtgcttctcgagaaacgcgcaagctcgctcctttcgcggcgtatccgaaagcaaagagaagaagaagcagcctcgaagcaccgcacctcgtccttcgaagcgcggatggggtcgctgaagaggaaatcgattggggactccggcggcgaagccctacccccggcgaagcagctgcgggaggacggcgccgccggcgagggcgtggcctgcgtgcacgacgtgtcgtacccggagggctacgttccggaggcggagccgccgcgctcgtcgagttcgcaggaccgtccggcgccggcaaaggagttccctttcacgctcgaccctttccagtccgaagccatcaagtgcctcgacagtggcgagtccgttatggtgtcggcccatacatcagctggaaaaacagttgttgcgctatatgctatcgccatgtccttgcagaataagcaacgtgtcatatatacagctcccattaaggcactgagcaaccagaagtatagagagttcaaggaagagttctcagatgttggcctgatgactggggatgtcaccattgagcctaatgcttcttgcttggtaatgaccactgaaatttggcggagcatgcaatacaaaggatcagaaataatgagggaggtggcttggataatatttgatgaggtacattacatgcgtgatagggagcgaggtgtggtatgggaagagagcatcgttatggcgccaaagaattctcgctttgtattcctttcagcaacagtgcccaacgccaaagaatttgcagactgggttgcgaaggtacaccagcaaccatgtcatattgtttacactgattaccggccaacaccccttcagcattacgtttttccttctggaggtgatggtctgtacttggtggtggatgagaagggaaaatttcgtgaagatagctttcagaaagctttaaatgctttggttccagctggcgagagtgataaaaaaagagagaatgggaaatggcagaaaagtttggtgactggtcgagttggtgaagaaagtgacatatttaagatggtgaagatgatcattcagcgtcaatatgatccagtaatatgtttcagctttagcaaaagagagtgtgaatttcttgccatgcagatggcaaaaatggatcttaatgaggatgatgagaaagtgaacatagaaaccatcttttggagtgctatggacatgctttctgatgatgataaaaagcttccccaggcaagtgttacaaatatgttacccctcttgaaacgtgggattggcgtgcatcattctggtttgctcccgattctgaaagaagttattgagatcttatttcaggaagggcttattaagtgtttatttgctacggagacctttagcattggtttgaatatgcctgcaaggacagtcgtgttcactaatgtccgaaagtttgatggagataagtttagatggatttctagtggagaatatattcaaatgagtggccgagctggtcgtcgaggtattgacaaacgtgggatctgcattctaatggtagatgaaaagttggaacctcccactgcaaagatgatgcttaaaggaagtgctgacagtttgaacagtgcatttcatttaagctacaatacccttttaaatcaactgcgttgtgaggacggtgaccctgagaatttgcttcgaaattcattttatcagtttcaagcagaccgtgccattcctgatcttcagaaacaagcaaaggaccttgaagaagagagggattcgattgttattcaagaagaagaaagtttgaagagctattatgatctgttacagcaatataagagtttgaagaaagatgtccgtgacattgcgctctctccaaagtatagcttacctttcttgcaacctggtcgactggtgagtattgagtgcacttccagtgataaaagtggctcatctttctcgatggaggaccaggcgacttggggggttataatcaatttcgagagggtgagaagcgcttcagaggatagtggaaacataaaaccagaagattcaaactataaagttgacgttctgacaagatgtgttgtgagacgagatggaattgcaaaaaagtcgataaatgtcgtcccactgaaagagcctggagaaccggctgtagtttctgttcctcttttgcagattaacagtctaagcagtgttcgtttggtcataccaaaagatcttttgccattggaagtccgggaaaacactttgaagaaggtgttggaagttctttcaagatttgcaaaggaggggatgccgctgttagatcctgaagaagacatgaagatccagagtcactcctatagaaaggcagttaggaggatagaagccctagaaagcctatttgacaagcatgagattgcgaagtctccacttattgaggagaagcttagagtgttaaacaggaagcaagagctgacagccaagattaagtcaattaagaaagccatgcgctcgtcctctgtattggcattcaaagatgaacttaaagcgcgaaagcgggttcttcgtagactgggatatataacaagtgacaacgtagtcgagttgaaaggaaaggttgcctgtgagatcagtagtgcagatgagttgaccctgacggagctaatgtttaatggtgttctaaaggatgtgaaggtggaagaaatggtgtcgctcctctcttgttttgtatggcgggaaaaacttcaggatgctacaaagccaagggaagaacttgacttgctttttatgcagttgcaagatacagctcggagggttgccaaagtacagcttgagtgcaaggtccaaattgatgtggaaagttttgccaattcatttcggcccgatattatggaggctgtatatgcttgggccaaaggctccaaattttacgagatcatggaaatcacacaagttttcgaaggcagtttgatcagagcaattaggaggttggaggaagtccttcagcagcttatactagctgcaaaatccattggagaaacggaccttgaatcaaaatttgaagaggcggtattaaagataaagagggatatcgtctttgctgcatctttgtacttgtagttctctgaaactcgtgatgtttagctgaagggagacctaatgaaggtgaagataacaatagacccgctgcaaataatctggcaaaatatagtgggtaattcattgaggagattacgtagctgagatggagactagtgttcgccagttcgaaatactcaggaagtaaattctagattgactgatctatgtatttggcacaaccgacaagatactagcagcaaaggctatatggattggactcatatgacatgacagaactgcagactgtccgagagtagggtaattacgctctgggtgtccataagtggaatcgtagcgggattatcttttagcccttttaaagaagagtaacatatgtccaagtatgtcggtttcgatagcatgtatgattcataggtgcattttatgccggaaattttgggactttgtattaatataattgtataccatttgataattgtgcacatgaagaggtccagttgagatgattttgttaccgctctacgcattgtacttatctttttg

SEQ ID NO: 5380 - DNA, 3751 bp, Vitis vinifera
gtgaaacgtgggtagccaccacgaccgctgcatcctcctcgttgttctacgagtcagggaaaacgttatttccttctttttccctcactttctcacaagccaaacaacaccgttgcttttaactctctcttccccacttcctttttctgtaatccaattatccatggggtcgctcaagagaaaatcaacagaagacccctccgtcgagcgcctctctccacagaaacaacagcgagaagacagtgcttcactcaatacgttagaagaatctgtggcttgcatacacgatgtttcgtacccagagggctacgagccacgttcttccttttcgtcttcgccccggaaagattcgaaacctgcaaaggagttcccgttcactctcgaccctttccagtccgaagcaatcaaatgcctcgacgccgaggaatctgttatggtatcagctcatacatcagcgggaaagactgttgtagcgttatatgctattgccatgtcattgcaaaacaatcaacgagtaatatacacttcgcctatcaaggcactcagcaaccaaaagtatagagaatttaaagaagaattctcagatgttggtttgatgactggggatgtcactattgagcccaatgcttcttgcctggtaatgaccacagaaatctggagaagtatgcaatacaagggatcagaaattatacgggaggtggcttgggtaatttttgatgaggtacattatatgcgtgatagggaaagaggtgtggtatgggaagaaagcattgtcatggctccaaggaactcacgatttgtattcctctcagcaactgtgcctaatgcaaaggaattcgctgattgggttgcaaaggtccatcagcaaccgtgtcacattgtttatactgattatcggccaacaccacttcagcattatatttttccttctggaggcgatggtctctacttggtggtggatgaaaagggaaaatttcgtgaggatagctttcagaaagctttaaatgcactcgttcctgctggtgaaggtgacaagaaaagagaaaatgggaagaggcagaaaggactggtggtgggcagagctggtgaagaaagtgacattttcaagatggtgaaaatgattattcagcgtcagtatgatcccgtgatacttttcagcttcagtaaaagggattgcgaatttcttgcaatgcagatggcaagaatggatttaaatgatgacaatgagaaagtgaacatagaaactatattctggagtgctatggacatgctttcagatgatgataaaaagttacctcaggtttcaaatatgctacccctcttaaaacgtggaataggcgtgcaccattctgggttgcttcccatactgaaggaagtgattgagatactatttcaagaaggtctcattaagtgtttgtttgccacagagactttcagcattggtttgaacatgccagcaaagactgtagtgtttacaaatgttcgtaaatttgatggggataaatttagatggatatccagtggggagtttatacagatgagtggtcgtgctggtcgtcgaggcattgatgaacggggaatatgcatccttatggtggatgagaagctagaaccttctactgctaaaatgatgctcaaaggaagtgctgattgcttgaacagtgccttccatttaagttacaacatgcttctgaatcaaatgcgatctgaggatggtgatcctgaaaagttgcttcgcaattcattctatcaatttcaagcagaccgtgccattcctgatcttgagaaacaagcaaagaaccttgaagaagagagggattcaattataattgaggaagaagatagtttggagaattattacaacctgatacagcagtataagagtttgaagaaggatgtccgtgatattgtgttttctccaagatactgcttgcccttcttgcaacctggaaggcttgtgtgcatccaatgcacaaagactgaggaaaattctccatctttctgtatcaaggaccagaccacatgggcagtgattatcaattttgaaagggtgaaaggtactgaagatgatgtaagtagaaaaccagaggatgcagactacatggtggatgttctaaccagatgtacagttagtagggatggagttttaaaaaagacaattaagattgtttcattgaaggagcctggagaacctgttgttgttactgttcctatttctcagattgatggtttaagtagtgtccgtctgatcatatcaaaggatcttttgccattggaagctcgagaaaacaccctgaaaaaggtgtcggaagttctttctagatttgctaaagaagggatgcccctcctagatcctgaggaagacatgaaggttcaaagtagccagtacagaaaggctgtccgtaggatagaagctttagagagcttgtttgacaagcatgaagttgcaaaatctccacttattgagcagaagcttaaagttttgcatatgaagaaagaattgacagccaagatcaagtcaattaagagaacaatgcgctcttccactgcattggctttcaaagatgaactcaaggcaaggaaacgggttcttcggaagctagggtatgtcacaagtgacaacgttgtggagttgaaggggaaggttgcttgtgaaatcagtagtgcggatgagttgactctcacggagcttatgttcaatggggttttcaaagacataaaggtggaggatatggtttctcttctgtcttgttttgtgtggcgggagaagcttcaagatgctcaaaagccaaaggatgaacttgagttgctatttacacagttacaagatacagctaggagggttgccaaagttcagctggagagcaaggtccaaattgatgtggagagctttgtgaattctttccggcctgatatcatggaggctgtgcatgcttgggccaaagggtccaaattctatcagattatggaaatcacacaagtgtttgaaggaagcttgatcagggctattaggagactggaggaagttctacagcaactcatacaagcagccaaatccattggagaaactgagcttgaagcaaaatttgaagaggctgtttccaagattaagagggacatagtctttgcagcatctctgtacttgtagttctgccgagaagattctatttcacttttttaccttgttgaaggattcaacaaagcgagaatctctctttttaaagcaacggtaaaacaatctgcaagcagatgcatatgggaaagttgcatttgtgatgagagaaacaaggaggagacccgtttggggttggcaacccgcaaagttttggctcttgttgacatatgctccttggtgtcgtcttctatattatttactcagttgggaagaagaaaaaggtacaaaggttactcatttgagagtagtacgtgtgctgggcagatggaggtgatcatcttaaacattcacacaagagaccacagcagcataatctaggaaaggaattgcgtttgagaatttatgtttcaacatcagcttgtacaccctctatttttggcagtcatcggttagaggctagtactgtgtggtatgttatattttcactaattaagcacttcatttcccaacctctaaatttttgctacttgtgtcattggtaacagaagttgagcttggacgtgtcacattattaattaatttacacatgagtctaatttagatgtgcccaggagcattagtattgggtgtttttct

SEQ ID NO: 5381 - DNA, 3115 bp, Citrullus lanatus
ctcctcaattccaagctgccatgggctcttcgaagagaaagctggtcgacgatgcgcccagacaatcttcgccgaagcaacacagagccaatgcccgtgccaatgttgaagacgaaccagttgcgtgtgttcatgatgtctcctaccccgagggttcttttaatcctctcccatcttcaagtatctcttccactggagagaagttggaaccggctaaggtcttccctttctctctggacccctttcagtctgaggctatcaagtgcttggaaactggagaatctgtcatggtgtctgcccatacatcagctggtaaaactgttgtggcattgtatgcaattgccatgtctctccggaataaacagcgtgtcatatacacctcaccaatcaaggccctcagcaaccaaaaatatagggaatttaaagaagaattctcagatgttggtttaatgactggggatgtgacaattgatccaaatgcttcttgtctggtcatgaccacagaaatttggcgtagcatgcagtacaaaggatcagaggttacacgggaagtggcatggattatttttgatgaagtacattacatgcgtgatcgggagcgaggtgttgtttgggaagagagcattgtcatggctccaaagaatgctagatttgttttcctctcagcaactgtaccaaatgcaaaagaatttgctgattgggttgcaaaggtccaccaccaaccatgtcatattgtttatactgactatcggccaacacctcttcaacactatattttcccatctgggggtgaaggcttatacttggtggttgatgaaaaggggcattttcgggaggatagctttcaaaaagctttaaatgcacttgtccctgttagtgatagtgacaagaaaaaggagaataatgggaagtggcagaagagtttgactttgggcaaaacaggtgaagagagtgatatatttaagatggtgaagatgataattcaacgtcaatatgatcctgttatacttttcagctttagcaaaagagaatgtgaatttcttgcaatgcagatggcaaaactggatctaaatggtgatgacgaaaaggcgaacatagaaaccatcttttggagtgcgatggatatgctttcagatgatgataaaaagctccctcaggtttcaaatatgttgcctctcttgaagcgtggaataggggtccaccattctggcttgctccctattttgaaggaagtgattgagatattatttcaagaagggctaatcaagtgtttgtttgccacagagaccttcagcattggtttaaacatgcctgcaaaaactgttgtgttcagtaatgttcgcaagtttgatggggataaatttagatggttatcaagtggtgaatatatacaaatgagtggtcgagctggacggagaggaattgataagcgtgggatatgtatccttatggtggacgagaagctggaaccttcaactgctaaaatgatgcttaaaggaaatgcggattgcttgaacagtgcttttcacttgagctataacatgctcttgaatcaaatccgttctgaagatggcgatcctgaaaatctgctgcgtaattccttctatcagttccaagccgaccgcaacatacccaacctcgagaaacgagtgaaaagccttgaagaggagagggattccattgtgattgaagaggaagataatttgaagaattattatgatttgctaaagcagtacaaaagtttaaagaaggatattcgtgatattgtactgtctcctagatactgcttaccatttctgcaacctggcaggcttgtatctattgaatgcaacagcaatgatgagatttcttcaactttttccattaaggaccaggttacgtggggattgataattaattttcaaagggtgaaaggtgtttctgaagatgatgctagcatgaaaccagaatctgcaaactacactgtggacattcttacaagatgcattgtcagtaaagatggcattgggaaaaagaatgttaagatcgttcaattgaaagagcatggagaaccccatgttgtttccattccaatatctcagatcagtactttagctagcattcgtatactcataccgaatgatcttttgccgctggaagctcgagaaaatacattgaagaagatttctgaagttctatcaagatttccaaagggagtgccccttctagatccagaagaggatatgaaaatccaaagtagttcatacagaaaggccgtgcgtagaacagaggctttggagagcctctttgacaagcatgaggcggcaaaatcgacacttgttgagcagaagctcaaagcattacatttgaagcaagagttaacagctaaaattagatcaattaagaaaacattgcgttcttcttctgcattggctttcaaagatgaactgaaggccaggaaacgagtattgcggaggcttggttacatatcgagtgatgatgtcgtggagttgaaaggcaaggttgcttgtgaaatcagtagtgcaaatgaattgactctttcagagctgatgttcaatgggattttcaaggacataaaagtggaggaagttgttgctctgctatcttgttttgtgtggcaagagaaacttcaggatgcagcaaagcctagggaagagcttgagctgcttttcattcaattacaagacacagcccgaagggttgctaaggttcagcttgaatgcaaggtcgaaattgatgtagaaggttttgtgaattcatttagaccagatattatggaggctgtttatgcttgggcaaaaggctccaaattctatgagataatggaaataacacaggtatttgaggggagcttgattagagcaattagaagactggaagaagttcttcaacaacttatactagcagcaaagtccattggtgaaactgaacttgaaaccaagtttgaagaggctgtttccaaaatcaagagggatattgtctttgctgcttctttgtacttgtagtagttttccttatctttttaattttaatttttgtataacatcgagttgttatttataattatatgcggctctttgtaaagtttcttatattcattttattgttaaaacta

SEQ ID NO: 5382 - DNA, 1077 bp, Zea mays
ctatgccggtggctgtttggacatctgttgacacaccccaccccgttgccaagcggcgccaaaccaacgagagcacccggaccagacgcccaagtcgatcgccatggcgatgaagccggcggcggcggctccccctaccccggccgcggcgcacagcgtgttcgtctacggcagcctgatggcggacgaggtggtccgcaccatcctcaagcgcgtcccgcccgccgccccggccctcctcccaaactaccaccggttcaacatcaagggccgcatttacccggcgatcctgcccgttgagagcaagagagttgctgggagggttatcatgggtgttactgatgaagagctccagcttcttgacgcgtttgaagacgtggagtacacgaggacaagagttgagatatcattggctgactcttccgagaacatgctggctgacacttacgtgtggagtgatgcagaggatctcaatctttatggagaatgggactttgaggagtggaagaaactgcacatgaaggatttccttgcgatgacgaacggtttcatgcacgagctcgagcagcctgaatcgaagacccgggtggagacctaccaggaattcatgcaacaacaggaacagcctgcgccggggacccaggtggagggttgagagctgcaatccgctggctgctgatctacatctagtcaattcccatggaggaattgcattggcattggactgtaccgtatctaataggtcacctatatcatttgtgaagatcaggattatccggtctataataactaaacatacaaataaaatgtccaccgaggtttctgttgattctttatgtcattgttgaccccatggctgctgctcaactgctgatgcgcggtctctataatttgtgaaagaagatagtgattaacttacataatgcaatagttaagtacatgtatatgaaacagttttccttgagatttctgttgattattttgtcgttgttcatcccatggctgtttgtggaatatgattaggagtaacctgtgagatagaataattaagtacagcgatgaagttgtcactgagat

SEQ ID NO: 5383 - DNA, 1508 bp, Panicum virgatum
acttcaaatgactaagattcctttgcaaatttttttttacaaaatgaactaaacagacccttgctagcttattatcttttcgttcaggtcatgatgtcaggtcagtccccaagtcttggcgtgcattgcatcagtgagaaacacatgagcagcagtacatgctcacgctgctccgatcctccagctgaaacaacttttgcagcctgcgttcggattcggcgcatgtgtcctcgccgaatttcaatcggtggccggagacattggccattgtcctggaggtgaagtcgccggccgccggactttgtgcttctcttgatcagacagggaggcagcagagcacgacgacgacgggcagcgggctcgaatcagatcggggcggccccgtccaggcgtccacacggcaccaatctcgatgcgcggcgggttcctccgccctgctcgcgtttaaaaggcgcacgcgtcccaagccatcccctgctcaccatcgcacacgccaccgagcgcgcgccgcaacctgccagcgcagagctcgacaagcggcggcacccagggcagaggcccgagcccccagccccacatggcgatgacgccgccgcctcctgctgctgctgctgatccggccgcagccgcgcacagcgtcttcgtgtacgggagcctcatggcggacgaggtcgtgcgcgccatcctcaagcgcgtcccgcccgccgccccggcgctcctccccaactaccaccggttcaacatcaagggccgtatttatccggcgatcctgcccgccgagagcaagaaagttgcaggaatggttatcatgggtgttactgacgaagagctccggcttctggatgcatttgaagatgtggagtacacgaggacaagagtcgagatatcgttagctgacccttcggagaaaatgctggctgacacatatgtgtggagcgacgcagaggatccaaatctgtatggcgaatgggattttgaggagtggaagaagctacatatgaaggattttctcgctatgaccaatggtttcatgcacgaaatcgaacagcctgaagccaagacccgggtcgagacctaccagtcattcatgcaacaacaggaacagccagcatcggagacccaggttgagggttgagacctgcagttctgctggtcgttctcaggaagaattgtactcctactagcactgggctttactatctgtaataagttgcctgcatgatttgtgaataatatctttattggatcaccgtataaaatatcataacagttacagatgaaataaaatttcctcttctttagatcatgtgtcttgtactaatgcattgtacaaattattagctgtcttctgggaatggttgggtgctccctaatttgtttgtgttcatgctaatctgtggcttcagcctgcaatgactgcgttgtttgtaacgtactactgtcaaccttctgagatctcaagtattgcaaagcctaaataaaattggcgccaacccaccccccccccc

SEQ ID NO: 5384 - DNA, 657 bp, Saccharum officinarum
cgctcgccaagcggcgcggcgcggagccagccaacggcacccgaaccagacgcctccccagtccccacctcgatcgccatggcgtcgccgccgccgcagcagacgcttccccctgctccggccgccgcggccggggcgcacaccgtcttcgtctacgggagcctgatggcggacgaggtggtccgcaccatcctcaagcgcgtcccgcccgccgccccggcgctcctcccaaactaccaccggttcaacatcaagggccgcatttacccggcgatcctgcccgttgaaagcaagagagttgctgggagggttatcacgggtgttactgacgaagagctccaacttctggatgcgtttgaggatgtcgagtacacgaggacaagagttgagatatcattgactgactcttcggagaaaatgctagctgacacttatgtatggagtgatgcagaggaccccaatctttatggcgagtgggattttgaggagtggaagaaactgcatatgaaggatttcctggcgatgacgaatggtttcatgcatgagctcgaacagcctgaatctaagaccccggtggagacctacgagtcattcatgcaacaacaggaacaagcctgcgcccgggacccaaggttgagggttgagagttgcaatctg

SEQ ID NO: 5385 - DNA, 858 bp, Setaria italica
ccaccagtcaccaagcgcgcgccgcaacctgacagccctcgactcgacaactcccccacatggcgatgacgccgccgcctcctgctccggccgccgccgccaaggccggggcgcacagcgtcttcgtgtacgggagcctcatggcggacgaggtggtccgcgccatcctcaagcgcgtcccgcccgccgccccggcgatcctcccgaactaccaccggttcaacatcaagggccgtatttacccggcgatcctgcccgtcgagagcaagaaagttgcagggatggttgtcatgggtgtcactgacgaggagctccaagtcctggatgcatttgaagatgtggagtacacgaggacacgagttgagatatcattaaccgactcttcggagaaaatgttggctgacacttatgtatggagcgatgcacaggatccagatctatatggcgaatgggattttgaggagtggaagaggctgcatatgaaggatttcctcgcgatgactaatggtttcatgcacggtctcgaacagcctgaagcgaagacccgggttgagacctaccagtcattcatgcaacaacaggaacagcctgcatcggagacccgtgagagttgagacctgttgttctgctggtcattctcagaagaaattgtactggcagtgccctgtactatctgtaataagttgcttacatgatttgtgaataagatctttataggatcccgtataaaattacacatatgaaataaaatctcatcggagagatttctgttgatcctatggctggttcagatgcatcgcttttagctgttccaagtgttgagaatttactgccaaatcaggcaaattcttggctggc

SEQ ID NO: 5386 - DNA, 831 bp, Panicum virgatum
cgcacacgcccccgagcgcgcgccgcaacctgccagcgcagagctcgacaagcggcggcacccagggcaggcagaggcccgagcccccagccccacatggcgatgacgccgccgcctcctcatcctgctgctgatccggccgcagccgccgccaaggccggggcgcacagcgtcttcgtgtacgggagcctcatggcggacgaggtcgtccgcgccatcctcaagcgcgtcccgcccgccgcccccgcgctcctccccaactaccaccggttcagcatcaagagccgtatttatccggcgatcctgcccgccgagagcaagaaagttgcaggactggttatcatgggtgttactgacgaagagctccaagttctggatgcatttgaagatgtggagtacacgaggacaagagtcgagatatcattagttgactcttcggagaaaatgctggttgacacatatgtgtggagcgatgcagaggatccaaatctatatggcgaatgggattttgaggagtggaagaagctacatctgaaggattttctcgcgatgaccaatggtttcatgcacgaacttgaacagcctgaagcgaagacctgggtcgagacctaccagtcattcatgcaacaacaggaacagccagcatcggagacccaggttgagggttgagacctgcagttctgctggtcgttctcaggaagaactgtgctagcactgggcagtactctgtaataagttgcctaaatgatttgcggataagatctttataggatcaccatataaaatatcataattgttacagatgaaataaaatatcttcttctttagatc

SEQ ID NO: 5387 - DNA, 1063 bp, Panicum virgatum
taattaaatattaattattaaataacaacgaaatgtactatattatcaaaatacaaattttttcacgaactaaacaacccctaattaaaacggcgcacgcgtcccaagcggccaagccatcacccacgccaccgaagagctcgacaagcggcggcacccagggcaggcagaggcccgagcccccagccccgcatggcgatgacgccgccgccgccgccgccgccgccgccgcctcctgctgctgccccggccgccgccgccgccaaggccggggcgcacagcgtcttcgtgtacgggagcctcatggcggacgaggtcgtccgcgccatcctcaagcgcgtcccgcccgccgcccccccgctcctccccaactaccaccggttcagcatcaagagccgtatttatccggcgatcctgcccgccgagagcaagaaagttgcaggactggttatcatgggtgttactgacgaagagctccaagttctggatgcatttgaagatgtggagtacacgaggacaagagtcgagatatcattagttgactcttcggagaaaatgctggttgacacatatgtgtggagcgatgcagaggatccaaatctatatggcgaatgggattttgaggagtggaagaagctacatctgaaggattttctcgcgatgaccaatggtttcatgcacgaacttgaacagcctgaagcgaagacccgggtcgagacctaccagtcattcatgcaacaacaggaacagccagcatcggagacccaggttgagggttgagacctgcagttctgctggtcgttctcaggaagaactgtgctagcactgggcagtactctgtaataagttgcctaaatgatttgcggataagatctttataggatcaccatataaaatatcataattgttacagatgaaataaaatatcttcttctttagatcatgtgtcttgtactaatgcattgtacaaattattggctgtcttctgggaatggttgggtgctccctaatttgtttgttttcatgctaatctgtggcttaagcctgcaatgactatgttgtt

SEQ ID NO: 5388 - DNA, 667 bp, Pennisetum glaucum
gccggggcgcacaacgtcttcgtgtacgggagcctcatgacggccgaggtggtccgcgccatcatcaagcgcgtcccgccggccgccccggcgctcctccccaactaccaccggttcaacatcaagggccgtatctacccggcgatcctgcccgtcgagagcaagaaagttgcaggaatggttgtcatgggtgtcactgacgaggagctccaagtcctggacgcatttgaagatgtggagtacacgaggacacgagttgagatatcattaaccgactctttggagaaaatgtttgctgacacttatgtatggagtgatgctcaggatccagatctatatggcgaatgggattttgaggaatggaagaggctgcatatgaaggatttcctcgcaatgactaatggtttcatgcacggtctcgaacagcctgaagcgaagacccgggttgagacctaccagtcattcatgcaacaacaggaacaacctgcatcggagacccaggttgagagttgagacctgcacttccgctggtcatactcagaattgttctggcagtgcgctgtactatctgtaataagttgcttacatgatatatgaataagatctttataggatcccatataaaatatcataataattacacatatgaaataaaatatcattggag

SEQ ID NO: 5389 - DNA, 674 bp, Panicum virgatum
cgggagcctcatggcggacgaggtcgtgcgcgccatcctcaagcgcgtcccgcccgccgccccggcgctcctccccaactaccaccggttcaacatcaagggccgtatttatccggcgatcctgcccgccgagagcaagaaagttgcaggaatggttatcatgggtgttactgacgaagagctccggcttctggatgcatttgaagatgtggagtacacgaggacaagagtcgagatatcgttagctgacccttcggagaaaatgctggctgacacatatgtgtggagcgacgcagaggatccaaatctgtatggcgaatgggattttgaggagtggaagaagctacatatgaaggattttctcgctatgaccaatggtttcatgcacgaaatcgaacagcctgaagccaagacccgggtcgagacctaccagtcattcatgcaacaacaggaacagccagcatcggagacccaggttgagggttgagacctgcagttctgctggtcgttctcaggaagaattgtactcctactagcactgggctttactatctgtaataagttgcctgcatgatttgtgaataatatctttattggatcaccgtataaaatatcataacagttacagatgaaataaaatttcctcttctttagatcatgtgtcttgtactaat

SEQ ID NO: 5390 - DNA, 2147 bp, Sorghum bicolor
ccgcatcctggcacgccgccgataccgccgccctcagcccttagcttgccaccctccttcggcttgcgctgctgagggatcgctggagagaatggggaaggggaagaagtcgaaggagaaggagatggagaagaaaccggtggacatcctcgcggggtccgacgaggactccgacggcggggaggatctctccaaggtccagatcaacgaggagtacgcgcgccgcttcgagcacaacaagcggcgggaggcgctgcagcgcctcgaggagcgcaggaagcagggcctcgtccccgcctctgacgacggcgagtcggattccgagtccgagtcgtctgaggaggacgaggaggccgccattgcctcgcgcctcgtcgaccgccgcgtgttcgaggtgatccgccgcatccgcagcggtgaccctcgcatcctagacaaggacgccaaggtctactcggagtcggaggaggaagagggcagcgaagaaggtgagggcgccgagaaggaagaagagttcaagcaggggaagaaaaaggccaagaaggagaagcctctgtacctcaaggacgtcaatgcccgccacctgctcgaggagggcccggagttcgcagcgcaggccagccggagcagcagcaagttcgagaggatctcctatgatgagcagcagaagaagggtttggaggctttccttgaggcacagaaagaagtattacgcggcgacgacgacgacgacgatttgttccaggtgaagcccaaggctagagcaggggctgatgatgaagtggaggaggatgaggaggagaagcagaccaaggaacttgctggtaaggtctttgggaacgatgaggagctggatgagaacgagaagttcttgaaggaatttttccttaagaggccctaccttgaggcagagaagaggaagtcctatctggatgatatccaggaattatcagatgatgaagaggagctcgagattcaggaagaaaatgagcatggttataattaccggcatgaggaggccatggcatcaggggcagtggtggcggaccgggtaatgggacattcaagggttgttgaggggtcagtgaggaagaaggagagcagcaggaagcagcagcgcaagagcaaagaggagcggatggcccgtgttaagcaagagcaggcagaggagctgaagcatctcaagaatttgaagaagaaagagattgcagagaagcttgagaggatcctaatgattgctgggattgaaggtgatgctgcgtgtaagcttggtgctgatgacttggaggaggattttgatccagaggattatgacaagaaaatgcaggagatgtttgatgacagttactatgaggctgatgatgttgatcctgagtttggaagtggtgaggagatggatttgaagaagccatattttgacaaggaagatgaattgcttgggcttcctaagggctgggctagtgaacattcaaaagaagagtctactgccaccgatgcaaaaggtgcaaaagggaagatctctctcaaagacaaggtggagcttgagaaagagatggaagagtactacaagttagactatgaggacactattggagatatcaagactcggttcaagtataaacaggttaagcccaacagttttggtctgagtgcctgtgatatattggaagcagatgacaaggatttgaaccagtatgtatccattaagaagctatctccttatagagaggatgaatggaaggttacacatcataagaggcagagcaaggatttcatccttggaggccagaagaaagggaagaaggacaaatctgtcaagaaatctaggtctgaggaaggcggccctagttcttcaaaaacagagaaagacaggctgacaaatgggcaagagtcaacggatgacaagaaaaagactacccgaagtgagcgaaggaagcgtcgtaaggctgacctaaagatatccgatgatcgattagtggcatttggaaagacaaattcgaagcgtcacaagagccattgactttctgagattcatctaagtacatctggggaattttgcggtatgcattatggatcggtgaaagtcttaggtttagcagtccttgcttctattttgggagctgcaaaactagtgttgtcctagttgt

SEQ ID NO: 5391 - DNA, 2244 bp, Zea mays
ccatcgattaaaaccctaacccgagcatcttccacgccgccgttgtctcgccgcttccagccgttgctcgctgaagaagatggggaggaggaagaagtccaaggagatggagaagaagccgctggacatcctgtcgggctccgacgaggacttcgacagcggggagaacctctccaagatccagatcaacgaggagtacgcgcgtcgcttcgagcacaacaagcggcgggaggcgctgcagcgcctcgaggagcgcaggaagcagggcctggtccccgcctccgacgacgacgagtcggagtccgagtcgtcgtcggaggaggaggacgaggcggccgccattgcctcgcgcctagtcgaccgccgcatgttcgaggtgatccgccgcatccgcagcggcgatccccgcatcctcgacaaggacgccaaggtctactcctcggaggaggaaggcggcgaggaaggtgaggacgccaagaagcaagaagagtccaagcaggagaaggaaaagaccaagaaggagaagcctctgtacctcaaggacgttaatgcccgccacctgctcgaggagggccccgagttcgcagcgcagcccagccggagcagcagcaagttcgagaggatcgcttatgacgagcagcagaagaagggattggaggctttccttgaggcacagaaagaagcattaggcgatggtggagacgatgatggcgatttattccaggtgaaggaaaaggctagagcaggagctgacgacgaagcggaggaggacgaggaggagaagcagacaaaggaccttgctggtgaggtctttgggaaggatgaggagctggatgagaacgagaagttcttgaaggaattttttcttaagaggccgtaccttgagacagagaagagtaagtcctatctagataatatccaggaattgtcagatgaagaggagctcgagattcaggaagagtatgagcatgcttataattaccggcatgaggaggccatggcatcaggggcagtggtggcggatcgggtgttgggacattcaagggttgttgaaggttcggtgaggaagaaggagagcagcagaaagcagcagcgcaagagcaaagaggagcggatggcccgtgttaagcaagagcaagcagaggagctgaagcatctcaagaatttgaagaagaaagagattgcagagaagcttgagaggatccgaatgattgctgggattgaaggagatgctgcttgtaagcttggtgctgatgacttggaggaggattttgatccggaggattatgacaaaaagatgcaggagatgtttgatgatagttactatgaggctgatgaggttgatcctgagtttggaagtggtgaggagatggatttggagaagccggattttggcaaagaagacgaattgcttgggcttcctaagggctgggctagtgaccattcaaaagaagagtctactgccactgatgcgaaaggtgaaaaagggaagatctctctcaaagacaaggtggagcttgagaaagagatggaagagtactacaagttagactacgaggacactattggagatatcaagactcggttcaagtataaacaagttaagcccaatagttttggtctgagtacctatgatatattggcatcagatgacaaggatttgaaccagtatgtttccgttaagaagctagctccttacagagaggatgaatggaaggttacacatcataagaagcagagcaaggatttgatccttggaggccagaagaaggaagggaagaaggacaaatctggcaagaaatctaggtctgaggaagaccctagttcttcaaaaacagagaacgacaggatgacaaatgggcaagagtcaacagatgccaagaaaaagtctaccagaagtgaacggcggaagcgtcgcaagtctgagctaaggccatccagtgatcgattagaggcatatggaaagataaattcaaagcgtcacaagagccattgaccttctgagattcatcaaagtacatctggggaattttgctgttctttttatgcattggacaggtgaaagtcttagatttagctgtccttgcttctattttgggagatgcaaaactagtgttgccctagtagaaacatctgttgtcttatagttttgcagacattgtgttgtgcgcctccttttgattttgattgttttatttgtagaccatatatatataatataatttccctgcaatttttcttgtc

SEQ ID NO: 5392 - DNA, 2219 bp, Panicum virgatum
cgcctccagtcggaaaaccctaacctgagcacctaccccgctgccgccgccgctgccgccgacgggtcgcctcctgctccgcggtgaatacattgctgaagatggggaaaggggggaaggagaaggagaagaagtcgctggacatcctcgcggggtccgacgaggactccgacagcggcggcgaggacctctcgaagatccagatcaacgaggagtacgctcgccgcttcgagcacaacaagcggcgggaggcactgcagcgctacgaggagctcaagaagaagggcctcgcccccgcgtctgatgacgaaagcgacgacaacgaggagtcgtccgaagaggaggaggacgaggacgccatcgcctcgcgccgcgtcgaccgacgcgtgttcgaggtgatccgccgcatccgcagcggcgacccccgcatcctcgacaaagacgccaaggtttactcctcggaggaggagggcaaagaggagaagaaagaagagcccaagcagaaaaagaaggctaagaaggagaagcctctatacctcaaggacgtcaacgcccgacacctgctcgaggagggccctgagttcacagctcagaccagccggagtagcaggtacgataggatcgcctacgatgagcagcagaagaagggtctgcaggctttccttgaggcagagaaggaggttttaggtgatgacgacgacgacgatgatttgttccatgagaagccgaaggctggagcaggcgccgatgacgaggaggatgaagaggaaaatgagacgaaggagctagctggtgaggtttttgggaaggatgaggagctggacgagaacgagaggttcttgaaggaatttttccttaagaggccatacctcgagtcagggaaggagaagaagtcctatctggatgatatgcaggaattgtcggacgtagaagagatcaatgaacaggaaatatacgagcatgtttacaatttccggcatgaggaggctgaagcatcaggggcagtggtggcagaccgggtaatggggcattcaagggttgttgaagggtctgtgaggaagaaggagagcagcaggaagcagcagcggaagagcaaggaggagaggatagcccgagctaagcaagagcaagctgaggagttgaagcatctcaagaatctgaagaagaaagagattgcagagaagcttgagaggatccggatgattgccgggattgaaggcgatgctgcatgtaagcttggtgctgatgacctggaggaggattttgatccagaggattatgacaagaaaatgcaagagatgtttgatgactgttattatgaggctgatgatgttgatcctgagtttggaagtgacgaggagatggatttggagaagccagattttgacaaggaggatgaattacttgggcttcctaaaggctgggctagtgaaaaagataaagaagagtctagtgccacagatgggaaagctacaaaagggaagatctctctcaaggacaaggtcgagcttgagaaagagatggaagagtactacaagttggactatgaggacactattggagatctgaagactcgattcaagtataagaaggttaatcctaacagttttggtctgagtacctacgacatattggcatctgatgacatggatctgaaccagtatgtttccatgaagaagctagctccttacagggagagtgaatggaaggtaacacatcataagaagttgagcaaggacttgatccttggaggccagaagaaagaagggaagaaggacaaatctggcaagaaatctaagtctgctgaaggtggctctagttcttcaaaaccagagaaagacaagctgccaattgaacaagagtcaactgatgacaagaaaaagtctaccagaagcagcagaaggaagcgccgtaatgaggatctgaagatacccagtggtcgtctagaggcatatggaaagataaattcaaagcgtcacaagagccattgagctttggagattcatcaaagtacatctagggaattttgcttttctttttatgcattttggaagggctgaaatcttatttgagaggctttgcttcttctttgggagttgcaaaccagtgtcgtcctagtagaattatttctctgaattttgcagacagtgttgtgcacctccttttgtgaaccatatagtttaattgccttgaagtttgctgcaactacattttgtgtt

SEQ ID NO: 5393 - DNA, 2177 bp, Setaria italica
aaaaccctaaccagagcacctaccccgccgccgctaccaccgctgccgccgcctcctgctccgccgtgaattcactgctgaagatggggaaagggaagaaggagaagaagccgctggacatcctcgcggggtccgacgacgactccgacggcggcggggaggacagctcgaagatccagatcaacgaggagtatgctcgccgcttcgagcataacaagcggcgggaagcgttgcagtactacgagaatcttaaaaagcaaggcctcgctcccccgtctgacgacgagaaggactacggggaggtgtcatccgaagaggatgaggacgccattgcctcgcgcaccgtcgaccgccgcctgttcgaggtgatccgccgtatccgcagcggtgaccccgcgatcctcgacaaagacgccaaggtttactcctcggaggaggagggcggcgagaagaaggaaggagagtccaagaagaaaaagaaggccaagaaggagaagcctttgtacctcaaggacgttaacgcccgacacctgctcgaggagggccccgagttcacagctcagaccagccggagcagcaggtacgataggatcgcctacgacgagcagcagaagaaggggctggaagccttccttgaggcacagaaggaggttttaggtgatgacgatgacgatgatttgttccatgagaagccgaaggctggagcagctgctgatgaggatgaggatgaggaggagaagcagacgaaggagctagctggtgaggtttttgggaaggatgaggagctggacgagaacgagaagttcttgaaggaatttttccttaagaggccgtaccttgactcgggtaagaagtcctatctggaggatatccaggaattgtcggacgaagaggagctcaaagatcaggaaaaatatgagtatgtttacagtttccggcatgaggaggctgaggcatcaggggcagtggtggcagaccgggtaatgggacattcaagggttgttgaagggtctgtgaggaagaaggaaagcagcaggaagcagcagcggaaaagcaaggaggagcggatggcccgggctaagcaggagcaggctgaggagctgaagcatctcaagaatttgaagaagaaagagatagcagagaagcttgagaggatccggatgattgccgggattgaaggtgatgctgcttgtaagcttggtgctgatgaccttgaggaggattttgatccagaggattatgacaagaaaatgcaggagatgtttgatgacagttactatgaggctgatgatgttgatcctgagtttggaagtggtgaggagatggatttgaagaagccagattttgataaagaagatgaattgcttgggcttcctaagggctgggatagtgaaaactgtaaagaagagtcttctgccaccgatgggaaagctacaaaagggaagatctctctcaaggacaaggtggagcttgagaaagagatggaagagtactacaagttggactatgaggacactattggagatctgaagactcggttcaagtataagaaggttaatcccaacagttttggtcttagtacctatgagatattggcatcagatgacaaggatctgaaccagtacgtttccatgaagaagctagctccttacagggagagtgaatggaagataacacatcataggaagttgagcaaggatttgatccttggtggacagaagaaagtaggaaagaaggacaaatctggcaagaaatctgggtctgccgagggcggccctagttcttcaaaaccagagaaagacaagctgccaattgaacaagagttaactgatgacaagaaaaagtctaccagaagcagacgaaggaagcgccgtaatgaggatctgaagatgtctgctgatcgactaggagcatatggaaagctaaattcgaagcgtcacaagagccattgagctttggagattcatcaaagtacatctagggaattttgcttctctttttatgcattttggagggagtgaaatctcaattaacgagagtctttgcttctactttgggagttgcaaactagtgtaatcctcgtagtcatttctctgagtttgcagacagtgttgtgcacctcctttcctgaaccatataatttaattgccttgaagtttgctgctactatgttttgt

SEQ ID NO: 5394 - DNA, 2334 bp, Panicum virgatum
aaaaccctaacctgagcacctagcccgccgccgccgctgccgccgagccgccgcctactgctccgccgtgaatacattgctaaagatggggaaatggaagaaggagaagaagtcgctggacatcctcgcggggtccgatgaggactccgacagcggcggagaggacctctcgaagatccagatcaacgaggagtacgctcgccgcttcgagcacaacaagcggcgggaggcgctccagcgctacgaggagctcaagaagaagggcatcgtctcggcgtctgacgacgaaagcgaggagaacgaggagtcgtccgaagaggaggacgaggacgccattgcctcgcgccgcgtcgaccgccgcgtgttcgaggtgatccgccgtatccgcagcggcgacccccgcatcctcgacaaagacgccaaggtttactcggaggaggaggagggcgaagaggagaagaaagaagagcccaagcagaaaaagaaggctaagaaggagaagcctctatacctcaaggacgttaacgcccgacacctgctcgaggagggccctgagttcacatctcagaccagccggagtagcaggtacgataggatcgcctacaatgagcagcagaagaaaggtctgcaggcattccttgaggcagagaaggaggttttaggtgatgacgacgacgatgatgatttgttccatgagaagccgaaggctggagcaggcgctgatgacgaggaggatgaagaggaaaacgagacgaagaagctagctggtgaggtttttgggaaagatgaggagctggacgagaacgagaggttcttgaaggaatttttccttaagaggccgtaccttgagtcggggaagaagaagtcctatctggatgatatgcaggaattgtcggacgtagaagatgtcactgaacaggaaatatatgagtatgtttacaatttccggcatgaggaggctgaggcatcaggggcagtggtggcggacagggtaatgggacattcaagggttgttgaagggtctgtgaggaagaaggagagcagcaggaagcagcagcggaagagcaaggaggagaggatcgcccgagctaagcaagagcaggctgaggagctgaagcatctcaaaaatctgaagaagaaagagattgccgagaagcttgagaggatccggatgattgccgggattgaaggcgatgctgcatgtaagcttggtgctgatgacctggaggaggattttgatccagaggattatgacaagaaaatgcaagagatgtttgatgacagttattatgaggctgatgatgttgatcctgagtttggaagtggtgaggagatggatttggacaagccagattttgacaaggaggatgaattacttgggcttcctaaaggctgggctagtgaaaaggataaagaagagtctactgccacagatgggaaagctacaaaagggaagatctctctcaaggacaaggtcgagcttgagaaagagatggaagagtactacaagttggactatgaggacactattggagatctgaagactcggttcaagtataagaaggttaatcctaacagttttggtctgggtacctacgatatattggcatctgatgacaaggatctgaaccagtatgtttccatgaagaagctagctccttacagggagagtgaatggaaggtaacacatcataagaagttgagcaaggacttgatccttggaggccagaagaaagaagggaaggacaaatctggcaagaaatctaagtctgcggaagggggccctagttcttcaaaacaagagaaagacaagctgccagttgaacaagagttaactgatgacaaggaaaagtctaccagaagcagacgaaggaagcgccgtaaagaggatctgaagctatccagtggtcgtctaggggcatatggaaagataaattcaaagcgtcacaagagcaattgagctttggaggttcatcaaagtacatctagggaattttgtttttcattttatgcattttggaaggggtgaatcttatctgagcagaggctttgcttcttctttgggagttgcaaaccagtgtcatcctagtagaatcatttctctgagttttgcagacagtgtttgcacctcctttcgtgaaccatataatttaattgccttgtttgctgctactacattgtgtgttactgtcatttccttctctaatttgcttgaattatcaaactatcctggtgatcgattggcatatgaactcatatatgcctattacacttgcctcgtactaatgttattattattgtcaaattttaatggtatgatgccttggccatgcc

SEQ ID NO: 5395 - DNA, 810 bp, Cajanus cajan
ggaacttccggagaattcttggtgttcctctctggaagctcccattctacttcgattacctttataaataatgaaaatccatttactcatgcgtcagcacagaatcgaagctattgataagaaaccacattacagagagaagagaagaaggaaatggatatcaggttgatggatttggattctccattgttcaacacattgcaccgaattatggatttgacggaggacgctgagaagaacttgaatgcgccaacgaggacatacgtgcgcgacgcaaaggcaatggctgcaacacctgctgacgtgaaggagtaccctaactcatacgtgttcgtgatcgacatgcctgggttgaaatctggggacattaaggtgcaggtggaggaggacaacgtgcttctcataagcggtgagaggaagagagaggaggagaaagaagggagcaagtatctgaggatggagaggagggttggaaagttcatgcgtaagttcacgcttcctgagaatgccaacacggatgccatatctgcggtctgccaagacggtgttctcactgtcactgtcaacaagttgcctcctcctgagcccaagaagccaaagactattgaggttaagatcgcttgagtttcttcaatgagaaccagttatatgtccctgttttcgagtttctgtgtgctgccaatgtttttgtaagttttcgtttatgcttattttgcctatcacactgtaatgcaatcatggctgatgtgatgcatgcttctatatgaatttcaatttcaataaatcatcaaattctaagtgttaaacttt

SEQ ID NO: 5396 - DNA, 809 bp, Glycine max
attttaaataccgaaaatgcagccatctacaagcacacgataacgagagaagagaagagaaggcaatggatatgaggttgatggatttggactctccattcttcaacactctgcacagaatcatggatctgacggaggacgccgagaagaacttgaacgctccgactcggacatacgtgcgcgacgccaaggcaatggctgcgactcctgctgacgtgaaggagtaccctaactcgtacgttttcgtgatcgacatgcctggcctcaaatctggggacattaaagtgcaggtggaggacgacaacgtgcttctgataagcggcgagaggaagagggaggaggaaaaagagaaagaagggggaaagtatttgaggatggagagaaggcttggcaagttgatgaggaagtttactctccctgagaatgccaacaccgatgctatctctgctgtctgccaagacggtgtgctcactgttactgtcaataaactgcctcctcctcagcccaagaagcccaggactatagaggtcaagatagcctgaattccaacttccaacgctatctatccctgtttttgttttctgtgtgccaatgcttttctatcgtgtctgctttatgcttatcacactgcaatttgatcatggatgatataatgcatgcttttgtatgaattttaatttccttcattcctattttttttatatgcttgaaaaaaattccctaatttacaagggaagaaacataaaattcgttttaaaaaaagtgacagggactatatatataactaaatgattttgctgcataagttg

SEQ ID NO: 5397 - DNA, 940 bp, Glycine max
tagaagcatgaagcgaacctcctggaacttccttctggaaactaccactccattttaaataccgaaaatgcagccatctacaagcacacgataacgagagaagagaagagaaggcaatggatatgaggttgatggatttggactctccattcttcaacactctgcacagaatcatggatctgacggaggacgccgagaagaacttgaacgctccgactcggacatacgtgcgcgacgccaaggcaatggctgcgactcctgctgacgtgaaggagtaccctaactcgtacgttttcgtgatcgacatgcctggcctcaaatctggggacattaaagtgcaggtggaggacgacaacgtgcttctgataagcggcgagaggaagagggaggaggaaaaagagaaagaagggggaaagtatttgaggatggagagaaggcttggcaagttgatgaggaagtttactctccctgagaatgccaacaccgatgctatctctgctgtctgccaagacggtgtgctcactgttactgtcaataaactgcctcctcctcagcccaagaagcccaggactatagaggtcaagatagcctgaattccaacttccaacgctatctatccctgtttttgttttctgtgtgccaatgcttttctatcgtgtctgctttatgcttatcacactgcaatttgatcatggatgatataatgcatgcttttgtatgaattttaatttccttcattcctattttttttatatgcttgaaaaaaattccctaatttacaagggaagaaacataaaattcgttttaaaaaaagtgacagggactatatatataactaaatgattttgctgcataagttggtgtgaggtatttaagttgtttcattctattaaagttagcaaaacaatagaatgatattttgaattcatttcatttcaat

SEQ ID NO: 5398 - DNA, 685 bp, Glycine max
ataaataccgaaaatgcacccggctaccggcacacgataacaagagaaaagagaaggcaatggctatcaggttgatggatttggactctccattcttcaacactctgcacagaatcatggatctgacggaggacgccgagaagaacttgaacgctccgactcggacatacgtgcgcgacgccaaggcgatggctgcgactcctgctgacgtgaaggagtaccctaactcgtacgttttcgtgatcgacatgcctggcctgaaatctggggacattaaagtgcaggtggaggacgacaacgtgcttctgataagcggcgagaggaagagggaggaggaaaaagagaaagaagggggaaagtatttgaggatggagagaaggcttggcaagttgatgaggaagtttactctccctgagaatgccaacaccgatgctatctctgctgtctgcctagacggtgtgctcactgtcactgtcaataagctgcctcctcctcagcccaagaagcccaagactatagaggtcaacatagcctgaattccaacttccaacgctatctatccctgtttttgttttctgtgtgccaatgcttttctatctttccgtctctgcttcatgcttatcacactgtaatttgatcatggatgataaaatgcatgcttttgtatgagttttaacttccttaa

SEQ ID NO: 5399 - DNA, 936 bp, Glycine max
attgggtaaacggaatgaatggggttggatttgacggaaattccaaatgggccatagcaaagaccaggcctgttgtgattctggagcatactagaagcgaacctcctggaacttcctaggctctggaaactaccactccattcctgtcagccttataaataccgaaaatgcacccggctaccggcacacgataacaagagaaaagagaaggcaatggctatcaggttgatggatttggactctccattcttcaacactctgcacagaatcatggatctgacggaggacgccgagaagaacttgaacgctccgactcggacatacgtgcgcgacgccaaggcgatggctgcgactcctgctgacgtgaaggagtaccctaactcgtacgttttcgtgatcgacatgcctggcctgaaatctggggacattaaagtgcaggtggaggacgacaacgtgcttctgataagcggcgagaggaagagggaggaggaaaaagagaaagaagggggaaagtatttgaggatggagagaaggcttggcaagttgatgaggaagtttactctccctgagaatgccaacaccgatgctatctctgctgtctgcctagacggtgtgctcactgtcactgtcaataagctgcctcctcctcagcccaagaagcccaagactatagaggtcaacatagcctgaattccaacttccaacgctatctatccctgtttttgttttctgtgtgccaatgcttttctatctttccgtctctgcttcatgcttatcacactgtaatttgatcatggatgataaaatgcatgcttttgtatgagttttaacttccttaattcctattttttttatatatgcttgaaaaaaattccctaatttataagggaagaaacataaaattcgttttaaaaaaagtgatagggaatatatata

SEQ ID NO: 5400 - DNA, 749 bp, Phaseolus coccineus
agcacagaatcaaagccacagataacgagatcattgtttctgcaagagaagaagaaaaggaaatggatatcaggttgatggatttggactctccattgttctccactctgcaccgaatcatggatctcacggaggacgcagagaagaacttgagtgctccgacgcggacgtacgtgcgggacgcaaaggcaatggctgccacacctgcggatgtgaaggaatatccgaactcttacgtgttcgtggtcgacatgcctggcttgaaatccggggacattaaggtgcaggtggaggaggacaacgtccttctcataagcggcgagaggaagagggaggaggagaaagaaggggccaggtatctgaggatggagagaagggttggcaagttcatgcgcaagttcacactcccagacaatgccaacaccgatacagtatcagccgtctgccaggacggtgtgctcaccgtcaccgtcaacaagttgcctcctcctgagcccaagaagcccaagactattgaggtcaagattggctaaatttcttgattttcaaaaatcggctccaacctgtttgcactgctatccctgttttcatgttctgtatgaggttatacggttttgtcttttccctgctgtgactgtctttcatgttcttgtttttggttatgagtgtgatctgaaccagagatataataatgcatgtcttttaatgaattttaaattttctaattcttccgctgctatttttttaaa

SEQ ID NO: 5401 - DNA, 903 bp, Phaseolus coccineus
atgaggcacgtggaagggaatcatccttctcgacaaccacaagcatgggaactaagtggcgaacctcctcgaacttcctactactattctgtgtttctttctggaacctcccattctaaccctgtcatccttataaatacccaaaatgcacccgccactcagcacagaatcaaagcaacagataacattgtttctgcaagagaagaagaaaaggaaatggatatcaggttgatggatttggactctccattgttctccactctgcaccgaatcatggatctcacggaggacgcagagaagaacttgagtgctccgacgcggacgtacgtgcgggacgcaaaggcaatggctgccacacctgcggatgtgaaggaatatccgaactcttacgtgttcgtggtcgacatgcctggcttgaaatccggggacattaaggtgcaggtggaggaggacaacgtccttctcataagcggcgagaggaagagggaggaggagaaagaaggggccaggtatctgaggatggagagaagggttggcaagttcatgcgcaagttcacactcccagacaatgccaacaccgatacagtatcagccgtctgccaggacggtgtgctcaccgtcaccgtcaacaagttgcctcctcctgagcccaagaagcccaagactattgaggtcaagattggctaaatttcttgattttcaaaaatcggctccaacctgtttgcactgctatccctgttttcatgttctgtatgaggttatacggttttgtcttttccctgctgtgactgtctttcatgttcttgtttttggttatgagtgtgatctgaaccagagatataataatgcatgtcttttaatgaattttaaattttctaattcttccgctgctatttttttaaa

SEQ ID NO: 5402 - DNA, 727 bp, Vigna unguiculata
aaataaaatcacatcagaagcagttgtttgtaggagagaagaaggaaagaaaatggatatcaggctgatggaattggactctcccttgttctccactctgcaccggatgatggatatgacagaggacgcagagaagaacttaagcgcaccgacgcggacgtacgttcgagatgcaaaggcaatggctgccacccctgtggacgtgaaggagtatccgaactcttatgtgttcgtgatcgacatgcctggcttgaaatctggggacattaaggtgcaggtggaggaggacaatgtgctaatcataagcggagagagaaagagggaggaggagaaggaaggggccaagtatttgaggatggagagaagagtgggaaagttcatgcgcaagttcacactcccagacaatgccaacactgatgccatatctgccgtctgccaggatggtgtgctcactgtcaccgtcaacaagttgcctcctcctgagcccaagaagcccaagactatcgaggtcaagattggttaaatttcttaattttcaaggtcttttgcactgcactacattacacctatctcaacccctgctttcatgttctgtatgaggttatatggttttgtgtctttccttcggtttttgttgttggtctcactatgaatgtgatctgaaatgcagtgatattattatgaatgctttgaaatgaacttaatttttctaaaaaaaaaaaaaaag

SEQ ID NO: 5403 - DNA, 734 bp, Vigna unguiculata
ggatagaaaataaaatcacatcagaagcagttgtttgtaggagagaagaaggaaagaaaatggatatcaggctgatggaattggactctcccttgttctccactctgcaccggatgatggatatgacagaggacgcagagaagaacttaagcgcaccgacgcggacgtacgttcgagatgcaaaggcaatggctgccacccctgtggacgtgaaggagtatccgaactcttatgtgttcgtgatcgacatgcctggcttgaaatctggggacattaaggtgcaggtggaggaggacaatgtgctaatcataagcggagagagaaagagggaggaggagaaggaaggggccaagtatttgaggatggagagaagagtgggaaagttcatgcgcaagttcacactcccagacaatgccaacactgatgccatatctgccgtctgccaggatggtgtgctcactgtcaccgtcaacaagttgcctcctcctgagcccaagaagcccaagactatcgaggtcaagattggttaaatttcttaattttcaaggtcttttgcactgcactacattacacctatctcaacccctgctttcatgttctgtatgaggttatatggttttgtgtctttccttcggtttttgttgttggtctcactatgaatgtgatctgaaatgcagtgatattattatgaatgctttgaaatgaacttaatttttctaaaaaaagaaaaaaag

SEQ ID NO: 5404 - DNA, 656 bp, Trigonella foenum-graecum
cggccgggataacaacaaaagcaatcaaaacgtgcaacaaacacaaaaatggatttcaggctaatgggtttggattcaccactcttcaacaccctccaccacataatggaccttacagacgacacaaccgagaagaatctaaacgcaccaacacgaacctacgttcgcgacgcaaaagcaatggcagcaacacctgcagacgtgaaagagtatccaaattcatacgtgttcgtggtggacatgccagggttgaaatctggtgacattaaggttcaggtggaagatgacaatgtgcttttgataagtggtgagaggaagagagaagaagagaaagaaggtggtaagtatttgaagatggagagaagggttggtaagtttatgaggaaatttgtgttacctgagaatgctgatgttgaaggtgtttctgctgtttgtcaagatggtgttcttactgttactgttaataagttgcctcctcctgaacctaagaagcctaagactattgaggttaagattgcttgagcgagcagtgtttgatttcaaccaacgtttgcagtttaagagctgtgtctgttctttttctattttgtttgtgtgtggcaatatggttgtgtaataatatggatatgaatgaattttaattgccatggttggtc

SEQ ID NO: 5405 - DNA, 557 bp, Lotus japonicus
aatcattgtaagaaatctaagctcctgaaaacaacacaacataaaatttacacacaagagaagaatcaaagacaaagaggcaatggatatcaggttgatgggtctagattctccactgctgaacacactgcaccacatcatggacctcccagacgactccaccgagaagaactctcacgctcccacccggacctacctccgcgacgccaaggcaatggcagccacccctgcggacgtgaaggagtacccgagctcgtacgtgttcgtgatcgacatgccggggttgaagtccggtgacatcaaggttcaggtggaggatgacaatgtgcttctcataagtggtgagaggaagagggatgaggagaaagaagggtccaagtatgtgaggatggagaggagggttggcaagttcatgaggaagtttgtgctcccggagaatgctaatgtccatgccatttctgctgtttgccaagatggtgtgctcactgtcacggtgaacaagctgccacctcctgagcctaagaagcccaagaccattgaggttaaggttgcttgag

SEQ ID NO: 5406 - DNA, 826 bp, Arachis hypogaea
tctcaccttatatatccaaacctgtcacgttttgtcaccgcatagaaacaaacaaaaacaatcttcaaagaagaagcaacaaaaatcgccatggatttcaggttgatgggactcgattctccattgctgagcaccattcaccacatgatggatatgagcgacgacaatgccgacgccaagaacatcaacgctcccacaaggacctacgtgcgtgacgcgaaggcgatggcggctactccggccgacgtgaaggagtatcctcagtcgtacgtgttcgtgatcgacatgccgggactgaagtccggtgacattaaggttcaggtggaggacgacaacgttctgatcatcagcggcgagaggaagagggacgaagagaaagaaggtgctaagtatttgaggatggagaggagggttggaaaattcatgcgcaagtttgtgctgccggagaatgcaaacactgatgctatctctgccgtgtgtcaagacggagttctcaccgtcaccgttcagaagcttcctcctcctgagcctaagaagcctaagactattgaggttaagattgcttgagctttgaccacccagctatcttcggttttcacggccattttaaataactatctagggtttccttcttcctcatcgtcatcatctttgtgttttgtgcttttttttcccccctttctttttaggttctgtgtatgcctcttggttgtgattactagaaatatgatcatttgatgtgatcattttatatgatgtttgttaatgcatatgattgtccatcttgtttcttacatccttctgttatttaccgatcttggtaatg

SEQ ID NO: 5407 - DNA, 782 bp, Cicer arietinum
ataacaaaaaccaacgagaacaaaacgagtgataaacataaaaacttctcccaaaaaaagcaatggatttcagattaatgggtttagattcaccactattgaacacactgcaccacataatgaacataactgacgacacaacagagaagaacctaaacgcaccaacacgaacctacgtacgcgacgcaaaggcaatggcagcgacacctgcagacgtgaaagagtatccaaattcatacgtattcgttgttgacatgcctgggttgaaatctggtgacattaaggttcaagtggaagatgacaatgtgcttctcataagtggtgagagaaagagagaagaagagaaagaaggggttaagtatttgaagatggaaagaagggttggtaagtttatgaggaaatttgtgttgcctgaaaatggtgatgttgaagggatttctgctgtttgtgaagatggtgtgcttactgttactgttaataagttgcctcctcctgaacctaagaagcctaagacaattgaggttaagattgcttgacctggatgtcttccattccatgtttgcagagcagcagttatgtccgttttttttagtttgtttttgtgacaatggttgtgtctttccgcaattgtctgaaatgataaactcatgatcatgcgatgtaatgtgtgctttaatatcaacatgaattttaattaccttgtgtgttttcaattttttttttagttgactatgtgcttccatcttttgttaatcatatggatattctttaagttctgttcg

SEQ ID NO: 5408 - DNA, 1111 bp, Cicer arietinum
tgagtttcgctcgcgaaactcctagaatagaaattcccagcgcttttttcttcttttctggaacctcccataatattcctaccacccttataaatactctacacattccccattttcaaacacataacaaaaaccaacgagaacaaaacgagtgataaacataaaaacttctccccaaaaaagcaatggatttcagattaatgggtttagattcaccactattgaacacactgcaccacataatgaacataactgacgacacaacagagaagaacctaaacgcaccaacacgaacctacgtacgcgacgcaaaggcaatggcagcgacacctgcagacgtgaaagagtatccaaattcatacgtattcgttgttgacatgcctgggttgaaatctggtgacattaaggttcaagtggaagatgacaatgtgcttctcataagtggtgagagaaagagagaagaagagaaagaaggggttaagtatttgaagatggaaagaagggttggtaagtttatgaggaaatttgtgttgcctgaaaatggtgatgttgaagggatttctgctgtttgtgaagatggtgtgcttactgttactgttaataagttgcctcctcctgaacctaagaagcctaagacaattgaggttaagattgcttgacctggatatcttccattccatgtttgcagagcagcagttatgtccgttttttttagtttgtttttgtgacaatggttgtgtctttccgcaattgtctgaaatgataaactcatgatcatgcgatgtaatgtgtgctttaatatcaacatgaattttaattaccttgtgtgttttcaatcttttttttagttgactatgtgcttccatcttttgttaatcatatggatattctttaagttctgttcacgagagattttttattaataaatggatctgtctagaagtctagtgacttattttagagataatgtatagtttacaattaaggttaaagaaattaagaaataagtgactaaagctcaacttaaaattggatgaaccttttaagtttcagatcctacgggaatattatttaagcaacatttggttgggaatgacatttgaaatatggt

SEQ ID NO: 5409 - DNA, 766 bp, Medicago truncatula
atcgaaactcctagaatttcctcccataatcttccaaccacgctaataaataccccgcattctccacgaagcacgcataacgaaaataatcatcaaacataaaatctctaccaaaacaacaacaacaatggatttcaggttgatgggtttggattcaccactcttcaacaccatccaccacataatggacctcacagacgacacaacagagaagaatctaaacgcaccaacacgaacctacgttcgcgacgcaaaagcaatggctgcaacaccagcagacgtgaaagagtatccaaactcatacgtgttcgtggtggacatgccagggttgaaatctggtgacatcaaggttcaggttgaagatgagaatgtgcttctgataagcggtgaaaggaagagagaagaagagaaagaaggtggtaaatatttgaagatggaaagaagggttggtaagtttatgaggaaatttgtgttaccagagaatgctgatgttgaaggtggtgtttctgctgtttgtcaagatggtgttcttactgttactgttaataagttgcctcctcctgaacctaagaagcctaaaactattcaggttaaggttgcttgagaatgaatcaatgtttggagaataagggctatgtctgcttttttgttttagtctgtttgtgcgtgtgtggcaatggttttttgtcttttgtaattgccgattatcatgctatgtactagtaatgtgtaataatctcagtatgaatgaattttgatttgccta

SEQ ID NO: 5410 - DNA, 1055 bp, Malus domestica
accaataatcctctttattatttaatactattttccaaatattgtcctttttattttcccaaaaaatctggagaatgactaaagaagcactgcctttagtaaaagttttaaaccttccaaaccgttctagacgctcatagaagaattagaatttagacgaacctactggaaccccctgctatattccccgtgtctccagaaccttccttcttcccttcccgctaacccgcgtcccccactcaactcctcctataagtacgcatccaccgcccccctccatcacagcgactagaaattcctactcaaaagttcaccaaagcctgcaaatcaacaccgaaaagcgaaaattccacccaccaagaagcgaagaatggacatcagaatccccggttttgatgccccactcttctccacactgcagcacatcatggacgtcgccgacgacgccgagaagtcattcaacgcccccacccggacctacgtccgcgacgccaaggcgatggccgcgacgccagccgacgtcaaggagtaccctaactcctacgtgttcgtggtggacatgccagggttgaagtccggggacataaaggtccaggtggaggacgacaatgtacttctgatcagcggcgagaggaagcgggaggaggagaaggaaggggttaagtacgtgaggatggagaggagggttggcaagttcatgaggaagtttgtgctgccggagaatgcgaatgtagatgcgatttctgctgtttgccaggatggggttctgactgtgacggttgagaagctgccgccaccggagccaaagaagccgaagacaatcgaggtcaagatcggttgagactttagagtgctgttcctgtgatttgggttctgagagtaatcatgcggggactataaattaatggtttgcgggtagattttagtgcttcgttgtaattactgaaggtgtgtacgtgttttctttgtgttttggtgttccaagcatgtttggtttttcaggtcaatgaagcatatcgtgtattaatacctacttcaatctctgttaatccttt

SEQ ID NO: 5411 - DNA, 730 bp, Malus domestica
caaaagttcaccaaagcctgcaaatcaacaccgaaaagcgaaaattccacccaccaagaagcgaagaatggacatcagaatccccggttttgatgccccactcttctccacactgcagcacatcatggacgtcgccgacgacgccgagaagtcattcaacgcccccacccggacctacgtccgcgacgccaaggcgatggccgcgacgccagccgacgtcaaggagtaccctaactcctacgtgttcgtggtggacatgccagggttgaagtccggggacataaaggtccaggtggaggacgacaatgtacttctgatcagcggcgagaggaagcgggaggaggagaaggaaggggttaagtacgtgaggatggagaggagggttggcaagttcatgaggaagtttgtgctgccggagaatgcgaatgtagatgcgatttctgctgtttgccaggatggggttctgactgtgacggttgagaagctgccgccaccggagccaaagaagccgaagacaatcgaggtcaagatcggttgagactttagagtgctgttcctgtgatttgggttctgagagtaatcatgcggggactataaattaatggtttgcgggtagattttagtgcttcgttgtaattactgaaggtgtgtacgtgttttctttgtgttttggtgttccaagcatgtttggtttttcaggtcaatgaagcatatcgtgtattaataccta

SEQ ID NO: 5412 - DNA, 806 bp, Euonymus alatus
agtgaaagcatagaacaatcatcagactcaaggcgacattttcaccaaataaagcgcaagatttctccgacgggaaggaagcgaaagatggatttcagaatcgtgggttcggattccccgatcttcaacactctccaccagttgatggacatcggtgaagatgccgagaagtctttcaacaacccttcccgcacttatgtacgtgacgccaaggccatggcggctactccggcggatgtcaaggagtacccgaattcctacgtcttcgttgttgacatgcctgggctgaaatctgatgacatcaaggtgcaggtggaggacgacaatgttctgctgattagtggtgaaaggaagcgcgaggaggggaaagaagaggccaagtatgtgagaatggagaggcgcgttgggaagtttatgaggaagtttgtgctgcctgagaatgccaacactgatgcgatttcagctgtttgtcaggacggtgtgttgactgtcactgttcagaaactgccaccgccgcagcctaagaagcccaagaccatcgaggttaagattgcctaaaatatataggggataatgtggtctgagtaatggtttgatgtgaaataactcgtgctatgctaagtgttccgtctttactgaattcctctctgcagtcttttactttcaatgatgtttgttattgaagtgatgtgttcatgtttggttatgttcgtcttcgttatgtctaataaatgctattttccctcgtttctcctctgctgtctgtatccaacgtttctgcccttgtacttgaggttctgtctgga

SEQ ID NO: 5413 - DNA, 893 bp, Vitis vinifera
tataaaaaccacaccacggccgaggtttcgtcatcagaaaatcagttctgcattttcatttacaaatcgtcgccaatctaacagactaatcgctgcaaagcgggatggatttgagggtcatggattttgattctccactattctcaaccctgcaacacatgctcgacgccgttgaagattccgataaatctctcaacgctcccactcgcacctacgtccgcgacgccaaggccatggctgcgacaccggctgacgtcaaggagtacccgaatgcctacgccttcatcatcgacatgccgggcctgaagtccggcgacatcaaggttcaggtggaggacgacaatgtgctgatgatcagcggcgagaggaagcgtgaggaggagaaagaaggcgccaagtacgtgagaatggagaggagggtggggaagtttatgaggaagtttgtactgccggagaatgcgaatactgataagatctccgcggtttgtcaagatggggtgctgaccgtcactgttgagaagctgccaccgccggagcccaagaagcccaagacaattgaggtcaaaattgcttgaaatattgagggttttgggaatgtttttctgggtttttaatagcaaacaatatggtattgtgggtgtgcccaggtggcttttgtttgggtttgatcttggtcaattgctaggcgtgatgaagatggtgatctcttcattacactgcaatgtgtagttctgaattttcagtaccgtcaataaaggattaaagtctaccttttcttttccttggtctgttttcatttttttcctgcaaaaattttaagatttcatggcaagtaaaaaagctagtaaggtggtgtttcctctggttgacaactatatcataaggtccttttt

SEQ ID NO: 5414 - DNA, 772 bp, Pisum sativum
caaaaatcaaaacgtgcgacaaacacaaaatcatcccacaaagaaagcaatggatttcaggctaatggatttggattctccactcttcaacactctccatcatataatggacctcaccgacgacacaaccgagaagaacttaaacgctccaactcgaacatatgtccgtgacgcaaaggcaatggctgcaactccagcggacgtgaaagagcatccaaattcatacgtgtttatggtggacatgcctggggtgaaatctggtgacataaaggttcaggtggaagatgagaatgtgctattgataagtggcgagaggaagagagaagaagagaaagaaggtgttaaatatttgaagatggaaagaaggattggtaagttgatgaggaaatttgtgttacctgagaatgcgaatattgaagctatctctgctatttctcaagatggtgttcttacggttacagttaataaattgcctccacctgaacctaagaaaccaaaaactattcaagttaaggttgcttgatcggtgtacgatttcatgtcaacaaatcagaaggaatgtttgtctttttagttggtttgtgtagcaatggttttgtgtgttttcgcctagttggccctatatatgatgatcatcatgcgatgtaatttgtaacaatatgacatgaatgaattttaattacttggtttttctgcttgtaacattgttgcgttgcccccatgataaaattgagaaactgaagtattaaagaaaagaaaatgtttcatttac

SEQ ID NO: 5415 - DNA, 972 bp, Juglans hindsii x Juglans regia
attgcacagggaattcgaacaatggaacctcctggagcctcccaatttcttcaatgtccctctagaactttcctcttctccattgccccggtactgactggcttcctatgcacctataaattcccagaagcacctctcctttttacctcagagtaaatcgaacaatcccattccagaagtttccaagaaagttttctagcatttcgcgtccgcaacgagactaacctactcataagagtgaaatggatctcagaatcatgggtgtggattctccactgttctccactctgcatcagatgatggacctgaccgaagacaccgacaagtcttccttcaacgctcctacccgtacctacgtgcgcgacgccaaggccatggctgccactcccgccgatgtcaaggagtatccaacttcctacgtcttcatcatcgacatgcccgggctcaagtctggggacatcaaggtccaggtagaggatgacaatgtgctggtgattagcggcgagaggaaacgagatgaggagaaagaggggccaaagtacgttaggatggagaggaggatcgggaaatttatgaggaagtttgtgctgcctgagaatgccaacacagatgctatctccgcggtttgccaggacggcgtgctgactgtgactgtggagaagcttccgcctccagaacccaagaagcccaagacaattgaggttaagattgcataagcttgcagtagtcggtgggatgggcgacaagattaggctatgactgtgttgtggatttggtcggatcatgggaataatcgagtattttgtgtcgttcgtgtgttctgtctttgcttgcaagtggattttgtctgtgtcatatgtaggatttcaagttattatgcctacggtttgatggtagaaaacagttcttacaaatgatgcatgtgctattatgatataaacagcatttttatcttctggatgttttcatttg

SEQ ID NO: 5416 - DNA, 857 bp, Malus domestica
ctggaacctcctcccttccttccacgtttctccagaacattcattttccctccccgctaacccccgtcctccctcaactcctcctcctataaatgcccataaccaccactcccctccgtaacagcgaccagattccgactcgaaaattcacaaaagccttcaaatcgaaaccgacaagcgaaaattccacccaccaagaagggaagaatggatgtcagaatccagggtttggatgccccgctcttctccacacttcagcacatcatcgacgccgccgacgacgccgagaaatccttcaacgcccccacccggacctacgtccgtgacgccaaggccatggcctccacgccggcagacgtcaaggagtacccgacctcctacgtgttcgtggtggacatgccgggactgaagtccggggacatcaaggtccaggtggaggacgacaatgtgcttctgatcagcggcgagaggaagcgggaggaggagaaggaaggggctaagtacgtgaggatggagcggagggtcggcaagttcatgaggaagtttgtgttgccggagaacgcgaacgtggatgcgatttctgctgtttgccaggatggggttttgactgtcacagtgcagaagctgccgccgccggagccgaagaagccgaagacaatcgaggtcaagattgcttgaaactgtttctgtgatttgggttatgagaataatcgtgcagggattataacataagggtttgtgtgtggattttagggcttcgttggtgtattctggatgtgtttgttatgtttgtgttgtggtattataagcttgttggtttttcagatcaatgaagcatattatgtgttttatttcca

SEQ ID NO: 5417 - DNA, 705 bp, Hevea brasiliensis
ttcgagcggccgcccgggcaggttacgtctgctagagaagaaaaggaagcttctgttccgtgcttgtgataaaatcgtcgattgaagaaaaaagaaatggatattaggttgttgggtctcgaatctcccctcttttccaccatccagcatctgatggacacgaccgatgaagccgaaaagtcattcaacgcgccgactcgaacttatgtaagggacgcgaaggccatggcttcaactccggctgacgtcaaagagtatcccaactcctatgtgtttatcatcgacatgccagggttgaaatctggggacatcaaggtccaggtggaggatgacaatatgctgctgatcagcggagagaggaagcgtgaagaggagaaggaaggtgctaagtatgtgaggatggaaagaagggtcggcaagttaatgaggaagtttgtgctgcctgaaaatgctaatgctgatgccatttcggcggtctgccaggatggggttttgactgtcactgtggagaagttgccaccgccggagcccaagaagcccaagaccattgaggttaagattgcttgagtattattgtgtaccatctatggactatgactatgagcagtgtgtttggctatgttgtgtttgggtgttgatgtgtatctgagatgttataaaagttgcttttagaattaaacaaaacctgcccgggcggccgctcga

SEQ ID NO: 5418 - DNA, 831 bp, Vigna unguiculata
aaataaagaacccaacagctgagttctagaactttgtagaaggataagacctcggaagaagatgcacataactgaagctactagaatatagagaaagattccacagcacgcttttatttctccggaaacttccatttttttctggaataatctatgtccctcttataaatagctgtttccattccctcttctccatagaaagcgatggatttcagagtgatgggtttggaatctccactgttccacacgctgcaccgcatgatggacatgtcggaggagggtgcaggggagaagacacacaatgctccgacacagacatacatgcgagacgcgaaagcaatggctgcaacacctgcggatgtgaaggaatatcccaattcctacgtgttcgtggtcgacatgccggggttgaaatctggtgacataaaggttcaggttgaagatgataacgtgcttttgattagcggggagagaaagagggaagaagagaaagaagagaaagaaggggtgaagtttctgagaatggaacggagggttgggaaattcatgcgcaagtttgttttacctgaaaatgcgaacactgatgcgatctctgctgtgtgtcaagatggtgtgcttagtgttactgtgcagaaattgcctcctcctcaacctaagaagcctaggaccattgaagtcaagattgcttgagattcaagaacagaacaaatgaatgttgttttgaactgttgggggtttacaagatgttttagcttggtttggttgtaatttcttatctgtgtccactgttgtttttgtagttttgtgataatatcagcaatgattttgaca

SEQ ID NO: 5419 - DNA, 845 bp, Vigna unguiculata
  misc_feature (691)..(691): n is a, c, g, or t
aaataaagaacccaacagctgagttctagaactttgtagaaggataagacctcggaagaagatgcacataactgaagctactagaatatagagaaagattccacagcacgcttttatttctccggaaacttccatttttttctggaataatctatgtccctcttataaatagctgtttccattccctcttctccatagaaagcgatggatttcagagtgatgggtttggaatctccactgttccacacgctgcaccgcatgatggacatgtcggaggagggtgcaggggagaagacacacaatgctccgacacagacatacatgcgagacgcgaaagcaatggctgcaacacctgcggatgtgaaggaatatcccaattcctacgtgttcgtggtcgacatgccggggttgaaatctggtgacataaaggttcaggttgaagatgataacgtgcttttgattagcggggagagaaagagggaagaagagaaagaagagaaagaaggggtgaagtttctgagaatggaacggagggttgggaaattcatgcgcaagtttgttttacctgaaaatgcgaacactgatgcgatctctgctgtgtgtcaagatggtgtgcttagtgttactgtgcagaaattgcctcctcctcaacctaagaagcctaggaccattgaagtcaagattgcttganattcaagaacagaacaaatgaatgttgttttgaactgttgggggtttacaagatgttttagcttggtttggttgtaatttcttatctgtgtccactgttgtttttgtagttttgtgataatatcagcaatgattttgacatttctcaaatttct

SEQ ID NO: 5420 - DNA, 794 bp, Nicotiana benthamiana
aaagcaaaaacgcaattcaaatacagcaaaacaaaattctacattgaacagtatctcaaattgaaaccaattcaaccaagaagacgaagatggatttcaggctaatgggaatggacacaccattcttccacactctccagcaactcatggacgccgccggtgaagattccgacaagtccgtgaatgccccatcgaggaattatgtacgtgacgccaaggcaatggcagcaacaccagctgacgtgaaagagtacccaaattcctacgttttcgtggtggacatgccagggttgaaatctggagatatcaaagtgcaggtggaagatgacaatgtgctgctgataagtggagaaaggaagagggaagaagagaaagaaggggctaagtatatcagaatggagagaaggattggcaaattcatgaggaagtttacgctaccggagaatgctaatactgatgcgatttctgctgtttgtcaagatggcgttttgactgtgactgttcagaagttgcctcctcctgagcctaagaaacccaagactatcgaggttaaaattgcatgaggtattggagttgttattaattactctgttttctggacttgggaatggaagttctctgttttgatatttgatggtttggtgtaataacgatgttggagatctaggagcagcaatcttatgcttttctgtctttaagttctctactactatgttttatgagtatgatgaatagaaaatgtgccaatatgctatatcttgtggttaatgcaagtgaaattctacttttatgtc

SEQ ID NO: 5421 - DNA, 1116 bp, Populus trichocarpa
gggacttcaaatagtaagtcttggcaattactttttgggctcctcgtaaagactgggcactattgcttcttctatgaacattctagacccaactcgtatacccagcagaaacccctggaaagtcccttcagtttctacatctctccagaaactcccatttctccacccccaatatccctctataaataaccaccctccccacgacgagttcaaacacctgcaagagaagaaacactaaaaaaatcacacaagcgaaaactccagcgagaagagaaagatggatttcagaatcatgggtcttgacgcgccactcttcaacaccctccagcacatgatggatgcaagtgatcatgaggcagacaagtccttcaatgcgccaacacgcacttacgtacgtgatgccaaggcaatggcatcaacaccagctgatgtgaaagagtatccaaactcttatgcgttcgtcattgacatgccgggactgaaatcaggggacatcaaggttcaagtggaggatgacaatgtgctggttattagtggagagaggaagcgcggagaggagaaagaaggggccaagtatgtgagaatggaaaggagggttggtaagtttatgaggaagtttgtgttgcctgagaatgctaacactgacgctatttctgctgtttgtcaagatggggttctgactgttactgttgagaaattaccacctcctgagcctaagaagcctaagactatcgaggtcaagattgcttgaagaagaatgcttgattacatatataatgtggcttgttctgtgtgctaaggtgatgataaataatgagggttttgctgggtgctttgcttgggggtgtgggataattttgagtatgtttgcgtttgaatgagttcattattagttttctctttaggaaactagtgattgtttgttcaaaacgtggtatgaaatatatgaatgtagtggtggcgttatatattactttttctttctacttggttgctttactctaattcatatgtatttttaggtttctgccaattttcttcccctgaacatcttcatctctgatattttcgaggtttatttggaattctcgactatcattgcatgatagagctaca

SEQ ID NO: 5422 - DNA, 730 bp, Jatropha curcas
attccgaaaatatctagttgcacttcatatctctaaagatctctcgcgaaaacactaggaaaaatggatgtcaggttcgtaggtctcgattcaccacttctccacactctccagcaaatgatggacattggcgacgatgctgaccacaaatccttcaacgcgccaacacgcacttatgtgagggacgcgaaggctatggcttctactccggccgatgtcaaagagtatccgaattcttatgtgttcattatcgacatgcctggattgaagtctggagatatcaaagtgcaggtggaagatgataatgtgctgttgattagtggagagagaaagcgtgaggaggagaaggaaggagctaagtatgtgaggatggaaaggagagttggaaaattgatgaggaagtttgctctgcctgagaatgccaatactgatgccatttctgctgtgtgtcaagatggggttttgactgtcactgtccagaaattgccaccgcctgagcctaaaaagccaaagactattgaggttaaaattgcttgagctcagaggatcgttttgtcacgtttgactgcgtgctggaaataatttgggctatgttgaaatcgtaatctgcttgtgtttttctttttgggtgttttcgtctgacattagtttctgatgaggctgatgtttactagaaatattataaagtctattaagtattttcctctaaaaaaaagggggggcccggtac

SEQ ID NO: 5423 - DNA, 756 bp, Malus domestica
tccgttgctgtccagatttccactcgacaattcacaaaagccttcaaatcgaaaccaaagagcgaaaattccacccaccaagaagcgaagaatggacctcagaatccccggtttggaagccccgctcttctccacacttcagcacatcatggacgccgccgacgacgccgagaagtccttcaacgcccccacccggacctacgtccgcgacgctaaggccatggcctccacgccggcagacgtcaaggagtacccgacctcctacgtgttcgtggtggacatgccgggactgaagtccggggacatcaaggtccaggtggaggacgacaatgtgcttctgatcagcggcgagaggaagcgggaggaggagaaggaaggggctaagtacgtgaggatggagcggagggtcggcaagttcatgaggaagtttgtgttgccggagaatgcgaacgtggatgcgatttctgctgtttgccaggatggggttttgactgtcacagtgcagaagctgccgccgccggagccgaagaagccgaagacaatcgaggtcaagattggttgaaacttttgagtgctgtttctgtgatttgggttctgagaataatcgtgcagggattataacataagggtttgtgtgtggatttcagggcttcgttggtgttttctggaagtgtttgttgtgtttgtgttgtggtattataagcttgttggtttttcagatcaatgaagcatattatgtctttacttcctatttca

SEQ ID NO: 5424 - DNA, 1547 bp, Euonymus alatus
ggaccctataaataactggccacatcgtgcatcgaaatacataggaaaacagaaaagaaaaaatcatcactctctttgaaattcgcgaattctgtaaaaccaagcgaagatttccacggtgggaaggaagcgaaagatggatttcagaatcatgggtttggatgctccaatcttcaacactctccaccaaatgatggacatcggcgaagacgcagagaagtcgttcaacaacccgtctcgcacttatgtccgcgatgccaaggccatggcggctactccggcggatgttaaggagtacccgaattcctacgtcttcgttgtcgacatgcctgggctgaaatcaggtgacatcaaggtgcaggtggaggacgacaatgtgctggtggttagtggtgaaaggaagcgtgaggaggagaaagaaggggctaggtatgtgagaatggaaaggcgggtcggcaagtttatgaggaagtttgtgctgcctgagaatgcaaacattgaagcgatttctgctgtttgtcaggatggtgtgttgactgtcaccgttcagaaattgccaccaccggagcctaagaagcctaagaccattgaggttaaaattgcctaaatttggggataatatgatgggagtcatggttgcctggttgaatatgaaatagttcgtgctatgtgggtgttagtctctctgccttttttaatgttcggtgatgtttgttttgtcatattaagtttgtgtttgcttgtattctcctcaactatgtagtgaatgagaattaacctgttatgcttaattgatgctgtttcctcaaaccagcaaacacacactttagcattactagtactactgctacaatggccaagctcgtaatcttcctagccaccttggccgtactactcctcctcacggaggcctccatataccgcaccaccatagagattgacgaggaaaacccaagagatccaaggaaatgccaggagcagatccgggagcaacagaacttgaagaagtgccaagagttcatgaggcaacagagcggctgccgtgattactctcgacgacaacagctcgaccaatgctgtgaccaactggagcagctggactccaagtgccggtgccaaggtctagagcaagcagtcaaggagcagctacagggccagagaggaaaccgacagtctgaggaggaaaggaagttgtatgatgttgcaagggatataccttccaagtgtgacatgaagcccagggagtgccagtttagcagtcctagggtttgggttctagaggaaggaagaggtaattatgtaataataataataataataaaacgtggttgcatatatgcatatctctagcaagagattagtgtgtgtaacatgttttagttgtgtcttgtaataataaaaagcacattatcgtgtgtgtaagagtcttatgtatgtataatcagagtcttttttttttgtatatcaagctttgaggctatctacgttaatccaagtgttaatgtgtttcttcaattacttaattacttatatatatatatcttgtt

SEQ ID NO: 5425 - DNA, 879 bp, Prunus persica
atggccccgccccctgcaatgtcttcatacaccctacgtctctctctctctctctctctctctctcttagccatattgcaattacactcaattcttgtcaaagcaacaaaaattcagagacaccttcagagtttaaacaaagcgctaagcaagcacaaattcaaagcgagaattccagccagcaggaagagaaacatggacgtgagaatcgcgggtttggattccccactcttctccacactgcagcacatcatggacttcaccgacgagcctgacaaatcgttcaacgcccccacccgcacctacgtccgcgacgccaaggccatggcgtccacgccggcggacgtcaaggagtatcccaactcctatgtcttcgtcgtggacatgccaggcctcaagtccggagacatcaaggtccaggtggaggacgacaatgtgcttctgatcaccggcgagaggaagagggaggaggagaaggagggggctaagtatgtcaggatggagaggagggtcggcaagtttatgaggaagtttgtgctgcctgagaatgctaatgtggaagccatttctgctgtatgccaagatggggtcctgactgtgactgtggagaagctgcctccacctgagccaaagaagcccaagaccattgaggtcaagattgcttgaggagttttctctgagatttgggtttatgagcttcattatgcttatagcttatgataagggcatgggttggttttaaggccttttggtattaatccggatgtgtttcattttcttgtttgtttgtgttctggtgtgctaagcttttgcattttctgatcagttgtgaagtgcggcttttatcaatgaagcatatgtttgtaatatttcttcttc

SEQ ID NO: 5426 - DNA, 928 bp, Fragaria vesca
gtttacgaagactggaaaggattaaagacgaacctactagaacctccttacatccttccacgtgtctccagaactttccaaacttcccacacagccatcaacgccactcactccctccctcgcctataaatccccattaccgctgccccaaatatccacacagaaattccaaatcactcaagaacacacaaaagctctcagaatcaaacattccccaagccacgaagagaacaatggatttcagaatcatgggtctggatgctccaatcttgacagcattgcagcacttggcagatcttcctgaggatgccgagaagaccttcaacgcgccgacccgtacctacgtccgcgacgccaaggccatggctgcaactccggccgatgtgaaggagtacccgaattcctatgtgtttgtgatcgacatgccggggctcaagtcaggggacatcaaggtgcaggtggaggatgacaatgtgcttgtgatcagcggagagaggaagagggaggacgagaaagagggggctaagtatgtgaggatggagaggagggttggtaagtttatgaggaagttttcgctgcctgagaatgctaatgttgaagccatttctgctgtttgccaagatggtgttctgactgtcaatgtggagaagctgccgccgcctcagccaaagaagcccaagactatcgaggtgaagattgcttaagagtttatgtgtgatgtgggttgttttctgaataattagggtgatgggtatgagtgaaatgtagggggattaccagtgtgctttccatatgatgttttgtgtttgtggtcttatttctactgttgtccaatcggatgtattatgaatggtttcatctatgaagttatgtttaatcatctcccttctctttttgtttgttttcaaagcaaaatcctgcaaatctc

SEQ ID NO: 5427 - DNA, 703 bp, Cannabis sativa
tcagacatggatttcagaatcttgggattggactctccactcttcacaacactcaaccaaatgatcgacaattccgaagattccgccgatcacagcaaatccatcaacgctccgaccagaacttatgtccgtgacgccaaggccatggcggccactccggctgacgttaaggagtacccgaactcctacgtcttcatcatcgatatgccggggctgaaatccggcgacatcaaggttcaggtggaggacgacaatgtgcttctgatcagcggcgagaggaagagagaggaagagaaagaaggagctaagtatgtgaggatggagaggagagtcggaaaattcatgaggaaattcgtgttgcctgagaatgctgatactgacgccatttcggccgtttgccaggatggtgttctgactgttactgttcagaagcttccaccaccggagccgaagaagccgaagactattgaggttaagattgcttgaaaaatcaatgggtactgttgtaggctgtttggatatgaggaatgtttctgtttggtttggttatcctgtgtttgcttcttttggttttgttgtgattaaatgaaaaatgggtacgttttcgtattcatagtagttgtatgaattttcatcgagttttaatcgaaattagtactgtttgttttcgtttaccgaaatttaaagaaacataaattcatat

SEQ ID NO: 5428 - DNA, 2857 bp, Ricinus communis
aatatcttcttcttcttctttttttttgttgttttccacatggttttatatttttcgcattatttaaaaggaaacgacggcgttcggatctttactataaccggccaatttcattgctcaatactcgatagtgatctcgtactttgcactgcctgcttactgctaccagcaaggacaccccaaaaagaaaggaatgggcaagaagaagaatatgttatatactaaaccaccatcaggagccgccgggaaatctgagacccggcagctaaccagacccgagaggtcaggcttttatgcgagaagagaagctgcaaacgttttaaaaagagttcttcaaggccacgctcaacgtcgagctactggctcaatcaaatccctcgtttatagtccttctgttaggaacaaaagggctacttttgcccttgtttgccaaaccctaaagcatttacctgttattaaggatgtattggagtctgctggtgcactcaatacccactctaagaaaaaagaggaactgatgtacatagtcgcatatgacattctatttggtcaggaaatcccattggttgttggtgatgtcgagaaatttctcttgcgccggaaaaatgatcttcagagagctctagcaaaggttttagtaaggaagaaagcgaagaccattgatgatttgcttgctctttatcgaccccctgatgtctcaaaaccttgttacgttcgtgtgaatactctaaaatcagatgttgattctgctttacttgaactaggaagacaattcacggtacagaaggatgacatggtacctaacctgtttgtactgcctcccaacagtgatctacacaatcatcctctggttttggatggtagcatctttgtccagggaaaggcaagttcaatggttgcagtagcccttgatcctaaacctggttgggaggttcttgatgcatgttcagctccaggaaacaaaactgtccatgttgctgcactcatgagaggaaagggtagaattatagcatgtgaattgaataaggacaggattaagcgtctagaagacactgtcagactctctggtgccgctaacattgaagttcgtcattgtgatttcttgaacttaaatccaagagacagtcctttctccaagatccgtgctattcttttagatccttcttgttctggatccgggactgctgctcagagattagaccatttactcccgtctcatgctactgatcccaataatatggaaagactgaagaagcttgcggcttttcaaaagaaggctctggcccatgcattatcttttccagcagttgaaagagtagtttacagcacatgctctatcaaccaaactgaaaatgaagatgtcattatatcaatcctacctattgctgcatcccatgggtttcagctggttacgccctttcctcagtggcatcggcgcggactctctgtttttgagggctctgagcatttacttagaacagatccagttgaggacaaagaaggcttcttcattgctctctttgtcaagaaaggcactgttgatgagtcggggaaactacccaaaaatgttcctgtctctctggcaactgaaaaatataagcttaaaaggaaaagccatgtgaataggaaaaaactcttgatgcctctactctttaatagagtatccaaattttggttgcttaactgatattgcagattaagttagacgcagcagaagaagaattccacatatatattgaaacaaatgatatgttgcaatttttcttttctttttgggcttgacttgtttgttatttccttcttgcgttaatcgtcccccattagtctgttgaagctctgttttgaagcttattatctacaattagccagttgacttttgttctcttcttctgggaatgaattactaagttcgagagcattgcaagttcttattgagctgaaaatcaaattgatttactcttgcgtccaatattaattaaccagtatgaataggaaaatagacgaatgaattatatcttttctattttattattctctcacggtttctaatagtaagtaggtgaggcatttgttgacgttcttattttcatggagaagatgaggaagatatttcgataaaagcccttaattttattgagatctatgataacatatctactatataatagcctcgatctagaagccaaaccatcactcgaaaacagcacagcacacaccgagaaaattggaaaagaaaaacaaacatagcgccaaatcttacttgatatctttcataatcgatccaacagaggtcccccagatgcacaacccgtcttcaagcaatcttaacctcaatggtcttgggcttcttaggctcaggaggaggcagcttctcaacagtaacagtcaaaaccccatcttgacaaacagcagaaatagcatcggtattagcattctcaggtagcacaaacttcctcataaacttgccaaccctcctctccattctcacatacttggctccttctttctcttcttgacgcttcctttcaccactaatcaacagcacattgtcgtcttccacttgcaccttgatatctcctgactttagccctggcatgtctatgataaacacgtacgaatttggatactccttcacgtcggctggagttgatgccattgcctttgcatctctcacgtaagtgcgtgttggagcgctgaaagacttgtcggattcatcgccgtgggtgatgtccatcatttgttggagggtttggaagagcggtgaatcgatgcccattaacctcaaatccattttccttttcttggtcgcaggaacttccgagtgttttttgcttcttttctttttcagctggaactt

SEQ ID NO: 5429 - DNA, 688 bp, Ricinus communis
agaaaagaagcaaaaaacactcggaagttcctgcgaccaagaaaaggaaaatggatttgaggttaatgggcatcgattcaccgctcttccaaaccctccaacaaatgatggacatcacccacggcgatgaatccgacaagtctttcagcgctccaacacgcacttacgtgagagatgcaaaggcaatggcatcaactccagccgacgtgaaggagtatccaaattcgtacgtgtttatcatagacatgccagggctaaagtcaggagatatcaaggtgcaagtggaagacgacaatgtgctgttgattagtggtgaaaggaagcgtcaagaagagaaagaaggagccaagtatgtgagaatggagaggagggttggcaagtttatgaggaagtttgtgctacctgagaatgctaataccgatgctatttctgctgtttgtcaagatggggttttgactgttactgttgagaagctgcctcctcctgagcctaagaagcccaagaccattgaggttaagattgcttgaagacgggttgtgcatctgggggacctctgttggatcgattatgaaagatatcaagtaagatttggcgctatgtttgtttttcttttccaattttctcggtgtgtgctgtgctgttttcgagtgatggtttggcttctagatcgaggctattatatagtaga

SEQ ID NO: 5430 - DNA, 482 bp, Ricinus communis
aaaatggatttgaggttaatgggcatcgattcaccgctcttccaaaccctccaacaaatgatggacatcacccacggcgatgaatccgacaagtctttcagcgctccaacacgcacttacgtgagagatgcaaaggcaatggcatcaactccagccgacgtgaaggagtatccaaattcgtacgtgtttatcatagacatgccagggctaaagtcaggagatatcaaggtgcaagtggaagacgacaatgtgctgttgattagtggtgaaaggaagcgtcaagaagagaaagaaggagccaagtatgtgagaatggagaggagggttggcaagtttatgaggaagtttgtgctacctgagaatgctaataccgatgctatttctgctgtttgtcaagatggggttttgactgttactgttgagaagctgcctcctcctgagcctaagaagcccaagaccattgaggttaagattgcttgaag

SEQ ID NO: 5431 - DNA, 489 bp, Ricinus communis
aaaaggaaaatggatttgaggttaatgggcatcgattcaccgctcttccaaaccctccaacaaatgatggacatcacccacggcgatgaatccgacaagtctttcagcgctccaacacgcacttacgtgagagatgcaaaggcaatggcatcaactccagccgacgtgaaggagtatccaaattcgtacgtgtttatcatagacatgccagggctaaagtcaggagatatcaaggtgcaagtggaagacgacaatgtgctgttgattagtggtgaaaggaagcgtcaagaagagaaagaaggagccaagtatgtgagaatggagaggagggttggcaagtttatgaggaagtttgtgctacctgagaatgctaataccgatgctatttctgctgtttgtcaagatggggttttgactgttactgttgagaagctgcctcctcctgagcctaagaagcccaagaccattgaggttaagattgcttgaaga

SEQ ID NO: 5432 - DNA, 726 bp, Catharanthus roseus
aagagaagaaaaatggatctaaggctaatgggaatcgacgcacctttgatccacactctccagcacataatggacgcagccaccgaggattcagacaaatccggcaacgcgcctacgagaaactacgttcgagacgctaaagccatggcggcgacccctgctgatgtgaaggagtacccgaattcgtacgtttttgtggtggatatgcccggactgaaatccggagacattaaggttcaggtggaggatgataatgtgttaatcataagtggagagaggaaagagaagaggaaaaagaaggagtaaagtatttgagaatggagaggaggattggtaaatttatgaggaaatttgtgttgcctgaaaatgcaaatacagattcaatttcagctgtttgtcaagacggggtactgactgttactgttaacaaattgcctcctcctgagcctaagaagcccaagactattgaggtcaaggttgcttgaattttcaagggtctgtttctgctggataattggagctagtggtagtagtcttctgtctgccattgctttggctgggctttttaatggaataatttggttaggtatttaggttgcttcgtagatgtttgtttggggtttcttttttgttgattttctggagcttttggtgcctgtaatcctttgcttttctatgaatatgtattattatgaaaatatcttgccattatccagttcatcttat

SEQ ID NO: 5433 - DNA, 824 bp, Nicotiana benthamiana
tcctcagcaatacaaatctaaaactcacaatcaaaaaattccacatccaaaaaattcccaggatcattggaactaaaatcaagaggaggaaaatggatttcaggctaatggatattgacacaccactgttccacactctccagcaccttatggacgccgtcggtgatgattccgacaagtccgtgaatgccccgtcaaggaactatgtacgtgacgccaaggccatggctgcaacaccagccgacgtgaaagagtaccccaatttctatgttttcgtagtggacatgccggggttgaaatccggagaaatcaaagtgcaggtggaagatgacaatgtgctgctgattagtggagagaggaagagggaagaagagaaagaaggggctaagtatattagaatggagagaaggattggaaaactcatgaggaaatttactctgccggagaatgcgaatactgatgccatttctgctgtttgtcaagacggggtcttgactgttactgtccagaagttgcctcctcctgagcccaagaaacctaaaactatcgaggttaaaattgcatgagatattagagtagtaaaaattactctgttttctggacatgggtttgggaaatgctctgttttgatggtaataaaatggtagagatctaggagtggtgctctttccctctgtttgtctttaatatttcccatgtttttagaagtatgatgaaatgtgaagaactaaacgtctaggtgtgccatctcttgtttactgcaagggacatgctactgttatccagttttgtttcttcgactgctatcagtatagagagtgcaa

SEQ ID NO: 5434 - DNA, 972 bp, Populus trichocarpa
tccacccccaatatccctctataaataaccaccctccccacgacgagttcaaacacctgcaagagaagaaacactaaaaaaatcacacaagcgaaatctccagcgagaagagaaagatggatttcagaatcatgggtcttgacgcgccactcttcaacaccctccagcacatgatggatgcaagtgatcatgaggcagacaagtccttcaatgcgccaacacgcacttacgtacgtgatgccaaggcaatggcatcaacaccagctgatgtgaaagagtatccaagctcttatgcgttcgtcattgacatgccgggactgaaatcaggggacatcaaggttcaagtggaggatgacaatgtgctggttatcagtggagagaggaagcgcggagaggagaaagaaggggccaagtatgtgagaatggaaaggagggttggtaagtttatgaggaagtttgtgttgcctgagaatgctaacactgacgctatttctgctgtttgtcaagatggggttctgactgttactgttgagaaattaccacctccagagcctaagaagcctaagactatcgaggtcaagattgcttgaagaagaatgcttgattacatatataatgtagcttgttctgtgtgctaaggtgatgataaataatgagggttttgctgggtgctttgcttgggggtgcgggatgattttgggcgtgtttgcgtttgaatgagttcattattagttttctctttaggaaactggtgattgttgttcaaaacgtggtatgaaatatatgaatgtagtggtggcgttatatattactttttctttctacttggttgctttactctaattcatatgtatttttaggtctttgaacttctttcaggtttggatagttcttcaattagaggaattgtatgtctttcttgtcagcgagctcttggtgtgcaaccatggtttaaaaatacctctgtagaat

SEQ ID NO: 5435 - DNA, 800 bp, Nicotiana tabacum
ggccattacggccggggagcgaaaaaccaactgaaatacaccaaacccaaaatctcataatatctacaaatagaactcactcagctaacctaagaggaggaggatggatttcaggctaatgggtatcgacactccactgttccacactatccaccacctcatggacacagccggtgacgattccgacaagtccgtcaacgccccatcgaggaactatgtacgtgacgctaaggccatggctgcaacaccagccgacgtgaaagagtatcccaattcctacgttttcgttgtggacatgccagggttgaagtctggagatattaatgtgcaagtggaagacgacaatgtgctgctgataagtggagaaagaaagagggaagaagagaaagaaggggctaagtatatcagaatggagagaagggttggaaaattcatgaggaagtttacgctgttggaaaatgcgaatactgatgcgatctctgctgtttgtcaagatggagttttgactgtgactgtccagaagttgcctcctcctgagcctaagaaacccaaaactatcgaggttaaaattgcataagattttgttactctgttttgtgattataaaaatgctctgttttgatgcttggtggtatgacagtaataaagatggtagagatctaagagtggtttttctttccctttgtcttctttatattttctatttctatgttttatggaatatgatgaaactaaatgtgtaggtgttctatctcttgtttaaaatgcaagtgaaatgctactagtgtccagtttttttc

SEQ ID NO: 5436 - DNA, 777 bp, Nicotiana tabacum
ggccattacggccggggatccccagcaattcaattctaaaactcacaaaattccacatccaaaaaaatcccaggatcattggaaccaagtcaaccaagaagaggagaatgaatttcaggctaatgggaattgacacaccactgttccacactctccagcaccttatggacgccgccggtgaagattccgacaagtccgtcaatgccccatcaaggaactatgtacgtgacgctaaggcaatggctgcaacaccagccgacgtgaaggaataccctaattcctatgttttcgttgtggacatgccagggttgaaatccggagatattaaggtgcaagtggaagatgacaacgtgctgttgatcagtggagaaaggaagagagaagaagagaaagaaggggctaagtatattagaatggagagaaggattggaaaattcatgaggaaatttacactgccggagaatgcaaatactgatgcgatttctgctgtttgtcaagatggggttttgactgtgactgtccagaagttgccgccacctgagcctaagaaacccaaaactatcgaggttaaaattggatgagatatagcagtagttattaattactctgttttctggacttgggaatggaagttctctgttttgatgtttgatctaggagcggcgatcttttgcttttctgtctttaggttatctactactatgttttataagtatgatgaatggaaaaatgtgtcagtatgctatatcttgtgtttaatgcaagtgaaatgctact

SEQ ID NO: 5437 - DNA, 1663 bp, Malus domestica
atggaagtgatgagcctgaggaacttgggtttcgatcccaacctgctggagaccctgcacgacctgctcgacatctccgacgagcagaaccaacaaagctaccaggccccctctcgccggtacgtccgggaggcgaaggccatggccgccacacccgcagatgtgaaggagactaaagatgcctacgttttcgtggtggatgttccagggctgaggccggatatgattaatgtgaagattgaggaggacaacgtgctggtggtgagcggggagaggaagaaagagaaggagagggatcaggggatcaagtacttgaggatggagaggaggctcgggaagtatctcaagaagtttgtgctgccggacaacgccgatattgagaggatttcggccgagtgtcaggatggggtgctgactgtgacagttgcgaagaagccgccgccagagcagaagaagcccaagactattcagatccagataagcagcaaccaaggcggcggccagggaggcaaaggtggtcagggctgggaagaaggtggcgaagaggaacgtggcaagcagggcggtggccaaggttgggaacatgtcaagcaagatggtggccagggaggcgaaggtggtcaaggttgggaagaaggtggccaagtggaacgtggtaggcaaggccgtgggcaaggtgaccaaggcggtggccagggaggcaaaggtggtcaaggctgggaagaaggtggccaagaggaacgtggtaggcaaggcggtgagcaaggtggggaacatggcaggcaaggtgggcagagcggtggggagcgtggtgccggtgggtatgaagggcaagttgaagggcgtgacaaaaccttccttcccttcctgctaacccacgtcatcaactcctcctataaatacccagaaccaccaccatcctccgtaacagtgaccagatttccactcgaaaattcacgaaagccttcaaatcgaaaccgaaaagcgaaaattccacccaccaagaagcgaagaatggacatcagaaaccccggtttggaagcccagctcttctccacacttcagcacatcatggacgccgccgacgacgccgagaagtccttcaacgcccccacgcggacctacgtccgtgacgccaaggccatggcctccacgccggcagacgtcaaggagtacccgacctcctacgtgttcgaggtggacatgccgggactgaagtccggggacatcaaggtccaggtggaggacgacaatgtgcttctgatcagcggcgagaggaagcgggaggaggagaaggaaggggctaagtacgtgaggatggagcggagggtcggcaagttcatgaggaagtttgtgttgccggagaacgcgaacgtggatgcgatttctgctgtttgccaggatggggttttgactgtcacagtgcagaagctgccgccgccggagccgaagaagccgaagacaatcgaggtcaagattggttgaaagtgtttctgtgatttgggttctgagaataaatcgtgcagggattataacataagggtttgtgtgtggattttagggcttcgttggtgttttctggaagtgtttgttatgtttgtgttgtggtattataagcttgttggtttttcagatcaatgaagcatagtatgtgttacttcct

SEQ ID NO: 5438 - DNA, 858 bp, Prunus mume
aagcaccttgttcctcaatttatcccctctataaattcccactacccccgctcttcttctccatcacagcaacaaaaattcagaggcaccttcagagttcaaacaaagcactaagcaagcacaaattcaaagcgagaattccagccagtaaaaagagaaacatggacgtgagaatcgcgggtttggattccccactcttctctacactgcagcacatcatggacttcaacgacgagcctgacaaatcgttcaacgcccccacccgcacctacgtccgcgacgccaaggccatggcctccacgccggcggacgtcaaggagtatcccaactcctatgtcttcgtcgtggacatgccaggcctcaagtccggagacatcaaggtccaggtggaggacgataatgtgcttgtgatctccggcgagaggaagagggaggaggagaaggagggggctaagtatgtcaggatggagaggagggtcggcaagtttatgaggaagtttgtgctgcctgagaatgccaatctagaagccatttctgctgtttgccaagatggggtcctgactgtgactgtggagaagctgcctccgcctgagccaaagaagcccaagaccattgaggtcaagattgcttgaggagttttctccgagatttgggtttatgagcttcattatgcttatagcttatgataagggaatgggtaggttttaaggccttttggtattaatccggatgtgtttcattttcttgtttgtttgtgttctggtgtgccaagcttttgcattttctgatcagttgtgaagtgcggtttttatcaatgaaccatatggttgtaatatttcttcttcaatctctgttttt

SEQ ID NO: 5439 - DNA, 849 bp, Fagus grandifolia
ctttttacccaagagaaatagatccctctagaaatttctgtttctctcctataaattcccataaccatcaactcctctttcaatccaaattcaatacacattgacacaacacacagcctacaaaacaaaaccagcattttccattgcatttcatttttcaattcctcagcaaaacaaaatggatttgagaatcatgggtttggaatccccactgttgtcgacactgcagcacatgatggagctgagcgaggactccgacaagtcatcgtcttccatcaacgccccaactcgtacgtacgtgcgtgacgccaaggccatggcgtccacaccagctgacgtgaaggagtatccgaactcgtacgtgttcgtggtggacatgcccgggttgaagtccggggacattaaggtccaggtggaggacgacaatgtgctgttgataagtggcgagaggaagagggaggaagagaaagaaggagctaagtacttgaggatggagaggagggttggtaagttcatgaggaagtttgtgttgcctgagaatgccaacactgatgctatctctgcggtgtgccaggacggtgtgcttactgtcactgtcaacaagttgccacctccggagcccaagaagcccaggactattcaggtttccattgcctaagactaaaagcaaggccactgtctctcatgtcatctgctttcaatatcatatgggaataaattagtcgagttcttttgttttagtgttgtttttttattttgggtttgtgtacttatgtatgtgtgatgtgagtgggattttgcttgtgtctttgggcttccttatgattgctatttgtgcaatttgtgcct

SEQ ID NO: 5440 - DNA, 771 bp, Cajanus cajan
caaatacccattccgtggacacacaaacataagaaacacagcaaccaacgctaattcgaaaagttccgaattcaccaaagtaatggatttccgcgtgatgggtttggagtctccgttgtttcacacgctgcaacacatgatggatctttcggacgacggggcaggagacaagacacacaacgccccaacacggtcttacgttcgggacgccaaggccatggctgcgacacccgcggatgtgaaagagtgtcccaagtcttacgtgttcgagatcgacatgccggggctgaaatctggggacattaaggttcaagtggaggatgacaacgtgcttctcatcagtggggagagaaagagggaggaggagaaagaaggctccaagtatctcagaatggaaagaagggtcggaaagttcatgcgaaagtttattcttcctgagaatgcaaacactgatgcaatctctgctgtgtgtcaagatggtgtgctaagtgttacggtgcagaaactgcctcctcctcagcccaagaaaccaaagaccattgaagttaaagttgcatgaggaacttgttggaactactgtacaaataaaagtgttttctcttgttaaggggattctccatgtttgaggcagagacttgccttttagttgttagaaggttcttttttgtttggttgtatgatcgtgttgcagtgagttgtgttaaatgagaaagaattatgtattatcttaaagtatgatatatctaaacttaagtatctcttgaacacaaa

SEQ ID NO: 5441 - DNA, 710 bp, Nicotiana benthamiana
gcaatccatagcgaaaaaacaactcaaatacaccaaaaacgaagttctataatatctcaaaattgaaactcactcagttaatctaagaggaagaagatggatttcaggctaatgggcattgacacaccactgttccacactctccagcaccttatggacgccgccggtgatgattccgacaagtccgtgaatgccccgtcaaggaactatgtacgtgacgctaaggccatggctgcaacaccagccgacgtgaaggaatacccaaattcctacgttttcgttgtggacatgccagggttgaaatctggagatatcaaagtgcaggtggaagatgacaatgtgctgctgatcagtggagaaaggaagagagaagaagagaaagaagggtctaagtatatcagaatggagagaagggtcgggaaattcatgaggaaatttacgctgcctgagaatgcgaatagtgatgccatatctgctgtttgtcaagatggggtgttgactgtgaccgtccagaagctgcgtcctcctgagcctaagaaacccaagacaattgaggttaaaattgcataagagtttgttactctgttttgtgatcacagaagtgctctgttttgatgcttggtggtagagatgtaggggtgattatcttttccactgtctgctttatattttctatatatgttttattatagagtatgatgaaatgtgag

SEQ ID NO: 5442 - DNA, 695 bp, Nicotiana benthamiana
gcaattcaaagcgaaaacccaactgaaatataccacacccaaaatctcatagtatttttaaatagaaactcactcagttgatcaaagaagaggaaaatggatttcaggttaatgggtatcgacaatccactctttcacactcttcagcaccttatggacgccggcggtgaagattccgacaagtccgtgaacgccccatcgaggaactatgtacgtgacgctaaggcaatggctgcaacaccagccgacgtgaaagagtacccaaattcctacgttttcgtggtggacatgccagggttgaaatctggagatatcaaagtgcaggtggaagatgacaatgtgctgctgataagtggagaaaggaagagggaagaagagaaagaaggggctaagtatatcagaatggagagaaggattggcaaattcatgaggaagtttgcgctgcctgagaatgcgaatactgatgccatttctgctgtttgtcaagatggagttttgactgtgactgtccagaagcctccacctgagcctaagaaacccaaaactatcgaggttaaagttgcatgagaaattggattagttattttgttactcttttgtgtcaactgggaattggaagtgctctgtttttatgcttgatagtctgactctgtaataaatggtagagatctaggagaggttatcttatcattgtt

SEQ ID NO: 5443 - DNA, 710 bp, Rosa hybrid cultivar
aaacattccaccaaccaggaagagaaaaatggatttcagaatcatgggtctggatgctccaatcttaacagcactgcagcacctggcggacctcccggaggagaccgagaagaccttcaacaacgcccccacccggacctacgtccgcgacgccaaggccatggctgccactccggccgacgtgaaggagttgcccaattcctatgtcttcgtcatcgacatgcctggcctcaagtcaggggacatcaaggtgcaggtggaggatgacaatgtgcttctgatcagcggcgagaggaagagggaggaggagaaagagggggctaagtatgtgaggatggagaggagggtcggtaagtttatgaggaagtttgtgctgcctgagaatgctaatgctgataccatttctgctgtttgccaagatggggttctgactgtgactgtggagaagctgccacctcctcagccgaagaagcccaagactattgaggtcaagattggttaagagttttatgtgtaatgtggaatgtggcttgttctctgaataattagagtgatgggtatgagtgaaatgtagtgtgatcggtaccagtgtgctttcttatgcgtttcagttcttgtgttttaaatttgcggtttcattgctactgttttccaatcgatgtgtatgtctagtatggtttttatctatgaagcaatatattggcagttcc
